United States Patent 7,332,310 (MUTANT OF HOMOSERINE DEHYDROGENASE FROM CORYNEBACTERIUM AND DNA ENCODING THEREOF) - sequence listing, part 2

SEQ ID NO: 1 - DNA, 3309400 bp, Corynebacterium glutamicum (residues 1,654,701-3,309,400 of 3,309,400)
tggcgcaccgtattgcgtcgctgctgggcgttgtggctgcaggctgggcgatcaccatgctggccaggcgctgtcgggtatctgaagaagcgtccttttacctgggcgtacttaatccgctgctgattctgcacctgatcggcggtattcacaacgaatccatcctgctgggatttttacttgttggcctggaactcggactgcgtggcaccgaccggattcaaacagggctgtgggggcctgcgtggacatatattgcactgagtggcgtattgatttcttgcgcaggcctggtcaaggtgaccggctttattgggctcggttttgtgggcatggccttggccagggcgtttcatgcacgtggacatcgacacgtcgttgcgatcggcgttgcaggcctcgttcaagtagcagccctggtgatcaccgtggttgttctcagtgtgattaccggaatcagtttggggtggatcacaggtcaaggtggcgctgcgacgatccgaagctggatgtctatgaccaccaacattggcgttatttctggattcatcggaatgaatttggggctaggcgaccacaccgcagccatgctcgttgtgacccgtgcagccggaatcgcggtagctgccgccttcatggttcgtatgttgtttgccacatatagaggtcacattcacgctgtgggcggactgggcgtggcgactttcgtcctcgttatcctcttccccgtggtgcatccgtggtacatgctgtgggctatcgtgccgctagcttcctgggcaaatagactgttcttccagctcggagtgattgcctactccactgccttcagtttctttgtgctgcctcgcgggcttgcacttccagtcggaactgtcttttccatctacttcggcgcagcgctcggattcagcattctcctattagttggatggtggagtttgaggcggaatccaacctttggtttacactgatcaactgtgactactgatttttcggcctctagctctaattttggagccgcagaaggcgcacttgatgccataaaccccgtcccaccaaacgatccagcaatcgtggtgaacaacgtggtaaaaagatttggcaccaaggaagcagtagccggaatctccttcgaagtcccccgcggtcaagttttggccctcctgggacctaatggcgcaggcaaaaccaccaccattgaaatgtgcgaaggttttaccgcccccacctctggcagcatccgagtcttgggcatcgatccagccacagaaccagaccaggtgcgccgacgcatcggcatcatgcttcaaggtggcggttcctacagcggaatccgcgtgtttgaaatgctcaagcttgcggcgtcctacaacgacaacccacacgatcctgaatggctgcttgatcttgtaggactgcgtgaacaacgcaaaaccacctaccgacgtctgtcaggtggccaacagcaacgcctttctttggccttagcattaattggtcgccctgagattatcttcctcgacgaacccaccgctggcatggatgcgcaatcacgcaacatggtgtgggagcttgtcaacgatctccgccgcgacggcgtcaccatcgtgctcaccacccacctgatggatgaggccgaagcactagctgaccacgtgatcatcgttgccaacggtcaaatccttgccagtggcacacctgatgaactcactgcgcaacgcgatcatcttgaaattaatgtctccgtagagaccacgagcccgcttgatcttgatcgcttggtggatgatctcagcagcttaaacatcggtgatgtgaaagcacgagccaaccggccactgcattattcacttcggacgcaacaagccaccccggattccttggcgcacatcgtccaggctgtcgcccgccaaaacgtcatgattcgctctttggatacgggacaccgctcattggaagatgtcttcctggacatcaccggaaaagaactgaggagttaacgcacaccatgtctaaaccttttgaaaactctgcgctccgcggttcttctcgattcccagctggaacgttcacccctgctcccaaacgagccaccccggcaaaaatgttggctgctcagggcaagatggaatccctgctgtttcttcgccacggcgaacagcaactgctcagcatcatcattcccttggtcgcgctcatcgcactagcgaattttgatttcatccctggtgagaactccctcgacaagactttccccttcgcgctggccacagcagccatgagcgctggttttacaggtcaagccatcagcctagcttttgaccgccgctatggtgccctcaagcgcaccggcgccagcggtgttcccgcctggacgattatttttggcaaagtcatcgcagtcattgcagtcaccattgtgcagatcatctttctcggtgtgactgcactgctgttgggctggtccgcacctgtcggtggtgtgctctttggcatcgtgaccctatttgtgggtgtttccagcttcaccgcgctcggcatgctgatgggcggaacgttgtcctccgaattggtattggcactggctaacttgatttggattgtactgtccggccttgcagcatgggcggtcttttccccttccgtcaacgctgaaggagtgctgtccatcatcccatccgttgcgctgtcccaaggtatggttgacgcattcaacggcgaacttccgtggctccagctaggaattttggtgggctggctaattatcaccggcgtggccgcaaacaagctatttaacttctctgcgagccgctagatatacccttagtcggaaaatatccttaaaagttcccgggagtttcagtggcaaataccaccacttccataccgggaacaattgtataaaactagccatgacctgctaggatcagcgacgtgtctacttcagttgctccctcaaataatccagttgagttgaagcccattactttctgggcaccgaccatcaaagtgcagcgcattctcgcgctcctactgttgattttccagggaggcatcaccgttacgggctctatcgtccgtgtcacaggctccggcctcggttgtgatacctggccactatgccacgaaggttcactagtcccagtcgcaggcgcagcaccatggatccaccaggcagtggaatttggtaaccgcatgctcactttcgtgcttgctgccgcagcgcttgcgttgttcattgcagttcttggcgcaaaacgccgccgcgagatcctggtccattccttcatccagggtttgggcatcatcttgcaggctgtcatcggtggcatcaccgtgctggttgatttgcactggtacgccgttgctttgcacttcctgccatccatgatccttgttttcatggccgcgattttgtacacccgcatcggcgagcccgatgacggcgagattaccaccacattccccacgtggatccgcaatgtagctgtcattggtgcagtagcgctctccgtagtactgatcaccggcaccatgaccaccggcgctggcgttcactctggcgatgcatcaatcaccatggatgatcgcctcgatgtcagcatcgacttgatggcccacatccacggctacagcatgtacatctacctcttcttcaccctcatcgtggtcgccggtctgtacaaggcaaaaaccaccaagcacaacaagcagcttggcctcatgctgattctgttcattctgattcaggcaggtatcggcatcttgcagtaccgcatgggtgtgccacgctggagcatcccattccacatcgcaatgtcttctgtcgttgttgccttcacttcccttctgtgggcgcagggtcgtatacgcgtcggcggtaaagccaccgttactggttctgttgatggcgatattaagaacgagatcattacgaacccctttgagaagaaatcaaagcagcctgttaaataacacgcaactgtatcggtaaaaggcccaatcaaggattcttggttgggtctttttccatgcttttcatgcttcgaacagtccagaatagccctgacctagacttagagctatgtccgaacaaagactcgatcagcttgagcgacggctttctgaactggaacgggagatcgccgcgattcgtcaggagatccgccaggaacgcctagtgcttccggaaccggaacctgtgaaagttgatacagtcatcgccaccgaagcgaccggagtcaatgcatcgtcgggtccggaggcgaagatcgctttgttcatggagaggtttagtggtcgccacgatgtgtatgcgcggcgctggaccagcagaaaaacgggcaaaagtggatggtcgccggctactcgccagggtttttactcaaaagacaccacaccgaaggactatctccccttcaccgttgacaccgtcaatgcgcatctgcgccggggcggcgaccatatcggtctctatgtgatggtccccatcgacacgtgcaaacttctcgcctgcgatttcgacgatggcacctggaagcaagatgcggccgctttcgtgtcagcctgcaccgaccacggaatcgatgcgttggctgaaatttctcgatccgacgacggcgcccccgtgtggatatttttcgataccccaatctccgcgatgctggctcggcgcctaggttttgccatgctccgccaagccatgaactcccgccctgacatggatatgtcttcttatgatcgcttcttccctgctcaagacaccatcgcaacgcgcgcaaacggaagcgcacggctgggaaatttgatcgcgctgcccctcaacggcgactgtcgagcccgcaacaccgccgtcttcgccgattcggaaacgtgggttcccttcgaagatcctttcgcagcgctcgcggccatcacgccactagccaccgaaaaaatcgagcagatccttgccaccacgcaggaaaaatttggccccgaacccgaacacatcaaacgccccacccgcgccgaactcaaacaggttaaagccaacggcgaaaccatcaaactcaccatcaccaacgagctgagcgtccccaccgaaaggttacccgcggccgtcatcgcggagattaaacaccgggcggtaatcccaaaccctgagttttatcgtcgacaagcgcaaagattttcgaccttcggcgtgccgcgcatcgtcatccgcttcgcccaggccgagcagcgcttgctgctcccacgcgggcttgtcgacgacaccctccggatcctcaccctcgccgggtacaaagtcagcgtcatctggcctcggcaaactcggaaaaccatcgacgcgtctttcgagggcgaattgcgatccatgcaacaagagggaatcgactcgctcaaaggccaacgcaccggcgtattggtagcaccgccgggcgctggaaaaacagtgatggcctgtgcactcatcgcgaacagaaaaatccccaccgcagtgatagtcaaccgtgcagaattgatttcccaatggcgggatcgtctcgcgcaatacctgagcatcgacgcagactccatcggacagatcggcgcgggccgacgcaaaaccaccggaattatcgatctcatcaccgtccaatccttgagccgtaaagattccgatccgaaaattttggaacaatacggccaaatcatcgtcgacgagtgccacaacatcgcagccccaggcgccgaagccgcattgaaccaggtcaaggccccctactggctgggtctaaccgccacgccgtttcgttcagaccacatggatgaaatcatcaccatgcagtgcggtcctgtgcgccaccgcatggaagtggcaacagacaatgaacagcgcttgattcacatccacgaaacctctttcgactctgaggaaaccaccgaaatccaggatctctacaatgagctcgcggtcgattctgcccgaaatgcgcaaatcactgccgaagtgcacaaagcgcttgaagctggcgaccgatgtctagttttggtcaaccgaattgcagcccttgaagcactgaccagcagtattaccgaatctggcgatcacactgtcttagtgatgcatggccgccaaacccaagaggagcgagttcaccttcgtgcgcaacttgcctcattgagtgaaaagcaggatccgtttgtactggtcgcgatgaataaagtcgccggcgaaggccttgacatccccagcctcaacacgctgtttttggcagcgccggtgtccttcaaggggctggtgattcagcaaatcggccgagttactcgcgcaaccggtgatcaaaacgctcctccggtgactgccacggtccatgattttgttgattccaagattccgacactcaaacgcatgcacggtcgccgattgcgggctatgcaaaaggaaggattcgctgtttcggagccttgaggaggaccagaccaaaccagcgtgcccacggttggccatttcaggatccgtgggcacgctggtttggtttatcaacctcgaaaccggtcacagctgcccacgaaactcgatttcgcgatccgtgggcactctcgtttggtttcctcggaaagctaccctcggacggtcagaaaatgccctctcagaatcgcgtttaagagcctcccacccactagcccacaccaattactcattctgcgatcccaaccgcttaaacggccgtgtaatggctttcccgcaatctagccgaattcgaccaaactaggtgaccgaaaacctccagccgaaaacctcaatggcaagcccaaactggtcacctggtttggtctgcactctgactcccctcaaaagggcacaatttggtcaatttcccaaccttgtctttcagtcatggttagtgtgggaaccatgaaggcaatcttagtttcccgcaccggcggaccagaggtgttggagttcaccgacactgacgccccaaagcccactgatgatcaggttttagttgaagttgatatggctggcgtcaactttattgatacttactatcgccagggtgaatatcacgctcgcctgccgtttatcccaggttttgaaggcactggtcgggtgttggaggatccgcaggggttgattgcggcgggtaccaaggtggcgtggtgtgatgccatgggttcgtatgctcagcaggtgtgtgtgccgcgggatcgcttggtggcggttcccgagggcgtgagttcggaagtggctgcgtcgatgttgatgcagggaatcactgcgcattatctaaccaatggtgtgtatgagcttgaagagggcgattcttgcctcatcactgctggcgcgggtggtgttggattgttggctacgcagatggcggcggccaagggagtgcgcgtgtacagcgtggtgtccacggatgaaaaagctgagcttgctttggatgccggtgcttatgaggtgtttcgttattccgataatttggcggagcaggttcgtcggcacaacgggggtcgcggagttgatgtggtgtatgacggtgtcggccagtccacgttcaatgagtccttagaggctgttcgtccgcgcggcactgtgtgtttgtttggtgcggcgtcgggtcctgtggagccttttgatccgcagctgttgaacactcacggttcgatcttcttgacccgcccaagcattggcgcgtggacgtctgaggagggcgaatttgccaagcgtgcacaggcggtcacgcaggccatcgtcgaaggcaccttgcgggttcgcgttactggcacatattcgcttgccgacgcctacatcgcccaccgcgaccttcaggcgcgtagcacgagcggttctttggtcttggaaatcccgaaggactaaacacgcataaaaagatcctggttagcctcgcggtgaggttagccaggatcttttcgtcgaaaagcaagcttttagaagaaggtggtggtccagccgagcatctcgccgatggtctcaaggccgaggaccgcgtcgacggacaatgccacgaagaggactgccaagtagttgttggacaaaataaacagcttcagaggcttgaccttgccaccgtttttgatgccgaggtgcagcttgatggccatgaacaagaaggtgacgccggaaatgacggcgatcgctgcgtagatccaaccagttgctgggatgagcaagaaggtggtcagcacagttgccacggagtaccacacgatttgtgcggtgacctggactggggtgcgcacgacaggaagcattgggacgccagccgccttgtagtcttcgcggtacttcatggccagagcccaggtgtgaggtggggtccagaagaaaatcaccatgaacaggacaattgcctgccaccactgctgtggaacgcctggctcaaactgatcaacgatcactgcccagccgacgagcactggcatacaacctgcggctccgccccacacgatattcatgtgcgtgcggcgcttcagccacttggtgtagacaaaaatgtagaagaaaatcgtgatcaacacgaagatgccggcgagcatcgaatcgcacagcagccacagccacaagaagctggccactgtcaggacccacgcaaaaatggaggcgtcgcgattactcacggtgtggcgcaccaaagggcgagccctagtgcgtcccatgcgctgatcaatatcggagtctgccaccatgttgaaggtgttggcggcggccgcacccatccagccaccgaacacagtcagcaagatgagcacaatgttgttctcaccgcgttcagcctgaagcattgtggggattgtggcgacaaggaggagttcaataaccctgggcttcgttagcgcaatataggccttgatcgtgtccaagggttctcctccagaacgttgcattttcaaatcactcatatatttaagttgtgagtccttattatttaaatatccctgcggtgagtgtgcaccttgcgttgaaggcccagactctgacagaagcgtcagagtgtttactcaagacattttctaagacacacggcaaattagtcggatgaagttaattaaaagttcccgaatcaatctttttaatgttttcaaaccatttgaaggtgtgctgacccaggtggacgccaacctttaaaaagcttcagacttttatttccacttcataaaaactgcctgtgacgattccgttaaagattgtgccaaatcactgcgcaaaactcgcgcggaaccagaccttgccatgctatcgcctattcacactatttgagtaatcggaaatagatgggtgtagacgcttgattggcggacggttcacagcggacgatttcaggccctcgtagctcgagagtttgaaggggtccgattcgttccgttcgtgacgctttgtgaggttttttgacgttgcaccgtattgcttgccgaacatttttcttttcctttcggtttttcgagaattttcacctacaaaagcccacgtcacagctcccagacttaagattgatcacacctttgacacatttgaaccacagttggttataaaatgggttcaacatcactatggttagaggtgttgacgggtcagattaagcaaagactactttcggggtagatcacctttgccaaatttgaaccaattaacctaagtcgtagatctgatcatcggatctaacgaaaacgaaccaaaactttggtcccggtttaacccaggaaggattgaccaccttgacgctgtcacctgaacttcaggcgctcactgtacgcaattacccctctgattggtccgatgtggacaccaaggctgtagacactgttcgtgtcctcgctgcagacgctgtagaaaactgtggctccggccacccaggcaccgcaatgagcctggctccccttgcatacaccttgtaccagcgggttatgaacgtagatccacaggacaccaactgggcaggccgtgaccgcttcgttctttcttgtggccactcctctttgacccagtacatccagctttacttgggtggattcggccttgagatggatgacctgaaggctctgcgcacctgggattccttgaccccaggacaccctgagtaccgccacaccaagggcgttgagatcaccactggccctcttggccagggtcttgcatctgcagttggtatggccatggctgctcgtcgtgagcgtggcctattcgacccaaccgctgctgagggcgaatccccattcgaccaccacatctacgtcattgcttctgatggtgacctgcaggaaggtgtcacctctgaggcatcctccatcgctggcacccagcagctgggcaacctcatcgtgttctgggatgacaaccgcatctccatcgaagacaacactgagatcgctttcaacgaggacgttgttgctcgttacaaggcttacggctggcagaccattgaggttgaggctggcgaggacgttgcagcaatcgaagctgcagtggctgaggctaagaaggacaccaagcgacctaccttcatccgcgttcgcaccatcatcggcttcccagctccaactatgatgaacaccggtgctgtgcacggtgctgctcttggcgcagctgaggttgcagcaaccaagactgagcttggattcgatcctgaggctcacttcgcgatcgacgatgaggttatcgctcacacccgctccctcgcagagcgcgctgcacagaagaaggctgcatggcaggtcaagttcgatgagtgggcagctgccaaccctgagaacaaggctctgttcgatcgcctgaactcccgtgagcttccagcgggctacgctgacgagctcccaacatgggatgcagatgagaagggcgtcgcaactcgtaaggcttccgaggctgcacttcaggcactgggcaagacccttcctgagctgtggggcggttccgctgacctcgcaggttccaacaacaccgtgatcaagggctccccttccttcggccctgagtccatctccaccgagacctggtctgctgagccttacggccgtaacctgcacttcggtatccgtgagcacgctatgggatccatcctcaacggcatttccctccacggtggcacccgcccatacggcggaaccttcctcatcttctccgactacatgcgtcctgcagttcgtcttgcagctctcatggagaccgacgcttactacgtctggacccacgactccatcggtctgggcgaagatggcccaacccaccagcctgttgaaaccttggctgcactgcgcgccatcccaggtctgtccgtcctgcgtcctgcagatgcgaacgagaccgcccaggcttgggctgcagcacttgagtacaaggaaggccctaagggtcttgcactgacccgccagaacgttcctgttctggaaggcaccaaggagaaggctgctgaaggcgttcgccgcggtggctacgtcctggttgagggttccaaggaaaccccagatgtgatcctcatgggctccggctccgaggttcagcttgcagttaacgctgcgaaggctctggaagctgagggcgttgcagctcgcgttgtttccgttccttgcatggattggttccaggagcaggacgcagagtacatcgagtccgttctgcctgcagctgtgaccgctcgtgtgtctgttgaagctggcatcgcaatgccttggtaccgcttcttgggcacccagggccgtgctgtctcccttgagcacttcggtgcttctgcggattaccagaccctgtttgagaagttcggcatcaccaccgatgcagtcgtggcagcggccaaggactccattaacggttaattgccctgctgtttttagcttcaacccggggcaatatgattctccggaattttattgccccgggttgttgttgttaatcggtacaaagggtcttaagcacatcccttacttgcctgctctccttgagcacagttcaagaacaattcttttaaggaaaatttagtttcatgtctcacattgatgatcttgcacagctcggcacttccacttggctcgacgacctctcccgcgagcgcattacttccggcaatctcagccaggttattgaggaaaagtctgtagtcggtgtcaccaccaacccagctattttcgcagcagcaatgtccaagggcgattcctacgacgctcagatcgcagagctcaaggccgctggcgcatctgttgaccaggctgtttacgccatgagcatcgacgacgttcgcaatgcttgtgatctgttcaccggcatcttcgagtcctccaacggctacgacggccgcgtgtccatcgaggttgacccacgtatctctgctgaccgcgacgcaaccctggctcaggccaaggagctgtgggcaaaggttgatcgtccaaacgtcatgatcaagatccctgcaaccccaggttctttgccagcaatcaccgacgctttggctgagggcatcagcgttaacgtcaccttgatcttctccgttgctcgctaccgcgaggtcatcgctgcgttcatcgagggcatcaagcaggctgctgcaaacggccacgacgtctccaagatccactctgtggcttccttcttcgtctcccgcgtcgacgttgagatcgacaagcgcctcgaggcaatcggatccgatgaggctttggctctgcgcggcaaggcaggcgttgccaacgctcagcgcgcttacgctgtgtacaaggagcttttcgacgccgccgagctgcctgaaggtgccaacactcagcgcccactgtgggcatccaccggcgtgaagaaccctgcgtacgctgcaactctttacgtttccgagctggctggtccaaacaccgtcaacaccatgccagaaggcaccatcgacgcggttctggagcagggcaacctgcacggtgacaccctgtccaactccgcggcagaagctgacgctgtgttctcccagcttgaggctctgggcgttgacttggcagatgtcttccaggtcctggagaccgagggtgtggacaagttcgttgcttcttggagcgaactgcttgagtccatggaagctcgcctgaagtagaatcagcacgctgcatcagtaacggcgacatgaaatcgaattagttcgatcttatgtggccgttacacatctttcattaaagaaaggatcgtgacactaccatcgtgagcacaaacacgaccccctccagctggacaaacccactgcgcgacccgcaggataaacgactcccccgcatcgctggcccttccggcatggtgatcttcggtgtcactggcgacttggctcgaaagaagctgctccccgccatttatgatctagcaaaccgcggattgctgcccccaggattctcgttggtaggttacggccgccgcgaatggtccaaagaagactttgaaaaatacgtacgcgatgccgcaagtgctggtgctcgtacggaattccgtgaaaatgtttgggagcgcctcgccgagggtatggaatttgttcgcggcaactttgatgatgatgcagctttcgacaacctcgctgcaacactcaagcgcatcgacaaaacccgcggcaccgccggcaactgggcttactacctgtccattccaccagattccttcacagcggtctgccaccagctggagcgttccggcatggctgaatccaccgaagaagcatggcgccgcgtgatcatcgagaagcctttcggccacaacctcgaatccgcacacgagctcaaccagctggtcaacgcagtcttcccagaatcttctgtgttccgcatcgaccactatttgggcaaggaaacagttcaaaacatcctggctctgcgttttgctaaccagctgtttgagccactgtggaactccaactacgttgaccacgtccagatcaccatggctgaagatattggcttgggtggacgtgctggttactacgacggcatcggcgcagcccgcgacgtcatccagaaccacctgatccagctcttggctctggttgccatggaagaaccaatttctttcgtgccagcgcagctgcaggcagaaaagatcaaggtgctctctgcgacaaagccgtgctacccattggataaaacctccgctcgtggtcagtacgctgccggttggcagggctctgagttagtcaagggacttcgcgaagaagatggcttcaaccctgagtccaccactgagacttttgcggcttgtaccttagagatcacgtctcgtcgctgggctggtgtgccgttctacctgcgcaccggtaagcgtcttggtcgccgtgttactgagattgccgtggtgtttaaagacgcaccacaccagcctttcgacggcgacatgactgtatcccttggccaaaacgccatcgtgattcgcgtgcagcctgatgaaggtgtgctcatccgcttcggttccaaggttccaggttctgccatggaagtccgtgacgtcaacatggacttctcctactcagaatccttcactgaagaatcacctgaagcatacgagcgcctcattttggatgcgctgttagatgaatccagcctcttccctaccaacgaggaagtggaactgagctggaagattctggatccaattcttgaagcatgggatgccgatggagaaccagaggattacccagcgggtacgtggggtccaaagagcgctgatgaaatgctttcccgcaacggtcacacctggcgcaggccataatttaggggcaaaaaatgatctttgaacttccggataccaccacccagcaaatttccaagaccctaactcgactgcgtgaatcgggcacccaggtcaccaccggccgagtgctcaccctcatcgtggtcactgactccgaaagcgatgtcgctgcagttaccgagtccaccaatgaagcctcgcgcgagcacccatctcgcgtgatcattttggtggttggcgataaaactgcagaaaacaaagttgacgcagaagtccgtatcggtggcgacgctggtgcttccgagatgatcatcatgcatctcaacggacctgtcgctgacaagctccagtatgtcgtcacaccactgttgcttcctgacacccccatcgttgcttggtggccaggtgaatcaccaaagaatccttcccaggacccaattggacgcatcgcacaacgacgcatcactgatgctttgtacgaccgtgatgacgcactagaagatcgtgttgagaactatcacccaggtgataccgacatgacgtgggcgcgccttacccagtggcggggacttgttgcctcctcattggatcacccaccacacagcgaaatcacttccgtgaggctgaccggtgcaagcggcagtacctcggtggatttggctgcaggctggttggcgcggaggctgaaagtgcctgtgatccgcgaggtgacagatgctcccaccgtgccaaccgatgagtttggtactccactgctggctatccagcgcctggagatcgttcgcaccaccggctcgatcatcatcaccatctatgacgctcatacccttcaggtagagatgccggaatccggcaatgccccatcgctggtggctattggtcgtcgaagtgagtccgactgcttgtctgaggagcttcgccacatggatccagatttgggctaccagcacgcactatccggcttgtccagcgtcaagctggaaaccgtctaaggagaaatacaacactatggttgatgtagtacgcgcacgcgatactgaagatttggttgcacaggctgcctccaaattcattgaggttgttgaagcagcaactgccaataatggcaccgcacaggtagtgctcaccggtggtggcgccggcatcaagttgctggaaaagctcagcgttgatgcggctgaccttgcctgggatcgcattcatgtgttcttcggcgatgagcgcaatgtccctgtcagtgattctgagtccaatgagggccaggctcgtgaggcactgttgtccaaggtttctatccctgaagccaacattcacggatatggtctcggcgacgtagatcttgcagaggcagcccgcgcttacgaagctgtgttggatgaattcgcaccaaacggctttgatcttcacctgctcggcatgggtggcgaaggccatatcaactccctgttccctcacaccgatgcagtcaaggaatcctccgcaaaggtcatcgcggtgtttgattcccctaagcctccttcagagcgtgcaactctaacccttcctgcggttcactccgcaaagcgcgtgtggttgctggtttctggtgcggagaaggctgaggcagctgcggcgatcgtcaacggtgagcctgctgttgagtggcctgctgctggagctaccggatctgaggaaacggtattgttcttggctgatgatgctgcaggaaatctctaagcagcgccagctctaacaagaagctttaacaagaagctctaacgaaaagcactaacaaactaatccgggtgcgaaccttcatctgaatcgatggaggttcgcacccggatttttggctcagcgttagattctcaccctaaaaccgcgcacttaaaaaggttagctttctatacgtgcaccgcctctttgattggttcatgcgaggcgatccgaaagtcttcgctgtacagcggcgaggtgtttccgaccgctagttgtgctgcgagttcgccataagctggagagagcttgaaggcgtgtccggatcctccggtgagcacaatgacattgtcaaccgcgtcgataattggagatttgtctgcagtgtaggtgtcatagtggacgctgaaacggttgggctctgggttgaccccggggaagagttcgtgggttttccgaccaaattcagagactgcgtcccggtcgaggcggagatcttcatcttctacatgtgcgcttaacctggatccaccgatgtgattcaggtgtaacggcgtgggaaaataggaaatgccctcctgaactggaagaatcaagcttgcttagagtcctgattcacctgccagaaaggcacctcacaggtgcaattattacacaaccccacagcgatgtccgcatcctttgatgaccccaacctcatctcgcttgctggactggttccaaccatgcacttagccgatgctgccagcctgtccaccttggcccaggaccggttgagcatcaccggtgataaaggtgccaatgctggtgcgaagatcgcctccctagtcgcgggcatggtcgccggtgctgattccatcgatgacatggatgtactccgccacggaggtatgcgccgacttttcgaccggatctacgccccatccacattggggtcttttctgcgggccttcactttcggccacgtacgccaactcgatgctgtggcctcccgattcctggtcaacctggccaggcaggcaccacacctggtgccaccaccaccggcaggcagtggcggtaacgggtatgtgttcgttgatgttgatgacaccatcattgaagtccacggccacaccaaacaaggtgccggctttggttactccggtatccgtggactcaacgccttgctggccacggtcaccaccgcacagtccgcccccatcattgtgggccaacgattgcggaaaggatcgtgtggttccccacgaggggcccaccgcctgatcgccgatgcgatgaccaccaccaggcgcctgcccgggatggaggataagaaaatcctcgtccgggcagattcggcgtattatggtcatcccagtgtcagtgtggccctaaggtccggtgcggatgtgtccgtcacggtgcggatgaccccgaacgtcaagaaagcgatcgtcgcgatcccggaagatgcgtggcagacgattcagtacaccgatgcgatcttcgatgaggcatcacaatcgtggatctccttagcccaggtcgccgaagtgcctttcaccgcgtttacctcccggaagaaggccgaccatgttcccggacgcttggtggtacgccggattcctgagctgaataagaaggatgtgtatcagccgggcttgtttgatcttcaccgcttccatgcggtcttcaccaccgccgacccaggcgtgctggatactgttgctgcggataaaacccaccgtcagcacgcgatcattgaacaggtcaacgcagacttgaaggcaagcgcgttggcgcatctgccgtcggggacgttcaccgccaacagtgcctggctcgtatgcgcggtcatggcgtttaatctcacccgtgccaccggggttatcgctgcaggcgggatggccaaggccaccaccgcgacgatccggcggacactgatggccgttccagcccgggtcgcccgcaggtcccgccgactggtgctccaccttcccgaggggtggacgtggcaaccacagtggcagaaactgtttgatcacggccattcaccaccgtaaccggtagctccctgaccacccagccgagctttcggcgtgagatgacaacaattcgtggaacaaccagaacaagacgtgatctggcgatcacccctacccgaaaattccggacccgcccggaaccgggatcaggacatcaccgagggcacatcggtggatcgaggcttaatggaacgccccactcatccaatccggcaattttgatgctgtacccatcgacgcatggtgctccaaatacgtggaagccatcacggtcacggatgaagcatggcaggttttccggttggaagtccactggattgttgggcaggaaccaggtgagcactaggcgtcgcacttcaagcagtggcgcgatggagggcacgagctcgcttgtccagctgccggtggtgacgataacgcggtccacgattgtggtttcttcgcctgcttggatgactacgtgatcgccgttgtcttcgatgctggtgattttttggtgatcgcgtacttgggcaccatttgccttggctgtttcgattgcactgaacactgctagttcggggcgcagggctccaccttgaagatcaacaattccagcttcatcatcgcggaagtctagacctgggtaacgcttgcgcatctgcgcggcggtaagtcgttcatgtggcagctcataacgttccactgattccaccaggcgttggaagggtgcttcgtcttccttgccggtgcttaagacaccgaagttgtggaagagttcgcgtccggaaatctcgctcagtgatgaccatagtgctcgtgcgcgtttgagcaacggaacgtaggtgctgccttcgtggtaggccatgcgaaacagtcgggactcccctgtgaatgcgccgtagccatgggagatgccgaattgttcaaagccgatggcctctacacctgggatgttacttaagtgccacagtgccatggagccggttgatccaaggccgattaccgcaattttcattgttgtttcttctctcaagccagtgcgggtgattcccacaggttcaatgtggtgccgacgcctttttccagggcgttttcatacacttgggttgcccaggcgacgtcttctactggcatgccgccgacggaatagaggatgatttcctcatcgttggtgcgtccgggtagcttgccggagcagatatcgccaatctgggaaatctttgcaaggtcgagttttccttgcagcgccaggtcgtaccagtgggttcctggaatgccgagtagttggtaggcctgtgggccgtattcttctgcccaggcttcgtagagccccatgtagtcaacaacgaggcgggcgtcgtcaagcaaataagcgtcgtcgaagcgaccggcggctggaagcagcagcaatgcgcccggcttgagccattcttttttgaagtatgggaaggcggaggagccggcggcgtccgtggtggtggcggcgatgacgatgtcggcgtctttgaccacgtcttcttcagatccgacggcgaccacttcgatctcggggaatttttccaacgcccatgttgcaaaggcgttgatgccgcgttcgctgcgtcccttgatcttgatggtggtgattcctgggcgctctgcgatgcacgcttcggtgatggttttcgccatgacaccaggtccgacgacagccaaggttgtcgcgtcggcgaccgctaagtgcttcacgcccacgccgggaaccgcgccggtgcggtaggcggacagcaggttcgcggacatgatggccttcggtgcaccggtgaccgtgtcgttgaggacgaaggtgtggatcgagcgaggcaagcctgaggccttgttttccgcgttggatccgtaccacttcacgccggtgtttttgaatcgcccgccgaggtatgcgggcatcgccatgaatcggcggtcggggccgtccttgggcatgccttcaaattctgggttttccgggaaggtgatcatcgcgccatgcgagttggagttcaaaccggccattttgtagtcgccctgcgccaagagcacgagcgtttcctccatgacatcgacgcattgcgcgacgtctttgactccggccgcgatcatgtccggttcgctcaagaacaagaaattgatggcggtttcagtggtgtaggttgcggtcattttgaggcctttcgagtatcagcgattttttgcttatcgacgcccacctgcacggcgtcgggcacggtttcctcggggatttcaggtccgaaattggtgcgggttgccatcccaattccgttggaattgaggtggtaggcagattctgcgtgttctgcgcggtcaatgccttcatattcggcttcggaggtgatgcgcagagtcatgaacttgttcaagatcgtggcaatcaaccaggtcacgccgaatgcgtatgtaagggtcacgatgatggccagtggttccctccacagcagggagagttcgccaccgaagaagactccggaaactcccgctggtgctagtggatcgccaaagagcatgacaaacagtgcacctgcaatgccggccattccgtggactgcgaacacatcgaaggaatcatcgactcggtgtcccttcttccagctaattgcccagaaggagacaactgcgccgagcgctccgacggcgaatgctccgagcgggctcactgcatccgcggccggggtgatagccacaaggcctgcgattgtgccggttgccgagccaaagaaagtgggttttccgctgaacacacgttcaacgagcatgaagcccatcattccgccagctgcagcaatgagagaggtaacgaccacgtagcttgcgaggaagttggcaccacctgcggtaccaccattgaatccgaaccagcccgcaacgatcagtcctgcaccaatcaaaatcagtggaaggttgtgtggacgcacagccatggagtggcggcgtcccagcactattgccagcgcgagtccagacgcacccgcattcatgtgcactgccgttccaccagcaaagtcgtggaactcaagcacatttttcatccagccacccacgtagccggactcaggatcatcgatagcgaaaacccagtgtgccagtggcgcgtacacaaaggtgaaccacaggacaccgaagaccagccacgctccaaagcgcatgcgccccgctgcaccagatgaaacaagtgcgagtgagattgcagcgaacagaatgtagaagccggcccacatgaggtctccggtgccgtcatcttccataatgttgcggaagccgaagtattcaaggggatttccgataattccccacccaccgatggagtttcctaagacaagtccgtgtccataaatgatgtacacaaggctgatgattccaagtgagctcataaccatcatgaacgtgttaagaacgtgttgcccacccagcatgccgccgtagagcagggacaatccggggaacatcaggcttaccaacgcaaaagctgcgagaatccaggctagatctgaggggtccatgttaaaggcctttcagctaagtgatgctgtcgagcggagtattttctattccgctatagataaacctagtccagtttttacctatcgttctatagatttctgtttttataacgaaggtcacgtttttaacccgcacttacaccacgtctccccagccgaaaaatcccctatggcagcgttttaacctgcggttttatagactccacgttccgtcgggaaacagttcccctttaaagatgtccttagggaaaattggaatgtatgtgaattaggcaccaagattttccaattttgaccaccactttgccgaaatcttggtgtcgaaagtgcacaccgaggaacagtggggagacaacaggtcgacaaaacccaaaaaagcggctcccctatgaaaagggaaccgctctttttaagctcgtgtcttatgaataagtctggatgaggttgagtgcgacaatgcacacaatccagataacggcaaccaaaatggtgacgcgatccaggttcttttcaacaacagtggagcccgaaagattggactgcacaccgccaccgaagaggctggagagtccgccgcctttgcccttgtgcagcaagacgaaaaccgtcatgagcaggctggcgacgacgaggatgatttgaagcgtcaatgccatgtggaaaatgttcctttgccgtttgagaacccaggtgaaccttatgcccacctgatttcgaataactttagacagtatacacgagtactacccagccggctggactagccggagttgcgcagcgcagtggaaagaccgttcatggtcagctgaatgttgcgggacacttgctcgctttggtcgccttttcggtagcgtcgcatcatctctacctggatcacgttgagtggaagcaggtaggggtatcggcgctggacagagcgtgcgagaagtgggttgtcatcaagcagatcatcagagccggtgattacgcagaacatcttcttggtcaggaagtactcctcgcggatgacggaatagactcgctcggctacttccgtatctgggatcaggtctgcgtagagctttgccaaacgcagctctgccttggacatcacctgagccatgttatccaacactgaggtgaaaaatggccaggactcattgagtgtttgcagctcggcaatgcgttgggtggcctgctccccttcgccaatccactgctctaatgcggttccgacaccaaaccagcctggcagcatgacacgagactgtgaccagctgagcacccatgggatggctcgcaaatcttccaccgaggaggtctgcttgcgtgaggaaggcctggatccgatgttgagggatccaatctcctgcagcggcgtggactgggtgaagtaatcgatgaagccttgatcctcgtgcaccaaggaggcgtacttcttcaagctgagctcagagatctcactcatgatgtcgtacgcgcgttggtgatcggtgagttcggagacgtcgagaagcgatgcctcaagcgtggctgagaccagggcttcgaggtttcggcgcgcggtttcggggttgccgtacttagcggagatgatctcgccctgctcggtgatgcgcacggaaccttggacagcccccctgggctgggcaagaatcgcgtcgtaggaaggtccgccaccgcggccgacggtgccaccacggccgtggaacaggcgaagcttgaccccggctgatcggcatagttcgacgagctgcagttccgcgtcgtaaagcgcccagtttgcggagaaatatccgccatccttgttggaatcggagtaaccgagcatgacttcctggacgttgtcgcgctgcaggaggtagttgcggtagagatcaattttccacagttcgtcgaggattccggcgccggcctggagatcttcgatggtttcgaacagtgggatgacatcgacggtgccgcgtgggttgtcgccgttggctgcgatgagtccgaattccttgagcaacaccatcggctcgagcacatcggtgaccgatgatgccatggagatgatgcagtgaggcaccatccgtggcccgaatttcttaacagcctccgacgcggtgcggaagatgccgagctcgcggtcggtgacctcgctgtattcatctgaaccgtgcgggatcagcggacgagggctgcgcagttccttcagcagcacctcaagcttctctgcttcagacagctcgcggtagtttgcggtgacttgggcgcgttcgaaaagctcggtgaggacgtcctcgtagctttcggagttttggcgcagatccagtgcgtaaaggttgaatccaaagctctcgatggcagaaatcagcacagacaaacgatcatcggcaatgagaacgtccttggattcacgcagagaatgatcaatggtcaacgcatcgtttaagaattcttccggagatgcgtatggagtaaagaccttgaaccacacgccctcaacggcgtcctcgccgatcagctcggccgtcgtcgcgaggatacgtccgcgaacgccatggacggcgcgtcgataaggctcatccacgcggcttggcacgtcgttgtgccctgcatctgccagcgcaagcagctgcggggtgaccttattcatgcggtccgacaggctgagctcatgctcgagggaatgcagctggcgtgcatagtacttgagcacggtttccgcagcgcggtgagtggaatactcaactgtttccgcggtgacataagggttaccgtcgtggtctccaccaatccaggaacctggcttgaccacgggcttcaaaggaacaccctcgccgaaacgctcacgaagctcaacagccacatcacggttgatacgtggaatctcttccaaaaggctcagcttgtagtagcgcagccctacttcgatctcgtcctcgatacgtgggcgggccacacgaatcaacgcggtctgccacaaaatggtgatgcgacggcggatgttcttctcgatctcatccaacttgctttgcgtacgagcggtaggctccgcagactgcaaagcgtggcgttcacgcatgtgggtggtgatccacttttgcgcatcaaaaacagtgcggcggcgagtctcagttgggtgcgcagtcagaaccggcgccacctcagcattgcgcagcacatcggccacagcttctgcgccaacattgccctcattgagtttcagccaggtggcatcaagagtgctgtccggaggggtgtcgcctgcatcgagagcctgttcacgaagctcttcatcgtagaggtcttccgccaggttagccagcagagcgaagtgggaaaatgcgcgagcaatcggtgttgccttggctggagtaatgccgtcgaaaacctgaaccaggctatccatttcggcgttgcccttggcgatatcaaaagaagtcaggcgcgcttgttcgaccagttcataaacctcctggccttcttgttccgcaattacctcaccgaggatttgaccgaggaacctgatgtcatcgcgtaaaaaatcagtcataactactttaaacactctttcacattgagggtgttggcgtgcatgagataaaaaatcacccagcaaaacaggtgtttagctgggcgattgatttcgatggctttcatgggctcatcaaaaccgcacttctacagtgcttgtgctttaaggctgtgctttaaggctgtgctttaaagctctgtactttaagcaacgctcgcagcgttggcagccagcttggcgaatgcttcaccgtcgagggaagcgccaccgacaagtccgccgtcgacgtcaggctgaccgacgatctcagcgacggtttctgccttaacagaaccaccgtaaagaatacgcaggccctcagcgacctcgtcgcctgcaagctccacgatcagaccgcggatagccttgcacacttcctgagcgtcagctgcggaagcaaccttaccggtgccgatagcccacactggctcatacgcgataacggtgttggccagctcagcagcatccaggccagcaagggacttacgggtctgctcgacgacgtactcaacgtgggtgccagcttcacggatttccagtggctcaccaacgcagacgatcgggctgatgccgttggacagagctgcctttgccttcgcagcaaccaactcatcagactcgttgtggtactcgcggcgctcggagtgtccaacgacaacccaagagcagttcaactttgccagcatgcttgcagaaacttcaccggtgtacgcaccggactcgtgctgggagacgtcctgagcaccgaaagtgacctcaagcttgtcgccctcaacgagagtctggacggagcggatgtcagtgaaaggaacggtgactgcaacgtcaaccttctcgaagtattcctttggaagggcgaatgcaagcttctgaacagtgccgattgcctgctggtgatccaggttcatcttccagttaccagcgataagtggcttacgtgccatgtgtgaaacacacctttcttaaaaaagtttcccggtggccctttatgttttgttttctaacaaagggccgtgtcggatttactgagcgagaattgcaacgcctgggagttccttgccttcaaggtactcgagggatgcgccaccaccggtggagatgtgggagaagccgtcttcgttcaggccgagcacgcgaacggatgctgcggagtcgccaccgccaacaacggagaatgcgtcgttgcctgcagttgcatcgatgatggcctgggcgatgccgcgggtgccttcagagaatgctgcgaactcgaacacgcccattgggccgttccagaagatggtcttagcggtgctgagaacctcaccgaagttcttgacggactctggtccgatgtcaagagacatccagccttctgggatggagtccaggtcaacgatctgcttctctgcgtccttgttaaattcggatgctgcaaccaggtcaactgggagaacgatcttgtcaccgaagcgtgcgagcaggtcggtgcaggtagccttcatttcttcctgcaggagggactgctgaacgttgtgtccctgagctgcgaggaaggtgtagcacatgccgccaccgacgatgatcttgtcagccttggcagccagcgcctcaataacaccgatcttgtcagagaccttggatccaccgagaaccactacgtatggtgcctctggtgattctgcgatcttttccagaacggaaatctcggtctctaccagtccgccagcgtagtgtggcagcaactttgcaatgtcgtagacggaggtctgtgcgcggtggacaacaccgaagccgtcagaaacgaatgcgccgttgtctgctgcaagagctgcgagctcctgagcgaaagcggtgcgctctgcctcgtccttggaggtttcgcgtgggtcgaagcgcacgttctccaggagcaggatgtcgccctcggtcaggccgtttgcgcgctcgtgtgcgtcttcgccaacaacgtctgcggcaagtgcaacgtactggccaagctcatcggagagtgcctcagcgacaggtgcgagggagtacttctcgttgacctcgccctttgggcggccaaggtgagccatgacgatgacctttgcgccaccttcgctcagtgctttaagggttggtagggaggcaatgattcggcccttatcggtgatctcgcggtcatcgttgaggggaacattgaagtcagatcgaacgatgacgtggcgtccgtctacgccttcgtcgagcaagtccttgagggtcttaacagccatgccgtactccttggagatttgattgtttaaaaaattcttctggtgcaatgtgatgcactgtcccagattgccacacattgtgtggcgctggcaccggtattcaattgtattgattaaagacacaaaatagcccggggtgcgccgaggcacaccccgggctattgggatgacacatcaccgtgagcatcgatcgcccacgttagcgatgtgaactaattagagcttggaagctacgagctcggtcagacgcaggagctggcaggtgtagccccactcgttgtcgtaccaggaaacaaccttgacggtgttgccggagaccttggtcaggccagcgtcgaagatggagccgtgggaatcgtggacgatgtcggtggaaaccagtggctcttcggagtaagccagggtctcgccgaactcgccgactgcagcttccttgattgcagcgttgatggactcaacggtgacctcagacttggtgttgaaggtcaggtcggttgcggaaccggtgataactggaacgcgaagtgcgtagccgtcaagcttgcccttgagctctgggagaaccagagcaacagccttagctgcaccggtggaggtaggaacgatgttgactgctgctgcacgtgcacgacgcaggtcgcggtgaggtgcatcgtgcaggcgctggtcgccagtgtatgcgtgaacggtggtcatgaggccgttctcgatgccgaacttgtcgtttaggacctttgccattggtgcgaggcagttggtggtgcaagatgcgccggagatcacgttgtggttctcaggatcgtaggactcgtggttcacaccgtaaacgaaggttgcgtcttcgttgcttgctggtgcggagatgatgaccttcttggcacctgcttcgatgtgagccttagccgcgtttgcatcggtgaagaagccggtggactcgatcacgatgtcaacgttgtgtgcagcccagtccaggttctttggatcgcgctctgcgtaaacagcgatgcgcttgccaccaacggtgatggagtcatcgtcgtattcaacttcctggccaaggcggcccatgatggagtcgaacttgagaagggtggaaagggtcttgttgtcggtgaggtcgttgactgcaactacctcgagatcgtcgctgcgctccagaactgcgcggaagaagttacgtccgatacggccaaatccgttaataccaacacgaatggtcatgttgtgtctcctctaaagattgtaggaaatgcaatgtgtcaagcagttaggtcaatcagagcatcggtcactcaagaattcttgagctgacagaacccaagggcgagtatggcgaatttttccaactcacgcaccaaacctactcacattggataattcgtcgagtcaactccgtgtcaacctgtcctcaactttagcggggaaacaaagatttcgcagcagatgcaaaatcatacagacacattcaaaaatggacattgaccccaaacgggggcatttccaacacttgcgctaaatagtttttgcagggaacgaacctgaaatcgttcgcactacgatctgctcccccgaatggggttaattatgaactacattacacccccgtgaatccacaaattaaagtctcagatttgaagccaatgtgatgcaactcacactggcttcaatggtaatcccaataggctcggtcgtttttaggcttcaatcatctaaatttcttccaacaaatcttccgtcacaacagaatttgtatcaggaatcttcagatcttcggcgcgcttatctgccatcgtcaaaagacgacgaatacgaccggccacagcatccttggtcatttgaggatcagccaaccggcccaactcctccaacgatgcctgacggtgctgcacacgcagctgtccagcctcagccaaatgctcaggaacatcatcaccaagaatcttcatggcgcgttctaccctcgctgcagcggcaactgctgctcgggctgacctgcgcagattggcatcgtcgaagttggccaaccggtttgccggagttcgactttcccgcttgatgcgtttttcttcccacaacatgcgagttttctgtgcacccattcgagtgagcagtgccccaattgcttccgcatcacgaacattgacgcgatcaaatcctcgagaatctttcgttttcgccgcgatcccaattcttcgagcacatccaaccagtgccaatgctgattcttgaccaggacacaacacctccaacgaagaggaacgacctggatcacttaaagatccattggctagaaacgcaccgcgccatgcagcttcagcgtcactgattgttccgctgaccacagaaggcgctagacctttaaccacatgtccagacctggtgaccagtccggtgcgtcgcgcaatttcatcggcattgtcaatgatgcgcaccaaataccgtggcgttttcctgctcacagtcgggttcacggtgtgcacatcgactcgagagttgtacaaaccttggataaactcctgaagcctcataccgacttgcatgctgtccaaatttgcttcgatgaccagcttgccgccgacagcttgcatctcaccagcaaaccttaaaattgcagacacttccgcagcacgaacactgtttttggccacatggacctgcgccaattcttgtttgatatcactcgtcagtgacacgcctactccttaacgctttcgtgctccagcaaaacttgccagcaacgctgcacacagctttgctggatcgtgaatactggtgaatcgaccacggccatcttcagcctggacatcatggaaggagacttctgcaccaagggtgcgagcagctcgttctacatgattgcgttcggtttgtgaggacagtgtcttggcatcgacaatgacttggtcaacctgaaggtttcgagcatgctggcggagcacatggatgtgtcgttctgcagagaatcccgcggtctcccctggctcggacgtcaggtttaacaccacggttttggttgcttttgtctgcgccaaggcatcaacgatccctgggaccaaaatgtgtggaatcacagaggagaaccaggaacctgggccaagggtgaccaaatctgcatcgagaatggcctcgatggcagcggggttcggttctggattgtccggaatgattcgaacgcgtcgcacctgcccgggggttgcagctaccgccacttgaccacgaacttgacgcatgactcgagcatcagagtctagacctgatacttccgcttcaagatccaaaggttcagcacataccgggatgatgcgtcctttggctccagcgagttgagcgatttgatcaagcgcatgctgggaggtgcccaaaatgtcggtcaacgccacgatcacgaggtttcccaaggcgtgaccagctagcgcaccatgtccaccgaagcggtgctgcaggaggttttcccacaatccgccttcttcggcatcggcgatcaaagctgccaacgccatgcgcagatctcctggagggatctgccccagctcacggcgaatacggcctgatgagccaccatcatcagcaactgtcaccacagcgttgatggttgtcggtgagcagatttgagctgctcgaagggtctgaaaaagaccatgtccaccgcccaagctggtgattacacgtggtcgctcaagtggagcttcttctggtgtgccatttggggcatcgaagaaggttgtcaattagttggcccctttcctagtggcggttaatatcgcggtgtactacagacacgtcgagcgtggtctgatctgcgattcttttggctagttcttcagacaccgcaactgatctgtggtgtccaccggtgcagccgacaccgattgtgatgaagttttttccttcgtggcggtatcccggaagcatgtctttgagcatgtccacaaagttgttcaaaaattcttctgcgcctttttgggagagcacatagtcagatactggcttgtccactcccctaaatgggcgcagctctggaacccagaatgggttcggcaagaaacgcacgtccacaacaaagtcggcgtcgcgtggtgagccgtgtttgaaaccgaatgattcaatggtgacgtgctgggtgcgcgtggcgattgtcctaaacgaggattcgatggcgcggcgcaaatcatgcacggacagatccgaggtatcgatgaccactgaagcgtcttccttcacaggagacagcacggttcgttcacgttcaatacccacctgaagggtttggctgccctgcaaaggatgggtgcggcgcacattatcgaatcgcttgatcagcacctcatcgcgtgcttccagaaataacaccgtgggatcgagctgcttatcacgcagctctgaaacaacctgggtgaggcttccgcggaattcacgggagcgcacatcgcacacgactgcaactttgtcgacgggagaatcttcccgagcgcacatatcaattaattccaggatgatctgtggtggaatattgtgcgccacataccaacccaagtcttcgaggactcgggctgctgtgctcagacctgcgcctgacataccggtgatgatgacaggtgtgaaattgtccctgtacttcacaggattttcttgtgcagacttatcagtgtgcgtgaccccagtggattgaatcatggttacatcctagcgatctacttattttgacgcgtgaagaccttcatagacagcctccgcaagtttcgggccgaagcctttcacttgggaaatgtcctcaacgcttgcctctttcagttttgccacggatccaaagtgcttgactagttcagtgcgacggctctggccaaggcccttgatgctatctagctcggaaacacgcatgcgcttggatcgttgctggcggtggtaggtgatggcaaagcggtgggcttcgtcacggatttgctggagcaaaaacagtgcttgggagtttctcggcaagatgacgggatcggggtcgccgggcagccagatttcttccaagcgcttggctaggccaatgagcaccacgtcaacgatgcctaattcatcaaagacttcttgggctgcagctacctgcggggcaccaccatcgacgataaaaatctgaggagggtatgcaaaacgcctggcgtcggtgctcatttcctcgactttttcatcgctgaaggtcgagccgtcaaactcttcggcttcgggaacagcaagtttgtcttggttgtggcgcaggaagcggcgcctggtgatttccgcaatggatgccacgtcgttggaatgtccatcgcctgcggcttctttgactcgatagcgtcggtagtccgattttcgaggcaaaccatcttcaaaaaccaccagggatgccaccacatcggtgccctgaatatgggaaatatcggtacattcgatgcgcagcggagcctgctccatgtccagcgcttcctgcaattcctgcagtgcagctgaacgcgcggtgagatcaccgacacgcttaagcttgtgttgtttcagcagctctttggcgttgcgctccacagtttccatgagcgcacgcttgtcaccgcgctgtggcacgcgggcatcaacgccagcaccgcgcaattcctccagtactttcagggtttgctcagcttcattgggcgcaacttgcacgaggatttcacggggcacgaccgaagcgcgcgtcactggggctgcctcttcaaaagaatgcttatcgacgccacgtcgctcgatcaccgcagcatcttccttagcctcagtttcagcacgctcgacggcgtcgccataaaactgaacgaggaaatcttgcatcaaaaatggcagtgcgggatctgtttccggggcatcaccctcaggttgggtcgtagcgtcgacaagcaatccggcgtagtcgccgggcttttccacaacccagccgcgctggccgcggattcggccacctcggatgttgaagacttgcacggcggcttctagctgatcggtggcgaatgcgatgatgtcggcgtcggtgccatcgccaaggacgacggcctgtttttccatgaccttgtcaatggcttccagatcatcgcgcaggcgggccgcgcgctcgaaatcgagttcctcggccgcagccatcatgtcggcgttgagtttgcgagtgactttgtcggtgtgaccagccatgaaagaggtgaaaccgtcaacgatttcgcggtgttcctcttcgctcacgcggcccacgcacggggccgcacatttatcgatatagcccaacaaacacggccggccgaggctttcgtggcggttaaacacaccctttgaacaggtgcgcatggggaaaacgcgggtgagaagatcaagggtttcccgcactgcccacgcgtgggaatacggtccgaaatagcgcacacctttgcggcgcggacctcggaagaagaacgcgcgcgggaacctctcccctgtggatactgccagcatgggataggttttatcgtcgcggtattttacgttaaaccgcggatcaaaacgtttaatccaggtgtattccagctgcagcgcctcgacttcgctggacaccacggtccactccacagacgacgctgcgaacaccatttggcgggtgcgcggatgcagttgggtgacatcctggaaatagttcgacaaccgcgaacgcaagtttttggccttgcccacgtagatcacgcggcggttttcgtccctgaatttataaacacccggctccgttggaattgttcctggagccgggcgataagttgttggatcagccacagcttaattagtcctctggcatgtacttgttttcgaggtcgcggaaggtcgcaaccgcgcgcaccacatcttctccatcgcgggactggaaagcccacatgggaacgaattcaaagtctggaagctccaaacgtgccacgctgctgcccttggggaaagacatgccgtagatgacaacccatgggtagaaacgagttccgatgaagttacgcacctcaacgccgtcttcgttggcacgcacgcgagggcgagtcagtcccaagaacacaagaacggagaagatgatgcccaacgctgggaatgccagagtgtcaacaaaggtgaccgctgcaccggtgaaatcgacgtccaccacggcacccatgaagatgtgaacggccatgatgacaaccacggctacccacgcgatctttttcagaaactttgtggtcacctccagctcccatggcttggttgtggtggtgccagcgaaagctgcggtgtattcctgaatttccgcatcgctgagctgtacctttggcttcccgacagcgcccgaatgtgcgttgttgatgttgttcgttgctccgtcgggggcgttggttgtcacgatttcacaaatccttagaactaattagcggtggcgcgcatcctgctaggcattaaaccgaggcgtcaaaccttttaaagaacagtctaaccctcagttgcacgaatttgagaaagcacgagggcagtatcgagtgcagcgaccattgcctctgcgcctttgtcctctacagagccttctccaccggagcgttccacggcttgctcttcggtgttggtagtcaacacaccgttgccgattggggtggaagtatcaagagcaatgcgggtgaggccttcggtgacagagtcgcacacgtaatcaaagtgtggggtgccgccacgaacgacacagcccaaggcaactactgcgtcatgggtgcgtgccagttcttgcactacgactggaagttccagggcgccgatgacgcggtattcgctcaccgttgctcctgctgcacgtcccgcatctactgcgtgcttgtgcaggcggtcgcagatttctgcgttccaccgtgcggtgactacggcgacttttaatccgctggcgtcggggagttcgactgccggcaatccttctttagccattgttgtgctccttagttttctgggtgctcttgttcccacagtgcgacatctgggaggtcatgtcccatgcggtcacgcttggttttcaggtatcgaacattgtcttcatgaacagcaacagggatgggggttcggctggcaatggaaatgccgtggccttcaagtcccaccttcttggctgggttgttgctgatcaagttgagcgagcgcacacccaagtcgtagagaatctgggcgctggtgccaaattcgcgggcatcggctggaagaccaagtgcgaggttggcatcgacggtgtcggcaccttcatcctggagttggtaggcgcgtagcttggcgagcagaccaatgcctcgtccctcatgcccacgcatgtacaccactactccccgaccagcttcctggatcaggcgcaaagactcgtgcagctgctgtccacagtcgcagcgccgggatccaaaaacatcaccagtcaagcactcagagtggactcgaaccaggacgttttcgccaccgtcggatgccacgtcgccggcaacaatggcaacaagctcggtgccatcgatgatggaacggtaaccaacagccttgaacgtgccgaaatcggtaggcagcacagtttccacctggcgctccaccaaaatttcattcttgcgacgccactcaatgagctgctcaatagagatcagcttcagatcgtgctcatcgcagaagcggcgcagctcaggaacccgagccatgccggtggggtcctcttcactgaccacttcgcagataacacctgctgggcgcaggcctgcagcgcgagccaaatcgacagctgcttcggtgtgtccagcgcgcaccaagacgccaccttcacgagcacgcagtggcacaacgtgtccgggacgggtgaaatccgtgcggtcggcttctggatcagcaagcaagcgcaaagtgtgggcgcggtctgttgcagaaatgcctgtggtgccggtgttggcatcaacggtcacggtgtaagcggtgccgcgggcatcctgattgtgcgcggtcatcggaggcagatcaagacgatctgcatcctttgcggttaatggcgcacagatgtatcccgaggaataacgcaccatgaaagcgactaattctggagtggctaattcggcggcaaagatgatgtcgccttcattttcacgatcttcatcatctaccaccacgacggctttacccgcagcgatgtcagcgatggcctcttcaacagaatctaattggctgtgtgcctgctcatgttcactcacgttgtctaacctagtctctcgtgaaatcggtgtagtcattgggagtgtttccagccacgccgcgcgtcatcatgcgttcgacgtacttagcgatcacatcaacctcaatgtttacgatatcccctaccgccagttcgccgtgggtggtgtcgcgcaaggtggtgggaatcagggaaacctcaaaccaatcatcacccaaagacgatacagtcaaggatgtgccattgagtgcgatggagcctttttccaccacatagcgagccaaatcagctggcagctcaaaacgcagaacatcccagttctctgagctggtgcgcttgatcagcgaggtggtggcatcaacatggccttgcatgatgtgtccacccagacggccatcggctgccatggcgcgctcaaggttgactttgctaccggtggataatgcgcccagggagctgcgatctaaggtttcctgcatgaggtctgcagtgaaatgtccctcgccaaaggacgccactgtcaagcacacaccattgacagaaatggaatcccccaaatgcacaccctctaaaacggtggacgcggaaatctgcatccggatggaatctcccagatgttccacgcctgcaacggagccaagctcctcgacaatacctgtgaacatttagtgttcctttctcatcatttctatcaatacatctgaacccaactgtctcacggacgtggtgtcaaaacgcataatctgatccatcgtggtttcttgtggccagttaatcactgatcgtccagcgcccaacaaagcgggggcaacataggcctgcacctgatcaacaatgcctaagcgcagcgctgccccagctaacgttgggccaccttcgattaaaatgtctcggcaccctttatcccacagcgctgataaagcctctggtattcccgcgtactgctcatatcccaagcgagccaagttggaatctgctggaacctcgcgggagccaataacaacgcgcctgggttgattttcataaagacccgtatcggtccgcgccgtcaaggagggattatcagtcaacgcagtaccggtacccacgatgatcgcatctcttttacttcgatcttcgtgcacaaacgcccgcgcatccggcccggtaatccactggctggtgccatcggtggcaccagcaaaaccgtccacggtggacgcaaacttcaacgtgacatggggcctgcccagacgcgtcgcaaccagccagggctccagtgccctgatccgctcatctaaaaaatgcgtatcgacgcccgcctccgccaaaaaggcaccgcccccagcggctgacgggaagggatccgcattggcgtaaaacacgtgtgcgatcccggcgtcgagaagcgccttggaacatggacccgtgcggccgtaatggttgcacggctcgagggtgaccaccgccgtgcccccgttggcacgcactccggcagctgcaagcgccaccacttcggcgtgcgggccaccaggaggtgccgtggcgccaacgccaacgacctcgccgtcggcgtccaaaatgacagcgccgactggcggattagggctggtggtgcctcggacttgatctgacacgtggtgggccagatctaacgcgtgcgcaacatccatttactgcgcgagtgctcgcaactcctggatcgccttgttgggatcctcagcgccgtacacagcggaacctgcaacgaaggcatccacgccagcgtcggcagcctgcttgatggtcttggcgctaatgccgccgtcgatctcgatgacggtgttcagaccgcgctcatcgatgaccttgcgcagggtacgaaccttttccagttgttcaggcatgaagctttggccaccgaatccaggctcgacgctcatgacgatgacttcatcgaagtgctcgaggtcatccaagtaatcctcgatgggagttccagggcgcagggagaaacctgcacgcacacccttggaacggatgtacttagccaactcaacgtgaccttcggtggcttcaacgtggaaaacaatgcagtccgcgccagcgtcgatgtagttgtccacccacttctctgggttttcgatcatcaggtggacgtctagttctttgtccgtaacgcggttgaccgcagctgtgatatccgcgccaaagctcaagtttggaacgaagtgtccgtccatgatgtcgacgtgaatccagtcagcatcaggaacagccaacacctgctcccctaagcgggagaaatcagcagcaagaatggatggggcgattagtggagtacgttgtgccatgccctaaatcatagccctcttgtctaccccacttagctcacaggtctacttctttcgcagcactgccacaaacatcgcatcggtgccgtggcggtgtggccacatctgcactgatttctcatcgccggtatcggtcatgcctggcatgaactccgcagcctcaagctcttcgatctccagagcccccagtgccttgtccacgattccgcgggtttcacgcagatcaggtgaacatgtggagtacacaatcacgccaccggaacgcaccttgttcacagcggattcaagcagctcgtactgcagggtgttgagctcaacaatgtcgctttcctgcttgcgccaacgcgcctcagggcgacgacgcagtgcacccaaaccagaacacggcgcatcgactagcgcacgatcgtaaccaccggtcaagttgatggtgcggccatcgcccacatgaaccttgacgggcaaaccacgcacggacttttcaatcagtcgggcacggtgatcagagacctccacggcatcaacggtggcacgatccatgcgagccaacgcaccaatgagcgccgctttaccgccaggacctgcacacatatccagccaacggccggcatcggtgccctccacggggatttccaccaaggcgcgagcaatcagctgagaaccctcatcttgcactgctgcaagaccatccttcactggctcaatatcacccgggtcgccaccctcgaggtacaccgcgtatggggaatacttgccctcgtcaccaccggtgatcagcgccaattcctctgcactgatctcacctgggcgagccaccaagtgcaccactgggcgctcagagtccgcagcaagcgctgcttccaactcatctgccgggagcacctgtgagaaactctgcgcaatccagcgtgggtgcgcagtacggaacgcaacgcgagccaactcttccgcgggctccaattccttcaaccactgctctggttccttgcgcgtgatgttgcgcaaaattgcattggcaaaaccagtggcctggaatttcttcagcccaccgaccatctttactgaagtatcgaccgcagcgtgatcctccacgcgggtaaacatcacctggtacgcgcccaaacgcagcacgtccaaaacctctggatcaatatcagacagttcacgcccagatgcagccttaatgacctcatccagcaagccgacattacgcaaggtgccgtaggtaatttccgtagcaaaggccgcgtcacggccagaaagattgtgcttgctcagcagtcgtggcaacaccaagttggcatacgcctcaccggtacgcacacgatcaagcacctcaaacgcaatttctctcggcttatcgacgcccagagccctcacttccctggcctgcgcagggggcttgcggtttccgccgcctttgccactgctttggccctggcgctgcccctgactctgcccctgcccccgagccggggccttctttgacggagatttacgcgcctgcggcttctgcttagcaggttcctgctgcgcttttggagtcctggagcggaatccgccggatttttctaggctcattggaatttcgcttcctgatcaagttggacaccacgcgcccagtctgctgcattcatcattttctttcccgggggttggatattgcccagaacaattggtgtggtgcccgttccgaccaccacggagttcttttgcgccaggatggcgccaggcgccaagtccgctgctacttcgacctcgcctgagtggctgatgggcccgaccttgaggcgggcgtcgacaagcgtggtccatgcgccaggtcctggggtatgtgccctgatgtggcggtcgatgacctcggcgggcttcgaccaatcaatctgcgcgtcctgggtggtgatttttgaggcgtacgtggcctcgccttcctgggcgcgcggggtgattgtgccctgctccaggccagtcatggtctcaaccagcaggtcaccgcctgaatacgccaggcgagtaagaagatcatccgcagtatcggtgggctgaattgtgtcctcgatggtggacaaaatcacgccggtatccaggccctcatcaatgcggaaggtcgtggcaccagtgatctgatcgccttcacggatcgacgcctgaaccggcgccgccccacgccatgcaggaagcaaagaaaagtgcagattcacccaaccgtgtggcgcaacatccagcaaatccttggtgatcagctgtccgtatgccaccaccggcaagcaatcgggggcaagctcagccaagcgctgacggattgcttggccatcttccgtatcagccttcagggaggtgggctttaacacctcaataccgtgctgctgtgcaagctccgcgacagctgaaggatgcagcgtacgaccacggccgcgacgtgcatctggttgcgtcaacacagcgacgacctcatgatcggaatcaatgagcttttgcagtgccaccactgcaggttccggagttccggcaaaaactaggcgcatgaagtgccctttccactcattatttgttaaaccatgcagacgcgcgaataacgcccatggctgctttacgttcagctggatcaaggcgcttcaaaaacagcacgccatcaaggtgatcagtttcgtgttggatgcacctggccaacaatccattggccacaaaccccactggattgccgtcgcggtcctggccagacagccgaaccgtttcatagcgggtggtctcagccgagacatcagggatggacaaacagccctctttgccagtctgggtgtcctcagtgagaggctcccacaccgggttgatcacatgtccgcgcaatccaccctcctggtgggaggtatcaaacacgaacacgcgccttaaaacacccacctggtttgctgctagaccaacgccaccggcatcttccatggtgtcaaacatgtcatcgatcagggtggacagtgattcatcgaagtccacgacctcatctgcccgactcacaagtacgggatctccaaataatctgacttcacgaactgccatggttgtgggaaggctccttcaacaataattcctatgggtggatgatcttgtctccccatcttatatcccacatgggacacgaccccattaggcctttcaccagcagttttatccgatgtgaatcggatccatctgaatacgcaacggcaaatcattcttcctcaccgcacgcgccacctgggctgagcgcagcgctctacccaactcagaccgcggtcccaatggagttctgatgagaaggcgctgcggcggaccaaagcgctgctcatcatattcaccaggcaaactcacacccggtggcagatcaacagggccgaggacttcagcatgatcgggaagctccgccaaatccaagaaactttccaatgcagcggtagccccatcgattgctgccatgtgtacagaaggcgggaacataacctcgcgtcggctagccaactcttgcgctgcagcacctgccatatcccaccgaatcaacgattgcacagcaggaaacgatggatctgcaaccacgatgacttgaccctggtgcagatgagaatgcaccagcgtggccgccgctgcccacttgtgcagcgcgtcctccatggcgcgcagatcttgccgacccatcaacgcccaggtatccagcaataacaaggcaccgtaagcgcccttgtgctctggtttctccgatttctctggtctctccggcgagttggccacaaaaggttctgcacctggcgtggacaccacaatgctggctcggttttccaccgaatccaccaccttgttgccaccagaggtaattacccgcacagacgggaacgcgcggcccagttcttctgctgtgcgttccgttcccagcaccacagcacgcagttttggagagccgcagttttggcacttaaaccgcgaatcagggcgtccgcaccatcggcaagtgggcactcccgctagatcagagcttccctggggaagtcccacaggcccattacagtgccggcaccgcgctggggtgcggcagtttccacacgccaaggttggcacgtagcctttccttggtacctggataagcgctggttgatcacgttctaaggcgctgcgcaccgcatgaaacgcaatgccaggcagccgcgctgatcgggccattggatcgcgttccatctggaaatcggaatcgcccactgcctgaatacgcggcatcctagtgcgaatggtatccctcggtgcgatgagattgtgcatccatcccgattccaccagcaattgggtttccgcggtccgcgcatgtcccgcaataatcaaggagcttgcttccaaactggaacgcgtggtcagcacttccctggcgtgggcatagggcgctctaggatcaacgaggttgtcgtcgccatcatttaaaatgacggccagtttcagatccttcacgggtgcaaaagcggcacttctggttccaataatcagtcgtccctgcccactgagtaccgataggaaacgccgatatcgtgcctgcggaccaagacctgaattaagcacagtgatttgtttcgccgcaaccaaacctcgaagcgcagcttccaagcggtcgagatcgcgctgatcaggcactacgagaagcgctccgccgccgtctttgacaaccttgaccgccaaagaagccaaagccagcgcccaatcatctccgggagcaatctgccatgacgcccgcgcagttgttcccgccaagacggcgtcaacaaatgattgaccatgctgatacgcagaccacgacgataaatcgggttctttaacctcacccaatgactcccacgacgtggaggtatctgcctcttctgccccagcatgccgcgccggtagcgccgaacggatgagatccgaacgtaccccgccatagcgatcactgagttgctcaattagctttgctgtttgaggtggatacaccacgatcggcgaaatcacccgatccagccacatcagctttccctcgtgcgaggtttgcgcggtgcgtgacatcacgatggcatcaactaaacgtccaccaaaacgcacgcgcacccgcacgccaggttgcacatcatcgtgttggtcttcgctgatgcggtaatcaaacagtcgatccaggtgaggtaaccccaaaagaggtaaaacccgcgccaccgacttttcaggagcggggacgcgggtttttgccatgaatccgaagatactacatcagatttttaggccaacttgagggctgcgcgaagttcatcaacgcggtcgatagcctcccaaggaaggtccaaatcagtgcgaccaaagtggccgtaggcagcagtgtcagcgtagatcggacgaagcagatcaagctcacggataattgctgctggacgcaggtcaaagacctccaacacggcagcctgaatctgctcgtcgctcaggccttccttgttggtgtcaaaggtttcaacgtaaagtccgactggctttgcgcgtccaatggcgtatgcaacctgaacttcagcgcgatcagcaaggcctgctgccacgatgttctttgctacccaacgcatggcgtatgcagcagagcggtccaccttgcttggatccttaccggagaatgctccaccaccatggcgagccatgccaccgtaggtatccacgatgatcttgcggccggtcagacccgcatcacccatggggccacccagaatgaaggaacctgaagggttgatcaacacggtgatctcaccggttgccagatcctcaatgcctgcgtctttgattacccaatcaatgacgtgttcgcgcagttgggtttccaaccatgcacggtcaacttctgggtcgtgctgggtggagatgacaacggtatccaggtggctagggcggtcttgcgcatcgtatgcgaaggtgacctgggtttttccgtctggacgcaggtgaggaacgatgccctctttacgaacctgggtcagacgacgtgacagtcggtgcgccaacgcgataggaagaggcatgtactcttcggtttcgttggtggcgtagccgaacatcaggccctggtcgccagcacctgcgcggtcgtcttcttcaacgtcgccgttggtgcgggcttcgtcggagttatccacgccgtcagcgatttcctgggactgctcaccgatggatactgagacgccacaggtgcgtccgtcgaatccaacctcagaggagttgaatccgatttcgatgagcttgttgcggactaattgagggatctctacgtaagcgctggtacggacctcgccaacaacatggacgattccggtggtgaccacagtttccactgcgacgcgcgactgcggatctttttcgagcagcgcgtccaaaatggtatcggaaatagcatcacatattttgtctggatgtccctcagttacagattcactggtgaacaaacggacggcggttggctgagccacaaatacccttctttcgaagaagttgagaataaatagtcttaaatacaaaaaaccaatatagaccaagctgtctaaaactgcaatgtcagtggtctagctggatttttctagacttcgcgatacgccagtgccgcgtcccaaatttgcgcagcaacctcgattttgctgccgtgctccacatcgactaccccaccgtgagcatccaaaatccagccctcattgtgcttttgcccaaacactttgcccatgcccacctcattacacatgaggaggtcgcagcccttcttctgcagtttcttgcgcgcatactccaaggcggtggtgtgctcgtctccagtttccgcagcaaaacccacgatgacaggattactgtccagctctcctgcttcacgacgcttcaccgtggtagccaaaatatccgggttttccaccaacgagatggtgctcaatgcgtcttcatcagaatctgagcccttcttcaacttcgatgtcgcctgcgatgcgggcgtgaaatcagctaccgctgccgccatgacgatgaaatcagattggccagctcgttcctggactgcatcaaacatgtcttgtgtggacaccaccggcacgatctctgcgcctgccggagtgggcagctccgcagcatttcccgccacgatgctgacatgagcacctcgctgtgctgcgatttcacccaacgcaaaaccttgacggcccgaggaactattgccaataaagcgcacaggatcaatatgctcatgcgtgccaccagcagtgatcagcactttcttgcccgccaaatcctgaggcaacctcgccccggcgtgcaccgcattggctaaatcaacaatctgctctggatccggcagccggccagggcctgtatctttaccggtgagtcgaccatgcgcaggctcaatcacggtaatcccccgctgcctcagcgttgccacattggctacggtagccggattaaaccacatctccgtatgcatggccggcgcaataaccacggggcacgttgccaccagcagcgtcgccgccaacagatcgtcaccgcgacctgccaccacacgcgccatcaaatcggctgtcgccggcgcaatcacgatcaaatcagcctcctggccaactttcacatgctgcaccgaatccaccgcatcaaacaccgttgtagacaccggattgccagacaacgcttcaaacgtcgccttccccacaaacttcaacgcggattccgtaggaaccacccgcacattatcgcccgcttctttaaacgcgcgcacgatgtgacacgccttgtacgctgcgattccgccggcaacaccaacaaccacgttgcggggtgcggaggggcttgaaacatgagtcatgggcacaacaatccttcaaagtaagaggctggctgggttcccacacactctacaagatgcttttcgacgccaccccacgctctccctcgacctccgctgtgcatagggcagcaagatttcctgattttggccacctttttgccgaaatcttgttgtcttatgtacacacggacaaacctgccgccaaaaatgcaaaacacccaccgcaagtgacaactcgcggtaggtgatttttacaactgtgtgaagttataaggtcttttaaccttcctcgtggtccaacagacctgcattgatctcacgcagagcaatagaaagtggcttttcgcctggctgcggagtaaccaatggtccgatgaactcgaatactccctcatctgcctgatggtagaagctgttgatctggcgcgcacgcttggctgcgaagatcacgagggcgtacttggaagtgaccttatccagcagttcatcgatcggaggagcggtaatgcccactggcggatcgaagacggccttggtggcgttggtctcgttgctcacgttggtcactgacaccttttcaaaagtatatggacagtagtgttaagagcgggaaaggttgctcaatcggataagcataccctaccgctctatgttttggctaagcgccgaggagaacatcctcaatagccttgacggctgtatccacatcatcattgataatgacgtgcttaaattcgctctgagcagccaattcttcgcgtgcggtctcgagcctgcgagcaataacgtcttcgctttcggtgccacgtccagtgaggcgttcaaccaaaacttcccatgaaggtggagcaaggaagatggtttctgcatctggaattaagctagcgatgtttcgggctcctgcaagatcaacctcaaccaatactggccgaccattttggcgagcctcattgacgggacctgctggagtgcctgaacgctgcaaaccgccgtggatatctgcccattcaagcatctctccacagtcgattttgtcctgaaattcctgtgcagtgacatagaagtagtcacgtccatcgacttcaccaggacgaggtgccctagtggtcatcgacacactgaaatacaggtttggaacgtcattgcggaggcgatcaaccacagtcgatttaccgaccgctgaggggcccgcaagaattacgagccgtcctagttggttatcgcccgacactgaagaattaatcctcgaagccgaaacgctcgagaagtgcgcgacgctgacggtcacccagtccacgaagacgacgggtctgagcaatgcccagctcgtccataatctcctttgccttgaccttgccaaccttagggagagcctcgaggagagcggagaccttggtcttgccgatgatctcgtcagactcagccttgtccagaacttccctgaggttagtgttgccgcgcttcaggttctctttgagctctgcgcgtgccttgcgtgcctctgctgccttagcaagcgctgccttgcgctgctcatcagtcaactgtggaagggccacggggttcctccgttatcgtgtggtttttagtgacaaaaggaataccaaagtatccagaaatcgagggtacacctggttaataccaaggatgtcagcctgcgattttcgaatagtctagcactactttcgcaaacacaaaggtggcagaacccctaaaagctaaacctgcaggtcacaggcttgcaattaagggccgtttccgcgactatgacctggggaaaccaggaaagtctgcagcattttttgccacagaattcttcatttcagcgatatctgggcctgtcgccaaaatacttctagagacatttgggaatgcaagatgagccatgtctcccgcaatctcatcaacgtcgcttgccgtgccgccctgggcgccgacgccgggcatcaaaatggcgcccccgagcgtcgataagcgtggtggtttggacaaggtggcgccgatgacgacgccaatgttgccagccttgccctgggccatataaggcgcgttaagcgccgctgcctgatccacgatctgctgggaaatgctcacgccgtcagcgttttgctggtcctggagttcgcgggcctcagggtttgaggtcgcggccaagacaaacactcccctgccgtgttgctcggcaagttcgaacactgggtccaaggaatgaaaaccaaggtagggagagaccgtcacagcgtcgctagacagcggtgacgctggatctaaccacgctgaggcatagccagccatggtggagccaatatcgccgcgtttggcgtcagagaccaccaaacagccacgctcacgcagcgtctgaatggtttcttccaagatggcaaagccagcggaaccgaaacgctcatagaacgccacctgaggcttcaccaatgccacggtgtcggcgaaagcctccacgcaggcgcgggagaactccgcaagtccgtctacgtttaccggcagcccccaggacgtcagcaggctttcgtggggatcaatgcccacgcatagcctgccacgggtggaggcggcgttcagaagcttctcgccgaatgtcatagggcttaagccttgactgcgtggtcgagttcctgcagcgcgcggacgctgacaacgccctcacgcagggcctctatgccctggacagctgcggtgacaccctgaacagtggtgatcagcggaacacccacggtcactgctgctgcgcggatatcgtagccatcgtggcgagcgccagcagaaccagctggggtgttgaggatgaggtcaacttcgccttcgcggatacgatccacgatggacttgccctctacaccttcgcggatgtcggaagccttgagcacaacttcacactcaatgccgttgcggcgcagcatgcctgcggtgccttcggtggcgaggatcttgtagcccatcaacgccaggcgctggattggcaggatcagggtgcgcttgtcgcggttagccacggtcacgaagacggtgccttcggttggcaatgcaccaaacgcgccagcttcagcctttgcatatgcagcgccgaagttgttggccaagcccatgacctcgccagtggacttcatctctggggaaagcagggtgtccagggtctttccatctgggcgacggaagcggttgaacggcaacactgcttccttcacagcgattggagcgtccagtggcaaggagccgccgtcgtactcggtaggaatcatgccctcatcttggagatccttgatggtggcgcccactgcgatacgggatgctgccttggccaggttgacgcccgttgccttggagacgaacggcacggtgcgggatgcacgtgggtttgcctcgatgacgtagaggatgtcgtccttgagtgcgtactggacgttcatcaggccctgtacaccgatgcccagagccagcttcttggttgcttcgcggaccttctcgatgtcctgtgcgcccaaagtcattggaggaagtgcacatgcggagtcaccggagtgaatgccggcttcctcgatgtgctccatgacgcctgccaggtagacctcgtcgccgtcgcacagtgcgtcgacgtcgatctcaatagcgttgtctaggaagcggtcaaccagcactgggtggtcagaagacaactcagttgcgcggttgatgtaatcctcgagggaagcctcatcgtagacaatctccatgccacggccacccaagacgtaggaagggcgaaccagcactgggtagctgatctcatcggctactgtgcgagcctcttcgaaagaggttgcggtgccgaatgctggagcaggaagctgctcgcggttcagcagtgcaccgaactcgccacggtcctcagccatgtcgattgcctctggggaggtaccaatgacagggacgccagccttcttcaaacgatctgccaagcccagaggagtctggccaccaagctggacgataacacctgcgacggtgccggactgcgcctcagcgtggtagacctccatgacgtcttcgaaggtcagtggctcgaagtacaggcggtcagcggtgtcgtagtcggtggacacggtctctgggttgcagttgaccatgacagtttcgtagccgacgcgggagagctcaagagctgcgtgaacacaggagtagtcgaactcgatgccctggccgatgcggtttggaccggagcccaagatcaggaccttttcacgctcagtctgtggtgcgacctcagactcagctgctggatccagctcgtatgcggagtagtggtacggagtcttagcttcaaactctgctgcacaggtatccacagtcttgaatactgggcggatgcctagggacagacgcaaggtgcgtacgccgtcttcgccagcgaactctgggcgaagggctgcgatctgcaggtcggacagacccatgaactttgcttcgcgcaggagatcttcgtttaggaatggtgcgtcaacgagcttctggcggaactgcacgagagcttcaagctcggcgaggaaccaaggatcaatagaagatgcttcgtagagttcttccacgcttgcgccaaggcgcattgccagctcaacgtcgtagaggcggccttcggttgggcgcttgagatcttccagaacagctgccttatcggtagcgcgctcccctgcgaagaactcatcaggcttggtccagaaaccctgctgcttggtttccagggaacgcagtgccttgttcagtgctgcaatgtagttgcggcccagggacatgacctcaccgacggacttcatggtggtggtcaaagtgtcatcagcgccgacaaacttctcgaaagcaaagcgtggggccttgaccacgacgtagtcgatggtgggctcaaacgcagctggggtttcaccagtgatgtcgttggtgatctcatccagggtgtatccgatagccagcttggcagccatcttggcaattgggaagcccgttgccttggatgccagagcggaggaacgagacacacgtgggttcatctcaatggtgatgatgcggccatcaactgggttgatggcgaactggatgttacatccaccggtgtccacgccgacctcgcggatgatggcgataccctgatcgcgcatcttctggaattcacggtcagtcagggtcagggcaggtgccacggtgacagagtcgccggtgtgcacgcccagtgcgtcgacgttttcaatggagcagataaccacaacgttgtctgcggtatcgcgcatgagctcgagctcgaattccttccaaccaaggatggattcttcgatcaagacgtttgcttcaggagatgcagcaagtccgccaccagcgatgcgctcaaggtcttcggtgttgtatgcaagaccggagcccaggccacccatagtgaaggatggacgcacgactactggaaggccgagttctgcgacagtctcgtggacttcttccatgttgtggcagacgcgggaacgcgcggattcgccaccgatggtggtgacaatatccttgaacttctggcgatcttcgccgcgctcaatggcatcgatgtctgcaccgatgagttcaacgccgtacttttccaggatgccgaggcgatccagctggatagctgcgttaagtgcagtctggccaccaagggttgccaggacggcgtcgattgggtggccctgctcgatttccttagcgaaaatcttgtcgatgtattccggctcgattggctccacgtaggtgtggtcagccatttctgggtcggtcatgatcgttgctgggttggagttgatgagggtgacgcgcagtccctcttccttcagcacgcggcaagcctgggtgccggagtagtcgaattcacatgcctggccaatgacgatggggccggaaccgatgacgaggacgtggttaatatctgaacgctttggcatgttatttatgcgcctttcttctgagcgtctgcatccatcagctcaacaaactggtcaaacagggggcttgcatcatttgggccggcagcggcctctgggtggtactgaacggagtatgcgcgtccggacttcagcgcaataccttcaacgacgccgtcgttgaggcaggtgtgggtgacaattgcagtgccgaaatcggtctcgaattcctggcctgcttcacccttgagtgcgaagccgtggttctgggcggtgatgtcgatcttgccggtgatgtggttcttcactggaacgttgatgccgcggtggccgaacttcagcttgtaggtctccatgccgaatgcgcggccaagaatctggttgccgaagcagatgccaaagaatggaatgtcggcttcaagaacttcgcggacgatatcaaccatgacgtctgctgctgcaggatcgccagggccgttggagatgaacacgcctgatgggttgtactgcttgatatcctcgaatggggtttcagcaggcacgatgacggtgcgaacaccgcgtgcagagaaacgacgtggggtgttttgcttaatgcccaggtcgtaggccacgacggtgtggcgctcttcgccttcagcttcgatgacgtaggtttcatcagcagagacctcaacggagaggtttgcgccggtcattgctggctgattcttgacgatctctacgagttcttcaactgggcgctgtgcgtcagcgccggagaagatgcccgctgcaatggaaccttcattgcgcaggtggcgaaccagtgcgcgggtgtcgattccgccgatgccgacgatgccctggcctgccatttcctgctgcaaggaggtggtggcgcgccagttggacacacgtgctgcgaggtcgcggataacaaggcctgcaacccaaatcttgccgtcgcgggactcgttgtcctcatcgttccagccggtgttgccgatctgtggtgcggtagccacaacaatctggcggtgataggaaggatcggtcatggtttcttggtaaccggtcatggcggtagtgaacactgcctcaccaagggtggtgccgatagctccaaagccaaatccggtgaaggtacgtccgtctgcaagaaccaggtatgccggaacggatccgatctcggtgactccctggtaggtggtggtgtctttactcacggtgactgttgtcgcctttcgtgtgtctgcctttttaaaagaaattggctggttgataaccctgaatgtagtttattcaattcattgcattatatgcaatgtggcgcgtgcatactatgcacccacccgttaagcgttttgtgcaactccgtctgcacaagtcaccttgccacgaagcacggtgtgtgtgaccttggcactgaattcttggccctcaaatggggtattttcagccttggacgcaaagtctgcaccggatgctgtccaggtttttcctggatcaacaatcgcgaggtttgctggctcaccttctgcgattgggcgaccctggcctggtagacgggtgatttctgctgggcgttcactcatcacgcgcgcaacaaagcgccagtctgcaagtccggtggcaacgaaggtgtccacgatgatggacagtgaggtttccaatccgagcatgcctggcttggcgttttcgaattcacagcacttatcttcggaaccgtgaggagcgtggtcggttgcaacaacatcgatggtgccgtcgagaagcgccttcttgagcgcttcggcatcgcggctttcgcgcagtggcggattgactttgttgaccgcgtcgtaggtttccaggcgctcatcggtcaaggtgaggtggtgcggggtgacttccgcggtgattggaatgccctgggacttagcccaacgaagcaactccacggtgccttcagtggaggcgtggcagatgtgcacgcggttgccgtagtcacgagccatgatggcatcgcgcaccacgatggattcctcagccacacgtggccagccgcgcagacccagacgagctgcgttttcaccctcgtgtgctgaagcgccctcagtcaggcggtgatcctcagcgtgctgggcgatcaaaacgtccatgcccttggcgtattccagcgcgcggcgcatgacctgaggatcatcgacgcacttgccatcatcagagaacatgcgcaccttggcttcagagcgagccatcatgccgaactcagtaagctccttgccctcaagacccttggtgatggatccaactggatgcacgtcgcacaggccaatgttttggcccttgaaccatacggattccgcgataaccggctgatccatcactggagtggtgttcgccatggtgaatactgcggtgaatccgcccttggctgcggcggcagaaccagtggcaatggtttcagtgtcttcgcggcctggctcacgcaggtgaacgtgcatgtccacgaaacctggaaggagaactcccccattgccgtcgatggtgcggtcagcctcatgagtgccgccgatagctgcgatcacaccatctttaacaaacacattcgttggctcgccttcgccgtagaccaaaacgttgctgattaggagtgagtctgcaggagccggtgccagtgcgccggtttctggatactgggtgttgctgtcaaccacttctttaatccctcgttaccttttctagaatttcgcgatcagatggtcgcgattagatagtcgcgtcagagcctgcgaccagggcgaacaaaatggccatgcgcatgtgcacaccgttgcttacctgctgcagtaccgcggtgcgtggtgcgtctgccacctggaagttaatttccatgccacgaagcatggggccggggtgcatgatgatggcggagtccttgaggcgagcttcgcgctctttggacatgccgtacagcgttgcgtactcacggtgtgaggggaagaaaccaccctgcatgcgttcttgctgaacgcgcagcatcatcactacgtcggcgtcggcaatttctgcgtccatgtcgtaggagaatcggactggccagttctccacaccaataggaagcagtgtcggaggagcaaccagcactacctctgcgcccaaagtggacagcagatccacattggagcgcaccacccgggagtgcaaacagtcgcccacgatgacaactttgagtccctcaatgcggccggtgcgctgccggatggttaaagcgtcgagaagcgcctgggtggggtgctggtgcgaaccgtcacccgcgttgatcacgctggggccgttgccacctggtgcgacgaactgcgcaagctgctgcgcggcgcctgaggctgggtggcgcatgatgatcgcatccgcgccgattgccgacaaagtcaagccggtatctttcagcgactcgcccttcttcacgctggatgatgaggccgaaatgttaatcacatcggcgctcatccactttcctgcggtttcaaaggacgaacgggtgcgcgtggagttctcatagaacaaggtaaaaatggtgcgaccacgcagcgtgggcagcttctttacttcacgtccttcgagcacctccttaaagcgatccgcttcatccagcaatccaacaatctcatctttggaaagatcgctaatggataggaggtgcttcatctaggaatccccttcagagtcttctcgggtgagcgtgactgcatcgcggccgtcgatttctgtaagcatgacggaaacgtcttccgcgcgtgcggtggggagatttttgcccacatagtcagcgcgaatgggcagctggcgatgaccgcggtcaaccaacacagctaactggatgtagttggggcgtccaacgtcgcgcaaagcatcaagtgcagcgcggatggtacgaccggaaaacagcacatcatccaccaaaatcacggtggtgttatcgataccacctgctggaatagaggtgggctgcagtgcgcggtgtggtttgtttcgaagatcatccctgtacaaggtgatatcaacagcgccggtatctaccgaaacgccggaaaattcttcgatcttttcagcgagcctacgggccaatgggactccacctgagggaatacctaacaacatgacccgatccgcgtctttggaatcaagcgcggttttctcaataatctggtgcgcgatgcgtgcgatggtacggctgacgtcgtcctcattaaggagttctagtacagcactattacgttcgctcatcgtgacctccttccccgcctctctgtgcggtccgttaaaggatgtccaattttgcaaaaactctgcaacgaccagtttcctggttgttgtctgacactatagcgtaccgtgtcacattcaccccaagatgctgactatgatcttaaggtagtgctccacggtgaaacactgttaacaacagtgaaacaccaaaatgcttaaagcagatggtacagcatgccagtcgaatctgtgacaattgatcgttgtaggacacccggtgtatacccactgggacctcataaatccactgacttggagaagcccctgtgagtctgaccacaagccattttattccttttccccgagaaatggtctgggattggcatacccgcaagggcgctgtcgcacgtctgactcccccattcatcccacttaaccccattacgcaggcagaacgcctcgccgacggcaccaccatcttcagtctccccgcgggacttaaatgggtggcacgccacgatttatccgggtttttgaacgggtcacgcttcaccgacgtctgcctcaccgcccctgtgaaggccctcgcaaactggcgccacgtgcataatttcgtcgaccaagacggcggcacactcatcacagattccgtgagcacccgcctaccggcatccacactcacgggcatgttcgcctatcgccaaactcagctcatcgaagacctaaaattcttaagtagaacaagcacgcttttcgacggctcccccctcaccgtagccatcaccggctccagggggctcgtcggccgcgcgctgacagcgcagctgcaaaccggcggccacgaagtcatccaactcgtgcgcaaagaacccaaacctggccaacgtttctgggatccactcaacccagcatccgatctcctcgacggcgcggatgttttggttcaccttgccggcgaaccgatcttcgggcgattcaacgactcccacaaagaagccatccgcgagtcccgcgtacttcccaccaaattcctcgcagaattagttgccgaatccacccagtgcaccaccatgatttccgcctctgcagttggattctatggtcacgaccgcggcgacgagatcctgaccgaagaatccgaatccggcgatgatttcctcgccgaggtctgtagggattgggaacacgccactgctcctgcctcagatgcaggaaagcgcgtagccttcattcgcaccggcgtggccctcagtggacgcggtggcatgcttcccctgctgaaaaccctgttctccaccggactaggcggaaaattcggcgatggcacctcctggttcagctggatcgccatcgatgacctcaccgacatctactaccgcgccatcgtggacgcccagatctccggccccatcaacgcggtagcccccaatccagtctccaatgcggacatgaccaagattctggccaccagcatgcaccgtcccgcattcatccaaattccttccctcggccccaaaattctgctcggaagccaaggcgctgaagagctagccctggcgtcccaacgcaccgccccagcagcactggaaaacctcagccacaccttccgctacaccgacatcggggccgccatcgcacacgaacttggctacgaacaactcgcagatttcgcccaacagcaagaaatcgaagccgaacgcaaacaggaacgagccgaactcaaagccgccaagaagatcgccaagaaagccccagtcctagaggaatcccccaccaacctggaagatcccgaagaagtagagcaaagtatcctttcatcaatcctcaatttccgccgtaagcgcaacgactaaaaccaccatctgtagtgtggtggaaaagttacttttaaaaggattttggaaggactgaaactccccagtgcctcaatcacccacagcacacgaccccaacgacatccaggaatttaacctcgatgccgttgcagggattctccaggacgaaaaactggactaccgcatcgatgaacacgacggcgaaaaagtaatccgcaccggattcatcaacgccgccatcagcttcatcctcttagacggcagcttaaccatggaagccatgtggcgaggagccccctccaccgatgctgccgcacaagttctcgcggccaccaacgaatggaacctcacccagttcgcacccaccattcgattcttcgaactcaacgaaggcaccctcgccatcaatgcactgcgacacgtcgttgtttccgcaggcatgagccacaaccaagtcggctcctacgttatgagctccatcgaatccgctgttcagtgcttcgaatggcttgagcagcaattcccagatctagtcacctggaaggacgaacaccatgaccactgattccaattctgcgacaatcccaaccccaaagccgattccagtgaccatcgaccgaatctccctcatcatgaaagaattcggcattgacctatccatcgccgatgaacaaggcaccggatcccaagtagccagcgccaacctcaacggccatcacgtcatgttcgctgtcatcggttcagtcctgatcgttcgtgccgatcgcgccaccgaaatgccagtctccgacggcaaccccgcatggcatctcgcctgcaaccaagtcaactgtttcaacttcgctgccaaggctgtcgtagttgatcgcaccgacaacatcgtgatccgcgccgagaaggatgtccccatcgccgctgggctcaacgatattcagctttccgcaatgctgaaaaacgccatcgatcacgtcctcgcgattcaagatgccgtagccaatgcaggcaaggaaatcggctaacatgtcggacgagtccatcgaagagcaggaaaaagaactcgcggcgctgaaggctcaaatcgatgaactggaaaagaaagacaagcagaacaagctaatcatcgagattttgtccaaggccgtcgaaaagaatgtggcagaggcagaagcgaaaagagcccgcaaatatccgcccaatcccctgtggtgaattctaaggcgtcgaactttccgaatgaatgtttgtatacctccattggttctaagccgttggaggcgattctgttgagtcgacttctttgggcccaggcaccagaaattgggggagaccagaccacactgcccacgaacctcaaaagtgaggtttgtgggcatctgtgtctggtttgaccccctcataaccagacacagatgcccacgttctagaaactcgcgactggtgggcagtgtggtttggtctcggctagccaataccgaaccggaccggttttaaaggcgataaaccaaacgcacgtgccaaaactcctggaaatcgaagaatcttgtcacacctgtctagtcccctctcacaacgaagcgccacccacccctaaatttctccagggtgggtggcgcttggtgttagccagaaaagatttagctctcgtcagccttttcttctgaaacctttgaaacttcagagtcttctgcgacttcggaaacctctacagtctcttcagcctcaaaaacctcagcagcatctacagcctcaaaatcttcatccgagtcatccaaagcatccgagtcatcccacggcgcgaccggagcatcatcgagagattcggaagcttccgccagaactgcttctgggttggcggcgcgctcgcggagggtctccacctttgatgccatggcgtcaagtgtcgcgttgatgtaggcactggatttgtctccggagtattcggaggcaatttccacggcttcaacgattgcggtggtgacaggaacgtcggcgttgtagatcatttcccaggaagcgacgcgcaggattgcgcggtcgacggatgggagtcgtccgagagtccaggtttctgcgatgtgttccgcgaggaagacatcgagggtatcgagttcaacggcaacgccattgatgatggtttcggtgtattccgctaccggtgcaacgatggggttggtatcgcgcgccaacttgtggcggtcatcgatgatggccacgggatcaacatcgcgggattccgcttcaaataggatgtctacggcacgcatgcgcgccttgtagcgggatccgtgtcgcttgtaatcttgtcgacgctcgctcacgttttgttctctttgttcctgttcaatcaaaatgtttctggctgattcttaaaggttttaagaatcttagttgttaacgcgggagaggtaggaaccgtcgcgggtgtctaccttgagtacgtttccggtctcgatgaacagtgggacctggatttcagcgccggtctcgagggttgctggcttggtgccgccggtggagcggtcgccctgcaggcctggatcggtgtgctcgacgcggaggtcgacagatactgggagttcgccgaagagtgcctcgccttcgtggaaggagacctgaacgcgcatgttttcaagtaggaagcggccagcgtcgccgaatgcgtctggggacagctcgtactgctcgaaagtcttgtcatccatgacgatgaaggaagtgccgtcgttgtacaaataggtgacatcgcggcggtcgacggttgcggtttcaaccttgacgcctgcgttccaggtcttgtcgatggtcttgccggtcacgacgtccttgagtttggttcgcacgaatgctgggcccttgcctggcttgacgtgctggaactcgatgatctgctgcagcttgccttcgttcttgagaactagaccgttcttgaaatcagcggtagttgccacggatgtgatctccctcgtggattacgtggatgggggtctgcgcaaagtgcttgaaaaacgcgcagaccgattagctcacctagattacaccacgatgaggtccttactcaccttggtgatgatttccggtgctcctgaggtaataatcagggtgtcttcgatgcgtacgccgccctttccggggacgtaaattccgggttcgatggtcagtgtggagccggtttctaggactccttgtgaggttttggatgcgcttggggcttcgtggacttcaagtccgatgccgtggccggtggagtgcacgaagtattcgccgtagcctgcgtcttcgatgattttgcggcatgctgcgtcgatgtcgaagaggttggcgcctgagtaggctgcttcaacaccagcgagttgggagcgcaggacgatgtcgtagatttctgcttcgaactcccctgcttcgcccataacgagggtgcgggtcatatcggagttgaatccgcgtgcgtgtgcgccgaaatcgatggtgactagatcgccgcgctggaggatgcggtcgcctgcgccgtggtgtggtttcgcggagttaggtccagaggccacgatggtgtcgaagctggggcgttctgctcccaacaggcgcatgcggtattccagatcggcggcgacttggcgctctgatcggccttcggcgagttctcctgctgcgagtaaatcttcgaatgcttgggaagccagcgctgcgacatcgcggaggcggtcgagttcgaagctgtctttggtcaggcgaatggattccacaacacctgacacggggatcagctcgacgtcttcctgggttgcttcacgcaggctgtctagctggtccagggtggtttgtgcggcttcgattgctatacgacgcggcccttcgacctgcgctagcagcgtcgttgccgaggcacgctcaatcagcgcctcgatgtccgggacttcttctgcgatctgggtggtgtagcgaccgtcggtgcagatctgcgcggagagatctttgttcacgatcagtgcgccgttggagccggtgaatccgctgagatagcgaacatggatcgggcttgtcaccaaaattgagtcgatccgttgagctgccagttttgcggcaagtgcgcgacgacgagtggcaaatcgggtatcagccaaagccatgttctctccttaaaaattcactgaaagtgggtaacttctagtccaaactagtagattactcaacacttagtggctgattgcctcataagcactctgtaaatcttgttttgagggcccctcaatgcgggtaacctcgcccacggcggtcagtgcgacgaagcggatgttgccgtcgcggtttttcttgtcgcgggtcataccgtcgtaaagctcgtcgaaggctccgccttcgtaggaagtgggcagaccgatggccgccaggattgagcggtggcgctcgaggaggggcgcgtcgataagcccgagcttgtgggagaggttggcgatgaacatcatgcccactgcaacggcattgccgtggcgccagcggaagttttcgcggagttcgacggcgtgggcaaaggtgtgtccgtagttgaggatttcgcgcaggctagattctttgaggtcttggccgaccacggagcccttgacggtgacggagcgccaaatcagttcaggtaggtgggagccttcgacttctttcttcaggcaggctgcgggatcagtttcgtaaaggcgcaggatttctgggtcggcgatgaaaccagttttgatgatttcggcggatcccgcgatgatttccgcgtcaggcagggtggctaggcgatcggtgtcaatgaatactgcgtcaggctcgtggaacgcgcccacaaggttcttgcctgcggcggtattgatgccagtcttgccgcccaccgcagcgtccaccatggccaacaaggtggttggaacctgaatgacgcgcacgccacgcatccatgcagcagcgacgaatcccgcgagatctgtggcagcaccgccaccaagtccgatgacgatatcgcggcggccgaatgctgcgccacccaattcatcccagcactgccccgctacttccaaggacttgccgttttccgcatcgggaacattaaggtgcaggaccttcaaaccagcagcgactagtgctgcatccaactcggatgcaatgtcatccatgctgggctggtgcaaaatcgctacctgctccgcgcctgattccgctgcgcgctgaacaatgagctcgttgaggccggaaccaatgtggacatcatagggggaagatccattgacgtggacggtgttgaaaatctgcactgcgctcatggggcacgttgcctttcgcttgtaataggaagaaaccgggcagcccaatgttaatcaggtgcccggtttaattaatcgatttctagatgatgcaacactgctgccaccacttgctgggggctgcggttgttggtgcgaagtcggtaggttgccacctcttcgtacaacggggtgcgcactttcaccaggttgcggtagtgctcggcggggtcggcggcttgcagcacggggcgggaacgctcgtttgcggtgcgcctgatgccttcttctactggcacgtcgatccagaccacgtcctggcctttgagcagttcacgggtggattctgtcagcacagatccgcctcccaagctcaccactccggaggatttcagtgcttcggccacgtggatggcctcgagctcgcggaaggctggctcgccgagctcgctgaacacggcgccacaggcttttccggtggcgcgctcaatcagttcgtcggagtcgacgagttcagtgtttaaggcgcgcgctaatcgacgtccaatggtggattttccagctcctggcaaacccacaagaaccacgatcgggcaggagcattcagaggtgtcatctgattgatgatctaagtgaatttgatcattcacttcattacgctccatcctctaaaccttcgaatttcattcgttcctcaatgtttttgaggtaggtgtcaatgttgctcttggtttcgctcagggagtcaccgccgaatttctgcaggactgcgcgggcgagaaccagggtgaccattgcttctgcaacgacaccggcggctggaacagcgcacacgtcggaacgctggtggattccggttgctgccttgccgttttccatatcaatggttttcagggcgcgaggcacagtagaaattggcttcatgccagcacgaacgcgcagggtttcaccgttggtcatgccgccttcgaggccacctgcacggttggtgttgcggtatacgccgttgtcatccaggaacacttcatcgtgggcttcggagccacgtcgacgagcttcttcgaaaccgtcaccgatttccacgcccttgatggcctgaatgcccatgagtgcagctgcgatctgcgcatcgaggcgatcttcgccagaaatgtgtgagcccaaaccgatgggcaggccttcaacaatcacttccacgatgccaccgagggtatcgccggctttctttgcggcctcgatttccgcgatcatggattcttcagcgtctttaccgaatgcacgaactggggaatcatcgattgcttgaatatctgcaaaggttggctccgcgccagtgtaaggctcggacgcaccaatggaaattacgtgggaaagcacttccacgcccaaggtttcacgcaggaaggaacgcgcaacggttgctgctgccacgcgtgctgccgtctcacgggctgaagaacgctccagcacgttgcgggcatcatcgaatccgtacttgagcatgcctgcgtaatcagcgtggcctggacgcggacgagtcagttttgcgccccgacccgaagacatcgccgcaacgttatctgggtcttccatgtccaaagcgtcagaggacatgatggtggtccacttatcccactcagtgttgccgatcatgattgagatggggctacccaaagtgaggccgtggcggatgccggtgaggaaggtcaacgcgtcttgctcaaacttcatgcgagcgccgcgaccatatccaaggcgtcggcgcgccaattgatacgagacctcatctttagtcacgggcacgcctgctggcatgtgttcaaccgtggcgataagcgcctggccgtgggattcacctgctgtagtccatcgaagcatgcctagcattatcgcacgaaaggccgcagaagacgtatccagcccaccccaagggctttttaaaattgcttttcgacgtcaaaaagcgacataactgcaggcactagcgataaccatacttggaccatgtggaataaatttgggccttttcacccctttaacagccgcaaaaattccacccagtaagacagaaattaacgatgatcccacaattgccaccatgagagcctgcattcccaaggctgctacggctgtccccaaaccgagagccaacttgatatctcccccaccaattcctcccaccagcactgccgtgaggaaataaatccccgcccacacaagcccgccgagcatccactgtggataaatagtcaatgcccataaattaattaacagtgcaccaggaagggtgagcacatcgggcaggcgccggtattttatatcgatgacagccaagactgcgcaccacaacccaactagaaaaatccccatatcttggttggactgcagcgaacgctatttggttccctttaatgtcggtgggtgcccccgaggtggtgaagcaaggtgtgggtcgtggcgtcgacaagcttatatcttgtcacccgcccctccttgaaggactcgaccactccgttatctgcgagcagttggagcgctgcggaggccgtgggcagggtgacgccgacgatgtccgcgagttctgagacggtggcttcaccggggccgtgataatgcagcgcgatgaggaggcggaggcgcgtgcgatcgccgagcattttgaatgttggcgcccactcatcggcgagcttcaggagatgaggttgatgctccattgataatttctttcgctaatagtcaaatgatcatttgagtgttagtgttttctcatgcttctttccgcccgcacacacacgagtttccaagaacttggactcaatgctagtcggcgcaaagcaatcaactggacactggcactcactgtggtgctaattgcctccatgtttgttggcgtgctcatcggtgcatccgggacctcagtgttttccacgtggaccgtaattagccaccatctttttggcactgagctaggtggctccgacactgccgacgccatcatttggtacatccgcaccccacgcgtcttgctcgctgccattgtgggcgcaggccttgccctggcaggtgccatcatgcaagtactggtccgaaacatgctggcagacccctatatcctcggggtgaactcaggtgccagttgcggtgcggccgctgccttactgttcggagtgggcgctggatttggcgattacgccctccaaggcagcgcgtttctcggcgcaatggcagcttccggattgatcttcttcgtggcgcgcgcagcggggcgcatctcctcgacccgcttgttgatgtccggcgtagcgatcggatacatgctctctgcggcaacaagctttctcatcttctcctccgactccgccgaaggcagccgctccgtgttgttctggctgcttggatccttaggacttgccgcatggaatgggccgatggcgatcatcttcctcatcgtgggcattgccctggcgttgctcatggtgttgggtccgcaattggatgccttaaactccggcgatgaaaccgcacttaccttgggagtatcccctgatcgcctccgcattctcctcctggtgatcacctgcctgctggtgggatccatggttgccatggccggcagcatcggattcatcggccttgtcatcccccacctggccaggcgttttgttagtggaaaacaccgactcatgctgcctgtatccgcgttgatgggcgcaattttgctcatctgggctgatatcgccgcccgcaccctgcttgcgccccaagagattcccatcggcatcatcaccgcactcatcggagcacccttcctcctgattctggttcgccggatgcacacctactgatttttaaggaattatgcgtaaattagcccttcccctggttgccttcctgacaggaggtttagctgcatgctcctctagtgatgtggtggaaagtcaagggataaccgttgaaaactgtggctcggtggtgaattttgatagtccaccatcacacatcgccttgatgaaaagcgccgccgtacccacgcttgatgctttaggtgttttggatcgcgtggtgaccaaagctggtgccttcccagctgggtattacgacgccgatttatcggaaagagtcacggacatcccaacgctgtccaacaagatcgacgccagcggacacgtgttgatctcgaaagaagtcgttgttgccgccaacccagacattgttttcggcgaaactgacaccatcaaccgcgcatccatggcatcctcgaacatcccggtcgtggaggaaccagcattctgtggcagcatcgacggcgacgtgagttttgatgatgtctggtcacaaatctccacctatggcaccatttttgatcgctcgacagaagcagacgcatacattgcaacgttgaaggaacgtgtttctgaagtatcctcgcgggttactgactccggaaaaactgtggcggtgctctaccccaccatcggcggcggagtcacctacgcatacggccgcggatccatggccaacccacttgttgccgaagcaggcctgaccaacgttttcgcagaccaatccgaacgcgtctttgaggtcacggcagaagaactgatctcccgaaaccccgactacatcatcgttttacacagcgacggttccccttcagacatcgtcgcagaggtgggcaatctccaagggtccagcgcactcactgctctgagtgagaacaaagtgctgcccatactcatgaactttgccgaacccccaaccccgctggccgtcgatggcctagaaaaaatcatcgactttgtggaaacccacccatgatcgaggccacacacctacgccacagttttggcgacaacatcgtcatcgatgacgtcaccctccatctacctgcacacggcaccgtcagcttggtcggccccaacggcagtggcaaaaccaccctgctgcgtgcactatacggagcactgcaaccaaatgaagggcacatccacgtagatggcgttccactaataagcttgcaccgcaaagacatcgcaaaaaccatggccgtagtcatccaagaacatgactccgacctccccatgaccgtcgctgacctggtcttactaggcagactcccccaccaaaagatgtttgccggcaactctcaagctgatcagttactcgttaaggaagcactcacccgagtcggcgccattcacctggccgaccgacaattcggcgcactttcaggcggtgaacgccaacgcgtcctcatcgcacgagcactcgtacaaaacgccacacacatcctgctcgacgaacccaccaaccacctcgacatccgctaccagcacgaagtcctccacctcgtccgcgaactcagctcaagttccatcatcgtcctccacgacctcaacctcgcagctgcctacagcgaccacatcatcctccttgaccaaggacgtgtggttactcaaggaacgccctcagaggtattgaccccagagcatttggaacctgtgtatggcgttcgtgttgagcgctttgacctaggcgatgaagtccaccttcggttcaagcgtcactaggagttttgttgaggaggtggcggggacttagtgttcttctgagatgcctaaagactcttccaaagcctcacgcatggcatcgcggggtgcatccattccggtgaattgttcaaactgtccgtaggactggtgtgccagcatgacgtggcctccgacagctttgaggcctttggctcgtgtgacttctacgagtggtgttggccaggggtcgtagatgacgtcgaggactggggcgatcgcaagggtgtcttcgaggcctgcgattgctgcggagggcactgtagagactacgacgtcggcttcgatgtggagatgctcgagcggggcgtaggccaaggtggtgggggtttcgtcgaaaagcgtttgcagttcggcggtgcgatcggagcggttgagcaccgtgatccgggcgaccccggcttcgatgagtgcccagatggcggggcgtgcggtgccgccggagccgatgacgatggcgtgtttgccggccagtgatgcgccgccgaggagttcaccgagagctcccctgatgccgtcgacgtcggtgttgtcggcgcgccatccggtggccgtgcgcagcaaggtgtttgcggagccgatggcgcaggcgcgttcggttacttcgtcggcgaattcaagagctgcgaatttagacggcatggtgacggagaatccgcagtaggtttcatcagcgccggagacgatgccggggagcatgtcgccggtgcactcaaagcggtcgtattcccattggtccagtccgagggctttatagccggtgttgtggaggactggggatttggaatgctcgatgggtgagccgagtacggccgcccggtgagtgatgtgagaacccaattttattcgctgatccttatcggttgctgtctagaacgccactgttcaaagcttgctcaatgtcggcttcgtgctcttcgaaggtgtcgttgaacacggtggttccatcggtgtcgatggtgacaaagtacagccagtttccttctgcagggttttccatggcttggagtgcttcggtggatactgcggcgatgggggtttgtggcaggccgtccatggcgtaagtgttccatggggtgacggtctgacggtcttcgtcggtggttgctacttcttgttcagacagaccgtagttgacggtggagtcgaattgcagctgcattggctcggcgagacggttcaagatgacgcgggcgaccttatcaaaatctcctgctggtgcttcgcgctcgattagagatgctgcggtgagcagctcatatggagtaagtccgatggcatctgcacggcccgtgatgtcggtttcttggaaatggtttgctgatcgcgtgatcagatcggtgaggattccctgggcgtcgttggatggatccaccacgtattggccaggcatgatcaggccttcgaggcgctttggatcagttccgcgagcttccacagcagcgattgcccaatctgggacacccaattctgcaggcgacacggtggaggcaacctgctgcaaatcctcagcggtgatgcagttggcggagccttcggtgcaggtcacggctgcgatctgggagtagattcccgcgcgggtgtttccgccgacaacagtgacgtccatcaaggtggcgccgccgtgaatgtcgaggagatcaacctggttgtctggatcaagcagagccgacactgcagctgctgcgttcatttgttcctgcagacggtagaaacctggctgtacactacccgcgttggggttgttgctggccgctgtttggaacgctgagttggtggccacgatatctcgttcttccaactctgggccgagctctgatatggaggaaccttcagggatttcgaccagctgaaccacaccgtttccggagccttcatagtcatgtggcgtccggtttgaggtggctacaccgatatagatgatggcaccgataatgaggatgagtgaagcgatcgtcacggcaataaaccgttggcggcgctttacgtagacgggctccatccggcggtttcggatttggttcatcctgggaaatttcccttctcgtcgaaatcttgggtgtctgtggattgtggttcaagggctcgggtgcgagcatccaaccaggtttgaaggatttctactgcggcagcttgatcaataactttacgtcccgctttttcgctgactcctgaggcccgcaaggcttgggtggccacgacggtggtgaggcgttcgtcgccaagccgtaccggaatgttctttccagcattggtgaggcgccgacggacgcggaaagcaatttcctttgcatgcttcacactggcggagccatttccctgcagatctgtgggtagaccaacaatgacttccacggcgttgtattcctcaacgatggcgaccaaccgatcaatatcggccaggtctggccctttgaatccagtttcccgcggaacggtttccacaggcatggcaagcttggcatcgcggtcagaggctgccactccgatgcgcacggtgccgacatctaagccaaggcgccggcctgggcctggatcatcgtgaccgggtgtatcggcggaaaccttcatagaaaaacccgcttacctttccattgtttagtgttaagaaattaatgtgttgcaaggcacaaagacaaatttagcttttaagcatagccgtacggaagaagacccgtctgatctgtccccaaaataggacccaaacccttctaaaacatgcaatgccggggttctcgtcgtgagaaccccggcgttattttttagggcctagactgaaggcttagagtgcctcgatctcagcgcggactgcgccgaatgcggattccaggccagcaatgttggcgccggatccttgtgcgaggtcagccttgccgccaccgcgaccgtcgatgtaggaaccaacgagcttaaccaggttgccggagtgagctccgcgagccacagcggccttggttgcagctaccacgaatggaaccttgccggcgttgtcggaggcaataaccaagacgccttcgcggtcgccgagcttgtccttcagggtggttgcgatggtgcgcaggtcaccggcgttggtgttgtccttgacgcgcagcagcaaggtggtgacgccaccgatctcttgagcgttgttcaacaggtctgcggtttgtgccatgagctgctgacggtgcagggcttcgatttccttctctgctgccttcagcttgtctaccagctgtgcgacgcgctctggaagttcctcggatggagccttcagggagcttgccaaaccctcggcgagtgcgcgttccttggacaggtagttgaaggagttcaggccggagtaggcctcgatgcggcgcacgccggagccgatggatgattcacccaacagtgccactgggccgatctgtgaggagtgcgcaacgtgcgtaccgccacagagttccatggagaaaggtccgccgatttccacaacgcgcacggtgcttccgtagttttcgccgaagagcgccatcgcacccattgccttggcttcctcgagtgaggtttccacggtgttgacagcccagtcggtgtccacggcttcgttggtgatcgcctggatttgctcgacttgtgctggggtgagctgctcggtgtagttgaagtcgaagcgcaggtagcctggcttgttcatggatcctgcctggagggcagttggtccaagaacctgccgcagagcggcatgaatcaggtgggttgcggtgtgtgcctggcgtgcagcatggcgccattgcttatcgacgcttgccaccacttcatcacctaccgcaagtccaccgtttgccacgagtgccttgtgaacccacagtttcttaccgatcttctgcacgtcatggacatcaagcacggtgtctccgagcaggatctgaccacgatcgccgagctgtccacctgattctgcgtacagaggtgactggtcgaggatgacctcaacttcttgaccttctgtggcttcagaaatcttggcaccatcggaaagtagtccgaggaccttggactgggaatccagttcctcaaagccggtgaatacggttgggttgttgtcgacccattcgcggtagatgctcaagtcggtgtggccgtgcttctttgcctggctgtcagcctttgcacgggagcgctgctctgccatgagggaatcaaagccttcaacgtcaacctcaaggcctgcttctgcagccatttcgagggtgaggtcgatggggaaaccgtaggtgtcgtgcagtgcgaatgcctgagcaccggcaaccttggtggatcctgcagccttgatggaggttgcagcctcttcgaagaggtgggttccagagaccagagtcttcaagaaagcgcgctcttcggtgacagccacacgcatgatgcgctcacggttgtcggcgatttctgggtaggacggggtcatggtgtccatgatggtgttcatgaactgctccatggtctcaccagtagcaccgagcagacgtgcggaacggataatgcggcgaagcaggcggcgcaggatgtatccacggccttcgttgcctggggtaacaccatcgaggatgagcatcatgccggtacgagagtggtcggcgataacgcggaagcgaatgtcagaggtgttgtcagaaccatacttggttccggtcagggtctctgcaacgtcgatgactgggcgcagcaggtcggtttcgtagacgttttcaacatcctggaggatgcaggcaacgcgctcgacgcccatgccggtatcgatgttcttctttggaagatcgccaaggatgtcgaagttgtccttgccaataccctgtccgcgttccttctccatgaagaccaggttccagatctccatgtagcggttgtcgtcagcgacagggccgccttccttgccgtacttctcgccgcggtcgtagtagatctcggagcaagggccacaaggtcctggtacacccatggaccagtagttgtcagccatacccaggcgctggatgcgctctgatgggacgccgatcttcttttcccagatctctgcagcctcgtcatcatcgaggtacacagtgacccagaggcgctctggatcaaggccaaagcctccgtctgctacggaaccagtcagaaggccccatgcgtgggtaattgcgccttctttgaagtactggccgaaggagaagttacctgccatctggaagaaggtattgtggcgagtggtgatacccacttcttcgatatccagggtacgaacacacttctgaatggaagtcgcagtgccgttttcaaaaggtggggtctgctggcccaggaagtacggcttgaatggaaccatgcctgcgttaacgaacagcaggttagggtcgtcgagaatcagtgacgcgctaggtaccgcctggtgaccggcattgacgaagtgattggtaaaacgctccctgatctcatgggtctgcacagcggtatcctgccttagaacttctcgaaatgttttagcgcattcaaaaacacacgcctaaaaatggactggtggtaactttacccgtctccactaggtgttgagcaacccgggctacttggttccacggattatacgacgaagcctgccaatgtactcggcaatccgcttctctccaccgtgtgtggtgggctcgtaatagacccgatcgcgcaggttctccggtaaatattcttgccggaccactcccctgggatcatcgtgaggataggaatatcccactgcatttccgagctttttggcgccttcatagtgaccatcgcgaagatgcgcaggaacggtaccgatgtggccttgctgaacatcagtcaaagcagcatccatggccatgatgacagcattggatttgggagcaagagccaaatgaatggtcgcttgcgccaaattgatccgcgcctctggcataccgattaattggacagcttgagctgcagcaatggccacttgcatggccgaaggatcagccataccgatgtcttcacttgagtgaaccaccaaccggcgggcaataaaccgtgggtcttcaccggcatcaatcatgcgcgccaagtagtgcaaggctgcgtctacatcggagcctctaattgatttgatccaggcactgaccacgtcatagtgctgatcgccatcgcggtcatagcggaccactgcgcggttcacgttggccatgacggtgtcaatatctaaaacgccgccatcttctacggcttctgcagcggcttcaatgtaggtcaggcctcggcgggcatcgccaccggcaagaagaaccaactggtcaactgcttcatcggtggcggtgattcgaccggcaagtccacgctcatcttcaagcgctttattaaggactgttttaatatcctcatcgcttaaagattccaactggagcagcaaggacctggacagcagtggagacaccactgaaaaggaggggttctcagtggtcgctgcaacgagcaacacggtgcggttttccactgcagagagcaacgcgtcctgctgagttttggaaaacctatgaacctcatcaataaacagcacggtgcgctgccctaattgcagatccatcctcgcacgttcaataacggcgcggacttctttcacacctgaggacagcgccgacatcgccacaaagcgatcgcctgcagctgcagaaatcaatgaggcaatggttgtttttccagtgccgggaggcccatacaaaatgacggaggcatcccctgaaccttcaatgagccggcgaagtggcctgccctcccccagcaaatgctgttggccaaccacttcatcaagcgtccttggcctcatgcgggcagcaaggggtgcgtgtccgcctgggtgaaaatacttcgaggcggctttggaattgctcacgctgcttgtgttgcctgcggatcccggtgtttcgggcgtttcaaaaagtgaatcctgggccatagtgcacaggttagtcgcttggctgaaacaaccaagcaaccggtgctcttcagctagtcatttttgaggaacaaacgcaccacgtcgtctgcgaatcgtgccacctcagggaacctggaatccagcccgcgcgctgcaaatcgctgaagcgcggagaacgtgtcgtggaggtcttgctggaccagctcgtcatcttcggcagatcgtggaatcaacagttcatcaaggttggagacatccaaagtggtgtttccatcttcggtgacgtgcagcaggttaagcatgccgctgatggagccgagcttcatgaaggcaacactcgatagtgcccagccgatgagagcggtcacgatacgtgcttggaggcgctcttcattgttcacattgggccagattccacggacttcttggacccaggattcaatgagttcgtctacctcatcatcagagatggggcggctgaacacgaattgcgggaaacctgcgatcacacaagcaacatcaaaggtggcatccctgaaaccggcaacttcgtagtccaggaagtgggtgcgttcagccacgatgatgttgtcgggtgacaagtcaaaaggtgtgaaggcacggtggcgtccggaaatcaggcgtcgccgagctacgcgggcaaactcctcgacgacttctggaacggtgaccccggcgtcgacaagtatctttttacccacctcaattgctgcgggcagcaacctatcgcggtttttctgcatctcagctgtggctgggtatttggccagcatacggttgagcagaatgttgaagtcttcttcgcggtctgcggtggcggcgtgcaggctgcccagcgattggccgaggttgcgcaggatctgcatgcgctgatcaccggtacgctgatcgatcagatccgcaaaggtgtcgccgttgccggaatctgaaatgaccaggatgcgcttgtcaatgtcataggccaaaatgactggccctgggcggacatcttccgacaaggaggtggtgaactggtaggagacgatttcacgcaccagcgcagaatcatcaaagacgtctccggtgctgggcacgtacttcagcaccacggagcgctgttggaggaatggggagttagccaccctggcacgcagcaccgcggaggtgccggaaccgttgagctgctccacgtcagaaagagtttgtacaccgccgtagcgtttagacagcaaatcttctgcgatcgcaacaatttcttcgtggctcagcatgggcattctccttaatacatccgccaacaggcactgaacaggtcccctagctttacctgttcaaaaaacttccgattaacaatcaatgaatttgatcggcgcggaagcgcatatttcctcattctatggtacagagcaccatagaaaatgggggtgagttagataacatcacccccatttcattcttaattacttttcagcagactcttcagcctgtgcctctgcctgtgcttccgccttaggctttggcttggcatcgatgccagcttccttacgctgctgcggggtgattgctgcaggagcatcagtcagtgggtcgattccgccaccggacttagggaacgcgatgacgtcgcggatggagtcaaagccgcccagcagggacacgatgcggtcccagccgaatgcgattccgccgtgtggaggtgcgccgaatgcgaaggcgtcaagcaggaagccgaacttctcgcgtgcttcttcaccggtgatgcccataacctcgaaaacgcgttcctgaacgtcgcgctggtggatacggatggaaccgccaccgatttcattgccgttgcacacgatgtcgtatgcataagcaagtgcgtcacctgggttggtgtcaaagttgtccaggaactctggcttaggtgaggtgaaggcgtggtggactgcggtccacttggagttacccagtgcaacgtcaccggatgcggtggcgtctgctgctggctcgaacattggagcgtcaacgatccaggtgaatgcccagtcgccttccttgatcaggtcgagcttcttagcgatctcgccacgagctgcaccgagcagtgcgagggaagacttggtgtctcctgctgcgaagaagatgcagtcgcctggctgtgcgccaacgtgagctgcgattcctgcgcgctcagcgtcggtgatgttcttagccacaggtccggacagctcgccgtcttcaccaacgaggatgtaagcaagtcccttagcaccgcgctgcttggcccattcctgccatgcgtcgagctgacggcgaggctgggaagcaccaccggtcatgacaactgcgccgacatattcgttcttgaacacacggaatgtggtgtcctggaagaactcggtgcactcggtgatttcgatgtcgaagcgcaggtctggcttgtcggagccgtagcgacgcattgcatcggcgtaggtcatgcgtgggattggagtcttgatctcatatccgatcaacttccacacctcagagatgatctcctcgcccagtgcgatgacatcatcctggtccacgaaggacatttcaacgtccagctgggtgaactctggctgacggtctgcacggaaatcctcatcgcggtagcaacgagcgatctggtagtagcgctccatgccagcaacctgcagcagctgcttgaacagctgtggggactgtggcaatgcgtagaaagtgcctgggcgcagacgagctggcaccaggaagtcacgtgcgccttctggggtggaacgagtcaaggttggggtctcgatctcggtgaaatcgtggctgtccagcacggtgcgtgcagccttgttggcagcagaacgcagacgcagggcgttcgcctgaactgggcgacgcaggtccaggtagcggtacttcagacgggtctcttcgccgacttcaccagcagaggaggaatcctcgatctggaaaggaagtggagcggactcgttgagtacctcaaattcggtgacgctgacttcaatgtcgccggatgcaaggttagggttttgagagccttctgggcgctcttcgacgacgccggtgacgcgtaggacgaattcgctgcgcagtgcgtgtgcacgctcagcaacgtcctcattgcggaaaacaacctgggcaatgccagtacggtcgcgaagatcgatgaagatcacgccaccgtggtcacggcgacgattgacccagccggtcagagtaactgactggcctgcgttttctttacgaagctcgcctgagagatgagtgcgcagcacgttggtggaagtccttccgcttggttttgatcagtcgatggtttctggagccttaaacaataagctcaaccgcccaaaaagggcgggcatgcagcccagaaacaggcaacacacgcattgtacccgccatctggtttgccttgaaccttgagtggtttattaggtgcagtcagttttcgattgcatccattttgttacacccaaacctgtcggtttccctatgtaatgtgccatgatttctttcatgacctttcgtgatgatgtaactcgatcaggtggaaatgcccgcaaaagtggcggcggtggccgagggatggccgttggtggcggcatcggtggcctgctactagtcgggctcttcttgctccttggcggtaaccctgccgagatcgaccaggttttaggtggcgatcaaacccagatcgagtctggagagtccaccggagccggcgactttgatcactgccaaaccggcgcagatgccaacgccagtgatgattgtcgcctttactacacctcattctccgtcaatgaaatgtggcagactttgcttccagctcaggctggtatcgaatacaccgagccgacattgactcttttcaaaaactccacccaaaccggctgcggtttcgcttctgcgtccactgggccgttttactgtccgtcagaccaagatgcttattttgacttgactttcttcgatcagatgcgtcagttcggtgcagaaaacgccccgcttgcccagatgtacatcgtggcgcacgagtacggccaccacgtccaaaacctcgagggcacactcggactgtccaattacaacgatccgggcgctgattccaacgccgtcaagatcgagttgcaggccgattgctacgcaggcatttgggctaatcactccagcgaaggcccggatccgctactccaacccatcaccgaatctgagctagattccgctctccttgctgcaagcgccgtgggcgacgacaatatccagcaacgatccggtggcgatgtcaatcctgaaagctggactcacggctcatcgcagcagcgcaaagacgcgttcctcgccggctacaacaccggccagatgagcgcctgcgacttcctcggccggggcgtctacaacgacgcttaaagcattgcttttcgacgtctccccacaccgattaattccggccttaggcaactagcttaaggccgtttcttcatctttagggccagtggattcagtaagccctaaccgtgcacgctcctcatcaataacccgtgctgccagctgtgattcagtgatatccacagcatctggaatctctgcggtttcagatagccgggcgtagacgtcgaagacgtgagttttgcctgccaggatttctagcatgcgttcgtctgcggtttcgtcgccgatgagtcggtggacttggacggtggcggtttggcccatgcggtggactcgggcgacggcctgctgttcgatggttggctttacttgaggttcacaaataatgcataggctcgcggattggatgtttaggcctactcccccggcggtgatttgggcaatgagggcggatccgggtttggagtgggacagggcgtcgacaagcaattggcgcttggtggctggcacgtcgccggaaatgcggccgatgacgcgctcgcctagatgcttttccagttcgtcgaggacgtcgaggaagtaggtgaagatgagggctttgcggccgtgttcttctgcttcttcgaagagttctaggatgcgttgcatttttgcggaagttaggcgtggtgttggtgagagcatggcggagcggcgcatgcccatccagctgccttggcggacttggtcgtcgtaggcgctgcggtcttctggggtgaggtcgatccagtcgatggagtcggtgcgctctgggagttcgtcaagcacatcagcttgatttctgcgcagataggctggtgcgatgcgctcgcggaaattctcggcctgcattttggacatgccacgggtgatcagctccggttggatgtagcgcacgagatttacaaactcttccactttgttttctagtggtgtgccggtcatcagaagggtgtatggggcggcgtcgataagtttgcgcagtgcttgggtgcgtttggtggaggggtttttgatcaggtgggcttcatcggcaatgaccagacccggcgcggggatgtccatggtgcggacgccgtcgtaggtgcagattgcgattccgttggtgttagaccaggcgttgatggcgtcttgtttgttgtctccgtgggcgatgaatacggggaggttgaggaagcgtttgcattcgcgggtccagttaacaatgacggatgcgggtacgacgacgagggtgcggaagtctttttcggtggcggcaaggtgtgcagctgcggagagggcttggactgttttgccgagtcccatgtcgtcgccgaggagggttttcttttggatgatggcgaagcgggcgccgaatgattggtatccgcggaggtggaggtcggtgagatgagttttgtcgagggtgaggtctctgattttttggagggtggtggcgtcgaggagttcgtctgcgccttcgatgtcgcggccgagcagcgtggctagcaggccttggtagtgagcgggacgggagatgtagtcgtcccagatgtcggcgggtggggtggtgattgtttgtgggtggaagaggttggggtttgcgtcgatccagcggaggtcgtcggtgaagttgttgaactcaggcgttgctgggttgatgacgatgtaggggtcgaggcttgggggtatgtgttctacgtagtcgatgacgcgggtgcggcgggcgcgttcttcgggcgtgatggtttcggtttggtcgaagcgggccagcacgttgattagacgcatggcgggttgggtaggttcgtcgccgatggaggtgttttggcggcgtagtgcttcttgtttgagtgtttctgctgcggctttcatccgccccgcggtttgggcgccgataccttgcacggtggtgaggatggaggtgtgtgtttttaggacgtcggcgacggttgcgacgtggatggaatcgagggatccaaagcgcaggcggtggtcggtagccatgcgtagggcatcaacggggagttgttcgaggagtatctgtacgcggagctcgttgatggatgtgaggtgtttctcggcttcgcttttcagccggtattcggagttaggatcttgggcgtagcgttggactacccggcgcgcttgggcaagggtatgtccgtcccagggttcggcaccgaatccagcgataccgagggctgaggcgagtacctgttgtgcgcgttcgatgtagcgctctcccactccatgaatacctgggaaaagtgcaacgccttgttgttggcgggtgcgggcagcgtggacgccctcgagcatgcgggagacttcgtgggtggtagatgaaatctcgtcgagtttgaccatgaggtcgaagacagcttggtcgccggcttggaccttggtggggttgaatagtctgcggaacatgccgccttggccctcgttgatgatctggcataggcgtgggatcgaagcgactgatgcgacgtaatcggtaagggtggcttctgcattcatgccgtctagaaagacgttgacatacaggttgtcaggccaggtgatgttgcgggatgggatcagataggtatcggtgccgagtgtcccgttgtcccctactgtggccgttccgggtgttttcaacagtcggagcacgttgtttgcttgttcggcaaggttgattgtgtgctgtgctctatctagcagtgcagagatttgtgcccggtccatagcgtttgattctgccattaacgctattgaaccgggcgggaaaagcttttagaccttcagttctgggtggtagtccttcatgcgaagaaccttgtttgttctattcgccagggtggagatggcgagcatcagtgcccagatgaagagcagtacccagattgcttgtatgaagcgtgggtcgttggatggggtttcgttgaagatcatttggcgcacgaggttgactgcgtaggtgatcgggtcgtaggtgtggaaccagtggaagaatgctggctgggtttctggtgggtataggccaccggaggagactagctggaaggacatcatcacgatggacagcacacggcctgcggagggtcctgccacgttgttgaacatatgggtaatggagatgaatacccatgagatggcgaccatcgccatccacagtccagctgggtgagctggattgaggtcgagcaggaagtacagtactgcccacatgatggttgcttggccaaggcctaagactgttgatggaaggtagcttgccagggtgcctcggaagcctcccatgcgggagtcgagtgcgcggcgactgattgggtgcaggatcatccaggcaacggttgctcccatgaacaggccgacagccatgaagaatggtgcgagaccaataccgaagagcggtgtggtgtctcctgcttgttctgtttcaactggggttgcgatggtggtgtctgcgccgtcagcgaaggttggtacttggcttgcgccgtcggtgagtttgagggcgagttcgctggagccttcatcaagctggacggtgccgtcgcgcagtgcttgtgcgccaacaactagctgttcggaacctgcggccaattggctggtgccatcagcgagggtgcgtgcaccgatgctgagttggctggatccgtctttcagggtttgcaggccggctgctagttgctgggatgcgctcacagcggagtccacgccggagcggtaggtgctggagggatcagatagttcagaggcaatggtggctgcgccgtcgcgcagggtgatcaactgagagttgatgtctggaacataggcggtcagtggtgctacttggtcgacaagttggcccacgccatctgaaacctgggttgcgccttggcctagttgggcggtgcccgcagacaggctggatagaccgtcggcgagcgtttggctgcctgtagccgcggagccgaggccggtgtcgagctggctggcgccgtcggcaagcgattgcgcaccctcattggcacttgcgatgccgtcgcgcagggtgaccgcgccgtcggcaagctgaactgcaccgtcgttggcggaaccgacgccatcgctgagcgtagtggcaccttcggcggcttggttcatgccgtcgcccaaggtggagaaaccgacgagcatgttatccacaatgcggacgccgaattccgtgtccatggtctccacaacagtgttgaccacctggttgcccagcatggaggcaatgaagccgttgctgttgttgaataccgcgttgacggttgctggcgcgggtgaatcgctggtcacgctggcaatagaatcgctgaagttcttcggaatttcaatgccgaagtagtaggtgccgtcgttgattccctcgcgggcttcctcggcgctgacttcaatgaatttgatgtcgtcttgctccaggaggttctccaccacctgggcgccggcatcgagttcaccttcgtcctgattgaccacggccacgggaagcttggacaagccaccgatggggtcatagtaggcagaaacaaagacgccgccgaaaagcaacggcagcaacatgaccacaacaaaccccaatggtgggagttttccgcggccaaatcgtttcagttctgagccaaagtgtaaaaatgccattagtttccagcccccgtaatggtcaaagcggtatcggccaaggaatcaaaatctgggttggtggataccacgaccacagggagatcctctgcaacgcctttcaatgcgtgcaacacctccgcacgcaattccatgctgcgcacttgatcgggatcatccacgaccaacagttgcgcctctggccgcgccagcagcgccagcgcgatgcgcagcttaaaacgctcgagcacgctgaggtcgccgattaaggttttagggttcaggttcaggccaagatgcttttcgacgtcaacccaccgtcccgaatcactaatatccctgggcaccatcaggtaccaagggcttgaccaagcgagttgttcacggacaacggtgcgcacagtgacaagtcgctcgagtgaatcgatttcagggatgcccgccaaagccacatgcttggccagcttggttgccttgatgggttcgccgtttaattcgatggttccggtggaggcgcgcatgcggccggaaagtaccaaagaaaaggaactggattgggattcgcgcccggtgctcagcaaagtgagtccgctgtctggagctatctcaacatcggcgaagggtgtgtcgcggatggagagcccagagcttctcaaaagaggggtattcatgtatcttcttccgtaagtggaggaaacactatcagttatcgtaggctattttaggaccaccaccacccccgctgtcaactagaggacaacaacatgagagcagacgcactaaaacgccgcgaacacatcataaccacaacctgcaatctctaccgcacacaccatcacgattcgctcaccatggaaaacattgcagaacaggcaggagtgggtgttgcaactttataccgaaacttccccgatcgcttcacactggacatggcatgcgcccaataccttttcaacgtggtgatctccctccaactccaagccatcagcaccttccccaccgacccagaaggcgtgtggacctccttcaaccaactacttttcgaccgcggcctaggctccctcgtcccagcacttgccccagaatccttagacgacctccccgacgaggtctccgccctgcgtcgcaccacagagaaaaacaccacaacactcatcaacctagccaagcagcacggactcgtacaccacgacatcgcgccgggcacctacatcgtcggtttgatcaccatttcccgcccacctatcaccgcgctggcgacaatttcagaaaactcccacaaagcactgcttggcctttatttgtccggtcttaaacacggcatgatggctaacatcggagaacatgacggaaagtcctgatctagcagtttcctttttagccgccttcaatgacatcgaagcgcaccttcgaacccagctccgcgctaaacgctccgacagtttcagatggatggtacgtatcgccgagaaacagcatctgatttccaaagaacaagcagaaacccttgatgcttttgcggagctgcgcaacgcaattagccacggccaatacaacgatctacgcccgattgccgatccccgccccgacaccgtggacaccattgagaagattcgctccctccttctcaatcctccaattgcgttaaacgtcctcccggagcaaaaggtccgctcctactcacttgaagatccagtgagtagggccttagaagttgtgcacaccacggagatctcccaattccccatatataagggaacggaatacgtggcactgctaactaccaacacaatcgctcgctgggttgcctccgatttacatgacaatgcccagctggatgcacgttctatcaaagaggttctggattatgcagaatcctctgacactgcagttttcttgccccgcacctcaactgctcaagaaattatcgacatcatgaccggccctaaactcccctggtccgtcatcctgaccgagcacggtaaaccccaccaaaagcccctgcgtgttgtcactggtcgagacatgcgaacactgatggacatgctcaaaatctattagtcatacctatttagaatttttgttgacgcatccattaaaaactgctagtttggtgacatatcaacaaacttagttggaaggacacattaccatgcaattcggcatcttcaccattggcgacgtcaccgtagaccccaccaccggcaaagcccccaccgaaggcgaacgcatccacgcgatgacccaaatcgcactcaaggctgaagaagtaggcctcgatgtctttgccaccggcgagcaccacaacccaccatttgtaccctcctccccaaccacacacttagcctatattgcagcgaaaaccgagaagctcctgctctctacctctaccacgctgatcaccaccaacgacccggtaaaaatcgccgaagattacaccttcctccagcacctctccggcggccgtgttgaccttatgatgggccgtggcaacaccggacccgtttacccatggtttggcaaagacatccaccaaggcatcccactagcgattgaaaactaccacctcctgcgccgcctctggcgcgaagacgtagtcaactggcagggcaaattccgcacaccgttgcagggatacacctctaccccagcaccattagacggcgttgcaccattcgtctggcacggctccatccgctccaccgaaatcgcagagcaagcagccttctatggcgacggcttcttccacaacaacatcttctggaacaaagagcacaccgcccaaatggtcaacctctaccgccagcgtttcgaacactacggacacggccaagcagaccaggccatcgtgggactcggtggccaagtcttcatcggcgattctgaagaagaagcaaagaagaccttccgcccctacttcgacaacgcccctgtctacggacacggaccatcacttgaagatttctcccgcctgaccccactaaccgtcggtaccgctgagcaagttatcgaacgcaccatggaattcgccgactgggtaggcgattaccagcgccagctcttcctcatcgaccacgccggcctgccactagaaatggtccttgatcagatcgaacgcctcggccacgatgtcgtcccagaggtacgccgccgcatggaggagcgtcgcccagaccacgttccctccaacccaccaacccaccagagcctgaaggccaaccgaaacagccctcacttccagatcaaccctggtcagccaactgagtagtttttctgaaactaaggagacacattatgcgaaagctcactgttgttaccgcaggcctttctaacccgtccaccactcgctccgtggcggatcaactcaccaaggcagtccaaaccgctgtttctgctcgtggcgaatcctggatattgaagtaattgaaatccgagacctgatctttgatctcgctacctcattcacaagcgccggcatgagctccccagcacttgacgctgcaaaacagcgccttgctgaatccgatggcctgatcgctgttaccccagtatttaccgcgagctactccggcatcttcaagatgttctttgatgtcctggaccccaagaccattgtgggtctgcccaccatcattgcggcatctgctggaacggcacgccactcattggttctcgaccacgccatccgaccactgtttacctacttgcgagcagttgtcgtacccaccggcgtgttcgcagccacggaagatttcggcactgaagctggcgcagacattgaacgtcgcgtgaaccgcgcagctggcgaattagcgacactcatgttgcaggattactccagtgtgcaaggccttgggggcgcaaccgcgaaccaagacgctgacctttccttccgtcgcaccactggcgtgaccccgggagagaacttcagcagctttgccgatcttctcaaaggacacgacggaaacggctaaattcgcggatctccgtttaaggcattgaagcatttggaggccccaagacatgacccagaccctgtaaagcgcttaaacggcgttttagagggtcatagttttgggacaagtgggacaagtgtgaatcctgaaagcttccagggcaaggatccaccacaaaccggccatcgccctttggaatcggtccgaaaattgcaggtacagagccttttaccgagaaaatccaccacagattgctgaaatttcgtgatctgtggtggattcgtgcaacttcagactcttacggaggcgatggaccaaaaacaactacaatcaagcagatcaccttgtacaccaccatagaaaaggcccaccctcagccatggctatcagtgttgttgatctatttagcatcggtatcggaccatcatcctcacataccgtcggccccatgagagccgccctcacgtatatctctgaatttcccagctcgcatgtcgatatcacgttgcacggatcccttgccgccaccggtaaaggccactgcactgaccgggcggtattactgggtctggtgggatgggaaccaacgatagttcccattgatgctgcaccctcacccggcgcgccgattcctgcgaaaggttctgtgaacgggccaaagggaacggtgtcgtattccctgacgtttgatcctcatcctcttccagaacaccccaatgccgttacctttaaaggatcaaccacaaggacttatttgtcggtgggtggtgggttcattatgacgttggaggatttccggaagctggacgatatcggatcaggtgtgtcaaccattcatccagaggcagaggtgccttgtccttttcagaagagttcccaattactcgcatatggtcgcgattttgcggaggtcatgaaggataatgagcgcttaatccacggggatcttggcacagtggatgcccatttggatcgagtgtggcagattatgcaggagtgcgtggcacaaggcatcgcaacgccggggattttaccgggtgggttgaatgtgcaacgtcgggcgccgcaggtacacgcgctgattagcaacggggatacgtgtgagctgggtgctgatcttgatgctgtggagtgggtgaatctgtacgccttggcggtgaatgaagaaaacgccgctggtggtcgtgtggttactgctccgactaatggtgctgcggggattattccggcggtgatgcactatgcgcgggattttttgacaggttttggggcggagcaggcgcggacgtttttgtataccgcgggtgcggtgggcatcatcattaaggaaaatgcctcgatctctggcgcggaggtggggtgtcagggtgaggttggttcagcgtccgcgatggcggctgccgggttgtgtgcagtcttaggtggttctccgcaacaggtggaaaacgccgcggagattgcgttggagcacaatttgggattgacgtgcgatccggtgggcgggttagtgcagattccgtgtattgaacgcaacgctattgctgccatgaagtccatcaatgcggcaaggcttgcccggattggtgatggcaacaatcgcgtgagtttggatgatgtggtggtcacgatggctgccaccggccgggacatgctgaccaaatataaggaaacgtcccttggtggtttggcaaccaccttgggcttcccggtgtcgatgacggagtgttagcggtacggctttaacacggcttggattttgtcttgcttggcgaggtaggactggcactgggcgtcgataagctcagctgaccacccggtgacctgcgccattgcttcggccgtcgcacgcacggcagccggttgcacataacccagcgtgccgagcacgatgcgacgatccagcacgtccgccaggtcgacggccgcctcctcggcgacagcaaaaacggcctgcgccgcgatatcaaggttgtctgggtcaagtcggcgccccaggtcgggttgctttgcgacgagatccagcactttttcatgctcagttccatacagtctggccagatgcacgcggatttcatcatccacatccagctcggggtggctgcgaagcgctgactcaaaggaatcagccacggactcatacgcgccaaaagaagtactcaacggcatctgcctggagtcaaagtggcgcagcggaggtaacaccgcagcttggtgctccaccacatgctcaatcaccttgtaccccatcacgcgcgaagtggtccacttgccgccagagacagacaccaaaccatcaatgccgacgttggcgtgatcggaaatatcgaaacggcgagaggacgtgtaggtgtcggtgccgtcatcaacaagcgggcgcacacccaccagcgtggagatgatctctttgcgatcaagcggtgtagcgcgtaccgaatcgatggtctcaagcagcaaatcgatatcgctttcatctgcagccgcatcatcagcgtcaccgtcaatcatggtgtcggttggaccaataagggtgcgccccatccacggattcacgatcacatgcttgccgtttttgccacgcacaaacacgccactctggctgcccaaatcaccagtgagcaaatgcactcccttggattggcgcaccttcaacttggttacctccgccaaatcacccaacgcctgcgcaacccacggacccgcagcgttgatcaccacaggggcattcacctcatgcgtggtgttggtgacctgatcagtcacttctacacccttgacgcggccttcttccacgttccggagaatgcgagtgactttggcgtggttgatcgccgttccgccatctgccgcaaaagctttaatcaccgcgaggaggagtcgttctgcatggagattcaacgtatcatcgtggcgccacgctcccttcaagccctccgggtcaagccacgggacttccttgagcagtgcatttttaggaatccaccggaaacgcggcgagtggttttccttcgattgcccctggttacgctgccacgccatcgtttcatacaacgccacaccagcacccaacataggggctttcggctctgaccaatcaaacgccgtgagcatgaaactgcgtggagccaccaaatgcggagcggcgatacctaggtaccggcgttccttcacggcttcctggaccacgccgaaatcgtactgctccaaatagcgcaaaccaccatgaatcatcttggaggttgtcgatgatgttccagaagaataatctctggcctcaaacatcacagtgcgtaaaccgcggccttgagcatgtcgcgcaatctgtacacctgagataccaccgccaatcacaatgacgtcataattatcgcgaagcggagggccaatccggcgggattcaaagtgtgcgctcgtcataaaagtgagcctaataggaaaaccgccaacccacatcgtgaattgacggttttttacttatgaattatttaaataagtttcccctgcaaaaaggccacaacctcgtccaatgcgacatcgtgctgctcatgcgcacgcatatccttcaccgcgatggtgttgttctccagctcctgctcgcccagcaccaaggtgtacaacgcgttggagcggtcagcgcccttcatggcacccttcaggccacggtcgccgtaagacatatcggtggaaatacccgcagcgcgcagcgtgttcacgattccagcaagagccttcttagcatccttgcccagtggaacgccgtacacatcaacgcgacgctcagcaccaacagtcacaccttcagcttccagagccaacatggtgcgatccacacccaggccatagccgatgccagacagatcctgtccgccaagctgtgccatcagaccgtcgtagcgtccgccgccaccaatgccagactgtgcgcccaggccatcgtgaacgaactcaaaacaagtcttggtgtagtaatccaaaccacgaaccatgcgtgggttaatcacatatggaacacccatgtcatcgagcaaaccagtcactgtttcaaagtgctcacggcactctgcatcaaggtgatccagcatcaatggtgcatccgcagtcatctcttggacttcaggacgcttatcatccaacacccgaagtgggttgatctctgcgcgcttgcgggtttcctcatccaaaggaagtgcaaacaagaaatcctgcagcttctgacgatactcgggacggcagtgacgatcacccaagctggtgagctccagacggaaatcctgcagccccaagctgcggtaagaacgatcagcaagcgcaatgatctccgcatcaagcgctggatcatccacaccaattgcctctacgcctacttgctgaagctgacggtaacgccctgcctgaggacgctcataacggaagaatggtccggcgtagttcagctttacgggaagctgtccacggtccaggctgtgttcaataactgcacgcatcacgcctgcagtgccttctgggcgcagcgtgacagagcgctcgccacgatcagcgaaggtgtacatttccttgctcactacgtcagtggactcaccaacaccacgcgcaaacaagccggtgtcttcaaagatcggcagctcaatatgctcaaacccggccttatgtgcttgattaacaaaggcatcacggactgctaaaaacgctgcagattttggtggggcgtaatcaggaacacccttgggtgcagcaaatgactgaagcttttcagacttggacttgttttgactcacgattattaacgatacctattcgaagaagtagtacggaacttagccctacagtgccagcaagaaagggttaccagtgcgttctgcacgcatggtggtggttgggccatgcccaggaagaatctgcaatgcatcatcaagtgggagcactgccgtgcgtagtgactcattcatggcatctgcatcagaccactcaaaatcagtgcgaccaatagagcccttgaacaacacatcaccgctaaagcagtattccttgccgacgatcagcgtacaaccaggtgaatgccctggtgcatgcttcaacgtgaattcttcgccagccaaagtgattgtctcaccatcaaccagatcacgcagtgactcaggatcaggggacaccatgttgtcggcgtcgaaaagcatggccgtctttgttccagatcccttgtagacctcaaggaaaaacgcatcatcaggatggatatagaccggcgcattgaaacgctttgccacaacaccagcatcacgggtgtgatcaatgtgtccgtgggtgagcacaatcttgtccacgctcaaattattcgtggtgatgtattccaccaaatcatcgtgggcatgcatgccaggatcaatgatcgcgacctcattctccccgcgcaccacatagcaatttgttttatacggaccagccgcgaatccgaggatctccatgaataaacagtgtagtgcgtaagcggcgctcccccatcattccctcaaggtgtgaagatacggttaggatagaaaagaatttttttgacgttggacattctcaaaatcaagtagcaagggatcaaactctgtgagtactaataaggaacgacgccaacaggcgctttcccagctggagaaagaaatcaaaagccgggaccgcaaagaaaagaccaagccactaaccgtggtctttgcttccctggctgtcatcctggttgtcgttggcggtatctggtacgcagctacccgcagcaccgaagacgaagtcatcaccgctgatgaaacatccaccaccgcagagacccctgactaccagccactggcgctgacccgcaccaccgcgctcggcgactccgtgacctgtgagtacccagatgctggcgaggcttccaaggatgtctccaagcctgctactgaaaacgtgccagcaaccggcaccgtgaccgtcaacctgaccaccgcccagggcaacatcggcatggaacttgatcgctccgtatccccttgtaccgtcaacgctgttgagcacatggcttccgagggctactacaacgatactgtctgccaccgcatcaccacctctggcatttacgttctccagtgcggcgatccaagcagcaccggcgcaggcggcccagggttcagcttcgccaacgaatacccaaccgacgaagcaactgacctaaccaccccagtcatctacgagcgcggcaccatcgccatggccaacgctggcgctgacaccaacggctcccagttcttcctcaactacgaggattccccactggcaccgaactacacctacttcggccagatcaccgaagaaggccttgcaaccctcgacgccatcgcagaagttggcactgaaggtggaaccggcgacggagcaccagcgcaagaggttcgcattgaatccgcagctgttgcgtaagttctaagcccctcttctttcaacaccgtgtttcttggccagctgccaagaggcacggtgtttttgctgtctttgactactatttctgctgctggatcacagattgcttttactggatgcctcttctggatgcatcgcagggcagttcactgggcatttccaggccagatccccaatcgtttacatcctgttaaatccatgttaaccggacttttatctttgttttcatccgtttttacccctaaacactctcaggtttctcagtgaaaattgagaattggtgtcgtatgacgctccatttgcgcaggcaataggtagtaaatggttagatacttttaaaaaggagcctgccaccccaaataggggtaaaggactggcatgtaatttacaggcgcctgcaaggaatagtcccaagaagtcgaaaactagtcacattagtcacaaaaatcacttaaataacatcttgcttgagttttcatcacaaaaggcttgcacgactataaagccccggttaaggtgatcagagaaattcaacctctctgaaatgaaggatccaggaaatgaagcttttctcccgcacctcactggttgcacttggtaccgctgcagctatcactctctccggcgtaaccgctcctgcattcgctgatgaggactccaacgcagctgtaagtgctcttaagaccgctgaagataatacccctgaggcgccaggggcttctactcccctgaagcttgagcagcctggcaccatcaccggcgtccctggcaaggcgatcaccccggtcactgttaaggtcgtcgcaggcgaagcagaatccttcacctcagacaaccttccttctggtctccttatcgacaacaccggaaagatcaccggtactccaaagaaggaattcactggttccgcaaagatcattgccaagaacgaagcaggcgttgaagcagaagtttacgttaactttgatttcaacgaagagccttccagcgaagagccttccagcggttcttccgacactgacaacatcgaaaactggatcaagatcatcacagcagtcatcggtgcactaaccaccattttaaccttcagtaccaagctggattccttcctgaagtaatttccgccttacgcgactaatcctttgtgaatcaccattcacaaaggattttttgacgatatgggctgcgctcagctcgaatcgctttgcacttttcttagcaaaatatcagctttgacctgcacatatagttgcacaatggtgaaagtgcacataaagtaactttcgtattcgaatatttaaacctaaggggtttagcaatgaagctattttctcgtactcccctcgtcgcactcggcacagctgctgcaatggcagcaacctccatctccgttcctgcacaggctgaagaagtcgcaccagcacaggttgtgtacgtggctgacaccgtagaagaagaaacgggtagctccaacggatcttctgacattgactctgacaccattttggattacgtcgtcgttattactggcatcgttggcgtcctcagcgctggtttgaccttcgctactgctttccagcgttcattgcagtaaatttcagcgttaatcaccaaagccttgggcttcaaccacacggtggttgaagcccaaggctttttcacaatctaaaggcctctagccacccgaggtcactcggtagacatcaaacactccttcggcattgcgcagctgtgtcatcagggatcccaactgcttggtgtcagagaccgcaaaggtgaagcgcacggtggctacgcggtcttctgagcaatgggagttcattgcggtaacggagaccttttgttcgttgattacgcgggtgagctcaaagagcaggcctgcgcgatcaagtgcttcaagctgcagtgtggcagagaatactgaaccttgaccttccgaagcccaggagacggagacaatgcgttctggctcttctttgagcttttccacattcgtgcagtctgttcggtgtacggagacaccgccaccacgggtgacgaatccaaagatttcatctcctggcactggcatacagcatttagcgagcttagccatgacatctgggctgccttcgaccaggatgccggtgctgctttccgtggtggcacgggagttgaccagctcgctgaatggggtgcgtgcaaccaatgcgtcttcggcatcttcttcgtcaccaaagatagccatgagacggttgactacgtgttgcgcagatacagaaccggagccgatggctgtgtagagcgcatctacatctgggtagtgcagctctgttgccaccgtcttcatggaggacgcggtgaacaagcggtgcattggcaggccgccacgctgaataactgctgccagcgcatcgcgtccggcttctaggtattcttcgcgtcgttccttggcaaaccactggcgaatcttggcctttgcacgaggtgagacaacaaattcttgccatcccctacttgggccagcgttttggtccttggaggtaaagacttcaacacgatcgccggatttgagtttcgtttccaaagcgaccagtttgccgttgattttggcgccgatgcagcggtgccccacttcggtgtgcaccgcgtaggcgaagtccaccggggtggagttcaccggcaggttgaccacatcacctttgggtgtgaacacgaagatctgcttggaagtcagatcgtagcgcaggctgtccaggaactcgttggggtcggctgcttctttttgccagtccagaagttggcgcatccacgccatttgatccacttcggcttgctcgccactgtggctgcctttggtttctttgtatcgccagtgcgctgcaatgccgaattcggcgttgtagtgcatgtcgtgggtacgtgcctgaacttccagaggcttaccgccaggtcccatcacggtggtgtgcagggattggtagacaccgaagcgcggggctgaaatatagtctttgaatcggccaggcagagcattgaacagggagtgcacgacaccgatggcggcgtaacagttgttcacgttgtctaccaggatgcggatgccaacaagatcaaaaatatcgtcaaaatcacgaccgcgaacgatcatcttttgatagatagaccagtagtgctttggtcgaccaagcacttctgccgcgatgttgttttcgcgcaagccaccggtgacttgatcaataatttctttgaggtaccggtctctagagggcgcgcggtcggcaacaagacgcacgatctcttcgtacttcttggggtacaaaatggcaaaggatagatcttccaattcccatttcacgctggccatgcccaggcggtgtgccaaaggagcaatcacttcaagggtttggcgtgcttttttagcttgcttttccggcggcaggaaccgcatggtgcgcatattgtgcaaacggtcggccactttaatcaccagcacgcgggggtcctggctcatggcgacgatcattttgcgaatcgtttcggcctccgcggcagcacctagtgcgactttgtcgagcttggtgacaccgtcgacaagcctggcaacttcttctccgaaatctcgggtgagatcgtccaaagagtagtcggtgtcttccaccgtgtcatgcaacaaggctgcgacgagcgtggtggtgtccatgccgatttccgcggcgatggtggcgacagccaacgggtgggtaatatacggatcgcccgattttcgaatcacaccatcatgaagacgttccgcggtgtcatatgcacgttccaacacttgtacgtcggcgcgtgggtgaaattgccggtggatgctcagcagcggatccagcacagggttggtgcgaacgcggtttcctgtgaggctgcgggcaagcctggctgacatgcttcgcacacccatggaagatttttgtgtgttgcgctccagactcattttcctgccgcctttctttcgatccttctactgaggatctctgaccacaatgacgggcctatcaccaagattatccctaccgccgaggcctgggacctcaatggcaagaacatatccggaaacatgtccgtcacacgattcaattagtttacgtgcagcgcccaaggtgccgccggttgccagcacatcgtcgatcaaaacgatgtttttaccagcaatgtcgattccttcactgggcagctcgagtgctgcagtgccgtattcaagttcatactcctgggtcaccacaggtggggggagctttcccttcttgcggatagccagcacacctaggccgagtttgtaagcgacagcagatccgaggaggaatcctcgcgcatccaagccaccgatgatttctgcattcagtttttctgcagcttcagccatggcgtccaccacggccacaaatgattctgcatcgcccaacaccggggtgaggtcttcaaaaagcacacccttttctgggaaatcctgcacatatcgggttttcttgtccagggcctcacgtgccctgtcgaaggtgcttagagcttgttcgctcactacttattcctcacttctggaccaacggtccatgttccatccgataccggctaggtctgtattaacaacaacgttaccgactgtgcgatctatcacaaacactcggggttgcgctgctagtggaattgatgggacttcagcccacaattgttcttcagtgcgcctcgtcgactccgcatcagttccaatggtattggcattttcatactcccgatgtggatccactgtacgcagaacagcgtcaagtgtcccttcgaagtactgctcatagccccattcactgacttcggttcgactgagatcattaagactaacagcctcctgcgacgcatcgataacggtgataccggcaggctcacaactttggcgaatcgcctccaccattgcagccttgcgctcatcgggtccgtcgtagccaatgcggatggattgacccgccaacgctgatgcggcattaatatccaccgccatgtgctgtgctggcagatcaccgatttggtgcacgaccggattttggtgacgcaccgagtgcacacctacggcaggcacatcgattccagagatgcttgacgacgccgcagccaccgcttcctggtcaacgcaggccgcaaacgcctgccgggcctccgcagcgtaaaacacaccggcactggccaaggtgagctgctcagtcaaaacaccgacctcttccttaatgtcataaggattcaatgggtcatcgcgatttacccacggctcgctctcccacgccacaacatctgcgatctgaaggtttccattatccgcaatggcgctgagatccgagcctttaggccacatcgtgatttctgcttcaaccgcctggtcgccactgtaaaactcattgcgtaccagcttgacttcgccgaattcacccacagaatccaccttgtacgggccaaaagccgtctgcagctctggatcaaactgggacagctggaaaccttcgctccacacacgagcaggttcagtcaacgcttcaggatccttatccttcaacgcctgattaagctcctccaaggtcatacctgctttggaagcaacggcatgggctggcaacaaatcgccctgctcaaaaagataacgccaacgctcaccgaggtcttccttgaacaccacggtggctactttagaaccagatacacagtccactcgctcaatctgcgaggtcaatggcacatgggactggaacagttccggcatctgcccagctgtcgcagagagcagaaaatcatcacacaccacaggctgaccatctgagtaggtggcatcttcattgatagtgtaaatcacctggcggttaatacccggcaatacctgcgtggaagcaagatcagtgttgggaatcatctgcccagaaggaccctgaacatacacacccggatacactctggcagccaaaagaccagcatcattagccactcccaacagcgacgccgcgttggttgtagccagcgaagagttaactgcgtagccgaaaaggcttgtttggtggctggttggttccggttccccatcaccacagcttgtcatcactaacgctgcaaccaacatgattaccgcgctgcgtgacttccgaaacaacatgtgtgaagtacccagcctttccccgaatcgtaataggactgtaattatacggtttttgccccggcgacaaccaaatctggcaatacctatataacgacgtcccgtagccgaatgtctccccccgttacttaagttcgagatcacatgttcaatttctcgggctcaataccttgcgctcaatttcccaaactcaatttcagtcggtttttggtgcttttcctagcggtctcgaacataagaaattgagcgtgaggtatcgaaggtgagaaatcgaacttaaggcggcgacatctcaacctacgacaccgcagattacgagacctcaacctacgacttcgcgtgctcaacttctcatgagccgacttcactggataaaaacggcaaatccgactgaagtcgaccacgtgaagtcgtcgtttgggaacatcgtgagtcatagacgcacaaaaaaaatcccgcagaacgcgagtctgcgggatttttcttcgttctccaattggtttagcttctgcctggtcgccaggttccgcttgatcggtgatcatccacaatgggtttgcttactgtacgttttgcaggtgcttcgggggtcacaccgtcagtgtcgctttcggtgccgtgcgcggaggcgtcggcgttggtgtgtggggtggcgtcgataagcgtgctttggccgtcgcgcaacttcataacggaagcggtgtgcgctttggttttgctcaggcggtttttcaggctgaccagcagtggggttgccaggaagacggaggagaaggtgccttcgatgacgccgatcagctggatcagtgcgaggtctttgagggtgccaacacccatcatccagacggcgacaaccatcaaagcgatgatcggaagtgcagagatgattgtcgtggagatcgaacgcatgaaggtctggttgaccgccaggttggcttgttcggcgtaggttcgtctgcggctgccttcgaagccttcggtgttttctctgaccttgtcaaagaccacgacggtgtcgtagatggagaaggtcagcacggtgagcagaccgatgacggttgctggggatacttcgaggccgatgacggcgtagatgccggcgatgacgatgccgtcaacaaccaatgctgccatggcggcgatggccatttcacgctcgaggcggaaagcaatgtagatcgctgcaataaccaggaaggcaatcagagccaacaccatgcgttgggtgatggtggaaccccatgattccgacaccgtggaattaccgatggcatctgggcttggctggccctcagagtttaggggttggtattcctcgtagatcgccaggcgggctttttctacatcctcatcgctgagtcgctcggagtagatctccagggtgcgggcgtcgccggaaccgacgatctgcacgatttccggagtaatgccggtggcttcagtaaaggtttcctccacctgttcggtggagtaatccgatgctggcatgctcatcttggtaccgccctggaaatcgatgctcagggagaagccacggatggcgatgaacaggatcgagataaccagcaaaatgccggtgatccagtaccacagtttggttttggcgatgaagtcaatgccgccgtcaccggtgtagaggctgttgaaccaactgcgttttttggctggttttacgctctgagttgacagtgattcagtctgggaatcagtcatggctacttctcctcctcttggttcgtatcggtgccaggtgcttcagaattgtcagtggaagaattgtcagtggaagccttatcagctgccgcattcttggcatggatctttttcaggtactcaggctcatccaattcaccgttggcgcggcgttcttcaacgagcttcatcactcgtcccatgccgttgaccgatgacttggcaaagaatgggttgcgtgatgccaggataaccagtggtgccgtgatcaggaaggtgacaacgagatcgaatacggtggtcagacccagggtgaaggcaaagcccttgacttcgccgaccgcgagcaagtaaatcacgatagcgccgagcaaagtgaccatgttgcctgtgacgatggtgcgcttggcgctttcccatgcacgaggtactgcagatctaaaggatcttccttcacggatctcatccttgatgcgctcatagaacaccacgaaggagtcggcggtggtaccgataccgatgatcaaaccggcgataccagcaaggtctagggaatatccgatccagcgtcccagcagtaccagaaggccgtagaccaacacgcctgcggcaaacagggtgaacagggaaacgaatccgaagacgcggtagtaggcgaacacgaagatggcgaccagcgcgatgccgacgatgcctgcgatcagtccggccttcaaggatgctgcgcctagtgatggcggaacggtggtggtagttccgccgcgctcgccgttttcacctgcgaagctcaggggcaatgcaccgtagcgcaggttgttcgccagatcttgggcttcagtttgagtgaagtcaccggtgatggatgttgcagaacccacaggggttgctgactgaatcacgggtgcagaaatcacctgagagtccagggtgatggcgatctgctgctgcaggtactggctggtcagagaggaccaagttgcagagccttcttccccatcgccggatttgaaggcaaagctgatttccatctggccggactgggcgttgaatccaccggtgatgggacggttggtatcgatctcattaccggttaggcgcgcaccattttcctcatcggtttcgccgttgagcaaaggtgcaggatcaagtacatacacgccacctacagctggatcacatgccaccaatggcaggcgtggatcatcggtgccggccaaaggatccatctcatcagtggtgcactgcatcaaagaacttgcagcgatctggacagtgggatcggtggactggcggtcggtgcgcagcatgtccgtgatttcctggcgtcgctgtgttgcctcaatggagttggctggctcatccataggggtcgccgacacggtgacgggttctggctcagttgcttcttcgccttccaccgcagtggtcgatgcaacagcggtgttcatttcctccaaggaggcatttgcctgctcttcggtgatgacgccgtattcaacccacctgttggccatctcttccagctctggcatcaacgtggtcatatcgggcattcctgcctgaccaacgggacggaacagcagctgggaggtctgtcctagggattgcgcctgtgcggtattttccccgggaacagtgatcaccagcgtgttaccgtcagcgaccacgcttgcacctgaaacgcccatgccgttcacacggttttccagaatggtgcgtgcctgattcagctggtcctgagttggatcctgcccctgcggcacgagggtcactcgggttccgccttgcagatcaatacccaattttggtgtggcagaacgatcgcctgtcaacagcaccaacgcataaacaccaacgacgatgagcacaaacaacgctattgcgcgttttggccatcgttcccaggcgctagcggcactctttttttgccgagccaagaaagtctccttcaattccaatcaaccagacaaccacgcttgtcgacgcccacccactccatgcgccactcacccacgccaggtggcgtgggtgagtgcgacacgagcgagaaaggcaaagtaacggtgccttcgggatagtgtttaacccaaaacatgctacgccatctgcgtagttttgccttcccatacccctgtgagtctggctaccaatatgagtagatatataaacagcacccttgcccacagaaagtaatgagcaaaagggtgctgaattattattaatttctaacgattctcaggatgtccgtcagtgcgtccatcgaaaccatcgttcggctgatcgtcttctggctgatcaaacagcgtcggctcatccaacatctgaggttcattggccttggacagcacacgcacgatagcaagcttttcaaaagtgctgatcatacccggcgcgatctctagatcaacggtttctgcagtggtggaaatgaccgttgcgtgctgtcccgcggtggtgacgatgcggtcgcctgggacgacagagtcctgcagcttttggatttcagtcatccgtgcgcgctggcggcggctcatgaggaaagtgggaacgataaaaatggctagaagaattatgaggaaaacgatgtccatggttagttagtttgccagaccatggaacatcctggccacctaaggtggctaataatcgccgatggtgccttctggtggttccagccccaggtgtctccatgcagctgcggttgccacgcgtccccgtccggttcgtgcaatcatgccggcacgcaccaaatagggctcgcatacttcttccacagtgccgggttcttcaccaactgcaaccgcgagtgtgttcacgccaacagggcctccgccatgtccgcggatcaaggcatcaagcactgccctatccaggcgatcgagtccgacttcatcgacatcgaatacaatcagcgcagcattggcagcacccatcgtgatgtgaccatccgcatgaacttcagcgaagtcacggactcgacgaagcagtcggttagcaatacgaggagtaccacgagaccgcgaggcaatttccacggcggcatcgttgtcgattccgacatcgaggatcttagctgttcgtttcaccactttggtcagatcaggcacatcgtagaattccatctgcgcggtaaaaccgaaacggtcacgcagtgggccggtgagcatgcccgacctggtggttgcaccaacgagggtaaagggtgggatctccagcgggattgaggtagcgccaggacccttaccgacgatgacatcgatccggaaatcttccatcgccatgtacagcatttcctcggcaggacgtgcgatgcggtgaatctcatcaataaacagcacgtccccttccatgaggttggacagcatggcagccagatcgcctgcgcgttccaaggctgggcctgaggtcatacgcaaactggtgcccaactcctgggcgataatcatcgccatggtggtcttacccaggccaggagggccagacaacaacacgtgatcgggaaccacaccacggtttttcgcaccggtaagcaccaaactaagctgatcgcgcaccttcggctggccgataaactcagtcaaagacttcggacgaagtgttacttccgcatcgtattcatcaggcttcaggttcgcatctacgttggtatcagctgcacggccttgaccaccgtttcgacgaggtggaattcctcccggaatttcaaactctgttctttccacatcggacatgagggtctactttccgctgagttttgccaatgcggcacgaagcgcgccactggtgtccaaggatggatccgccgccagcacaaagctcactgcatcatctgattgcttctcgctaaagcccaaccccaccagcgcttgagaaacctgctccacaaccacctcagaagcaatgttcgcgttaggcaaggaaatttgctcccctccctcatccacgacaccggcagcaaaagctgcgaccttgcctttaagctccacgatgagacgatctgccatgcgctttcccacacccggaacccgctgcaaagttttggcatcggcattggtgatcgcctgagaaatctccagtgggctcaacaccgattcacatgccaaggccaggcgtggacccaatccagatactgtttgcaacacggaaaacatctcacgtgattcattgtcaataaacccatagagtttcatcgcgtcttcgcggaccaccatggtggtcaacaccagtgcttcctcaccgcggaccaactgtgacaaggtgttcggtgtggtgacaacctcatagcccacgccattgcattcaatgacagcagagctcagaccaatgttgataacagtgccacgaagtgaggcaatcatgaagacactcctgaaaaatgtactagaactttttaaaaactaattggtgtcagttcgttgaaactgactgggatgagccgctttagcaggatcggatgcatgggattgagcttgttccgcattgtaagttgatttcgctttacccaattttccttgctgcacacgccgtcgcttttccaactcttgctcggagtactgcgattgcgcccgcataagcattggcgcccgccagcagtgacacaccgccaacgataaagcatcagcggcgtcagcaggtttgggtggctcaccaaggcccagaattcgagtgatcatgaccgtcatctgtttcttatcagcgcgaccattaccggagatagcctttttcacctcactgggggtgtacatgtgaactggcaatccgcgttcagcagcagccaagatcaacacacccaccgcatgcgcagtgttcatcacggtggaaacatttccgcgctcaaagacacgctcaatagcaatgacatctggggtgtactcatccatccactcacccactgctttgctgagccgaagcaaccgctccgccaactccgcatctggtggggtgcgcaccacgcccaccgacactggatacacggtacgaccacgacctgcttgaaccacagataagccacaacgggtaagacctgggtcaatgcccattacccgaagcccttcgtggttcatattcgtgtcctcactgattcgtcgctgattcgtcgctgtgcagttgctattccatactcatttttagcacacaattgcgatcaccccgctatcctctgcgttttagctgcagggatagcggggtgaacggagtgcggaaaatacgaactagtcgttttccagctctgtcaaaacctcatcgctcaagtcgatgttggtgtagacgttttgcacatcgtcggaatcttccaacgcgtccacaagcttgaagatcttgcgtgcaccgtcagcgtccagggggacctgaacagatgcccggaagtctgattcagaatcttctacttcaatgccagcttccacgagtgcgtcgcgaacagcctgaatgtcagttggtgcgcaggtaacctcgaacagatcgccgttgtcgttgacttcttcagcaccagcttcaagaacagccatgagcacgtcatcttcactaagatcgcccttttgtacggtgacgacaccggtgcgggtgaacatgtaggacacggaaccggactcgcccaagttgccaccgtttttggtcattgcggtgcgaacttcggtagctgcgcggttacggttgtcggtcagacactcgataagcatggcaacgccgttggggccgtatccctcgtacatgatgttcatccagtcagcgccaccagcttcttcgccggagccacgcttgcgtgcacgttcgatgttatcgttcggcacagaagccttcttggctttcttgatcatgtcatcaagcgttgggttcgcagacggatctccaccgcctgtacgtgccgcaacttcgatgttcttgatcagcttggcaaattccttgcctcgcttggcgtcgttagcagccttcttgtgcttggtagtcgcccattttgagtggccagacatatgctccctttcgtcgtctagcttccatcatccaccggaaaatggtttctcacgcagcccagagatagctcaatacaccaccaaatgtgtggtgcgccgtgtgaaaattttagactcatgttgcggtggcgaaagccgggtagcttccatggaaacggagttggtagttggaactgatgaaacagtatacgccaaggtcaaatgatgaaacttaaagggcaccaatttctgtcgcgttaccggattcagatcttcaagttcgctgcattttagtctttgcgcatcggaattgattgcgcaccctcgtggagtgtgcgggtcattccctcttgattgacaatagcgaccaaatctccctgctggttgaaaagccgcccgtgagtcaaggctcgcccacttgaggccgatggagagcgctgatcataaagcaaccattcatcgacgcggaagggacgcaggaaccacacagcgtgatcaagtgaggccatctgcattttctcacctgggtgtggcaccagggcactatgcagcaaagtcatatcggacagataagtcagtgagcactggtggaaggtgggattatccggaagatcagcggtgcaccgaatccacacagcttgctcagtagcggtgaaatcgctgagttctaattgatcctgcggaataacgcggatatcccattccgcccattcatcaagcactcgcctacttgagatcggcatacgttctactgttcccttgatctcatcaggagctggaactttacgcatcttgtccatgtgctcaatgccttcatccccacgatgaaagctggcctgcatgctgaagattacttcgccgtcttggatgccacgcaccgagcgggtgacgtagctttttccgtcgcgaactcgatccactaaataaattgcgggtgctgttggatcaccaggagctataaagtagccatgcaaagaatgcacagtaaaggctttatcaacagtatgcgttgctgctactaaagcttgggcagcgacctggccaccgaaagtcctggctaaataagattcgataacgggaccacggtaaatatcgcggtcgatttcttccaaggtcaaaatatcttcaatagttttcactgatcactcccaattaatttatgcacttcggtgaggttactcacaaagagtagcgtgcaaagcccagcaataaggtgatgtttcaacgattaggttacggtaggggccatgacgccacagaaacttcaccgttttgcagcccttttagaaatgggtacctggaccctgctgatcatcggcatgatcttaaaatacagtggagtgacagacgccgtaacccctattgccggcggtatccacggctttggcttcctctgttttgcagccatcaccatcaccgtgtggatcaataataagtggacattcccgcagggtatcgcaggtttgatcgtctctgttatcccgtgggctgcattgccatttgcattgtgggcagacaagaagggcctcgttgccggcggatggcgcttttcagatccgtccgaaaagccacacactttctttgacaagatcttggctcaattggtcaggcacccaatccgatccattttaattctgctggtgattatcgccgtcgtcttctctatcttgctggcgatgggaccaccttatgatccagatgccatcgcaaacactgtggattaaacaacagcctccttcacatgaaggaggcttttttacatttaagtcagcagatctgtatcgagtagttcgaagtactccggcaagggtgcggtgccgccgagtcggaaggatctgaccatcaatcgggttcgaagatcgcgggtgtcactgacggcttcgttgtagaagcggtgggctaattccacgcgggtggcagcgtccacgatggaatctggaagggtcttcccctgtttcaagatgagttcagagatttctcgttcggcgcgggcgcgttgggagaagcgggagtattccaggggaattgcctcagcgcgttttgaggcttctgctgcatcgggcaacaacgcacctactagtgctgctcggcgatccagtgctgcttgcagggcttgtcttgctgagtcggtgcggatgtggagccggttgaggcgttgtgctgtgaaatacgcccacagaacagttgcggtgacaacgacagcgatgaggaggtaaacaagggtcatccaagcctcactttgtcgatcgcaatggtttcatagactgccatgacctgggtggatactgtcgaccagtcgtaggcgtttgcgcgctttagccccgcggcgataagcgtggaacgggaggaggggtcgtcgataagcgcttgaagttttttggctaggtcggcgtctgagccggttttaaatagcacgcccgctggctgtgcggcttcagaatcggtgaccagggagaacgcttctaggtcgctggcgacgacagcgcatcccgcggccatcgcttcaactagcacgatgccgaagctttcgccgccggtgttgggtgcgacatagatgtctgcgcgacctaagattgctgccttttcctcatcgctgacgcggcccacaaagttgatgccggcgacttctcgcggggtgccgccgccaatgacggtgcaggtaaacgggcgatccagcctggtcagagcgcgcaggaggatgtcgaggcctttgcgggactcatcgaggcgacccaaaaagacgatctctacaggatcattcggttcgatttggcgcgcggctttgaacatggaggtctctaccccgttggggatcagcacgggatcgccgccgacttgctccacctgccagcgccgagccatttcagacacggcgatgcctgcgcgcactttctccagcatgggcgaaagcactggtaagaaagccttgagcagcttcgatccgctactggaggcgtggtaagtagcaacgatggggccttccgcaaagcgtagcgccgccatggaaaaacttggtgaattcggttcatggatatgcagcacatcgaagttgccttcgcggaggaacgtgcgcacggccttgaacattttcggcccaaagctcaagcgggcaaccgagccattgtacggaatcgggatgctgccaccaccgcgcaccacgaaatcgggcacctgcgtatccgcactacacggaccaagcacctgaacctcatggccttgggcaatgaaggttcgcgctaagtcaaggatatgcgcttgaacaccgcccggctcatcgaaggagtacgggcagaccattccaattcgcacctaattgtcctcctgtaatgccaccggtttgtgaacatttgtctgctccctagagcgcttgagacgctccggatccaaatcaccaaaccacaggggttggagcatatgccaatcagcggggtgcgccgtaatatttgccataaaaagatgtgcgatccgctgcaccgtgtcggataaattatccacggtcacggcatcggatacgctgagaccccagccgtcgtcatcgaaccatggatgcaccacgtgcagcgccgcacctgtttcaatggccagctgcgcaggtcctgctggcatggaggtcttctcaccaaaaaaagtggtctccacgccggaatgccgcaggtcacgctccccaagaaggcacacgatacctccagatgtcaggcgctctttcagcttttcaaacggcggacgctcgccaccggtgagaggcagcacctcaaatccaaggctttctcgaaactccacgaacgcttcaaacaagcgttccggcttgaccctttctgcaacggtggtgaattgcccatgatggctaatcagaaaagcgccagccatatcccagttgccgctgtgtgggagcgtcaaaactacgcccttgccggcagccaaagattcatccaacaaatctaggccaacagttcccttacgcaaccgcgcaagcagctcaggatctcgcgcgatcgccggtagccggaacgcttccagccaataccgcgcatagctgcgcgttgcttgcttcaccagcgcctgcgtaacgttttccgcaccgaccacccgcgccagattagcgcgtagctgccccatgccttttccgcttttcgacgccagatccgccccaaggtcaaacacccggcgagcaataggcaaagggagcatccggacaaaacgccaaccagctagatagcccagtgcgcttaaattctccgcccaattttccgctgtgcagaaatccttcggcttcatgcgatgctccctcggctaatttttatttggtgttgctgtaatctgccttcgcacctgctggtgccttggtaaattccttagccaatggggactttccagccatgaccaagcgctgcacaacagtgtaaatactgccagctgcaagggcccacagtgccacatcgatggcatatggaacgcccattccggtcagccccaaaccaacaaggctgacaatcagacgctcagggcgttccacgagaccgccgtccatggtgaatccggaggcctctcccctggctttcacgtaagagatcacctgggaggcaaccaaacaaaccaaggaggcagcgaccaatgcctgtggtgcatcgtaggaatacaccagccaccaggtaatcgcaccaaatagtgcaccatcagtgatgcggtcacacgtggcatccaaggtggcaccaaatttggtgccaccaccttgcatgcgagcaaccgtgccatcaatcatgtcgaaagccgcaaacaggcccgtcaaaactgccgcccaaatcaaatgccccgtaggaatcagcagcaaagccaccccaacggtgaggccagcgctgactaaggtgagctgattaggcgtcaccttcaacttgatcatcaatttggcaacaggctcaacaataacctgcgcaggcttacgtccatgaagtcccagcatcagtgctccttcggtgctgcggtacggatcgctgaagtcagcgttgggtcgacagtgcctggtgccccatcaatggtgccccatgcttgcgcaagcatggccctggtttgacgcagggtctgcggtagcactttgacaccgtcaatcacagtcatgaaattagcatcacccgaccacctaggcaccacatggacatgaaggtgatctcccactgagccacccgatgctttgccaaggtttaaaccaacattgacagcatcagggtttgacacctgcttcagcgccttgatggccgtttgggtaaagagcatcaactccgcagattctgccaagctcaaatcctctagattcttttccttacggaatgggatcaccatcatgtgtccagcgttgtagggatacaagttgagtacgcaatacaccagctcaccccgcgcaacgatcaggccgtcctcatcactcattttgggaacctcaatgaaggggtcccgcttggcggtagttgattgcttaccgccagatcgagtgttgatgtagctcatccggtagggcgcccacagacgttccagtctgtcgggctcccctagaccttgatcaacatatacatcctgaccaacgtggctgtcagatgagtccatctcagggctacctgcgagctgcaatggagtcctcgctcggctgatcattgatgcggtcaccaatccaggaagaaatcacagcgattgcctcatcgacgggcacgccgttgacctgggtgccgtccaagaaacggaagctcactgcgtttgcttccacatcgcgggcaccggcaagcagcatgaatggaaccttgccggtggtgtggttgcggatcttcttctgcatgcgatcatcggaggtgtccacgtctgcgcggatacccttttcacgcagctgtgcggtgattgtctccaggtgtggaatgcaatcatcagcaactggaatacccatgacctggtgaggtgccagccatgctgggaaagcaccagcgtagtgctccaacaacacgccaaagaagcgctcgatggaaccaaacagtgcgcggtggatcatgatgggctgctgcttggaaccatcagatgaggtgtattccaagttgaagcgctcaggcatgttgaagtccagctgcacggtggacatctgccaggtacggccaatcgcgtcgcgtgcctgaacagaaatcttagggccgtagaatgcggcaccttctgggtctggaacaagttccaggccagaattggtggccacacggttcaagatttcagtggaacgctcccagatctcatcagaaccgactgacttcttaggatcgcgggtggagagctccaggtagaaatcatccaaaccgtaatcgcgcagcagcgacaggatgaagtccagcacagaggtgagctctgcttccagctgatcctcggtgcagtagatgtgagcatcgtcctgggtgaagccacgggcacgggtcaggccgtggatcacaccggacttttcgtagcggtagacgttgccgaactcaaaaagacgcagtggaagctcacggtaagaacgtccacgagaatcgaagatgaggttgtgcattgggcagttcatgggcttgaggtagtactcttggcccggcttggtcacattgccgtcttcgtcgaactccgcatccacctgcattggagggaacatgccatccttgtagaaaccaaggtgaccggaacgctcaaagagatcctgcttggtgatgtgcggggtgttcacaaaggagtagcccgctgcgatgtggcggcgacgggagtgatcttccatctcattgcgcacgatgccaccgttgggatggaatactggcagaccagagcccagatcatctgggaaggagaacaaatcaagttcagtgcctagacggcggtgatcgcgcttttctgcctcagcgagcatggtctggtaagcatcgagggattccttatcctcccacgcggtaccgtagatgcgctgcaggccagcattatcctgatcgccacgccaataagcagcggatgatcgggtcaatgcgaatgctggaatgtagcgggtggttgggatgtgtggtccacggcaaagatcagaccactccacctcactggtgcgagggttgacgttgtcatacgcggtcagttcgcctgcgcccacttcggtggcttcatcagagttgggatcaacgttgcccttgtcctggataagttccagcttgtaaggctcgttcttcaactcttccgctgcagcttcagcggattcatagacgcggcgctcaaacttctggccggtcttgatgatcttcttcatccgcttttcaatggtcttgagatcttccggagtgaaaggctcagccgcatcgaagtcgtagtagaaaccattttcaatggctgggccgatgcccaacttggttcctgggaattctgcctggacagcctgtgccagcacgtgagcgcacgagtggcggattactgcgcggccgtcatcagtatttgcaggtacagcggtgaacgtagcagtggtttctgggacgtgtgaaagatcctttagttggccttcagcgtcttttgcacaaacgatagcctctggacccttgttgggcagatctagttcgcgcattgctgcaccaattgcggtgcctgcagggacctcaaaaacaacaaggtttgctactgcggtatctgtggtgttcacgaaaattgcgctccttcgtgcgctcacgtgggcaaacggcatacctggccgcccccactagttcaaggtgcgcagctgacctggcgctcccgatacgtccaaaagagggaaatatcgggattcaccgcagatatattaggcaatacctgatgtggtgcgtgagcttctttggctttgtctacttcagtcgtcctactgatgacgcattagcagttaaagaaactcacagccggtggccaactgtcgttccacatcctaccgcgtggcgggttatagaaggagtccggcaccccaaaaatcatcccgagatgaatcattcgggtcggtgcctggcgggatgaagaatacagcggagccaatatgggtaatccactgattcaggcggtcttgttcatccagccgttgttgaatgggcgtgaactgcagatcggggtttttctggaagcagataaacaccaaaccagcattggacagttcctctgaagtgggatctggtggcaggtcatagttgaacactcgtcgaagaatcacctgctccggattgctttccggtgcacgcgatctagccatgtggcttgccggatcgataagcggcagaccataggaatcgcgggcggagtaatcagcctcagaaaactcatcgccaccactaagtggcgcgccggtatccaaggtgcgccccacagaaacttcacgggacgggcgatccagaatttcccattcatccaaattcatagcaatgcgacgcacaaccatgcagctgccatcaatcgcccagtccggaccctcagaaatccaggctgtttgctggatttcatcatcggtacggggattcacagtgccatctttttggccaaagagattccgcggagtctcatccgtctcattcacaccatgggcattcatgaaaccctgctgcacccaccgcgtagccgcataatccacaccagagcgaatcatatgcctagtcgcatgactcaacgtcaccggatcatcactacaaatctgcagcacaagatccgcctcgccccattccggacgcaactgatcccgctcaaattcaggaatcggcttcaaccactcgggacgaagatcaacctgctgggtcacgtcgaaaagcgaagcaccgaaaccacatgtaatggtgaggtttgccggcgacgtcaccatctccggctccaggctgcccagcggcgtctcgccagcgcacagcgcgcgggcatcttcggtccacacgcgcatcaaccgcgtcacgccagcgcgatccacgcccgcacgcagcgtaaacgcaaccagattcaaattcgcctgatgcggcgtcgcaatgccggcctgatggcggccatcaaactccaccacctggccttttaagcttatcgacgcaccgtccggctcattttcccccgcactgcaccccgccaacgcggacgcaccagcaatcaagccggcaccccctaggaaacccctacgggaaaccatgtcgctccttatatatagtggccggtttagtggccctcgtggccttcagttcccagatcgccataatcctcatcaccagcagcaatggtgcgcgccgggatcggatcaagcttaacttcagaaccatcagccaattcaagagtgaccgtcacttcatcgccagcctcgattgggttcgcaagccccatgatcatcaaatgatcgccacctggtgccagctcgatgctctcccctgcagggatcacaaaaccacctggcttttcctgcatgacgccatcaacaacctcatggacctcaaagctggcagcatcaacatcagcagtaaagccagaaacgttgatctcatcatcagaattgttcaccaacgtagcgaacactgccgtcatgtcgctgtcctccacagacgcacgaacaacagcgttttccgtggtgatcacagcatcgcttacctgcgtgctgctggaggaagtagtctccacgctcgtggaggtggaatcactttgattagcaggcgaacacgccgccataaccaacgcactgctcagtacagcacctgcgacaaaaaacttcttcatggtgaataaaccctcttatttctggttacgattctttgcaatcatcatgacgatggcacttgcaacaacaagcaccgccacgatgctcaaaacccaattccacggcgcaggaattccagaagtttcatcagcagtttcagttgtctctgcttcggtggtctctgaggtgtcagtggttgctgctgactcagttgtcgtctctgctgttgtctctgttgtcgtttcagcagagcctgtcacctcaaaagagattgaacctttagtagcgtgaccatcagaagaagtgatctggaaacccaaaatgtagttaccagctcccgtctgcacatcagatggcacttcatagctcaagtgctgcccctcaagctgaggagttccagaagttaacacctctccggaatccgcattgctcaatgcaactgttgtgaacagatcctgaggaataccggaaaactccaactcaatggtctccgggaactcatcaacgacactgccattttcaggattagaatccaccaccacatcatgggcagcagcctgcggagccacgagcatcgacatcgcgccaacgcccaacaccccagcagctgccgccaaggtacgcaattttagattcttctctgaagccacattcaacctctcatagatgggcgaaacttccttttcgccgtggtcggacgcattagtttcatctttgcgcccggttagttgtcgaaatcttcccccacttagttccccagagggaaatatcaagcggaggttaccagtaggtaaatagagtctatccagcttggagccacttttcgaagtcgtgtgatctagactacgttcccattctgggggtgtcttgcgcaggtttcggggtagaactcaagggcgggaaggcattaccacatgcacccatacacgaatagaaaaaatgtgcgaatattcaccacaaaaagcggatttcctgctggctgtggtggatatttccgctttatctgcctgcgtgcgcaactttaggaccgatttctagagtccagcctggtttgtggtggatccttgccctggaagctttcaggattcacaactgccccaccggccccaaaagtgagggcccctaaaatcgcgcccagccgcctgaatgacctcaatccatatatcgacccatcttgagcacttcgaccccttaaaacactttttgggaagcacgcaaaaacacctatgagcgttaacccataggtgttttaaattgagcggatgacgagactcgaactcgcgaccctcaccttggcaaggtgatgcgctaccaactgcgctacatccgcatgaacattgattaaagaggttgttcgtcctcttggtgcgcgatactgggattgaaccagtgacctcttccgtgtcagggaagcgctctcccgctgagctaaacgcgccagaactgcgaggtggaaacgggaatcgaacccgtgtgcacggttttgcagaccgttgcctcaccactcggccattccaccatggcataaatttgcctttaggtacgtggtaaacataccagagcggatgacgagactcgaactcgcgaccctcaccttggcaaggtgatgcgctaccaactgcgctacatccgcatgaacattgattaaagaggttgttcgtcctcttggtgcgcgatactgggattgaaccagtgacctcttccgtgtcagggaagcgctctcccgctgagctaaacgcgcgggacatttcatcgattggcccggtgaaatgagagcggatgacgagactcgaactcgcgaccctcaccttggcaaggtgatgcgctaccaactgcgctacatccgcatgcactacttagaacttgttcctgcttgttccgttctgtgcggtgctggaataactttagaccgaacgctccctcgaacacaaatccccaagtcaatgccacaaaagcacaggtaaaacccctagtgaaaacccactttccaaatcacacggatgttatttcgcaggacagcaaagaaaacctcgaatatttgaccaatgctcatcgctccagattcagaaacgtggtgacatccgatttccatctattaggtacaagaatttctcttccatatagaagctgggtgaaaaattgaaccgattatgaatattcaaaacttccgtgttaacttctaagcacaccgcaaggtcctatggctcagtggaagagcgttccgttcacaccggaaaggtcgctggttcgaacccagctaggaccacttgtttagcccctgcttgcaggggttttattcatttttagggttaaaaaacacgcgtttgtggggtgaacgtggggtgaaagaattcattacgagtgcttttaagcacctctccgtcactcccgctagttttattcacgatccgcgtccagctgcaacaaaccgcactacaaggccaccttcgacacgtcgccgctgtgcatagttttctgcaagatgtctctccgggtccttttctgtcacgcataatatgcagaggttttttcccaccccacaaacccagctaggacacagcacccctgaaattgtgcacccgcaaaggggcaatgctgtgggctaaaacaatatgtgcagacagatggatctgtgattgaacgtatccatctaaccccgcctcgcaactcccccagctcacctttttgaccctcacccccaaggcaaaccctgagtcgaaaacagttcacgcagacccaatgtgcaccccaaaaacagcgctctcacacctttcacttattgaataagtttgtataaagttattccttaatgaactaacaatagttctgggaaactttataaaaggctttttgacattctttattaacggtttctacagttcatattcgaataacgagaaaggtagtgtcaccatgccccatccccctatgaatcgcactcattcagctgctcggggtcgaaccacaatcacagcacaaacaactgcattacataatcacgtttccagaacgactattaaacctgttgttaatattgaattacaggacgcggatcttcgcgcctactcacgtgctgaagttcaggagcgactcggcggcatttgttcacgctcggttgatcgactcatcaactcaggccaactcaaagctgtgcctggtacccgaggtaaagggaagcggccactcattaccgcccgatcccttgcgcaatacatctactctgggggctagagcgcgccaaagaaaacacagagcaaccaccattgcagcagtgctgcaatggtggttgtttttttggcacagtctcaggctgtgttcgatgagtgcaacatcagcagcaatcccattcgagcagtcaatgaccacggggacgagccccgaggttttctcgcacattattcataaaaaaaattgccaacctgtgcttagatcaaccgcgaaagaaaaggaacacggtaaagcaacagactggcaatcttccacacaggtattcgacgaggggtttggggaaccaagggaacgaacatctgcgagatacttaagcttgggacgacactccctcactagagaacctgttactagtgtaacaaagttaaaaccaatactcaataagattctctagtttaaaatacctagttcttagatgaagtttgaaacttcatctaagaactaggtattaattacttgcgtgctttcgctgcaatcgagcgtgccgcaatcataagtccttcgcgattgagcttgcgcgaatatgctgaatccaaatacagcaccgggaacgtatcttccgaacccatctccgctgccttaatcagcaacgcttcatgcagtcgatcacgcagcgggccggaaccaccgccgtagacaaaggctacttcggtaagagcacccacgtcgctcaacactcgtgcgaactctgcagccacatcctgaacaaagaacactgcctcctgatcaacatgctgttccacgcgggtatagaaattccgcttgagtgcactcggtggtcgctgcaaataatcagccaactgcttacgcgagttaaagttgtgtgccaacccagcatcgtccatagcctgaatcgccgactccaagacggtgccataacccttgtcataggcgcgtgaagcatcatgattaaaccgcccatccgtaaagactgggaaattcacagtaccttcacccacatccacaccgattgtgtggcgagcttgtagcacatcacctgctgtcacgccctctagagcaagccctttggagcgtacatcggcgagcattccgttcataagtacttcgccacctgcggtaatggcatactgtgccgatgcgccctcggcaatgacctcgacacgctcaaagatgagctgcaccgttgctggggtttcaaagttgttaaccgtcaccacatgcacagccgggttcgctgccccatcacccataaactgtgccttatacccatgacggtgacccacatattcattaatcggtaacgcaagtgcaagatacgtatgcacacgcagcacaccgggatcaccctcaacagcaacctgtgggattcgaccatgtgctgccacaaagtctttcacagccttggccgcaagtactgccatgaccagcaccttgctcagttcttgttccgccttggagcggttacccaccagatcaaattcctccaagctacctcgtgcagacaagctgcgcgtgccacaaaggtaacgataattacctttcaccataggcgaattgaaattggtatcaatgtggttgaagaaatccgcaccggtgacagcaacagcggtgtcatctggttcgggaacttccgttggccggctcatgcgcgttgctgcagagggcatatcaataacatcaacagacgtgccagtcgtatcaccggttgcctcgataatgcccttgacataaccgtttccaatatcgagtccagcggtataggtgtagacaccgatattcgagcctaaagcagatccgtgctggcctgtctgtactgcatctgtcgcagagtaattcttcgtattaatgggcttaagtactttctgtgtggtcttcttctgcacattcacagcgctggtcataatcttcttcccttaaaaagtgtcgttgtaacaaggtatgagctagcgaccgaacgcttggcccatgacatcatccatatcaaagccatcatctggctctgactgtgctggttgcgccgacttttgttctggtttttgctccggcttctgtgccggctgtggtgctacctgctgcttgggtactttggcctcaacaactgactcctcaaccggctgactctccgcctcggcaacaaactcatttacctgatcaggtgcacgggttgtggtcgatggcggtgctatctgctgcggtgccttcttgcgtgtagtcacagcgtctacgtcagcaaccccggccgcgagctgagcaaaaagatcactaccctcagcccctgcctgcaggctttccaccagcttgaggccaataacggtagcaacctctacatcaccgtattcagcgacaaacaaatagatcagctgtcgcatcgcaagcgagatgccacgagcaccctgtgtttccaaaaaccgctcaacgatagcgtctgtttctgggaagcgcatacgcacattacgccacggggcatcgtcctctgatacatgtgtcgtgtcctgtttttgagccatgtgtgacccccatttcgtacattgtgtcgggaagtttctcttcaataactgcattgtttatgactaacgttattgactaatttaatagtaacatagaagtgtcttttaaaagacaattaaaaagcaattaacgtacttttaaaaggcacttatgtgtcaattaataattaacccgtaaaaaacaattaatcgtttcttaaagggcttttaaacaaccactaacagcacaatcccctatgtaccgataatcgaccgttatctgccttttaaggcacttttaacaagcccttaaaacacgcctaacgtgcacttaagcaggcaggtaataaacccctagcggtcgattaaataactatttaatagttaactaatggagccccaccatgacatcaacctttaatctccaccgcattattgagtgcgatgctgtaaccatcaccccgaaaatggcgcgctcgaacatcgagctcgctagaagaggcggccttacctgcgacggtggagccgtagctataaccaatcacaacttttctttggtctgggttgcgggactgtagggctgtttgaaacttctgaagatctttcgcagcgtgattggccactgcacctgataccgcagtggagatagaatttggtgcttgataacccaaccacagtactgttgcggaattggtggaagtggaaaccgtgcgggcgcgatcagcgtgaaaaggcaaatttacgccacaagttggcctaaaggtaacactcgcacgggtacgcgggcgcgcgcataggtatgcaggagacaaaaagaaaccccgcgactgagagttagatcagtcgcggggtttcccgaatataaacaatgaagttgccgctatgtccgaacggcaggacgcaatatcaaagccgggaagagctacagctccactcccatcgtgtaaacaacagggccacccggaacctctgatcgatgggagaccttgaagccatgacgctcgtacaacgaaacattgctttcagctgacgtctcaagcgatacccgtcgatgatcagactctgaaacacgcagcaatgcttctttgatgagtgcagaacccaagccccgcccggcagattcaggtcgcacgccaagagtcgcaaaatcccaagacgtatcgagccttggcggaagcaccagaccgaatacctcctggacacgatcgcccataatctcagctatctcaagctgaacactttcagaaggctcaggtgcattaggaggaagtaacgcagccacaccatcgcgatttggtgttatcaaaatcatgccgtgctgtaaagcatgagagagatagatcgattgaagcctcaacaatcgcgagtcgtaatccgcctcgggaaggcaccatctagtccaaggataggaaacaaaggctacggctagggtcgcagcagcctcatcgatgtcggcctccgtagccgactgaacaacgtaattcacaagcaaacactaccacagcgactctaggaactcgggatctttctgcaggaagcagcaggtagcggactcgtcgcgcggaactgcgaagcaggacgcaacgcctagaagaagaatggcagcagctcttgtcggaagccttcagacagcacgtgtggctacggactgtgtggctcgcgaatccacaaggagaagcaaaggagtgtttttactttaacaaaaggttgaggggtattttttatgctttaatcaaccacagatgtacaagccttgctgtgtatattgttctgctgtactcaacccccacttattcaccgatatttttccagaagagggcacactaccctatgactacaccgcaacccagcaaacctgcgccatggtcgcttgcctataagtatcaagccatcagcaatgatgattttgacaaccatatggatgacctcagcagtcgccaagaccatgaagcctacggcacgtacaaccccgataacggtgtcatgcccgatcatgtcatcgtgccttcaccctatgaaccatatgatgatgctgcgccgattgatcctttcgactacgacgaagatcttctcgatgagattaaagaagagcgcgctgcacaagcggctgacgcacaagtaacagaaacaactaaagctgacgcagacgttgcagagctcgcagccgctattgacgaacagaaccgcacccacaaagagcagttccctacggcagatcgcaaggaactattcgcctggttggataagcgtcgcccagaattaagcgacgatttcatcaaagcttttgatgatttccttcattcttttgcgtgcctggacaaaacaacgatcaccctattggcgcaatcaccggtgcgcacatccactggctatacaggtacttttatcggcatccccaataatgaaccactgtccgaagagcccacccccaccatttacattgtgcacgataatcacacagggataatccacagttaccccgcacgaatgattaatcttaaatctgagctcggttccgctgagatgattcacgaggcaatctgggggtcaccccatcaacagcagttaatctcatggtatgagacttactacaccaacatctactatggttttaacccacccactgaaccacataagagtcttgagatttttgctcaagacttctgtctgaccccaccagagaaacctccttttttctaaggcaaggcccgtggcacacatacacaacaacccctagagaatatctctaggggttgtgttccgactttaatcagtcatggtcgttgctctatgacctttagtcaatagtaccttcggcatctgcaccggtctctgcaccggcctcagcatcatctgggaatccaagatcatcacctgggaccgtgatgcagtcattgccggtaccagggttgccgccaccgccaaaggttgtcgaaataccagtgtccttttcgccgatccaccagtttccgttctcaccgatgtgcggggtgagaccatccttaccgtcagttccgttagtaccgttggtgccatctcgtccatgtggaatggtcacagtggaatggtcactgaatcgaatagtggtgaaaccaggagtctcttcagtacctataacagtgaggcccgatgcattcggtagagaatatgccattggtgaacctgtagcgtagaacacaacagcactatgtggtggaagggtgtaatcatattcttcaccattgatcgttgcagtaatggtcttgggttcatcactagtgttgaagaccacatcagtgacacccgctaccgcctcaccaacgggggtcgggcttgcagagacacctgtatcggtatcaccgatccaccagttaccgttgtcgccaatgtgtggtgtgaggccatcctcaccaggtgttccagtgccaccctgagctgggataccagtatccttttcaccgatgtaccagttaccgttgtcaccaataacagtgtgcgggatttcatattcaaattgatcaagaatgatgatggtggcctggccaccacctggataactcgattctcggatctcaatgtccacattaccggaaccctcgcccggagcgcccgtgtcaccagtgtcacccttatcgccctttggaccctgcgccttgacaccggtattttcaccattgatgtaccagtagccattaatgatctcaacggtgttagcaccgttggttccattttcaccgtcttgtccatcggctccgttggtgccattttcaccaactgccttgacaccggtattttcaccattgatgtaccagtagccattaatgatctcaacggtgttagcaccatcggctccgttggcgccatcctgaccacgagcaggaacgccggtatcaacgatgccgatccaccaattaccattatcaccgatgcgtggggtgtcaccgtctttaccgtcattgccacgtgcagcagtacaggtgttgttctcaccgatccaccagttaccatctgggccgatgtacggggtcagtccgtccttaccgtcttcgccggtatctcccttgtcgcccttctcacccttgttgatggtgatttcagtgccgttcgagaacaccacaacagtgttgccgtccgcatcgaaacgggtttcgatgaccgtaatggactcgccatctgcgccattacttccatcttcaccatcggcgccagcgtcacccttatcacccttattaatggtaataacagtgccatcggagagctcaacaagagtgttgccttcagcatcgttgctggtgttaacaacagtaattgattcaccatctgcgccgtcttcgccatcggcgccagcgtcacccttgtcgcccttctcacccttgttgatggtcacattggagccatcggagaattcgacaacagtgttgccgtccgcatcaacataagagttctccacagtgatgctgactccatcagcaccgtcagagccgtcagcaccgtccttaccatcggtacccttctttacaatgatcgtggaaccatcggaaagctcaacaacggtgtctccatcatcgttgatgtaggtatcagttacggtaaggtccttaccgtcttcgccgtccttgccgtcttctccatctttaccgtcttcacccttgtcgataacaatggtggaaccgtcagagaactcaacaacagtattaccttcatcgtcgcggtaagtattaacaatggtgatagcagcgccgtctttaccattggtgatggtgatttcagaaccatcggaaaagacaacaatggtattgccgtcatcatcagtcttaatctcagtaatggtgatcgaggtaccatcttgaccatcaacaccattttcaccatcagtgccactggagccacccgcgaagtcgaagccttccagccagcagtagtcaaccagtgcgatcaggccggcagtaccagcaacagcgccgatagcagggcctgcagtctggcccacctgtgccgccaggtcattccatccagccatggttcgtgctgcttcagtgagatcaataccctgcacagcgttctgctgtgggccgtgcacgccgttaccgaggccaatgttgagcgattcaagagagttgttgaactgattgctgagatcctgcccaatgcgctgtgcgtcagactgaatctgggacaccatatgctggaattctggctgctgagacagcagaccaacacccactgctgcgcctgcaacaagcggtgcagcagcacaaatggcatcacgggtggaatcggagttggtagtgtcatccgcaacatcctgtgcagatgccgcaggaacaatagacagacccagaccagcaacagtcagcgcggtaatagaacgcgcagaattcttcttcaaattaagagacaaggtgaaacgcctttcataaaaggtaataacatgctgtaactagttaaaagatgaaaacttaattattatttcccataaagtaattaatgacttttaaactacttttaaagatatacgttatagataactatatgcaactaaactattatttacttattaacttcttacatgtccccagaaaactaaaaaacctttaagaaaatttcttaaaggtttttcttcatgctgctgtattaatccagcattacactggcgttaacctgcgttaacaagctcagggtcttcttctacttcgagatctgcatcagtttcagtgtcgatcacactatcgtcgtcaccatcaaccttttcactctgttcagatgatccaagcccagaagagccagttggcttttctgccgccacgtcaccatctgcgttgtcatcggcatcaatgtcgccacagaaatcatcagcgagcaccgacagcacagcaaggccggtagcaccagagatcaacaaccctgcatcaatatccttggtcgcgttgtagagccactgatcaaactgggggttgaggcttggaagattgaactgtgcacgcacatcttcaacaacacgtgggatcgccggtgccacagcgttagcaatagcacctgcagcaggaattgctgccagcagcaacatcttcgggttcagcagacactgtgccagctcatcggtggcacccttagctggcgctgggatagtgacctcagaaccatcggagaacacaatggtaatggaaccatcgtcattggcaatctgatcgacaatggtcgcgttagcgccgttctcaccatccttgccattttcaccatcagcaccatcctggccgtctgagccatcgttgccgtccttaccgttagcaacaacaagcacagagccatcagagaacgtaatgacgatattgccgttggcgtcagtcgcagtagacaccacagtagcgtcctcgccatccttgccatcttcaccatccacaccgtccttagctgcaggaatggtgacgacggtgccatcagagaaggtgagcttgacatcaccattggactccgtagcgacatcaacaatggttgcgtccttgccgatcacaccatcttggccatcggtaccatccttgccatcaacacccgccttgagggtgacaaaagtgccgtcggtgaagtggaaggtgatgtcaccagtcactggatcaacaacggtgcgatcaaggttgacaacgtgaatcggggtaccagcacctacctgctgagccgtagctggtgccgcaccaacagcagcaacaccagagacaccgactgcaacagcgacagcaatggatgcaagacgacgagaattaagcttcaaagacatgtgaatattccttatctatataaaggtgagaaaaaaactcaaaacagggagtgaaaaaactacttactggaactaatgacggagccgccaccaagaccgaacagattaaacagcgggagaagcaaatcaagcagcttggacagccagtttgtcggcgttggcttcgtggtgatctgtgaaccgtcctcgtaggtaatggtcactgagccgttgtcgttggtaactcgggacacctctaccagacctttaccgtctgacccgtctacgccatctgtgccattgactccatctttgccgtccttaccgtctgacccatcaacaccgttgcgcacagtgaactcagtaccgtcagaaagaacataggtgatgttgccgtcctcatcaggggtagcagattccagcgttaggccagtaccatcaagcccgtcaagaccatctttgccgtcttgaccagcatcaagagtaaacgtagtgccatcggacaaggtgacagtcaccgtgccgtcagcattgtcaacaacatcaatggcgacaacaccgtctcggccgtctgagccatcagacccatcgtcaccgtccttgccgtcatcaacagaggggaggttgccatcgccatcggtgatgttggggccaaacaagccatcaccggaaagcagatcgtctgcgtggcgatgtttgtagagctcaccctcagtgaaatagttatccctagtgaacgcccccgctggttcaccaacagaaccttgcaccttatgttcgaaggttttaccagggctaaatggctctagtgcttcaataccagtccaactaaaggaaatatccgaaggaatattcttaaacgtcgctgttgctgtggtcttatccgctgaatacacaacggttggttcccacgcagctacgtcgtactcgggaaatgcggcaacaaattcgtcatattcaaatgaatttttgtaagaatagctgatcctcgtcgatgtttcctctacccgaggaacttccgagaaaacgtcgaaatcctcaaatccacctccggaacgttcgcgtaaagtggctccgtctgcggctgtgaaattaagtatcacgtcgcgtgtggtgggtgtggtattgacaagcgcaccccggaatccagcaccgttgttattgctaatgacaacattggcgtgcccgaccacgacgccaagtggagctgcgtatgctaatgcgcccatatcaacagctggtggttgattaatcttccagtcttgttcacttcggaaatgcgacacggtctgcgtagacttaacccacgtgtgctggacagtactgataatccacgggtgtccagcaacgccgtagcggactaccttgttctcaacctgaccctcagtcttacccacagtccagtcttgaattggtcgctcacccgtctgctgggcgctactcacccacccgtacagttccatatcaagagctgcggtgcgagaagtagtgccagcatccgaactaaagtttgtcaacgtaccgcgcgtaccaccgttgctcaccaaaagatctgcgacacgaatacctgcatcattgcgtacagggacggtgcgatcgtttgaattgaaaaaccgaagtccatcgccggtgagattaaagacgtactcatcctcggcagttgctgaatccgggatcgaaaactccatctgcaatcgcagttcacccttggtgatgtctcctagaagctcttcacgcttgtcgttgtcactgatacccagctcaaccgggtcagaaaatgacagcccgttcaacgtataagaaacactggtcacaatactgtccggcaacgtcgcagcagacgcagttgccataccaaactgtgccacatgatcagatgtcgccactgccacaccgccaatcgccacagtggtggcgagcgccaacgcaataggacgagcaatccgagatcccagtacaaactgaggacgaacccctacctctcgaccctgtttattaaaagtcataaaaaaccaccttcataaatgtagttaatttactgtaatgaaactaaagaacgtttcatagtaattaacataacacatgtatgaaataattgtgaatactaaagttaatagtttctttattactattattaacataatggccccagggaaggtgctggtcataccgccaaaagagcaccgcagcacagctgcggtcggacactagtgcgcagtactacctcttacccaccccatatataaggagtaaaaaatgactgctctaccctgcccaccaacacagaagctgctctatgcacagatgcgtgaaattgcagccgaacttacagcctgtgacgctactcgcggactccatgccgaagtggctgccgaatggcttagtgacgccataaccggcgaacccacctctatcgagattgacccccaccgcaacctgttctacgcacttaatgttgagcacccgcgactccatgaactctttgccggttacgctacacgccttgatgaactcgaccgcgcaccgcagcagtgtgagtcgcgtcaatattttcttgattatgtctgtgctgacaacccttttggctcagacaaaccagagggcattatcgtgctgctcgctgatcacgtgctggcagcagatccagtgacaaacaagccggcactcaaatcagaggcattccctactgtcacagactattgccgcactcactctgctaaaccaacagacattctcatttaaggattttagtcaccatgacgaaacacgaccatacttacacaacccctgcagagcactcagatccagctgatcagcgcatttttccgctcgctgaatcagacatagaaaaattcgacatgcagctcgatcagcctgtcaacaccaaagagatgcaggcttttccgcacgcccccaccatctttggcactgagattgtgttcgattaactaccactgctgcacacacacatacaacacctctcacacacaaacaagaaagggtcaccccatgaccaccgttcaagtatccacccgcactgtgcgcgaacaccgttttactgtgccagtggactacgctgtcggcgccaccatttcagaaatctatgctgcctgtgccatggccgaaaagaaagccaacaaccttgggcttaacactactaaggacgattgggcacgagtcactgtcactgataatgctgttgtgttcattgtcgagaatgttatcgggaatacttagaattgtgtgctccttaacggctcactgcgacccaaccagccttaattaagacacctctacaactgttagcagggtctttccctatgtagcgcacccacagtagctacccttataccgatacacgccaatccaagaatcgagatcaatctgctggcctcatcgcttgtacatccaccgtacgggctgtgcaatgcctcaccgtcactaaaaaggtgggtgtcaggacaaaagccaaaacccttaacctgatataggtataacaggttaagggtttttacgcagatgagaactgttagaaaatcacttgtacaaattctttcagatcagctcagcgctgattagaggggaaaagggcagataatggacgaggtagtgttttttcactaaccatgcgaactcaattacccactacagataatccttcagtgccaccggtgccaaaaaccccgaaaatctccagcgattcatcttcatcatttttctttgagatgtacgacgtccactctccaccggcctccctcaccaggagttcgccgataagcaaagccacattattgagctcttgctcatcgtcggtggggaaagtgtcacgctcaatgagatctacgatactctgcagtgaaagatcatcaccgacatcaccagcggactcgttgtgcttttcccactgttcaaaggcacggctagccgctttctttacatcaacgagagacaccgttcctgcttcaacaggatagagcaccgaaggtgtttgatcatcgaatgaaggattatacaacttgaatagccgtacctggctcaaaacctgaaggggctgcctcggctgcattgctaggtgctgcgatacctacgaaaacacatgtcaaagctgcacctgcagccagtctcttaatcatccctaacctttctgtcgtatgtatgggactgcgttcgactttacgtatggtgcatgtattttaatagcactgtcagaaatatctatcggaatatttaaatcaggtgccacactgttttacccaatcccttccgtgaggaattgtgacgaggagtaaaccccacgttgaggtcgatttattcaacagcttaaaaaactgatctccgcattggtgctctcatacatgccctcactcagggtcaactgccaccagctcctctagagcaaactcacaccaaactcagcatgaataacgctatgacattgcgtgcgggtccacgtgcggtgaccctcaaccatccctgattcccggcccggtaggaatgcactggccagagtagtacccgcaccaattgtccaggcatgcccattgggacaacactcaggatgacgctccacccactcctcgatattggaatgcatattccaatattagcttacccaggtgaccatggtgcaacgttcgtgctgcatgattgtttttacattctatatatatacaattatcgatttttaaagtgatattacgattataaagaaactcaatagttgcatatgttgttatgttacaaaacatacaaaagatcgcctcagattcgctaagaagctcatccgcaagtcatgtccagcaggaagaatcgcccatgactaacataaccatcatctccatcgttaatccacaccgagcgtagtaagaaaatctaagtactgttaggctgaggttggcctcttgattaacctcgcctatgccacataccaataagtgacatcggctaaaactaataattttcgaaacttcatggtcgatttcgatgggttaatacatgaacctcagataggattctaaatgctttcaatttgcgcaaaaattggatattcgacgacaattgcagaagtggaaatgaacttccgaaagggacaaacatatggtatttgcggtgaaaacggatctggaaaatcgacacttcttcgcaccctgtgcggggaaatccatccaattgacgggtatgcaactatagatgaccaaagtgtcaccgaaccaagttctatcggtaaaattataaagatttctacccccgaattctatcccgatatttcaattggagagcactttaagatactgactaaaaccacaaaggtggactatgatgacgccattaaacgctggaatctggaaaaactccttgagaaatcacctaatcgagtatcgagcgggcagcaacaacgcagctttctagctttacaattgggggtgaaatgcgatgtgattgtcttggatgagccggagaggcatttagattctttctggataagaatcctatcggaggaactgaaagaccgagccaaaagtggtacgactgtgattttagccagtcattcacaagagattcttaaagtttgtgacgaggtaatctcactcgaaagatatttaaatgcaaataaataaagtgatcaaatttgcaatactgttggctgttgtcttaggtatttcgttttcaacggtgtcgtgggtttttgatcaatacaaattgaatgcaaatgattactccccgatatcttcatttgtctggaatctgatattcatcataggtttatcgactctagtagaaaaatttctaccgctcctatcaatctcaaaactagagtggatatatcatgtgagacccttaggccaattgtcttttggtcggtttagcccaatcttgcaactgagtgtattcgctctctttggacttcttgttggtgctgcgaatgggcatttttggatatggctcatgatcagcctcttagctagactagtcacaggcctttttaagagaaaatcaattccaaatcttctttctgcaggtagaagaaaaattttgtcggaagccagccttaacgttttggattctgcactagtcgcagatagcacaacagtcgctcatctaaaatggatagaccgaccccccaccggaaactacctcatactcacttttagaagatttttaagaagaccccatatcgctttgacaatgctagtggtcatctctttcacattctctttttccaatgtttttggaaattttaccccttgcttatttttcctactgtggtccattttaggtgccgatgtggcgcggtgcgcagacttctctaagctaaaaggaccaaaccaccttaaagtcgtgactcttattgtgcatgggttattcgcgctagcgatcatgctaataatcacagggacaatccaaatgctgccctacgggattttaatactgccaagcattctttggacaggaatagtcagaagtcgagcgaggagagtagatcaaatcacctatatagacagcggcgttataggcccaatttccccagaaatcatcaagttctatttatcaggtttactaccgactgtagtagtgtcaattattattgtttccctactaaattaacccctaaaggggtaatccactaccagtaatttctactttcaaatacaaatcctttgagccatgttaatttgatgatgccaatacatggcaaccccaactcaagacaggaaaaccaaaaatggttaatatcaatcgatacacatctactaactccattgcatcagacgctgggaaaccagcagacggtcgcaccacaccaactactgtttcttctgtaatttgcactgaaactatcgcctacactgtcactgctaccatcacaatcggttgctagtaggctacaaatgaaccgcccccttcaaagtcaaaatttttcaataaccagcgaatgggcaaatgccacgttcaacgatatcgaagactctttggaggggtcttttgacatcgaaccaggccaatacattggacgcggagaatacttcgtagctacttctggaacgggttccaaaaagtttatcaaggtggttttgggtgacggtatcgatagcgaactaaatcgtcgcatcgaaggtgaaattcttgcaagtagtctccatcttccatccacagacctaatctctcctgtcgtaattcagtatgtgaaagagtcttctaattttcccggtgacttctacatcgtgtccgacttcaaagacgacacagaaactttagagctatctaaggcttctctacccctcactgacttagccaagatcggagcgtttctctttcgtttggaatctgtaacagttccccctcaaaatcctgcaaggcgagcaatggatgttttggatggactttctcttcttgcaaataaaggcaacattgaaacaggcgcacaattaacaaaaggaactatacaagctcttgaaatcattaatcaagaagcgaccaacatcgagaatgcacttgaaaaagtaactaaagtaggatcacggaagtttttctcgcatggagatcttaaattttctcagttcttaattaatggtgaaaccggaaagattttcctatgtgactgggaagaatgcggtagtgcacatttcgcaaatgacctatgttttctcgcaggtgatttgttctatagcacaattcgggaactggtggataccaacatcaaaaacattaaaggctcctcgatcattcaggaagcctacgataatgcaacgcttgaggctgtatcaaaagtaaatgcaatattaactggctattcctcagagaggggttactctctcacctcggacgaaaaacgaatcattagtatcagaatcggattggctggtctatttcgactttacactgtgagcgctaaatctaatgagttacgcccgcgcgaattagccttagcctccatcggaatgcaaattactttaggtcaagcacccaatctggtgtttacagatagcaaggtggtttaagtgaggaatttgcacgaaacgatagacaagatcaaaaactcaatggtctttttaaatgatcaaacctttacgataccaccgtatacagggcatccagaaacagaaaacgtccatgtaacttcgctggaagccaattcggtactggctagttatatttattctcaatatcatgcccgagcaacagaagtaattcctcttacaaccaagcttgacatagttcgctttctcagagctgatccatatctcatgggcctttcgggagatccgaatcaagaacaagcgataccgaaaatgtcattagtccgatcgcctggattcgtccacagttttggaaatcgtaagtgggttcaaccaaaaaaatcaataggcagaatttacatgtccgcgaaaaacgcggtagagcgaaccgaaatatttttagctactttacaaatcgctgagaatagcaatctaatatttcaggggaaaactagttggaacacatccctcctgcggactgatgatattgtattctactttccgttggaatctcatttctcggaagcacaaaggctgatcaaaaaatttttaccctttcgatcagatgacggcttagttgaatcattctttacttcctatttggcaccaggtgtgagtaaagctgttgaagtcccaactgctaagaacaatgggctcagttttggtatggaatggtccaccatttgcgcccaactaataatcgaagaattttcaggaaaatccgtcacgatcgcagaaaaactatccgaatggggtattcctcagaaggaggcccacgcataatgaccaaagttacgaatgtgtcttggttagtaacaggttcaatgtcggccctatcaataccgggtctaattttctcacttcgctcatcacatcctaaccttaatttcactccctatctaacacaaagcgcaagtcgaatcgtcactatgaccagtatggccacgctaagtggagtgactcctagaaatagtgactgggggtcagaaccagaggctacacccagccacattcaaatcgaatcagagtcagatgcatatctgattgccccagcgacccttgattttctagctcgctttgcgcgttatgattgttcgacccctttctcccttgctcttcaatgtacgaaaaagccaattctcgtagcaccgtccttgccgcctggggggaaagattcaatagcatataagtcactaagcatggacctcttaaagtgggagaatttacggttattgagtcctatcgaaactaaaagtgcttcttccccaaacgcatcgtcatccggcttcggatctgccacacgattaatcgaattcatgttagaaaacctacagggtacttagagtgaaaaaagtttttcaaaatgaaatgcgcacaatttggcaaagagattcggccaatgatcaagaaccgtggtccgagatccgtcggtactctcctgcaaatggaaaacttcctcgcttacccgagcaacttcctcaagaaaacagttcgatctattggggtcaatcggaagatttcacatttaaaatcggcactttgattgatgaatcattctggagtggtattaacaaaaaagcaatcagtatgaccgatgatgacaagagtaagcttattttgaactactcagagaaagctattagtgctttctctgagttctctactagcgcccactgtcgatatctgccggtttttgcacagtacatccatcatctaccaagagatcttcgagaattaaaagaactcctgttggatagccatgtgcgctgtgtatttgaggacgctaacctatcagtctcctcaatattcaaagacatccagtcttttgaagattactctaaaaagtctcatcgaatagttcatggttgttttcgatttagaaatataggtttctcaggcaatggcaaactgctcgtaatctccggggatgatctaatctacgggtctgaaatatttatacaagctgcgatgctggctgatctatttgagctaagttcctccaaagtcgttgctgtaaacaaatcaatgttcgttatgtatcaaaccttcactcaaaacaaggacagtttttatgtaaataaattaaacagatttaccttcctctacctaatctcccactatgtacaatttctttttacctacaaaaaatcttttcctaagagacttctctcggaggcaacgctactgagattcaacgggcctgtcatttagcctttagaaactggatcttttgtgcgctctaataaacagtagtaagagtttcttcacaacaacgacagcgcagttgccttcgagatagtggctgaacactactgtgtacatcatcatgaaggtcatgcaatgtctgaatacttaccactcgcgcaacacgtgctctcccagcgcacgcagccgtggccagaagggtcttttcatgtgccactgacaggacacagatcacagtctttgcccggtggctacgacagccatccgtttcaacatggactctaccaacgctaatacggcatcatggagcgaggccttagcaagcacaaccgctttgtgctgcactcgcatggcactgggcgccgacacagtgtcggtgcagatgcggtgtgggcgtacgtcattacagcgttgaagcaagcttatctgggtcggttctcttttgttgctgaggcactactgttaacacagccaaaccagtggccggctcacgcgcaacaacaatggcagcaactggtactacaagccgatcatgccaatctctacagcgagatttatcatcccagcgtgctcatgaagcgcaacaccggcataattgctgctgctgatctcgtgcttgctgtgattaacaagaatgccaccaccggtggcacggcacacactgttcgggaagcagaaaccatgagaaagcaggtctttaggattcacccagcaggtctggtctaaaagatagtcaacactcgcgcacaccccaagaggatttcctcttggggtatgtagctctttaactccaccgaattctatttttccaacttgtcgctcttacgtttttgcaccactttcaccaaaattacaatgaggccgatcgaaatcaatagcgcaacagtaaaaaataaaagtgcaaaaaataaaataaactccaacgaaacctccttccaacaataaatccgagcaactcaaaaaatttcacacattagtttgcgctaaaatgagcgccattggtatcgacatcaacctgtatccaggccatattttgtatagggaatccctggaataataatgacaaaagagcactcatgcgtacatttcgatcactagtctgctcaaatgttggtgtttcaaaactcattccgatcccagtaactgacggattgtaaaacttctgaattttcgcatcttgtactgtgtaatagtagtcaaaacgaaatgacatcgtagccaaaataatagtcttttgtgccaagcaattagtgttaaaacgatgcccttgagcaaagaattcctcacaatcccgaatagagccaggaacaatcgacctcggctggatcagagaattatttgcatcaatcgggacttgaagtgtagaaactacgactgacccatcagcaaaacgctcaatagtacctttcccctgttcattttcaaagtcctcaatgtccaccggatgtttttgtgggtcgattgaatcccacagttcaccctgttcgagttttcctattaatctattaacttgctcttcagggacgttgtatgaccgaaggccatcacgaacttcatcaatttgctcagccgtgtaatcaatagttaattgatcggtaatgtgtattggatcgacaccctctattgcctcagaaggcgaggcaaaagtcagtgtggaaattaagacgctcaatgcaattaccgtagtagacgctcttattgaagtaagcactttaaaaattatcctcttctagtagttcttcaaatgccagataaaagcatagttttgaactataacacgaatgtattaccagtaaatggcctttctcatttcgccaccccctctgtgaaacaaagccatcacagcttttctttgcaaaatgaatataacaattataaacagggcttaaatactcatcttaggattctgcatataagagccccgacatacactggctacaccctcaagtatgtaaacgacaacacacctgcattcggggacatgctcgataagtaggctacgtctgcctgctaccgctaccgttcttgctgttatctccgatttctgaggtcagtacgcgctcctgtctaacttctaccacccagcccaaccaatcgtttttcaagggttcaccgaagcaactgttgagcacctcatgcaggtcattgagacgcttgatcccgatcagcgcgcagcggtgctcgctgcagcgataccgcgcgaggctaagatcctggggcgaaaagtaactcttcgccctggttggggcaatatgcgcgtacacgtcgtgattgcagttatctttatcaagtttttgcaaccggatcttcgccaggcgctgctaacaacaggtgatgccgtacttgtcgaagatgatacctgaggcgccttctggggcgtcgattcgcgcaccagaaaaggcgacaaacacctcgataaagcactcatgactgtctgtgaaattctgcacaacgtacataatccaaaggacttccccctgaggtttctttttctcccaaggacaacgacagcacagctgcgttcggagacatgctcgaccaaccacccacccgcatcctcaaaggagactgcacatcatgttcctcaccaaagatatgctcgcacgttttcctgcaagtttgaatttgccaatgcacagtgctcagaaccagaagaaatgggcgaatacttccaggtcgttcaaaacatcgccatgacactgggtgctggcgaaagcgttgatcttgttgtccgcgaatacatcaacgatgtggaaggcaacccgaccatctatcacggtatgccgctgcgtactgaataccgcgcattcatcgaccttgatcactgtgatccgtccgctggtgagcctgagcctcgcttattgggggttactccctactggcacccctccgtgatggagaaagctctcgcctttgcttcaagcgatgttggtgctgaattcggtcacatcaacgatgattaccgcacctaccgtgcccacaaagacagcctcatgtccaagttccatacacaccgtgatgatgtcatttcacgtatcactgcactactaccccagcttcgtgcacaagagctgcaaggtcaatggtctgtggacatcatgaaaaacggggaggatttctacctcattgacatggctctcatgtgcgagtccgcactgtctgaactactcactgttacagatgagtacgccacagtcgagccgagtgtcatcaatgacttcgccaaccagctggtcattgattatgacgagcacgatatgggctttgatcgagactttccagcaggtgtgtataacacccgacaagcaagtgctatcaactaaaaaatacacacaaccacaccccaagggacttccccttggggtttcttttttaccacctctactgcacctgttgcacctactgcacctgttgcacctgttgcacctgttgcacctgttgcacctgttgcacctgttgcacctgttgcacaccagtgccggcaacagtcccaaaaacataaaagacaacgacagcaaagctgcgttcggaagaactcatgaacaaagatctggccacctcaatcccttaaaaggagatcatcatgaactgcccaaactgctccgaagacatgactgtcgttgatgttgttggtcgtggtgccagccgaggtctgttgcttattgaccccaccactcacgtctgcagcgactgcggatatatcgaagtactgtaaatcagcacactctcacatacctttacaccaccccataccctttaacccctgcactgctcatccacaagcactgtgcaggggttgtgttttctaacaagaaaagagaccaccatgttcacagcttttaaaagcaatcctacgaccattaaaaagctggtttctgagctcattaatggcgacgatgcagcgctcaacgaactagagcgacacgtcactaatgaatcagtccgtgctcgcgaactccctaatgtccagtacaaagccactgcggggcgcaacttcgccatatccaagctggtccaaaatttgcgtcgcatcaacaaggcacaaaacaatccacgtggtgtgcccactcatgccaccgtgattctgcttaaggaagacggcagctacgacggtgaagaacagtggcgcattccagaaaaggcgatcactccgttcgacatgctacgttcgcctgacttcaaccacaacaggctgaagaaccggccgctcatggtcgagtcccaatacccctggggcgtccccggactcattaaaatgaactgatcaatccctgacacagccattgattccgaggatatgaaagacccccggactaccgcgaaattaacaccggtgtcggtaccggcaactgcatcattgtcgttcctgaacaagcgccgtggtttaagccagccatcatcaaacaggcttaaaaatactcaatcgtcccattcaagaaaagagcacatgaccatgtacaacgccgcaaagacccttgttccccagattgttgctttcgatgacacagcaatcatcgcactcgaccaagccgcggaagatgaattccgcaaggctaactaccccgaggttaaagccaaccaagaagctgcctatatcctggcggaagctgcccaaaacattcaacgcattgcaacagctcgtgccacaggcgatgtcccagcgactgctcgcgtggtgcgcattaagggctctgagaaatactacaccgaggagcagtggcgcattccagagaacgcctactaccctcgcagtatggctgaatctcctgatgctcaccttgatgaccgtggcatctatatcatcccagctcaatatccttggggatacgaggaaatcattaacctaccggcacgcgctacctctacacctgctgttgctcctcgcactgaggctgctccagctacagtatctgatgctgaggtccagagcctgcttgagtacttgcgtactaatgctttcgtaagtcgtcacgacggcgacaccacgaaggccgacatcttcaacaagcacgcggatactgtcaacaagcttgcagcactacgtgcaccctaaacccacaccgcataacccccctgcataggctgatgtccagcctgtgcgggggttattttttcaactgaatcatcggtatcttgccattgttagcaatggctgccactacacctaaggttgcaaccgcaacagtcccgatgagctctgctttgtttttcgctaacttctgcaacaaacccttgttgtctttatcgtgctcacgagcgtactcatctatccgcgccatattctcccgagcttctttcctagtttcttcagattgattcggatcgagcgcaatttttgcccacatctctcgactggctttaatatccgccaaataagcatcagagccatgctcgttacttttaatgacttgctcattagtttcgtccatggaccctgtagcctgcgacgttaaattagccagatttgctgccacctgcgctgctgcggcgttctcgtttggtgtaccggaattcttcggcgaaatgctcattacatactccttagcctcgtaactgtattacctcaagtgtatccggtggacacgacgcagtagtaaaaaatttagaccacccttgcgaataaaaactaataaatactgttcactatattttcgataatttattaaaactattcacccaaaagtttttgtatcaaaatacacatattttaatgactttagctatacttctatcttgtgacttaaatgaaagtcacaaactttgttggggtttctttaaagtaaaatacagaagtttctctggcaaaaaacctcactactttctacagaaaggcgtcttcctcatgaaggcttctcagaccctcacccgcaacactcgtgcacgcaagctcggcatgggtattctcgcagcaactattatggctaccggtgcacttgctggcactgctccacaggcgacagcagcagtagataccactgcgccatacgtgtcctatgtcgttgacattcctggcaaggttggtgaaccaatcaagcctcagtacctcaccatctccgatcagtccgcctacaccgtgaccttcaagtacatgccatcctggttgaagtacgacgcaaacaagaagatgctgtacggtaccccaaccgaggttgatgtctggactcctgaggtacatgttgttgatgctcatggcaacaagactgtccgttacttcaccgttgtagcagtcccagcaaacactgcaccaaccaccaccacgccatctactccaaagccatctaccccgcaggtgaccaccccaactactccgaaggcgcctaccttgccaaagtccaccttcgactggaccttgtggggctccatctttggtttctagttctcactagcacctcaaaaagcaccaccttttaaacaacccttgtactgcaccttggtgcactgcaggggttgttttctatgtgccaacgagttcttaagaaacacaacgacagcaaagctgcgttcgggagcatgtgtgaaccctcgctgtgcccgcacttgcctgcatacagctcactcaacaacacagaaagaaccttttaccatgctcaatgcactcaacgctgtccttgatgttgtcgaatctgctcaagggctggtctttgtcgtcatcactgctagcctgctcactcttgctgtcatctacatcaagaactatccccacgcgccacagcctgctacccaacacaccactgaccaaccaactgtgccagagccgctgcagattcttgacaaccctgctcagacaactgctgctggtctacgccatgaccttcatagcgatctctacgccgaagaaaagagcgcataatctgtgtctcgatgttgcctgggatgctgatgaaaacctccctgttgtcgttgaagtcaatcctgtagcgatgcctgggtgttgcgcctcgggcgcagctgggtgctaacttagcaccgcatcaacgcagcgaagccgcgttcgggtaaacccgtgacaatcgcacggggcttgtttacctgacactcaagccccgtgcaccacaacaacccaccttaaagaaaggtttttccacccatgtccgaattccctacacctacgacttttcacgtcgaaccagaaacgcttagctccgccaccgatctcactgttgatgcacataaaatcgcagaactgctgctcagcaccactgattaccgtgtgttctacatgccgcgtctcgccggtgtgactcctatcgtgtcctacctctatgtctacgatggtgaaaacttcctcattgttggtcgctccactcatgtgccgtgggagtactacgttcactaccccatcaagccatcacgtgaatttggctctgctattgctgtgcctctcgatgattctgatgacccttatgatgcagcagaagttgttgctctagtaaagcagtacatgacgcccacgctcactcctggtgagggttatatgcagggcttttacaagggtctcaccttcaccaaccacctcgatatacatcgaccactgacccagattatctcagactaacagctatattcacccacctacttcatcttgtgcctgagcaacaaccctgcttatgcactcgctgtccctgctgacacactcgctgttaatcccaacagcacactgccagcacaacttgccatcgttgaacacaccaccttaggtgctgttgttgcagtacacacaccagacgcccgtaccggacatcacctctatatccgatccagcgtcactgctgaatcagaggtccacaccggcacggcaacacctgttgaactggtcttttaaaactacttcactttttcgcttcgttttacccacaccagcacgtcaccctcttgcatcacgccgagagggtgacgtgcttttttcctacttttcctcataactacagaagggacgccctcatgtctgcttttgatgaactccgcaagaactaccgctacaagttcactgacacctggccggccaacgctgttaccggcaccggctactacgccaacccagcttttatcatcatctccgctgatgccatgacgcagaacacccatgccgattccaatctcatcacggttaaagagcaccttaacaccctgtttccgtacagcgtacaacgcaaggatcgtgcctttgtctctgagatctacacccctattaacctgctcgaagataatccagaactagctcaagaaatactcgatgtgctcgacaccctgagcaacaacgctgtttttaacgatgcgcactacagcgagcttgaactagagcgcctcaatgaatatgtcatcgacaccttggcctatgacatgaagtccgacatgatgcgcgccctcgttaaggcccgaccagaggccgatcttgaggcgatggaagaactcgacattgccaatatccagagctggattaatctccactcctccactgtgagcgaacacaacgatggcagcgttgatgatgcaccgtttaattctctcgcattagctgagatttatttgcaacagcttgcagaccacactgtctaagcacgctgtgtaactaccactgattttcatcctccgctagaggacacctctgagcacgaccgccatatcgcgttcattgttgatggtatttatgactcaaccaggcgcccctacgtcatgacgtttgcgcccgatcaactccacgacatctgacacagaaagaagattcaccatgtctaagaacaacgcagctcacccgcagtctgtcttccatattcatatcccagcacataccactatgcactctgaccgctttgagcacccagacaacggctatggctacaccattcgtcaggacactgatgcagagaacccgatgacccatcacgatacgaaagatgcagctctctgggttcacaaccgaccacgacgcggagataccgtcgccgataagccagaaggcaatgagattctcgacatctttgccaagttcatctgcggccagcacgataatgatgacaacccgttcgaagtctggtccgacggtgactcggatgcatcactcatccgcaccaaggcgtatgttgccgagcaccaccccgaacttatattcgacatctctgcgaaaaccatcacgggttattcccaaggcgattggctcgatgtggtctgtgttactactgccgccacttgcgacgaacttatccctgctgacagtcttattgacatctaccgccagtgggcttttggtgatgtgtggacagtgattcctgattctcagccaggtctcgcaggtatttatgctgacgatccagctgacgcccttgcgtactatcaagagaatttcgaagatgaacccatctgggatctcttaagccgccacgacgctgacaaagacgccgcagcactggcagctgcctctgctgcagaaaaccacgcactagcgcgaggtactaccccagtcgttatccgtacccaagacatcatcactaacgcgcgatacctcatgtctgatagtgctgatgacaatccagaatacgatcgcgccttggtcgaacttagtgcttatctcttaagtatcgacctcgatgatcgcgttgctgcagagatgaccattttaggtcgccctgtgcctaaagaaggataaccaccacaccagaaaagaagtacctcattatggctcgaaccacacctccaccagctgatgtactcgacatcatcatttaccaccgtgaagcagaccatcggcattgatcttgctgaactgattcagggccgtgcactcggccaggctcaaggtgaggcacaaggcaaagctagtgcagcagcccttgagcaggcacctcataatgagcagtaaataacacacaccacatgtgcacagatacagttagtcgcatgtacgcattctatattctcgacaccatgcttaatcgttcgatcaaacagattgagcaatgcctggatcgacaagacaccaccatcagccacatcatcgccgatagcgtgcacgacaagctacatgaatatgcaacaactaatccaccctgtgacagcgacaaacaagcacttctcggtcatgtcgagcttgagatagctagtttacagatcatcatcacgagcatccatcctgcagagggcacagatatggtggtgtgcggcacagtctcagcatccgcatcaacatggttttataccgttgatgaggtctttacccaaggctggcgcagtcactttgggtcagtgcttgtcgaaggcagcttcgcactgttgatagaccctgacacctttgacgtgcacaatcttgatcttgtcggtcaacaacacgtgcactgggtgccagctcgacagccgtaaagaagttgtaggtctttttcgcttgggatactgatgctctcccaagcgaacatgggcgggagcccatgtcggggtgttgtgcgaatggctgtgtgtcaactacctcagcctgagaaaacaacacttataaagaaagaccttttactcatgacttctacaactaactccaccgccatgttcaacgaccaccttatccctatggcagagcttgatgaacaagctctgcgcgacagcgttggttcttgggcacagtacaagcacccgcttgaccagcgcaaagaaccagagctcgtccttattcgtcgcgtcaacagctcagagcgtgtgtgggtcttaagtttcactgacctgcgtgctgatgcaggtcttgtgcctcgtagcacaccgaatgctgacccctccaatatccgcaataccattttctctgtcgctgtccgcgatcttgtccttgatcgctcacttccccggctgcttaacctcaacgggcaaccaccagcaggtgaatgggaagaaggctttgtctacgtcgattatgaccagagcgacaccgtagatggctacctcattgagcacagcgaacctgtctccattgaaagtcaaaccaccggtgaaatgcactatttcgataaggtgccaggcggtgtggctgttaccaacaatcccgatggcactgaacaaggtgatgcacgccgctgggtaagccactgggaatcataaaaaagaaagtagcactagctatgcctaatcacccacctatttccaccttcgatgaccgtcgctctgctatgcgcgaaggcattactgattaccttgccaatacaaatgcaaatgggttaggcggttacagcatcagcgacacccacctcgacaatcttgctgagaaattcacccgcacacatggtgaagcacagtacgatgccggctttgatcccaatgatcttgaaccagagacttttgttcgtgacattgagatgagctgggatgagcgtgctattgatcgtgccctgatccacacacaactgtgaagaaagaagccgcaatgtccaccacatccacctatgagagccgtaaggcagctattcgcgacgctattctcgcctatgtcaacaacaatcaaggctgctgcaccctacagccttcatgcccatgatctcgaacagcttgctgtagatctcactttagttaccacctttgatagcaatgctgcagttgatgtcacgccaacacatacagaagcacctggttttaccctgcatgagggcaccgatactgcgcctatggctccaaccctggtcgtacctatttccagcgacatctccacagccgtttcggaaatatctacattagtgcagcaggctcgcaccgacgcagcaagcgccattcatgaagcagaagctgaattttacaaccaacttgctgcggtccttgctcagtgatttaatgtggccgacacacccgatcgcgtgccagctaaaaacgccctgtttcacgggtattcgcctgactttgagtcagcaaaaagcgtgcattctcacaatagcaacatctcaaaaactagccctgacctgcacagtctagactcactcgcactttaacttaagcctcacatactttcgtcacagtgatgttacgtaaccacctcataggtcgcttaaaaatacagacccttgagggagtgccctcaattctgccaaaaaagcaccaccgctatcaccagccatcaccacttcctgtgcacgggttgaggcgatcgtgttcctgtctgggcactgggcggtttatgcatgtttgttgcacggttactgtacgggctcatccaccacacctacccttgcagcagtacattcgtactgctacatttttttaacgtgccaacaagtgctaactcaccgccgtccaaccactaccccactgtcacccgagcgtccaatactccaagtgtcggattagggtagaccctgacacgacactgcccacagcactgtttagactgtcggactaagcggtcccctggcatttcccaacagtgtcgggttaagtctaagacttattccgacagtttattcgataattatgcacctactccgcaataatacactcggtatacttttacactcagtgtatattgttaggtctttgcttagagtgggaattggcacaacacgccttaacaatacgcccgtatcgtttcgcaaaagaacgtactttagttttgttaataaaacccgcgtatgcatatgttgacattgacaactattgttttaaacaagtacatagttttgtgttttctacttccctactgctgtaataatggaaagtagttttcatcacacaacacaaaactattaaaggtagtcttaaatgtttggtagtagttttaaggaacaaacaactaacccgagaagtcaacgagtttcttatttgcgtgtctctagcaccgatcagaatctggctcgacaacgtgaagctgttaaccattccggtcatattgatcgtgagttcacagatgagctttccggtggcgccaaatcacacagacctggcttggaagactgcattaattatcttcgcgaggatgatgttcttgtcgtcgcatccattgaccgacttgcacgctcgctggttgatttacgcgtcatcattgaccgcatcacagacaaaggcgcatcggtcatttttctcaaagagaatttgactttcgctgcaggccgcgatgatcctcgagcaaacctcatgctcggtattttgggcagtttcgcagaatttgaacgctcaattattcgcgagcgccaagcagaaggtattgccctggcaaaaaaggccggcaagtatgcaggtcgcccaaaagccctcgacaaggaacaaatacaagaagcaaaagatatgatcgctcaaggtgaaacaaaatctgctgtcgccaagcattttggtattaatcgctcgaccttgtacgaatatctcaaaaatcctgactagattgagaatcaactatgcgacaagtcaacttgcataccagtatccgagcacatccacccccgaaaaaattaggtaaagcttgcctatttaagaagaactgctataagatcatccatacatgcagagcacagctttcacacatagacatcactgcacatttatctaatgggagactcaatgacagttgcacacaaacgaagtctgacatggatcaagagactatctgcgactacatttgcagcttttcttggcattcagcttgtgacccccgctcactcaattgaaaacacgacgcagattccagaaagcgaattgcacaacctcgggctcacagacgaagaaattcaagaattcaatcaatatctcattgacgagtcactctttcaagagactgtagaaacctctccgatcgtagtcagcgacaatgaagatgcagcccaagatcccggtttcggccttttcaccacaaatcctgtgaaacacacagatgagcacattggcgctctatacttctccgacctaccaggtatttccaatcttacgtgcactgccaactacatcggtggaaaattctggaccacagcacatcattgtgttgaaggccgcagtcgcttcgtcggcttcatcgagcagtcggacggacaatatgcaggcattgagcatgtttacacaaagtcaagtgactacgatattgccctcattaaagtgggatctggaattgacgcagaacagttcagcctcactcgatcacgccctgcggttggaaaaatgctggaagtcgttgggtttgcagttgtgaacccattctcctctagagcaacaatggaagtcaccaactcaaacacagtcgcgaactatcctatgagcaacctgtactacaaagacgtattctcggctaaacccgcaggatcattcccttatgtcatttccggaggtgattccggcgcagctgtttggtcgggtgaaaccatgtacggcattgctagtggctctaacggcagcactaaaaacctagcagcaaatgttggaccgcacgtctcttggatcgaacaaacgatgcaaaacaatagcaattcctctccctatgaaattttgcaagcgttccgaggcggccttgcaacgtcttaccccaaatataatcaaattagagacctagtcgactcaagtagttaagaggaaacaacaataatgttacgaaaagtatccattgcattggtcgcatccgccgctatcttggtatctgtacctttcgcacaggcatcgacctcagtggcactgtcgtcagaaagctcagattctctgggaagtattccaaacgatttaattgggggtctagccggttactttaataaagatcttacggaggaacagcgcgatgctattcgcttcggccccaccacagcacaagaagcagaacagtgcttagcaaaatacggacttggcggtgaaggcccgtggcctactatcgcggtgtaccctaactgctctttcgagacaattgaacaagatttctatgatcaagcggtagccgagactctcgcagcaataggcatcgggagctcttaaacaatcaaaggtacaacccaaaaaacaaataggaaccctgtacagagatctctgtacagggttcctatttattacttacacaacacgtagtgcccgaaaaacacaagacaacagtggatgcagtggtgccagttgtgcgcgagagtcatgttgcacagtactggaaagaacgaccctaaaaacaacgacagcaaagctgcgttcggatatattctcgaactgctgtagtgcatacgctacagcccgctaccaccgtaaaagcgagaacatatcatgactgttgatctctaccaggcacgcattccttttcagcgcgatggcgtgcgctttgatcatacgatgatcacccacattcaagccggcctgcatcttggtggctgccgcgcagcaggtttactgcctataccagcacatattgatcatattgtgcgcctgacagccgcagatttctatgacacccagtcagcaccgcagctgctcagcaacactgtgcttgatgtattggacaccaccactcaagacttgaaggcattgtggcctgttgcagaacatattgctacaaccattcctgaatctgagaacgtgcttatccactgccagatgggtatcaaccgctcagctgcactcatgacacgggtgttgatgttgcgcaacgattgcaccgccgatgaagcaattgcactgctgcgtgatcgacgctcaccgtttgtactgttcaatgagcattttgtggaacaacttcgagcactgtaagcgctcaaagacccattaccccgtgaagagaacattctcttcacggggttcttttttcttgcacgggtgatggttgatgtgggtgtctgcgcaagaagagaaaaaacaacgacagcgaagctgcgttcgggcgaatcggcgataatcacacaccactcttcctgagagaatcctgaggtcatcaccatgtcaccgaacttccaagctcgcggtactactgcgcccactgttgctttgtccatgcgccagatcgcgcacatccgtgaagaaattaagaaatcaccactcgctgcttccgttttcatcacacccaccaccaaacaaatggttgtccgagatctagaatcactgttccagcagctctaccacacagatctacctgaaccatccatcaaagacagtggtcttatcagtgctatcggctctagcgccggcaataccaataatccagcactcgccctagaaactcagatggcttaccacctggtgcttgctatgcaccacaccgatgttgctacctggcacaaggtggtgaccaaaaacatcaccgaatctgctgctgcacaagatgctgcggtcgagcacagtgctaaatacgatgctgtgtacgatgccgcacaacttatgggcatcactgttgaggaaggtaatgtcggtagcatcgctattgcctttagcacagcacgtgcagacggtaaatctgattggtgtgtttccggcatcagccgctacatcgaggtcaccgaagccttggatgctgcgcgagctgtcactaaaaatactgctgcgctcaataaaactgctctaccagacgtgcagccggcgccggttgtgcattcagcacagttcatgaacaagtccgcacacgatcatggggttaatactgcggaaaaagatcaaccaaccctgttttaaaagactgtccatttaacaaccacatcgttacccccgaacagtcttttaaaggctattcaggggtaattttttcgccacactcccaatatctaccaaaaatggtgatctattatacataatggaattaccaaagcttcatatcacttttccacagcctgaaagaacatactatgtccgcagctttacctcacacagcagcagatcccgtacacaccaccccagcgaaaccgctgctcgatcatgtcttagattcactaggacgcagcatcatcagtggtgaaatggaagccggtagcacattcaaactgcaagacatcggtgaaaaattcggtatctcccgcaccgtcgccagagaagccatgcgtgccttagagcaacttgggttggtggcctcatcgagacgaattggtattacagtgctctcgcacgagcactgggctgtctttgacaaagccattattcgctggcgcctcgaagatgagcgtcaacgtgaacagcaactgcagtcactcaccgaacttcgtattgccattgaaccaattgctgcacgcagtgttgcccttcatgcatcgagcgcagagattgctatcatcggtgatcttgctgcacgaatgcgtaacctcggtgaagctggtcgtggcgcatcacaagaattcctagacgcagatgtgaaatttcatgagcttattttgcagtattgccataatgagatgttcgctgccatggcaccacccataaaagctgtactagtcgggcgcaccacacttggccttcaacccgatcgacctgccgaagaagtcttggacaatcatgatgctctcgcacacgcactaagtgttcgtaatgcagacctcgccgaaaaagcatccaggagcattctgaatgaggtgcgcgacgcactgacctcgtaattgccactaaacgagtcactacacaattacatcgctcattgttacttaattaccctttaatagtcttttacaaggctgttaaagggtaattttttattagtttgcttaaagcctattacatgacaattacagcacaattgaaaagtcacttaagcgcacgctaaaagcgaattgtagagggttatttttttcgcaattaaaagccttttgcgacacaaataggacaacaaaacaaagatgcattaactctaaaagaacaaaattaatcaatcagaaaaacatattgaatacttataaatttctgacatactcattaatgagatattcgaagtctttatcaaaatgattaacaaaaggagtatgtttatgtcgctaaaaactcgccgaatattcggcgcacttgctgtttcgctatcaatctctttctcagccattgctacacctgcagcatccgcacaagaactagtggtgagcacatcagcagtaaacgaatttggtgtagttaccagtgacatcacggctgagcaaattcttcaggcgcaagatctaatcgctgagatgaaacagtcagaggacatatatgagtatttcggtgccttgtctgacgttgaacagagatccatcattgcagctgtaaaggaaaatccatatctcattgagaacgaatcaccccgtatgagagtccaaagtgaaacacccgacgaggaaacacctgataagaaaaagccgagcaaaacctacaagctctatatgagcattctcgaaatgatgtcatgtatcaatcttgttgatgttccgtcatgtgcccaagcccttaaagcggcaaatatagctgaacgcgaggccaaggcccgttaccccgattcggtcactaatggtaaaggcgatgcccttcgtcattgtgcatggagcgctctcatgactattcgaatcggaaaagatgcagccgaaagaattggtaacgctcatgaaaccgttgtgagaggtgaacccgaagaaagagaaatggatctcatcaataacgcgctgggtagagacatcggcgaaagattcatcatcaatggcgatgaaacgggtgcgctcagtacttgtgtatccatggctaatatcgggctacttcatactctgttgtaaacaaaggaagtttctatcatgaaaatcaagaaattcagcatcacagcgctagcctcagttctaatgctcacgggttgcgcgaccaatcacagctcacctctgtacagttatctgaatgcgtcaacatcaaccactgttgaacaagtacgtctcagcgatctttacggtgagcagtggaccgagttcgctcttgtctgcccctacaccacaaaagacgaggtaaaagaagagcttggtataaaaataaacacctacctcaccgattcgaccgatgacagtagtaacgatattgtgctcagggataaagacggttcatatgattggatctatttcaacagattcgacattgtgtacctctgcaacggctcagcggaaaatctaaaaatctaccccattgattcagttctagaatttgagcatagagacgactacggtacctggaaactgagcgctatcacagagccgggtaatcaataataacgcggacacttaagtaccttttatcggtcgattaagtgtctactgtttatccgctaccaaaccacgccgctaatcgttacttaattaccctttaatagtcttttacaaggctgttaaagggtaattttttattcgtttgtttttgggaccattaaatgtcaattacatgtcgagtaagtgacacttacagcgcaattgaatagtcacttaaacgcacgctaaaagacaaatgacagcgaagctgcattcggatacacacctgaagaacactcttcaccactagcattccaccaacgcctcggaaagggctatctccatgtctgttgacgatctttacgctgttgctctcgatactcacaccggtaagcctatcccctgcgtactctgtgaaaatgctccacagattgttatctacgatggttgctgctcgcttgcatatacccaagcacttggcgatctcgccgaagcggaatactacggcgccgatcttgctgcagctgcctaaacaaacttcatagaacgacaaaaaccccgcctcagaatattgcacaacgcaatagctgaagcggggtttttgttttctgactcaaggtgccagtttccatagtcaagattcccaatcaacatttaagtatatgtgaattattaaagttatacaacttaattaatcaataacttctcacttcaccaacgcaacaaccccgctatcaagagttgcatcaaggcaacaaatgaagcggggttgtgttttcttgcaggcttcgtcttaaggaaactaattattagtatataccaacacaaaaccattaatcaacttagttattatatatcaccctccatataacccattctggattgcaggattaccacatacacgcctatcgcgtttctctattttaattaatataattaatgtagtttattaacctattatgcaatgacattttttaataattaaccacgtcacaacattctctcagatcacagaggttcgctcatgcgccacaccacgtcagccacatcaactacatctattattaagcgtgctatgaccattagtgccgctgttcttattgccagcgctgttggtctcacaaccagcgcaagttcgctcaatactctcagcgctacatcacctgaatcacccgatcaggcagccactgtgtcacaggctgaatcagatagtgaattagatgacggcatgaaaaagcttgcaaccaagatccttaatcgcgctgacaacgctgaaaataatgatgacaccggcaaaaacctcaacaatgatgataagaagctcaacacgaagcagccgcagcgccctgctgaaaaagttgcccaggcgatcgagctaagccttgataccaccacgaatgcagaaaagcctgataaaagttttcaccatgaaaaacccgtaaacgcctatgtcacaagtgtcagctacaacaaaagcaatgacacctggactatcaaaccatcagacagcgcggtgaatacaccgaccaatgatgctgagcgcatcagcaatatcatccaagaagctcgcgacctcggtctcagcgacgatgaatccttgacgcaacagatcgcatttcacgctcatgctgctaattatttagtcaccgaatgggtacttcgcggctatcagcttgctaacccgaaggtgcttccatgagaaaacaacgacgcatgatgatggctgtagggtgtgccggaatcttgagtaccctcgctgtcggcctcacggcgtgtagcaatgacgctgcgctatccgatttcttcgagtcggcatcgcttcgagatcatctcgctgcgcacacaccaggtgaatcgtctcgtgataccgcaactgtgagtgtgtctctacatgagttctacagcgtgcaatggactgacttcgccattgtatgcccaggaatctcgcgtgatgacattactgcagctcttgatagtaccgttgttggtgataattatgatgatattcccgcaacaggtttacccgacacagcaagcgcactcgtgaccaacacccatccaggagcgtaccggccagacccgcctctaatgcagagctcaccgctagacaagtagtgcactttaagcttgccgcgccaaccgccccgtcattcgccccaccaactctgttcccaatcgtaagcagggattgatgagacaagacaatgccaaaacagagtaaaacgatatcattcctataacaattatgggattttgtacagtaagtcacatttcgtgaaaatatatgcaacagtagaagtcaggcgagatcgttccgcaacttgccaactccacacacacccatttcactgattggaatgtgacatgaggaaactagcttcgattggtattgcaatagcattatcgcttgcaatcactcctactattcaggcgaatgaaataatcacgcctcaagccatggatcgaattgcagtaaagtgcaatgtccacaaaatttggtcggttccaagcttgaacaactatgacggttgggtcgtagttggtcatgcctattctaaggttgaggctgaaaaaagggccaatactttcgtcccatttggtcatactaaacgtcattgccttccggtacctattgaccgctttccgtttgaaggacttaaccgaagttaaggtgctaggcgaatcaactcatgcgaaaaacttatgtctttctaactcaatttattgtagaaaaaggcaatgaaagtaacgcctacaacagatatcgcgaacgagtgcagaatctattggctctggacggtgttgatgtaatttcagtttctaaaaaccttcagcaggctgaaaaagcttatggatgggagtcgctttccgaccaatatcaaatggagcacgacggtaaatatccagaaaaccatattctgtgcgatgtttacactgtggtcgttctaaatgacatagagaaatttgaagaagctgctgaactcttgatcatggatgaccgagacgtgagtgttgatgctttccccagtcgcgtcgacgctttcgaacaggtgctgttttagaagggaaatagacagcatcaacgcttcgcgggtaagccagcagagcaagattcatgggcatgagtcgtaagacagaccgtgacggcaccgcatagccactgtacagttgctgttaactaggactatctcttttcctgccctgaatggcgagcagaagatcgttgcgtaacccatcagaattttctgcaaccaaagaccgcactttgtatcagcaaagtgcggttaataccaattcccggaaagtagaacatggggagatttaatgaggaagcagtaccgaacatgcatgaaagagagacaggcaaatagccgaccagagcgtataaaggtaccatacacaccctgtcaaccgatgacatagtcattccacccgaatgagtagtcacacaaccaagacaaatcacaactgtattaccccaccggatggtgtaaaaagcacggaagacttgatttaaagggtccactaccgattaaggcgattgggtaccggaattccagaaagtcggtacccaatcaccttaatcggtttcttacttactctggaaaacaactccctaggaagctgttacaaacagtcactcatcaaatcctgaatcagtcgcagtaccttctgtggattgatcactgtcagcgatggatactttctgccgacgtttctccatcagttttttagaacctccgaccagccctacacctgctaacagcaccaaagatgctcctacagagccctgaaccctgcccttgtgcagtcctttattaaaaccatgtccccactgcgcactcatatgtactccaaactattgacatctacggtagatacgagtctagtgcgatctcgatgcagtgcttacccgcaccaccagcagaggtagcgacagttgaaggacacctttagtacgattaccggatcctctatcatttaatgcagtcgccgctgatggtgaaatttattcacctgactccttacacgctatgccagaattaattgaagtcatgacctcagcctcatcaatcgactatagaatctgcgatactgtagccccctaatcgttctcgagtgaaatcacttcttccagtctccagtgcatatgcgacaacttttcgcttcccttcccagctaaaatccgtgaactgtatcttacctagttctacatctacttcagacttggttatagcccgtagagaatcaggtacgtaccgtgaaaacagactatgctgaaaagaatctatccatgcaccaccgcttggtccctgtcgcgaagaatacacagtcgttaagaaaagcactccaatatctatcacatcaaactgatgttcctctataccactttgcagagacttcagcactgaagaaaaattcgagcttttcgccaaaataccaagcgaatatggacctaaatcccaatctgaggggtcctgattcttcaatacacttaaaattctagcttcggtctttatattaactttacgaaaaagctcaaggccacttacatcattaccacaggctctagccctttcccccacctggtttaaccagaaagcagcctcattaagcgtcatctcagaaaagaatttctcatagagttgttccactggtaattgaggcaatgcaccaagaatcgagcacgcatgggaatacaggtcactgaatatgccgctcatacgcacttgacgacctttatcatgcataccattagcagcggtgaataacacctcaactgccatgtgcctaacaccctctccatcaagtcgatcaattgctagaggaagctttttcatcactgatgccaccatgtcattgtcatcggagttaattaaatcgacgaaacccatagcatcgtccgcattagatagatacttatccaactgttcatcacttatgacatgtccaggtctttgaaacatgaggtacgtgtcaaaataaacttccgtcgagatccccctctcacgatgcattctcgtactagggtgatccgaaagacgtgggaaaaggaacaaaagcatggtctttaaaagatccatctgctcgttgttcatcccctcacataattgcttttcccaaccgggtttctgcgagcctgtcgttcgacctccttgaagcaatacttccttcgctcgagaaagacgtttatacacagacggaaaaacaattcgaatggtcgcaagtattgtgagatcaacgccgttaacttcacctgatccatatatccgagtccagttggttagtagagcagcaaaacggtgcaacagcctcggcgtgaccagagtcttttcccagacatcgaacattctcgacttcactagtgcaaagtcttcaggatcacccgatagcgaaacaccctggaaaagcttgtcaaataatgcactgagctctttctctatttgaaatgatgtcagaggcggaacatcgaaaggatactgcacgattttctccatgaaacgcaaagcatcatcttcgctaccacctacagctgtcgatctggctagcgtcgttaacagtgattcttcttcataaaccaaaagataattcacctgcgggaatcgtccaagcaagcgtattactttcattaacagcgccaattcatcagtatggaggcgatcaatatcatcgacgacaatgagaattcgcttgttcagatctttaaaatggttcgcagcacgtgtatacagcgttggccacgaatcttgctcctgtttccatgtcttatatacagcgtttgcagcatctactccttttgagagcgcaagtgcttctaggacaccaaaccctccgaccccacctgcaattgacccaatcgtgctaaaggttttctgcagaacagttttgatcttttggccggtcttatcatcaggtaccgtcccaacgattactcggtaaaactcctcaatcaaagattgcgggtcagaggccacccacgggttgaaatcaacgattgtccatttttcgttcgatagagattcttccgagcgaatcaaattaacaagagatgtcttaccactgccccactgaccagtaagactgaaaacagtgctcgctccccaaggtgccacatcgcagattatatttgccagctgggctgaatacgcagaacgctcgaaacgatcctcagagatcttagtaataggcaagtctcgaccagatactgaatctccatcagtttttaccgtgttgttttttgccgcatctgaaaatggggtaaacagtccgctcatttctagcactgtaccgtgctaaatcttggcacatgcagcaatatcggtgggacacatcatccatcgctgtgtgctagaaccgccgtatgttaataaggcctactacgcccctgcagagattctagttctccttcttaaaacggatataccatccaactcttaagtcgccgtatacatcgacttttcggcttcatatgagatgctatttacctacttttccagtggtgtgtcataagatccgaagcatgactgttttccatgattttgaaatagtagttaccccaaatcctgatgccccagaagctttgcaaaaaataggagaacaatactggataatctcggagattaacccagatctgaaaactgttcaatgggcgcagaatgtctcagatattgaccatcaaccctggtcatcttccgcctacctcgctgctgcagcagcagtggatgctacagtccctaccgcacattgtagtgcatgtgattctatcttgacgttaacgtctcgtgccgcagtgagcgaggtactacgagagcgacctataaagtgcaaaaagtgtacccccaagattgatgaacacatcaaaaaaatattagacccagcagcccaggcgagacaaaaagaacgcgctgcgcgaaaacgggaagaagactgcaaaagggcgcaacagcggcttgcagatcagaaggcgcgagaggcgcgacagctgctagatattgaacgtcagcaggtgattgcagatcgctatgggccgttggtgaatatgcatagcgacgctgtgctagcgggtgcttcaataagagcaaaaataggtgctctcgcaactatttacggtgctcaaaacttagagaatgtcattcactcagttagttttactgacagacgtatttctcccgatggacaactgtcgaaagaattatttcgcgaagcttggagcgcaaaccttcttatccctgatccatcttctgatgtggaagcgtttgcgtggagcgaaaagaattccactgagctagcgggaggcatattcgttgagaaaatgctatttactgtcccggacacaggccgctccaataaccgtgtccagagcttctcagaagaacttcgtaaccacatttctttgaaagatatgtattctacacaacgtgaagagctattagaccttgcctacgagctcatggtgggggaagcagtacgttttgctaacttccgcctttatgatcagaatctcccaccacttactgaagcaaatatagacaaattgagagcccatctacgtgaggccgcagctagtgcgtcactaggagtgttatatctaatggtgtggcgatctgtaaaagacgcagctgcagcgcacactaaacatacaagaatgagcaaagaaaatgcgacaacgcatagtgttacaaaagtttctatctttgttgaccaattattaagcggaacattcccttgttcaaagccttttcacgaatcttcacaagtcccactgagtgaagccaccaagatagtttttaatttgattatggagtcaccgccgatggaaactgagccgagtgtgctgcgaaattccctccaagaacactcggattgggagctattgcaacagtgtgatgagaagattcctgatcgggagtttctgatggagtggttatatcaagaacagacgtggactgcagagcaattttttgatgctctagctatggtttcttctagcgagtttcgtatatgtgcacctggatgtgcgcatcaagtaagtgcagacatcgctacacaagtcttagaattccacgatcgagtgtctttccatgacgatcgtaaaagcgccatgcttgctgctgaagcaactattattggtaacaaaattggttcacaagcacgggccggagactttgttttaggtgaagtaatcaccaagctgcagaacatacctggtgaggtataacttctgcgtcgtccaattagtctatgactatttttctcgacgctgatggagaagtcgtggattttcgcccgtaaccaccaagaactcgccgaggtactcctcgaacatctcgacatcacccatgacagcgatctcgtgcgcctcgcagcagcgtgtctcgactgtgaggtcgatgccgtcatgtgggtagaagacaaagacaatgaaccaccactcaacagttttttcacactcagtgcagtgacactactcaacatctatctatagaaaagccatcaacgcccctcacagaaaaagtgatgaggtgttgatggcgttgacagagttgccgcacatccacaggcgagcgcaaacaacacacctgcgacatccgtgtgaatttctacccgtcaatgaccacaaggtgaacccgtggcttactcaagtgaagtgccccaggttttgttccgtttgagtagatgggaaaatctgaggcacttcataccggcacacttgatctctgtgcacatagcgatactgatgttcagttccggccactcaacacagcgctgacattccactacaatgcagactctgcagtatgggaactcgcgccatttgactaacacatccacaaaaaataaccctcgtagtagcttaaacaagctgctgcgggggttatttttttacttttacatgcaaacccatacagtgactcctgccggcaacaagccccataaatcgacgtgataagccggtgcgacttcctccgggagattcctgcgaactcactttttcgaccatgatctcccatcttttgatatcctctccaccctaaagagtggagattccggctcaaagagcggtggttcaagctgcctctgaattacgctccacgaaaccctcaagccccggagctacccaccctacggggagtgaccacaagtgagacagatcaggtctaaatgatgtgcgctcctcttcgagcacaagtgcagcaaagtcttcttcgagtgttgcactcatgagagattgacctggaaaaacaaaagaaatttcaccaggcgtggaaagagccgtcacaaacaccagatggaccaattgccctttatatatttcttcacgagcaacatcagccttgttaatatcttcccattcaagaaaatggttcttcagcttcctacccttcagaagcttttcaatataatcacgtccatctgagccatctaataaacctacgcagcattcatagcttgaatgctgctcagaaaggaacaagagaatcagtttgtcggaatacatgcctcaattctcctatcctattccttatttaactacggcctatcgtacagggaagataagtcgccttattgatatcgcagcccaatacgcgcccctgcttcagcgggtccgacccccggatggtggacacggaggatttgatcaggaagcagatctcaggatagcaggaccgcgctcctcaaacacgaccggagccagatatctacaccaggaatgccggcgaaccgtgttgtaacgggtacaccagcggaagacgtcccggcgacagcacaattgattttcaaaggtcttggaatcctgcaggacttcccgcttcatcgcggcattgaaagactccgccaaagcgttgtcagcactggtgccaattgatcccatcgactgcctgatccctagtttcttacacgtctcctgaaacgcatgagacgtgtaaacgctgccgtggtcggagtgaaaaatcgcacctttgaggtttccacgctggtctttagccatgagcagcgcgtcctggaccaagctcgtgcgcatgtgatctgcgatagaaaagcccaccaacctgcgggagtaacagtcaatgaccgtggccaggtacatattcgacccatcctgaattggcagataggtgatatccccgacatagagctggttcggcttgtcagcggtgaacttccggccgacaaggtcagggaacactgtcttggttttgtccggcacggtggtggtgaccttgcgtttctttgtgtatccgaacagcttcaacgatcgcatgatccgggcaacccgcttgtggttcgcaaggtcatggccgatctggtctttgagttcagccgcgattcgtttggccccataacagccactgtgagtggtgaatacagtcttgacctggaccccaagaatagcgtcgctgagcaggcgtttttcacgcgtgaaggcggtgcttttccatttgtaatatgaggaacgattgagcttcaacacgtcacatatccgcttaaccgagtaggtctttcgagcgtcatcaacgaatcggaagcggatcaccagttcgtctcttccgcgaaatatttggccgctttccgcaggatgtcacgctcttcgcggaggagtgcattttccttttcaagttggcggatccgttcagcttcggacagcgcggtggccgtgttagcgccatgtggagttgagttggccccgtatttagtaatccagtttttaagggtcattcggttgattccgagatcattggcgatcttctggatcgaggtgccggcggagttctcgtagagcgcgacagcgtcgcgcttgaactcctctgtgtaggtcttgcgtggcatggtggcagattacctttcccagcatcatgcttgtttcaaggtgtccaccatccgggggtcaggtccagcttcagcttttgaacttctccacattggatgacatcaactaagcgagtgcggacatactgcagaaacaaatggtttcctcacttccttctatgaaatccagctaggtgcagcctctgagctccctactagaaaatcgcgcataagttccagtacaccgatcacgaatggcgttgcttgacatcctccccgccctcgacgtgcggggctggcgcgtataccgagaggtcacttctgcatcaacaacgcaaaatactggataaccaccaacatcaatgcctgtattaatagtgctgacatgctgcagcctctgcctataaagcgcatcaacacgagactgcgcactatcatgcggtgagctgtgaaattcttttgctaaagtgcgatacaccataagctctattgtcccctacgtgctcgtttctggccttttagtaagcaccaggaataagcgccgatgaagacacaatcataccgacaattaatcgtgccgatatgagctcttaaaagacagcataaaacgagtttttcaaaagcctattaagtgtcaattacgacgtgcattaatagatactcaatcaccttaaattgttgacacactccactaaaacaggtctattaaaagacaattgaattacgccctagtagtacttgtttcaggccaccacttagaaggcttttaagtatccactatgtatcaattatctagaacctttagtgactttgaaacggcagtactctattggctcttaatggtcaattacataacaattatattgagcctttgaaacaactcactctgctgcatattaaaaggtcgattaactaacgattgaattgatccttaaaaagcctttatctatcgcattatgaataaatatttaatcgacctttaatagtgacctaaaagccttttaaaagccaacgcattcagtgacttttaaaaggctattaagtgtcaattgaattgccttgttactggcttttaaaaggctattaaagaacactcccctattgtcttttaatcgtcacttaatcgacctctaaaaggtaactaattgactcttgagtgacacatatttaattgacctttaagtaacgattataaggcaattaatgtgaccaaataaagacacgtaactgactaatctttatctgactattacaaggctttaaaagagcacttatgtgtcgattaagtgtctacgcaataactgtgctttaagaggctttaaaaactacaattgaatcgaccactaatcgttacttaaatgactattaacaaaagtcacttttagagcaccgcaaaagccttttaatggtcacgcaataagcctttaagtaacaattaaataagtggctttaaaatcactactgcagcacgattgaaaggtaattagcggtcgattaagtgtcaattaattaatagtgattcaaaatctcattaaagcgcaattcaattgacagctaataagcccttaagtaacaaatactttatccgtactttaagggcacgctaaaagccttttaatcgacatctaattgtcataacgcttcgatgcgcccatgggaatacacttagcggtcgattaaatggatactaagtagcaattagccagagtcgcgtgacagagttgtggcgcacagtagcacatcacccctacccccgtgcatctcttaattagcactaaaacaacatttatctactttatgctgtttagttttaacggactactacccccaccattgcgggacagtgtaacggtattgtccgcactaaaagtgactgaaatatggctacagagctgcctgcaacgagcatccaattcaagccgacaacgagcttgtagaaacgcagctacagcggacaccaacgagccagcaacgcatgatctagcggcctgaaacaggcgccttgaagcccgccacaatgtcgcaacaaggtcgcaacaatagcccggaaaactccccaacggactgttgaggcaatcagcttgagtcacccaacaagtgccccagcgagcctgctctatcggttgcgaaatcggcctcagcaggctctctcaaacacttgagaaaaactctgcagcaaaccttcctcacgccccgcaacaagacctcacaagactgcaacggctgctagaaaaagctcctataattcctcgcagcaagctcccagaaacactgccgcagcaccgtttaaaacccgccacagaattacagcaaacccctcagcgacactgctgaagcactgtcgcatgtcgcagccctccgtgagcccagaaccccttaaaaatatccattccaggacctcttaaacggtctctacaggggctgaaaaagcacttatcaagctacaacgtctgcttcatctctatcaccggtatattccagtgggaccctcgttctcgtgcctcgaaccccactgaaatacaccggcgtcgcactcgcttcgctcatatatacagcagacctctcctacctgggaaaacgcaaaaccgtatacacgtatatacggctgaaatcggcaaaaaccgctgccgtatacacgtgtatatgaacttaatttccccagcttaacaagcatattcgccccttttctggtcgctaaagctcccgccacaggggaaaaagaatgaaagggcataagggggtgtgacgcattgagcctttcgctgcgctcaattctcaatccgatcggcatagccgatacacctggtttgctgacgcaaacccccgtccttcggacggcccttatcacccagctcccaagccaaagaggggtcagttgctgcgctgtctttcctcccctcttcgtcttccgctgtgtgccccttcggggtgcccctaacaaccaccgatgtggctggcgccacgatcttttcggtggttgtcattcaagcccttgagacaccaacctgactgcagctgtcgctgcgtcatgcctgtaggttcgctgcgctcactggtgttacgggctttcaagacaggcgtgctgcgcggccctcataatcgttgtgacgattcttcgttgcccgctgcgcccgcgacgcgcctaaaagcaatcacctttgcacggctgctgctccgttcttcgaactcccacatcagctcgcacagcccgttgaaggcgcgctaaaagatgaaaagatcctgcaacaaaaacggttgcaaaaaactcaagggaagctcgctacgaaacctctcgtttcttcgcaagcggtgcgcgacgcacacttaaaaaacactctcgcaacactcgctcaattactacgttcaagagtccaaccaacacaacaaaccaagctctaagaatccgaaaatatcagataattatgcaccccttttaatatcaacaaaggtactcagaagttcattaattactcacccacataatttatgaaaactctgtccccgtaggcgcacaatggatgccgtggattagtagcaaaaagtctgactcaaggcaagcgctcgcaacctacggttgcttctcgcgcttgtgcacgtgtagtgagttgggttctttttttgcccgaggttgaggtaagcgattctcggtttcaccgatcatcgcgccaggcggtgcctggccggatgaacttgggagtgttgggtgcgcagcctcgccgcccggtgggtggttgctatgaaagaaaagcaacccgccccacaaacacatacaattaacttctatatttagtaaataaataactagtatttttaatgacttacaaatatcaagaaagaatctattccttatgtccgcattatctagaccgcacaagatcgccaccggcgttgctgtcgcaactcttaccctcaccttgtgtacctctgctgccggcgttgtccatgcagcgcaacaatccatcagcggtccagaatcctcctgtgcttttaatcaacagcgttgggatgacagcaaagttaagcttgacgacaccatcgctacggccaaaaactcattggtacaaacaggcgaactgcaccgcaacgaacaggatctacttactggctatcttttccagcaaccgcacagcagcaattaccttgcactcaacaacgcttatgccgatgccgtagcaatcaaagacagctttgtccgcccaacatgtgacggttctaaagagtccaagattgccagcgaacacgccgtgtctgaggttgtgggtgcagtgaatgtactcgcccgagcacaaaaagcgctgcagattaactccgacacctacgaacagcaacgtcgttgtgatgcccttcgtctagcaagccgagatgaatcagatgttcttatgcgcattgatcgcaccatgctgcagcttcgtcgcacactagctgacattgaccaggcgtccacagacattcgcgatattcgggctcaaacaacaagctttgaacgtgatcttgcccgcgagcaaaaagaggccgacgcagcagcacgtgctcaagctgtagacacttcgaccacaccaacatcaagcacagaagatcgtgtcaacgacattcttaaagagtcccgtaccgatcacagtggcgacagttacacgcgctcaacgacaacgagcgcacaaagcactgagccggattctgcaaccaacacctcatatctgtcacgtcgtctcgacagcctggaacgcagtgcgcagcatattgatctcaatacccagtgcgacaacctcgatgatcttcgtgaactcaccaacaatgacacgcgtgatcacaccggctccgtcatttccattgccgatcaactcacagacatcaccaatgaaatcaatgaattacgcgatagcacttttgccaccagagacagtgcccaacaagcacaggatcaggtaattgctcaacgtgaagaactgcaacgagcaaaggaagcacgactagaagaacagcgactcgccaaagaagcagaagagggcgctcgcaacgcagcaattcaggaacgtgacgcggccgaagcagcactgcgtgaagcacaagacctcctcagtcgcctcgatgacacaggcaacgcaaccagtgatgacacagcagcgctagtagacggtcttctcaataactaacaatcagcaacaccgctcaccggataccttatgaaacacctggtgagcggtgtgtttcaccccaacaaccgagtaaaatatatctagtactattttacgattgaaagtagatttttctatgaccgttacctcaccagcagcgctcgcactcagcgacatgtcctatgtggacatcattaagaagaagcgcggatggacaaccgagtttttccacagcaccatcaacaccggtgaaaccaccacaccgctaccagacagcgaccgtgccacagcactaatccatgaccacatcaccaaggctcaagagataaccatcatcaccgactttgatatggacggtatttcagccggtgtcattgcctatgcaggtcttgccgaactgggcgcacaggtcaatatggtggtgcccgactatcgtggcgaacgaaatgtcacagccagcgatattgatcgtgcgctagagctctaccctgcaacctcactcatcatcacctgcgatgtcggcatcggctcccatgaaggtattgcccgtgctcacgaacgcagtatcgccgtcctggtcacagatcaccacatggaggtcgaaccctgccaggccgatgtggttcttaaccccaacagaattgactctgactaccccaacaaagatatttgcggtgcgcaggtcattttcgccacattgagtgactatgcacgtcgttatcgggcggacaagattatcgacattaatttgttggctgttttctcaggcattggtgcactcgccgatgtcatgcctctcacccgtgacactcgaccaacagtgaagcaggctattgcgttgcttcggcttgctatcccacaagtaagtaaaaaccgtttcggcggttgggatacctatgctgcacgctctgttaatcctgatacgtccacactcatgcatattgtcaatgccagccagcatgatcaccgcttcattgcagccttccaaggcatctcaattcttcttggtgaactgattgcgcaaaagaagctagtaaacatcgacaatatttctgagtcattcattggcttcactcttggtccgatgtttaacgctactcgtcgtgttggtggcgacatgcacgattcatttctcgtgtttgcgccccatgccgcactagcatcacagccgtcgatgaatccaaatcgacatgctgcgatctctcgcatcattgataacaacgaacgtcgcaaagagctctccaagtcctcttatgctgccgtacacagctcagatcagccctacgcgccctttgtgtggctctctgaggcaccaagcggcattcttggtctcattgcctcacagctcactcgtgagtctgacgtgcctgccattgtcattaatccagataccttgtccggttcagctcgctcacctgagtgggcaccgatcatcacccaagtaaacaccctcagcgcacaaggtcacggcggtattcatgctgcaggccatgagtacgcctgtggtatgcgttttgataaccatgatgacattgtgacctttgttgcaacactcgacgcactcgataaaaacacgccacgggaagcacagccggcagatctgcatttggttgacattgaccacgcgcgtcctgtgcttgataacccctcactcacccaagagctcagtacggtcgatgctgcagtggatgctgcacagttgcttgttctcattgatcagcttgatcaactgcagccatttggacatggttttacctatccgcgcatcgacgtgacgttcaggccggcagaaacagaattcaaggttatgggtcagcaccatcaacatctcaaggtgatcactcactcagggttgaccttattgtggtggaataaggctcagcagctcgatgagatcgcacagtctgaattagtcaccatgtctgtggagctcgatgtcaatatgttccgtgggtttatttccccgcaaggcattgtctctgcgtgcacagttatctagcttggttgcataagcaccaaaaacaacccccaacagcctctacacaggcagttgggggttgttgctatgtttgtggtcgttaaggtctgaaaaagtctctacacaggcgcagatgatgcgcgtaaacgggttgccatagaaaacggttgtcctgatttcatgccagggatacgcccctcatcgacagtgaccaccacatcactaaaaactgtcatggctgccgtcacagcatcaccggtgagttctttcccgaacactgtgcctttaagcaaccaaccgtgatgtgcagtggaatcctcacccgcacgtgcctggtgtcgcacatggcgatcctctcgaagtgcgtgacgaccataaccgtcttcaaagcggcaccctgcagcccacatgacaaaatgctcacgacctttaatggtgttggcctccccggtgagaccatcgccccatggcgtgcccataatcgccacgctgtcatccccaagaccggagactgcattaagtgtgagtaactgcccccgcgtctgctcacgcagctctcgttgccacagatcgtcgtgcacagtgtcaaaggagtttccataatcagcaagaagattgagactaagcttcacaggctcagaaagccccttcactggcacagtgactgtgcccgtggacgcaagaccagccttagtgcggttgtggctgtacgtactgccttcaggcgcacaaatgatcaaagagtcagtgtgaatctctacagccgtgctgtggcgtcgcctgaccttggtggtgtgctctaaatagtcatcgcctgctggtacttcgcacagatcccacgggccgatactaatgccacgttgaaattcgtcagcgattcgttgtgcggtggtcacagtcatagttatttaaaagtccctttacttacattacttagttattcattaattactctaacaaacttaaagctaggtaacaccagcaagaaaggtagttctcctacattccagaaaaagacaaaaagtagagccactgggtcactactcccaatggctctacactcttctcgctccgttaaagattcctactgttcaccatccctgccggactatctgcacaccaggcaagtaaaggaaaactgatcgcggtcctggacagggcagcagtaaatgtttaactcacttttcagtatagacaaactttaaagacaatgcaactagtttataaatctatttcaaagtcaattacttactcactaagaagaattatccatatcctgtcgcacccatgcccgaaaccatttttatgggccataaagtgtacgcaaactttttagatcacgcagaaactaaaaattcccataagtttcaattaatgaacacagtaactacttgattattgaaatagaacaaatgtgtgcataacagccatatatatgaatttaattatgaacgtaacgttacaaacgttacgtatcgttacacctcaaaaacatgccttgagctgctgtaaaggtgaatctgtagcgctacggtgtaacgatacgaaaaagctaaagttacacctaaaagtacgctttaacctgcttctatagttctaaaattgtggtttgtaacgttgtaacgatacttttgcaactttaatatagacagaagagaaagagagaaaacatataaacatgatataggacacataagtgcataaaagcacatatgcgcgtcatgtcatgtcgttttactacctacgaccacataagcgtgcacatgagcactgccactccgcacagtggtgatgataggtaaataagataaccctgtatgagctactcccgcgcgtatagaaaacatgcacagtatcgttacaacgttacacttttacattcatgcagttcacagtgtgtttttcatgtaactttgatgtaacgcttatattattttaagaattaactttaatataataaaagggtctttgacgtgcatctttagtgctgtaacactgtgtaacggaacgtaacgatacgtaacgttacgctcgaattaaattcacgtttttacggttttttagcgttcatctcattatgtggaatttccgtcccataaatcgaccccaccgcagcaccctttaaattgactaaacctatcagtcggcgtgcacctgcagcctctaaaacactcccctcactccattacgcacacagttatggttcgtaacgctcgatcacgtgcagcagcactcccctacccaccacgcgcatatgtgtgcacgtgcaactgtgcgctaaatgcgtcttaataaaccgttgagtttctttattactaagcttgtttaaattgaaacttcgttatattctgattaaagaaagtaagtaattaagtacttcggctccacggccacccgcaccgttgttcacccacagtgcacaagaaaaagcaactcacttcgtgcttttttcaccgaccccggctgtgtggatgccacccacttacaccgcacaatcgaaaataaaagtaaaggatgttcaccttatgtctgacaccacagacagccacgacccagcaacctcccctacagtcgattcagccgcatccggtacttctgaccccaaccagcaacccaagaagaaattcaccatcattaagcaggtgaacatgattgcgcgtactgccattgatgactgcattaatcgactaggcccagatgttgtcaccatgtccagcgaagacattgctgatcaagtggtcaactccattaacgttgctattgccagagaaaacacacgtgcccaagatgccaatgctgcggtgcgttacacacctatctttaagctcgatttctcccatgtcgctgtccttatgcgcagactgcatgtgattatcaacatcgcgccatcgcataactctgatcctgacagcgatatgttggctatttacgaccccaacccacgcagcgagcattacgggatctatcgcacctcagaggctgaaatacgccgcgtagcccgtgaatactgccctgacctcacctcagcgcagtttagagaactgcagatggcactctcagatgctgcacctcgtaaagtccgccacaagcagcgtgacttgattcccgtgaaaaacggcatctttaattactcgactaaacaactagaaccgttttctcaagagtttgtctttcttgctaaatctgcagtgaactacaacccaaatgcacaaaaccctgtcatcactcatccccaggatggctctgtctgggatgttgaatcatggatgaacgatctctccgatgaccctgaagtcgttaacctgctgtgggagattatcggcgctatcgtgcgcccctatgtgtcctggaacaagtctgcctggttctactcagaggccggcaacaacggtaaaggcacgctcgttgagctcatgcgcaacatcttgggcgcagaggcctataccagtatccagctctcggacttctctaaagagttccaccttgaatcactgactcgtgcacaagcaatccttgttgatgagaacgatgtcggcgccttcttagaaaagtcagcaaaccttaaagcgattgtcaccaatgacgtcatctccattaaccgcaagcacaaaaccatgctcagctatcagttttatggctttatggtgcagtgtattaacggcttccccaaggtcaaagaccagtcggagtcatttttcaggcgccaactctttgtgccgtttgagaaaagcttcaccggtgccgagcgcaagtacatcaaagacgactacatgtcgcgcactgatgtcctcgaatatgtactgcaccgcgtactgcatatgaactacgacaatctctccacccctgctgcagctctcgctgtgctggatgaatacaaagagtttgtcgatcctgtgcgcgcattctggaatgaattcagcgatcaatttgtctgggatcttcttcccctgcaattcctctacgagttttatcgcaagtggtttgaccgtgacagcccatccgggtctgtgctcggcaaacgcagcttcattcaaaaaatcaccaccatcgccgttgatagcggtcagtgggagtatccgctgacagcacagcgtcccggtggcgatatggccgttcctgagccattagtcattgattatgacctcaccgagtggcaaaacgccactgtacctaaaggtcacgtcaacaaggggctccctctaccactcaaggctaattatcgaggactgctccgcaaacctctaacaacacctgctactccccctgcagcgccgctcaaccccacaccacccaccccttaacaaccacaagaaagatttatcatgtccgctccaaccatctaccccggcaccaaaacatctattgatccgatcaccatggatgacgctcgcatcatctttttcgatattgagtcgctccacaatattttcacggtagcaacctacgattctctgtcccaccacgtcgatgtcttttacctgctcgatcacacaaccagccctcagatcacggtgctgccgcactcaatggattatttcgatcaaacgcgcagcgatgctgttatggctgccatcattgagcaaaaccctgcgttcgcagaaattaaaggctcacccattacaaccgcagatgtagccctccacaatctcggtgacaccaacgccaaccgacgctggcagtctaacgtgctgcttgcccggctactcgggggtattagtgtgcgcggagaggtacctgagcaccagagccacaaccatctcgccaagcagtttgccgaggcaaccttggtcaccagggacttcgatgtgaattatgatccaacaagcgctcacccttttactgctggcttcaactcgatcaactatgacaccaccttgctcagcctgtacttcgcaatgttgacctcaaatatcggaagtacaccgacgtatttcccggtgatcaccgcacaggaacttcgtgcgcataacgacaagctctttagccctgagttcatcaaaaacatgccaaagtatctctgggatcgcgacagcggtgctggactcagagctgcatcgggtttccgcaacgccatgctcaaatcgggtcgccacattgatattcaacgcctcaatgaaaaacagctctttgttggactcaagcgcctgcttggtctcctcggtcaccagattctcgaatctgatcgtctctctggtgatgatgcccatgttgatactaacgaggatgtacttgatctcattgcctacaacgtctcagacgtggtgggcaccagactgctcgctgaggacccggtgtactccggctctttcgatctgcgggcaggtctactgagcacctacccagagactgtttttgatcatgatggtactttccgtcagccatccacgcagatgcgtaaagatcgcctaacgattaatacctcatcagctcagttcgcagcgcgtattttggcgccatatcgcccactccgcgatgtccctgatgcgattggcgacatgccggtggtgtcttacttgtacccggatgcagcagtcgccgaagcaacaggtcaaaaacaagtcaacgtgcttgatgagtcaaagaagttcttctatgacaacatcaccgacccggaagcacgtgctgcctttgatgaggtctttgctttttacgctgatattgagggtcgcaacttcaacagtcacaatgaggctattgatacccagattaaccaattacgtgcttatctcaaccaggttgtcgcattcgatgcagctgggtatgcgctctatgatgtacgtacacgttttgagcagatcttccccaaggatcgcagctacatcaacgatgctacggatatgacccctcgcgcagtatcgagctttgacgatctggttgcactctgtgatgatattcgcggtgtacttgatcgaggtttagagatctcatctccgaatcatcatgagatggtggatgctatgcgcaagcagctgcactatattcaggcattttaccgtgcctggggacccattcaacgccgcttcaatgacgctgacccagcggtgacccatccgcatctcacagtgatctacccaccgctcacccctgcatccgcagagaaattcaacaagatcacctcagtcgctgctgtgagcaagcgcccaaccaccctgccgtatttccgtgcagatggttcacctactcgtggctttgctaacttctccacaggaggtattcacggtgcggaatacaacgaagatcgttttgaccatgatcaagatctacacacagtggcaacccgtgaattcttcgccattcttgatgcgacattagcggctctctacgcagcccaccaagccgaacctgaatcggcggactaccagattgcacaagacgcactcgcctgggcaaagaatgtacttagcgatcaaaaactcatcgctaagtcgcctcagttatacaaccccgaaaccggggtcacctatgagtgggagtttgtcgctcaagcagcatggtggattcgcaacaaaccggttgaggttattttaccaacaggtgaatcaatgaccgtaaaacacaaatctgtattggcatctgcgtcctacccactccgagacaacgtggcgtactggcgtagcgaacccaaaacaccacagctgtttcccgtagcaaaatctggtggttcctcgcttgagaagaagtacaactacacctctgtgggtactgctattcacgaggactttagcagttactatccgctcttgctcaccaatatggctgcatttaccaatgctgacttaggtattgatgagaaaaccgggcgccctcgtgaccgctaccgtgaaatctacgaacaaaaagagatctatggcgcacagcgcaaagacccctccattgatgaagaaacaaagcaacgtctagggattttgcgcgaaggtaccaagttgattcttaactcggccaccggtgctgctgatgctggtcacgacaccccgatcctcatgaacaatcgcgttattgccatgaggattattgggcagctattttcttggagaattgggcaagctcaatcactggctggtgcaacgattatttccactaacactgatggcctgtattccgtactcgatatggggactaaccagcgcgttcttgatgaacacgctacagccatcggtgtgcaaattgagcctgaagaactggatattgtctccaaggattccaactcacgtgccgaatttctcggcaatggctacatcaatgcggccggtgacttggcgtgttgggatggacccaactctcggaactcactagatcacccggcctttgttgaccatgtgctggtgaagtatttccagctcgtcgtcaacaacactgtgccagagattccagaaacacctgagcttgagggtgtaccgctggctcttgatcaacccatgaaccgccacgaagtctcgaagattgtcgccactatgcacaaggaattcgagccgaaaaagctgctgtcgttttaccaaaacattttggcctcttcacgcggttctaataccttcctattctctgtcccctatatccctgcaacagaaggagaagaaacccaccctgcaacagataccagcactattgcgacaccaaccttgagctttgatgcttatggtaataaggccgaggtcatgccgactcaatccactgtggataagcgcgtgccctctttgctgcagtattacacgcgtacattccatgtgcgacaagatacgcagcaggctgtctttgatgttattggcgccaaccccgtgctcatcgccgcagcaaaagctgcatccatatcaccggcttctgctgattcacgtagaaagaagggcctggcctccaccaacgctgacccagtagccaagcatgtactagaaattgcaggagctgatgtggaatcgctgcgccatgaaaaggatctcaaggtcaccaagcacactggccaagacccagcactgcctgtcgtggtctttaaccaaaccatttggcataaccccaacgacgatgtgattaatgcattactgggcgctattgaccaggatgcctacattgacatggcgatctcgtcctacaacaagtcctggcacaacattatcccggcttaactaccgctgggtagaccccttgatgacctaaaagacctggtaaagctggtaaaattcagtactaccaacgcttttacatcaaggggtttttgtcatgtctaccaccacgtccaccaccacaaaacacgcacctgttcgacctttagagacagtcatcgaacaagccttacaggatgcttgtgcagtacacaacatcatgtacttaaagttcacctcaagtgtcaccggcgtgcctgatcgcatcctgcagggtattaacgcagcaggacaaccattaaccgtctatgtggaactcaagcgtccaggaacacacccgcgtactcgccaaaaggaggtcatgaacagacttataaatcatggcgcattagtgttcgtcgtcgatgcgagagacatcgacgtaactcatttccgacacaactatcacactgtggaatcactcttagagctcacgtttctcagcactaagatacctgttcccgagcgctttgacctgtttaattcaaacacaaaagcgaacacatatagcgctgttccagcactataaattgacattttttacacagatttttacatcaacaaccacctacgagcaggtttaatagcctctcatgggtggttgtcttaattaagggtgttgcgtgaaacacgcaaccggagaggagggtgaagtgtggggttccttgcgggcgtatgtccggggtgcttgctatgcttcaaacgatttcattcaagaaacttaatttattaacaactcttaaaagaaaaggagagctggtcatcatgatcactcgtcacgatgttccctacatcatcgctccgcctgtctacgcgatctttgcgagcctgatgaccacgccaccatggttttatcgaaccacctacaccattgacggtttcgattttaagatcagctgggtctacaccatcaccatctacatcagcctcatgatcctcattatcgggttctaccaagccaatatgcgcaaagcgtgcccttatgaggaagatcctttggtcgatatttggcacaaggtgtggagcactgcactctttatcctacctatcgttttatccatcgcggtgtactcactgatcacacagcgcgggtttgactggtatgtcatggtgtttattctccctgtaggcttgatgatcgcttatggattcttcaagccctgtgattgcgacaaacaccgttaaggtatacttgtccaagactttccccaccggcagcccaataagggctgcgcctaacttaaaacacgacacatagaacccctccccggccacacgccccagaggggttctttttcatcctttttaaaatatacttatatgtattaatcccctctttgtgcagcataggagactactgctatgacctcaacaacccaacctggcacaacacctgagctcagcgcagacactcattctgagccctgggatgtcgtcatcgaaaacacccttgaaccttttcaaaaagtcgttcgtcaatttattattgaccgcccctattccggcattttcctcaccatgggtggcggcaaaacactcactaccctctccgcattgacctatatccagccacctggacacattctggttgtcgcgcctctaaatatctctcgactcacctggcccgaagaggttcgcaagtggaatatccctgttaacgcaatctcgctgatcaccaatgagcgcggcaccaaactcacccgcgccaaacgcctcaaactctatgaggaaacagcgaccacaccaccaacgctgtattacatcaccattaatctgctcgaagatattgtcaattactttggtgataggtggccgttttggacagtcattattgatgagtcacagacaatctctgatatatcctccaagcgcactagagcgctcttttctgtgcgaccctatatcggcagactaattctgctcaccggaacccccagcgccaacaagttcgactccatttacgcccaagtcgcagtgctagattatggtgccagcctgggtgacaacatcgacgtattccgagccagatggtgtgcgcccgacattattaccgataaacaagtgcgtcgctggaagccggctaacaagcaggctgaagcagaggtgtaccgcactattagccacctggtcatgtctgccgtcaacacggatattaagctgccaccgctgcattttgttgatcacgaggtacacatgagcgacgatgagcaccgcgactacgagctcttcaaaaaggacgcggtgcttgctgcattgctcgatatggctgaagagaatgagggtggcgaaggcgctgatgacactgacgctgctgattcagcgacaacgaccccacctgcgtcatcacagccaacaaaccctgccatccccgctggactgcttcaggcaatacaacaaacccaggacaccaatggtcgcgccatcgcgcctgtgaccacagctgaacttgatcattttgatgatctgccagtacagcgccaagaagatcttggcaccttagttgttatctctgctgttcacgcagcgactctgcgcatgaaactgctgcaatacgcaggtggtgctgtctatgtcgatccagaagattctgcgcagtcccaagacctggatgccagcactgcacgtgatgttatcgacgctaccaacaccgccatgaccactattacctctcgccccaccatgattgtgcacctgcacaaggtgcgaaaagtcattgagattttatgcaaccctgcactcggcggtgaacctgtcaatatcgaccaggacgagaccggaaaacaggtgtacacacccaccccaacgcttgtcgcctatcgctttatctctgacaaagaaatcctgcttcattacctggcgcaggcgggtgtgcagggtgtggaggtttttgacgggtcgcctgacatgctgagccgttggaatgcgggacgcattccggtcttacttttgcagcctgcgtctgctggtcacggcttgaatttccagcacggcgggcatcgcttggtgtggtacaacctgcccgataataacgagcattatatgcaagcgaatgctcgtctacatcgcattggtcaaaagaatcccgtgaccattcaccgcattattaccgctgatacttatgatgcgaatatgccggcgattctggccggtaaagcaaatagacagcaacgtctcatcgacgccgtgcgccgtgatccagtctaagaccggcacgatcgcaccgttatagctaatcagcaccacctacaacaccacaaacacaccccaatcagcatgatcgtgccggttggggtgtgtcttatcccctaagaaagtgacacctttaccatgtcagaccacgacgccccacaaacaccgatccccaaggggttttggcagcagatcgaccaccaactcgatcgcctcggcacgcagcgcccagagaccttcgcagcactgcgtgacattttgcttgatcctgcctacaccgccattgttcatgaccgtaatcgctacggcgttgtcacctttgacaccaactcagccttcttctcaggctctggcggagacaacggcttagccgacgtactcattaactgtgattggcgcatgactgactaccgcgccgagtactactacgtcatgacacataaatacaccaaggaatcgtttacctatatcgagggcgacgtgaaacgcggcgacctcatcccgcctaataattaaggacaaccgccatgactcagatcgccatgtatctcgcaggacccatgacaggtatccctgaatacaactaccccaccttccatgcagcggctaataagttccgtgcagctggctacaccgtactctcccccgctgaagacgaatatgaatcccagctcactgcaccattgcctgagaacgctgagcacaaatacgaccactacttgcgtctcggtatcgaaaagctgctcaaggctgatgctgtccacatgcttcagggatggcagagtagcgccggtgccactcttgagcacgatattgcacagaaattgaggcttgccattacctatgaagaaccaccagcatcctaaggcgcctccggcatagcgtaaacccccactgagcaacaatctcagcgggggcgatcatgaattaatgtgctgtctcgatatttacctctagtgccgttcaacaattctccacagggctcttattcgaaaggaatgccttctttttcgcagtactctttgtacgcgtcgatgatttcctgtggcacgataccacgttgaccaacggccatgtcattgtcaatagcccacaaacgcgccttacggtgcagctctgcatctacagatccacgacggatctggcgtgcagattcctcacgaccaatcttgatgacttctttgagcgtgatcatatcgagctcagtatcaatgtcgtcaccattaaggtccactacatactgtttaccctcgtagaccacgcctacagagacgacattggtgatgcgctcatgtgagacatcagatgtgtattcgaccgactgaataatggccatgtccatagtcctaaccaatcatgtaataaatgtaataacttagtgtcacataatactacataatttattgtgtttaggttatgtcaaagttattgacatactttcttaaagctcgtgattgaacatctagctagataaaaaacttctttcatcaagccttttcttcactagttgctcttattctccattaaatcactaaattacctaataatgcaatctaatcgactcttattggtcaattaagtgtcaattaaaggaattttcttaggcttaatgaaaagtactgtcgcatatctacttttaactacgacaccaatacctacagcgaaactgtttaataacctaaataacgacaccacttcgacaaaaacaataataaagtcatgtcattttttagtcgcagcgtgcgcacaccatagtgggacctggtagggctcccacgtctacgctcaaacgcgcgcaagtacgctcacgcacactgtagctacacagacgaccagttaaagcacagtcaatccgcggataccaccagcataggcacacgccggcagtgatgcaccgcacttgagaaaaataaatcatctcaagaaacaaactaatacgttattattgtaatttaattagagaaaagaaagtgacttttaaagtgcttattcgcatcgccgagcatcaaggccggctccatgtccatagcccctactcaaaggcttttgccgcccgcgctcgaaagctcaacggtctctggtcacccgaaacgaagacctggcatttcagccccgataaagaacaaccggtgagacgcgcactcaaggatgtctacggctgggatgaattcaccacacccgagctatgcacggtgcagctcactgtgaccccagaggcagtgctcaacaaacacacactcaccatcgctggtgttacacttctgagccgtttacgcagaaattactcggtgtggttgggtgataatgtccgcatcatcagtggcaatttcccagaagcagcaggatcaccccagtaccccctcatcatgggtgtgaaggctcaacccgttgttatccatgtgcaggaattccctgtagatgctgtttcgactattcccccgcgatttaatcctattgttatcactgcaccgccgagcattgatattgctgctcttcgagctgaacgcgaacagctcacccgacgcatcagcgaaattgacaagaaaatcgcacgtgctgtgcatccaaccattcagactgaggctgcctaataatgatgcagactctcaagcggaaaattccgctcatctcatgcaatgacctcaaagaagtgcagttactttttcttaaaggtcagatgcacacagtcggctacaagctagataccgatcttcgcaagctcactaataccgatgtgcttgatcttattaacgcgctcttcggcaccactgtgaccagcgcagatgacgaagcagcagatttcattgactctgatcctcagtttgcagtgctcgttgagctggcctaccacgactgtgcacgccgcgctgccatgggtctatccagggtacagcagctcatctatgacaatgcggctaaatcaacctactaccgcagcgtcgcagctagacatcgcaaacacatccgtgaactccacgagcaaacacagcgagatggtattcacttcgacaacccgttgtctcgtgcagtcatcaacgatctcagcatgtccatgaaccgtgctcgactaaaccgcatcgcttcatggaaatcagccggcgtacagcgctatctcaaccccactatctcttagaaccacacacaaccaagaaagcagtcactacatgaccacctcatcaccccttaagtccaaaaattcccttaacggcgcgcagaccacatttgtccgcaattgtgttgcagacggcccaaccgaggtaaaagccaccattgatgcacgtggcggtatcgaacagctccgtgacaatgagatttcacagctccccgacaagctgtggttcaatagcgcaacctccgcatccaatgacgagttcaccaccgataacatccgacttgggttgctctacaacatggcactgaataaggcatcggctcatcgctatgagcttgctgcccgctggtacgccattgttagccctcagccatcgcaagaagctagccacaagcgcatcgcgtcctggcaccttacccagctgcacgcactggtgaccctatctcgcaccctaggggtcatcattcctggtgatgagatcgacgctctagcgcagtctatggagaatgctcgtcaagttggcaccgagaattggtccactgtcaccatgcgcacctacgtgaccaaccgcaaggcatcctaatgactcgcgatattttccacgaggctgcaaaactcatcgcacacctggggtggagggacgcttttccagcactacagcgcactgacccagcgccaacacatgctgtgccgatcagggcctttgatctcaaggcgggcgccgtcatcaccgatgaaaatcgaagcaatgcttatatctatgacacccttgtcatcacgcagccatataagcacgagttacctcatcaaaacacccacccttttgagtgggccctggaacaaattgccacgcttgatccggcgttctcgatcaagctcgatcgctcagtgaccgtccctgaaattggactctacgcccgcacactgcatgaccttaatactcggcatcaagacttcttggcacagcgcaacgccatgttgcttgttgttgcccgtcgtggtgttgatccaaaaaatatcgcagacgtacttggtttaaccaccaatcagatacatcggattctcagtgctactccggctgattcccctactgatttaggcgttaaccccgccacaacaatgggtgatgtagtgaggtttatcaagaaacgtcgcaccactatgcaactacgcggcaccgctgtccgtgcactgctctatcacggccttacgccggcagtcatctcccgactaagcggcatgtcgcgtgcgggtgtcatcaacgcagccaaggcattccccaccaccatcaaccacaaggtcaagaaaagaaagcagcacttccatgtctaatctcggcacatactatgcagcacgacgtgcagttattgggcaattgctcaatgaaggtcttgatgctgagcagatcgcaacacgattgcaactcagcccggatctcattaacgcagattttgaggctctagaaaaagagaaaggtgaggcccagaaaaagtctcaacagcctggtttctgatccctctaaacaaaaccaccaattcgcacgccacaacagcccagcagcatcatgttgctgggctgttgtgcatttctacacacgctttgaaaggagaaccaactatgaccacccaaccacttgtcatactcttcaccctccacgccaatccctcccatgaccacaaagaacgcgccaccactattactggctcgctgagctccatccgtcgctggttggtttcgcaggcagatctctacggctggaatctcggtaatttctctgcttggagtcttgatcgacgcgatcatgaccctggtgaaatcatccctgagctcaatcaaaataccctgctcgcctgtgcatccctggtctgggatattccaccagctcatattgcactgcaggctgtaatacccaagccagaaaatatccctctgatgagagcagcgacgctctaagcacaaaaaacagccatcaacataacgttaatggctgtttttttaaccctctaccactacattactgtatcgcagcagcaagttcctgctcagtcggaatcgccaatggcgtgcctgcatagatcaggtctggatcaacaagcttgttgcgatcaatgatcaacccaaccggcacaccactgtcctgagaaatagaggacaaggtttcgccattctcaatgacgtgcaccgtacctggacgggcaggtcctgcgacagcatcaagtgctgatactggtgtgtcaccgttgccggtaatggtcaaggtggggtcggtcggagccgttggctcttgagcactgtcgtgctcacggggttctttgtgatctgagtctgcgccttcggcggtgcctgtgttgctgtcagcatcactggcgtcagatgaagaaggatcgtgaaccttcgtgacaatttcggtttctgtcacgacctgattttttacctcgtcctgtggctcgacgacggccactgtattgacatcaccaccgccttgggcgagaaaggtcacgcctgatccacctgcaataacggcagcagcaataaacgcacctgctgccacacctggtactcgatttttcggcattgcgcctttaatcgccatgttcgtttgtcctttacctttacccgtttaatgttccctggatactacaaattaaactctagtatcttattaatttctgttactattaacatataggttttttaaagtttcgtctacataaacctgcaacagaaatcactacacccagttctcgaaaggctttttctctcatgacctacccagttacccctcaacctgtgcagccagcaccagtcgccgaaaagatcaaggcatcaagcctcaaagaaggcactcaggtatttatcaaaggtcgggttaattactcccgcatcgcaagctttattactggtaccgagcgcgaaaaccgtaatcgcgacaggcttcacccaatcgaattcgactacacctccctgactttgagccaccctgaaatcatctacggcaacccgcaacaaaagaccaatgaagaactcttccttgagcagcgaatctttgtcggcaagaagcgtcctgaagagggtccaaaattctccattgacaacaagagcaaccgtctaccacaggtttgggtgccatccaccaatgctgatggtacttatgagcagcttgaaggtctcgaaggtgagctcgacgcagggctcaacgtcattattctcatcgagttctataagccacgtacacaggttaatcgcggctcccgcctcaacgccgtgttcctgcaggagcccattcgttactacacccctggttacaatgcagataagctcgctgccctcggaatcgtacttaacgcaccgccaaaggacactattcagctcgttcctaatgaggtcgctgcaggacaagaccagtccaccaccgatgcatccggtctcccgcttccaggccagggatatagcgcacctgatcagccatatcaggcgcagcctcagtatcagcaggcaaccccagcggctgcacctcagcagtaccaggccccacagccccagtaccagcagtcagctccacaggcacaacctgcaccggcaccagttgcgcagttccagcaggcagcgcctcaggcacctgctcagccagcacagcagcagtatcaggcaccacttcctgccggtaatcctcttgcagcaggtcagccagttgcaccacaggctccactcaaccagccaactccggcagtacagcaggcaatgcctacccaagccccacaaacaccggcacaaccagttcagccaccagcaccacaagccggttctgcatttaccgatgctccgggtgctgtgccacaggcaccagcagttcaggctgctcccgctgtagctcaggcgcctgtcgcgccagtagttgatatgaccgagccagcatccccatgggatcttccagctgcacctagtcagccagcgcagccagctcagggcatcacctacccggcataacaaccagcacaacccttagaccccagactcgcattttgcagggtttggggtcttttttcaccagggtcgaggcgcggtctgtgtgcccacctcgacccacttttcgcccaccacttttcgtcaacctaccaacaacaaagcccaggtcacttatggtcaacccttttcacacgcttgataactcaccgtttgatccggtggcacagtttcctgcgttttatcacaacccgcttatcaatcacttgggccgccgtcgcgcctggacaatctcagacatcaacaaacgccccatcaatgtccaacagatgctgaccacggccacctacggtagccccgttattcatggtgcccgcattgaagacgcagcaacctccctacttaccctggatgaactgcgtacacagattcccaccgctgccaacaatgcgttttatctcgatgctgtccaagatggctgtcttattttagatattgaaaaaacctgtccccccgaggtcgcagccacactactcacgctctcccccaccgccttttacacagaggtgtccatgagtggtcgtggctatcacctcgttatgccgataccagagaattttgcagcgtttcctgccgtacacaacaaacccagtatcaaacaccccaagcgctggttcgaaattcttacctcacagtggatcaccttcacccgacaaccaatcccagagcatgttctccatcacagtgaatctgctaacacaagtgctgtgccatggttgaatgatcaaccacttacatgggaaaacgtctttgcagacttagctaaaactgttgcacccaacttaaaaaccggtgccggacttaccatcacacccaatgcactgatgccaccagatctcagcgatgctgagcgcattcgcgacgatgaagtcatcgactcgacctgtcgattatttgccgaacattactcgaaaacacttgcggacttctatgatgatgcatcccggttcgagttcagccaaattggtgtcattatcaatctactgctccccactatgaggatgcatcccaccacgatcagtctcgacaaacccatcaactccgatcacatcatcagacttctgttcgctgtcgctactcgcgtgatcactcaccgcagcaaacatgatgaggagcgatctggcgttccgtatctgatgtatcaggttatttcctgccttgacatgcgagaacaccccgacaatggcgactaccgtgtcgtaccctcccggcataatagagaccaacacagcaacaacccctcagctcatgtggtccaccaacaaccacaaccccagcccagcgcagcagattcgccacatcactaccgtgcactaccccaagaaaacacggtgtccgaacacagttttaaaatctataacccaccagccacaccccctctaggaggtgaaaattagatttattattaaaacacttgttctaaacataaggaacgcgctaccattcatagttagtgggcattccgccccataacaaacagtagaaaattaagtagcacagcattgtaaatgtcggggaaacaaaattattcaacacttttccaactaattgttgatatgcacactttgtcgaacaattacaggagctacatgcacttttacattttctatcagcttgttattagtaattatttatctgattaaaatatcggagtttatttatgtgatttgaccggtaattgcacaataaagtaatagttaattactaggtatagcaacggattaaataatcactataattaattctttccgtactcattttaatcactacctattcaccacttgaacggagcgtttttcgccatgttgaaattccgcatcatctccacagtcactactggatctcagccaactccacgaaaaagctggagccaccccgacaccactctcctggtcaccatggtcactgcaccatcgctgtgctcagccatcaacgtgtggaacgcaactgagcgtattcccgctcaaaaaatccttaatgtcgaagaagtacacgttcttggtgagtgcagcgacgccatcatctctacgtcactaaccaaaaaggacaatccgcacgcacttgtgcccgatgatttcgaccaaatcggcgatgtgtttggctatgcgcaagacaatgtagctgtttttgatgtcattgtcgcagcactgggcggtgctggttatggcctgctacccggactggtcatgcaccacattgatgagcacaccgttgcacttgtctttgatactgattcccctactgggacgcatatcctcggtgagcgctgcgtgtactccgacatcattcacatgactgacgataagtctgcccgtggctggggtgcagtcattgccatagcacgagccatcatcctcaaagtcgaacagatcatgtagtaccccaccatgactcacttgattcaccacaatcgaccgcccgtaccagcatcactacctgtgcacgtgcagaaccagacctgctctccgcccattatgagcaggtctatgtcatatctacccacactattttcttgacccaacgaaatgtgaatcacattctcttctccacacacctcgcataagaaagaacacttattatggctaaagaattcgaattcaccatccctgaccaacataatcgtttaccgcttatttacctggtcgcagcacgcacaatcaccagcgctcgcactcagcttcgtgctgaactcgatcaggacgaccccgatttgctctcaagtatcgacattgatgcgctcccctacgtcatcgtcgagtaaaggcgtttctttttctccccctgtggtctgacctgtcaggcagtcaggttggttgattttttctggcggtggctgcatggtgcagcgtcagtgaaaagacaacacagcgaagctgtgttcgggggattatgtgagatcgcaccggcacgtgttgcggtgcggatcgcacgttgttctcttgtggcctggctcagatagccactacctacacgcatctgttgtgctgaaacaacagcgcgacactcactcttctcattactcaacaacttacttttaaggactacataacttatgtctctctaccttgacgacactttgtctcgcatcgttgaacttgatctcaaagacacccgcattgtgccgtttcttgctggtgaaccaggtatcggtaaaacctcattcatctacggcatcggcgaacgtgcaggctacaaagtcttcagtatctcggttaacacccttgccgataagggtgacctcacgggcgctcgcaccctgcaggaccctgccgatggcaagtggaagcagatgtttttcccgcacgcgaccttcgtcgaagcaaatgactatgcactagcaaacccaaacgaaacggtcgtcattcttctcgatgagattaaccgaactgattcggatgtcacctctgcctcgatgactatctctactgagcgtcgcgttggtaccaccgatctagcacccaatgtccgccttgctgtcaccggaaacctcaccggtaatgtcacccaccttgattcagcatctctgaccaggttctccctctatgaggtcaagccatccgcagagaccttcatgaacatcatgggcggccgcctcaacaagtacatccgtaccgtgctgaccaaatacccggaatacatcttcatgaagccaactactgctactgctcttattaccactggcgatgatgatgacgaccatacaaccaatgcgaagcaaatgatggacttcaacgctgtgctcggttcagaccaagacatggttcaatttaccgcacctagaactatcgaaggtttgtccgtctggctcaacaacgccgatgatgactttcttcgtctacttctacaagaaaaggtggatggtcttgctcgatccatgagcttgctgcaggctacgctcgaatctcacaccggcgataccgcttttaccgcagaagtcctcagcgaaatgaccaatgatctgctgagctccgcatcgcaagctcctagtggtccaatcaaaccatttgtctacgaccgactcgctgctgcaccaagcaatactgtactggaacaagaggttcacacactcagtctcaatgaccgcgccgatgtcttgttgtttgccctccatgacactgtaaacaacgctgcaccaagcatcatcgctcaccttgcatctgaaggcgtacttgatgaactgcccaaagacagaatcagcaaaattgtttcactcggtcctgtaccaacggcaaactatcacgccttgaccagacaggatacaacgttgactcgaaatctcggtcccgctgtcttgggcttcttggaaagttaaagcaatttcctaagtacctttggcagctgaggtagtcatctgtctacctgcgtggagtagacactaaatcctgtccacgcacccttacccttcttgacactagtaattgaaagcgatcccctcatggttaccttcagcgtcgcaaatcacgcgcctcatacttttagcccattcgatattgaaccaccactcaccggtaacgccaccaccgacgaacatggttacgaacacacctcagtgctagaaaaactagcctccaaccacctgttcaatccaatcaatccgcaacacccagtcactatcacagccaccgaaaacggatcaaccgttgatcttgatgcagcagcactagcacaacatcttgctctagcgattaccccagactcaatgctggcaaatcatcaaggctacaaccgtgacatgatgggtctactttcgcagcttactaaccatgttggctttgatcgccgattcattgttgaccaactctttatctcccaagtgctcaaagcgaatcgtctaccagcaccggcaaacaacgttatttacaccgtgcccaatgacgttatcccatctgctaaagacatcttgtccaccactgcaaaaatgaacaatccactgacagttactgcaagtgccccaattactgttgacgacattcacacagcctatgaggtatttttcgcttctcttgcctcagtgtttttcccttatacctacggtgcggtattccttaacaacgcagaattcgttgagtttgttgattaccttattaacgaagcaacaacactgcactcggcatcactcatctccaacaacacctttaataggttccaatcaatgcgtaacatctccattgataatctcaccgccgagtttctcttacgcaaaaatgaagcagagacaactgatgattattcattcccccgcgtacttgtttccctgctgcattcttgggtgaaactcaatcacgatgatgctcgtgctaacaatgatgcacccacctgtgcactagcaccgtttagtgtggctcaatggatcatgccggagaccattgtgtttattaatgctgaagctcatgctcatgcatcctcccaggacattgagaagaaatggaaggaaattaatgcggcgttaacagggtctattcgtattatgtcgccaaatgcaatttccaagctgcaatctgctcagcatctcgggatgcaagcacaaatgcaggccatgcgtgctcgaaaagatcaccacaacatgcagaagcgttcctcacaagaaaacgacttttccaaggcactcccctcaccacagactatcgtgctttctgtcgcagaggttctgcgcaaactcactcacgtacgccaatcgcacaaccctcagaaataccagaagaagtctctgaccagagcttctcgccgacacccggataaccctaatgtccctggcaccattaagagcaagctcttctaccctgacctgcatgtttatgtagatacttctggttcgattagtgaagaaagctaccgcaactctgtggttctgctcatgcagcttgccaccaaactggacatcaacctctatttctccaccttctctcacgtgctctccgaagaagtactattgccgaccaagggtaaaacaccacagcaattggcagctcttatttcggccatcccaaaggtctctggcggtactgactatcaccagatttgggattacatccagatcaatccgcagcgccaagaacgcatgaatcttgtgttaactgacttcggattcatgccgaatcgcggcttaaacatcgaccacccaagttctattttctacgtcccaatcctgcctgactacggcagctggtcaatggttcgaagagatatgtctcatttcgcaaatgaaatggttgacttcgacccctatatccacagccgactactcggcgtacacggaaaatagcagctgatccatctagggtcagtgaactctcgcggattgccacacaccaccaaccactacaagaaagaaccccctaccgtgccttttcacgatttcactgaccctgatagcgatcctaggcaaaatgcaccagctaaccccaccgctcaaccgccatctgcccccacctcacactcatcacagcagggtctccctccgggcgccattatgatcccttttccagggcaaccgcagcagcaaagcgcacccaatgacgagacccgtttcatcgaccttaacgaacgtcataaagatgatgaaccagccctgtttcgcgatgatgttattgatcaaactctcgctattttgatcagtaaaaataagcccaatgcgctactcgttgggcctgccggtacaggtaaatcccgtatcgcagaagatattgcgcgccgccttgccaatgatgacgtatctattcccgatcagcttgtcggccaccgtattcttgatgtctccattgcagagcttgttgctggtgctggcgttgttggtcagctcgaagaacgcattctggatctcatcaagtatgcgaccgacccgagtaacaaagtcattatctttattgacgagattcaccaaattgctggtgatcagtccagtcacagtggatcgcaagccaaagttgctcagattctcaaaccctatcttgcccgtggtgaccttcgtgttattggtgccaccaccacccaggaagctcgtgacttcgatcatgatccagccctcaaacgccgttttagcagagtaaatgtcgatgaatttgatcgagatcaaacgctcactattcttcatgctgcacgtgatggttacctcaaacatttcaacaacgctgtcacggtatctgacgacgtactgggctatgtctacacctactcgcagcaattcaacccaggcaatacagcacaacctgatgcagcactgacgctgtttgataaggcgttggcttccctaactatggagaaacagcgtctgatcaacaaccatgtcattgcgccgtcgctcaagttccctgtgtcagaaaggcacatccataacaccgctcgcaaacttgcctttggctctcaagtgccagcctccatcaatactgatgatgctcgtgacaaactcgaaacgttgtttggtcaagatcatattattgagccagtactcaccgctatcaagcgtgaacagcttggtattttccctcgcaccaaaccattgagctgggtgtttgctggttcatctggtgtgggtaaaacagaaatggcgcgtattctctctcgcgccattaatggcggcgatcccatcattatcaatggtcccgaatacattagtcctgagtccattactggccttatcggatcatccgatggctatatcggctctaattctaagcgtgctaaaccactcgacccgctgatttctaatccgcgtcaggtgattgtgctcgatgaatttgagaagtctcaccctcatttccagcaattgttcatggcagctcttgatacaggcactatggcgatggctaatggcacgacattgaatttctctcaggccattatcattgccaccaccaatgcagcccgcgacaaaatcggtcgtgacagctttggattcgattcagataattcaggtgtcctcggttctgctcaagcagcaactgatccgcgtgcacaggaacgcctcaagtcactgatgtccaaggatttccctgttgaactgctcaaccgtttccagaatatctttgccttcaaccgcattgatgcaggcacctaccgtgagattctggacaatctctaccagcgtcgccgtgacgccgtgctgcttagccacccgcattacgcagcacagatccctgcagatattgattcagacactcttgatcagctggtggaaaccacctttatctcagattttggtgcacgtcctgctgcacgcaccatcgaagaccacatcgcatccttgctgatgtgaccaaccttttaggagtacatcatgattgataccactgctaacagcacctcaggcaccctacctacactcactgctgaccaagctgcgtttatcaccggtttttgcgaggctgctatcttcacagccaccgtcacaatagataacgaacctatatttcttgatgaagcgttcttcttaggtcaagaaacctataccgacattctcatgaatcaactccgcaccaatgaagccattgttaaagactgtctcgacttcttccttgacaactacaccacaatgaacaagctcattgttgatggtctatgcccagattgggagcaccacggccatgatttcctactcacccgtgaccatcatggtgccggattctgggatcgtggctacgacgaatacggtgcccaactcaccgacaatgccgaaaaatattcagaaaactgtctcaatttctggattgagcctgatagtgaccctctcattatcaacttcgagtaccactaacaccccttgaccttatttttctttggttaaggggtgttagccaccccacctactcactgttatttcccacgaccaaagaaaactcacccacatgtacgattttcaaactatcccgcagccacctcgtgacggctacgacaacccctcacttgatccacgcaaccctggttaccgcgagcaagagtacgaggattacctcaacgccgtgctcatgacaggtaattcaacgcgttaccctgctgcagcataaaagaacctgcctcaacacacctccactttttctacttttaagaaagccacattctcatgccaattatcattgataacctcaattctgacgacgactccaccatcggcactgccaccgaatacaaccctgacactgacgccgatttacttgatgctattaacgctgatgctgaccttgatggcgacgccaccatcagcactaacgcgacagaagaaggtgtagacgcagcagctgaaaaacctaagaaaaagcgtaaagcccctgctctgaagcctaaaggactcacggcaaagttcttccaccgtgatcttactggcgtaggtggtaggaccggtcgcctcaacaagaacgtacacccgaccaacccagatctgtcctaccagccagtctctgatgtctacaccccacaatcagcagatcacaagggtattaagacccgctacatccttacccatccaacccccgctgttgttctcagtgagtccatcagcaacgcgtttcatgtctctaccctgcgtcgcaacaataatgtcaacaactctgattcggaattggctgcctggccgtacctctaccaactcgatattccgcagctggaccagatgattaatgtcgctgacatctgtgattaccatttccacggatataacctgtgggtggattttaccccgcagactatcgctctacgatccggtaagacggtactcgatgacggtaccaccgcctctgataacaccactcatgtctattaccgcgtcaccgttcacgttattgccggtcaagatcatggatctactctgcttgatgaccagggcaaccaggtgcttgatagggatgataatcctatttctaccccaagtatcaagcgtattggcgctgtcactgatcttttcgatcacaatccttttggcttcgctagtgtaaactctttcgcatttgtcgatttctcatgggacccagccaccaccttggtcgatatgctcaacaaccttgattcatatctctctaatcacatcaatattgccagctccccaacccccattgccctcgatatggttgtgctcaatgaatggtctgaaaagtcctatcagctgtgcgaacgcgttgttgcacaggcaaagctcatcaacagcaacaagatcaccgcacatgtgagtgatgtcatcaagcaaaatgcccacaatatcttgtggtttaccgaacagatgaaccctggcaccaccaacctcagcgaggtacctatctccaagaagtctatgctgccgatgtctcgccagctacgtattttggagcactacgatgtaccactgaccgcgtactctgctcttttctggactgtcagcgccattaagaatgaatctatggtgcagtaccttgtgcgacagaatatgcagctcaccttgagctcaaatctggatgcactcaactccattgtctcccagctccctgtaccagataaggacgttgtggctgcttctggctaccagattcagccacacttctccacgcagcagcgtgaagcaatcaccactgataatcctctcgcgattattcaggccggtgctggtaccggtaaatccaccgtgattctggaacgcattgagtacttgtgcgctgcaggcaccaaccctgaagagattgctgtgctgtcttttactaatgctgccgccgataacatcacagcaaaaaatgacaaggtgacctctatgaccatctccaagatggttcatgagatttacgcacacaatttccctgatcatgagatctccaccatcgacaccattatcaatacgcttgatattgaatacggcgatcaaatggtgacctccgattacatgattcagctccgtgacctgctctataaggtcatgacgcagggtggcaacgccaacctgacagcgttgagcatcttcatggaatcccatatcgaggcgttcatctcggtgttggatcagatcaagcagacttctcttgagctggaaatcatcatctgctacctgctcttggataagctgatcgagcctcatgcatcgccgaagtacctcattattgatgaggtgcaggacaactcggtcttcgagttcgtctttgcacttcgttttgcggcaaagcacaatacgagtctgtacttggtgggtgactcgtcacagaccttgtatgagttccgttctgctaaccctaaggctctgaactccctggaagcatctggtgttttcggtacctaccgtttgaccaccaattaccgttccaaccaggaaattcttgacttcgctaatatccacctctcggatattgaagctaaccagttcgcaggtattcagctctacgccaactcttttgatgcacctactgcggacagcttcaaagaaaaggttgaactggacatgcaccatgtgtctaagcagtctgagtttaccgacagcattccttatttcatggagtccaataaagctcgctttgatgctgcgatcttgaacaatgagcaaaccattgtgcttgctcattctggtcgtgaaattcgtgcagcgcagcaagcgctagccgagatgtaccccagcatcacggtgcgtaacttgcagtccgataagggtttcaacaacacggtattttcgacctttattaaggatttctggtttgaggtcaccgctgtagacccagctcatgccgcatttacctttaccagccaagtcaccgctcatctagataagttggtacgcggaaagcgtgagcagatggaggatcgcgttatccggtctatggctgcatggtggcgtgaaaatgagcgtgacatccagggttgggtgcagcaaactcagtccggtgcgatcaccaacgaagagttcttctaccgtcttcgtcagtgcattcttgactatgaaatcaggaataaccgagcacgtcagtccatgctcaatgcgcgcaacaacgctaacaaggaggctgtcgcacaggagaaaccactgctcatggtctccaccattcacagtgcaaagggtctggaattcgataatgtcatcgtgcttcaaaaaccaagctccgatgcagagatgaccgaagaaggtaagcgcgcaacctatgtggcgctgacccgtgcaaaaaagcgtgaactcattattgctggttctactcgcgcatacccacgcatcgtcaccgattatgagcaaatcgttgatcttcttgaaaagcgcgatgaggagcgcaaaattaaggaggaagaggctgcagcactcgccacccttgaagctgaacaggagacgcgcgcccttgctgctgctgaggcgcaggctcaggcgttgttgcttgagcacaacccgtggttgcgtgatctcagcgatgaagaagtcactgctctaactgagcaagagatcatcaacaatgttgaggcagccctacagattgaagaagaggaggaagaggctcgtgcactcgctgcagcagagccagcaattcagcagtacttgtctcagtttgctttcgatgagttcccggacgacgacaatgtagccaacactgtcgtacatgtagcaccacagcctattctccaccaggcagtgcctgcagatgtgactgtacaatcaagcaccgcccccgtaacacctgttgttgcggatcttgaggtaaccactgttgcagctgatccagtcgaaccgactatcgttgctgcacagcctgaggtggacgacaaccttgtctacagcacgtccacccctaatagtcacagtgacgttattgcagtgaactctgatacctcagaaaacgctgctgttaatccagttctgtccgatattgaggcactccgagcaattttcaacaaccaggactaaaacacctgctgctgttgagcgcttctcacacatcatcctcacaaccccgttgcagcaccagcataaatctatattcgctgtgacggggttgttggggcgcgccccacattcactctttttcccgattggtttctactacacacccatgacctctattactactaccgataccccgctatatacagcactgccccatacccgtatctctgatgcggaattgttgacaccaacaacaactgtgcacgagattctcgtttacggaccggctgagtgcccagggtgtacagcaacgcttgacttctttgcacgcaaaaacatgccggccaccaaagtcactgtagctgccggtgatgtagcacatacctacatcacccaagacttaggttatctccaagcaccgattgtcactgtccgtatcagttcctctgcttctaaccacgacaacgaacacaacacccagatcctgcactggtccggcgttaatcgctacctcatgcaggcactctcccgtactcatttctagaaaggtttttcccgtcatgtctgaatctacttcttctgctaactccaccaccatcctcaacgacaccttcaacccgaagcctggcgtaccttatgcacgcgtcgataatctcgaatttgccacacgtgacgaattccgcgcttgggctaccgcagagatggaggccggtaacgttatctctgcaaccatcgccaatgccccacgcgaagaccgcatcaagtcttttgtcatggatcttgttcgagacggtattgacgacgctgctgaggaaatcgtctcacgcattgatagcggtgacttcactatgaaggaagctctcaccgcgatcgcggcatcaatcaacgacctcgatgctgacgatgtagtcagcgacatcgttgaaaaccacttcaactagtcaacacaccagccctccacaagagcgtcgaagcaatctacgcttcgacgctctttttttcactacctactcatcccccacataagaaaaaaagacgacaccaccatgattgaccataaactgtggtttaacacagtaaccaacaacgcctctgtccgagaagctgcaggaaaatgcgacatacccatcagaacgctcaacgagcagcttaaccgtcgaatactccctgaaaagaccgtcatcgctctagcacgcgcttatgatctctcacctgttgatgcgctcgttcgcaccggacacctcaccgaagaagaggctggtagtcgtgaagaagatgccagcccagattcagctgacgactaccctacctgggcactgaactcgcaccttgactatggcattctcggagcttttggcgacatcgctgaagaagtaaacagcgaaagagttaaccgcgacaacgccatagagcaaattcgcgcatggctcgacgagcttccaggcagcctattcaacaacctccgcagcactaaaacaggctacatcgaactattcgagacctatctcgattaaacccaaccagcacaacaataaggagaaccctcaccaatgtcctttaagcacctctacgacaagacaccagaaatgatcgtccatgtgtactgttccgggccactgtgtgatgcagaattagagcatgaccgtgatgggtggacatgccctgaatgtggcactttttgggttgaccccagcggcaaaggcgaacgcgcccaggttgatacacccgatgatgaactagaggggttacctgtctataacctctcaggtgaacacctctacaaccatcatgagcatccagaaagcgcggaaatataatgaccacacctcactcccaccgcgcaccacgtctggcatccacggtcattattgcccgcgagtctgctgactcaggtaccttagaattctttatccagcagcgacaatccactatggcttatgcagcaaacgctgttgttttcccaggcggcggtgttgaggacagcgattatccctttatgctcccccaccgcgatcagcacatgtcgcctgaacacatcaagcatcatgccagccgactccacatggactcagaaactatggcagctcatatttccgctgcacgccgggaagtatgggaagaaacaggcgttgatctcggtaattacaaccatgaactcatcccgatcgaccgctggatcacacctgatattcctgcttttaggcgccgttacgacaccgccacctttgtacttattctaagcaaagacagcactaacgcagctctgcagcaccagcatcaaaccaccgaggccacccattcttattgggcaactgcagaagaactgctcactcaatggtcaacaggtcatctcaacctgttgttaccaacgtggtggcatatcaaccagctcaatcacctccacacgctaaaccagctgtatagctttgcccagcgtacccataatccgcagcacactccacccacagtgtttgctaactggactgcaccggctgatgaggccgccatgcagcactatgggttccctgatcccgatgcgtactttgaccatgccactatcgcaggaaaacaccacacactcatcacaagaaagtaggtctcaccatgacttttgcagaacttagctcaccgcgtaccatcatcgcttttaatggccgtgccgaatctggcaaagatactgcagcacagtatctcacccatatgcacagttttcaccgcatcgcctttgccgatggtgtccgtgacgcactctatgcgcttaacccactggtctgtgtggagcaggctatcaccacacatggtgccatttatgaccgcgtggccactgttgtggacacacttggttgggataccgcaaagcaaatccccgacatccgcgcacttatgcagcgtattggtaccgaagctggttggcgcatccacggcgagcatctgtgggtcaatcttgctatcaaaaagatcaatgaactgcccgctgaccacgccattgtcatcactgatttgcgattccccaatgagattgagtggttgaacagcctcaaagccaacccgatgaacaccattcagaccgtcaaagtcatccgaccagatcatgaatcgaccttgactgcaggatcattcggtactacctcacatatttccgaaagctttaatctcactaccgacactgtgctccgcaacgatggcaccattgacgatttgcactcaaagctggctgattttttgagcacttccccgcagcccgtgctctctcgtaacgcccctgtaccaaaacacaacgcaccggcaccaaccactgatgccatgtaaataacccccgtatcaagatcactgccacacagcagctcttgatacgggggttatttttttgctcaacagctcataccttaaccaaagctaaagccatcattttgctgctgaacttgggtttcttcctggataacaggtcgctcttcttggttcattgcctgataacgctgacgcatccgaagctgctggtccacagagttgagcacaccgttcgcgtccataccaccctctccaagtcgtacctgcgtcttaggtacgcccataagctcttgggtgtcgcggtttgtcggatctggggtcgtcataataaattcttctttctatcattttctattaataaccgtactgcggatcattggttttcgcttcagtctcacgaacatacgcttcataaggattcgcgggtcgttcctctggcagattcgattcacggaaatcatgaacattcatatccagctgtgctgcctgattgatttgcgctgcttgtacacgacgacgagctgccagttctcgacctgatccacgattttcttgaggtcgaaccatagcatcagtgtactcgctgctcgtgtctttttccatagttatggatttaacaaaagcgtccgcatcctgcccaaatgtctgcccatgtttgcgcacaaacttatccagaatcgctggatgatcacgctgcatcaccttctcagcctgatccatcgcccatacctgaacctccttgacctgctcagtcgtcatcgcggtctgattaccatcatcctgcaacaccttgatcgctgcctgtgtgcgctgtgccatagcaatctggcgcacccgagaagcactgcgaccacgtgtatcaaagtcaggtaacagtttcttcgcagaggcgaggccactttctgagacatcagtcgctgtcatgaagccggcaactacatcacgaacgccatcggaaccgtactgctcaccagctacccgcatttctgtcgccaaagtcgcagccaggttgtcagcgaagttctgcgcattacccatcggctcacgaacactaaaccagccggcgtttttactcaaacctgcaccatcagggaattgccatgtcggggtctttgaaatcaccatgccacgtcgttgttcacccaggcgcacggtgccaaaagccgtctcattaaaccgggcagcatagcctggatcgcgctccatgcgacgacccacaatatcgcgggcagcgccataaatatccttcgacttcaggccatgctcttcaccctgcttgaccaccatgtcaatatcttctgccacctgtgcagagacatccttcgcatccactatcgcttgaccatccgtatctacttcacgcatcgcctcatacgcttgatcagacaaccgaaccacggtctgcgcggcagaagcaacactcatggggattcgttcacggttgctgatgatcgctgttttctgctgcatgaacgcatcagagagcgacttcgcttccttctccgtcttatcgcgcgtcagctttgacttccaaaaatctttggacacatacttcgacaacttagtgtctttagcctgttccagatccttgttaaacttgcgcttcatatccacgttcacaccggtcatacgtgggctcatgcaccacatcaccgcagcagtcgtacacgcggccatcaccgtttgagtgttgacccctttgcgcagtggtcccatcgcagcctgtgccatctcttgggcaaaattatcatgagctgcattgatcttccgcttacgagcagctgcatctttggcatcccgtgctaggtacggattatcactttttggtggcttggcatacttcttttccgctgctttgcgttcctttttggcaacgtcaatagggtcaaaactctgtgcatggacttcacgcatgtgcagctgctcatccacaccagaaagattagcctcattatcagctacatcttgtgcgccactacgcggtacaccagcctcatcagcgagtcgatcatcatcactacgatcatcttgtccagcacgcacccaatgactggtatcaaattcttcgacatcactgaggtcatcaaaatcagacggagctgattcaccaaaaatgctgcgctgttcaccatcagcaacctcataactcggtgttatctcagatgggtgaagctttcgccgaggcaacacatcacgcagtgtttctggttcctcagactcaccataagcaacaggctgttgctctacaccaataatagaagccaagtcgctgctactcatgacatttttccttgggtcatgcagctgccccaacgtcttaggctgggttaatgactggacagaagatacctcgacactaacctcttctacctgttcatttacatcaggcgcctctgcttgttcacgcacctgctcacttgcttgtgcagcaagactaatctccgcctctacgactgcctgggcacgccgagccacccgctcttctcgtatcttattcttctcattcccagccactgtcaccacactccttaaaagtccatatcgtcaaactgattattctgagctgctgcacctgtgcgttcaaaacgacgcaacaattctgcggcacccaaccgtgctgttcgcacatgcgccggcacaacagccgctaattctttatctgttaaaggtgacacaggctgcgctgcaacctctaccacggggtcagaggcaaccacctcacgtgcaacagatcgactctgctgtcgtggtgtagctctcatgctctgaccccgcgttccttttctgctgaaatctactgccattatttagagctcaaacccgccatcctgtcgttgtggtggttcctgttggttgtaacggcttgtatcaaatcgacccataaactgattgttcgcaccaccatgagtaaacgggtttcctgtacctggcttcggcacaaccggagtaggcggaacagaattctgtggtaccggattatgcacaggcggaatattctgctgctgaggcacaactggctgttgcgcccccattgcaggtccctgatgtccataattcccgatttttccgccctggtcgagtggctgaccaacgccccggaagtccgtctgagcaggcgaaacaggttgctgtgccggaggtgtgacaggcataactggcggggtcgcaggcacctgctgctgaacataattcccctgtacacctgcatcaggtaacggtgctggtgcagcaatccctgtacctacttctgccggcacacgacgctcaatacggaaaccagaacgttgtgggactcgctcaaagctcgccaatgactgctgtgcagaaatcgactgaatctccacatcagggataccaaaacgcgctgcatcctccattgccttcatattggcgcgcaccacacgaggggcaaagtcataagcatcaccgtcgtagatgttgacctgctgctttgccatctcgcacaacaaatcaaagcggttcttcttatcgccataggcaagctgatcaagtgctagtggcttaatctcagtgggtagctcatcatggctaagcacacgcatataaccctgctcatcagagaattcttccgcgatcttctccacctggtcaacgccaaccgagacacccatacccttgtcatcggcgtacatctccatgtactgctgtacccattcatccttggtggcctggataggctggtggttctcgtccctaacgacttcccactcatagcgaccttgctcattctcaccacgacgcatcttgcgaccttggtagagatcacctactggtcccataagagtttctgcacgatagagcgcgtcaatcgggtcgtgcttcgcctgcagaatcgactgctgtgccggtgctgatgcagccatagcttccttggtcagaccaagattgcggcacaatgccaccatttcctgctcttttttaccagccacaccggtaaagagcaccttaattgcagtcgccttctgcgaaccctcatagtggctacgcagcgcttctggcgttggttgacctacgtctttaaaaccctgcgccggatcagcgccgatataggtggcatattccttcagcttgccaggcgaacctttcgcacccgtctcgaagcactgcgcaacagaagccatatggttttccataccgtcaaaacgcaaggtcaccaaaccatcgcggttggcaaaagcctgtgcatagtgctcattgagatcatccatgtgtgcacggttgacctctagcaattcttcgcggctaatctcgccggcctcgtattcacgctggtagcggttaagctcagagacaataaccttcatgttctcggccattgccggatcatggtgctgcgctacctgtacatcgaggctgtcatgcagagttagcccataaaacatagtgccgtcctccatacgcttaccatcaccaagatcaagcatgtttgcctcaactgtgagcctggacaatgcctcctcatgcgcctttttcggcagattgccgaccagacctacagagtcaccatcgaagtcaccgtcaaagctcttcaccgacacagggttgactgccacaccgtgcagatcatcattaataaccacacgcaaatagcgcacaccaccatcgcggatcaccggatcacgccacaccattgcataaccgttatcgagaacgccgagttcacgtgccatcgaagagttcatggctacttcatcaactgacaggcgtggatcacctgtccacacagcagtagcggagtgtgactgtcgcgccgacataaagccgtccttgaacacattgttcttggtctcgatccggctggcgacaatatcattagcaattccatcaaagcttgcctgcacctttttctgtgcttgatcaacaaacttctgtgactcgctcagtcgcttttccgcagcacgaggcaacgtgccgtgctgcgcttcctcctggcgcaatgcgtcaatcttggcttgctcttctgccagcttgtagcacgtatcaaaaatagccatataccgcgtggtgtactcatgtcgagaggtactaccgtccgctaaatcctcatcactgcgcaaatgcgggctcagtagtggcaactgatacatgtctggattattaggtgactcttctagctgtgcaccattgcgcaactgtaactggaaaggaatctccataacaccaccagcgcgactgatctgctcaacaaaagcttcgcgcacctgtgcacgattaacacgattattcagctcaccgttctcatcgtaaatgcttggcatctcgatgatattgcgctgctcattggactcgctgaacccctcgcgcaactcaccatacggggtgacatcaagccccgtgacgcgaagatattcctggaagttagccaatgcagagacgttgttgccataaaagtgctccataatctcatgacattcctgggcttggagcacccacgccagctgagaagacgctttacgtccttggccctcacgaacagcttcttcatcatagacattggttttcgcatcaacagccatatgcgtgacgatgaagttgagatcaccagaggcacctggttgaacacgagtagaaccatcattattcctgaacaccacatcctgcgggttgttcatgagctcacgtgccgtgccaccattaaaacgagaaatggcagaaaacggactcatgacaacctctagatcagggttgtctcggaaaaacgccacctctgattccagccctgctgcacgtgcatcagcatcactcatcgctggatcaacaacaagagcgatcacacccttattaccgtgaaaatcagacagcttatcgccggcaaccaaggggcgcatctcatcttccgtatcgcgaataacatgggtattcgcaaaatcggcagagacaataatgccatcttcaaagttccaaccgcccagctgtatcatcgcagtgcgtgcaccaccagtcacagcgctagcctgcatgatgttcgagaaagtcatgttctgacggtcatgtgggtcaaagcccatcgcccatgattctggatgcgctgcaacaggtactcgatcagccggatcaccaggggtaatcatgccatcagcgcccaccttcgcagaaggcaacaaatagcgaacagaaccctggttcgccgccataccagtcatcatgggatcaaagaaacctttacccgcatcaacatcaagtacagaaatgttacgcccaccggtaagcaccagcgcatcacgggagttatcattacgcgcatcaaaaccacgctgctgtgctcgaatatcctccatcacattcgcaccatcacgaatagagttgtcgtagcgcacacgcaaactcgcagtctcaagcaacgcagcacgccactcatcgctcaaaccttcttcggcgctgcgctcgaagaagtccacagggaagcgattgtcatacagtcgcttatatgcactgttgatgctggttgtagcacccactcgggatcgctcagtgaacatcaaatcttctcgcacacggtacaccaacgcctctgacatcacctgctcatagcctttgagcttggtacgctcttctaaactctttgtctcaccaggcttttgtggtaccacagacgcggtgtagccaggggcaaacatatagttctcgccaccattaaatttggtgacaatttcaccatgctcaccgcgagtaaaaatctgacctatctcaccctgcacatgacgggtgcgttcaccgcgaacctgccccttactatctactgcacgactatccttcgcaccaacacgtcgctgtgcggtccaccgcaccacaccgttatcgtcaacagcaatatcgaccacatcagcaccattgcgggaaatagtctcggcaatgacagtgccaaatcgagccaactgcgggtcaagatcagggttattaaccattttctgcgcggtctcaggattaaatttgagcaactgttgattaataacatcgttatagaattcgtcaccgcgcagttcatcgccagtaatcgaagtcgctcgcaacgcggcaataatatcgtcatggtttgaccacagggatttagcactcggcatgtgctgagcaactgtcaccggattaaaacgcaagccggtaacaggatcaggctccaccgtgccgacataatcatcaagaacaagggccgcgtgctgacgcacacgatcctccacggtcacagcattcattgctgaggtcatcgcagcaatctgctcatgatcaccatcgcggatagcagccatataatcatcgcggttaaccccagggttaagcagatcggtttcctcacctcgcagcatcgcccaatagtcctgctttatcgccatgagctcatcctcaccagcaaaagccggcatgaagtcaggatcatcggcgtactgtgcagaaagcgcaatcagttcttcaacgccgagctcttcggccacacgcgcacgagtaagggcgatattgttaccaagccactccgatgctttcgcttcattatcaaaccactttccaggaccagcacttcgatcacgtgcatcctgaacgatcgagagcccttcacgcaccatgaatgcggaacgattcttagtgaaatatgcatcctgtgcctgctctaaagcacgtgggtgtcgagcattaggcacaccaacaagacctttgccatcctgtcgctcaacctctcgaccgagagcaaatttcacgagatcgacaacttcagttgggcttggttcataatcagtagccggtgtccacgttccatcaccgttctccatgcgctcacgagctcgtagacgttcttccgctgtttgttcggcggaatacttaatcacagtgccagaatcatagacacgacccacccactgttcattggcgcgagtatcagtgagacgaatatcaatacgggtgccctcaatacgcactttaagctgtcccggctcacgatctggctcgatcctaaaatccacaccctcatccgacagatacgtcaaaatagcttccgagcgcgcgataccctcatcagacatgaccttgttggggtcaattttctgactcgcaacatctgcggtatcaatgagtccagcacgcagccatgacgctgcggcacggtattctttagccgtcataaactgaccaatattgggcagtcgcatctggtcattctcggtgatagtgcgccaggcaatagcttcaccattgacccattgagtcaacggtcgcacaccgcctttagtgtcgtcttctcgatgagtgccctcgtaaacatcattatcttgtaggtggatcgttgctagatcaaggtccctgatcatgccaacactctcttcggacagtgatagcagcttggtaccgtgcacacggactacttcgcggtctgaccagcgtggatcataaggcgaaataggtaaacgacgaccacccagatcaggtccctcaggcaaaccattaggtccaattgcagtgccgaccatcttgtcgaaacggtgacgcagcgcctggtacccctttgaaccctcaccctcgcgagcaatcgcactaaacatgggtgctgcgtgaggtgccacctcagcaaaggcagcattgacagaggcgaagaatgcctgagtactcccccgctgctctactggttcataggttgcgagatgctcatcaacaagcgctcggatcgcacggccatcagaggtgctaaactgcgacacaccagcatcaacgtgcgtaccccaggtaccaaacatctcgacaccttcatagaaggcgtactcccggaaatagctctccatcggatcaatgacaggtaaacccacaccctctgattggcgaacggactcttgcgcgagcgtttgttcagcctggaatgttgcttgatcacgtgcctggaaaatagctgcctgctcttgctcataagcagcttgctgtagcgcttgtgcctgctgctgttgggccacgagatcctgctgcaccagcgcgtcataagatgacttaatcgccgtgtattgcggtgaattaagaatatttcgcctagttaccttcgcgaactgtggtcggtgtacacagccatgagcttcggcatcagcggcgaaggcatcatcgaaagacgcaaacatgatggcgccataggtcgcttcatcattgaggtctaagcccttattgtttgctgcgcgctgtttcatcaaggcttctgcttgcctatagatacgcacagcatcgtgatcacccagtggagctttgccccagtgatctttttgaccccactctgagcgcgccatctcaagcgaccgttcaaaagcgtgtcgaaataaagttttggacatactaaagtcctcccttttctttattcttttgtcatatcactaatggacatgcggatgtgtgtagttacatccataatcatactctaaaacttaatcgtttttaaagtacttttagaactagaaatgaaagttaaaaaacttaggtctttagagcaccgacaacccctcatccgagctcaaaaatttgtactcggctgcccttgcgcattaggattctctcaactaagacatgttcaccacggcaccaaaaagacaccattttatgccgcacatttgttcactacattcactgaaaaatcttgttgaccactgacaactagcaagaagcggcaaatatgtgcggcttggcataaactgtgtccatcggtacctgtgtaatagacacacggtaaacacgcacaagataaaacattgcgagatttttcatgagtacaaaacccactattgtgtccacattttctggttgcggtggcctcgatcttggcctccaagaggtcggattcgaccccatttgggccaacgacttctcagaagaagcagtccaaacctataagcacaacatcggtgaccacattgttcacggcgacatcactgaaattgatccgtttactgatgacaccatccctgacggcgatctcgtcaccggcggcttcccgtgccaggacttctccatgatctggaagcgtcctggactcgacggcaagcgtggcaccctgtaccaaaacttccgtgactttgttgcagcaaagaagcctaaagcctttatcgcagaaaacgtgaagggcctactcactgctaaccagcacaaggctattaagaccatcattgaagacctcgaagctgttgagcctggctacatcgtcaagcctcgcctgtacaacttcgctgaatacggtgtcccacaattccgcgaacgtgtgctcattgttggcattcgccgtgacaccggctttgatttcaagcacccagctcctacccatggccctcgcggtgacatgccgtataagactgccggcgaagcgctcaaaggcgtgaaggatgtccccacaaacaacaaccacatgaagatcatgcctcgcaccgttgaagtgcttaagcgcatccctgagggcgaaaacttcaccgcgatccccaaagatgacccctactacgtcaagggcatgattagtcacgtttaccgtcgcttgcaccgtgatgagccatccaaaacccttatcgccggtggcggcgggggtacatggggataccattatgaagaaaatcgagcattgaccaaccgcgagcgggctagaattcaatcgttccccgatgactttgagtttttgggatcaaacaccgaagtccgccgccaaatcggtaatgctgttcctcctgtaggtatgcacgctgtgggtgagcgactgatgaacctgtacaccgggaattacactcccgtcgatctagaggaacagcacgcgtacctgcagacgctctccattaaggaacgtctcgcgctggctgatcaggaagctgattaagtagatatatgaagcccaccgttaatgttgtgttcaatgcgcatcaccccaaagatacgcagccgttggataagttcttcgataaagaacttaaagacacacatcatctcgatataacggtgggttatatcagtgagaaatcactacaatatttgcttcttattgcaggcactcaccccgacctcaccatcacactcacctgtggaatgcacgctcgtgaaggcatgactgctgcccaactgcatcatgcgcgagtgctccatgactacttaagcgaccatgatcgaggcggggtgttcgttattccccgattgcgttatcacggcaaaatctatcttttccacaagaaccagcacacagatcctattgcttatatcggtagcgctaacctctcagccatcgttcctgggtacacctctacattcgagaccggcgtcatcttagaccccgcacctgaagatctcgtgcttcatctcaaccgtgatgtcgtacccctatgtgtccccattgacaccgcgcatgtccccatcattaaagatcaagaatccccgatgaagcacgtcgctgaagcaacagctgtgtccacctctgatgttgttgccatcatgtccagcccatttacttatagttttgaccttaaactcaaagccactgccagcagcaacctcaatgctcataactcaggcggtggcgcgcgcaaacagaaaaacggtagcttccttgcacgcaattggtatgagggcgaaatcattgtcggtgtcgagacaacaagactcccaggttacccacaaaacaaatccgaattcactgcggtcactgatgacggctggtcatttgtttgcaaaatcagcggaggaaacggaaagaacctacgcagcaaaggtgacctgtccatcctcggtacgtggttaaagtctcgattcattgaacaaggtgccctggaatacggcgaggatgccacccaagaaaacatcgaccgttttgggagaacacatatgaccatgcgctatcacccagatttcgatgtgtggtcattcgatctcagccaaaccccgaagccttcgacacagattgggcaggattaatttgtcacaccacactcacctcaataactacatcacgagcttgagtgataacgctgatctccgtgaaaaagtcaccgcaaccgtagacgctttccgccataccgtcatggatgacttcgactacatcagtgatcaacaagtcctgctttatggcgatgtccaaagcggtaaaacctcacacatgctgggaattatcgcagattgcctcgacagtacgtttcacaccattgttattctgacctcgcctaacacacggctcgtgcaacaaacatacgaccgtgttgcccaagcatttccagatactttggtgtgcgaccgtgacggatacaatgatttccgtgcgaatcaaaagagcctcaccccgcgaaaatctatcgtagtcgtcggaaaaatacctgcagttcttggtaattggttacgcgtctttaacgacagtggcgcactttctggacaccctgtactcattattgatgacgaagcagatgcgacaagtctcaacaccaaagtaaatcagtctgatgtttcgaccattaaccaccagctcactagcataagagaccttgccacaggatgcatctaccttcaggtcacaggtacacctcaagcggtgcttcttcaaagcgacgatagcaactgggcagcggaacatgtgcttcacttcgcacctggtgagagctacatcggtggtcaacttttcttttctgagctcaacaacccttatctacgacttttcgctaatacccaatttgacgaggattctcgcttcagcgacgccatttacacctatctcttaaccgcagcactgttcaaacttcgcggtgaaagcttgtgtaccatgctcattcaccccagccacactgcatccagtcatagagacttcgcgcaagaagcccgcctccaactcactttcgccttcgagcgattctatgaaccaatgattcagcacaatttccaacgtgcttatgaacagctcgcacaaactgacagcaacctgccacccttgagaaaaattcttaacattcttggtggcatggaagatgacttctccatccacatcgtcaatagcgacaacccgactgttgaggaagattgggctgatggttataacattattgtcggtggcaactcgcttgggcgcggtttaacattcaacaacttgcaaaccgttttctacgtgcgcgaatccaagcgaccacaagcagacaccctgtggcagcacgcccgcatgtttggctacaaacgccacaaagacaccatgcgtgtgttcatgccggccactattgctcaaaccttccaagaggtctatctcggcaacgaagctattaaaaatcagctcgatcatggcacgcatatcaacgacattcgggtcattttaggtgatggcgtcgcacctactcgtgccaatgttctcgacaaacgcaaagttggaaacctcagcggtggcgtcaactactttgccgctgatcctagaatcaagaatgtcgaagcactcgacaaaaaactcttggcctacttagacaagcacggtgaggactccaccatcggtatgcgcgcgataatcaccattctcaacgcctttactgtagaccccaacgatctcgacctcgcgaccttcaaggctgcgctccttgactttgaacgcaaccaacctcatctcacagcacgtatggtgctgcgaacaaaccgcaaagtcaatcagggtacaggcgccctgctctcccctactgatcaagctctcagccgtgcagaagtcgcacacccattattgatcctataccgcattgaaggtgttaacgatgctgctgcgcaacgaggtgaacctacgtggtcaagcgaccctatctgggtgcctaatattaaactccctggtcaacgtcaattctggtgcgtagacggctaaacctcgccaccaccaaaaaacatacaaacaccgctgttgattacgttcaacagcggtgttttttatcgctcacgacacttaagcatcttcaatacgcctaaaggctcgcgcgacttctttatcaaagtgaccctgggcgagatcacgccaatgcggaagctccaccagcatgatgcggaatgctcgggtggtcttatatttacccatagcagacagcggatcatcctctgtgccagatagagcttcttcaccctcagagtagacacgcgactgctccactcctgcttgcgcgcgcataagtgcaatatcttcctgcgacaacgcctcaatcaacacagtgccatcgacagcattaaccaagccgttgttagcagtcacccggaaattcggatcttgagcaaaagcgtgcaggctctcatcataggctgcagtgagctcatcttcgagtgagtcctgcaggatgtggccgaattgatcagccagcatatctcgtgacaccttgccttcggcataacgcttcaaccgcatgtcagcgagcttatgttctgcattctcctgatcgtgaatgaattcatcattgacctctgcttcttcagacagagatttctttttcaccttcgtaccagtagccacggggaagccctgagcactgtcttcgaactcatcatcaaaaacgtcatattcagactccatgaaatcacgagcattcatgacagactcatccccctcgtcataatccggcgtgtcatcgtactcatctttcgcgatcatcgtgtccacgatgtccatgatttctgctgaatacacatccatatccaggcgtgcaatatcagagtcatcgagcccagtcgcctttttataaatatcgacggcacgctgagtacgaatcgactgcgccatgcgcttttccagcatcgccataaagtccggtgcattttgattcacatcgaattcattagcgctcgacagtgttggaatagtctgcaacgagtattcgcgacccggttggataatctggttagcaaacaacatgaacgacatcggccaaatcgtttcattgcgtgaccacaccggatactgacccgcacggaagacgatggcgttctgcgatggcagagtatttaggtcattataagacaccaccggctctttttcagttgcagacgtgtacgacactttaccctcggtgcgcataactaactgtgccaagtcacgggttacggtctttgaatttctgcgtacaacatgtcgctcacctgaccaatccaccaacgtcttaatcattgtttcgtctgtggatttcaagaagataatgttggacgtgttgtgggtcgggatcatatcgtcagtgatgtagagatggtcacggtcggcaatgctgatgcattgcacggtatcgcggcgggagaattctacagagacgatttcattgtctgctgcgggcacgtcgagacgtgcccgatctgctggatcgaagttgtcgaggatctctggcgcccgcgctgcgacaccaggcagaaacaccttatcccctcgtgccagcatcgctttaagctctgccgtggtgacgattctgcgctcgccagcaagtgtttgcgtcatactataaaccccttcaattaaatcaagtaattaatatactaacttaattgagtttatttttacggtttaatttactctaagcgaagacgcccggaatcaccataagcaccgtttccagacgcagaaactaattgagcatattgtaaaatatagctatgctgacaatgattccgccacgaccatctacacagctgacagatagaagcgttgagaagtgttttaagtgttagcgattaaagcgcccacaaatataaccaacagcaaatccagcaagagcacttgttgttgcgctctcgacaggacgggtggctatatcctcggcaggactatcggggctatcagcattatcttcgtcataaaaatcagtgagtatgccatcaataaagtcatccatgattgatgtgatgaaactggcgactgcaatgagcagcagcgatacgcacataatccatgcaggtgcatcactaaacgtattaggtgtgcttgggacgatgaatccaaatgtaacagagtagacaagtccgggaattagtagcgcataaatagcaattaatactacataagcaataacaacactgaacctagaagaagtcttgttgacgtaaagcgccatgcgacgtgcgatatgcgcgaactcatggcgaccgtgcactactctatacattgttatcgccatgtagatcgccaggattactacggatacaatcattgcagtcgaagttagcccttcgaccaatggagttggcgcaatcatcaaaaccagcagcagcgctctaatcttgcggacgaataatgtgcgcaacatacttcctgcaatttgcatattgctaggatcgtctgtgcccctgccacgtccgcccttgaggtagtggtcttcaattctattggtattagtcactggacttttttctccttgtgtaaatgttcctgaaaatagtagactcattcgacttttaggaatggcaattaactctgtcgatgaaactgtgaagtaaaagcagtttcagtaaaagcacatctatacgtgctctcactatcactgtgcgcgcatcataaaaacgcgcaagcactatataaatatcaacagtttctgcacaataatcagaaaacaataaataagctggtcaccacagcaactcaccccacccggtcccccttttttcctcactgacaccggagccgcctcaagcaccacgctgcaatcacagaagctagttgagcatattgtagaatataactatgccaacactgcttattgacacccatccgcatcttgcagcgcaacttcttgaccctggtttaggtgaacttcttacagccggttccaacaaaaaagtgcagtggcagtgccctaagcactccaatcacatctggacggcctcggttaataaccgcaccaatgcaaagaacccgcgctgcccctattgtgccggaacacgagtgttggcaggttttaatgatctcgccaccactcacccgcatcttgctgtacagctggttgaccaagatattgccgtcaccatttccgctggttctggcaaaagacaactgtggcagtgtgtagtaaacccaaaacaccagtggttggctacgccaaataatcgcacgagtactaaatctgcgagttctggttgcccctactgtgccaaccgagcggtattagtcggtgacaatgactttgcaacaacctaccccgaacttgcagcgcaattagtagatcaatctgcagcgacaacctttacagccggccacaacaagcctgttgagtggatctgttgcaagcatgaaccaccatttatctggaaaacctcaccaattttgcgtgtacgacagaacacccagtgccctgtgtgctcagagcgaactgtggcgccggcgcttaatgatcttgcaaccactcaccctaaacttgccgagcaaattgcagatcctcaaccaagtggtgtgagcgccgcggccattatccccaccattagcaggggttcccatacgcaattaacatggcaatgttctaaaaatcatgaccaccaatgggtcgccacagtaaaggatcgtgttcgcggaacagactgccccacctgcgcaaatacaggaacttcacgcaaagaggctgaacttattgaggtcatccgtgcattattcccaaacactgatgtccagcaaggtgcgctcattaatggacgtaccggtaatcaaggtgcatcgccgtcaaccgatgtactcataccgtccaaaaatctcgctatcgagttcaacggcctgtactggcactctgagcttttcatcaaagataagcattatcatgcgaacaaatcagctctcgcagaacaagccggtgtgcagctcattcatgtgtgggaggacgactggaatcttcgccgcgacattgtgatccgcatgatcgcacacaagcttcatgcaacccataacctcagtgctgttttgcctaccgaaactactgactcacgtgtggcaaccaccgctttcgcccgtacactcacactgtcggtggtctctggttcacgcgctgctgcattcttgaacagcaaccatattcagggtgctgtctcggccactaagcactttgccctgtgcgacaacaacgacgatattcgagcactcctgtcggtgcgctcaccaaaaaacaatgcccgcatgtatcgcaaaaaaggcacatgggaaatccagcgctatgcgacactcggtaacgtccctggcggttttactaggctgctgaagtttgccgagcacacactcaacgaacacagcacagtactcaagcaatggatctcattttctgctgctgatgtctctgacggcagcctgtatcgaactgccggttttaccgccgagcaacagcttgcaccggattatcgctatgtcggtggcgcaacaggttggcgccgaacacccaaagaaagcttccagcgcaaacgctttagagacgacccagcgttgctatggaacgaatcttggacagagcacgaagcagcgctcaacaacgagctctacagaatctacgatgccggcaaaacccggtgggttaaaaatgttgcttgattctgcagattagttactgaaactgaattaatgtaggctgcgtatggcctatttttgctggttgtacagtgtttttccgcattcgtaagggatgagtgacctgtcaggttgccacttctaaccaaataataagtaatcaattttaaaggaaaagaattaaagcatgtctaaaaatacaaatatttcgccattgctctcctagcacccatcctcggcttagtcgctgcaggttgctccactacagctgaagagccagctgcaactcaggtagaagaaacaacagtcgcccgagttgaacacgatacttacgacactattgctaaccagctacaagatgccggtgtctatgacgatgtggcctttgccgaaggctactaccaggaaatggctgaggttgtatgtgaagcacgcgaagagggtatcacccacgaggacaccctgcatatgctcaatgacatgatggcaatgaaacgatctggcgaagtactcaatacgctcgctgatgttctctatgcaaatgaatgccctgaatatcgaatctaaattgttggttcactctgcatagacacaacaccacacaacaaaaaacaaccccctaaggataatcctcagggggttgttctgtttcgactcattatgctgcgcttgctgcatcctgctcggcaggaaccacaatcacttcccacaaatgctcatcacaagcctctgtggttgagccatctttacgtgtcacagtaaatacatctcgctcaccctgtgggaacacaccgtcaatctcgctgactgtcccctttggggtaagcaccttcatacctgcttctgcttcgcccatcgtgacccatccatcaggtgttgcgatcttcgccgtcaacggctgcgcattaccttggagaatcttgtctgaggcttcgccatacacctgagtcaactgctgcagtgtctgcagaatcaatgatgtcaataggtaacgctttgatcttatctccacgttttcccctgacccacaccgtacgtgcgactttcaccgcatacggcgctccatcactagagttcttatccctccggtgacttgtgaccattactcctgctctcattacaagagctatcaacgcttcgatcactacttttcaacactcgttcgactgcttattattcttcgtcagtctacgcaaaaccgctatccaaaaacttcttcctgaaacggaccacttactaataactcgccaattgattctgctgttctcgccgtatatgggatctccaaaagtgttagctctcggactacagtaaacgctcgttttcgtctgtcgtgctcttgttggatcgcgaaacgactctctccaccgaaatactcaactggtctaaaatgctgctcaccttggcactcaatcaacaaccagggctcggtatccttgaaaaccaaaaaatcataactcagtggtcctccaccaacccccaccaaaccatcgaaagtcttttgagattcaaactgaaaatcattctttaaaagaaagtccctgacatgtgactcttggattgatccgtgcaaacaaccacacgattggctaataccctgcctcaacataatcccagcaacagcattttcggagccgcacatacatcggcacaaccacatttgagaccgcccaccaccagggtaaaacctgtcatccgtacgagacagcacagtccactggttaaataccttgccagtcaaatcttcaaaaacagcagtttctcgtcgctgttctatgcgatagcacccgcacgatattgaccgaccccgcaacaaagactgttccaatacgtcccttgtcgctccacactcgcactcgcaaaaccacgccttagataagcgaccccactgcagcacgtcctcaccacgtcgaacaacagaccatcgaccaaatgtggaaccaactaaatccctattctttgaaagcgactcgatttttagacaaccacacgatttcgaatcaccattcttcagtgaccccgcagcaagatctttctcaacaccgcaagtacatctgcaatgccacatggtggttttccttcctgtggaggaaaccctactttccgctcgatctatgacagtccatcgcccaaacacctgacctatgagatcctgtaagttcttaccctgcatccttttacgaacagtctcataacgacgacaaccgcacgatgcggtttcatcagcgttcttaaatctagaggccggtgcatcatactccctgccacaatcacaaagacattgataccgaacctcaatcttgccacttttgtttacacgatcgttagtgcgataaagaacttttatatgcccgaaagttttaccggataaatcattaaactttcgtcgccgatgttgttgcggtgctcgtattgtcatctcaaactactttcaaatatatacctttatttgtatatattaccccttttaattaattaaacaagctttcagccttgataacaagtggtccatttcactataaagttattaaatattggcagctatttcacgccgaatatctttcccagttccgtttcacctatccgttacatgctgcccttaggtgctcactctgaccctgctcgcctcggatgtgcctgtaacacatcagggaggttcataaattcaagtcttacttgtcccctacgagcactaacgcatttctacgccgaacaattcaagagccgtacattcgcaagttcgtcagttatctcactcgataacattctcaccctaggcagtttctggacacccggcatatcagcggcacatcagatcactctgacgctttcgtagctactgtgatcaaatcccagcacctttacgaccgaccttctgccgactctaacgggctttatacagttctattttgttcaaaccgcataccgtagcttggtgtgcacatttcagggcgttactccgtcattctgtgtatcaatgaaacagtttcttgcaactttaagctgcaagagcgtagtttttcgctacgcaactggtcgcactaaattgttgttcttgtcccagaccgatcgagagcatggtttcaaatcccgcaataccatgaccctcactctgaaggtttcccaactcgtccaacatgaaacgagtcttataatccggcttctgattctcacgcgtcatatacgaggaatcgaagttcagatccacaagctgtttgatgagaatcaaaatcaacttcgcatatttcataagatgcggaggcgttacgaagaacactgccttaggcttctccgaataccgcacattcagagccgacaccgcatcaaccatcgcatcaacctgcttgatcatgtcatgacccggcatattgatctgttcctgcgtgagttggtcaagattcagtttcttcgtcttaaactgcacatgacctggaacaaagtcaccagcatcgtttttcaccagctcgatcagcagaccattcttaatgatcttctcatcggtcaccggatcagtaataaacgcacggcctttaaggttcgtttggtagcccttggtgaacttgaagtacagagtcttgatcaacgtgccagaagtaccattgagaatccgcaaacgcaggtacgcagtattactcgggaacgagtctttaatatagaaccgcgcccaaccctcaaccgacagcgtgtcatcatgaacaaaattcttacccaacggcttggtgaacttggcgtcactatacgcatcccatttcacctgtgatccaaccaggttgtagcgcttcacatagggggccgcaaaacgaacacccatgcgccgtggaaacgacaatccggccaagtcaacgttctgacttagtgtgcctgaggttaacgttgaaattgtggggtctgtaaagaaggacatcgctgtaatcgcgataccgtagaccgacgccatcattttttcagcgccacccattgctttcagggccttatctgcgttgcccaccagagtacgaacactggactttggcagaccgtctgtggcactaaagaacaaggtgagcatgtctttttctttctcaccctcccacagaaacatttcgttctcttcggcctctgtcacagcatcctggaacatcatggctgcattttcatcagtctctaagttaccgaattcaccggcacgtgcacgttcattgagtcgctcaacgggattcttcagcttctttgccgaaagctgcacaaagagctggtagcagttgtagagcgtgaccttaccccacatctgatcaatacgtgtatcaagcaccttggcatcccaattctcagctgcagcctgcttgcgcatctcgcgctcctcttccaaatagaagtcgataagaccataggctgcacgcttgaaggcattgttggccgcattcggccataccggatcatcggcaccgtccaccggaaagaacacctctgcgatattttccacataggttgcgcacttcatcccgttaccttcgcgagctgcttcggctgctaatcccaacgggttataaatatcagttttcaggttgttaatcaggttaaactgaacaacctgaaaaccgcgcttagacatccgaacataatttttcttcagcaactcgcctttagggtcgttgatacacatattgttcggtcgagtttccctcgtccacatgtcgatcattggctcaatgtaggtctgacatgatcttcaggactgttcgcaacacaatcctcgggggcgaacccctgctcacgctttcacgtgagatgagattatatgttcatcttaagtgcttaataacttaataagtttgtcgagaatcccaatcaattgaatctaaacaaccaccatcaaaccacgctcgcgcatcacttaatcgaggatgtcttccctcaccatcaatagaactgctgccatcccaaaaaaccaaataattcaacttattgattcttgcggcctcgcgcttagccacatcagtttcggtccagacacgaatgaaactcctatatctagattgaccgccaaactccgattcaagttcatctgctctacccatccaaaatctaacaagactctggtcacgctcgtcagatgaatcaaaccagtggtcattatgactacgatccccattcaattcgatgaacatatctcgggatttgatgtagtagtcaacatgaaaaggataacgatcatccacaaccacatttcgaagtacatcgtccatgccaaaacgattttgaagcaaaacttctaaggcgtcctctggttttgaatcatttaatgtaccgttcaatctgcgagcttcgaaaatcttctcccgaatttcaggtaccaaaacactatccggcgcaccataaagcgatgtcatagtttcttgtctagactttcgaactttttccgcaacttctgggatttgagtcggataatcaacaccatggcgatcattcatcgtagccctaagggtattttgcattctcaataatatgtctggatcttgattcgggtgctctactccataacgttcaaccaacgtggctgttcttttctcccgcccacgctcaacagcaacctcattgacaaaccgatcaaaggtcgatttatcaaaaacgttatcgactccgtagcgctccctgactgtagcaatctgcttcaacttccaacactcatctcgcaaaactctatagcgggactcacccagaatcgacctgaatacctttgcgtaatccccgaatccacaatctaacgccataattttcttcgatcttccagcttggtatagatcatcaaattcacaactcatctccctataggcagcttctacttcatcatggttaaatcgtttctcaataaaactaatctgataattttgcacatcagctttactaaaccgagtgcccttaaccaaattctgtttcaataccgattgaatagataatccggtatgagttttgatgtagtcaccagggaaaccacggaggtacaaatctgttgcctgttgaagaattgtcataaaaatattctactaaattaatgacattactatcgacaaacctattaagttatcaaacaacataagagttagatttttcttctgccatgagcttgcagttctactcccccacaaggggataatcgttgaacctaccgcatggtgtcacgcactgtagcggtgtggctgctaaagacccattgttacgtgatctcttaggatttaaccttaagaccatctcttcttttctttccgctttcgcaaccatatcggtatgagttttcactctgccgtttcggtaagaagagctttagggattcaaagcaattaacctaaaagtatgcgcttgtcaccaaacgcacagggccttagttacccttacctgcacgagtcatagccaacaccagcgtattcaccggagcttcatcaaccacataagcaccagctggtcgctgcggctcataatcgggaaactcccaatcctcattgatgtgctgcgcgacagtatcttgcttaccagtcttgtcacgattactaccaccaggattccactcaatctttgctggattaaagaaccgtcgcagctcgggaagattcgggacatctgatttgtcaaaaatcgcatggctaaattcgttgtcaatcatcggcaagctctttgtgatcggttgtcctgcaccgtcatagagcacttcacccttttcagagacaatttcaccagtgtcattgtcgataattgtctcctgtgcaaactgcgttacatccacctttttcaagcccttattcgacagcatcacatgggaaatcatgcttgagggctggactggtgagtgtgcaccgacatcggggaacagactcaaatcgcgcacaatctcctgcggaatcgccaaacgtgcgtcattggtgtgctggttaatatcggtggtgtccacagcgacgttttgtgtttctagctgacgcatcattgctgcgcgtgacatcgcatacacacccgctgcaaccgcaatcacaaacgtcacccgaataatgcccacatgaccaaataacagccagctacccaccgaattatcaataggttctggtgcatcaaagccatgttctgcgaacacactagctacataatcggcgtaccacactggctctttaggcacgctacgcgtacagtcgccaaaattattgccaaattcatcaagcggttggtagcacgtggtgtgagcactactggtgccgatttgctgttcgacagcaacataatagggtctcacaccaagctcatcaaaaagctctttgtcattaggtgagccagtattcatcatggtctggatcagcagcccgataccgccccaggccagccacatcacaaccaggacaaacacgcccagaatcgcagcacccacctcaacccacatcggtgagcgcatttctccgatttcaccgcgtgccagttgctgctcattgtgtacgtcacggttgcgggctttatccgtcacccgctgttttcgcagctgatcaaaggtccgatcagtctgctttagatctttggtgccaccacctttgaaggctttgccaccagacacattgtcataatcgcgtttacttgaaccgaataatgccattgcccttacctttctgttgttttttctatacaaatgcccgccacacaatcacttatgtggcgggcatcaacccaatcgcctatacagcccgcgcaacgatcttttagaagaaggctgcgccagcgaccatgccggcaatcagccccacaatgaggacggcaatcaaaatgatgttgttgctgcgatcctgctgcttgactgactcaacaaacgtcatggagttcgcctctgcttgggtggctcgatcgcgctcaataacaatctccgcctcatgcgcctcattatttacacgaatttgctcttccatgcgcttgagcgccgcctcagcatcaagacgtgctgtggtaatttcccgctcagcacgttcctccgatgcagcgacaatagtgtcgcgacgcttaagctctgctgcgaattccgcttcctgacgctcaagtgccttgcgctgggaggcgatcatcttatcggtctcgacgcggataccctcgatgcgctcttcggcttccttggtcaactgtgccacacgattatctgcagcaagcttctgctcattcaccgatgccaaacgcaggtcatcttcgcggtgatcagcaataaacttgtcaagatcaacaatgaaaccatcgaaagctgctcgttgcagttctgcctggcgctccacaatcgggcgcaattcgtcaataatgcgagattctgcagcgttagcccgttcaccagcacgtgcacgacgcagcgtgttcatgcgtgcggtgtaatcctcaatggtgcgatcccgcaggctcgtcagctctcgacctaccgcttctagtgatgcggtatggcgaggcatatgacggcgatcatactccacgcgctgctccgcgatctttgccatgacatattcttcacggttcgcctcatactcctgctgcaattgctgacgacgctctgactccacacgctgttgatcaccagccataacatcgcggtcacgctcaatggcacggtaaacctcgtagaattcggaatccttattatccagtccaagatcacgagcgatctcaagattagagcgatcattaagcgcaatgtacatcgcgcgcacttcttcgtagtcacgctgatgctgatcaagcagctgaccattaaacacagccaccaatgtacgaagctgatcacctaaccacggtgtagtctcctggaattgcggcatcgccacctggaacggtgccctggtcaaagcattattgaagtttgcctcatcgacatacagccccaagtcgtcattaacataacgtttggtgacagcatcacccacttgatcggcatcaaagctgcgggcatcagctgcgtgcacctgtgccaatgctgcctgtgaatcctgaaccggattgtaagccagtgcttgtgcaagttcttctcgcaaagcattaagttctgaaccagtctttgcttgcacggactcagacacaccacgaatcagcgcctggatctgctcatcggacatgccggctacaggtgccggtgcagcaacaacatcggatgcaccaaaatctggttcatcatcactgccgaaaggatcgtcttctgctacatcaccaaaaggatctgcatcagctgttgcttcgacaacctcctcatcctctggctcagtaacctcggcatcgtcaataccaaatccatcactgaaatccggtacatccacctgttctgctagtgcgacatcatcagggctctcaataaccactgtgtcatgggactcctgtgcatcaacatccactacgtctgcgctgtgaagcaccggctgtggtgccacatgatgcttgccctgcaacttggtgaacacatgcacaatattgtcaatgatctctgcactgctcggataggaatccacatcaagcttctcgcgaatgaggtcatccgtgataactcccgctgcattgacaccctcaagaccataaggcacgtcgccatcttcgtcatcaatatccacctcagaggtctcattcagcacctctaggaaggtggcaatgacctcaaaatcaaccacgtcttcgaggtcagcagcaccgctaagcacatcgccgacctcggaaaaaatgtcaccgcgtgccgaagcgctatttttcgcgggcaccttaaacaccaccagctcacccgtgtcaggttcaattgcagccactccgtagtgccagcgtgctttgttacgcagtaaatcaaactcatccatgcgatcgaaagaatctgcatcaggaatgacaccaagcacatcgctgtcaagaagttctggagtgacaacggaatgaatatcatcgttgaccaccaggttgatgatcgtgcctttatcctcgcggttcttttccttagcgttgagcccaccgaattgtgaatcgtgagttggcaacagcatgactacccaaccggtctcacctggcaaagcgaatgcgtcattgcgacgcatgacctcgactgcagcacctggttcggtttcctgaatgactgaggcgagtcgttcttctttgcgcagtggctttactgctgcatcgccagaaacagccccctcccccactccatgagaacctttcgctttggtgaagcgatttttcaatgaatcgagcataacccctgctttctgctgtatttcgagaatctacgtattcgaaaactattaaagtcgcgtaattaatataacactaattacgcgactttaatattgagtttctttatgtttaaaacttatttaagcgaccccagagtaattaaccttcgacacgctttatcaccacacgggccgtagacacacggttagtcttattacgcatctgaccatcgacatcaacgtaaatgtcacgcacttctgggtaggtattaataaaggtcgccacttcagtgaccacttcccgctgcaaagaccgcaccgcaccacgggcaccaccagattcagcactttcctccacctgatccacaagcagaaactccataaccttttgtgaacagtgcagtttcacgccgtggcgttcatagacctcagtagccacatcctgcagcttcttgctaataatcctgtcctgtgtcgtctccgacagcggttgaaaaggcacaatttcatctacacgaccaagaagctcaggtggaaaacccttattcttgatcgacgtgtgaatgtttttcacaaagtctttgatcgcccgaccatcgcccgtgtcatcagtggcatagttcgaaattgtctcgaaaatctcagaaccagcgttagttgtcatgacgatataggtattaagaaaactcacctcacggttgtaatcgtcagatagtcggccatcatcaagtacctgcagtaacaaccgcgcaatagctcgatcagctttctcaacctcatcgagcaggacaatagcgttaccctggtcagcgacacgacgagtgagctcagacctgaaaaggtcaagacttgattctaaggcgaactctgacatgtcaaaacgaatcaatcgcccagtgtcatcaccaaagagcacccgtgctagttgcttgaccagctctgttttaccgacaccagtaggcccggtgaacaagaagttcgacagtggccgtgatttatcatgaagatccgccaccaccagctgcaaacgacgtgctaccacagtggtggcaagactttgcgccattaccttctcatcaagcttgtctttaatgctcgtaccatcgaccttgaatgcaatatcgacaccaatagcatcgtggagcacatcaccgagcagatccatatccatcggcttgccggaaagtcgatgccaaccaaccatcgcatcaaggacacgaatggatttacgaggctggacagaactcggcataaaacgctcagtggtggagtaaatctgctcaaaaacgtggtcgtcatagaactgatcacttacgccataacgatctgccataccacgcaaaatcgccacagtggtcttctgatcggtcggcgttagtcgaatttcctgcaaacgctccgtcaatgcttggttcggcctgatgtgttcgtgaaattcttcgagagttgtcgcagcgataacgcgcacaccaaggacaccagacatcgccaaaatcggcttgattgcctctaccgcagcattagacagctgcacaatttggtgaaactcatcaacgaacagcaccaattcatgaccttcgtgcttgcgataggcaatggcgtcctcaaacacacctttaatacgcgcagccatttgcgccggggtgctcaaatccgcaaccattttcgctacatcgacctcgatgtagttacgctctggatctttcaccagtgcttgctgtaccaacgtagttttacccgaaccagcaggacccacaagcatgacattagaaatctctggacgcatcagcgcggccataatcttattgacttcttcttcgcgcccaataatctcacgcaccggtacagcaacaggcgctgcatacgagctcaaataagggtacttgtcttcatcaatctcacgattaatcgactctcccaccaacgtacccgccacaacctgggtcatcttcccacctttacaaaaaagttaattgaatttaataattaattaaatactacactttattaactaatttgttaatgcagattatccccgtaaatattgtcccagtgctcaacaaaagacacctcggtctgctgtgccgcacccatagcggtgcgccactgctcttgtgacatatacacccatggactgtccatacatggtggatacgccttcatccgcataagcccaaaagggccaacaatcatggctgcggaagtacctagacatagaccaataagcacaccgataaaaccaccgagcataagccctaaagctggcccacccacgatgagtatgcacaagccaataaacaacccgaccatgagctttttcatcgcctcaaaggaatacacccgcttcatcacccagacgtaaggctgcgactcatctggctgataatgcaaaaacttcgtcgtgtcaccgcccatgccatctgcaccatcaccgaaattcaccaacatcacctcggcctcaatctgatgaatacctgccggcacacccaatagcgacgctgcatcatcaagggtaactagttcagtgttgttaagaccaagactatgaaactgtgcttcaagctctgcaatttttcgatcatcctgcgatttagacatcgcggacacccgctgccatatcaacgtgcacaacgctgtcgtcatctctacagccagctatactgcgggttttctccgcatacgccaacacatcgtccacagcggaattatcaacggcaccaactttgcgcccttgtgctttcttcgcacgctgcttgtcccgcttacagtgagttttctgctcctgagcagcctgtttctgcgccaccagttcatctacacgcgcttgcttcgcagcctttttctcggcccgccgttgtgctgcagcagctttccctgactgctccgctacaaattcttgagccttacgcttacgctcaatctctttatcgcgctcagcttgggttcgcttgcgttgtgcatcgcgctccaactgcttagccgcgctcgttttacgtcgagcttcttggcggtggttccaccagccggccacatcaataccatcggctcgcccaataatgacgcgatcttttttacgtgcgctcgcctgcaccacaccatgagcgtgcaccgtgacacccaatttctgagccaccacacatgcccgacactcacagtcacgcagaccagagccataatcctctagttgcgctggatcattatgcagctcacgaccaagcttgtggtgataacgtcgctgggtttctaccaacatatgctgacgcaaggacgcgatatagttaccaacagcaacagcatctgacgcaactggctttttcgcttttttcgcttctgctcgggctgcaatatccgaggcaatatcgcacttgatgccctcccagatcactgaatccatttcgacaggatctgcttcctcgtagactgtgcctgacatgcgctgctcatagcgcaatagcgcatacaccaccatgacgatgacagtcacaaaaatcggcacgtacaacagtggcaagccggcgccaataataaacaccagaaccgcgagcgcactaagaatcccgctcacaattatatggattacccatcgagactcagtgatctcagtaacgctcactcggtgatctgcggcatctcgggtcacctcacaacgagttgtgcgattccacgtgtgaaatatgatctcattctccggcgttcccattttcataactgtctacctactttcctgacgtgaaaaaatactatatttacccctctgtaatattagtactttaaaagtagacttttatatagctaaaaataaacaacaaccccgctcccagcacagctgaaaacggggttgttataaagcgcttacgcttcgtagccttggtcgtagctcttatctacagaccgtgattcttgaggtagcgctaattgttcaagctcggatcgctgtggttgaccaagattcgcaaactgcggaatctcggtgctgatctcactattaacctggttggcactaaaccccgatgcagatgccccagcgttgctgtagtcatcgccaccaccaaagtagttttgtgctagtcctgcgagaccgcccgtcgcaccgccaataccagcaccagtgacaccgccaagcgtggagtaaccaagaccacctccttgaatagcgcccgacaaggaatcagccaacccctcatgaccagactcagctaatttatcgtgcactttatccgcaccaaaaccggctgcaccgctggccatcgcggatttaatcacacccggaccgccgtctttgagatacgatcccaagccgcctgcaatggcagaataagcactagccttcatcgagccaccctcggcctgaattgcatcattggcaagcttggtgaacacaccagctccggcaccagcgagccctttgccgaccatgttgcgggccttcgaggacaaactttgaccatcttcaaaatcgctatacgcaagccctgcgcctgtagcagcacctgccaaacctgcacccagattgccgtattgacccatgaaaccgctgttttctgatccagaattctgtgcgctgttgttgacctgtccaaaactcatctgctgattctgggcctgctgattattctgagagttgctgagaaacttatcttttgcccatcctgctgcaacgggggcaactgtgccagcaaccgctagaagcggaaatgccatatcaatcttctcctacattgtgctgttcatgatctgagacaaacaccccaacaatcaaaaagtttgttggggtgtggtgtattgcgccttttaaaacggtggctcgttatccatctgaggttgtgctgccggctgctgcgtctgcggtgccagagctgctgctactgctggcggctgcgtctgcggtgccagagctgctgctactgctggcggctggttaaacggattcccagcaggtgcctgcggtgcctgagctgctgctgcctgctgctgcgcggttgcatgagctaccgcgtctgcatagacaggggctcctgcatatgctggctgctggccctgtggcactggtgcctggaattgctgattctgcataactggctgcggtgccacctgtggtgcttgagcctgggtcgcttgggcttgtgcagccttctgcgcttctgctgcttggcgattcattgccacagccataaactgctgctgctgaatattcatcgcgtccgaaataggaaccccagatggctgcagagacttagtgttcatgaccgcagggagagacttgccgtccttggtcttcgggaacatgacatcagccttgaccaacatggagtaaccaactgtctcaccgtctttgctcaagagcggggtcatatggttgcgcccctgtgctgccaccgtctgcatcgcttgaatctgcgcatcagaatacgcaacacctgtgttgcgctgaccgtccttagtgtcaagatgcagatgaggcatagtctgtggtgcaagattcgcattcgcacgagtgccgtcagcgtcaatcggaatctgcgctacctgaacatccacaaagtggacagtgttacccttttcggtcacatgcttggcgctgtcgtagacgttgacaacaagatctacacctttagtagacgcgttcggattgatgacattgccatctttatccttgcttcgaaaattagccatgatacaaaccctttcacactaatttgttcgggactttttatattacttcccagaacaattcttattaagtattaatgtgaagcataatcaccttgtcaaacaaatgcaatacttttctttaaaacttatgagattcatttaccattgctgaaatatacttttaaattaataaaagaacacttcgacttaattcatatcaaagtgttctttttttttaatcaaccgcctaccccaatccaccatcacgggtactccgcagctgtgaatccagcacagctcgatccacagcatcacgaatcagtggctgcactcgcttatctagcgcaactgttctaccccgcttaatctgcaccgactccggttgtacatgtcgttgcaccacctcgaacgctggttgcgtggtctcctgatcaatttcttgttgtcgctgtgctaccaactcacgctcacgacgagcctgctcttccgctgcacgctgagcgcgttgtcgcgcctgctctctaattctggcaagcatggcactacgcaaaatacctgtacgggatacctcactactggttgcttccatgcgagttatgtccgcgccggcatgatcaagctcttctgccactgcttctggttcctgctgcgaactgatcatccactcccgagcgcgttcaaaagcataacgtcgctgggtgactaactcaccgtaactacgcacaatgggctgactgaccttctgatcgctaaaccagtcatagtgaagatcgtgcaggtcagcgccacgcacctgctcaaaatcatgctccggtcgaaacacgacctgaaacctgccacgcaaggtgtgcactggatcatgagcgctcacatcacgactatcacgtaactcttcgtcaaggtatgtgcgcacagaatcagatacatcagcgaccggcaactcaattgtttgctgctgtatctggcgttcatctgcaccctctcccccagattcacgtagatctgctgcatccatcaatacagcatcaccttcaacctctaaacgtgcaccgagctgtgcccattctcgtcgcaaatcatcaattttttgctgataggtcaccatcatgcgctcaattcggccatccaggaccgcacgcccagctttaccctcagcgcctgttcgagccaataacccaccaccgggttggtcataaagttgccgacccaaagcttcagctgcacgttcatcgctcatgcgtgccaaagaacgatctgcccgcagtgcacgcagacccacaacccttttaccgtaatcagcaacctcagcccattgcttctcccactgaccgacaggtggggcaaaggtcaaaaagtgctggtacttggattggcacatcgcatgatactgctcctcagtgtcataaaaactccacattacctgtgaggtgggatcagccaaaccttgagagttagcgtcctcccacgagcgttttttcacggcaaaggcttctcgttgttctcggtgatgattcaagcgtgctgaatacgaccgcaaacgcagcccaaattcctcaatacttggctcaggctcttctttccccacctcttgtgatccactactaccctgctcgtctagatccttgctcttcttccgcgcaataccatcgagcaaatcctcatagtcttgacgcatgactgtcaacatggccgtagagacatcgcgttgctcatcggaaatcgcggataggacactgtagacaccgttcatggcctgctcaatgatcttttcgcggccattatcaatcaaacgctgggtgtcctgcttgcttaaaccttctttaacgcggcgtttttgcgcatactgatagacctgcgacagtgctgccggcatcggtgaatcagtctcaccaagtcgcgcctccaccaactcgcgcactaatctattcggcttatccatttccttggcattggtcgatgcacgccacagtcgcttatcctctggcaaacaagcgaccacaaattgcgcagcactttcttgggtgagctgatgaaacgcccagcgcttgacgtagctggtgacattgcgtttttcataccccactgctgctgacaagtgcgccatatgctgatgctgatcaagccaggcgtcaataccacgccgcaaaatagccttacctggcttattgattttgcctttttgcgtaccatcagcagcccggtgtccataaccagcatccaccatggtcaagtgggcgtgcacatgcttcgtatcaacctgaatcacgccgacatagcgcaaatcatcataatgacgctgggctagacgatccacaccatgcatgacagccatgcgtagcttcatttggtcaacctggccgcgataatcaccagcacgcttaatatcgagatcctctggaataaggccatgcgcggtcaggtaatcctgggtaaaagataggaccactttcatcacggtatgcctattttcatagagctcttggacgttattacttgctgcatgaagatcatcatgtgacagcgagacatcgccatacccaaaggccactcccccattaccctgagccctcagcatgagatcatgaacgcgctgcccatcctgggtagtaaattccgcgagttccctcgggtgcacaggttgtgatgggttggtggtgtcggagtctgtattcacgcccgctcgcaatgctgctcgccgggcgctgcgttctgcacgacgttgtttcaaggtcgcgcggcgaccttgccggccacgacgagagttcatttcaggttgctggtcatagtctgcgttactgtccgtggtgagctgctccacggcactatcacgtgccatataccgcatgatgaaatcatctaatttattgcgcacaataggtgctactgcttctaccgcatcgctgcgtgccatatagccagagatatatttacctggcgatgatcctcgtgaacctttgccatttgcctgcttaatcgtatattcattgcgcacgataatggcttgtttcaaactcattttcccaccgctctttctttaactacaacaacagcgcccccaccaaaaaaacggtaacgacgctgttgcttctcttgatgcctcaccttggctaaagcacgacgttgcgtgcctcttgctccacaaaccgggattcaacaccacgtctaaacagcactcgttcggtgtccgtaatcttcacctgtgcattaccgcgtgcatcgtcaacgcctgcatccgccatcattatgtgcgcatagacatagctccggctcacctcgatagatgcgacataacgcatatcctcaaaaaacgttccctcaagccccaagagcccattcatcacggctaaacgcaattccatgagatcaatctctggatgggtgtccgcataaatatcctgaccaaaatagttcggatcaaagctcatgattccatgctcactgagatagctcttatcaaaaacgacaatcgctgagataaccgtatgcccgcacgcaaacaaatcctgaatatcttctgcagcagttgctacatcgtcattactcagcgacgcatccccataaccgaagcacgagcctccgtcatcggctctcaaccctcgggctgcaatattgcgctggatatgctcatagggtgctagttgcgtcttggttgcgccgcgacctttgaccaggcgctgttcgatcatgaccatagcgtcgtcaagtttcactgtatttctcctgttgccttatgtgtgtacagctatgaaaaaatcggcgccaacagcacaaacatgcttaaagtagcgccgatcctcgttatagatctagcccgcgttctgcaattttctcatcaaacttgcgcccctccgcaggtgatgcgtcatagccatgcttttgctcgcgaatatatgcctcacgcacagattcttgagtctgaatcttctgtgcaacacgtcggctggcttctcgctgcgcggtcttagcccgtgactcgcgatcaaaatcaagctctgtcgcagaaatctctgcagcactgacacttgctggcgcctctacctcggcggtattgacaacatcatctgcatcaagatcaatcacgtcatcgaattcaagctcatcaagatcatgaataacatcgttaatctctgcagcactgacagttggtgctgcatcaacctcagtctcaatatcgctatcccgctcagcctcccgctccaccacaggctcctgggcgcgaatcttctcgttgtagaactcggtaacctcgcgctcccactcactcataccagcggtgtcatcaagatcatgggcgaggaattgctcagcatcaaagctctcttccgcaccaacaagcacgggttcagtctggaaggaaatgccagcaagtttcgccatcaactgtgctgcgctcagcgctcgctcctgctcaaggcgctgtgcatgtgcactgacaccggtacgggtgcggttagcatcagcgaaaatatctttgccttcaatctctgcacgagaaattgactcagagaaatccttgtccgcctcgcccgcttcacgctggctacggtagtcctcaaacatgctggtgagctcatagccagaggattcttgactaaaatccacaccatgaatctcagataagcccacaagcacaatcggtggcgcatcctgcgactctggtgccacgacagtgacatcggcattcatgggtagttcccacggcaggctcgtcatcatctcgcgcggtggctggaaaccttctagatacagacctttatcaatgagctctttatgctgctgtggactgaatttataaaatccactaaaacgctgttggttttctgaatcaaacgtaattttttgaatgtcgtacggtagctgcgacaatgcagtcacgctgtcgatggcaccctcaacgtgcaataccggctcatgctgcgtgccaataaactcaacttcaacaacatctggggtaaacaccgcgtacaccggtgcatcgagctgtaccttttcaccctgttcggcaacccgctgcgctgcgggtgaattggtgttaaaacctgcaagcttcatatcatttctcttttctctacgtatcgtgtgtcaggcgtggtaactagctagttgcgagctgctgcaacagcgtcgttgagggcgtcgtgtcggttcttatcgtctgactcttctggctcagactgtgcctgttgcgccagagtctcttcagcctgttgagccgagtaaatggcatcaagtttgcgctgctttttggcttctttagcctgctgcttagtcagcttcttttctgctcgtgcgcgcttcgcgtcgtcgcgagaaatcttttcacgacctgcgtataacccctgtcgcaaagtcatggtgaagcgccacaatgcaccaaaaataagattgagcactttcatgaccaccagtgccagcacaatcatgagaaacagcaccgggatgacccagctaaagaggaacccatcagtagtggagataatcacaccagcagaagcgccgatgctggaaataaccagacttggcagtactgatactccccacgtaccgatgatggtgaccacagtgccagctgcaaggatcgctaccggccacacggcgatggcaaaaaccaggaaagcaaaccaaccaccaagtgaaccagtgagcttccagaccttatcgacccacgaaggccatccaccggtgcgtgcattaattggttcaaccgtgttaaccgctaccgcttctgcaatctcagcctgtgctgcatcatgagcgtgctgcaattgacgctgtttcttatttttcgctcgtgccatagtgcctatctcaattcctttttaatgcaagtatgtttgtcactttctttttataatattaaaagacaaaacccccaatagctagtcaccaactaactattgggggttgccccagaaacttttagcccgagtatttcacaccaccggggacagtacgtgcttcgaggttacgaattttgccgtcgatcacgtcataggcaaggcgtgaggtagaggttgtttctgcctcaccaccagagcgcttcgacttcatcgtcaccgtggatacatagctgtactctgtaccattaatgcgagtaaccacggattctaagctgctaaagcggttggacagatctgcatcataggcatagtgcacttcgccagttggatcggtgcgagcaatgcccgccatttcaccaggcataaacaccgacataaactgtgattcttcatccaggtcataaacccgcatcacttgctcgcgcacatcaaggtagtcgcgcacgctgtcccacgtcagcgccatggacaaaaattctcgaacaacagcatcatctgcagccttgtgttcaatatccataccaccggtagcgtcacgcaccacctgctcaagttggccctcaagcttactgtttaatgcatcacgttcctgttgcaaggccataatctcaccagtttgacgcttaagtacagcatgtcgatccgcagaggtgctggtggcaacaataatgaccaccactgccaagatcaacgcaatgatcatgacgatattgcgaacaaaaaagcgcttgacctgatcgaacatcggctcgtcctcagttacaccactctggttatctacatttcgtgtcgtcattatctgttctcctgtttgttcagctgagcgatctctagtgcccgctgcagctcatcaacgaaaatagcctcgccctcaagccccccgccttcactgccagcacgtgcagcgctcgcctctgcatttgtgccgtgggcaccaaattcacttggtgaggtggttgcaccaatacgctggtgtccttcataggtatgcgccaacgccagcgagctaaacacgccggtgttgatgttgtaatcggctgtcacccacgccaacagcgcaccgtcacgctcacctccggtcaagcgggcctcccacatcaccacaacgtgctcggtatctgacatcgacagtgtaggggtcacagtccatccccaggactcagcccccatcggcgcccaggtgggtcggttgttatctccgacaacaacttcttgtggctggtaccaacgacccgccgcaggaaattcacctgtcgtaccagcagagaccgtgaatttcggtttcagctcatcaacaattgtcttgaactgctcggtcgcggcatcatcatcaacactggtaataatgccggctaactgattctgtaagtcagccacattctgtgcacgtgaggttgctgcgtcaaattgactagcaagagtctcttttttgggcattgtctctgcagtgttttttaagtcgttgacttcattacgcagagtgacaatctgctcattgtttgcactcaccttgtcgtcaaagccgcccgaggtggtactgatccacaacgttgtaccaataaatacggcgccagccagtactgtgacagcgatacgacccaaaccaaacaatggcttacgcttacgtgcatcttcttgcgcttttgctaaacgacgtttacggatttgttctgcacgacgacgcagatcatcaccggtaatcttctcgaacgcctgcttttctttgtcgctgcgcacttccccattgacgaccccatcgacagagatgggcttaaggtcatccgacccgccattattctcagccatattaaaccccttttaaagttactaagttattgaagtttctagaatataagttattacacaaaaacggggtgcacaagcgccaaccagcagctcgcacgccccgtcacaccaacccagcgatgaaaaaaacttatcctgcaggagtagttcgagttgggttagtcatttcgccaatttctttaccagccggaatctgtacaccagagaacactgagtttgtctcagcctgggtgttgcggaacaccttgaagttcacgccccatccatccagactcaaggtatccagaccaggtgagcggtcattcaacgatgcatgaccaatagctgcattaggctctgcattaccagggcccaacatgtccacaacaacctcattgctgacatacatcgcaacgtgattcggtgcaccaagaagcacatcgccaggtaacaaatcgttctctgacatggtggcaagattgccgatttcctcccaacggcccgatcctgtgcccacaacgtattcatactgtgctgctgttggacctgctgggaacgtatcatccgtgcccgaccagcgaatagcggtagcaacgccacggtcacaggatgcgtaatacggatcaccggtgagcacttcatcatggatatagcggtaaatatcagtaccgtcattgccacgagaatcagccagataaggatgtgaaatagtcaccattgcttctgcagcggacgtatttccacctgaggtgcggtcctcttcaggacaatcattaagagcatcctgctcatcacgcgccgtggattttgctgctgcaccatcagccatagcgatcacagactcacccaaggttgagttcttttgccaaccacccatctgcgcgtaccacttagatgcttgctctgcacgaatgggtgcattacctgcgacatctgccgggcgctcccactcacgcaggaagtactcggacgctgcggtggggctattgctactggagtttttattatcaaccatttccagaaaaaccttgcgatcgctttcattatcgccactaatagcaaatgcaagctgcacgtcgatgtaatgccagtctcggtttctatcggcggcaaaatctagcaacatctgtgtgcgccctgctgtccactgcccaagcccaatacccatcggctgaggttcaaagttcttatcccacgcagctctcttccgaggaccgatggtatttggttcatcaaaaataccctccaccgcagtcgggtcgatacctgattctgtctcaaagttgcccaagacaccggcgatattttgatcattcatcccaagatacgacagcgcaccgtacaccaacttcgcgttctcagtcatatcacctgcgtcaatggtaaacgggttggccgttactggcggctcacacaactcgataatgccgtcttttcgacctgccggcaccacaatcatcgacacaatcaacgcaatagtcgtcaccgacgacaacaccgagcctgtacctgccagcattgcgcctacacgtgcagtgatcatgccacctgtggcagcagagataccagtaccggcagacagggcaagccccatcattcgtgtccacaggtttttagccaaattacccatagagcgagcaccattggctgcaagtgctgcagtaccaaaacctacacgtagtgcgccataacctaagccttgtgcagctgagcgggtcttatcttttgcttcatcaacaaaccccgagcttcccgagtcaccattatcaggtgcatcgggggcatcatttggttctataaaatcattagccacaatgcactctcacaatcaataaaaaaaatctagaaacggaattcaacagcatcggaaccttgggcaacctgagtattttccactgcctgatcaagctgtgtttccgagatcaacagttgttgcaggagttggcgctggtagcgctgcttttcattgaaatagtcctggtacgcctgtgccagattgttttttaaatcaataagtggcttggcaccttcactgagcacatgatcttctaggcgatcaccgttgcttaagacccactccatttgattggcattccatgtcgctttagtttgatacgcgtgatctgtaatccaggtcatagcatcttgattccctgggacaacatccttgaggtagccatcaagtgtggtgcctaagcgccaatcaaagtcataaccgccaccaaaaatatgatcggtgaccaggcggtatgagttgtattgatagccctcactcatcagattatccagcgacgcagccatgaacgtcttgtcctcccaacctgggacagatttcccggtggggtcctcagcgagctgcttggtaacatcgacacttgccaaaccttcgatacgatcaccgcgaattgactcatgcggaataggctcaatcagcgacacgcgctcacccataatggtcgcgctcgtaacgccgagcgcctccttgtaattctcgatgcgaccaagcagtgcgttcatacgtgaaagtgacgtatctagtgcctgtcggtgacccacctccgtatctgtcatagaggtctgccaatacaacgcacggagatcaatctgttcgtcatttaatgccggcaacgtcgccaaagtctctgccgctggattgagcatgatgcgccactggtcgtgatcaataaaggaatcgtcatagccttgagccttcatattctccgaggtcaagtttgtactatcgacttcgacaagctctttctttgcacgcattgtgatgttgagaacctgcatatcaaagccctcaggggcctcaagcatgagcccaattcgaccatcaccaaagctataaatggaacccacagttgcttgagagacatctgctgctttggggctggtgccaaggtctttcacaccggtgacataggcaaaataatcctcagcattagtggacatattggcgggaacagcaaacttaataacagcaaaagcccgtgtgccctctacatttttccaaaagcctgcgagctcgctgacctggttggttcgtgatgatcgaaactcggcgttgtacgtggctgtttgagaaaaatcaatgttgccggcctgcactgcgtaaacaattgtgctgccaaaaagcaaagaccctgataccactgctgcacccgaaataagtgctacccgctcgatcgtgtagtgctggcctaaacgaaagcggctgacaatacgatcgactttcttctgcataccctctttatttgatgatgactttttctgctttgcttttctctgcacagtatttgtcatagctctaccccatttctttaatgacaaacttattttaactatttaaagactaattaaatttaacacaattaaataaacaaacatactgcattatttaactcaactaacgcccccaaaacatacaaaaagcacaccctcagacatctgagaatgtgctttttgtgcggtgctgaatcttagccacctgtaccgaaaccggtaaccgtatcgcctgcaccagacgcaaagttcagcgcaagtgtgataccaccaactaggaacgcaccaccgacaatgatgagcaaaatagtggtgaaccactgaatctgctgaccactctgaccaccgaagagcttgcgcatcacgttgacaaagccccaaatcacagcagcaccaccaacaagtgccagcagcgaaccaccaataatcatgaggtagtcagtcgagttttcaaggaacgactgtagatcccaactctcacccgtggtgtactgatcagcaccatcccaaccggtgccaccctgtgcaacataactaacatttccaggaattgacatattcaccctactttccacactattcccataagtaataaacaacttttgttatcacctagtaacttagtctgttttttagtgggtttcaattcctaaatacatttattatttggttaattaataaggattaatcaccccagaagagtatattaaaggcataaagaatccccatacactttgcgtgtatggggattctttacgtcatcaactaatcaaatactaattatcctgtgctggtggagttgatgaagacgaagtttactggttatacaacacagtatctagcttaaatactcaggaaaaactctatggacgtgcagtgaaatgctcccattttgagctaaaaatcatatacatagcaacaggaagcatttccacgagagatcgcaacgctaccggttgtcctcgtaaaacgcatatccctcacgtgttgtcgattcatcgacaacacgtgcaacaatcggcaacattggtggcacgtgcctatgacccttccaaccgacattcctcggatcatttcttgacggcacctcgttcaccggcaccccttcttcagaaaccgccaatctagcagaattatgcgtcttattatatcttggctgttccagcttaatatataaagcctccttctcttttgcctcagcctgggtaaagcaagattcaagatgaaatgtagccatcgtagaaaaccacggcgatactagcctatgatgtgcgtggttaatagaccctaagccggcatgctccctcaaccgtacaagagggtttattgtctccccgatatacaaaagctgaccttcgcgatcaaacgccctatagatccaatgtcgattgacgaaagatgaatcatcaaatttcttaagaatctctggatacaatgccaaaacttccttataacattccaccttctgagtagcaatgcgcctatgctgctgataataatcagcaatgtttacgcgtaaaacatcagggtgattcgtcgcaagtatcatttttctcgtcatcggcaagggctctggctcgtctagtccttccgaaaacttatgtagaggtgggcgaaaacgaccatcctcccaatattgctcgtgttcaattaaagagctgatcgcctgagtatcctcccactcaactgattcaacaagctttctaatccttgcctctgcaccccaccactcttggtcaagcattagacatctgaccaactcctccatttcccgggaaagatcttgtacagggcgcccacggtgatcctgtaagtagtaatcagaatcttccaaaggattccaattttcagatacctcgtctaaagcctgctgcacctctacttcttcacgcagctccccttgttcaatagctcccaaaacatctgtgacaaccgctagtgcatggtcgatatagtatgaatccggctttggtatccaaaactcaggagaccattgatagtcaccccgttgccttgtcacttcagcttgcagatactgctccacctcatcaacatcagcagccgacggctgaaaaggaagttccaggttcgtataccattcttggagctcactaaactttagattcagctcttcaagcccttcaaatccagtttcactagaagaaagatcctcaagatctcgaagagcccaagaaaagctttccaaggatcgctcagcgaaggatatattgctgattagatcgctaacgaaccagtagctattcatgttcttaccgctccacgaggtcgcgtcagcttctgaatcataagcaaagaaagactcaatcatgaattgatctcgccaaccatcatccttcttgagtattgtattttccccagttacttcatcaatgagtagcgaatatactacttctttcgcggtgttataaagttcaaacaaccatacaggtcgatcaatcacgttttacctccgttgaggtacacagccctatcgagcgttcttcgtttacagtagacccttgtagctattccaacactgaaattgtctgattttaagaggcaggcaactaaaaacttaaaacctggaaaaactcgcttaaattggttacgcttcatctgccctacttaaaacagcggatcagaaagcaaaagattatgtccaacctgccaactgaggtttacctatcaaaccaaaatcaaaatgaaaccatcttagccctcaaaacgtggctatcacctagcgtggcaaaggtggaatatggcggatcctcaatttctgtggcaaagctactggacaatccctatgaggcattaaacatcgcccgccatgaagaacccaaatcctggcaaacggtcgcaagaattcacttcgattcttctgaagaggccactgtcattgtgacaatgaaaggtttaggtggaacagatcgtatccgactcactatttctcagtcagaaagctagcatgcaaatgtagttactaagcccgttccaataccattatgtagccctttaactaactaagctgcagattattgaaatcggcactattttcaaaacaggcctaaatagcacatattttctatcatcgtgtatcacgtgtcgtaccgaaagtttataatgggcattgtatccaccactggatatccgacataaacaaggaggcacctgatgaccaagcgaaatatcactactgtccgcacagaagacggatggggcaaccgccgagacaatgcgtcccggctatcaaaaagcttcgacacccaatcagaagcgattgctgccgctaaagtgactgctcagcgagaaaagttggagcatcgtatccagggccgggatggaaaaatccgtgaagccaactcttatgggaatgatccacacccacctaagggctgagtttcacaatccacaatacgttccaacctgcccgattaaaggctcagtggccaatcagcttagctgattggccactggaattggggcaagcactaagtcgtaagcgagtacaatggacagcacctaataagaattgtagaaaccgttgaacgcagctttagcttgattgcagcagcgtttccaagtcattcaggacttcttgcgcccctttagagccaacttccgaaatccaataggagctgtcagccgggtacatcttaggaaaattcttacttgcttcgcccaacatctcaagaacttgaggattgtcaatgtcaggtgaagcaaaaaaattttctatcaacataagagtttcagtcgccttctcagagaaagaattcttgacgaggattctaggaatgtccctctgatagagaatggcgactgaaccgcttcgcctccatccactcatcagtctcccagtcaagtacaaaccctctcccctgccccgccacggcgtgtcgtatgttcaactgatagctgcggtaagtatccccgtccaactttgaccacgcgattctcggtcgctcgactccaagtatttcccacgcacgctcatacacgtcacggtcaatcggggcatgaagaaacacgtagacttcttccacagctggatgtcccagcacagataggtacttgagagtcatattcaaccacttctgcgcatgcccgtagtggaactggaatgtcggtctctccgggtgagggttctccgcaaaaaaggcaactagatcctcgcaccaaacctggtgctgctggtcgaattcgtcttgggacctgataccaccgaaagagtgcacaaaactgacaatcttgtcgcaagacgtggccttcagctccttagctctagggtgtgaccccatcccccagagggtccgctgcacatctcgataagctggccaacatacagatctgatggtctcgtcactgtgaggcgccgaggcaacccttcttccaaaatagaaagcagtgagtgaggtgagccgacgttcgggattcatgacttcactttacccatttcggcatcccatccctggctgaaaccaaaagattccaaggttagtcaataaccaccgctgacgtgttgatgcatcacattaatgaccggtcctatgagttctggtttcactacagcgaccttgagcattaggcgcacctaattgcattaatcccactgaggttgagattgtcactagcaataggggtgttctcacgtgcgagtcgtacagcgagtttacatgcaaaatctttgcgttatcgagcaatcttggcatgaatctgagcaactttacggtgctgtttcttctagctgtcacttaccttttaacggtgcctttcatcagccttttgcttacgtgaaagatcacgttgcgcacgcttaaactgacgaagcagagattataagttcacgagtgccgtcggaatcgacaacggctgcaaaagagttgaaccccatatcaagagccgcatgatgatcattattattcaaatcttaaccgtcttttacagcaccaataaactcttcgctagttactgtgttatacaaccaatagaccccctccgtgttggttgcaccagcgcaggctaatacaggcgtatctcttgctaaaggtgcagctaaatggacatcatcaaaagtcggtgaatcaatttcacttctaacagagactgtggcagttaagaattgacctgatttatttcgtggaagctctatgtatgggcttccggaaccttgttcttgcgcttggcaaaacacatcttcctgattgaaataaaacggatcatgattagaaagtactatgtcaaaatctaccactgaatattcaggtagattctcatcaaatatataaactcgacaagtatctgacttcaattgactcaaacgaatagtcgctgtttctctaaatctttcgcgctgcaagtcccacgaatatcgcaatctagccacgtgaaacactccagcggaaagttcctttcctctaaacggggtgccttttttaaaaatatcattgtggaaaacaagacgttttatgtcggtaggttttttctcacgttttacatgaaagcgttgttcagcatgcctctcagttttatcatgcaatgacaaatgaatcggttgagcaccatcgctataagaaggcgtaatataaaaatcggccttcttcgaagtaaaaagaaatgggatacctaacaccctatctgtgcccccactaaacgcaatacaaatttcatcaatagtattatgccgactcatttgatgcccctagttattgtgaccttacagtcaatcaaagatatagtctgtcgagcggtaccgcttataaacgccacgccaagctagaattaccatcccctagcctcaactacggagcaggaccagtagcattggtaaatcagtagtaaactcgctcgtttataaacttgtttggatttactcacacaggctcagattctgagaactctctaatcgcggagtccaaaatactgttagtggcctgttctagcaatggaaagttaatataagtagctgggcgcactttctggccactatcaatcatctctttttgtcgccaagctgaattgtaaatttctctcagcaattcttttatttctgaaagactttctcggacaattggtgcccagagggacagatcgagttcgtctaccgccattttaaatttaacgtaagtagaaaaatcgttgtcgctttgcccctcagcatgtttaactaaatcttcacgaaactctgcatctaaccgattcatctcaattgtatgctcatgattcgctctttcaatagcatgtaaaaatctaataacagccaagcgctggctttctctaaactcgctgcgagcaaccttcaggtttaccttcgcttcttttctaaagtccaagtaccggtccacatatttcaatacagctgtgaatacagcaacaagcaaaccgcctgacacccctattaataaactttctaaatttatgggcaacgctgctatcttcttttctctaattatgtggatcagatcagttaattgtcataatagtgttaatctcaacctcaaagatgatttccagacgcattgattgaaatcacaaactcagttccgctggatacatcttcaaaagtgttatatgactacgaaagaaaataacgctctttaaactccggcgaacaggcttccatgacactactcatcattgttttattctcttgcctcttcgttttattcttctctcgagcgaggattcgcttctcccagtacggttctgcctgaagcatcttttgtggtgaaagcttaaaattcccgtgctcattagtccaaatgaaagagttgggggtaaaaatttctgagttgaacatatagttcgctaaatctacagaccaagaaaactctcgactttcagaaaaatggtactgacaaagacgacccaaaagagcacaaatccagtctgcaaactgaacagttccgtataaatgactgtccgcctgaagcggtatatcaaccactctgctcaaatctttatctgcatggcggctaaaaattgtgctacctaaagtggacaccgctctcgttcggttatcagcctcagtcgcatccatgatgaccataatctcatcatcctttgaggcaccaatcgacccaacgcgcttaatagtttgaatcaaacaatgcttttctcgctcctgagtcgattcgcagctgatgctcactggaccgagtggcttctcttgcccaaagaaaaaaacgtttcctctagatcgcttaagctctctcgatattcgtttcaaggcgggaatcatttcactcccatacttattatagtttttggtagtaaggagactcgcccctttcttttcccatcgtcgcggatgaacatttgctgcacgaatttcttcagctaaaagacgctctttaatatgttcgaagtaaccaccaaatcgacgaacctcgacttcagggatgacaaatccgccatagccaaaaacagggttttcatgatactttttatgctttggactgatataggggcctacatgcccaaattcatccaagtatacaatcaacaaaataaatacctccttaaaggctcagtggccaatcagctttgctgattggccaccggaattggcgcgttacccgtttttcagagccgccaccgtactccttaatattaaggagaatgttgcacttgcgcaacctcaattactgttgtcgcatctatctagtgcaaagaatacccctttccatcacccctttgtctaaaaaatacaatcagacaagagctaacacaacgaccgcagagatccctctccacggtcattgtgttttacacgctatttaacgcctttatcacccttctcggttacgccactcccctgctgtggatctgcttcagtgccacctacactgttgccgtccatgtttgccatgcgaccgcttaccgctgctgaacgcattgctgcattcatcgcctggccggtcacagaaggcttctgacctcgctgtgcacggataccgttcttagcactgacaccgctgcgctgtgcgcctcgaccgccttgagttgctccaccacggccaccagagcgtccgctgccacccatcgcgtcgcgaacattagcacccatctgaccaggctgaccgattcctcgtacagcctgtgatgccagtgagccagcaacgttcgcgcccataatttgagctgatgacggtgcacgcgtgtttgctgtgtgcgcggtgttggcctggttgttctgcacaaatgcttgtgcatgaccagactcttggtagtgagcctgaccaggcgccactggtccatgtgatgcattgaccacatgtgcggcacctgttgagccagtagctccaccggaaacagcgttgttgatcattcccgcaccagctgcagcattacccatcgcaccctggacagtacctgcgccttgtgctgcagagcttgctgcgcccgctgcaccgatcacacctgcgacaccggcaataccagctgccccctgtgccatctgaccaaagcttgcgccagaggaaccagcatccgcattggtcacagcattctgaatctgacctggaacctgagacaagtgctgtgctgcctcggtgaccttgccagccacatcaacaccacccataccgcctgcagcataagcgctgttcacactgtcacctacctgctgtcccatggacgccagctgagtattgagcgctgagccagaaagatcgccaagctgcttgccggcctttccagcaggtgcttcagtggcttgagcactaagttgctccataccagctatggaacctgctggtgcaagaccctgagacgctgcaatctgaagagctgcgtcattcatggcctgatcggaactcgacacagatccaccagcgagagcgcccattggggtgccactctgcaatgcagcctcgctcatgttcagacctgcgcttgaatcggtcgcactgtaatcagcaccggtagttccgactgtgcccgcagcacccgagacatctgcaccataggtgtctggaatcttggacagaccagactcagtgacactgcttgccagagactgatcgtccatgacatccgctgcagtggtaatgccactcgatttcacaccagatttctccatcatggttcctgacgagctcagaccagccatcttcatttcagcttcagcagcactcattggtgtgccatcagcatgaagcgggttaccctgtgcatcaacgctcgcaccctcaccgtcgagagtggttccatcggagctatacgcagcattgctaaatgacgcgcgaccagcaccatcaacaacaccgtctacaaaatcagcgttagcatcagcagaagcaattgcatctccatctgctacatagtcgccatcaacggtagcgtcaccacctgctgcgaacgcaccatcaccgtcgccgttgataacgccatctgcataattatcgagcgcatccgtagcatacttaccgactaatccggcaccagccacagttgtgacaaccttcgccagaccagcagccttctcacccaagcctgaatcgctaccgccacctgatccaccagagcctgaatcagatccaccaccgtcaccatcacggttgagtaccatatgtgtcgcaccaataccaagacccgttgcggctgcacgacgcatcatgccgtcaccagaggtagcacctgcagaagagacctgtgtatccaagaagcggttaataacactggtcacggcttcatcgacacctgataccaaagatccgcgcaccttcatcgcaataatcgtgaagatgatgacccccatggatgaggccactgtgatcaccatgccggcaatcgcccagttgcctgaggtagctagtgccataccgactagccccataccagcaccggcaaccagctcagcactctcgttactacttaaggaatcagccaaaggttgttcaaagagtgctggtacagccatcaagaaccgggtaatgagctggtacaaaatgatcgttccgataacctctacgagcatagcgatggtgtacacaatgaccttggcaacaccagcaataaagcccatcgcagcaaaaggaacggcaccaatgagcgacagcgtgcgtcgaatcgtattaaacagcatggcaccggcgtaaccgataccgatcacgatgaagctacccatcagggacattgcagagaaccagtacacaaagttcatggcaccagaaccgataagactcactgcgctatgcgatgcacgggtgtagcttgacgcagaagtggacgtagaaaagacacttgcatcagctggatggaatgaggtgttgaggaagttgtacatcgtcaagggcgacatattgcagtcacttcggtagtccccgaccacagcacgagaacctgtcacgactgagttgttgcatgacgctgtcgcatcaccagatttaaatgacaccgcattgcggtcaataggtcgtccctgcagaccagctgagtcgctgacctcaagcaatggattgttcgcatcagctaattcagcagcagtgatctcattaagaccagaggctgtgttgtaaccagtaacccaggccattacatcaccaccggcaacagcttcgccacttccctctttcgaggtcaaagattccatcgcacttcgaatagaggtttcgaaactgccagaggagatactgtcgttgtcgatataacgactcagtagcgcgatggttccctggaaaatagtcgtcgccgaacttgatgaggtcccatcggtgccagaattggctggatccgccatcttttccatccagtccatgctatagcctagatccatggaacctggattcttaaaagtagtaaaactctcatttgattgagcattaatttccaacgccgaattgcgtaccatccgcatggactgccctgttggcgcctgatcctccagactccacgccagtgttactttgtcaggaacacgcatacgggtgttttctgcccatgattggaaatccacgtaggtggacaacacaatctttgtcgcatttgatccagcacttgtggaactaccgctgtcgaggaaggaatccagcgcaccggtataagagacaccaagcagtggcaggccaacgacaccgtacacgacgcggataacaacctttttaaacgctgatcccttgtccatgcgtcgaaacatcaacgcacccatcataaacagaccaatggagacaggaataacgatgagccagcccacagtcactgaccagttatagatcaacccgaagaaatcagtcattccttcaaacggtgttccttctgtggtctgcccaccagccatattctcagtgaatgtcttgttagtattctgagatactggtccaacgagcagtctaaatgggtttatggtgctcaagatattcagcacagtgttaaaaaccagatcaatgcctccggagatgatgtacgcgatcatcatcgcgtaccccatgcccttacgctgagcaaaatcagtctgcgaatcctccgcctttgagctatcaaagcctaagccactcagtgtcgcgccaaataatgcaaagtgataaggcccttgaaaggcatgatcagctagagaatcataggagtacgttttctcgttgttggcaacaccattaccaaagaaccaaccagagtcctcgttgtgtttcgcgtcagcataaccaaggacattgcctccgttggcggccttactgagaatgccctcccacaccttaagaccggcgtcctcagaatcgaggaactcgttcggtccgccttcctctacaccggcagtagctgcccgaccattgccatagaacgatgccatcgcagaggccatacggtacatggagtaatcaggggctttatcaaggttctgttctttacgttgctcttcgtttttcgcatcgtagaagcacttcaagacatcttctgcttcgagacacttctcgataatgtgcatttcacctaagttctcggtgatgcacttaagaagcatctcggtgtcaccatcactgggacaaatcgcttcaaaggcaacctcgcccatagcaccgacaacctgggcaataatagcgctggcgaaagcattagcttcacgttccttgttaccaaacgcaccaaagctcaaacccactgagatcaagagcgtcatgacaacagccatcgttcggcgtcgccacgtcttgtgtcggttgtgtttaagctccatgcgcgcaatctcagcatctacgtcctgctcactaagctgtacaggttgcggttctaaaactgtcgcagtcacttgcccgccaccccctcaatattcgttttaaacaattgcttaaaaagtttcattaatccccaattcaaagttattttagaatggaatatagaaactttaacacattaaaattgaatattaaatgttgtttaaagtcgaaattgtgaatccagatggatgggtatatccagctcaagacgtaaaaaccaccctgtacaccatcaggtacagggtggttaaagcggggtgctttaagtgaaatagctttattcagtgggcttatacgagtcaagctccgtacccatgtcatacaagtcaggagattcgccatcaaaaaacaactcacaatactcagggaccccatcacagtaatcacctaatgtaatacgagatgccgaggattcagcctctaaatctgtaaatcccaattcagacaaatgagcgatgacatcactacgcacctcgtcaagcttctcgcttcgcgcgccaccaaagtaccaagattccaaatagccaacagcctggtaatccgcagcgaattggaaaccatcacccaagcgctccgcagccgcctgcgcatcagctttatcaaagcccttacctacagcgttgtccacagccacagcagcagatgatccatcagccacagcagaacgcataaaggtgtctaattgagcatccttatcaacagctgcagaatctgttgtgtcagccgatgcagaagatgagccagtactgctactactagcaccgctactgtccgggccgtcagcatcactagagcaagcagataagccaaacatcagcgtactgacagccagcagcgcaagagttttattcttcaacatgagttacgtccttaatatatacagcagtcgtggtgtggaccatgactgctgtagaagtctccccctgcacccatggttagcgtactttaatatttataacccaaaccatattatttcgcagaattatgtgcaaaatgtagcgactgcgctactacccccggtagaacatggggggatttaaagaggaaatagcgccgaacatacgtgaaatagagacaagcaaatagtctatcagagcacataaaggtgccatacccactctttcaactgatgacataggcattccacccgaatgagtagtcgcacaaccaagacaaatcaacgctgtgttacccaaccggatggtgtaagaagcactgaagacttgatttaaagtcatcccccgctgacggccttgaatttctctagccacctgaaaccagttgtgggatgttttcgattatctgtttacctacaagatttaacattgtagtgaaggctttatcgccggcttttatgctgagttccttcaacttttcaaaagcattctggataaaacctttattcggagactccttcttcaactcatccgcgatggattgaatgctttcttcggcttcagctctagcttcccctaagtcgaacttttcaggattaatggtctgcataatcttcagtaggtcatccacggacaatcccttctgcacagctttagcgctgttaccaatggctacagctccattggcttgagtgattgtagtttcgtagttattttcaatgtgcttcatgaccgtggcattaaccttttcgctgcttggtagttcatccagaggagttgcgtgtgtgaggtcggcaatcatggaagtcattagagttcggatgcggtccacaattcccgaaaaataagagttatctaagtaaacatttaaattcaaaatttgatttaatggcgcgtactgatcattatgaagatcgcggacccgaagtaaattcgggggcgataaattaatcccatcctgcctagtcgaccattcaattagcgtttgaatcggctgatcaaaatgcagctcttcagggaaatacttacgagctctttcaggaacattatgtggccccagtaccatattagacattattgaattaccagcttgaattttcgcgaatacaggaggtcctttcaatttgcgatattccggaataccatcaatggagccataaccatttaattcatttttcgcccactcttgtaaagagtccgagttagtatcacttccaaggaagatacacgcccgaagaagctccgttaatggacgctcttctattaagccttttctgatggatacaagcagagaatcagtcatgctaaatatcataatccatcaaacatttgatcggtgtcaatcaatgcgttctggactgaggtgaccaccatgcaagacgaggtggacctagtgatcaccaacccgccgttttctctgttccgtgagttcctgagttggctattacacggtgacgtgttgttttctatcatcggtaacgcgaacgtaatcacatatctaggtgcctgaatctagattaaaactataaacattatttaaaaccattgccttattggagcatgctgcaagcttttcgcggtgggcttgcaacatcttacatcagaatgaatgatgttaaacacctaataagttcaagtagttaaaaggaaatatcaacaatgttacgaaaagcatctatcacgctaatgatatccgttacgctcttaacatgtgcctctccagcacaggcactgtcatcacaagcactctcgtcagaaagctccacttcgcagagtgattctcctacgcaatttgttgcgagtatagctgcgcccttcaataagaacttaacctatgagcagcgcaaagccattcgtttcggacctacgacagaacaagaagcagaacaatgcttggcaaagtatggtcgcgatggcgaggggccatggcctgctattgctatctatcctgactgctccttcgatactatcgaacaagatttctatgatcaagcaatatccaaagccctctcagtaatcagtctgggaagctcctagaagactcgtaacgaccaaaagcaccgagaacagatgcaactcaagcccatttacatctgttctcggtgcactcgtatttatagcctcgcgcatagcttccaaaatccagaatcagatggcgcaattaaatcaagatctcagaactcatttttcaatctcttcttttagggcacccgtcatcaattgagctatcggccattcattaaaaactgcgcgtcgatcaaccgaaagctgagtaagcaaaaaattcgcctcttctctatcgtcaagaagcaaagcgcaaccaatcataatctcgctatagttgtctgggtgcattgtttgatcaagattatgcctaaaagatcgaatttctgttctttgtgaatccagtaatccagtttggcgatacaaaatttgccaaccattaagcctgtaaattggcgactcttctcgatctcgttccacgagccaatcattgagagcttgagctgctataagaaatgcagttttcctgctctgctcagaatcagctgccttaattaggcgaagcaccatccatgtggcgagattatcaacatcaacagtttcttcaagcgctgaatagaaatcaacaagcttatccaaatgcagattcaatactgatggaagccatcgattatcaatgagctcgtacggcgtcactcgctcgattgaggagtcgctccgatccgttgaaggtgtcatagcaaaatgatgacgcttggaaattacttcatgataagtccactcccctgcaacatcaccagggtgagctatcaacgcaagattccaacgaccaaaaggctgcaatataagtctagtctcatctttaacctctaaattctttacgtattctcccttaacggctgttcgatacacaatatccaactgccagaactgtttttctgtaatctcaccaattcgaataagggacggatcaatattgaaatggttagctatttctaccaactgacgaagaacacccgcttcatccttaaggtcagccacagtccggttcgagttaatcttcaacacaacaggttcttcattaataaaaaacgtattcgcctgaagcactcctaggaagaactcaatgtcttttaaccgttcaggaagactatcttgaaactcaaccgtaacgctccccggagcatcaatggcgagcttttgtaggcggagagtaatcccctttccgattttcaattcaatgtgctcatcatcaatgtttcgatgcaaaacattgtcatagacgaccccattacacgaaacattataattggcttgatgaaactgcatattcgggggtattatttctacggtggcattgacgaactgttcaattccatccccagtacgaataatgatcgaatggtctggcgaactaccatcatatacagccagcttatccctattaaggggttcagccgatttaacagtaattgattccatattttcatagagatagttactggggttctcgactatcttttcttgcctcgatgcgagcgctaatgcgattatggcttccattcgatcttcatcagatggtaaccgttttaagcggacgctaattgtcttttggcccggcttcgctttactcagtagatcatgaatataaaacggtttcaaaagaacatactttggatatttcttatttgatttcttatcaatatcaaccacaaaaaataagagaccagccagtgtcacgaagcctcgtagatcaactactgagaccggatagctatttaagtcggcagccttggcattaacctttcgccctttaatctgaacattcacccgacccccaaagctacgcttagctccagaagcatcattactaatatctatgtgtccatctgtaaaagtggttttatcattttcactaaaaaacccctctaaatgcgcacatgaatcgatcatcttgcctatttttcgaaccgcagttttctctgttttcgatgtactcattatgtatgagacttccttttctcgactaaccgtttctctcctgattctataatctggaacatgaaaggtttgacacgctcacctggaattaaaggtgtctcagtccatcaacttgagatatgagtgacgaaagaccccctcacagaaagcatcaatttcgctaccgagtcaaaccacgacgctgatttaatttcgtcaaagaaagtcatgcttaacaactctggtttttcagcctcagcgacaaccaaaccgataaagtccccttgataagtaagcctcaacgccataattcggcgggacttcatggacattgctgtggctgtctcctcggaaaggctatacaggtcgaccccggagcagcagccaaaagaaaggcactgaaagactttcctgaagacgagtttggtaggaatgctagccgggcagggtttagcgttggtctacttttcttaggaattgtcgtcagctacatcgccaatatcgatttactgacaaaacccactctacctagttacgcctgcaactatcaggtaattctctaccattctcgtgaggccgtcgatttactaaaaaccaaatcaccaggacctaacgcaggcatgaggatctgcgtgtggaatgcacgctgccctaaatcagacacggcctgtcgtgcatatggcaccagagtaaaaatcgcatggttgttaaaataatccaccattgcatcagattccgttaaataaaccttattctcaggaatcaaatagattgcttcaggctctaccgttatctttccgtcgggaacctcgatggacaccctcaatgaaacctcaatgattcgcggcacaccttcttcgtctttactcttgtcgttaacagtaactccaagtttaaactcaggacgatctgatggttcctcaattttgaccgataacgcactgagctcccgatactttacatccgcaagaactaagtgctgcactaactcatcatgatgagaaggtagatgcgctgacatgatgtccatccttgtcttggtatttcaatctcaacctataaaacccgaaacactacgccaaaatgggcttttcccaatcaacgtagggcggggcagcttcctggccggacacggatacgtgattgtttgtcctcgactcatactcttgatagagggtggcagaagagctaaccctataagatatagaagcatctaccgctagcgcatagcgtcggatcgtagacagagtgggatttgcatcgtagtgctcaaattgagaaatagcactctgggaaacgcccatccgattagccacctcgtcttggctaatgccagctttctttctcaaagctacaagtgagtcaaggaattcacgctgggaagccagaagagctttagctttagctttcatcgctttcttactgtgcgtcatgagttttaccttatatcctctcattcaattttttctaaaaactcgccaatgggggtagttcgttgatgttaagacgaattaatctactggtgatccatcagcacttaattcgtcccacagtttcacagcaatttcaatctcggtgttttgacggtgtttggtgattgtgtcatcagtattgatttctttctcgtgcgcatgaagacccagaaaccagtcacaacctgatttttcaacatagtagagtcgcatcaatattgagtatccatcactgtatatcccagaaactggatcttgatctcttacgaaaatgtcgttccatctaatctcaaacatatccagctgcggttgactggaaatactcttaacatgctcttcgggggtcaatcgccccctctccgctagctccaaacgatcttcgataagagcttccgcatccgcttcggtcaacatattgaagacatactttctcttcaatatgtccattattttctctacagtttcttcaatatggttatcagagcagttataacgccagtgataatgcaccggtttaccaccactgcagatgctttgcttaatgaccatctacgcatggtagctaaattgacatggccgtcccgagaaatagtctttgcgtgacataactcatatatcataaaactacggaacctgagccgcagcagttttacctggaacagtcgattcgacgtcctactggtggtcctatcgcaccccctcagggcaccatctagctgcaggttcacctcgcttgggtccgagactacctagtgactggcagcagtggagatgggatagctcagaacctccgtcagctgcaccgtgggaagatgaccgttggattccgtatgacggtaatatatccacaccaaactggacgattggcccttccccttcgcctgactaacccagcaacgccagcttcaatctgatacaactatggaatgctacgaaaaattcttgagcagaaactagacgtatccctgcctcagacatagcgctcggggggggatggctacgagggcagggatacatacatgatcataccttcgacgctgttcgcgcgcatttcctacactgaaattgtgaacaggttatgctccagcgctctgcttctggagcataactcaccatctgagggagtttttccttccaatgtgtgcaaacacgagtaagtagattcaaatttgctgataaacctgtaatttatgaactcaaggaagacccaaagaaaggtacgctatcgtcctggaccgacttatctgtcacttcgaacaagtaatgcacctccgaatacgtgccatctggataaattaattctgcagcaaaccacatttgcccagtacgatcttccggtgctgtgaaggtaagctcaccggtcttctcatcaatgacaatagttgcccccatgagttccgcatcttcaactgacccataacgatcgcgaaccaccttagctccctgcggaaccccgccaatcgctccatccccagcaatgaccgtcatcggaactttaatactctgaccattacgaacccgttgagaatctatgctctgaacactgtagtaaaaactatctgatacctcgactactgaatgaggtgtcactatgtcaatagaactatcagggtagaccactcttacagttactcgatctatataagatcgcgtcacttccccagggttgtaactaatagttccggcgcctccaaaagtatgccggatcactcctgtctgtgaatccagccgggaggtgactacgccatcgctaacggcgactgcaaatgtgtcactgtcaaggacgaaccgagtcccctctggtaattccgcaaagttttcaacggtctgtgagaccgaattaggcaaacctgcatcattatttatcgagccgagacgcgtttctaacgactcgtaatccggctcgtaaagagccgccatgggtacattttcctgtgcaattgcaacactcgcgccattaaccgttgtcccaaatactaacgaacatgacagaatggcagtaaccaaagtgcgtgactgtaccaacatccctctacaccactttctgaattagaaatcctctattctccctcatactatagggacagggtgtctcaatatcattgtggtatcgaactgacctcttttcagaaacgtctgttgacccgtcttttttgtactgcacaagaaagcaccgcctcgacactccaactcgaagtcagtgcttttctaccattaaaagtgataaggcccttgaaaggcatgatcgtccatcaagcaatatccgaagccctctcagtaatcagtctgggaagctcctagacgactcgtaacgaccaaaaagcaccgagaacagatgcaactcaatctcatttacatctgttctcggcgcactcatttccatagccccactcgtagcttcccaaatccggaatcagatttcagcaaccccacgacgaagaataaccgacacacctgcgtaaacggtcatctggaatactgccctttagagatgccactgcatgtcactccactacggcaagatagtggagtgacatgcagtggtttttagctgagatttccacgtgcgggatcgaaagtgcctttggctccacggagaaggcgcccggccacacggtagactattgcatcacttaattagttttcatgcccctgcagaaaagtgccacggttgtcatgattgacgacaaacttaattaatggtcctcgttgcgcagcaataacggacaggtggtgaagagtaagaactaaatcttgaagctttggatcgctctcaagttctttgatattcaatcccagctcaagtgctttactgaccgaaatgtgtcgattatgcgcaagagtaacggaatgatcagcgagctctttgatagcgcgagtggctttttcttctttgtcaggctcgtctaaaaacatacccttttcaagccactgcttaaccatcgagttggaccactgaatagcttttttagcttcacccaacatcgtggggttgtatttattcaagatcacctgccatatatgagcagtctgcggattctcagagacctctttcttcgcttgctcaaattcttccaataacccgtgtgccggtaggccgttaaactgaggatcaatggggccaagactagaatgcttccccataacaatctctttggacgaaagtgcgatcattgttcctgctgacattgcgagttgggggacaatgactctgaaatcttgaccaaagagtgcgtgaatgtaatctactaacgactctgtcgcagcaacatctccacccggagtgtggaggataagatcgagacctttactctgatccaacttatggagcgcagtcataaaactgtttttatcagtatcatttaccgaaaaatccgtagattgcccggaaaatcgtcgaccattttctaaccacgctgaataatagacgattacatttcgaccagtatgttcaaacagtgcttgtagcgcttctctacgtttatcgcttactgcgtcaacatcatttatttgtctaatcttgtactgattatcttggtaaatcttagaaatttcatcagtaatctctgcccagttccccatgtagctatcctctactcgaccacactaacgtggctggtcgctgttgctcaaaaaaatctaagaaacttaagtcactgggtaatacttctaccgactcagattccaaatagcgataaaagtcctctgccgattcaacgaattcagacgaagaagtcatgtttctactccctacagtaagcattaaactatcataaaccctaaatttaaatttagactcaaattcaatataatcaatgaaccaactatataaagacaagtcgtacacggatcatcttttatttcagttcaggagactgtctctagaaccctactgttgcgtgggaagcagcgggtcaccctactcccaccaacaaagacccggtgtgctggaatggacagtgtgaaaacgttccatgtctcacctcttcagtgcacagtattgcttattgctccatttctcgcggtaacactaaccgcatgcgccgatagcgctgagcaccctgtatcccaagatctaccaagcatcatcacaagcacggtcactacgacagtgtcccctgagcagaatctcgacgtcaataacgaccaaagcagtgtcaacgacaatgacaatcagaacctacacgtcacgtcagagggcgccggtgtactcttcttgcggttagacaacaacgtaccttccacagatgctgctaacacaacgattgagggaaaactgatctccggccctggcggttgtctttctgttcaaccaggtggtcgaccagaactactcatttttaacaccgacacccgatttagtgaccatccaccacaggtaaccttgggtgagaaaacaatcaaaatcggagagcgattttccttaaacgcaatcgaagtatcttctacggaccttaccggaatccctgataaatgctctaacggtgccgccgacagggcttggattgtcggtacgaagtaaaacaacagcgcattaccactaatgcctcaacgcgaaaagctccttgatgttttgtgggagagaatgcctggatgcctagagaaaatcactcagcctcacctctccggcattcttgtggacagctaaccgggtagtcccacatcatctctagaaaaagtcatcgaactgcgtgatgtagtacactatcgctcgtatacaccattcaccatcacgtaaccaaattcttgcagtactaagaaaccactattcttgcttcgcacttgaaacacgaaagaatacgtagtattaattaagtttttcaagagctgataacactaatcttcaatgaaagcacttaaaggggagaatcatggggtacctgggaattgatagagacaacgaagaacacaacatccacatttgtaccactgcagatgcactctatgaagcacaggtatcggtttacgagatccatagagttttagcaaaattttggaatttgacatgccatcaaattgaagaaatcctcgacattgtcgatgaagcgcggcgagatcgtagagcgctaggagtcgatatctaacttcgccgaaagttgatgcatcttggtggcatgactcactgagctcacggtgttaaagagcaggaaaactagcccattgcatcgtctgcatcgtctgcatcgtctgcaccgtccggcaaaaaatagaattctgcttctagctctttccgtaattcggacggatcttttccagcgatggcggtactacagaaaacagatagatcatctgtgtcgttagactcattaacctgggtgcatgtgaaattgagatccactaaaacaccatcagcatcgctgagggaaacccctcgatcctggacaaggtatctgcgcgcttgagacataccttgacgtatttctccatgttcaaagcgcacgcgatataactcttgttgagtcaacccgtaagccaactcgtatagtgccattcgttctgggtctatatcaggtgactcacgtagtgggctaggtgtcaacgttgtccattgcacatcagattcgtcgtcgttcaagggtgaaacactgtttggggcatcggaggaagcgcaactcgcaacgccccacattgacacgctaacggatagaaccaaccagggcatcatcctcatatcactaagcattgacacaatgcactgccctacctctcctgatttttgactacaccgcggacagctatgagcgcgtgatccgctctaaaaatagccacacagtttaagttgatgagcacctgaaaatcagctcagtccactacttacatcagtgaatacttctttgatgttacgtcactaaaaaatgcttgatgcgaatatcaagagaatatgacaggcttcatacacgccccactagtgttatacccatggctaattctgactgcagtgacttatctacgtttaccactccgcaacacagattaaagcactcgatattgagagcttttacagctgaccatgcgctgtcgttctttcagtggcacaacccgacctaagttcaatgtttcattttaccgagacacatgacgtcattatctaactctcaaccacccttacttagcgggtatcatgtctgcgttgtccaatcaggctatgactttttcttggcgctgcacatcaacaaacccaccgccaaccacgtcgcctaccgcttcgccaggtgtttcttctccaccgcagcaagaccttcttccacagtctgcggacccttcttcgcagctaactctttcgcctctactgcagcaagctcctctttcttgcgggtagatttttctcccaacctttcttcccggtgctctgcccgcgcctgcatcgccaccacatccaaatcagcagtacctgtggtcacagtgccaccgccgtaatgactgtctcgtttaaaacgcttcttaccacgttgtgcttctgttgctcggcgtttcttcatatacggattcacaccgagggcaagattcgtttcaaaaactacgttggtagcaccgcggcgaagataacttgcaccggaattatgcgtggttacaagacgtgccaaatccatgggaatcgtgctgttcagtagctgttggtacacaccgaccgcgtcagcatccatagggccaagaatggtgtacgacgcacgcggaaacatattaaaaccatctgtattaagcatcccatcggcagatccgtacagataagccactcgcccaccgcgttatctgatgcggaaaacaatgctgaactcaccactgcacagattctgcacattgaccccgtcaccggtgtggccatcccacgtcaaaacattctgctgggtgaggattttcagactatggccagctcttttagtcaaatccgccatggatggggtatcacccagctcatcggacaagaccccaacagaaaccaaccaatccgctctgctgatacgtggacagtgactggatcgactggactcaccggctttaatactgctacgcataatacagatgacacagacgccactgccgcatataccatgccggcaagcgatcctgccgtaggactatgcgcactggaatccaacaaagacgcaccggtggatgaatttcgcgatctcagcctcagtgctttacgtaccgctacggtcatgtcaagctctggctccgccgtgattactatgcatgatcctatggtcatgagcaccactggcgcattggaagcacgtgcatacgttgacggcgaagtcatcaaccagcacgatcttgactcactgcgtgaccagctaggtattactacagacagcgcagataccacccctgccctacctgctgatcccttggcagcattgggcttgagcacaccaactacatcagctcttgtcccaggtcttgccgagctggactgcctcaacactgatcaagctcgcacctggcatgaccgtgacaacagcattggcactggtaaaccagctattcttgccgtgattaacgccgagctcgctgatgattacaccctgcagatcctcaaaaatagcactgcgacccccaccgactccaccgactccagcgatactgctgaacgcttcgtagcgcagctacctgcggaaacagcctttgtgcttattgatccggacatcggcgctgtgaccgatctgttctttatcaacagcataaatcaggatctccccgcaccgacaacccagatcaactcagtagcggtagatcaacgtgaccccaacatcatctacgcgacctttgccaatgatgaccgcgtgtaccagctcatgctgggttaaccgcgacccgtttttatctgtgctgatccgcgccgtgccaactcgcactgggtcgcactgggtcgcacaaccgcatacacatacacacaattaatcaccctcaacacgaagatttatcatgacatttttgcaccgttccgccagtttccaccctcgtacccacgatcacctcagcgagctcggtcttgatccttataagctctctcaagacatccccactgttatttatgaagtccagccgcacagtgtgttcattttaaaattcaacactgccgatgttcgggtctatcaggaacactccgatctctttgtgcgacatgctgtgcttgttgatccagaacagcgtaaacatgagcatgaccagctccttaaagagattctcgacctcgatgcccctcgtgtcaacgatgatattagtggtcgcacgacagtgtttctccacgataaaacagttgttacgcacagtggtggccccattgcgattattccgcacaatcccgatgtcgccagcgccgctgcgtcagctaataaacacaaacaatctgtgatgacaacatccaggcatccttatgcgcagatgtctctcagcgacatgctgaaacaaggcttcacgctcacacctctagagttcccctactgcgctgttgatgaccccgacagctcacgccacacaatgcacgtcatcaacgttcgagatcatacagtgtgaactaccgcgccgctagagatggtgcagctgtgtttataaataaaagcgtaatagttgtaaaccagtgacaaataatttatgtttctccactaatcagtgacaatggtcctccccgtattgctggcactggttcttccacactgattggtttatcgtcagaagccttattctcctcttaactaccatgaggtaaccatctaaagtagatggttgcaacaacttttcattacatcaacatgtttaaaaaaggacactgattatgacttacttcgcactcgttgctcgcaattacgctgagacaggtgtctctgttgaattccatgaggtcgatgatgacgcagataactcaaatggccccaacaacacaagcaatttacctctaaaacttcttcgagatcactcttttgatgccactgttgtctatggtgacctggtgcttcacacctcagcacatctcagagatacggctatcgccaactcagacaaccgtccgcgagtagtgaccacagctcaaaaattctttgattacatccgcttagccaccagacacggtgctatccacgacatgatcaataacgcgccagataccggcactgacatcgttgttattacggccactaatgatgctcttattagtgatgaatcagaatactatgacgagctttttcatattctcgaatccgcacagggtgtgattcttaaatgattgattaattgatatgattaacactgaatcccgagctatgcatgtttactaaaaaactccaaatttcggaatgagcgccaagaatcacgtccttgaccgtttaagtcgttaaccttgtccagccaactagaatggctaaacaaggttaacaacagtgtttcaaactaaaaaacgattagtagtagacgttaagcaccactgaattcggaaatgatctagcgacaacgcggtgagttcctgcagaagaactaattggtcccacccatggaatatttggaaaagcaacaaggttaacatcaccatagaaggccgcaagaccaccctctatacctccacgtggattgcttgtcgtcactgccaatcctggagcactgttatactttacgtaactgcgaggattgctgacagaagtagcgattcctacattggagtagtaggttccaccagtacaaacctttaggacttcaattccgtagagagtattcgttaaacacccctcaatataatcagaaccctgccaggctgctggagaaatgacatttggatcttcgtcgcctacgttgtccgtctgaaccacttcaacattatctgggagaatttcttctccagagaccgacctcagcactgcatcactagctaaaagactcttgaagccctctagttcgctcggagtgaaattggaaattttttctgcattagctatagcctctggcactccattggccacgtcctctgcagttgtacgttcgaattctgcaaatgcgagatctactgctgagacatctccggatacctcttcagcagaagagacagaattcatgagagtggcagtcgcaataagagcaacaattccaccggtaactgtttttcgtaacatcgggattcctttctgttttgccgatgaccacatctgactgtatgattgactcacctttatttccagtcttgtaataagaatgttacaaatgatcgaaacgtatgaccactacattgtcgaaaagcaggggagtaaaccacaggtgaatgtcgctaacgaaatcaatacgtcaaacaatatcccccttccggaaatgtattcagttttccttcttgctttcgtggttttagtcatcgcaaccgccctgctcaccgcgattttagagtggcgaaactctcattctttaccgttagcaaccctatggggtctcatcagctgcgccttaccttttgcggggccacttttctggattgttataagctactttaagaatagaaaaaaataaaagaatcaaagcgaagtgctatttacttgattcacccgttgataaatatttattcatatattgaagttctcggcatacattccccataaagctcataaactctgtgtcgtgacctctcagattattatgatgagttttcccttttccacgtaattgaattagcacgaagggcgattcccaaatgaccaatgggtcggatcgcctttttgctcatgctcagctcactggcgtacagcgcacagttacatttcgaccagatagcgcactggatgcactgtcgtgattacttacttctcagctatagacatactttcgctacttattctcagcgtcattatgctcatctgcagtgcgccagtcttattagtcatctttcgcagcaacagtcctgacgacctcatcgcagcactcatcctgacagcgttgttgggttttctcgctgtcaattttgtactccccacactcgcagacatcggctgcacgctgtgcgagctttaaaccagtaccccaaccagaaagtgactacgacatgagcgcaaaatcccctaccccacagcctccgtacgaaataccatcattccggaaaagacgcctaatcactaccggattattaacaatcacaacattgtggttcatctacttttatgtggatctagtaagcgccactacgctacttacgctgccggtgattatcgctgcaccattgatcatggtctacatctggtaccacgaattcacatactatgctcgtgtccgcaaaaacaataagctttacaaggctctctatgggcacctccaaaaccatcaacatcctgaaaatacggatactccacccatgtaaatagtcactaagatttagtcacagtgactgtaatggctcaagcctctacaacaccttcaacacaaaaaacaccccggttgaaaactcttaaccggggtgttgctcatatctcaaaaaagaaaggaccaacaatcatgctttattatctcgctgctgctgtggacacaacaccccgtgacaccatgaccatgggtgaagtcttcattatgacctgcctaacatttattgtgatcataagctttttcggaatggtatacgccatagcacgcctaattgaacatttaatttaccaacaatggcgctcgttcatgacgtctgcgtgttggctcataattagctcggtcgtttccctcatcagttatggtatagctttaaacaaaagcgataacaatgaaccgatggtgtctacgacagaaccgactcccccacccactaacaccccaccagaaaataacacctcgaccgaacctatggactggtcgatcattattaatgtgcttgccgttgctactgtcgtgatactcacccttatcatcgcagctgcattatataggggtttcacacgcaacaaaataaaaaaacttgaagctatacgagaagcccagcaacacgaacgcgacaatcccactatccgcattgctgatcttcgcggcatcatggatactcaccactacatctacaccgacgtcatggttacacgtgcacatgaactcatgattactgcacccgcattctttgatgtcactctccccgaagcagtgctctacgaagatactaaacgtgctgctcatgatgcccttaacggctataaagacaccactgtcgctagtgcagagaagatcatgcttgtagatgcagtcaccgcagcatggactctctattccacaaaagcaaacaccggatccacgtgatccgagagccgagtaccgcttaagtctcaggcataaatcaagaactcagagacgatccggcaggacgaatgacatccacaggttcaggctgatccgtcacctcgatcacatattgaacctctgagtccgaaccatccgggaaagtcacttctgtacgaaaccacagttgaccggttcgatcatcaggcgccgtgaaggtgagatcgccagtcttctcatctatgagaatgattgcacccatcaactccgcattctcaattgagccgtaacgatctcggaccaccttcgatccctgtgggaccccaccaaccgctcctgtaccaccatccgtcaccctcaatgggatcttgacagtctgaccattgcggactttaggataacccgtgctttcaatgccgtagtaaatactgtcagccacataaaccactgaatggggtgtcactctatcaaatgacccatcagggtagaccaccttgacagtcactcgatctgtataagatcgtttcatttcaccaggggtgtagctgatccccgaagccccaagagtatgtcgaatctcccctgtatttgggtccaatcgagaagcgagcagaccatcatcaataataattgaaaacgaatcaccctcaagtaaaaatcgagtctcctctggtaattcagcaaggttttcaacagactgttcaaccgacttgggaaagactccactagaaccgagacgcgtttctaaggattcataccgtggttcatactgagcagccatagacacattttcatatgcaatcgcaacacccgtgccatttaccgttgctccgaacaacagtgaacatgacagtgcagcggtaaccaacgtgcgtgaacgtaccaacatacttctacaccactttctaaattagagatactctatgccacctcacagtataggtacaggatgtgtggcgttccctgccctcatggacggggttgctgcgtaccaactgccctacacattgcgagagccggataacgcttaagtctcaagcagagatcaagaactcagagacgatcctacggggcgaatatcatccacaggttcaggctgatccgtcacctcgatggaataagaggccgtcgcatatgtgccatctggataaattaattctgcagcaaaccacagttgaccagttcgatcttcccgtgctgtgaaagtaagctcaccggttttctcatcaataacgacaattgcacccatcaactccgcattgtcaattgagccatagcgatctcggaccaccttcgatccctgtgggaccccgccaatcactcctgtgccgtccatcaccctcaatgggtcaggcccttcatacttctacctttacagaaccagactatctattgacgaagctcagctactcagaaatatgctgccaacggaaatatcaatgtgcaaagctaatggcaggccgtcacctgctataattgcccagctcgggtctaagttttcaggatctactatgaaaggatcagtacgaccgtcgggatcactcaattgaagatacaccgggtttgcttggggtggttgatcctgtggcattgggccggccatgtctactgtatcaataggcaacccacatggttgtacacgaacaatgagatcacctgcttcagatactgaaaaaccagcgcgccctttgacattaatgtctcccaaataattgccgcatcctgaaacagtcaggccgcagattactaaggctgccaaagtcttgattcgtcgttccttcatcataactccgtcttcgttgcacccatcagcaaaaaaaggtacagcgttgtttggctttcaccctggtagataagatccacttctagctcaaaatagcatctgataactacgaaagtgctatcagggatgcagagaggtctaagctttattagctcatacactatgcacatcgtgagatggactatcgcaacaggttgtagatctctgaattcagcatgaatcaattgtctttcgatgccattatcgcgtgaggtttccggctcagaaagcggtggttcaagctgcctcggaattacgctccacgaaaccctcaagccccggagctacccaccctacggggagtgaccacaggtgagacagttcaggtctaaatgatgtgcgctcctcttcgagcacaagcgcagcaaagtcttcttcgagtgttgcactcataagagattgacctggaaaaacaaaagaaatttcaccaggcgtggaaagagccgtcacaaacaccagatgcaccaattgccctttatatatttcttcacgagcaacatcagccttgttaatatcttcccattcaagaaaatggttcttcagcttcctacccttcagaagcttttcaatataatcacgtccatctgagccatctaataaacctacgcagcattcatagcttgaatcctgctcagaaaggaacaagagaatcagcttgtcggaatacatgccgcaattctcctattccattccttatgttaactacggtctatcgtacacggaagataagcgtaattagttgctgactgaccgaaatacggctgaccttcataagtcacctgaaaatatgaagtaccccaaaataatgtattcttctccccgctgcaacccgcctctaaattggtttgcacaacagaattcctattaccgaagaattgttgtgcatatgctgcttgagcccatcgtccccaatagtcgtagtaaatccatccataccccactacatctgagacagttccaggaaggtcgcaatccatcctagccttaaacccaatctttggaaccctaatcccgactccgtcactcttcgttctcacatgaatgttagcggattgcgattgacattgaatcgaatctttcttggcgttaagtgaattcgcctctacacgagaatttgacaatccgttctcaaaatactctattgcttcctcaagattagcaaagggtaaaaactcaataaaagcctcaagaggattggggtataggttagctgcaagttcgcctttttcgaatacctgattagccatgttttctgtatacttttctggatcgccgatagggtaaccgaattccccactctcagctccttcttctctccagatgctgtatatatcccctaatatagggtgagctccgtgttgcggatgccagtagacaactccgttctggaaaacagaaaatctgcccacaccgtcagctgtcacagcctcatccgcaatgggaaaaccaaggtcactatcaggaccacccaattcaagccatttatccaagatcagcccattaatactggccacctggaaaccgtccaataccggactgcgatacactcgcccaccttggaaagtttgcacccacccactcaactcaccatcaatcggattggaaccattcacagggacttcaccaccagtgggataacccatccacccagactcccacccattacgctcccacacctgcgcactgtaattattaacagcatgcgcaccagttgtcggatgccaataaacaaacccattcataaaccgctgacgatacccctgaccatcaggatttaacgtttggccttcactcggaaacaacatccacccaaactgggcaccctgctgaatatagcgctctaaaatagcaccacaaacctgatgaggtgacggccaaaacgtctgacacgccgcagccgcagcaaggcctcgcgtctgtggctgagattgttgctgtgcaatagctatctctgcctcatcagcggctgctttatcaatagttactggcagctccaccttatctgaccacatctcacccggaatgagctcttcattaggtgcgccagattcttgggcttgtcggatagcctcgtggatctcggcgatttcttgctcagtgtagccacccaccccgtctaccacaggtggggtattcccttcgtggtggaactgttgaacatacgcatcttggtcttcaggtgtgaccacctgactagcttgcccctgtgccacaggtgctataccacctgcaacaagaagtgctgcagcaatgacgcctgcagccttggaaaacagtttcattcacatgatcctttcgttactagttgatgtgaacaaactgaccctaacccgaaaaaatcataagttctgtgaataaaattgttgtgcgcgtatttccacccccgttataggcagggcaaacatcacataaaaaaggtaacttttggctactgacttttatgcccattcacggtatttaaacgactccatccaccagcgccaaaaatcgtccgaaacatgaggtgatagcggttttatgcgccaattagttcgcagacacagcccttactctggatatttcaagggtgcatacacccccagcactacacgtgcaaagcaccatctcaacacatcgagatggtgcttatttattcaccacagccaacaactaccgcttcgccaggcgcttcttctccacctgtgcaagcgcatcatcaagattcttcggcccagttttcaaagctagttctttcgcttctacatcatcaagctccttcatcttgcgcgcagatttctcatcaaagcgctcttcgcggtgctcggccttcgcctgaattgcgacaacatcaagatccgctgtgcccaccatcgtcgtgccaccaccgtagtgcttgtctcgcttggatcgtcgctgacctcgctgtgcttcaatcttgcgacgctgctccatataaggattaacgcccaacgcaaggttggtttcaaacaccacattggtagatcctcggcgcaaatagctcgcaccagaattctgcgttgtcaccaaccgtgccaagtccatcgggatctgactattaatcagagattgataagtatccaccgagtcaacgttcatcgggcccaaaatggtgtacgcagcacgttggaattgattgaagccaacagtgccaagcatcgcgtccatcgagctgtagagatacgccactcgcccaccacgctcagccatatatgcgaactgattagccaaataatcctgaacatcaacatcgacaatgccatcagcaccgtgaatgatgaccacatcgccttgaccaagcgtctccacagcaaaaccaatcacgttaaccagctgtgccatcgcgacacctgcgccacgtcgcagcactccagaaaaatcatagatcacgcggcgtgcagagttcacagaatcaatgccatctgccgtgtgctgattaaacagatcgccatgagtatcgagcaaatccttataggtcagtcgcagcacagaaatggcacgaaacatttcagggtctttggttccctcatatttctggcgctcatattcttgatccaaataggacacgaagacagagagcaacgggatctgctcatgaggcacaccaacaagacgcagcttgtcacggttttcaccggcattaagagcccacattttcatatccacataaaaggctgtaataatttctttgagctttccgcgcaatagcgccagctcagaggtcttatcgcccaatgcctgctcggtcataaacacgattttgtccatgtgtgtggaatacagcgacagctcatcttcttgcttaccaaacagctcgaacatgttgagatctccgctagtcatatccacatgagcggtcatggattctagctttggtcccatttcatcgagcttggcaccattgagcaccaggtgcactacgcgacggttattcagtagcgctgcctgagaaatcttcgacccccacatgtcaacgacacggggacgcttaagtagtggtgatgtattaatcgagctatctgcgcatacgacatgtcccgaccagcgatccacatcaaaaagcacagcggagttgttgacatcgccacgcatgacaccgacgtattcgccagcaacatcgttaagaccattggtgaccaaagaataagaaccggcaaactcagtcgaggtgaagtggaatcctttacctcgctttttgctatttttgccaaaaatctgtgacagttcttgacgttgctcaccgtggtgtgcagcaatatccattcgcgataagtgctcgataaaactgcgtcgaattttctcaacagtcgaatccaagatctcaaggtttggtccacgcagcagcagacggttgtgcacagtcaaatatgatgcaccatcatcaagctcggcgatcacctcatcaagatcaagtccacgcttaacagtcttgcggcggttggacttagtggaagaatcagccaagtctgattcttctgtcttagctagtcggtcagtatttttcagattgtcatcaatccatgactgcttcatccgctccacttgctcaaaaagcacagctgagacaccctcaggcagattgcgtggaatgcggttgacgccccagaaagcaccgaattcatccttggcatcctcattgtggaaaaacgacaaaatagtgccgatttcatcatccacctcaaaataatccgagtggaaaacatagtgctccctcggcttaatcaccatgaggtgaccgtgattttccatggtgcccagcgctgcctgagcgtcctttttctgctgacgagtcatcgtctcgtcatcgagctcatcactaatttcttccacgtcatgcgcatcggtatcggtggcacgatcatcaaattcaccaaaaccaaatgatccactcagtgtgcgcgcggtgcgcgcaggtacaggtgggatcgggtctgattcggaggtgcgaccaatgatgcgagctcctaacgaaggtgctgggagcggtgcttctacagcagtggtagtggtttcttcagcctccgtagtaagtgatgcagcaggttcttgtgcccgtttgttcttgagcttgttaaaaagtttcatctatccccaattcagtttaagagaaatatattaaagaaactttaacacaaagaaagtagctattaaatgtcattttaatagcttatctgcaccccagttgcttacccacagacatgaaaaaacaggctgctggatcatccaacagcctgcatcaaactccaggtgctactttttcttatgtccgtaaatgctgcgcaacaggtcattaacctcaaaaccgttgagctggcggcactgtttatacatcgcacttgagttttctacctcagagagcaaaatctcttgcgcagtatgcagtgcagcgtcattgggtgaatgcagcgtcaaatactggtgaattgagctgaattttccacctacgtcataacgcaaaatatcaagcgattcctccatgagtttggtgagctcagggtgtcgatacactaagttctgatttttacgctcgacgttggcgacctggctaaatacggcttgagattctttcgtcgtgatgaaattccactgcgtatctgtttccaccttttgccaaaaagaatctacgcggtcaacgatttggccgcgatcaccagaaaacaacagtgctgaggccgtgcctacgacagagtagaaataaccgacgctgccgtccaaataacgcacatagccatcttcatcaacacttttaataccgacaagctgcataaatgggtatggtgcggtatcacgtcgtgtagaaattctacggtgttgtttctgcagatagccgaacagagccggcagctgcataaacttcatttccttggtcttagtccactgtccgaaatacgcagcaaaaccaatcacccacagcacgataatgattttcagccacaccggtgagtgcttgaccggtggtgtcataatcacagctgcagtggaaataaacactacaaaccaaaacagcaagactttaacagggataacaccaaggctaaacgacttggtagtaatcggagtctcataatccagcacactgcgtgctagagacggtggaactttgtactctgcttttgccatctcacaccttctttcttcaacaaatggtttgtttcttctagtgcacgtacttgtgcgttaatcgcgtggtgcgagctggaagccgacgaacgaattaccgttgtactcgccgcgctgcagcgatccccgagcggtgtacggcttcttggccttcgacatggcatcaaaagcaatctcgcggccctcaagcagatcggcgatctccttgtcggtgaacttgtgaccaccccatacgcgcttgaagcgaatcttttcaccctcaaccttccacacacccaccgcgtacacagctgggtctgcagaggcaatgcgatcaacctgccccttaaacccaaagaacttaatggtcttgccgtctttgttaaagctttgatgcgccagcttgccggtgactgtcgtgatctgtccaccaatcatggcatcggtaatggtgagctcctcaccgcgcagcaacgcctcgcattctgcatcgctaaattcatgcccgcagtagaccttcttaaagctcacctgctcaccgttccaggtgccggagtgcttgacagaaggggtaaaagtagtagtcatgagtttctttcctagttcttgggggatgttttttgcgttacgggtcatggtcgcaatatcttcttcgacccactgtttaactggttccagtgcctgctctgcagtcttttcaccagcagcaaccgctgccatatcggcataaacgcgctcggtaagtttgaggtcgccaatgtgggtgccaggaagcagcagataattcagttgccctgcgtcagtcatagtgactttgccacgcgtttctttgagcaatgctgacttgccggctgtgacctcggcataggtgctcgttcgtgtcgcaccggtaccgacatcatgcttatcgagctgtttcatcaaccacgtcattgacggatgcggtggtcgctgcggaaaaccctcaaacacttctggctcagcacgagtaccaatcccctgctgtgctgcatcactgccggcagcatcatcatcagcctcagcgtctacgtcgaaaatacctttccaacccaaggactttggcacatttgctgtaccgagaaacgctgggtaatccacgacgcggcctttttggtgctcatagaggtaatcctctgccagcatcgtgagatagctcttagcgagcacttcataaatgcgctgtccgagcacaccgtaggtggttttcaccgctgcaatactggtcggcacattcaaacccggacggttggcgccgtgtgcacccttgggcttaacatgcgtggaccgtggctgtcggtgcgtaaggtcagccgggttcacaccaaccaggccggcgatcttatcgaccaacggcgctagttccttaaactgctcaggggtaatcgtcttatcctcggtacgcggataagacacgacctgcgcctcgtacatctgctgataagtcttaagcacgttctttgcgctaaagccctctttagacagcagggccgacaggctcgccaggtcaagtagacgtggtggcgcggtctttttcatgctcttctcatagcattcgaccgcactagccttataaagctgtggtacctcgtcgcaagtcttataacgcggttcctcggggttgacgtaacttacaccgtgatcatcaatgaagcggttttgataaaaaggaatctttttataatcgttgtacgcatctaagccctgccccacaatcgcaaccatggcagatttcaggcgaccattgcgcaacactgcacgccgaccagtggtctctagcactttggtggcaccgcgagtccactgcatcgacagcaaatcaaagcgtgatcggaattccgccttaagataattgggctcgtcatgcatggaggtcacatcgcggcggttgataaacgcctgctgaatcgaggccggcgcctcatcaacaaattccatacgctgaatcttcttggtgtctaaccccagctcagcgataatctcccacgccaacagatcaccttcgcccgtgggatcaatatctgatccgatcacaatggtggtgcagctgctcaaggttttcttaatgcgtgcaatcgtgttagctgcaccgtgcttttgctcgcgtgaccacaaaaactgcgtctcatcccacggcagcttagccagatcccagtagccgccgatcttatcggcatagcttggtggcaccatctcttctggctcgacaaattcataaaggtgcccgctggctgcagcaataacgtacttctcgccgttataagtgccagagggtccaccgagggctttcgcaaagtttttcgcagccgaagctttctccgtcaaaattccaattgtcaaagtattaacctttcttacttttttaatactttaacacggtcaagaaactaattgaattagttatttgagttattcaaccgacccagcaatgcgggtcgcacagccaactcaccacatgagtcaccacgaccgaagattctgctgtcgcagaacggacttatttataggatttacacataactagcacctctgccagtgcccacagggtgaaacctcactcccacacagtgagataaacactgaaaaactgaacaaacgtgaatttaattcgagcgtaaagttacgtatcgttacactccgctacacagcgttacagcaccaaagatgcacgtcaaagagccttttattatattaaagtgaattattaaaataatataagcgttacatcaaagttacataaaaaacacgttgtgacctgcatgaatgcaaaagtgtaacgttgtaacgatactttgcatgttttacgtatacgcgaggggtcgtaataatcctttatggcctttacctatcatcacgactgtgcagagccgtagcgttcacatgctcgctgatatggctgcaggtagtaaaacgacatagcatcacgctcatatgtgcctttaggtacttatgtgtcctatttcacgtttatgagtttttacttttactcttccgtctatattaaagttgcaaaagtatcgttacaacgttacaaaccacaacattaagtttatagttgctggttaaacggtacttttgggtgtaactttagctttttcgtatcgttacaccgtagcgctacaaaactaccgttacagcagctcagagcatgtttttggggtgtaacgatacgtaacgtttgtaacgttacgttcataattaaattcatatatgtgactgttatgcgtacttccgttctatttcaatagccaagtagttactgtgttgataattaaaaacttatgggaatttttagtttctgcacagcgtcactttttccggtatgttggaaatcgttgaaactgtagtcataccgctgttatgagaatgtcaagagtgcaataacggccccagggcatacaccaaccactcccctacatcgtgcacagcagtatattcttgtgcgctcagaggcagcctgcgacgcttttttatgcctctgtgcttgtttaagcgcctcaacaattgtgcacgaacacaaaccagcacagcaccactcaagccgttaaacaagcgcgaaaatgcagcaacaccctctttatttaggcatgcaaaaagcagctcgctccggggtacgaacaccctcgaaacaagctgctttaattcttagcgctaattactcagcgccaccatcacggcagtggcaacgaccaccactaccccacacatcaacaccatttagcgcgcacctccaccagtgctcggcagatcaaagttaccgacccggtaatcctgcttggagacacacaacaccacagcattaagaaaacgcttcgggtcaggaacacgcacctgccacgcctcatctgtccgggtgttccacaaaataccgtccttcatcccagacatgaccaaatacattgcgagctgcaaaaacatcggatgtgtcaactcagagacgaatttcaattcataaagcacacccttgtgcaccgcatctgcgacacctgcaaaagacattggcgtgcgcactactttgctctgtactgcctcgccgtcaaggatcagtggaatctgattacgtgaatcagcattcagcctcgtactcagccgtgagaccaatgccttctccgcagcaaccgggatagagctgcgcacctgatcgacataccgcatctgctctgtggacgctgctgtgacaataaggcagttacgccatacgctattgtttttcttcaccaaacgtttaagatttttcgcgaactgactcgggtacgccgatagtgctgtatgaacgttgtagtccttgaagaacactgcttcctgaaagtttcccactgtgggtgagagatcaataagcccgtcactgcgattgacctcaatggctgcacccttgccgttgtcgagacgcttgacatcaagcaggtcaaaacatgcttcgacattctctgcgtacttaaaatcaaaggcttcagtcacagagatcggtcgcgcatattcgctcggcgccaactcaggtagttctttaaacactgaaacagggataaaacccatcatgcgctcaatctgtgactgaacctcacccacatcacccttactttcttctgccggcgtatgggcatctacctcaggtgcaacctcagtattgttgtccaccacacccacagcgagccctgcagcccagtccgcaccagcctcatacgctgcttgaagagaatcgctacgtacaaaaacaaccttgtttttaccgcgtgatgctgccaccaaaaacacattgcgcatgaccactggatcaacattggggtaaccaagacgcatgtcccagaattcttcgtcatagtcaaagaccacgcaggtatcgcgctctagacctttactggaatcaaaggtggtaaacaccgcagcgtcattagggtgtgcaatctgggaatcaccatcgcgaatagaggcgaacacagttttcttattgaactttgccggcgacttcctctccacgacattaagcgcatctgacatctgcccattgcggctacccaaacacaacagtttgctcggctcggtgctttggatcaacaccactgcctcagcgaaagacctatattcaatctgctgtgcggtattggcacccacaatcggtttattccaggcatcagccaaacccgctgccatagcctcgccaattcgaaacgactgtgtaaacggcgcgaagactggatcttcacacaattgtgctgcaaattcttgtggatctaacgtggtgtcagaccggactttttgttccaaatcacccaccatgacaatctgcataagcggattcacagacttaatgttgcgcagcagttctgcatagtcctcattgatgtcctggtactcatcaataaccagcaggtcgtaactggggaacgtgcgagaaatgtgtttgaagttcttgttaaactcccgaatcgactcgctaataccacacttgatgccggccttgagtagatgcggatagacaatgccgtgatagttctgcaccttggcgccacgaacgcgctgctgtgcatcgaccttcaacaacttcgaatacgtcaaatacagcacgtcatggtctgcacccatgatcgaacacagtcgttgaatagcggtagttttgcccgagcctacggtggcatcaacaatgacatctttgccagcaagtacataatcaatcatggcttgctgttcgctactgagttgaacttctccagcacgtggtcccagctgtggctgcggtgccacctgcgtgctggtgttgtacgcagcgagcattgctgctggattacccaacgacatcatatttatcataaactttctccgtaagttaataaaatattaattagagaaaattctaacaattatattacaattaccccacacacttagacacagcaaaacccttcccggaagaaaacttcccgagaagggttttgcactcaaccaatctgcgaaagaccagtggctttactatggttgatagcgattagcaacaaatagcacttcgccccacttggtcgaaatattctgatagtcatcgtaatgctttcgctcgagtgtggacccatcaggaaacacagtctcataatctacaactgcgtcggacagatctatggcattatctgagccgtgtaaatctgctcctttcagactgcacgcataaaaactagcgccagtggctttattgaacacacaccgacttgcttgcaaatcgacattcccaaagaatgcattagtgatgtccgcagaaatctccgcacaactcattaccgcttcacgaaatcgactatgcgataaatcgcccgaaattacggtatcgcccaactgagcgccaataaagttgcagtaggaaagatcgcaattcgttaatcgtgcataatgccacgaacactcactaaaattagcacccgaaaaacagcattccgacacactcaccgaatctgtttctaaggcatatagccgaagactgacctcaacttcaaacgacggggttttgtccaaaggagcatggaaaacatgtgttgatggtaccgcctgtgcctcaaacctttcgggggattcatcagacgcgcgccctaacctccgccccagttgctcaaatatttgccgtcctacagtaatctcagaccaaccgtatttccgtggaaaatctgattcgacaaacatatgcgtaacaacaatgtcacacagtgactgaacgatactcgctccataagttgtacccgttgctgcagcgcgatccatggatctaaacgcatgttgaactgtggcagagcggatcgcgctgttatcgctacttaaacccgcaatcaagggagcaaaaatatcgccttcaagaaggaaagcttcatcagtcttgttcatcccagtccatgcctttcttctggttcatgtggggaagtgctttcctcatacctgctttctaaaagccctcaagcttcaagccttaagccctaagaaagaactattctcaggagctttccgtgtactaactcgcgttgttcataccgcaggagctttcacaacaataccgtgcccaaaaacgctaaagtgtgtgaccaaaatttttggagttcctgcactaaacgctcatgtgcatgcagtgagacgtgatcgccaatgaaatctgggctgcgctcagcgcgttgtttcctgctatataaacctcagatagcccaccggcagaacagacctaggtttactaacgatgtcagcagttcttgcagaaaacttccggggtcacaacatcgtcgccaccctacactggggtgagcacgacgtgatctcaatactcctcgaatgcactcgattgtgctcgctgcatggccctggcctgcgaattgagcccttcgcaccaggaggggtaaacacgaaatccacgtttacccggctgtccgtctgctgcggtaatccccaattctgcaagatgaccagcggaaaacctaaacaatccgcgccgaacatcgttcctcacaaagacaagaagaccagcattcatcccgtcgtcactaaacggctgggtctgccctcccacgcctcgctgccaaaaggcaacaaaggcacccggcttcgacggcgtgttccggccagtccggacatgccactcatgaccttcaacctgtgctaatcctgattcataatcactgttctgtggctcaggggcgaccgaaacagttatgcccagctcggtcgaccacatctccaacgcgctaaatcccatgagctcaacttatcaacttcagccgcaggaagcctactgcctcctctcgcctccttccgcaatactccctagatcttgtttaaccgtcaggagttggagggtatatccggctactgaacgacaacacttttaaacgacggcgcttgcgactattacctttgacccggcgcactaatcaattttgaaaacgcgcaccattaggtaatctctcgataaatagtgtttggccagtaacagactcaaaagcttctgcaaacttgttaaatcgtcaaaacagccgttgacaaagctctcccaccaccgcaactctgcatcatgactccaataaaattcctcaaccggcatttgataggcataacgttcagctgtagaaggccccagcatcatccaactcgtcgctaatgctgactcccacaattcaagatctgtcttttcgaaaaccgagctaataggactaggcgaaccaggactcagtgcacaatatcccacaagctcacaacgtccagccgactgcgcccactcctgatcaggatcaacaatcagcgcacgcccaaccttgacatcaattccggtgtgctgcacaaagaactctaaccattcctgtaactcagatacagtgagcacatccggtagatcagctactaaggatcttatattggacgagaaaagtgaccacttttcagcaacgatcgcttgaaaaagacactgccgaacagctccggctatgcgctgattagtaaatacattacctgggaatggtagtgaactaccgtccctttttgtcactctagaaaatgcattccactttcccatgatgttgatgagtagaaaatctagacttagcgatggcccgataaagcgaaatccggaagttttatagcctctagtgtagatgcacagttgatggggttctgtcatatgcgaagcttattataaagattcacatgatcaggacattgggaaatttcaggctcgtgttcgattccaccaggtggggttgaattacaccatgctgaaattacccccttgggtctgttcgaatttgctccagtgaaagtatgaggattgtaaataatagtcacccattgcggagcgtgcatttctttacatcctgagttcttattgaatgtataagttctgcaatctagaaagtacaccgttttctcgaacttgtaatagctggttcctggcgatgagccataatcaatcaccgctttatctactacggcctcagccatagcgtggttggcgaagttgtgtttgcaatagttttttaaatatccccagccttcattcctgtaacggtcataatgcccttttctcacgacaaatctgaactcggtggggaaacctcgcgaactatactcttttttgatcgggccaccattcttttcaatgttgttttcagtttttctctgctcatctaaatcgggaagattcttgcaatccacgtattgtgcacgctgggaaaacagggtcatctcttggctcgatgaggatgagccgctacttccaattgggaggaaatcctccaaacttctttcttcatcgtcaggaatccatgtcagtgcatcacctgagcctaaaacaacacctctggtgaattcttgttcgagtgactcatttaatgatgtcaatgatggtatcggccaccctaaaggagtatcggtattttggtattgcagccacagggagtaaacatcaccatacagctctctggcgcctaggattccattccacgcaatcaccccgcgctccgcaaaattcaccacatggaatagaccagaaacctcaggtgtttcatctgcttcaggaaaacctaaacgacccgtctcccgacccaacgcatcccacacccgctgcgtagccaaatacataaaccgtgtctgacgatcatttcgccacgaaattgttccattggagaaattattgtaaaaatactcagtaccgctaggtagctcattagtgatcgggatgccaatggcatgattcgagccgccaagttcttcgtagcgctgtttaatatcgccccacacagcaccgccagtcaatgggttgtaatagttgtcaccaccttgaaaagtctgtcgctgagtaaggggatagtttgtatccatcggaccagaggttgggtaccccaatggccctgattcccagttcaaggtcccccactgcctcaaaccgtccagggtcactgcataagcgcctgtgtctggatgccaatagatggcacccccaacaaattcacttcttttgccaacaccgtcgggattggtcaactcgtttgactttggtggcccaagccatgacaactgacctccaacctgccgataagcgtcaagaatccggccacaaactgagaaacctgttggccacatagcctcacacccagttgcagccatcaatcgtgcgccctcattaagtcgcgcttccgcaacctccacctgatcagcttcgtccttgctcaccccctccggtaactcgatgacatctgagcgcatttcccctgcaacgatgtcccgcttaggtagcggaagttcctcaacattgtctttactatcgttgacgtgctcgtgatactcaatgactacttctggatgtgctgattcgaaatcctcaagttgttccttaacagtcggagcattcctattgggaacatagtcaacaccatcatcagcaaactgctcatcactgatttcttttacaagctcaaattgatcttccacttgtgcttgagctaccggagatgcaaccccgatggccagcaacatgacagcagaaacacccactagtcttcgtaccaaccgcttatatcaaacctttacctgtcggaaaatatgtacaaactgaggataggtaaagaattagttaaaagttggatgggagagaaaatacatgctctttacccgaaaagaggggtgaaaagactgtgttgtactttaagtgggaataggctctccggtagacggatcgacaccatacacggtcttaaacatttctggtgccaccactgcctgatagttcaatgcagcattgaaggatgcctcatcgccagattcacgaaaacggtcaagtccatctcctagtagtgaaaacatggcttcattaagcactcctagctgctgatctcgtgcatcgtcacgctcacgaagacgctttacctcagctgccaagttatgaatctgcttctgctgatctttgatgatctcgccagcagttctcgtctgtgccataatctttattcccctttttaagtcactaactttatctgtttgattcttactatatctgcatcagtattaagtcgaaagccttcagtcatcatttcgcaccgcatggaactgtctcccggctacgtctttcccccgctgccactcatgctccgatgactttttcaatacagcaagcactttctcatgcttttcactgtgtagatcaatgtcttctactgctgaaccagtcgcaatatcaccgatcatgaggcgttctgcgaaaaacgcactgagcaaatgctcaaaaaagaaattgtcgcgttcgttttgtacgctgcgcttgtgcaaaaagcccagtgtcttgttgatctgcgccatctgctgcgcctgttcatcaagcgcgtcattgacactttcctgccaacctacagatcggtgttcattgagaatgtcgagcacaagctggtcatcgtcacttaaagacactaatccttggacatcttcgtgattcgccagcagtgacacaatcccgaggttcaccaagatcccgaaaggaatagggcctcgaaacgtcacaccctgctgtgcaagcttcttgtgcacatgatcctgcagtagatcggtcagcctggcactcgtcctgtgcacagtacgcagttcatcctctagatccacaccatcgccatcacgcaacgtaatgcttgacttaaaggccaccacacctgcacgcggtgtacacgctgctgcatcggtggttgtgcgagcgctacgttgtcgtcgcggtgcctgtttcacagattttttgccagatcgcttgggctcctgtgctagttggtgctctttcgcggcgtctagatccgcaactacttcaacagctggcgccccctgggtcacctctgcagattctgcaaccgcctcatgcaacacaggcgcctgtgctacctctgtcacaacctttatctctgattgcaccctctctccacctgacactgctgactgccccaaccatgtctgagcatcagtgacaccctggtaaatatcgcgcaatcccagcatctgctgaaaaagctgctcctgcgctcttgtcaccgtaccggcagcaacacccttgttaatgctctcagttaaggtcacccatgagcgcccataagccggatgtgtgctatcaccaagaagcagattccttaacttatctgagcctaaagacagcttgtcccacagctgtgacagcacactgtgtagccgtgcattaccagcgacaagatccacctcatcaaaacgaacaccatcggtcaccacaattggtgtcacggccttagtcatgatcaccaccaccctcgcccatcaacgcagcactaagctctgcagcgagcgcatcaacttcttttttaagccgttcattttctgcttctaattcatgctgctgctgagcatgggattcaccctcggcaagtgccttagcgtagacctcatcaagttccttattatgtgccacctgagtcatcagccccaagcgtcgcaacaccacgctgtgctcaataccgttgagctgcataaaagaccgaattgcctgatcaatcggtgtaatagtctcacccgctagatcgacactcatctctacgtgctcaaccttgggtaccggctctggcgttggttctgacgcaacgacctgttcagcaacaaccgctacgctgtcagcgtcatgagcaggtgtcaccacaacctgttcatcaacgttgtctactacagctatatcctgatccatctctacgttctccttctctgtttcctcggtggtctttatcatttcggtgacatcatcatcatggggctcgttctccggtgggcgctggtaacgatttttaagttcttccagcatgatcgccccatcagcaccgacaaagacgctgagatcctggtgtccatctcgcatagcctgctcatgccttatgtggcggtgaacatcaacctgcccaaaagccagctcaaaatgcgtaccaaaaaacactcccgcccccacatctgcggcagtcgcgccagctgtattctcttgcccgccatcatctatgtcggtgttcactgccggttgtgttcggatgggtggtcctggtcgcagtgcattgggtacgggaagtctgggtcgaaaagatcgcaccgctgtcgcagtgccggtgaaatcacggggattgtctaccgactcttcgtgactgccctcttgtgcagactcttctgtacttgtcccagtgtcttcagcaacagcctcagagacatggttatcactgctcaactcacctagcggaccagcgtcacggggttcatcctgagcaaaagggtcctcatcaaactcgtcctcatcatcaaggtctgctgcatagtcataaggctcgactgacccttgtacgccagcttcagcctctaatgcagctaattcatcggctaaggcagcttcctcaagggcagcatcctctaaggcttctcgttcctgctcgttcatcgggtttaacccaggtcatcgagatcatcagagagatacgagtcgccacgagtcataccgataatggtgttgaaaccactagttacaactgtcgtgttgttcgccaactcacgaccaaacgagctgagctgatcaatgatttggttcatgcggttatccaacagtgaattcggaataacgtgcacaccgttatcacgatcaatcttctctctgatcgcctcttctgcatacgcgctcagcgagataccttttcgatctgcccaataaattgcccgctggtgggtgtctgaatcaaagcgcagtgtggcacgtacatgaacctttttctcgtctgccatgtctatccctattctccgaaaatccattaatgttaatgattaagttagtctatttcatagttgattaacttatccactacccagacctctacaagaaagttccccagaatgtcactatctattagttttcataaaattgcactctctgccaccaccttgcttggcgctgtcgcaatctctgcctgtgcgctagtaactcaagcacctcctattaacgcagccccggttactggcagcagctcattaagctccaccctcgacctgggcaccaccacccctaccagcatcgacacagtaaaactcactcagcaagcacaaaatcaagcggcaccacgcgttgcagcgagcctggtgcgcgtggttgacggcgacaccattgtcgtgaactatcagggtgctcagaaaactgttcgtatgatcggtattgattcccccgaaaccaaacaccccaccaagcctgtgggcttctacggaccagaatcttcacagaatctcaccaccatgctgcgcggtgccaccatcacactagaatttgattccacccaagcccgcgaagatcaatacggacgcctgcttgcttatgtctggtacaccaagggcgatagcggtcttaagcttgccaatttggaacaaattgcctcaggctctgctgctgaatacagcttcgacacccgctacaaccaccgcaatattttcctacgtgcacaaacccttgccaaggcaagcagtctaggtatgtggggttaaaagaaacccacctataccaaccacaaacccccagcaacgtgcaccgaagtcacggtggttgctgggggttttaccctgccggaggcagggtcgggtcaacatgcgcgagaagtttaacagcgcatgttagccaatcgcgttcatgagcttgacaaaaaagttgagcaagccattggcgttgtccaaaaaggtgccgagtccatcggagctaagaacaccttcgagctttgagctgagtccatccattgtgtaacaacctttcttgagaattttttaagagagaaaaagcaacgcctgactaggcgctaaatgcctcgccgtagccttcgacaccaagttcagtagagatcaaaccaccaaggtcaagcagatccccaaaaccaagcacctgcgagatcgcactggcgctgagcagaccttccagcactgcactaagcatcatcaccacaaactttcacagtagttttttcattaactttgttgattaagtttcaataaagtttactatatactaaagtggaaaccaaagacgaggaaagtatgtctatttgtttgtccccaggttgtccacatttgttttattccccgagaatgtcctagaaaggaactcgaccccatgtcctattcactcattatttctaaagcaccaacccactccatgccttttaatgaggctgaactcctagagcttgtcgatgaactgcactccgacaacaccgtgaaaaagccggttattgtgccactccccgatgatttctcctacaccgtagatagcgccgtgcgactacatgatttgggtgttgaccaggaactgactgactggattactgcacaagttgctgcagcctatccaaaccagatcgtctcagagattgctgctgcccctgatccgcaagccaagaccttattctccgccaatgcgtataacaccaggtcttttggtactttttggactgagcaccctattacacagctccaatacaagcgctgctaccaaattgtcatcgagaacgttacgggtgtctatcatccgttacctgttgataactaccgctacgtaccccctgtcacgccctcattgccacagccggtctaccacgaagctatcgccttaaatgagtctgatgtcgctgatcacggtactcgtgcagccaagcacgcaatgatcaaccgcaacgtataaccacacacgccacagatactcagctatctgtggcgtgttgttttacatcaacctctcacccatcccccatcactattaaagaaaatcaccatcatgacccacactgataccccagcccctgcacacggcgtaacaccgagtgaattcgctgttacctcacacgaactcaccacctcaccaacacctagtccgacacaggtcgctattgcagcccaggaaaaaattcgccagcgcaagctcgaagagcttaaagcaaaaaagcgcacagacacgacagctcaaccacttctacctgcacctgtgctgcatacacgcccactcccctcaccgaatccaccgcgaccatctccaccggcacctaccactggacactgggaacttcttattgtcaggtcacagcagaagaaaatgaccgcagccaatccctttctcaaattccttcatctcggtaaagccttcaacgtgaaagacctagggctcacctgcgatcgcaccactgatgttgacctctcacggctaggcaagctcaatccgcccagctcacttatccttgaactagcaacggcacttgacctgcatccattcctctcagtcgcactctcttcgcacagtgcggtcaacgcccgtcgcaaccaacttgaattaaccctgcacaaccatgacactcagggcacagcattaggtcacagcgttactatggtccagctacccgaggtcattaatcgagctgctgtagagccctatatcaaacccaagggctcgggcaatgacccgcttgaccaaagcctgaaccaccgcgcacccaccgtaagtgacgtgcaaaaagcccttgtgcaggaaaacacaggcacggcaacagacagcaacaactacctgcttccttttgatcctgattctggtgcaccaaaaaccaccgcgcttaatgcgcctaataaggatctcctacaggccaggcatgagcttgcctatattcccgagatccccgccattgcatcgtggctcgatcaccttgaccccatcatgcgtgtgcaccgtagtcttgcgctttcaattttcccagtgcagcttctacgtgctgccgttgagaatctccctcataacgtaaccgatctgcataatcaccttgatcctgaggatctgctccctgaggaactcaccacctggctcgatcacctcttcgatgcagacttaaccgctctcgcttcatgcccacagcttgcaccacctatcgtgcgcagccacaatcacgccaaagcgatcgcagctatcaccgtgacctctgtcatggacgctctcatcgccaaaactcttgatgcgcatgacgatccactgccctcactaccggagtttgtagaactactgcgtgacgctgtagcccagctcgcagcgcattttaagcagcagcgcggcgaggtactaccgcagcccaatggcttgcgatacgccaccgactttggcctgctctcttatattgccgatggcttacatgaatatgcacttgccatcgacttcgggctgatctacccgaatgaactcatcaccgagtaaacccactcctagaaaggtctttacccatgtctcgtatcatcactgctcccgtccacaagccttatattattgctcgtgaagtcaagggggtctcccatgtccacgacactgttggcggcaagtggcaggccaccttgcacacacttaaaccggggccctcctggccgaaaccgtcacagttcactgcgcctaaatccacgtccatctggtttattgcggtagcaacccacccacgtaacccacgggcacgcaaaggtaccctacttggtcgcggtggtctttacgaactcaaagacactgatctgaactttctcacagagcgacaggatttgctcgccacatctacctctcgtgacccagaggattgccgtttacgctttaattcgcgtcacgatgcagcagcatttttacatgctaacgcccgccacatcaacaagctttttcatccagcactaggtcatgctcgctacgatctcatagatgtgtaagcacaacgcttagcttatgagcccaaaataactactaccccctccgggtgtggggtagctgtaacaactaccccacaatctcagccggtcttccatacataactgcgaaattggttagagtctttttcatgatgctctaccaacacaccacacgcgggctgatcattagtgacgcgatcatcgcgaaaatcagccaagtcaaccaactgctgctactaagacccacgctgttgcaagacaaagatatgcaccatgcgacattgagtagcgacaccccatcaattcgcagtcgccgtcgctcctatcgcgagaataaagccgcctatgcgaccacgagcaccatcagaaaccgtgagacctttttcagcacatctgatattgatttcgccatactcatgattcaggacgtacaagaatctctcgtatcttttgaccccaccttggctcaagatatgaagccaagaaccaacgcagtcatttctgcactcaatgagctacgcgagccactggataccttctaccgtgcccatgaatacggtgacatcatcagcgatggtgcttatgagttcgatcatgctgccattgatgcacaacacagccttagtgaactcgttgccggtctgcataattatgacaacctcatgtttccccaggaaaccgctccgttgatgagtgaatccaatggcattcagctggctcagtactataagtccaccaaactcgatgagtcacaattgacggtggaacctaatgagcctggtatcagcattatgtggcacgcccatgatttcacctggtcttgcctagtgcgctatgacgacatgaaccgttaccctgagcatttcagcatttcttttaaagacatgctgatccctgaacagatctatactttccacttcaccccacgtgaggcaatgcaactgcgcaaggtactttttaatgccatcgctgcctacaagtctcagacatggggtgatgagaacactgatctcaccaaggctgaactcgaatttggtggcacctccatgaccttccgcgccggcctctcacagcttagcgtcaccggacctcctgatcaccgccaggtgttctgcttgtcgtcttctggtcgtgaggatcacaacaccccgccaaacatgcgagacggacatgtcattgatattgcggttactcaattgtccaccctgcgtaacctcattcgggtactgtgcaccactcacccggatcattcaccagcactgctaccttatggtcagcagtacaccatctaacatgctctaactcgaccccgaaacaccctgtcgccatcattgcgacagggtgtttttgcatgtccggggtcatgtgaaactcagactaattactttagtatttagtcaattagccaactacgataaaactagtgaataaacatactagttcactttgtcgcgcttaaaatactagaaagtaatataaaaaactcatgcgttatactccccgtacccaccgcgcactcggacttgctgcacttaccgctacagctctcctactgagctcatgctcgaccaccgctgaccttctcggcgccgattctgtggcgcaggctgtcaccgatggtggctctgcccttgatcccactgcagctcatgtgctcaccatcaccaatgccactgcaatgactcttgctgagctaccagaaaacaccgaccctgacgcagccaataacacggagccaacaatggcccaaagcgccctcaagcgtatttacggtctcgaaattgccgccgatggcactctgattgctgtcgcagcgccattaacctcgcgaaatagtggttctgagcagcctactgtcgcagcaatggctgatccagaaaacaatgctgaactcaccacagcacatattcttgagatcgacccagccacaggaactgccacaccacgtcaagatattgctctgactgaagattttcagaccatggctagctcttttagccagatccgtaatggctggggtactacccaactcatcggacaacaccctgatgatcccaagcaacctattcgttcagctgatacctggactgtcaccggctccactcagatcaccggctttaacaccaacaccccaacgggaaccgaagatgctgcctacaccatgccggcgactgagccagctgtgggactgtgcgctctagaatcaggctccgatgcaccactggatgaacaccgtgagctcagcaccagtgcattgcgtaccgcatcagtattgtcgagctctggatctgccaccctcaagctgcatgatcctatggtcatgtctgctactggcattgtccaagcacgcgcctatgtcgatggcgaagtcattaaccagcacgagattggcgatctccgcgagcagctcggtatcaacatcgaagaatctgaggctgctcaagcagaatcggatgcccaagcagccaccgatcacccacttgcagccctgggcttaagcaaccccaccagctcagcgttggttccaggtcttgctgagcttgattgtctcagtgctgaccaggctgccacctggcataaccgcgacaccagcattggcaccggtaagcccagcgtgcttgctgtcatcaacgcggaaatggccgatgactttaccctgcagctgttgagctcaggtgccaccactgccgaaacgcagcttgcccagctgccggatgaaaccgcgttcgtgctcattgacccatcatctggtgctgttactgacctgttctttatccaaagtctcaacactgatctgccggcaccaacaacccagattaattctattgctgttgatgagcgcgaccccaacatcatctacgccacttttagcggcgatgaccacctgtaccaaatgatgctgggttagttacacaactaactaaccaggcaccaacattttcttaaagaaacacccttatcatgacttttctccaccccaaggctgcgttctaccctctcaccatggatcatcttaccgatctcggtcttgatcctgagcaactcattaatgagttgccgacgattacctacgacgttcaaccacacaatgtctttgttctacagttcagcaccgccgatgtgcgcgtctaccaggaaggtaataccctttttatccgcagtgctgaattaatcaaccctgaactacgacaacgacagcgcacacagctcaacgacgatctcaacaaccctgcttcacttcgcgtctgtgatgagatcagtggccgcagcaccgtgttcctcaaagacaaaagtgttgtcactcacgatcacggaccaattgctgtgattccgcataatcctgatgaagccagcgccaaggctgtcgctaccaaacataagcacaccttgtccggcgctacctctgatcacccttatgccggcatgacgcttaaagacatgattgaacagggctttacgctcacaccgctggaattcccgctctgtgctgtcgatgatccaacagattctgatcgcaccatgcacgtgatcaatgttcgcgagcacagtatgtagattctaaagtgcggtacaacctgtaccgcccacacaattccaccctttaagaaaaggacttagccatcatgaccaccttcgcccttattgctagccccaacaatgttgatcccactgctgagtccccactcgccattgaaatccataccgatgaggacagcagctatccactagggcttattgactcagaccacctggttcctgctgtgatttacggcgatatggtgatctacaccaaaacactgctcgcacagaccccaccagatgatgtgtccactgctagcgccttcttcgacaaactcaccgcacttgacgctcagggtcgcacccgtgatctggtctacagcgccacctacagccaacttgttattgccggccacaaccgcactgtattaactgacgactcagagttctacgatgagttttaccaggttattgaggctgctcctggggtgatcttgaaatgatgtttatcgggcaacacctcacacttaggctaggtctctaacatgaagcagatagcgccatgatcaatctttttgctgcagccctgcccgcattcgagcctttgagtattacctccatactcgtgctcggtgctgtggcattgatctgtggcctccctgtttttctcgcactggaaaaaagcgctgagctcgatgatctcttcgcagcactcatcatcgctgtacttttaggttttgctgcttatacgtttgtgctccccaagctcgttgaattgggctgtactatttgccagctctgactagcgacacttaactttccccagcctggctgacttcagctgactatgcgtacttctacatgagcttcgtgacccccgcccttacagatgggggttgctgcgtaacaaccgctcaacaaaagaaaacaacgcatagctcgccgcgaatactactatcacctcgaaattctggggggggttccacccatgtaaagacccacggcagttccgtcacagtgacggacaatcccaccctaaccccacaccttgtcgcactctgatgtgccttcggtgcgggttttttcataagtactgctgtatgcacagactaaaagacacaagcaaaagaccaatgacagcgaagctgcattcggaaaaacaggcgaagccctaaaagctccaaaagatggaaaaaactcaacgacagcatagctgcgttcggggacaaccatgagagacgacaaaaaaactctcaacaataagagctcggtcaaatacctagttctacaggatctaaagagtcagaagacttctaaaagatctaaaagactttaaaaaccaacgacagcatagctgcgttcggaaaaactcttgaaaggctacacagccaacagcttaaaaataagcactgtgggtcttaaacactcaatccttcattcatccataccattaaggggtatttaccatgtctgctaatccttccaataacttcaacgtcatcggccgtcttgctgctgatccaaagatcttcaccaacccagatggctcccgcaacatccagatcgccgtatactccaccaacaactttgctaaccgcaatggtgtctatgaggactccatcgttccgctcacccagttctactccgcatccaaggaaggtaacggaatctactcctacctcaaggaaggtgaccaggttgcggtcaacggctacatccaccaggatcagttcactgacaagtccactggcgctaaacgctacgagttgaacctatctatcgactccatccagccgcttgaaaccaagtctgctgctgacgctcgccgtgctcgcaagcaggtcgttgaggcaaacaaggcgcaggctgctgcacagcaggcacctgcaccagttcagcagttcgctgctcaggacgcacctcagtacgcaggtaaccctttcgctggtctctctcagacccaggcaccagttgcagcccaggttgcaccacagccacagtacgtaaacgatccttacgcacagccacaggcaggttttgttccacctgcaccagttgctccacaggttgatattgacccacgcttcatctaagaagcaccactactaaagaaacccccaccacccagtatctgctggtggatgggggtttctttttctcgcctaactctattcctctttttacccactgttaatccagaaggattcccacatgtctacaaccactatcaacatcatcatcaccaatggcgctgcaccacacccaactaatctcaatcgcgcagaaattcatgatcacctacccctcactgcctctgattcggagctaacccgcccctcccaggaatcagttctctatgaccatgaatccgaaactgtcttgcgcaccatggtcatccctgcagacctgcacgtcgctatgaagcatctagctaaaaaacacaacctcacggtcacagagatctcgcgcatccttctgcagcgctacatcgaccgcaatattaaccatgtagagcaaaaccaggctgaatccgacatggtggaagtctttgccagccaaccaaccaatgcaaccgcaatgatccctgtacctggaaccagcttcaggcaaatatttatcaagcacagcactggtttctggaaaaacattgatcatgatcttgtcgatctcgacgcctctaagaccccgcgtgtacgcgaccgcagtgtcttaccacaacctcaactccacagagcgttgttatcagatgctgatatggctcgccttgcagcacaactgaccgacaaacactaaaacctccacaacaaggacatcatcatgactactcgcaccgtatctacttctgcaccccatgtcactgtcaacatcaataccgcgcacaacaaaacacgcactgttaccaatggcgccagaaaaactaatgcagagcgtggcaagagctgcatctcatttcgtgtagggccagaattgtttgatgaattcaaagcgacctgcatcgacaacgatatttccatgaccaaggcgtttgagaaagagcttcgcacctgggttgatgagcacaacgctggtgcaacaaagaaaagaaacacccatcgcacctacgtacaagcacccgttggtactgtcgccaccagctctattccaggtcttgggttatttactgtgttcaagaagagctctgatcagatgtggtacgacctggaaagcagcccgctgatcgcacaagagcccatgtcgaatatggacatgcatcgtaacggctcttttgagctgcacctgtagatctctctctcgaccacacacagctctcaccacctcctagaaaggacggtttcaccatgtctaaaaaacgcgaccacctcaccgtcattcctgaccttgagtcacgcacccatcacagccgcagtacacaaccgccaactacgctgcccgcaccacagctgactattatcaccgcaccagacaagcatcaaccacagcttcgggttgttaaaaacaccaccaccccatcttctgtgcagccctcgccgatcaactacagctttactgatcctgtacttcgcgaggctcactatgcattccagcacagcgaacttgccaggccaacagtcctggactcacactgggttcgtcgcgcacaagaagaattcgacactgagcataatgctgcctatgtccgtgccgctgaccagctcttatccccttttgatgcctacatgctcgacaacggcgatgtttacaccaagaccccacgtgccatcagtgctgctgaacaagaagaaatacttgagcacttgcacgaacaccatatctgctgggacgaagaagctgaattcctgctgcgctaaaggttgccactggtttcaggtgtgtgggtaggcacagcccgcctgggcgggacttgagcggtgcacaacacagcaaagctgtgttcggctgaatgctcgaacacagcttgtttgtgtatcccaactactatgcacagcccgtaaccatcgagccggctaaaatctatcaacagaaaaaccactgcctatttgaccattcttgtgcaagaaagtacacctatgccccacgacgtttacgatgtcgaacacatcatttccaagcaacctttctgctccatctttttccagctccccgctgcagcgctgaaacctactattcaaaaagctgccaccaaccgcgaccttactaagctcaacaccgaacagatcgctgagaacctacagcgctacctcgacacctacagtgtcatgtctcaccagcgtgtcaccattgaagaggtcactcatgtgcgcaaccctcatgagcctgattatgagttttcaccacagtacggtgcacatatctcgctcatcggtgagtcttatgctgtgaacacggccaccaacgagccttatgccaccgactccgagggccatcctctcgcactgtattttgaaatgagtctcgcgcccgagctacatggcgtcatccataagttcttccctggctttaatctcggtggcgagtatctgccggctgattctcgcgacatctacaccgagctcaatgacctgcttgattctgatgatctcgtcggcacagacatcacgatccagattgatcgtgccaacaaagactaagccactctagctaaaccaacttaccccaccccaacaccccatgaggcatctgcttcatggggtgttttgctatgccgcaacacttttctcaagaaaactacagaaaggcccccgtcattatgtctgcaccgctcaccattcatgatctgctgtccaccaattcgaagcttaacctcaagtggctgacctgcactgtcttgaacagcccaaatctcaccgaaccctgcatcacggtttctgtgaaccacaccgaaggcatgtccctggtctctttcgaaggtggtcacgggctcaccgagattgccaacacccagctagtgcctgtgcttgagctaccaaagttcaatccttttgaggcacttgctatccaccttgaagccgccaacaactaagaaagcatccttcatgactgacaacgctgacaacaccacagataacgtaaccaataactcagacaccaatctcgattacagcttcgacccgctccctgacgagccctatgcctacggctttgaactggtcgctgctgatgcacactctgactcaacaacaaccagcaccgataccccagagactgtcgctgtggcacttaaaacccgcgaggacactatcaactgggtcaacacccagcgtgccgaaggtaaacccgatgaaattcgtatcaataacccaattcgatcagagcgtattgctgagtttgtccacgaaatgatcatgcatcacggcctcgtagcctgcatggaagatctcgcaatacttatcaagcgcgacaagctcacccagctggaagccgaaaacgctatcacagcctggcacaacctcaccaaagaatcccttggtcagatcatggggctcttctatcagtacgtcgaaaacaacacaaaataggaaagaagaaacaccatcatgtctgacaacactcaggacaaccctttctccatccgctacgcacaccctgaccaccagctcgctcttaatgagcttgttgatactgccgatctacctgcaccaacaagctatatgaaaaatccctggtccggggacaacacgcctatcgccgagtggcgacgcgagcgcatcacccagtggcagcgcaccgagatcattgtcaatcaacgcgatgatgacgatctcattcacgtcagcttcccgaagctcggccagcacattcagctcaacaccgacgatattctcgcattggtcgcagcctgcgtcacacccactgctaacgacattgaggcaactatcgaagaaaatctccactcatatccgcacgatacggtcatcatgtttaacgcagatgatctagatgatgcccttggtctcgttgttgccgtcaaagacgcgagcggggaacactcaccgcgcgctgtctggcgcaccaacaccgatcatggagctcttgacgagactgaactcgcgcggctcattctcaaattcggtggcagcttcgatgactacggcgtgctgcaacattaaaccgactcactaagcaccgctttctctatcccctctctcttcgtactcaaccccagttcatacagattttctctgtgtgagctggggttttctgcatttcccacttgtttttctccaacactccacacacacaccttcaaagaagaaagttcgaaagattctatgaaaaaccgtaaaaaaatcatgtctaccctcaccactgtctgcgccgtactgggtatagttgcagctcatccattccacgcctctgctgtcatcggcggctctgtcccatcaactgattccgttgccaacgctgtcgcaaaaatcggaccaggcgcattgaactgcagcggtgtcatgatctcaccatcgtgggcactcaccgcacgccactgtgtcgatgacatcaacatactcggcgacatcgacaccatcacgcctattactccaggtattcatcgcaatgaaggtaactatatgggtgaggtttaccgcgcaccgtccggtgatctagcgctcattaatatcaacggcgtgcacaagggcaccattgcgcagctccccacacaagaatatccactgggaaccgctgcacagtcagtcggttttggtggcggtggtgtcaatatccgcaccgctgaatcggtcaacatgattctcaccgacatatatagcgtgaggtcagggaaattccatcacggtgtcggtcgatcacactatctcctctttgattatgacagtgctgaaactggtcgaatccacaaaggtgattctgggggccccatcttcattggtgacgaggttgtgggcattatgtctcacggcacaataaataagaacgacgggtcttttgatgacgaatccggcgctgatgtatttgcctctcttgagtggattctcgacaccaccggcatcacagtgacagacactgccgaggacaacaacgataactctgacaacgacgatgttgactcaaaagaaggtcctgcatcaaatacatcacttgtactcactgataacggaccgtcacgcattggtagcaacacttcttcagcactcatcggattatcctcagaagcactattttcttcttaactcgcacctcatctggtgtgggtttttttgcattttttacacaccccactccacacacactcgcaaaggattcatcatgagcaacaatgctcttttagtagcaaacgaagccgacatcggtctctacctccactggaatggtggtcgcgactcgattgaggcgtttctcgcctacgccgcatacgcgcagttaccacccatcaacgaaaataacgattggttgccaccgtttattactgtgctgaagaacttcttcggcaatgatggttctggcgtctacctcgaacctgtcaatcaggattatctcgacggcatcgactatgacaacggtgtttacatgcttgacgattatgagatcactgagcgtattaatccacccgctgttgagcaagactcccacgatctccacgacatgttgatcaaaattgataaagctcaaccacctgtcgatcaactcgggagttttctccatggcctagagacctctgtcgcagatttgggggttggtgatcgcgtatttttgccacgttttagcacctttgataagaaactcggtcgctaccgcatccacactgttctcggattcgctgagaacgatccgtttaaccctatgaccagcagcgagcgatttaaaggtaagccctatgtcgatatgttcgacaatcaagacaacgcctttaacccaaattcctatatcactacagataccgtgcgcatcgttgtcgatcctgtaccggaaactaatcccgacgatgagaaagcaggacgctagccatgtctcgcagctaccccatctacatcatttcttttgccccagcggatgatctccacggcgttggaggattcgagtgggttccagcatcaacaccagaaaacaaagctgccgccttcacgacctttgatcgtcaattcgatgattctcgtaacaatggtggctcgcatattgtgcgtctactcaatatctctgatcccaatatcacagcggatatgacccaagacgatattaccgcgtacctcgactcaaacatcgaccgctgggaatccacggaacatgcgctcaagcagtttgtcccacttaacgcgggtgctgatcgcgtacctaccggtggtgccgacgagcacattacccacgcctgccgctaataactgtgcagcgtagctgcacacggattcacctgcgctgtggatgcatcccaacaccacaacaccgcccctagtgccataaatgctaggggtgtttttttcatacccacaacaccgttcttctctagaaagagactcgatactatgcctcataaccccatcgaacttcacactaatgatgtactcgatgctctcgacattgacgccatctgcgacgatgtgtttctctacaccgacttcgagcacaccccaggtcagcttgatcgcttcgagcaactcgccttcacaaaaatctacgacatgctggaaacagctgctgaaaaattcccagatgtagcaattaatgacactttaagcactggcaaccacgctgctgaacagtactttcttgccaatcccggcaacatcatcgtgctgaccagcttcgcgctcaatcagaccgatctccgcgacctcataatctcaccgtgcattaagtacacagcacatgcacgagcactcatgcgtgcggtgacacgaacattgtgcactgcaaacaaccctgtagaacgcgcgactatcttccctgtgtctgtcgctaatgccttaagcatcgaagcgctgtgttccgaatatcatgcgttccgcaccaagcaggtgctcaacactgctgcactcatcaatcctgataacactcttatacccatgttgttgagcaaagcgtatgaggcatacgcctggcacaagggtgtcgaatccgcgcaacgaggtagcaacctagctcgtgagtactacgcaggacttatctgaaaattcactactcaactctggccccaactaacccgttcacacacctagcccagaaaggctcgaacacccatgatcgttgaggtagctccgagaccgaagagatcagcctcattgatgatgattcccctgatctcgatgaggacgataacaccgtgctcatcgccgaagacatccgtgatatggatgactatggcgaagatcatcctgatctttaaagctcactgttaagcccgcagcgagcttatcgctacacccacctttttaaccgcctgtgcaactaaccctgttgtgcaggcggttttctctatctacaccaacaactccacaacactatccggtccaaatctagaaaagagacaacccccatgacctcccccaccacgttaaagccctggtctattcgcggacccatcgacggtgaatacaccatgcttgaggcatatccgtttcagtatgtagcaaatactcgcccggccatcatgctctacgcactcgatgaaaacggtgtaccggaacaatatgccgacctcaccatcaaccttgccgatgtggagctcaagcaacttaaccacgtcatcattaacccagatctgcacgctgatgttaccgaactgtgcattagcgccggcctgctgcgacctggtgttctgggccagcaccaagtcggtagcaccaccgccaaggtctaccgactcactgagcgtgctgatggctggctacagctgttttagcagctacctgcgcctaatccccccacccatactcactccaaaacaagaaagtagtcatcatgcctcagtacaccatcacaatcaccgacgagcagaaagctgttctacacagcctcaccaacccccatatcgccactgctgaacacggcgctatcaccgcaatcgagattcatgacgaccacgatgttgttgtctatcacgttcaaccagacggcacactaacttacgagcgccttgttgaaggcttccattacggctggacacgttttgacagcgaaggttttgagatcgactccgacaataaccgcgttgtagacggactccgcgacgaatagttaacaacaacgaccgcacagaaaggtagtcatgtctacaaccaagacacctagatccactatcaccgcccccatcgaccagctcagccccataatgcggtgggtgtttcaagcaacaaactttctcggttcgctcatcaagccactacttattgtcacagcactagtgctggtagtagcagcacttacccctgagcgcttccatgaaacgctggtactaaatatcctcgccttctctgcaggctacgcagtgctgcgcctagttcgcagcctgcgccgacttttgcagcgccactaaacacccaaacacaacaagaaagaaacaccactatggcacaataccgcgtcagttttatcgcgctcgccgagtcaaccatcgaggtcgaagcagacagtcctgaagaagcactcgacctagccaatgcagaatttgactacccggtcaccttggccggcgatccctatgagctgcacgactgggaagcacgcgctgaaattgaatggctcgataccagctcgaccccgcagcaacgccttggagaacatgtcgtcaagatcgaagattaaactcgatcattaaacacactcttaagataaggacactaattatggcaacccaccgcgttcattttgtcgcaaccgcatccgcctacatcgacgttgaggcagattcccccgaagatgctatagaaaaagcgtatgatctcgccggtgatctgcccggcctcatcgccgacaacgaatttgatctcggtgaatgggaggtacaggccgatgtccagtggcctgataactctgtacctcgcgagcaacgccttgaagagggcgttgacctgctcgattaaacagaattaactcaaaccccctcgtgcttctgcgtttttcgcagctgcacgagggggttatttttttaaggaccgcacgactggtggtggtgccagatgaaaaagagatgagtgcacacgccaggcgtgcacaaggtgtccagtccttgctgctgtgtgggacagcagccggggtggagtgcgaagatcaggggtacaggttatctgttctggttaaggcttacagttagcactaacgtgctaacactgctcaaggtgccaacacgtgcatgtcgtgcacctttgataccttaaacacagttaacaaccacaagctcaagatctattaaaaaacactcaaccacaaaggaaacaatcaccatgttcgtcgcatttatgatccctattgttatggcacttggtgccatggctgttattaccctctttgggcaaaacccatcccagcgccgcaagcgcgcccaacagcaatccaaagatcgctacgagggcgctattcgctccggtcaatttattgaccactgcaactgcccacgttgccgacgcaactgccgtcgccggcacaagaagctcaaaggcttcagcggataccccgatgaaattctggggaagtatcctgttaaatacctttccagttaacaacacccaacaacagcgctagaaaaaatgcctgtggttgggtgttttttttgaaactcactgccgagtgtttagcgcgccatgcgctttgctagctcttcatcacgctcgcctgagtgctgataacgcagtgctgcactaggtgttgagtgccccagccgcgccatcacctccttgagtgtcgccccaacctgtgcatacttcgtacccgaataatgcctcatcgagtgaacggtcgctttactgtggacactttcccgcgccctatcccagttgtgcttaaaggtgtgatacggcatgggttcatcaggatctctcatcgagctccatagtcgcaaacccacatcaatcgtgtccacatgcttggcaatttctgctgcatctttgccatagatatagaggctacgaacaccagcttcagttttaggcggaccttcaactcggccatggtatctcgtgtgcctaatgctccgagaaatccttattcgaacacaatctacaaatccgctgcgatcaaaataaacatccacatcagtggtacgcagcgcaacgatttcaccgaatcgaagtgcaccagcggcagcaacaatagccaaacaaaagtacttactcggcagtgcaccaatgatcgcctcaagctcggcatcggttgggacatcaacctttttgcctgttttcgtattacccccgccacggactttgcacggattcatcgggataatgccatcctccactgcagtctccatgacagacttcatcatgctgtaactccgcgccattgaggtcaatttaccgtcctgaatagtatcgctataccactcacggacatcagcgacagtgatttcacagagcgcataatcagcccaataacttagtcgatctgattttatataacgaaagtaatcatctttcaccccttggctgagtttctttccttgggcatttgtccgggtttctatccacctcgatgcataactgaagaaggtctccatcatgcgttcttcggcttcgcgctgtgcctgctcgaacctctcccgcatctcaaaatccatccatgtgccattgatgatggccgtgcgttcagaggccaagaactcctgcgcctcacccttggtaccgaaggtatacggggcagagtatcgcctaccctcgtgcatgaagcgtgccctgtacctccccgagcgcaacttctcgatctctccccaattcctcgatcgtgacatatatcacaaaccctcttccacttttccgcatagttttcaggttgagaaatgtcattcagtgaaggtgtcaaagtagtcacttagtgtcattaccagtcactttagacattttcccctgctggtcgagggtgattttagcatccttgttcacatttgtcattgtcatttatgcgtataaaaggcaaacagaagccatcgctcatcccctctcccgcgtggggtgagcgtggggtgagtggattcatttctggtcactcttgggcgctttctgctgaaatgaagccatcgcgacctcgcgttttgtaaaggcaccaggtcgctacagctggttcgaacccagctaggaccacttgtttagcacctgcttgcaggggttttattcatttatagggtcaaaaaacatgcgtttgtggggtgaaaggattcattacaggtacttttaagcacctcctggtcactcccgctagttttattcacgatccgcgtccagctgcgacaaaccgcactataggggcacctttgatgcgtctccgctgtgcataattttttgcaagatgcccctcctggcccttttctgtcatgcataatatgcagaggttttttcccaccccacaaacccagctatgaggtttacccctggaaatgtgtacctacaaaggggcaatgccgcgggctaaaacaacatttgtgcacacatatatctgtgattaatagcgcccgctcacccctgccccacaggtcccccggctcacttttttgaccctcaccccaaggcaaaccctgagtcaaaaaacagttcccacagatccactacgcgccccaaaacagcactctcacacgggcccgaccccttgaaagtagacacaggggatttaatcaggaagcagacttcagaatagcagaaccctggacctcaaacaccgcaggcgccacatagccacaccaagaatgtctgcgcaccgtgttgtactaggtcacaccaccgaaatacctcccgacggcacaccaactgattagcaaacgtcttggaatcctgcagcacttcccgcttgagcgcggcattaaacgactccgctagcgaattatccgcactggtaccaacagcacccatcgactgacgaacacccaactttttacaagtgtcctgaaacgcctgcgaggtgtacacactgccgtgatccgaatgaaaaacagcaccctgtagactgcctcgctgactcttcgccatcatcaacgcctcctgcaccaatgacgtgcgcatatgatccgcaaaggcaaaacccaccaaccgtgctaagaatagcaatcaatgaccgtcgtcaaatacatattcgacccatcagcaatcggcagataagtaatatccccgacgtaaacttcattggcagccaaagcgttgaattgacgcttcaccaagtccgggaacaccggcttgacagctgctgggattgtggtgatgaccttgcgtttcttcgtaaaaccaacaagcttcatcgaagacatcactcgagcgactcgcttgtggttaaccggagttgttgtacctggcccgtcattaagctcggccgtaatacgtttcgcaccataacagccgcgttctttagtgaagatggacttgatcttcgctcccaggactgcgtcgctgagcaggagtttcttcctcgtcagagcagtctttttccatttgtaatacgaggaacggttaattttcaacacttcgcataaccgcttaacttcagtaggtttttcgcacgtcgtcaacaaaccagaagcgggtcataagtcttgcctcttgccgggaaaatatttagcagccttgcgcaaaatgtcgcgttcttcacgcagtagtgcgttttccttctttagctgtctgatttgttcagcttccgacattgctgttgcttctttggtgttggttgaggcatgcgcaccgtatttattgatcgaagtttttcagggttactcggttgatgccgagatcgttggcgatctgttggagtgaggccccatcggagttctcgtacaaagcaacggcgtcgcgtttgaactcctcggagtaggtcttggttggcatgataggtaggttacctttctgtcccagaatgttgggatgttaggtgtctaccaaacaggggtcaggtcctatttgtcataaactttctccttagagattgcgcggatagattaaggtctgtggcccggtcgggtgtcccagcggtaactagtccaggcctgtttgataagccgacgcagaataatcaccgcgttggctaaagcgataaacgcttccacaacccgggtacaacgttcggtgcagatactaagtttcttaaaaccccggttatgccaagagttagtacgctccaccacccaccgagtcccagcctgcagcggctcacctttaatgctgatcacccagctataaccaaattcgctgagtagcctgcgggttttcttcgagtcatacccagcatcgagatgcaccgtgatctgatcgggaagagagcccccaaaccggccgagcgtgtccaaggttgcagctaacaacggtaaatcatgccgattggctccggcgaccacgcacccgatcgggattccatgtccatcgaccattaacgagcgtttggtgcctttttcccggtcaaccgggaatctgccggctacctctccgccgcagggagctttaacaatgcagccatcaacatttaagttttctaggtctaacccgatgaaacggtcgtaggactccagacagatctgttctaaattcttgaaaatcccggcagtgatccactcgtctcggcgggtgcgtatcgtggtggctgagcaggtggaatcggaaatcttgatataggagacaccgaggacaagcactgcgatgagtttgtcgacgatgatccggtcagcaatgcgtgcacggtggcaccctagtgggtgggtgatgataaccggtgggattaaggcggagaactggcgccagagggggtcgatgatagatgatggaagggcaggcacgagtactcctggggtgtttacgttttcttggtcgaattcgtatttaccaggcctcgtgcttgttctatttcatgacccctatgttttcccttttatccacctatccgcgcaatctcttaaatttaatcacctattaattagagaaaattctagcaatcaaattcgcatttctatacaggtgcgaacacgacaaagccctccccggaacttagtccgagaagggctttgtcgtgttctcaaatgctgtcaaaactgaatgattatgctacgaacaatagcgatcggcaacaaactgcacctcaccccacttcgtcgaaatagtctcataatcactgtaacgttttcgctctaaaagcgacccatctggaaacacagtctcatgatctacaaccgcctcggagagattaatagcatcatcggacccctccaaattcgccccttttagattacatccccggaagatggcgtccgaagcgttcttaaacacacaccgactcccttgtaaatcagcattcccaaagaaggcattagtgatgtccgcagaaatatcagcaaaatttatcaccgcttcacgaaaccgactatgcgacaaatcacccgaaattacagtatcgcccaactgagcgccaataaagctgcagtaggaaagatcgcaattcgttaatcgtgcatattgccatgaacactcaccaaaatttgcaccagaaaaacaacaatccgacacattcaccgaatctgtttttaaggcatatagccgaagactgacctcaacttcaaacgacggggtcttgtccaaaggagcatggaaaacatgtgttgatggtaccgcctgtgcctcaaacctttcgggggattcatcagacgcgcgccctaacctccgccccagttgctcaaatatttgccgtcctacagtaatctcagaccaaccgtatttccgtggaaaatctgattcgacaaacatatgcgtaacaacaatgtcacacagtgactgaacgatactcgctccataagttgtacccgttgctgcagcgcgatccatggatctaaacgcatgttgaactgtggcagagcggatcgcgctgttaacgctacttaaacccgcaatcaagggagcaaaaatatcgccttcaagaaggaaagcttcatcagtcttgttcatcccagtccatgcctttcttctggttcatgtggggaagtgctttcctcatacctgctttctaaaagccctcaagcttcaagccttaagccctaagaaagaactattctcaggagctttccgtgtactaactcgcgttgttcataccgcaggagctttcacaacaataccgtgcccaaaaacgctaaagtgtgtgaccaaaatttttggagttcctgcactaaacgctcatgtgcatgcagtgagacgtgatcgccaatgaaatctgggctgcgctcagcgcgttgtttcctgctatataaacctcagatagcccaccggcagaacagacctaggtttactaacgatgtcagcagttcttgcagaaaacttccggggtcacaacatcgtcgccaccctacactggggtgagcacgacgtgatctcaatactcctcgaatgcactcgattgtgctcgctgcatggccctggcctgcgaattgagcccttcgcaccaggaggggtaaacacgaaatccacgtttacccggctgtccgtctgctgcggtaatccccaattctgcaagatgaccagcggaaaacctaaacactccgcgccgaacatcgttcctcacaaagacaagaagaccagcattcatcccgtcgtcactaaacggctgggtctgccctcccacgcctcgctgccaaaaggcaacaaaggcacccggcttcgacggcgtgttccggccagtccggacatgccactcatgaccttcaacctgtgctaatcctgattcataatcactgttctgtggctcaggggcgaccgaaacagttatgcccagctcggtcgaccacatctccaacgcgctaaatcccatgagctcaacttatcaacttcagccgcaggaagcctactgcctcctctcgcctccttccgcaatactccctagatcttgtttaaccgtcaggagttggagggtatatccggctactgaacgacaacacttttaaacgacggcgcttgcgactattacctttgacccggcgcactaatcaattttgaaaacgcgcaccattaggtaatctctcgataaatagtgtttggccagtaacagactcaaaagcttctgcaaacttgttaaatcgtcaaaacagccgttgacaaagctctcccaccaccgcaactctgcatcatgactccaataaaattcctcaaccggcatttgataggcataacgttcagctgtagaaggccccagcatcatccaactcgtcgctaatgctgactcccacaattcaagatctgtcttttcgaaaaccgagctaataggactaggcgaaccaggactcagtgcacaatatcccacaagctcacaacgtccagccgactgcgcccactcctgatcaggatcaacaatcagcgcacgcccaaccttgacatcaattccggtgtgctgcacaaagaactctaaccattcctgtaactcagatacagtgagcacatccggtagatcagctactaaggatcttatattggacgagaaaagtgaccacttttcagcaacgatcgcttgaaaaagacactgccgaacagctccggctatgcgctgattagtaaatacattacctgggaatggtagtgaactaccgtccctttttgtcactctagaaaatgcattccactttcccatgatgttgatgagtagaaaatctagacttagcgatggcccgataaagcgaaatccggaagttttatagcctctagtgtagatgcacagttgatggggttctgtcatatgcgaagcttattataaagattcacatgatcaggacattgggaaatttccggctcgtgttcgattccaccaggtggggttgaattacaccatgctgaaattacccccttgggtctgttcgaatttgctccagtgaaagtatgaggattgtaaataatagtcacccattgcggagcgtgcatttctttacatcctgagttcttattgaatgtataagttctgcaatctagaaagtacaccgttttctcgaacttgtaatagctggttcctggcgatgagccataatcaatcaccgctttatctactacggcctcagccatagcgtggttggcgaagttgtgtttgcaatagttttttaaatatccccagccttcattcctgtaacggtcataatgcccttttctcaccacaaatctgaactcggtggggaaacctcgcgaactatactcttttttgatcgggccaccattcttttcaatgttgttttcagtttttctctgctcatctaaatcgggaagattcttgcaatccacgtattgtgcacgctgggaaaacagggtcatctcttggctcgatgaggatgagccgctacttccaattgggaggaaatcctccaaacttctttcttcatcgtcaggaatccatgtcagtgcatcacctgagcctaaaacaacacctctggtgaattcttgttcgagtgactcatttaatgatgtcaatgatggtatcggccaccctaaaggagtatcggtattttggtattgcagccacagggagtaaacatcaccatacagctctctggcgcctaggattccattccacgcaatcaccccgcgctccgcaaaattcaccacatggaatagaccagaaacctcaggtgtttcatctgcttcaggaaaacctaaacgacccgtctcccgacccaacgcatcccacacccgctgcgtagccaaatacataaaccgtgtctgacgatcatttcgccacgaaattgttccattggagaaattattgtaaaaatactcagtaccgctaggtagctcattagtgatcgggatgccaatggcatgattcgagccgccaagttcttcgtagcgctgtttaatatcgccccacacagcaccgccagtcaatgggttgtagtagttgtcaccaccttgaaaagtctgtcgctgagtaaggggatagtttgtatccatcggaccagaggttgggtaccccaatggccctgattcccagttcaaggtcccccactgtcgcaaaccgtccaaggtcactgcataagcgcctgtgtctgggtgccaatagatggctccaccaaaaaattcacttcttttgccaacaccgtcgggattggtcaactcgtttgacttcggtggcccaagccatgacaactgacctccaacctggcgataggtgtcaagaattcggccacaaactgagaagcccgttggccacataacctcacacccggtggttgccatcagtcgtgcaccctcgttaagtcgcgcttccgcaacttctagctggtcagctttctccttgcttaccccctccggtaactcgataacatctgaacgcatgtcccctgcaactatgtcccgcttaggcagcgggagttcctcgacattatctttactatcgttgacttgctcgtgatactcaacgactacttctggatgtgctgtttcgtaatcctcaagttgttcctcaactgttggagcattcctattgggaacataatcaacaccgtcatcagcaaactactcatcagtgatttcttctacaagctcaaattgatcttccacctgtgcttgagccaccggagatgcaaccccgatggccagcaacataacagcagaaacccccactagtcttcgtaccaaccgcatatatcaaacctttacctgtcggaaaaatgtgtacaagctgaggataagcataaattcgcttaagagctggatgaaagaggaaacgctcctcttttctacccgaaaaagggtgtaaggattgcactgcttaagtgacattaggccctcccgggcaaatccttattcgaacacagtctacaaatccgctgcgatcaaaataaacatcgacatcggtggttcgtagcgcaacgatttcaccgaatcgaagtgcgccggcagcagcaacaatagccaaacaaaagtacttactcggcagtgcaccaatgttcgcttcaagctcggcatcggttgggggatcaacctttttcctgttttggtattacccccgccacgtactttgcacggattcgtcggaatgatgccatcctctaccgcagtctccatgacagacttcatcatgctgtaactccgtgccattgaggtcaatttcccatcctgaatggtgtcgctataccactcacggacatcagcgacggtgattgcgcagagcgcataatcagcccaataacttagtcgatctgattttatataacgaaagtaatcatctttcaccccttggctaagtttctttccttgggcatttgtccgggtttctatccacctcgatgcataactaaagaaggtctccatcatgcgttcttcagcctcaagctgtgcccgctcaaacctctcccgcatctcaaaatccatccatgtgccattgatgatggctgtgcgttcagaggccaagaactcattagcctcacccttggtaccgaaagtgtacggggcagagtatcgcctaccctcgtgcatgaagcgtgccctgtacctctccgagcgcaacttttcgatctctcctcaattcctcgatcgtgacatatatcacaaaccctcttccatttttccgcatagttttcaggttgagaaatgtcattcagtgaaggtgtcaaagtagtcacttaatgtcactaccagtcactttagacatttttccctgctggtcgagggtgattttagcatccttgttcacatttgtcattgtcgtttatgcgtataaaagacaaacagaagccatcgctcaccctctcgcccgcgtggggtgaacgtggggtgagtggattcatttctggtcattcttgggcgcttcctgctaaaatgaagccatcgcgacctcgcgttttatgaaggcaccagggcgctacggctggttcgaacccagctaggaccacaactaaaccccctgtaaacagggggttttcgtcgtttcatgactatctatagcttcttcagcttttcaagggatgaaggttccagctcctcgattaacgtcagccaattccaaccatggttgccacagttgggaggaaaaatacgatgagcgctcccccgatgatgtcaaagctaattccagtgcggatcattcgagcaatggatacgcagcccgaaccgtagacgatggcgttctgcggtgtggaaatcggaagcatgaacccaaatgaagcaccgaatgcagccgccatagccgggataactggatcaataccggccgctatggcaagtggaaccacgatgggaacggtaactgctgccgctgcggtattactcgtagtttcagaaattaggtgtcgatgcagcaatacggaactttgccaatgtgtttgaacaagctctcgggctcaccacccttgcacaaacagctggagcgggcgcagcggggggcttgggtttcatggcaatggcgttgttgtctgcagggatgcgctccggcgtggacatgattcttaatgaaaccgggggtgaaaagatgcttgcacaggcagatttagtcatcactggagaaggacgcattgatgcacagaccctcagcgggaaagctcctactggaatcgccaaacgggcacgtgcgaaaggaattccagtactggcggtttgtgggcagagcctattgggtccagcaatctcaaatgagctatttgaagacatctacagctttaccgatttcgaatctgacatcaatgaatgcattcgaaacccgctcccaattttggaaggtatcggttttaacatcgccaaacatcatctgagttagcgatatttcagcaaaccgatgctattcgatgagccagacagcgctctgatctttcatccgagagatcagagcgctgtcttattcctaagaaatggcctgcagcggggagtactccccgcttttgcggtacttcaattttgcctgctttacggtgaagttcatcagctacaaagcacatgccagctagctgaaaaggaaaccactcccctcctcggaaagtaggaaccatgtcttcattcacacgtcgtctcaatatcactgcggtaaccgttgcaatagccgctacttctctcctcgcagccacaacaccagcatcagccgcctgcctcgatgcaaatggtcagcagattggaccactccgagtacatgcttcaagtgaaaataccagccgcgtaaatgattgcgagaaagtttatctcggtaccttctgggaagggaccaacggcgagccggggaacttcggcatcttcaatttcaaatatgccaacaacaaatacttcgtcgtaggaatcaatgacatcactggtcttggtcttggatcctctgatcagaatcccctaggaaccttcggatagtcgaaatagaagcctcacccttttcaaatcccctcctcggaaagcaggaaccatgtcttcattcacacgtcgtctccctgtcaccgcagttactgcagtacttgcctcgtccacccttctcgctgcggcaacacctgcttcagttaaatgcgtgcaccctcactcagaacacgtgggcccattgcatgtttatggatctagtgaaaactcagatcgatttgatgtgtgcgggaagattgatttcggaacccattgggaaggcactggaatccacactggccagtttgggttatttaatgttaagtatgcagacaataagtttttcgttgtcaccattgatgatgccggcctaggctcctccgaccagaaccccactggcacctttggataacaccattccgtgtgaacaagctggcctagacttgaaacatggtcgatatcttggaactcatcggtcccctaccttctgtgtctacgccagagttaagggcaattgtcgtgactgccattaatggttccaccactattaatggcacgtctggtcagcttggaaattccacggatacggaacttctgttggcgcttcgcaggtggtcggacgtggtgttggttgggtcgagcacggtgaaggctgaaaattatggtggcgtggaggtttcgcctgaaatccagaagcaacgccaggagttgggtcaggaagcgattccgccgattgcggtgatgtcagggtcgttgaattttgatgtggatactcgctttttccttgaggccgaagtgccgccgatcatcatcacggataattccgatcaagcaaagcagcagcggcttgtggatgctggggctcaggttattgaggtggagacgttgacggcggaggttggcgtcgaaaagcttaggtctttgggttacgcccgcattgattgtgagggcggtgcaacgttgtatgggcagatgttggccgccgatcttgttgatgtgtggcatcacacgattgatccgacgttgtcgggcagcgtggagcgccccacggtgaagggcggcgatgatgcgccgcgccgattcgcgttggagcacgtctttgtcgatgatgacagcaccctattcttgcggtataagcgcgccaagtgagtgttggactctccggatctgctggggattcgctagattagtctcgtgagtttctccccggtagcaccttctatatcagcccccacgccgcgtcggagcaggtgggatagcatcggcaacgcggttgcatggccgttggccatgttgttgatggcgcatcgcttcttcgtgcttgcgattaacggcgcagtcaccgacgatttcacgacggtttatagtgctttacgacgtttcgttgaaggtattccggtctacaacgaggtctaccacttcgtcgatccgcactacctctataacccgggcgccaccctcctattggcaccattgggatatatcacccatttcacgttggctcggtggatgttcatcgcggtgaacctccttgccattgttttagcgttcgggctgctgaccagactctccggttgggcgctgcgcagcatggtgtggccgattgcgatcgccttggcgatgctgacagaaaccgtgcaaaacaccctcattttctccaacatcaacggcatcctgctgctcatgttggcgattttcctgtggtgcgtggtgcacaaaaaatcctggttgggcggactagtcattggtttggccattttgatcaaacccatgttcctgccacttctcttcctacctttggtgaaaaagcaatggggatcgctcatcctcggcattttaaccccagtgattttcaatgcagtggcctggttcttagttccgggagcatctgaatacgtcacccgcacgatgccctaccttggtgaaactcgagattttgccaacagctcactcccaggcttggccatctatttcggaatgcccacctggatggaaatcacctggttcctcatcttcggcgcaatggtcggcctcgcagtgctggcactcctgagattccgtaacaccgagccatacttctgggcagcaaccaccaccggtgtactcctgactggcgtattcttcctgtcctcactgggacagatgtactactccatgatgatcttccctatgatcttcaccctgctcggaagccgatccgtattccacaactgggttgcctgggtcgccgcctacttcttcctctcccctgacactttcacctcccagcgactacccgatgtagcccgctggatggaatttttcagcgcgaccgttggttggggactattgatagtggttacatttgtctcggcgctaatctggtttattggtgatatccgagccaagggaactccgagctcacccattaccactgatccaacgcacgaccatcttgagaggacagcatgacagacttcaaactcatcagcgataccgagtggcgcgaacgcctcaccccgcaggaattccatgtcctccgcgaagccggcaccgaaccacctcacgtcggtgaatacaccaacaccaccaccgaaggtgtgtactcctgtcgcgcctgtggtgaagagttattccgctccaccgagaagtttgaatcccactgcggttggccttccttcttctccccacttgctggcgacaaaatcattgagaaggaagatctttccctcggtatgcgtcgcgttgagattctgtgcgctaactgcggctctcacatgggtcacgtcttcgaaggcgaaggctacgacacccccaccgatcttcgttactgcattaactccatcagcttgaagctggaagaaaagccagtttcctaagcttccgagcacgaaacgagccttggccttatggctgaggctttttctcattctggcgctatttaagaggcccaatttttgggatgggttcttgtatggattcagtgcgttcaggcgcttagacgcgattctgagagggcacttttcatgggcaccggggcaggatttggggcggaccaaacgagagtgcccacggaactgctttttggcgatcgtgggcagatgtgaccggtttttacgacctcacaccaaacaggagtgcccacgaacttcatttctaggattcgtgggcattgtggtttggtctgggccgatgaggggccactttcttcgggttcaaacgccgtttctgtgccgcccaaggctggcctagggaaggaaaccaaaactctcccctgccgaatcggtccttggtctaatacgaacgcttattcaggccttgaaccgtgcatttcagaccaaacctcccccagaaactgacttccttggtctccagcgcacgcctccccaaccaaaagagccctggaccattagtccaaggctcaatcgtttagaaaagcagcttttaaggaagaaccttaatcagatctgcaatgtcgacgcgctgtccagaaataaatggcagctcctcacggacgtggaggcgagcctcggtgtaacgcatcttgtgcatcaaatcgacaatgcggtgcaactcatcagcctcgaaagccagcacccattcgtagtcacccagtgcgaaagccggcacagtgttggcacgaacatctgggaattccacagcagcttgtccgtgctcgcggagaatgcgggaacgcttcaagggctccatgatgtaccagtcgtagctgcgcacgaacgggtaaacagtgatccagtcctttgcttcttcacccatgatgaatgaaggcaagtgagccttgttgaactcagatggacggtggagagcgtttccgatccagaagacctcagaaacctgacccaaaatggtggtgcggcggaaatcagcgaaggccttctgaatgtcttcgaattcttctgcgtgccaccagatcatgtagtcagcgtctgcgcgcaggccggaggcgttgtaaatgccacggacagtgactttgccttctgcttcaaggtcggcaaagaacttggctgcttggtcagtgacttctgtgcgatcatcatcgagcgctccaggaatagcacggaacaccgcccactgagagtagcgctgcagtttgttgagctgtttaatatcgagctcgctcacagggtaacttcctttcgtggatctttgccagtgtcagtggccagaccctttagcgaatgaatcgtagtgtcggctctgccggcatgttccaacaacatgttccaacaaaacgcacacccagttatccatcataagtttgattgcaaagttttgggtaaacacccctcgttaagtccccctgcattggataattagcaggagtgaagttgcatcaaaggacaaacataaaataaacggcgcgcctccccagagttaccccaataattagtaaattgcagattgtgatcgattccgaagcgacctctcagcacaagacctcagctaccccggcagagagcactcccgcggagttttccgaagcggttgagtctatgcacagagcgcgcctgcgcccagaacttactttgggcacgattaggccgcctcagcgcctggcgccgttttcgcacgccattggactcgaagtcggaaatcaagaagagtcagacgatgtctccaccaacagcgaaggtgattcctttggtcgtttgattctgctccacgatccgggtgccgaagaaacctgggaaggagcaatgcgccttgtcgcctatattcaagctgacatggatcacgctgttgcttccgacccgctattgccggaagtagcgtggcaatggcttaacgaaggtttggaacaagccggcgcaggatttaccaacctaggcggaaccgtaacctccacaacctcggtgcgctttggtgaaatcggtggaccgccaagtgcctaccaagtggaaatgcgtgcgtcctggaccgcgactggcaccgacctcaccgcgcatgttgaagcgttcgcagcagtgcttgcctctgttgctggacttcccccagagggcgtcaccgaactacgaaggtagattggacaccatggtttccgatctccttcaaccccgcgacggcattccgcctttgctatctacccctggtgagttcactgctgcggcagatctcttggctagcggaactgggcccttcgccattgatacggaacgcgcgtccggttttagatacgatgaccgcgcatttttgattcagatccggcgccgtggcagcggaactctcctattcgacccggagcagttccgtcctgaattaactcaggcgttaaagccggtgctcaatggtcaagagtggatcattcacgcagcaagcaccgatttgccgagccttgcgtggcttgatcttcaccccggattactctttgatacagaacttgctggccgcttagccggatttgatcacgttaatctcgctgccatggtggaacagatttttgatctccacttgctcaaaggccacggttcggaagattggtccaagcgtcctctgccggaatcttggctcaactacgcagcactcgatgtggagatgctgctggagcttgccgatgtcatggctgaaatcctggatcagcagggaaaactcccctgggctgaacaggaatttgtccatattgtggatcaattcgccacgatgaccgaaccttccgaaacgtcctggcaggaccttaaagggctgtccactctcaaacgaccagaccaattagttgtggcccgtgaaatgtggttggaacgcgactctttcgcagcctcccgcgacctggcgcccggtaaagtgctgtccaacaaagtcatcgtggaagtcgcccgtgttctcccccgcaccccggcagaattagcgcaggtcaagggattccccggtcgatcccagggtgccaccaaacgctggttccgcatcatcacccgggcgctcaaatcccctcgcaggaactggccaaagcctcagcagcgcaaggacggcatccccgatcgtcgcgcgtgggcgtcctactacccagaagagcacgaagtgctccaagagattagagcgcttatcgacgacctcgccgccgatatcaacgttcccggcgagaatatccttcagccttcaactctgcgagtagctgtgtggatggctaaacacaccggcgagatccataatgctgaaacactcaacgctgtacttcgcgattatggtgcccgccagtggcaaattgaccagacttttccgattctgtccgccaacttgctgaagctctaaacctaaagcccgcggctaaggctgcgggcttcggtggagggcggcgtcgataagcagggttttattccccgaacagggaatccagccatccaacaacagtggtttcaatgccgtcggcgtcgaggccataatcggcgagcacttcattgcgggacgcgtgatccaggtacttctggggcacggcgatttgtcggcgaggggtatccacctcagaggcgttaagcgcatcagagagcaaggatcccacgccgccgtggatgacgccgtcttcgatggtgatcacgaggtcatgatcatcagacagcgcgaccaaggactgcgggatggggacaatccagcgggggtcaacaaccgtgacgttcacgccgtgctgtttaatcctggaagcaacgtcaagtgcaacagttgcgcgctcgcctaccgcaatgatgagaactgatggcgcatcgtcggttgattcaacgtcagtggcgtcttcatatgcgaggacatccacgccgtcttccaaggtgtcgatagcaacaattggagttggcaagtcgcccttggggaaacgcacaactgtggggccatcatcgatggaaatagcctcattgagcagctcacgcaaggaatcctcatcacgtggtgccgccacctgcacgcctggaacgatcgaggtcagcgccatatcccagacgccattgtggctcgctccatccgaacccgtgacacctgagcgatcaagcaccaaagtaacaggctggttgagcatgcccacatccatgagcagctgatcaaaagcgcggttcaagaacgtggagtaaatagccaccacagggtgttttccacccaatgcgaggcctgcggcagaagttaccgcgtgctgctcagcaatgccgacatcaaagaatcggttggggaaattggcttcgaacttggacagaccggtaggacctgccatcgcggcggtgatggcaacaacgttttcattctgcgcaccaatcttgaccagctcatcgctgaacacagaggtccaaccgggctttgatgcagatttaggagctcctgtgagcggatcgatgacgcccgtggagtgcatcaattcgtccaaatcctgctcagcaggcgcgtaaccacgacccttttcggtgaccatgtgcacgatgatggggccatcataatcatgagcgtatttcagcgcattgtcgacagctttttggttatgtccatcaaccggacccacgtatttcatgcccagttcagggaacatttcggtgggaatgacggtgctcttcacaccttctttaaatgcatggagcgcttcaaaagtacgctcccctacccaccccatggatttcagggacgtcttgcccttttccatgaagcgatcatagaaaggctgcatgcgaaggcccgcaaggttttccgcaaatccgccaatggttggagaataactccggccattgtcattgactacgacaacaactttgcggtctttaccagcagcaatattgttcagtgcttcccaacacatgccgccagttagagcgccatcaccaacgacagcaaccacactatgcgtggtatcgccatccaactgcttggctttagacaaaccatccgcataagacaaggccgccgaagcatgcgaagactcagtccaatcgtgctcactttcagcacggcaggtgtaaccagaaaggccatctttttgacgcaaagaatcaaaatctttagcgcgacccgtcaggatcttatgcacataggactggtgagaagtatcaaagatgatcgggtcttgaggcgaatcgaaaactcgatgaagaccgatggttaattccactacgcccaaatttggacctaagtggccaccagttgctgcgactttatcgaccaggaaagttcggatttctttggcaagagcgtccaaatcctcatcattaagggcctttaagtcagcaggtgttgaaatactgttcagaattcccattggcgcgagtcagacacctttgcttctcggatgcggacggttgtacaagtatcgggctggcgacacttttgtgcaggtgacaaaacaaatgtgcacctgcggtgttggagctatattactctgtctcgatagccaaggcttaatccgccttaggaaacgcggacaaatacaccaatcgtctcaaagtggtgagttccagggaacgcgttaaaaacagccaattgatccatttcgtagccgttgagcttccaatcggcaacgtcgcgagcgaaagtcgccgggtcacaaccaatgtggataaccagctgaggcttagcctccgcgatgctcttcaacacgtcactgcctgcaccggtgcgaggaggatccaaaacaaccacgtttggcgaaggcagctgggacgccatgccctctacccgaccagtgtggaaagtgacaggcaaaccagccaacgcctcttcgccagcctccgctgaacctggggacagctccacagagtggacagctgcctgcagcttgctggtgataatcggcgcgaacaggccgacgccgccataaaggtcccacgcaacagggccacgcttatcgacgtcaaccagttccaatccggttaacgcttcggcgatgaactctgaatacgccgcaggggccttggtgtgcgcctgccagaaggaagaaactgggaacttccaggtgtaatcgcctaccttctgctccacctcgccagtgccttccagcaccttcaacacagtttcagtacgacgaccacgaggagccttacgggattccacaacgtggcgctgacccgcatcatcaatagctgcaatgatctccacgccaggggtgaaacgacgagcgccctcacccacaaggccctcaagaagctctggcacaacctgagaacacgcaacctcagtaaccaactcattggacttcagcttgcggaacccggcacgaccagacgcatcaacgccgaggcgaacgcgggtacgccaaccagctgttggctccagatcttgaagctcaaattcaggaagctcatcgattccaccgatgcgctccaactgatcacgaagcacgcgggacttgatctcaagctccacagttgggttgagttctgcatagtcacagcaaccagcacctgctgccgctgctgggcaacgggaatcgacacgatcagcagacgcggtggttaccttaaccacttcaccgcgtgcccatttcttcttcaactgtgcgatttctacatccacgacatccccgggaatgccacctttcacgaagatgacgcggccatcgtggtgtccgatgccttcgccgccgtgagccggcctgagcacctcaacggagatgatgtcgcctttggcgagttcgacggtgtcagtcatgtgagtgtagtcctcgtttcacttgaaaaagtttctgtcccgttacttggagcgggacagcgcaaagagtttaaccctactctgcgttgggggtatttccctgatcggggttctgatctggggttccgttacctgctgcaggttgctgtgttgcattttgctgcgctgctcgctgagccatggcctgctgaacctgctccgccagctgctttggaagtgccactggaagtgggctgccagccaggattggggcgtcgccacggttcacaaaggtacgagcaataacttcccgaccaagatcgcgcatatcgtcggcgcgatcggatgggctgatcatggtcatgcgcagcatccatcgtggtccatctacacctgcgatgcggatcttgcggtcgttcgcctcaccgacgacttccctgccccatgggcctttttccacatgcacggtcaggccgtcgcgacgcatgccttctgcgatttccttggtggcttcgcgccactgtcctgcggaagttggtgctgcgaaagccactggggtgatgcgaccaaattgggtgaccacgtggagcatgcgggggccttgctcgcccatttccacttgtacttcagagttttgtggaagtggaacctgaatggaaccaagatctaggacgcctttggaaaagtccgagaaatcaaaatcttggatgttgacggaaccagcatcaaaaggtcccatatcgccgttgatggcgtcatgtactggatcgggttcacctgctgatggatcttcatccaagacaggctgctcgcccagggagcgcagagcttcaggcacggacgcctcagcgctgtctgcttctaccggagcctcaggagcggcaggtacctcagatacctcaggcgctgccggggtctcgtcgactacttcttttttcttaccaaaaggccacagagccatgagattcttttccgtcctttgctttcgcgtttctaatccgttccagtgtaggaggattgtgtattcctgccacccgatttaagcagttagggtggatttaggctgtttttccggtggaaccgtatccctggtcaccgcgcacggtgtcgtctaattcttcgacttcttcgaaatccacaagttccaccttttggatcacaagctgcgcgatgcggtcgccacgagtaatcatgatgggcttttctggatcaagattgatcaggcagaccttgatctctccgcggtaatcagcatcaatggttcccggcgcgttgacaatgctgaggccttcgcgtgcagcaagacccgaacgggggtgaaccaatccgacggttcccaagggcaaagcaattgcaatgccagtgccgacgatttcgcgatgtcccggagcaatcacagcatctgtggtggcatgaagatcaacgccagcatcgccacggtgagcgcgcttaggcagtggaagttctttatcgagtcggacaattttaatagctgctaaatcagtcacagtttttagcgtacctaccctgcgggaaatgaccttaaatgacccgtgggataggattgcctattgtgactgattcccgacaatctgattctgcatcttctgctccctccagcaatagcgctgatggagtaaccacaatttacagggaacggcagtgggtgccttggtactggtggctagcaatggcgtttgtggtcgccctgctcaccgcccaatttggtctcaaccgaaacgaatattggatctatattccagctgtgttgttgtccattgttggcgtgtgggtgctggtctcaatgtccaatacggtgatcaccgtcgagcaagacgccgatggcaccaggtggctgatcgcaggccaagcaaacttaccgtccgatgtggtgtcacgctctctagcggtgcctgcaacggcaaagcgcaacgcgatgggtcggcagcttgacccggcagcctttgtggtttcccacggttgggtgccagaaatggtgatgttagtacttgacgatcctgaggattccacaccttactggctcatcggttgcaaggacccagaagcgctgttgcgtgcttttgttcctgaacaagccgatgctgcgctagcggatttccgctagtcgctcttcttcatctcgcggttgcccttaaatcggcgatcgcgagttttttctttgttgagcagttctgattagaggtttcttccaaccgaagtcggaatctgctcccctgtctgcttcatatcgtcgagtacttcagcgactaagttccgcagaccagcctcagcttcctgctgatcagaaaacagccaagacagtgaaggaaattcggccaccgtagcgagaaactcctgatcatcttcagaccaggacacttggtaggtgtggttgttgatgttcatgaaggccagaccatttctctcactcggattttcgggtcacctggacttaacccgactatagcgacctaactaccgcctctggttgctttcaatgaagtcttacatcagaacccaagctctcgaacaagaaaccccgtttacctcaactggtagacggggttagttaatttccaaagccacatgcgtgaccggaattatgcacagtcaaggcagatgatggatccatctggctcgacgtgtgatttgcggttgttgcgctgtacaaggaagcagcttgcacaggtgaattcatccgcgcggcgtggaacaacgtctacgttgagttcttcgccggagagatcaacgttggggatctcaaaagactcgacgatttcgccatcgtcgtccatgtcgctgttcgcgttttctactgccttcaaaccttcgagagagtcagtctctagttcgtcttctacacgtcgacggggtgcgtcgtaatcggtagccatcttttgttcctcccgagtgggtgtcgttcactagccgtgcacgaacgcttttgcgttgtgcagcttcatgcgcgcatagtaaaggagtttttccctcttgtcatactgccaggtcagaggggcaaaattcggggttagtttgaagatggtttaacggtctaaagccttaaatgcgccgactacatcaaaatgggcgttggcgtcgtcgaaaactccgggggcagcgccgaagcaaatctctccagaggagcctggaatggagagccctggggcccgcacaaaggcgcccgcttcagcggcgataaggctgccagctgcgaagtcccagcagttcaggccatgttcgtagtaaatatctacttgtccatcagcgaggtggcacaggtccaaagcggcgcttcccatgcggcgaatgtcgcgcacagtaggcaagatttttgttaataaatcggcttggagggaacgtcgtaaagcggaatagctgaaccccgtagcaaccagcgactcactgaccacggtggctgctgaggccttgagcggcacgatttcatcgcgctcgggcagatatttggtggcaccttcgtggcgcgcggcggtgtacagcaccccggtgaccacattgatcacagcacctgccacgacctcgccgtcgatcgccgcagcgatcgagacggcgtattggggcaggtcataaaggaagttgacggtgccgtcaatggggtcgacgatccaggtaactccgcttatcgacgccgtccccgtcccttcctcgcctatcagcccgtctttaggccgaagttcctgcaacctattggcgataaaatcttcagccaaagtatctactatcgtcaccggatcgactgtcgaacttttggtgttggtgtagtcccacaaattggtgagttcagcacgcttatccctgatacgtacagcggtaagcgtggcagtttccgcggcgatggcacgcaactcattaaacgattgttgttccataagaccatcatcgttgtttttttagaaaattgcctgccaaaagccgaagtaatttgtacacttgggcgcatgactgagactggatttggaattgatatcggtggctccggcatcaaaggcgcccgcgttaaccttaagaccggtgagtttattgatgaacgcataaaaatcgccacccctaagccagcaaccccagaggctgtcgccgaagtagtcgcagagattatttctcaagccgaatgggagggtccggtcggaattaccctgccgtcggtcgttcgcgggcagatcgcgctatccgcagccaacattgacaagtcctggatcggcaccgatgtgcacgaactttttgaccgccacctaaatggccgagagatcaccgttctcaatgacgcagacgccgccggcatcgccgaagcaacctttggcaaccctgccgcacgcgaaggcgcagtcatcctgctgacccttggtacaggtattggatccgcattccttgtggatggccaactgttccccaacacagaactcggtcacatgatcgttgacggcgaggaagcagaacaccttgcagcagcatccgtcaaagaaaacgaagatctgtcatggaagaaatgggcgaagcacctgaacaaggtgctgagcgaatacgagaaacttttctccccatccgtcttcatcatcggtggcggaatttccagaaagcacgaaaagtggcttccattgatggagctagacactgacattgtcccagctgagctgcgcaatcgagccggaatcgtaggagctgccatggcagtaaaccaacacctcaccccataagttatcgaaaggtgatttttgcccagggccttgattcacaacgcaccttgctgtaggaaaaacaggcccctttgtgacatcggcgtagttgttcaactataatggaacgctgatcgtggacaagagttaaccatgagattgattcacccctttaagcctccaaagaagtagttgactcaacgcatttcggcatttaaaaaagccgagagcaaatgagactttccaggagaaggcaccagggacatgaacaattgatcggctgaccaactctataagagatgcacctcaagtttggggatacttattcggcgtttctggggaacaaatacgtttccctattgttgtatataggtattcgcacttaagaaacatctctcatggaaagaagctaggcggaaagggcgttaagtacttgccatttaatcctcagcatcactcggatcagtcggagatgtcgatgaaaatgcaccaggagccgtggagagcagcatggtagaaaacaacgtagcaaaaaagacggtcgctaaaaagaccgcacgcaagaccgcacgcaaagcagccccgcgcgtggcaaccccattgggagtcgcatctgagtctcccatttcggccacccctgcgcgcagcatcgatggaacctcaacccctgttgaagctgctgacaccatagagaccaccgcccctgcagcgaaggctcctgcggccaaggctcccgctaaaaaggttgccaagaagacagctcgcaaggcacctgcgaaaaagactgtcgccaagaaagccacaaccgccaaggctgcacctgcaactgccaaggacgaaaacgcacctgttgatgacgacgaggagaacctcgctcaggatgaacaggacttcgacggcgatgacttcgtagacggcatcgaagacgaagaagatgaagacggcgtcgaagccctcggtgaagaaagcgaagacgacgaagaggacggctcatccgtttgggatgaagacgaatccgcaaccctgcgtcaggcacgtaaagatgccgagctcaccgcttccgccgactctgttcgcgcttacctgaagcaaatcggtaaagttgccctgctgaacgctgaacaggaagtctccctggcaaagcgcatcgaagcaggcctttacgccacccaccgcatggaggaaatggaagaagctttcgcagccggtgacaaggacgcgaaactcaccccagccgtcaagcgtgacctccgcgccatcgctcgtgacggccgcaaggcgaaaaaccacctcctggaagccaaccttcgtctggttgtctccctggcaaagcgctacaccggccgtggcatggcattcctggacctcatccaggaaggcaacctcggtctgattcgtgccgtagagaagttcgactactccaagggctacaagttctccacctacgcaacctggtggatccgtcaggcaatcacccgcgccatggccgaccaagcacgaaccatccgtatcccagtccacatggttgaagtgatcaacaaacttggtcgcatccaacgtgaactccttcaggaactcggccgcgaaccaaccccacaggaactgtccaaagaaatggacatctccgaggaaaaggtactggaaatccagcagtacgcccgcgaaccaatctccctggaccaaaccatcggcgacgaaggcgacagccagctcggcgacttcatcgaagactccgaagccgtcgtcgcagtcgacgccgtctcattcaccctgctgcaagaccagctacaggacgtcctagagaccctctccgaacgtgaagccggcgtggttaaactccgcttcggactcaccgacggaatgccacgcactttagacgaaatcggccaagtttacggtgtcacccgtgagcgcatccgccagattgagtccaagaccatgtctaagctgcgccacccatcacgctcccaggtccttcgcgactacctggactaaaaccccagtcgggctcaagaccgggccgccactgttttcctctgcggggaacggtggtggcccggtttttctgttgctttggttcggctggtcacagttcggctggggtgttttaagtttgatttcacattgccgatttctaaacgccgagttctcggattcgagaccttacctgcaatttcacggttacaatttctcgttagcactttcgcgtactcaatttcttatgttcaatttcggtcggaaaagtgccattttccgacatcgccttgagaaattgaatacaagaaattgagcgcaaggtatcgaacttgagaaattgagctttagcactcactcccctgtttgatgaagtcagcaaagccaaaagacgacttcacatctccgacttcttaacagcgacttctcgtggctgacttcgctacctaaacctgagtttccttagcgaagtcgtgtgatgagaagtcgtgtgatgagaagttgggtatgagaagtcagcacacgtgaagtcgccttttctccccggcacgctcggagtagcgtgaaaggtggaatggagcgaggtggaacggcgcatcccttggacttttccctcactcatctggaggcgccgatgtggaaaggagaaggctagccatgtttatcaacgtcatgccggaaccaggccttggtggacttatccagcgattcatgcagtggattagttgcatgagtttcggcgagtgcatggtcatccagtagttagaaaaggcgctcacctccaaagctttggaggtgagcgctttcttgttcgactcggctagttgccttgagtgtatttgtcggaggctttgtctagtggagttgtgccaggaatctgtggatatgcagctggggttgggagttgtttaggtacgtagggatcttggagtccttttttgccgtaggcgatgtagcggtgcatcgattcgaatgggcctcgtttgccagctagttcgagaccgtatgctccgatgagggtgagaagccatacgcaggtggctacgccggcttcggcaagtattcctccaccttggccgagtcctaaggtgtaggtttgcgtgaggatcaggaacaggatggattgtccgacgtaaccgctcatggatcgggcaccgagggctgcgatcattttgatgggaagtgggaggtgcccatttcctttattgatttttctttgtagtggctggacgagcagtgccactgctgcaacgatgcctggtcctgtcaaagagccaacagcttgattgagaccgctaaagaccgtggctgtctgtgcagaaaatactccaatttcggctagtccccaggggacgccaaccaggactgcgattgcgataaagatccacgttgcaatccataggggttttctaaattcatcgacccgagagaggactcggtggcgtgctgcgatgtagccaacaatcatcactggcatgagcatgaggatttccacaggaactgatccgatttgaattggaacagagagcagacccatgcctaggtattccaggtaggaatcaaaggtcaggtcaaggctagccatggtatcagtggacacaccgaagtacagaggtagaacaactccgagtgtgatgccaacgatgacatagattgctgacatggaacctgcgatccaccacagtgttttgtctttgagggtcatgagcatggcaaaaatcatgcctgcgacaccgtagaagaacatgatgtcaccccagaagagaaacaccatgtggataacgccgaagagtgcgagaaatccgtatcgccgaagcagcactcccctggctgctgtgtcggggtattgacgtcgccagaggctgtacacgatcattccgacgccatatcctagaagcgtggagaacatcggtaggcctcggacatggatgaacatggcggaaaagacagcgtagatcttttcaaagatggagtcatgaacaatgccaccaagtgaggccgctgtggatcccgcaggagcagcaatccatgctgtggaaacgttggccagcgcaatgccgagcagtgcgatacctcgggcaatatctggtgagaggattctggttttctgtgcagtgcgcacggctttggtgtgtgtcgttggcgctgagtcagacatactttccttaatacaaacgctggttatctcaaatggagaaaagaaaaccctatgacttttagctgtcacagggtttccaatcaaattaagcgaagagctcttgaatgcattgttcttgagccgcgggatccgtgagcgttgcacactcagaaagtccagaactgctgaaaacaacgagtatcaatatgacgccaatcgcaaggaggatcaaggtcagaatcgacaggatcagaccggtaatggcaaagcccttgcgcctgtttgctggcacgaagttctttgctttcaccagcgcgataatggccacgatgacgcctgcgagagcgaggaatggagagaggaaagcaccaaatacagtcaccagagttacgatggaggcaatacctaagccgagtgcccacgctgctgcggtgttctttggtgcattcagaggtgagttttcaaagcctccggtatagcccgatccgtaaggatcttgatatccagactgctgtgctccagaagaaggcccaaacgattccccgtaaggcgctccgtagggttccccctggttggcgttgaacggatcattcgagtttccgccattgttgttgggttcaccataggggtaattcggagtggtcatcagctggcctttccatcgacgtggttcaataaatgctgcacaaagctatgtatttttatgcccagacaaggataccctcaacaccttgagcagatgttgagggtatggatattgcaacaaaaatgttatgtgttaccactttcgcaggtagtcaatgcgtgcccggagttgttcggcgctacaaagtgccgttggtgggccaccgcagtgtttacgtgcttcggtgtggattgcgccgtgtgggcggccggtgcgtccagaggtgatagacacgatggtgttgagttctttgcgcagacgcgggatctcatcactggctacttcttccacgggtttttcgtggatttcggcttcgcgttgctgttgtttttccaattccttgcggcgtttttcggcagcgtcgcgggcgtcgagttgttcttcttggcgtttgcggagaagctcacgcatttgttctgcgtccaacagtcctgggagtcccaggtagtcggcttcttcggcggagccagagaaagtgccggtgccgtaggtggaaccgtcatagatgagggaatctagttcggcttcggcgcccaaggattcgtacttcggcatgtcatccggttcggattccttgcggttggcttcttggaggagttcatcgtcccatccttctttggggcggtgtggttttccaaggacgtggtcgcgggagacttccagcttttctgcgagttccaggagtactggtaccgaaggcaggaacacggatgcagtttcaccgggcatgcgtgatcgcacgaagcggccaattgcctgagcgaagaacagtggtgtggaggcggatgtggcgtacacaccaactgcgagacgcgggacgtccacgccttctgacaccatgcgcacggcgaccatccactcgtcggtggaggcagagaattcatcgatgcgctcggaagctccggcttcatcggacaaaatcacggccacgggagtagatgataaggtgcccaagattttggcgtaggcacgcgctgtcttggtgtctgaggcgatcaccagaccacctgcatcgggaatgttttggcgcagctgcatcaaccgggtgtgggcagctgacaacacggctgggatccagtcacctttggggtctagtgcggtacgccaagctttggctgtttgttccgcattgagcggttcgcccaaccgggctgcgtactcttcacctgcactgtctctccagcgtgcttcacccgagtaggccaggaagacaactgggcggacgacgccgtcggcaagcgcttccgaataaccgtaagtgtggtcggacttggaaaccagatggccttcgtcgtcttcctgatagcgcacaaatggaatttgtgaatcatcagaacgaaacggtgtaccggtcagcgcgaggcggtgctctgcatcgcggtaagcctggctgatgccgtcgccccagctcttggcgtcgccgccgtggtggatctcatccaagatcactaaactgcggcgtgccatggtcaactgatagtgcttgaacgggtgcatggacacctgcgcataggtcacacagatgccgtcgtatgcgggattaatgctgccggagtttttaaactctgggtccagcgccaaccccactcgggcggccgcctgcgaccactgcactttcaggtgctcggtggggaccacaacgatgatgcggtcaacagtgcgggatgcttttagttccgtggctacgcgcaacgcaaacgtagttttacctgcgccgggggttgccacggcgaggaagtcacggggtttgtttgctagaaaattatccagagctgcgcgctgccacgctcttagattagaactcacttcttacgcatgcccttaaagattcgctcacagtccgggcacactggggagcctggctttgcttgtttggtaactgggaaggtttcaccgcatagggcaacaaccatgcgaccactaacggcggactccacgatttggtccttcttcacgtagtggaagaacttcggggtgtcgtcgcttgtcgcgttatcttccctgacatcgggacgttcaatggtctttgttgttgttctcacttaacccatcatgccccagattcctccgttgtcactaaacggactaccctgttcggtatgaaccagcgaaaagaccgacccgacggaacgtccgacgagtcggagcattcgccaaagaagcgactacggaagttgtttcaccgcaacgaagtgcttctgattaccgacaagaagcgcacgcccatgcaagatatgcgccatcggcggcgtatttacaacgtgattcaggcgttgcgtatccccttgcttattttggcgggtgtgtcgtgggttatgtggcatgcgtgggttttgtcgatcatcatatttattatctcaataccccttccgtgggtggctgtggtgatcgccaatgggcatgggtctccgcgtgatccgcgtgagaaaaatgtttataagccggggctggtgcgtgagatgaatgaacgcgcgcaactggaggctcaacaggcgcagcagctagaaaatcgctcgaccgaggtagatatcaggcgcacttttgatggaatcatcatcgatgctcaggaagaaaaagacaccaatgacaatgactagaactccgctcactcaggctgcagcgacgctgaaggcacggttccgtgagatcggctacaccacttcgggcatcaataatgtgctgggcccggatttcgtggctgccatgcacgccggtcagccggccgcagtgcgctttcacctcgattccttgccggaatcagacctcaacctcgccctacgggcgttcgtgttgagggaccaggtgcgcgtcgaaaagcttgctgctttgctcggggaagcactcaagacgcttgtcgacgcctctctcgttgaaatttccggtgagtacgcccaattcttaattgatattcgtccgcatttgattgctgggcgtcagcagtgggtattttctgatgctgatgcgtccatgactcaacatgttccaggccctgatcatgtgttgggtgtcggtgcggccagcctgtcgttgttgcaagcaacgccgacctcccccactggttccgtgttggatttgggtactggttcgggtattcaggtgcttggtcaggcaggtgccgcgcaggaaatcatcgccaccgatgtgcatccgcgcgctctcgatttcgctgaagccacgcttgttgattccggcattcccacgcagttggtggagggcagctggtttgaaccggttcgcgggcgcacctttgaccgcatcatcgccaacccgccgttcgtggtgggaccaccggaaattgggcatgtgtaccgcgattccggcatggatctagacggcgcgaccgcgttggtggtcaaagaagcctgcgcgcatctcaaccctggtggcaccgctcacctgctcggcgcatgggtgcattccgcggatcaatcgtggcagcagcgcgttgcagaatggttgccggataacggttatgttgcttgggttattgagcgcgacgccgtgagccccgcgcagtatgtgggcacgtggcttagtgatgagtccctcgatctgcgtagccccgaggcagcagcacgcaccaccgcgtggcttaaccactttgaaaaagccaaggttcaaggcgttggttttggtttcatcgccatccaacgtctggaggaagacgaggcggatgagaaatccgatatcttggctgaatccatgacccagtacttcgaggatcctctcggccctgaaattgaggagtacttcacccgcaccgcatggcttcgtgaacaaactcgcgattccattctgagctcccgcttcaaagttcgccctggcgtggcccgggaacaaatcagcctggccgatgcggaagaaggcatgggctttagtcctgtcacgttgaggctcacccgcaccgatggtcctcgttggtcccatgatgttgatgagcatgtggcttccatcgtcgcaggacttaacccacatggactcccctttgaagaaatcctggaaatgtacgcgatggctcaaggtatcgagggagaatccctgcacaacggcgccattgcggcgttggtggatctcatccgccacggattggtgttgcccgctgatcttctcgattcttaaataaggactgattgtgaaagccgttttaacccgtgtgagttccgccagcgtcagcgtggatgatgaaattgttggagccatcgattgccccgacaccggaggcattttggcgctggttggagtcggcgctgctgatagcgacgacgcctgggaaaccatggtgcgaaaaattgctgagctgcgcatcttggatggcgaacaatccgtcagtgatgtcaatgctcccgtactgcttgttagccaattcaccctgcatggtcgcaccgcaaaaggccggcgcccatcgtggtctgatgcagcacctggtgaggtggctgagccggtgattgaaaagattgcacaaggtttacgtgagcgcggaatcaccgtggaacaaggacgattcggcgcaatgatgaaggtcacatcggttaacgaaggccccttcaccgttttggtcgagtgctagccagtcaatcctaagagcttgaaacgccccaatgtgggggtgttaagaactccataaaagcgcttgggaactttttgtggaagcagtccgttgaacctcttgaaccgcgaatttaggaggccagttatgacagcaccgtccacgcaggatctcgcaacgactgaacgtgaggtagatcccggcagcagaaggggccaaaccaacgacaatccctcgcaggaccttgttcgcgtttacctcaacggcatcggcaaaactgccttgcttaccgcggaggatgaagttgagctcgcacagaccattgaggttggcctttatgcagagcaccttctgaaaaactctgaagagccactcacccgcgccatgaagcgcgatctaaaggttcttgccaaggacggcaagaaggctcgttcccacctcctcgaggcaaacctgcgcctggtggtgtcccttgctaagcgctacaccggccgcggcatgccactgctggatcttatccaggagggcaacctcggactgatccgcgcgatggaaaagtttgattactccaagggctttaagttctccacctacgcaacctggtggatccgccaggcaatcacccgcggcatggcagatcagtcccgcaccatccgcctcccagtccaccttgtggagcaggtgaacaagctttcccgcatcaagcgcgagttgtaccagcacttgggccgtgaagccaccaatgaggaactcgcagaagagtccggcattgaagagtccaagattgaaatgctgcttcgtcagtctcgcgatccagtgagcttggacatgccagtcggcgccgatgaagaagctcctttgggtgacttcattgaggattctgaggccaccgatgcagaatccgcagtggttgcttccatgcgccactccgatatccgcgcggtccttaacactctcgagccacgcgagcaggatgtcatccgtttgcgctacggcctcgatgacggtgtgccacgcacccttgatcagattggtcgccgcttcggactgtcccgtgagcgcgtccgccagatagagcgtgaagtcatgagtaagctccgcgatggagagcgcgcatcacgtcttcgtgagtacgcccagtaaaagcgtgaactaacaatcgaagcgtcggggcccacctaccgtggcctcggcgttttagtggttcctggaccatattttaccggcgagtcccaaggcgtgagatgacagatcaggtaactttagttattattcgctagactttaatacgttcaactgaagtaaaaccacggatacggggaagttttctttcctattaacaacatgcgccagcatcactactgtcgatggagatccctcatcagtcgatcgatagaaaaatcagtagactatgtggaagtgtgttctctgtcgagctcattctccttgaacatttcacgtgttttaagaagtgtttttaagagaatacgcattgaagtagttttccctgctggcagcggcataaattgagtttggaaaaacaaggaaggcagcctcctgtgaaggatctggtcgataccaccgaaatgtatctgcgcactatttacgagctggaagaagagggcattgttcctctgcgtgctcgtatcgcagaacgccttgagcagtccggcccaactgtcagccagactgtcgcccgtatggaacgcgacggtcttgtgcacgtcagccccgaccgcagcctcgaaatgactccagagggacgttccctcgccatcgccgtgatgcgtaagcaccgcctagcagaacgcctccttaccgacatcatcggcttggacatccacaaagtccacgacgaagcatgccgctgggagcacgtgatgagtgatgaggttgaacgtcgcctcgttgaagttcttgacgatgtgcatcgctcccctttcggtaacccaattcctggcctcggcgaaatcggtttggatcaagcagatgagcctgattccggcgttcgtgccatcgatctgcctctcggtgagaacctgaaggctcgcatcgtacagctcaacgagatcctgcaggtagatcttgagcagttccaggcactcaccgacgcgggtgttgaaatcggtaccgaagtagacatcatcaatgagcagggccgggtcgtgatcacccacaacggctccagcgtagaactgattgacgatcttgcacatgcagtccgcgtagaaaaggttgagggctaacacacgatgaagcttctggttaccggtggcgctggctatgttggcagcgttgctgccgctgttcttctagaacatgggcacgatgtcacaatcattgacaatttcagtaccggcaaccgtgaagcagtccctgctgacgctcgcctgatagaaggtgacgtcaacgatgtcgttgaggaagtcctttctgaaggcggattcgagggtgtcgtccacttcgctgctcgctcattggtaggcgaatcagtggaaaagcccaatgaatactggcacgacaatgtggtcacggcgctcaccttgctcgatgcaatgcgtgcccatggggtgaacaaccttgtgttctcctccactgctgctacctacggtgaaccagacgttgttcccatcaccgaggacatgcccacccagcccaccaatgcttatggcgcaacgaagctgtccatcgactacgcaattacgtcctacgctgctgcctttggtctggctgcaaccagcttgcgctacttcaacgttgctggcgcatacggaaacatcggtgaaaatcgtgaagttgaaactcacctcattccactagtgctgcaggtagcaaccggtcaccgcgagaaaaccttcatgttcggcgatgactggccaactcccgatggaaccgcggtccgcgattacatccacattcttgatcttgccaaagcacacgtgttggctttggaatccaacgaagccggtaagcaccgcattttcaaccttggttccggagatggctacagcgtgaaacaggttgtggagatgtgccgtgaagtaaccggacatcccatcccggcagaggtcgcacccaggcgtgcaggagatccagcaacactaattgcatcttctgagaaggcaaagcaagaactgggttggacccctgagcacactgatctgcgcaccatcgttgaggacgcttgggcgtttacatccgcactgggcgatcgttcccatgctgcaaagaagaaagcttaagctttcggatcggggacgtgaaagtcccgcaattgctggttgccgcggaggcaggcgtcgataagctttgttgtttcgccgttgaacaacccttcgcgcagcagattgctcaagttgtgccgcggcgtggcttcgatggctgcttccagcgccggtgaggccttcatgctcagccccatggcgatgaccgacaatgcgtaaaggcacagagcattagatcggaactcgcctgtgaaggtacatgccgcagcgcgcaggagcagcgtggcttcccgagggaagtcgacgcacaggtgaaggacggcgtcgcggagaaaactccctgccatataggtggctaccgtctgtaaaatatccacctcccccaaaaggccatcaaaattttcggcgccagatgatgaatcaatgtagttggctttgacgaattcgagcgcacgggtaagtacatcaagcgaagtgaggtagtaatagcccgaatcatcggcattaatctggtgctgaatgtcctcggccagcgtgcgggcgtctttttcaagctttttgcgtttcgacgccgacacatgcggattattttgctcaaacagggcgtacgcttcatgtcgattaagctccggcaattgcccttcctgaagcatcctctttgttgcagcggcagaactaatcggtgcaatccgcccaaattcccattcagagattccgtgatcatctgctgctagtgcctctggctccggaccgaagcacagcatgtatggctcactgctgatcacttccttggtgtaccagcaaccagtgatgttgacgatcccctgctcagcggtggctaaaagctgctcgagggtgtcatcgagtgcattgggcggaagctctttggtaataaggaaagcgaaaatccgagttggattgaaagaatctactgcttgacccacatcgggcaacaatctggtgtctcccacatcaagtcggatcacaggacccagcgttaaagttgtggcatcatcttcctgcatcatgcaggccaacacgatggattcagaagggtagaaaccgaggattccaggaatattggccagcaattggccgggggtttgaaggacggttgttggttcgtttcggtgtgctttagcggtcatgctgcacagtatgtccggactttgtggagatgtctcccctgcttcctgcggcgagcgcgaaaactgtggataactgaagttatccacaggcaccttttcgatttccaccaaacccgcacgtagatcgagttcccgtttcatgaaattggtggacgaaaaccaggtttggagtttagacttggcgaaattcacgaaaactatttattgccgggctacctggatgaacatcggtgtaattttagggattattttcgagggtccccacgttgtactgagcagttgccaatacggttgccagtccgaaatttaaaaaatggtggcttagagctataaaaggaggaaaaatgtcggataacaatgatcgtatgtacgagcttgagtacccgtcaccggaggtgagtggacaaacggccggtggcccgacgctcatcgttgccctccaaggctatgccgatgccggacacgccgtggagtccagctcatcacacttaatggacgctctagaccaccgcttgatcgcatcgtttaacaatgatgaacttattgattaccgttcccgccgccccgtggttgtcattgaacacaatgaagtgaccagcatggatgagctcaacctgggtttgcatgtggtgcgcgacaatgacaataagccgttcctcatgctttctggccctgaaccagacttaagatggggtgactttagcaatgctgttgtcgatctggtggagaaattcggtgtggaaaacaccatttgtctctacgcagctcccatgacggttcctcacactcgccccaccgtggtgaccgcacacggtaattcaactgaccgcttgaaagaccaggtgtcgttggatacgcggatgactgtgcctggttcagcctcgctgatgttagagaagctgctaaaggataagggtaagaatgtctccggttacacggtgcatgtcccccattatgtttctgcttctccttatcctgcggctaccttgaagttgctgcagtccattgcggattcagccgacctcaaccttcctctgttggctttggaacgcgacgcagaaaaggtgcaccgccagttgatggagcaaaccgaggagtcttcagagattcagcgtgtggttggcgcattagaacagcaatatgacagtgaactggagcgttaccgcaacaggcaccctcaggcagtgatgcctggtgaatctgagcttccaagcggtgatgagattggtgcggagtttgaaaaattcctcgctgatctagatgatcaaggcggatcggatcacaaagaaactccggaagcttaacttagaaccggcctccttataaacctcagcgcgtctcgtgttttccacagatgtgctgaggttttaccgttttttaatgctggttacccccggtgtcccaggcgttagctagtgtggttgattgtgaacctttctgagatgcttcctgatctttccgatgtccccgagagcttgatggatgagtccatttttgacagctttttaagttggacccgtgagcggggaatttcgctgtacccggctcaggaagaagcagctttaggaatcttggccggggacaatgtcatcctggcaacgcctactggctcgggtaagtccatggtggctatcgccgcccactttattgccatggccagaggccagcgcagtttttacaccgcccccatcaaggcgttggtgagcgagaagttctttgcgctgtgtgagatctttggtgcggaaaacgtcggcatgatgactggtgatgcaacagtcaacggcaaggcgccgattatttgtgcaacggcggagattgtcgccaatattgccttgcgtgatggctctggcgctgcgattgatcaagtagtgatggatgaattccactactactcagagccagaccgcggttgggcatggcaggtaccactgctggaactatcacgcgcgcaattcctgctgatgtcagccaccttgggtgataccgaatggttggaaaaggacctgcagcaacgcactggccgcacagcaaactttgttggaggcaccgagcgtcctgttcccttggagttttcctatgtgtacaccccagtgcacgaaaccatcgaggagctgctgaaagattccaaggcacccatctatgttgtgcacttcacccagcgtgatgcgattgaacgagcccaagcattaacgtccctcacggtggtgaacaaggaagaaaaagagcgcatcgctgaagagatcggcgatttccgcttcagcaccacctttggaaaaacgctatccaagctcctgcgccgaggcatcggagtccaccacgctggcatgcttcccaagtaccgtcgtttggtggaaaagctctcccaaacgggtctgctgaaggttatttgcggtactgacaccttgggtgtgggcatcaacgtgcctattcgcaccgtgctcatgaccggcttggtcaagtttgatgggtcgcgggaacgtgtattgaagtcccgtgaattccaccagatcgctggccgtgcgggacgcgctggctatgacacgatcggcaccgtagttatccaagccccggagcatgagattgagaaccaccgcctgcgtgaaaaggctggacaagaccccaagaagctcaagaagctacgtcttaaagccactcgccccggtgaggtgacgtggaccaagaagacctatgaacgcctcaccactgcagaaccagagcaactgaccagctacttcaaggtcagtaactccatgctgctcaatgttattgcccgacctggcgatggctaccagcacatgaagcacttgttgcggaccaaccatgacacccgcaccaagcagaacaaggacatcctcactgctgttgagctattcaagggcttgatcaatgcgggcatcgtggaaaaagtcccagatggacccgacgctacgggtcgcatctatgccctcacggaagaacttcagcgagatttcgcgctcaaccagccccttgcgcctttcgctttggctgcactgactctgctggacaaagaatctgaaacctacaccctcgacgtgatcagtgtgtttgaagcaatcctggaagatccccgacagatcctccttgcgcagcaaaaagcacagcgcggtgaagagattgaagctcttaaagccgaaggcgttgattacaacgaacgcatggccatcattgaggatgtcacctggccaaagccactggaagaggaactggaaagcgccttcgagaccttccgtgaaggacacccgtgggcaaaggaatttgagctcaaacccaaatccgttgtgcgcgacatgatcgaacacggcatgaccttctctgatttggtggctacctacggtgtggccaggtcagagggtgttgcgctgcgctacctcaccgatgcctggcgtactctccaacactcactgcctacggaagctcgcaccgaggaacttgatgatgttgtggtgtggttgggcgaactgatcaaacaggtcgactcctccctggtggatgagtgggctcagatggcggatccagaagcaccgatcagcaaggaagcgctggaacgagagctcgccttcggcgtggaagacccaacagcacttaccgccaaccgcagggcatttaccatcatggtgcgcaacgccatgttccgccttgtggagctatttgcttatgaaaaggaagatcagcttagtcagatgactgaatacctggatgaggctcctgatttcggtgctgcgatggatgcgtactttgatgaatatgcggatcttgataccggcccggcagctcgtggaccagagttcttcaaggtagagcacacgggaagaatgtgggaggtgcgtcaggtggtgaaggatccagaaggtgataattccttcgcgtttgttgccaccattgatcttgatgcctctgatgatgcaggtgaggtgcgttttggatcgctgtcgattgaccacaactaggggtttgcgtcgaaaagcaagcacgcctggtgcctgatttgagcggttttacctatggcgctttggcgccgtcaaactgtcccagcgatttcattattattttcgtgcattcaccgttatagttataggcatgagcaataaagagtaccggcccacactcgcccagcttcgcacctttgtcaccatcgcagaatgcaagcactttggtactgctgccaccaagctgtccatttcgcagccatccctctcccaggcacttgtcgcattagaaacaggcctgggagttcagctgattgaacgctccacccgcaaggtcattgtcaccccagcgggcgagaagttgctgccattcgccaaatccacccttgacgcggcggagtctttcctctcccacgccaagggcgccaacggttcgctcactggaccgttgaccgtaggcatcatccccacggcggctccttacattttgccgtcaatgctgtccatcgtggatgaagaatatccagatctggaacctcacatcgtcgaggaccaaaccaagcatcttctcgcgttgctgcgcgacggcgccatcgacgtcgccatgatggccctgccttctgaggcaccaggcatgaaggaaatccccctctacgacgaagactttatcgtcgttacagctagcgatcaccccttcgccggccgccaagacttagaactatccgccttagaagacctcgatctgctgcttctcgacgacggacactgcctccacgaccaaattgtggacctgtgccgccgcggagacatcaaccccattagctccactactgctgtcacccgcgcatccagccttaccaccgtcatgcagctcgtcgtcgccggccttggatccaccttggtcccaatcagcgcaatcccatgggaatgcacccgaccaggactggcaacagccaacttcaactctgatgtcaccgcaaaccgccgcattggattggtgtaccgttcctcttcttctcgcgccgaagagttcgaacagtttgcactcattttgcagcgcgctttccaagaagccgtcgcgcttgctgcctcaactggcatcaccttgaagcaaaatgtcgcggtagcgcagtaagtttttctagaggttttccagagtcagctacaagcaaaaagccctttccattgatgcacaccaacgtgagattcaagggaaagggctttattgattgcagaatgcctactgcattagcggcgctccaccggaatatttccaccactgatctggcggtaaatatgaacggtagacagcatcattactggcagcacgatgatcaggccgaaaccgatcgtgaaaataccgatgatgagtgtggcaaacccgccaaccagggagaacagcaacaacattgggtagttgcgcagcgagtccttgaaaccagtttgaacagcgcttcctgcagtgtggtgaccatcagctgtgtagtacacccagtaggagtacagaggattgatgaagaacaacaccaggtagacgatgaagaacatgcctaaaccgctgttattgacctcaacggtaccggcagcgtcattaaacgacaccagattttgagtgagaaaagtggtgaaggtgcccaggatgatgccgaagatacccagccccaccatcagaatcactgtttgaccaacattgatgggtttaaagaaatcaccgaagcgaactttgtgtccatcaacagaaagcagtgcaccgcgcatgacgcaaatggttattgcgaaggtgatgattccgatagctacgttcaacagggtctcggaaaccgaaaaaccagaagtcgtcgtgcccgcattagggtcgatcaaaaatgataagtagccaagcaacccactcacaatcatgaacgcaaggccaagaccgacggtgcccaaaatccacactgctggattggcaaacgtggctttgaatccgaagcgaatcgcccgcatgatgtcgactttgccgttgctcgcttccagcgccacgtcgttctgcggtgaagtagcgccataaccttggtaggaattctggtacggagtctgcgggtatggctgaccgtagcctccatatcccgaagcattacccgggccaaagccctgaccattgccctgaccattgccctgagcgttgccccggctgttaccctggccgtttccctggaatcctcccggcgcgtcctccggatgcgaggtcggaccgtactgggaatccttatttaggttctgccaggattgatcccaggactgctcgcgcgatgtgtcgtcgccctcaccgttgttgttcgtctggtcgtcgcggctcattgtttttcgtcgccctccctatagtgattagttcacctccagactacctggcaccgcgtgggctgctttcacttggactttcggcaaagacaagtagaattagcccctagtcatgactacttctgaaactgccccatcaaaggcttccctgtatgaacttttagagggcgtatccctctccgacgagcgcacgtttaggcgccgactgtccaaagcccgcgcgcccaaggcgcttggtgcgattaaggctgatatcgataaggcacgcttgcttatcgacgaaaagagccagttaattccgtctatcacctacccagaaaaccttccggtgagttcccggcgcgatgatatcgccgaggctatccgtgataatcaggtggttattatcgccggtgagactggttcgggtaagacgactcagattcctaagatttgtttggacctaggccgtggccggcgtgggctcattggccacacacagccacgtcgattagcagctaggaccgtcgccgagcgcatcgccgatgaattggggcaagacatcggcgaatcggtgggttatgcgattcgttttgatgatcgagtttcctcgcatacatccgtgaagttgatgacggatggtattttgcttgctgaaatgcagcgggatcgtttcctcaatgcgtatgacaccatcatcatcgatgaggcgcatgaacgttccctcaacattgacttcattctgggttatttgcgccagttgttgcctaagcgccctgatcttaaagtcattattacctccgcaacgattgaccctgagcgtttcgcggagcactttgctgatgcttctggaaaaccagcaccaattatcgaggtctccggccgcaccttcccggtagagatccgttatcgcccacttgaggtattagacggcgataaaattatcgataccgatccccttgacggcttgtgttctgctttggaagagctcatggctgaaggcgacggcgatatcctctgcttctttgccggtgagcgtgatatccgcgatgccatggaggcaatcgaggcccgacgctggaaaggtgtggaagtcactcccctgtttggccgcctgtccaaccaggagcagcaccgtgtatttagcccgcactctggtcgacgcattgtgctttccaccaatatcgcagagacatccctgacggttccgggcattcactacgtggttgataccggtacggcgcgtatctctcgttattcagtgcgcaccaaggtgcagcgccttccgattgagaacatttcccaggccagcgcaaaccagcgttctggtcgttgtggtcgtgtcgcagacggtattgcgattcgtttgtattccgaagatgatttcaactctcgcccagagttcaccgatccggaaattctgcgcaccaacttggcgagcgttattttgcgcatggcgtcgctgcgtcttggcgatattaatgatttccccttcgtccaagccccagagcaacgctccatcagggatggtattttgctgctccacgagttgggcgcactcaccgacgacacccaagccgatggttcaccgcagctcacccagatcggtaaagacttagccaacatcccagtcgatccccgcatggcccgcatgctcgtagaagccaacactctaggctgcctgcattctgtcatggtcattgtgtccgctctgacgattcaagatgttcgcgaacgccccctggaattccaagcccaagctgatcaagcccacgctaggttcaaggacaccacctcagatttcttaggctttttgaaactgtgggagtacatcgccgatcagcgcaatcaaagcagcggcaattccttccgcaagcagatgaaaaaagaattcctccactacatgcgtatccgcgagtggtgggatttggtgcgccaattagagcagattggccagcaacttggttgggcaaagaaggagcaggttgcaggcaccgccagccctgacatcattcaccaatccttgctcaccggtctgctctcgcaaatcggttcccgtgatggtgagagcaaagaattcactggagccagaggtaccaaattcttggtctttcctggttctgcgctaaccaagaagccgccacagttcatcatggctggccaattggtagaaacctcacgtttgtgggctcgcgatgtagccaagattgaaccagagtgggtggaaaaagcagccggcccattgctcaagcaccaatactctgaaccgtattggtcctcaaagcgtggcgctgccatggtgcaccgcaaatcaacgctctacggtgtgacaattgttgccgacaaggtagttccctaccacacggttgatcccgtggctgcgcgcgatatgttcatccgccatgccctcatcgaaggcgattggtccactcaccaccgcttctaccacgacaacgtggccaaattggaggcaatcggagaacttgaagccaaggcgcgtcgccgcgacatcgtcgtagatgaagacaccctgtttgatttctacgatgccaagcttccaagcaacgccaccaccacccgcaatttcgattcctggtggaagaaaacatcacgcgtcacaccagatcttctcgatttcgacccagatagtctgatcaacgaagacgctgacggcgttaacgaagaagccttccccgacaagtggattaaaggcagcctgatcttcgatctcagctaccacttcgaacccggccaccgcgatgacggcgtcacagtcctcatccccattccagtgctgggtggacttgataccgaaggcttcgattggctagttccaggcttaaggcttgatttggtgaccgagttaatccgcaccatgcctaaggctttacgacgcaccgttgtccctgccccggatttcgccgagcgggtcttgccgttactgcgtccctacatgacaccactgaccacccaacttgccgatgcactccataccctgggcggccaaggaatcaacgcctctgatttcgatcctgccaaactccccgatcacctgcgcatttcctatgcagcagtagatcgtcgtggcaagatcatcgaccgcgaccgtgacctcgaagcactaaagaaacgccgcgcgaaccaaatcagggcatctgtttctagcgttgctaaggcatccgaacaagatgaaactacgcagtggaccacagataccttgggcaccatcgatgaagaaatcgagaccactgtcgatggacagtccgtcaccgcgtaccccgccttggttgtcaccccgactggcgtatccgtcaaggtcatgcccaccaaggctgctgctgatgcctcgatgatcaccgcaacattgacactgttgatgcgtgagattgaagtatccacaaagcaaatggtcaagggactacccttgcaacaacgagtcgcagtggacaactatccccacggcggtgccgaaggactggtttctgatgcccgtatcgccgcaattcgcgatttgatgtttgaacacggcggagctgtgcgttcaccggaagagttcgacgttcttctagccaaggtgaagccggaaacaccaggagttgttcgtcgaactgtcgttgagctagccccagcattggttcactatgcatccgttgtgtcagagctggagtcctggtctggacctgccattgacgatatgaccgcccagttggatttcctcttgccaaagcaggccatcagcattcacggcatcagtaggttgaggcaccttccgaggtatctgcaggcgttgacgattcgcctagaagagatgaaccaaaatccggatcgtgacgccgaccgtcaagatgaagtgaacttcgttgaagagcagctggagaaacagctcagtaagctacccgctgcgcgagccaacaccaaggaagccaaggatattgcctggcagattcaggaactaaggatcagcctctttgcacagcggttaggcactccccgacctgtatcggcgcagagaatccagaaggctattgccaagcttcgataagcactgcttgagatgagggactagttaagactttgtgtctgctagtcccttccgcgtctgcgcatgaggcggatttctttttcaaagtcgtcagcactgtcaaaagacttatacacagaggcaaagcgtaggtacgctacctcgtcgagttctctcagtggatcgagaatggctaaaccaatatcgttagcgcgtacttgagagcttccgttgctgcggactgtttcttccacttgctgagctaggcgtttcaacgcgtcatctgatacgtcgcggccttggcatgcacgacggacaccggtgactactttttctcgactgaacggttcagtgacgccgtttcttttaacaacgaggagaacagctttttcgatggtggtgaaacggccttcgcatttgctgcactcgcggcgcctgcgaatggcgcttccggcgtcaatgacgcgggagtcaatgacttttgaatgatcatgttggcaaaatgggcagtacactaacggatcctctccccctcacttacttcgacttcaagcattcgcctaaaaataagtgaatcggctgttgtgcctttagtttatgccagcattgatctattcccgattagcgcccgagactgacacccaccatctgggtttcgtagtagttctggctcacttcttcttcccctgattgggagagcaaaattccggcgaaaataaccagcccaaacagtcctccgcccgcccattgtttgagggattctttaatcgaacgcgcgtcactattgccacctgtggtgttttctgggtcttgttcacgcacctgttgctgtgatgttcgataatttctttcaccgtgtggaagaatgcgaagacttgatggctgatgaaaacgatctccattcgaacagtcaatcgttcgaacatgcctcttattagctgatttaagaccggcgccttcccccatccagacagcagcggaaggtacgaccacaccttgacgcagcttacgtgaatctagctctttacccgcataaacagtcatttcaaaactcccgcctcaattgtttgcccacatcttaacttttagccacgacacgttcgaacaccaataccgttcacatgttcgactaagtttctatgttcgatttatagcaccccgttcgaacgttgtctagagaagatttaaaaatctcgaacactcgtaccatttccgcaggaaaacctgtatggttggaaactagaaatactgacagaggttcgaatagctcagcattcagcttcagaagttcacactggatgaaccctcatcaagagtgaacatggaagcgaacagagtttttagtgctttaacgggcaaacaatgagaggaagggaacggaagatggcaatcgaaaagaagccagcaggtgcacgaggcagtcgcggtagccgcacagttaagaccttgcccaacggaaaaccagatccagcaagtttgtcagataggcagcgcaggattttagaggttatccgagatgctgtggttttgaggggttatccaccaagcattagggaaattggtgatgctgcaggacttcaatccacttcttccgttgcttaccagcttaaagagctagagaagaagggcttcctgcgcagggaccctaataagcctcgcgcggtggatgttcgccaccttccagaaactgaaagccgttcctccaaggctgctacacaggcaaagagcaaggcccctcaggccggggtccatgatcctgagttagctggccagacctcatttgtcccagtggtgggcaaaattgccgctggtagcccgatcaccgctgagcagaacatcgaagagtactacccactccccgcagaaatcgtcggagacggtgacttgttcatgctccaggttgttggcgagtccatgagggatgctggcatcctcaccggcgactgggttgttgttcgttcccagccggtcgctgagcagggcgagttcgtcgcggcaatgattgacggtgaagccaccgtgaaggaattccacaaggattcatctggcatctggctcctgccacacaacgatacgtttgccccaattcctgctgagaatgcagaaatcatgggcaaggttgtttccgtgatgcgcaagctttaagtcgcttttcaggttcccgccacagtatgtgttctcacatatcgtggcgggttttgctttatatagccacattcgggggtaatcgggcaaataagtttttgctgatctagaaagtgagtttacctgtgggttttcgaaaattctgggccggacaatagaaaaacgctgcccggtttttttgattgactcccgatttcacccctccgccggcaaccaaatgaggcttttgggcgttggacagtgagacaatgggtaagaaattcggacatatttagtaaattggctttttgctttaaggagtgacatgtacgcagaggagcgccgtcgacagattgcctcattaacggcagttgagggacgtgtaaatgtcacagaattagcgggccgattcgatgtcactgcagagacgattcgacgagaccttgcggtgctagaccgcgagggaattgttcaccgcgttcacggtggcgcagtagccacccaatctttccaaaccacagagttgagcttggatactcgtttcaggtctgcatcgtcagcaaagtactccattgccaaggcagcgatgcagttcctgcccgctgagcatggcggactgttcctcgatgcgggaactactgttactgctttggccgatctcatttctgagcatcctagctccaagcagtggtcgatcgtgaccaactgcctccccatcgcacttaatctggccaacgccgggcttgatgatgtccagctgcttggaggaagcgttcgcgcgatcacccaggctgttgtgggtgacactgcgcttcgtactctcgcgctgatgcgtgcggatgtagtgttcatcggcaccaacgcgttgacgttggatcacggattgtctacggccgattcccaagaggctgccatgaaatctgcgatgatcaccaacgcccacaaggtggtggtgttgtgtgactccaccaagatgggcaccgactacctcgtgagctttggcgcaatcagcgatatcgatgtggtggtcaccgatgcgggtgcaccagcaagtttcgttgagcagttgcgagaacgcgatgtagaagttgtgattgcagaatgattcttacagtcactgcaagtccgtatctgttgagcaccaatgagcttgacggcaccatcgaaattggcgaagcaaacaaaatccggcaggtttccactgttgccggtggttttggcaccggtgtggctgccaccttgttttatggcggcaatgaaacttttgcagtttttcccgctccagaaatctctcattacatgcgcctggtgacgtttgctgggttgcctcatgaaattattccggtggcaggtcccatccccatgcatttgaccatgcgtgatgcagagggcaatgagactaagttcaaagactcccccatgcctttggatgtgtcccagttggcaattcttcgtgatctagtggtgcgtcgagccgaagatgccgcgtgggtgttgttgggtggcaatttgccgtctatcgcgcctgctgcgtggtttgtggatgtggtgagatcacttcgcttgtaccaccctcatgtgaaggtagctatcgcagcaactggtgctgcgttgcgtgcggttattcgacagcttgcagctacgtccccggatgcgctgattgtggctgcggaagaaatcgaaattgccactggattagaacccaaaaccttgagaggtccatgggtagagggagatctctccccgactgtggcggcagcgcgcgctttaattgatagcggtgtcaccgaggtgttggttaccaacaagcggacggaatctttgtatgtttccgagtctgaatcactgttagccagctacgacagcacccctggtaagcagggcgtgaattggcgggaatcttttactgcaggattcttggcagcatccaatgatggaaaatccactgaggacagcgtgatcaacgcggttgcttacgccaacgctgaaggcagtgagtgggacaactacattcccacacccgataagcttcgggcggagcacgtggtcatcaaatcgctttagaccacgcaaaaagcctcaaattcccacacaggaatttgaggctttttagctcaacagtggtttagactgctgcgtcgatcactgcgcgtacagcatcgcgtgcttcagttgcaccttcagcgtcaagtgctgcttctgctgccttcttacaggtttccagggtgacctctgacagctttgcaccgactgctgcgagagcagtggatgctgcggacagggagttcacgccaagaccggtgaggacagttgccaacagtgggtctgctgctgcttcaccacaaacaccgaccggggtgttaaagcgagcaccttcgtcacaggtgtgcttgatcaggcgcaggactgctggctgccaaggatcggtcaggtaggcaagctcaggagacatgcggtccgctgccatggtgtactgggtcaggtcgttggtaccgatggaaacaaagtccaggtgaggcatgatcttgtctgccatcagggatgctgctggaacttcgatcatggcgccggcgattaggccacgctcacggcacatgtcagcaaaccactttgcttcataagcggtagccaccattggagccataacccaggttggggcgtcgtcgccacggccgagttcttcgctggccttcgcaattgcgtcgagctggcgagtcagcagatcaacctgtccacgtgcgatacgcaggccacgaacacccagtgctgggttcatctcatcagccatcgatgcgaatggaactggcttgtcagaacctgcgtcgagggagcggacaacgaccttggactctgggaatgcttcaagcacctttgagtagaccgcagcctgctcatcaacgcttggctcttcggtggcggaaaggaagcacagttcggtgcggaacaggccgatgccttctgcttcggtctgtgcagcctgctgtgcagagttgccgtcttggacgttggccaacagctgaacgcggtagccgtccttggtttgtgcaggacccttccactcggcgatgcgagcagcgcgctcgagggactcggagacgagcttggttgcttcagcttcgtccgcgttgcggtcaatggtgccgaggctgccgtcgataagcaccttttcgccggacttgatgtccttgatgccggcgccggatgcgacgatgcaaggcacgttgagctggcgtgcgatgatcgcggtgtggctcgttgggccacccagctcagtgacaagtcccacaaagagatctgtgtctagtgccgcggtgtctgctggggagaggtcatctgcaaagagaatgacctgtccggaaacagctggcagacctggctcttcatcgccacgaagttctgcgatgacgcggtcgcggatgtcgcgcaagtctgtggtgcgctccgcgatcaggccgcctgcggcttcgaacatggagatgaacttggttgttgctgcaaccacggcgtattccgcagggtgaccacccttgacacccttgatgacagccttacgccagccacggtcattgaccatgccagcagtagctttaagcacctcagctgctggtccttcagcagcttcggagcgctcaagcaaacgagaagagactgtggctgcagcggcgtcgaaacgctcctgctctgcttcacggttttcttcggcgacgacttcgcctgcttggggtagttcggggcgtggggtaatccacaccgcgcttgcataacggactccaccgacaacgccggtgcccttcagtacagtgtcttgattcacatcagccacagtagccacccatcctcacaatcattgagttaatttcctcaagatcaccacaaaaccaacagttgtgcaactattcaaacatttggatattgacaaacaaacacatatcaacatagcgtgttgttaagcgatcaccatatttcatacgttgagaccatcgtcacaagttgatattccaccagcttatcaatgcatttgaaggagatttaacaccttctccatcatagtgactgaggccacatcatgtgttttccgctcgatttattttagattttccgctttaaccagcacttttaataacttcatacggttcttccacaatcggaaccaaaacaacactggtcaaaaaccagtttcccgcttgaacaaaatttcttccacgtcaacaccaactccaacatcagcgaggttaagcatggtcagccaaacggaaagacagcatgcaattgcttctttactggcaccaactggtgcggtgtctgtaggagatttagccgagcatttccatgtgacaaccgaaacagtgcgacgtgatcttcggatcatggagtcactgggtttgttgcaacgagttcacggtggcgccattagcccagagcccatgggtacgtctccccctcggctgaaacctgccttgggtaaaggaatgccaccggaaccccgtgttttagaacttgcagaaactgcagtttccctcatcacacctctagcacgcagcattttcctggattcaggtttagcgtgcacggcgattgccacggtgttgggggatcctccagaagatgccaggtggactgttgttacaagttcccccggcgctgtgattgccttgtccgcgacagatgccacctccacggtggtgctgcacgggcaggttcacggtaattgttcttcaatcattgggtccacggcagtagacatgatttcgcagttgcgcgctgatatcgccttcgtggaggttgatgcgattcaatccgatacaagtctgtgcacgtttttcccggagacgattcccatcaagcaagccatgatcaaaaacgcggctttcacagttgctgttctcagcccgagatctccccaagatcaagaacttcaacttttgaagcaccctttttccaccttggctgattttgatgcccttgttaccgatgaccacacgctagattttccagttttgcccgaccacaactttcaggtggtaaccccatgatcatcacattcaccccaaacccgagtattgattccacgctgtcgctcggcgaagagctctcccgtggatccgtccaacgacttgattccgtcaccgctgtcgcaggtggtaaaggcatcaatgtcgcccacgctgtcttgcttgcgggctttgaaaccttggctgtgttcccagccggcaagctcgaccccttcgtcccactggtccgcgacatcggcttgcccgtggaaactgttgtgatcaacaagaacgtccgcaccaacaccacagtcaccgaaccggacggcaccaccaccaagctcaacggccccggcgcgccgctcagcgagcagaagctccgtagcttggaaaaggtgcttatcgacgcgctccgccccgaagtcacctgggttgtcctggcgggctcgctgccaccaggggcaccagttgactggtacgcgcgtctcaccgcgttgatccattcagcacgccctgacgttcgcgtggctgtcgatacctcagacaagccactgatggcgttgggcgagagcttggatacacctggcgctgctccgaacctgattaagccaaatggtctggaactgggccagctggctaacactgatggtgaagagctggaggcgcgtgctgcgcaaggcgattacgacgccatcatcgcagctgcggacgtactggttaaccgtggcatcgaacaggtgcttgtcaccttgggtgccgcaggagcggtgttggtcaacgcagaaggtgcgtggactgctacttctccaaagattgatgttgtatccaccgttggagctggagactgtgctcttgcaggttttgttatggcacgttcccagaagaaaacactggaggaatctctgctgaatgccgtgtcttacggctcgactgcggcgtctcttcctggcactaccattcctcgtcctgaccaactcgccacagctggtgcaacggtcacccaagtcaaaggattgaaagaatcagcatgaatagcgtaaataattcctcgcttgtccggctggatgtcgatttcggcgactccaccacggatgtcatcaacaaccttgccactgttattttcgacgctggccgagcttcctccgccgacgcccttgccaaagacgcgctggatcgtgaagcaaagtccggcaccggcgttcctggtcaagttgctatcccccactgccgttccgaagccgtatctgtccctaccttgggctttgctcgcctgagcaagggtgtggacttcagcggacctgatggcgatgccaacttggtgttcctcattgcagcacctgctggcggcggcaaagagcacctgaagatcctgtccaagcttgctcgctccttggtgaagaaggatttcatcaaggctctgcaggaagccaccaccgagcaggaaatcgtcgacgttgtcgatgccgtgctcaacccagcaccaaaaaccaccgagccagctgcagctccggctgcggcggcggttgctgagagtggggcggcgtcgacaagcgttactcgtatcgtggcaatcaccgcatgcccaaccggtatcgcacacacctacatggctgcggattccctgacgcaaaacgcggaaggccgcgatgatgtggaactcgttgtggagactcagggctcttccgctgtcaccccagtcgatccgaagatcatcgaagctgccgacgccgtcatcttcgccaccgacgtgggagttaaagaccgcgagcgtttcgctggcaagccagtcattgaatccggcgtcaagcgcgcgatcaatgagccagccaagatgatcgacgaggccatcgcagcctccaagaacccaaacgcccgcaaggtttccggttccggtgtcgcggcatctgctgaaaccaccggcgagaagctcggctggggcaagcgcatccagcaggcagtcatgaccggcgtgtcctacatggttccattcgtagctgccggcggcctcctgttggctctcggcttcgcattcggtggatacgacatggcgaacggctggcaagcaatcgccacccagttctctctgaccaacctgccaggcaacaccgtcgatgttgacggcgtggccatgaccttcgagcgttcaggcttcctgttgtacttcggcgcagtcctgttcgccaccggccaagcagccatgggcttcatcgtggcagccctgtctggctacaccgcatacgcacttgctggacgcccaggcatcgcgccgggcttcgtcggtggcgccatctccgtcaccatcggcgctggcttcattggtggtctggttaccggtatcttggctggtctcattgccctgtggattggctcctggaaggtgccacgcgtggtgcagtcactgatgcctgtggtcatcatcccgctacttacctcagtggttgttggtctcgtcatgtacctcctgctgggtcgcccactcgcatccatcatgactggtttgcaggactggctatcgtcaatgtccggaagctccgccatcttgctgggtatcatcttgggcctcatgatgtgtttcgacctcggcggaccagtaaacaaggcagcctacctctttggtaccgcaggcctgtctaccggcgaccaagcttccatggaaatcatggccgcgatcatggcagctggcatggtcccaccaatcgcgttgtccattgctaccctgctgcgcaagaagctgttcaccccagcagagcaagaaaacggcaagtcttcctggctgcttggcctggcattcgtctccgaaggtgccatcccattcgccgcagctgacccattccgtgtgatcccagcaatgatggctggcggtgcaaccactggtgcaatctccatggcactgggcgtcggctctcgggctccacacggcggtatcttcgtggtctgggcaatcgaaccatggtggggctggctcatcgcacttgcagcaggcaccatcgtgtccaccatcgttgtcatcgcactgaagcagttctggccaaacaaggccgtcgctgcagaagtcgcgaagcaagaagcacaacaagcagctgtaaacgcataatcggaccttgacccgatgtctggtcggacattgtttttgcttccggtaacgtggcaaaacgaacaatgtctcactagactaaagtgagatcgacattaaatcccctcccttggggggtttaactaacaaatcgctgcgccctaatccgttcggattaacggcgtagcaacacgaaaggacactttccatggcttccaagactgtaaccgtcggttcctccgttggcctgcacgcacgtccagcatccatcatcgctgaagcggctgctgagtacgacgacgaaatcttgctgaccctggttggctccgatgatgacgaagagaccgacgcgtcctcttccctcatgatcatggcgctgggcgcagagcacggcaacgaagttaccgtcacctccgacaacgctgaagctgttgagaagatcgctgcgcttatcgcacaggaccttgacgctgagtaaacaacgctctgcttgttaaaagctcgttagaagcttgttaaaagcggtgccgcatccgatttggatgtggtaccgccttttgcttttgtgggtttgattgtttttagttgtttttgtgtgcccgatagtgtgattgatgcatgatgctctgtgtgccgatttgcgggcctagaaatccccgatgggtaacatgtgagggattcgtgcattcaaggcctgagaagcgattctgagcgggctaaatttccgggctttgaggcaggttgctacagcaaccaaacgagagtgcccacggatctcgaaatcgagtttcgtgggcagctgtgaccggttttgaggcctgtaaaccagacaggaatgcccacgggtcctcttttcgaggtccgtgggcagtgtgggctggttttgcccagtctccagggtcgaagtgcttcgaccacccctcatgttggcagctcaccgttagatctgggccctcgggttaattcccttaacctcgttgtactttcgacaccaagatttcctggttttggccatcattttgccgaaatcttggtgccgaaagtacagaagtaagtacagcctccaaaaaaggacccacccactcccccaaataagaaaaatcccctaccccaacgcggatcaaagcgtagggataggggaaattccgggtgaatctttatgcagacttcaccggtgcttggcacacctgaacataaacttcagaggccagttggtcgcaggtatcagcggtggctgggccctcgatgtattcttcccaaccgatgctgctggatggcagagtgcatccgaggtcttcgacttcatcgaggatttcgtcccagacgcgctcgactccatcgaaggggccggagtggcggctgtgcatggttttcatgtcgcggaagtggtggaggacaacgtcatcgatgtcgccaccggattggctcaatgcgccgcggcgcagggattctgcttgcgcggggctgacggggaaaccaatcaggatgtctacggtgtcagagacatcgccaaagtagtaggcgcgggcaggacctttaggttcgatgccttctaggcggaggaatttctttacttccgcgtagccgcgtttaaagagctcagggagatcctcagaggaaaggattacccggatgcccacgacgtcgtgagcagggatcttctcaaactgggtatcaacgatcaaggtagttttcctatacagaaatgaacacgtcccgcacgcggaaaccgtgcgggccaagctgcatactttagcagcgtactagaactttgcgttcttgccttccccaatggaaaggtacaggcgcttcatgattgggtacagcacaatgatgcctacagagccccatgcgatgccttcaagagtgactccgaaaacggtgagggtgaggttaccaatgcctgcaaccaaagcaacggcagccatggtcagattcactggattgttgaagttgaccttgttgtcttgccagatacgaatgccgagcataccgattaggccgtaaagaaccaaacatgccccacccagcacgccggcggggatggtgaagatcagtgcaccgaatttggggatgaaggcaagggcgatggcagtgcacgcggcaacccagtacgcagcggtggaatatacgcgggtggccgccatgacgccgatgttttctgcgtaggtggtggtgccggatccgccgaaggcacctgcgagggtggtgccgaatccgtctgcgataagtgcgtcgccggcgaggtcgtcgaggtcctcccctgtcatctctgagactgctttgacgtggccgacgttttcagcgatgagcacgatgatgactggcagtgtcaccaaaatggcagagagctggaattccggcttgtggaactgtggcagtccgaaccatgctgcttcacggatggtgtctgctgcgccttctgagaggttgccggtgatagctgcgaaaacccagccgatcaccacaccgatcaaaatgcccaggcgagcaatcattccgcggcctgcaacggtagcgatcaaaatggcaaagagggtcgccgtggcaaccagtggttggctggagaagtttcctgccgcggttggtgccaggttcaggccgatgagtgccacgatcgcaccggtgacagcgggtggcatgacagcatcaataacgcgtttgcccgctgctttcaccacaaatccaatggcgacgagcacgagacctgcgacaagaatgccaccgatctgcacgccaatgccatggacttgggttgcggttaaaggtgcaatgaaagcaaaagaactacccaggtacgagggtagtcggtttctggtgatcaacaggaacaggattgttcccagaccagagaataaaagtgtggtgttgaccggaaatccggtgagtgtgggaaccaggagcgtggcgccgaacatggcgatcacgtgctgcataccgattccaattgtgcgcccccagctcaggcgctctttaggagcgacaactgcgccgggttcgatctttttgccgtctccgtggacggtccatccccatgttgaagtcacgagcactaattatcgactcccaagggggctcttgggaaatcgacagttaggcagaggtgggttctacaacgtaactctgcagctcttgggccaattgggtggggatacgcacatccatcaaggtgccgtcttcggcgtagtcttcgctgagaacggtgccatgctggtgcaggcgggacacaatatcgccacgggtgaacgggattttcagcagtaggtgcgcgtccctggagttgaggaatagttcgatgcgagcttccagctccttaattccctcccctgtcagcgcagagacaaacaccacatcgtcgacggcgtggcgtagttctgccagcgtcagcggatcagcttggtcaattttgttcaccacgatgatctctggtggtggcaccgcaccggtggatcgcacaatatcgctaatcacggtgttcacagcgtcgatctgcttcagcgggaacggatcggatccatccaccacgtgcagcatgaggtccgcctccacgacttcttccagcgtagatttgaacgcctcaaccagagaggtcggcaggtgtcgcacaaagccgacggtgtccgtgaacacgacgtgtcggccgtcggcaagctcggcttttctggttgttggatcaagcgtggcgaacagcgcgttctccaccagcacacccgcgccggtcatcgcgttaatcagcgaagatttgccggcgttcgtgtagccagcgatggcgatctgcggcaccagggaggctgcgcgttgcgctcttttaatgcttctcgacgtatccagccccgaaagttccctgcgcaggcgagccatatccgatcgaagacgacggcggtctgcttcaattttggtttcacctggaccacgcagacccacaccaccattagaacctgcacgaccaccggcctgcctggagaggtttccaccccaaccacgcacacggctaatcaggtattccatctgcgccaacgcgacttgggctttaccttcgcgcgatttagcgtgctgggcgaagatatccagaatcagcatggtgcggtcaatgaccttgatatcaagttcgcgctctaatgccacgagctgggaagggctaagttcaccatcgcacaccacggtatctgcactagtggcttcgatgatctcctttaactcccgaaccttgccggaaccaatgtaggttccaggatctggtttatcgcgcttttggtacagcgtttcaataacctcagcgccggcggtatcagccaacgctgcaagttccgcaaggctggcgtcaatttctgcggtggtaccttcggtccacacgcccactaagataacgcgctcaagtcgcagctttcggtactcaacctcgtagccatctgctgcttcatcagcgtggatttcggtgtcccggcgacgttgggcatcgcgggcctctaggtcgagatcaccagttgatggttcttcagctcggataaaaccactgagatcaaaacctgaggtctcgtcagatcctgggcgcacggtatttttgtgaccgcggaaggcctgagcgagaagttcatcatgacttaagtttttcttttcatccattgtttatctattgtttcacgtctgctgtcgccaaggctaggtgtcgggcaacgccgtgagcgatcaagccaccataaacacctaaattgagcgctctattccatcaacgcgggggcaatttctcacgtgtaggaaaagtgactattgcctgttaagggagttagactaatcgccatgactagcgatctgaagacaatcggtatggatttcgccaagtggcaagatgcagtggaagcagcaattgcttcacagcgtctcgaggtaacaggcgaggtccgtggcggccagctcatccagttctcggatgattccggcgcccaaattaacattctggctgtcgagccttttgccaccttcgccggctttaactccgcaacagtcgcttacggccacgtcagcatgatcaatgatgtgctgtccctggtcgatatcatcgatcctttcggcacccctgttgccaccattacctgcaaccttgctcaaggcccactgcttgttgatgaaccagtgcagcgctggcagcagatccgcattactgccctgggcattgatgttgaggtccacgacaatgcagatgcttacatccgcaatggtggcgaaactgtcggcatgctggtttctgaaggtgcagagaagattgccagcggcagcggcgctgtcatcccggacgcatccgcagagttttccgcacgcgtgttgtctgcggagtaccgcaccaacactcttaccggccagcgttttatccacgcaacagttgatggcctcttcgcttttgatgtgtgccttcctgatgcaccagaactacctgcccgtgacagcgtgttgtctggcaaagtcatgctgactgctgccgttatccccactgaggtcaccggctgcggtggctccggtggcggctgtggctcaggtagctgtggctgcggcggacactaaaattctgcacaattttttaagaggaccccagttcccggggtccttttccattttttacccagtacttgaaacgtgatatatgtctattctgaaaatcatcgcatagaatactggtgcaatcgtttacgttcgctattaatgtgacacgtataagccgacacttttaacgaagcgcagaaggagtgagagcaagaaaatgggagaacaacttccgtttgctaatggttcacgctccaacaaactgccgctcatcgtcatcggtttgtgctgcataatgctgatcctgtggcttaaacttcccggcgtactgcttgccaccatcattggggttgccacgatgagtgtgatgcggatgcgcacctccaccccagaaactgcctcgctggttacttctattcggctgtctgcggaagatatttccgatgtgcaacatgagtggcagcagtttttgacctcccccgaggccgatgcgctggctgatcgcacgcttgtccgtcccgcactggcggatccagattgtggcgataaggctatcgagaaatttcattatgaaatcagcaatgccaatcgcttcttgggcaggttggacgctcgtctgcaacaaaacctcgtggtcagtgagctagaaacacttctcaaagtaacggacgagcgcgcactagagctgcgggaaacgtggctggatgcgcgtaaagcggcccagaaacttgggccgaactacaatcgcgaatcttagatctgcacctcaccgagtgcgatgatggcgcttgggccggtgagtgtggagccgtcgtcaaagatctggacttctacttccccacctggaacgcacactttaactgtgccttctcccaatccagcatcagctaaagcagcacacgctgcagcaacggttcccgtgccacaggagcgggtttcgcccactccgcgttcccacacgcgcatcgatactgcgtcatcttctaattctgtgacgatttctacgttcacaccgtgggggaagaattcctgatcaaacgtaggtgcgcgcagttccatatcggcaagagccgacgcacttaagcccggcacaacgcacgctaggtgtgggttacccatatcaacgccaaggccagcgaatacttggccgttgatgtcgcaggtggataatcccgtgacgtcagggatgcccatatcaacgcggacctgcgcagaatgttgatctgcctgcaaaatatcaacgtggcggacaccggcgcgggtaccgatatcaaagctcgtattatcaacaagaccgcgggagtacagccagtgcgcgaacaggcgcacaccattgccgcacatttcagccaaagatccatcggcgttgcggtaatccatgaaccacagcgatgggtcgaccgtggagccttctacgtctgcagctttaaccacgcggaggataccatcagcaccgatcccggcgcggcggtcacacagcgtgaccaccatttctggagttaaatctaggcgcgcatcctcatcggggatgatgatgaagtcgttttcggtggcgtggcctttggcaaaggggatggtcaaattcaccctcgctattgtagacccaaaatctccaaggcttgtgcggtgggatcgccagaggcgtcgacccaggacacgcggtggtctctgttgaaccagctgcgttggcgcctgacatagcgtctggttccggtgaccgtgcgttcgaaggcgtcttcccaggtcatctcccctgccatggctgccagtacttgggagtagccgattgctcgtcccgcggtggagtcagcgatgagtccttgctgcacaaggtgttccacttcggcgacaaagccttgttcaaacatcctggcggtgcgctgctcgatgcgtggatttagccattctggagtggttttcaggccaatgattcgagttccccagcgaggtggcgcgtctttgggcggttggcttgcttggaagggctggccggttagttcaatgacttctaatgctcggacggtgcgtcggggatcattgctttcgatgacggctgctgcttctgggtcaagctgagtaagttcagcgtgtagtgcttcgacaccgatgtctgccaagcgggcctcaaagcgtgcgcgaacagcgctgtcggtaggtgggaattgccaatcatcgaccaaagattggacgtacaacatggagccgccaaccaagatgggggttttgccacgggacataatatcttccacatcggcaacggcgtcggattgaaacctcgccactgacgcagtttcggtaacgtcccagacatcgagctgatgatgcgcaatgccttcgcgttcttcgacagtcagctttgccgtgccgatgtccatgcctttgtacagctgcatggaatccacattgactacttcaccgtcaagcttgtgggctagagcaattcccaaagctgattttccagatgcagtgggtccaaccactgcgatcggtgttaccacgatctagatctcccttaagttaaaaagtccagcgagcaacgtagcgtcccacgccgtgtgtgtcgtcgctgtcgagaagttgagcagttgacgcttctgttgccacggcggataagtcgagccagagctgtggttcgcggagggaggcgtcgataagcgtgctggtgctgggcacttccccgggctttccagacagcaatgagcggcaccaggcgtcgatgttggacgcgccgggcacgagtgcggacggcgcgcgggtggtcaagcccgtggggccgtcaagggcaagcaccgtaaccgtgttgtcgttgacgctacccaaccgatcgcgcacatgagttacacgcgattcgaaaccacccagcgcgacacgctgcaaaatttccggcaaataatgtccgtcagaaacctgcacgctcggtgcaccccaggcccgcagatttcccgcatgcttggtaaaccacgcctcatcccgggagccaaccaactcgatcgggcgatcatcattagccagttccgcatcaaaaactgcacgtaacgacgccaacaagcgcgcccccgcagcatccgctggtgccagttcaggtaccagcgccggacttccaggcatgataatcagcgttgcattcacgtcttccaccctatcctgcccaccgaaattgctgggcaaacacctctcctgagcgcggtttttcaagatagtgcaccctatctggctgacacctcctatggcacgcggtatgtttaataaacgtaattcgagtttcggcggccgtgtcgcgcggccaggacgaccctagcttttaaggacccaccatgactgagaaccagactcccagctccacctctgcaccgaagccgggacctcgcccgggcccacggccaggcccccgacctggggctcaggttgctgcaaagaaagctgcggttgctacacctgcgccgatcgccaaaacttctaacgatcctgcaaagtttggtcgcgttgaggcagacggatctgcatatgtcaccacctctgctggcgagcgtctgattggttcttggcaggccggcacccctgaggaaggtcttgctcactacggcgcccgttttgatgatctggccaccgaagttgagctcatggaacagcgcctaatctcccaccctgatgatgcgacctccatccgcacgaaggctgaagaactcaaggcaaccctgcccaccatcgctgcgatcggtgaccttgatggcgttgaagctcgcctgtccaagatcatcaacaactccgaggaagccaacgagcgcgccaaggaacaaaaggctaaaaaccgtgagcgcgcagtagctcgcaaggaagagctcgctgttgaggctgaaaccttggcagaaaactcctccgactggaaggttgctggcgaccgcatccgcgccatcctggatgagtggaagtccatccacggcatcgaccgcaagaccgatgatgaactgtggaaacgctactcccgtgcgcgtgactccttcaaccgtcgccgcggcgcacacttcgcagagctggatcgcacccgcgcatctgcacgcaaactcaaggaagaactcgttgagcgcgccaatgctctcaaggaatccactgagtggaacgacaccgcccgcgcattccgcgatctcatgaccgaatggaaagccgccggccgcgcaccacgcgaaatcgacgacaagctgtgggcagcattcaagggcgcccaggactacttctttgataagcgcaacgccgtagccaaggaacgcgaccaggaattcgaagccaacgcaaccgcaaagcagcagctcatcgacgaatacgacgcacagatcaaccccgagcagggcctcgatggagcgcgcagcaagctccgcgaactgcaggaaaagtgggaagaaatcggcttcgttccacgtggcgttgtccgcgaattcgaagagaagatcgccgtgctggaaaagcgcgtctccgctgctgaggaatcccagtggcgccgcaccgacccagaagcacaggcacgcgcagaccagttctccgcgaaggtcgccgagttcaacgctcaagcagacgccgccgaagccaagggcaactccaagaaggctgagaagctgcgcgcacaggctgcacagtgggcagaatggtcccgcgccgcacatgaggcagttgaccagctgtaaatgaagttctccaaattagcggaccaggtctggggcgaagaacccgatgatcaggtccgctcctttgtgttcatgtccaacctggatgcccaagaaaccgccaacaccatggacgtgtccgtctccgtggagcgcatccacgccgatctttgcggcaacactgagctcgcctccgaactgcactacacgcccgatgaatgggacgaggcccaaggctgggtaaaaatcaactacccgcttatcgacgacaccgcctcagccagcctcgacgtcgtcctcgacgccaccttccagcccctaccgggccagccctttgagggcgaggctttaacgcttatcgacgccctcctccaccacgccgaaaacgtcgcagcctccaacccctggaagcgcaccaccttccacaccgctcacatgcaccctccagggagtaatgcggattgtgactactgcctggtgctgcaacgccgcggatacgttaaagcccacgaagaaatccaacaaaccatcccgcttccttcaggtgactggtccgctggagaattcaccgtggtggacgttgaaggcaccgccttcccaagcgcgctgatccccagcatcgtggaactccaacaccgcgcagccctcgatgtgccccacggaaacttaagtgttgcgcctgcacagtgggatgaacaccgcttggcgcagcaatctgaaagaatccttaaaacaggaacgaaactgttcaccgtactgtttgccgaaggatccacagtcgctgccatgtcctccatcgcgattcccccaggctccaaccctgacatcgccgaacagggactgaccatcgtgcacccagatttcagaggccgtggtcttggaaccgctgtgaaattagcgggactgtcactactttcgaggtgccacccagaaattcaacgcgtagccacctcaaatgcagtagacaaccatgcgatgctggcgattaaccgctccataggggcaacagagatcgcccgaaccaccctgtgggagaagaaactctaggtgatggaattcgagaccaaggacgcggttttctagacttcctttggtctcaaatgcacatttcgagagccgattagtgtctttttaggccaaaagctcagcgccagtaagtgcgcttggtttatttcgacagttcgcagcgaagagagggtaaaacttgaccccaacctgaaaaaagcgacctcacagaatggcttctaagcgcctaaacacctcaaggcgatacaaacactcattcgagaaaaacgagcctttaaatcgcatcccaggcgggcacggaaaagcggttgaccacttgtatcgtgatcaaccgcttgaactagaacttaagcctgctccccttgtgcatcctgttcacgctcgcggcggcgggcgatgcgggcgcgacgatcgtcgacaagcaaaggattatcttctgggttgctttgctgctgctcaagaagtgcgcgctgggtagctgcaacaccatcaaggtctgggttctcggcgcgcatttcagcgatctccatttggcgatcactgcgggccaaaatcaccgaagatagaccccacacagcaaggatcgctgcaatcacagcaagcatcatgccaatgttgacgaaattcacttgggtgctggtggttgtttggcgcatccagatggcaaacacagcgaacacaagagtgacgcaggagaaaatccatgaaatccacgccatccacgtgcgcttaaacacgacagtgcccaaagaaagcaggaatacaccgatggtgcccaaccagtagaaaccgtactcaccaagggtaatgccggcatcctccgcgacattcgacagcgtcagaacctgccagcccatcactccacggatatgtgggaggacgagtgcgatggcgaaaagcacgactcccgcgatgagataccacttcttatcaccaagttcgagagtttttgcggcttgtttctctagtgccgcaagctctttaccacttagcttttgatcactcacgttgttgttcatctcctcgttggcgccgactttttcatcgactcctaatcgaccctctattctagcctgcaatttttagttaatggagcagcaggcagattctgtggcaggagccacctttggtgcgccgatttgtggcagtcccaagcccacaccgatcggtgctgtggttggaacttgaccaactgcagagttgtcaccagctttggtgcggcggtgggtctgcacaccggagtctgcgatgaggaagaaaggcttggcctcagtcaccgtgacagtgacaaaatcgccggggcggatctcaccatcaatgtcgccctctggcgcaaagtgcacgaggcgtccatcgcgtgcgcgaccactcatgcgcttggtggcatcgttcttgcggcctccgccagcctggaccagcaattcgacggtggtgccgatgagcttttggttttcttcttcgcagacttgttcctgaacgaccatgaggcgctcgtagcgttcctgcacaacttcttttggaagctggttttcatattccgctgcaggggtgccagggcgtgggctgtattggaaggtgtaagcagaagtaaagcgtgccttcttgacaacgtcgagggttgcttggaaatcctcctctgtttcgccagggaatccgacaataatatcggtggtgatagaggcgtgagggatcttcgcacggacctcatccaagatggagaggaacttcttggatcggtaggaacggcgcatctctttgagcaccttgtcagatccggactgcagtggcatgtgcagctgcgggcagatgtttggggtctctgccatggcgtcaatgacatcagaggtgaattctgcagggtgagggctggtgaagcgaacccgctcgaggccttcgatctcaccacaggcacgaagcagcttggaaaatgcactgcgatcgcgctctagctcaggatcaacaaagttcacgccgtaagcatttacgttttggccaagtagagttacctcggtaactccctgatccaccagtgcttgtacctctgcgaggatgtctcctggtcgacggtcctgctctttaccgcgcagcgacggaacgatgcagaaagtacaggtgttgttacatccgactgatacggacacccaaccagcgtaagcagactcgcgctttgcagaaagtactgacgggaactgctcgagggaatcgacaatttcgacttccgcttgggcattgtgctccgcgcgctgaagcaaggttggcaaggaaccaatgttgtgggtaccaaacaccacgtccacccacggtgcttttttcaccacggtatctttgtctttttgagccaaacaaccaccgacagcgatttgcatgcctgggttcttttctttcacgctgcgcaggttgcccaaagtgccatagaggcgcatatcggcgttttcacgcacggcgcacgtattaaatacgacaagatccggagtggtgtcctccggagcagcaacgtatccagcctcctcgagcaggcccgaaaggcgctcagaatcgtgcacattcatctgacagccgtaggtttttacctcgtaggtgcgaacctgcccctctgcggtttctgggagggtggcttgaccgggatgttgatttacctttgcgtggttcaattgctgcgtcacggttgctcattgtatccctgttgcgcgagctgacataaacgcctatttaggactctgaactaacaaggctcgtctccgaccttgccttgagaattcctaggcttagcgaagtttaacttggccacattcgcacgcttatttaacacgcaatatctatcatgtgataggtaaatttcggacaggatcggagactacccccaaaccttgccccctaccgacctgcgaaaatgctggtaaatgtagtgctatttgtttcaaaatggactcattcacacaattgcgaacattctcggcacaaactgctttaagctacccttatgacgcagaccacagaatccccgatgatcaagatgacgggagtgcaaaaatacttcggcgactttcatgcccttacggatattgatcttgaaattcccagaggacaagttgtcgtcgtacttggaccatccggatccggcaagtcaaccctttgccgcacgatcaaccgtctcgaaaccatcgaggaaggcaccatcgaaatcgatggaaaggttctcccagaagaaggtaaaggcttagccaatctccgcgccgatgtcggaatggtattccagtccttcaacctcttcccccacctcaccatcaaagacaacgtcactcttgcacccatcaaagtgcgaaagatgaaaaagtctgaagccgaaaagcttgcgatgagcctgttggaacgcgtcggcatcgcaaaccaagctgataaatatccggcgcaactgtccggcggtcagcaacagcgtgtggccatcgcgcgcgcacttgcgatgaacccaaagatcatgcttttcgacgagcccacctccgcccttgaccctgaaatggtcaacgaagtgttggacgtcatggcaagccttgccaaggaaggcatgacgatggtgtgtgttacccacgagatgggattcgcacgcaaagcagccgatcgtgtgttgttcatggcggatgggctcattgtggaagatacggaaccagattccttcttcaccaaccctaagtctgatcgtgcaaaagacttcctcggcaagatccttgcccactagttttcggctgcgcctctatcttcagagtcacttctttcagtgtcatttttctcggccctaatcccccgctggagttcaatcagcgattgcaaccttttagatatataaggagacaacatgtctgcaaagcgtacttttacccgtatcggtgcgattcttggagcaactgcacttgccggagttaccctcaccgcctgtggtgattcaagcggtggcgacggattcctcgcagccattgaaaatggttctgtcaatgtcggcaccaaatacgatcagcctggtcttggcctccgcaacccagacaactccatgagcggtctcgacgtggatgttgctgaatacgtagtcaactccatcgctgatgacaagggctgggatcaccccaccatcgaatggcgtgaatccccttctgcgcagcgtgaaaccctcattcaaaacggtgaggtagacatgatcgcagcaacctactccatcaacgctggccgttcagagtccgtcaacttcggtggcccatacctgcttacccaccaggctctgcttgttcgccaagatgacgatcgcattgaaaccctcgaggacttggataacggtttgatcctgtgctccgtttccggatccactccagctcagaaggtcaaggatgtcctcccaggcgttcagctccaagaatacgacacctactcttcctgtgttgaggcactgtcccagggcaacgttgacgccctgaccactgacgccaccatcctcttcggctactcccagcagtacgaaggcgacttccgcgttgtggaaatggaaaaggacggcgagccattcaccgacgagtactacggcattggcctgaagaaggatgaccaggaaggcaccgacgctatcaacgccgcacttgagcgcatgtacgctgacggcaccttccagcgactgctcaccgagaacctcggtgaagactccgtggttgttgaagaaggcaccccaggtgacctctccttcctcgacgcaagctagtgtgacggcttttaaaagccagctttaagaaatgtgcgtggcgcttaaaaccccgaaagcgccacgcacaacccatttaagttcatgatttatttccatccttaacaaggagcaccaccacatgagcactttgtgggcggatctgggtccgtctctacttccagctttttgggtgaccatcaaactcaccatttattccgccatcggcgccatgattttcggaaccatcctcaccacaatgagggtctcgcccgttaaaatcctccgcacgttgtccacggcgtacatcaacacagtccgaaataccccacttactcttgtggtgctgttttgctcctttggcctttaccaaaacctcgggttgactttggcgggccgtgaaagctccacattcttggtggataataacttccgcttggccgtacttggcttcattttgtacacctcaaccttcgttgccgagtccctgcgttcgggtattaacaccgtgcactttgggcaagcagaagctgcgcgttccctaggactgggctttggcgcgactttccgttccattattttcccgcaggctgtgcgcgccgcgatcgtccctttgggcaacacactgatcgcactgactaagaacaccaccatcgcctctgtcattggagttggcgaagcctccctgctgatgaaagccaccatcgaaaatcacgccaacatgctatttgtcgtgttcgcgatcttcgccgttggcttcatgattctgaccctgcctatgggccttggcttgggcaaactctctgagcgtttggcggtgaagaagtaatggctaatacagttcgcgcaacagtcctctacgatgctcctggaccaaagggccgtcgattcaacctcataatcaccattctcacggtggttctgggattggcgctcctcttctggattggctccatgctttcaggcaacggccaactcgatgccaacaaatggactccgttcatcaattcccaaacctggaccacctacattcttcctggtttgtggggcacgctgaaatctgccgtgttctcggtgatcttggctctggtcatgggtaccgcactgggtcttggccgtatctctgaaatcaggattctccgctggttctgcgccgtcatcatcgagactttccgagccattccggttctgatcctcatgattttcgcctaccagatgttcgcccagtacaacatcgtgccgtcgagccagctcgcgttcgccgccgtggtattcggtctgaccatgtacaacggttctgtgatcgcagagattctgcgttctggtatcgcttccctgcctaaggggcagaaggaagcagcgattgcgttgggtatgtcttctaggcaaaccacctggtcaatcttgttgcctcaggccgtggctgcaatgctcccagcgttgatctctcagatggttattgcactgaaggactccgcacttggttaccagatcggctacattgaagtggttcgttccggtattcagtccgcgtctgtcaaccgcaactaccttgcagcgctgtttgttgttgcgctgatcatgattgttctgaacttctccctcaccgctctggcttctcgcatcgagcgccagttgcgtgcaggtagggctcgtaagaacattgttgccaaggtccctgagcagccagatcaaggtctggagaccaaggacaatgtcaatgtcgactggcaggatcctgattataaggatctgaaaacccctggagttcagtaactcccttaccccggatgattcccatccggggtttagtttttcaaatcctcgattcgcgcgtctagcgcttcccgcgcaaggtccatggacattccagccggaaatccccgccgtgccagcgcaccaaccacgcgccgaagcgctttgtcgtagtcggcgcggtcctgcggaatcttggtctctgagcgcgcctttttcacggccaccgcccgcgccgtgtcccgctcatcggcctggtcgatttgctcaagcgccgcagcacgcgtttgcttgtcgacgcctttttcctgcagttcgcggtccagcgcacgcgaagattttcctcgcctggcagcacgttgccgaacccactcagtggcaaaaacttcatcatcaagcagtttggatctggtgagatcgccaatgacctcattgatgatgtcttcctcaaactccagtgctttaagtctggtgcttagttcgttgactgatcgtgcgcgttggttaagcagcagcagggcacgtctgcgtacgttggctttcttttcttctttttcatggtcaaagaagtctgattcgcctcgcgcatgagcgcgttcaaagttgtcgagtgcttttctgagcttttcaatcttttcggcttggatatccatcgcgttgttgcccttcgttgacgaaaaagcaggaacaagccacatcatggtttaagtgtgtggattgtccctgctttgttaaaactggtgcttagtcttcagcgtctgcttcggtgtcggcttcatcatcgaagtcaacgttaggcacgagctctactggatcgtcggtgagttcatctgaggctgcagcgtacttgcctactcccagcttcttgaagatcttatcttccagctcatcggtgagttcagggttctccttgagggaaagacgcaccttttccttaccttgaccaagctgttcgccctcgtaggtgaaccaggaacctgacttcttcacaatgccgttgtccactgccaagtcaatgacggaggattcacgggagatgccttcgccgtacatgatgtcgaattcagcgatcttgaacggtggggagaccttgttcttaacgaccttcaagcgggtgcggttaccaatggcatcctgtccgtccttcagagtctggattcgtcgaatgtcacaacgaacagatgcgtagaacttcagggccttaccaccggtggtggtttctggggaaccgaacatcacaccgatcttttcacgcagctggttaatgaagatcgcggtggtacccgagttgtacagcgcacctgtcatcttacgaagcgcctggctcatgaggcgggcctgaagaccaacgtggctatcgcccatttcgccttcaatttcagcctttggtgtcagcgcagccaccgagtcaatcacgatgatgtcgattgcgccggaacgaaccagcatgtcggcgatttctagtgcttgctcaccagtgtctggctgcgaaaccagaagcgcatcagtatctacaccaagcttgcgagcataatctggatccaacgcgtgctcggcgtcaatgaatgcagcgatgccgccggccttttgtgcctgcgcaattgcgtgcagtgcaacggtggttttacctgatgattctgggccatacacctcaacgattcgaccacgtgggaatccaccgatacccaaggcaatatcaatcgcggtgttaccagatgagatggtctggattggcggacgattctcatcacccagacgcatgacagcgcctttaccgaaatccttctcaatcagggctagtgcggcatcaagtgccttctgacgatcattccccttggcggcagttgcctttgttgctgtcttcttgggagccatttttaattcctcttagttttattgacgttgatgtggacgaaaattcctacggttgcatcacttcagcactgactaaaacagcactgcagcagtgacccctacttacttagacttgaagttcaaggatttggatcccgacttcactgtgttttcatctgttcttttgtttatgcccgttactgtagatgaaccctaggacacaacgtgctcaaaaaacagtatacacgcacaactgttcgaaattcgaattttcatgcgaaccccctcgaacaagctagaaccctggttcatctttaccaagtcgtcgctcttcgggaacactgaaatcaatgcacagttgttcccatacatcgcgcagatcaaccccggtatctactgcaacatctgcagtgacgccgagggcaccaatcacatgcgagtgtgcaatccactcccctttggcttctccgaattcatcttcaatgagttgccgaaactccgataaacgcatggggacgataatacagcgcaagcacagaagttacgtgtccaatctccgacagcgaccctaagaagggtccccgtcatgaccgtcttccagggcggatgaatccacacgcgttagttcaccgacgtcatttctctcaaactcatgaaaactagtttcccccgaaaaaagtacatggacggaggatactaccgtttctttaaacatcgtgtgttcttcgacgtactggcaataatacaaagcgcaatcggtttcaaggtcaacaaaaagaccccaaccagcatcctcatctgtgagatcttgagtaatcttcaggtaccgaagattatgcatggtcatcgaaaatccatttggaggtggcggagagtaaagctcgtgcattacaaagtccttccacatcaccatcaagccaggagcacctctcggacgaataatgaactgatctgattcaaaccagccttcagaagtgagtttgggagtatcgaaggattctctcgattcaccattggcataggttgtgaccttgtgctgtgcacctgtctgtggattacatcgaaaactaaacctagtagattcttctccaaagtcttcaacagaacccgaaatgcgatactccaacttcggctttccactcctgagcttcatgcatattcccagaacctcatcccgcgtgactggcgattcgtccacatcacagcgaatgttggctgctacccattttcccactggatcaaaattcatatttcttgccgatcgtttataagatttaagtaaattcacaaagatactccactgacacatctgccatatgcaacaatatctacatatctgacagttggatccagttgagaaatttcagcccccatcccccacatgaacgctgttcaaaacatccagcttgcttgttgaacactgttcaggtgtatgattttttcatgcctacatcctcttctcctgcaactgtgactccgctaaagaagcagtcttcacgtaaacagctccaagacatcgcgcttattgcagtttttgcagcactgatcattgtgcttgcttttgtttccatcccagttggcacagcgggagtgcctattgttttgcagaatgcctccatcgttttggctggcctgattcttggtggtcgacgtggttttctcactgctttgctgttcctggcactcggcctgattggcctgcctgtccttgcaggtggtcgtaccactttggccgcacttgctggcccaacagctggctacatcgtgggttacctcatttccccacttgttgcaggcatcatcgcttacctcgcacctaaaaagcgtggcgctggaatgttcatcgttttaggcctggcgggtctcgcgggtctgatcacccaatacgcttgcggcatcgtgggtctcgtccttcgtgcgggtctaagcttgagtgaagcaacaattgctcaaggtgcctttgtgctgccagatttggccaagatcaccgtcatggtcataatcgccgctggagttcatgcagcattccctgacatccgtaagaaatagttccaacccacttttcctcagaattgcagttcatgcccgagatcatttttgacaacactgaagtacgctacgatgactcgctcattttagagcccctatcgttaaaactgacagaacaacgcattggcatcatcggggctaacggcggtggaaaatccacgctcatcagaatgatcaatggtctcggcgaaccaaccacagggcgtgttctagttgatggccttgacgtctcgcattccggacgggaagttcgcaagaaggttggatttgtcttctctgacgctgaaaaccagatcgtgatgccaactgtgcgtgaggatattgccttctcgcttcgccggcacaaaatgccacgcgctgaaaaggcgcaacgtgtcgacgagatgatggcgcgattcaacttgagcgagcatgcagatcaatcaccgcacaccctatccggtggtcaaaagcagttgttagcgctggctgcagtactgattttggagccagaagtgatcatcgctgatgagcccactaccctgctggatctgcgcaataggctgatgatcaaagacgtgttcaataaactcgagcagcaattaatcgttgtcagccatgatttagatttcctcagcgattttgagcgggtcatttgcatcaatgatcataaaatcgctgctgatggccctccgcaaaagtccattgacctgtacgtatcgcttatggcggaacctgcgaaatgaacagtattcctttaggtttttacgtcgataagcaatctgttgttcattcttttcctgctttgtggaaattcccacttctgctgtttttcatcatcggcggctccatcgcggcttctaccccggttcatgggttgattttggtggggattgcagtggtgttttacgtgctggcgaagattccgctgaaggtcgcgtgggagcagttgtggccagtgctgccgattttgatcatgctcggtgcgtttcagtggtggcagcgcggctttgatttcgcggcaaccacagtgctcacgctgttttccgcggtgatggccgccatgttgttgacgttgaccacgcggttggaagcgctcatgaatgcagttgagcggatgttgcagccttttgcacgttttggcctgccagtagagacgatcaccttggctatttctctcacgattcggctcattccgctgcaattagccacggtgaaggaagtcctcgatgcccgtaaagctcgtggtgccggtttttctatcgccgcgtttggcacgcctgtgatcatcagatcaataaagagggcccgcaatatcggcgatgctcttctcgcacgtggtgccggcgattaatttctttcaacacatagcaaagggggctcgtactaacgaaagtacgagccccgcttttagtctgctgtggcaggtttaagcctcgccgcgcagctcacgcatgcgctgtgcaactgcgtcatcagtgacgttgttgcccgctgcaggagcctcaatggactcctgcttgttaccagcggtcagggaaccaccagccatctcagcgcggatctgctcaaggcgggagtgtccagccatctgaacgccagcctgctcaacctcagccatgcggccctcaacagagttggacgcaagctcagcctggccaagcgcgttagcgtaacgacgctcaatcttctcacgaacttgatccaggttaggagtgctgccggaggtcaaagaatccatggacttcagggactcggaaaccttttcctgcatcttcgcctgctccagctggctcagaagcttggtgcgctcagcaaccttctgctgcaaagccatggagttacgctccacagccttcttagcctgatcagcctgctgcagagcctggtcgtggagctgcttggtatcttcaacggactgctcagcagtaaccagctgtgcagcgaaagcctcagcggcgttttcgtactcagtagccttcttgacatcaccgtcagcgcgagccttgtcagccagctggatagcctggcgggtgttgccctgcagcttctcaatttcagccagacggcggttcagctgcatttcaagctgacgctggttaccaataacagctgctgcctgctgggagagctcctgatgctggcgctgagcatcttcgatggcttgctggatctgtaccttaggatccgcgttctcctcaatcttggagtcgaacaacgccatgaggtacttccatgccttggagaatggattagccatgttgaaaagtgagccttcctaaatatctgaaacaggtaatttcgctgtattcatttatgcgatcattatccatgacgccacgtataccggcacaactgccttcacgccacatgtaattttagcggtatgaagttagcggaacctcgacgccgtccatattagcgctatgaagccaacaatgggcgtcgaaaagcaatcttttactgcttttcgacgcccacccatgcgcttagacgcgagcgaggtcttcctgcgctgcttgcagcgccatggaacctgcagcttcgatcaacacatccgcaacgctggcccccaaagcgtggcacacggaggcaagaagctcagaggacacctctttgcggccgcgttccaattctgaaagataaccaggtgacacacgtgaagcttccgccagctcacgcaaagtaacgcccttgtcagcacggaaagaacgaagagctgcacccagagcttcgcggagaagtggctctggagctttccgtggggcagattctgaaatcggcttgtctagaagggttgtataagtaaccatcgttaggttcaactccctttccctaaaatttgttcccagtttacctggaaacttgagtcactgcgactcaatatggtcaatcagcaggcgaaagctttgctgcacagcagactctctaatatgatgccgtcccaattcagccaatattacctgttgttcactttcaaacgcacgatacgcgtcaattgttcccgacgccccaaaatgcgcaggaccagccactccgatccacacttcccccaccggatgaccatcttgtttgctggggccagcaacgcccgtgagcgaaaccgcccaatctgcctggcatctgtgtgcggcccccgttgccatcgcacgggcgcactgcggggaaacaacgccgtgcgcgtcgataagctcctgcggcacaccggcaagcgcaaccttaagctcggtggcataggtgaccagcccgcctttaagtaccactgaggcgccggggatctctgcgatcgtcgcactggcaaggccggcggtgagggattcacaaaacgccagcgtttcaccgcgcgatttcaacagctccaccactcgccccgccagattctccgacatggtctagctttctgcggactttcgtgaatcccacaggtactgcagacccgtgaccacggtgacgatcagcgctgcatacatgacgatctggcttggaatatccatccaacttgggaaagggcacagatacagagcaacggcaacagtctgcagagcagtcttaagcttgcccccctttgatgcaggcacaacatttccagcgcgcagttggaagaaacgccagatggtaatgccgaactctcgaagcacaatcaacgcagtgacccaccagggcaaaatgccgatgatgttgaaacagacaaatgctgtggtcatcaacgccttatcggcaatcggatccgcgatcttgccaaagtcagtgaccaggccacgtgctcgcgcaatatcgccgtcaagcttgtcggtgatcatgagcaaaatgaaaacaaccaacgcccaccaggcaaaagcattgttttccgtctcacctttaagcgtaagccacgcaaacaaagggatgacaatgatacgcaagctggtcaagaagttcggaaggttccagttggaaggcttgaccgcttgattgcttggatcttgtgcgccatttacgcctgctgatacatcactcacggtgttccaccctacctgcacccaaattgaagactacgactagtaatgatttctccaaaaaacttgtcacaaagcttgagcccactctattcctaaaaacctctcgacggacgaagcgccacaaaagcaagagaagaatataagtgaaccaaattccgtttagtgtacgtctagacgcctaaacttacctgttatgacttattttgccgtgctttacacatacaacccagacagcgagaaagtcgctgaagttcgtaccgtccaccgcgagttcattgccaaccttcatgcggagggcaaaatcgttggctccggtcctttcgtggacggcgacggtggcgcgctgattgtcatcaagttggaagaaggctccaaccttgttgatgctgaaaccctgatgaacaatgatccattccacgtagaaaacgtgctggacaaccgcgtcatccgtagctggaaccctgtgaccaaagatttctaggcaactttttctttaacaattttggcgcttggcttgtatgaaagtcaggtgccttctcgcttgcctaaaccagcgttgctgcctaaaccagcgttgctgcctaaaccagcgttgctgcctaaaccagcgtcgtatggctaaagggccagcaccgaaactcctcggtgctggccctttattttaagtaatgctgttacttcttctctgaggagatatcggtaacggtggcggatccggtttcaggctcctcaccggtctcccagttgtcgccctcatactttgcagcgttccactttggtggaataccgccctggttttcgtcgcgtttgttcttgatgatggatgcgatgacggtgattgtcaggacaccaatgatgaagaccaaggagaacacggtggaaacctcaggtacggagacgttttcaccaccgttgatgaatggcaggttgttttcgtgcagtgcatgcagaccaagctttgcaccaatgaacagcaggataagacccaagccataaggcaggtagaccaggcggtcaagcaggccgtcaagcaggaagtacatttggcgcagacccagcagggcgaatgcgttagtggtgaacacgatgtaaggctccgtggtgatgccgtaaatcgctgggatagagtccagtgcgaacatcaggtcaaccatgccgatggatacaagtgcaacgaacagtggggtcaggtgcagcttgcctccgaagcggtgagtgagcttgtcgccgtggtagccctcagtaaccggaatgaccttgcgcagcgccttaatgatgaacatgtcgttcgggtcggtctcaggggtgtctcgaacttcgtcccacaggagcttcacagcggtgtagatcagccagatggagaagatgtagaagacatcggaccaggcttcgataactgcagcacctgcgaggatgaatgccaggcggaagaccagtgccagcgcgataccgatgagcagaaccttctgctggtacttgcgaggaatcttgaaagaacccatgatcagcgcgaagatgaagaggttatcaacactcaacgccttctctgtcacgtaaccggtgaagaactcaatgccgtgctggtgtgggttacctggctcgccccaagcaaaccagaggaacacgccgaaaacacaggcgagggctacgtagaagaggctccaccatgcggattctttgatagtgggctcgtgtggggtgcggacgtgggaatagaaatcgaaaatgaagaagccagcaatcactgcgatagtgattagccatgtggctaagtttacttccatgacaaaaagaacctccggttcttggttagacaatttaagaaccggaggtctcccccacccttgtccctcaacgcatctaacatgcatctgaaaaacaaaatgggccagtgtgaccgggaattcacaacctaaaattctttaaagtttgatttccgtgttgacgatcaacgctgcttgtggggtactcccctccaatacgggaaaactataacccagatggtgggaaattgctaccccgtcaccgccccgaagctaaaaccgcagaaactcaacccgacttaagcaaaaagaatcggacatgctcccacagttcaaagcagtctaaaaccgcaaactgtgcgaacacgcccgactcaacatccagagccactaggctcctaaagccttaacacactcccttggaaggatcagcctgcacgacggtggtgttagccgcttcttcagcttccgctgccacctcgtcatcccaggtctcttccttcggtgcgtcggcggggtctgcacctttaagcatccacaaaatggtttccagctcttctggcttgaccaaaacttcacgagccttagagccttcggatgggcccaccacaccgcgggtttccatgaggtccatgaggcgtccggccttggcaaaaccgatgcgcagtttgcgctgcagcatggaggtggatcccatttgtgaggtcaccacgagttcgactgcttcgaggagatcttccagatcgtttccgatatcggcatcgatcttcttagcttcggaagccttatcttcggtgacaccgtcggtgtattcaggctggcgctgagccttggccatgtccacgaccgcttggatttcttcatcggtgacaaaggcaccctggatacgttgtggcttgccggcaccctgtgggatgaacagcgcgtcgcccatgccgatcagcttttcagcgccaccctggtccaaaataacgcgggagtcagttagcgatgaggttgcgaaagccaaacgtgaaggaacgttggtcttgatcagaccggtcacaacgtccacggatgggcgctgcgttgccagcacgaggtggataccggcggcacgtgccttctgggtgatgcgcacgatggactcttcgatttccttcggtgcggtcatcatcaggtcagcgagctcgtcgaccacacacacgatgtatgggtacgcacggtattcgcgcttggatcctggaggggtctcaatttcgccagatttaatcttgcggttgaagtccttgatgtggcgcacacgggtttgtttcatgtccatgtagcgctgttccatttcctcaaccagccactgcagtgctgccgcggccttctttggttgggtaatgatcggcgtaatcaggtgtggaatgccctcgtatggtgtgagttccaccatctttgggtccaccagaatcagacggacttcttctggctttgcacgcgtgagcagtgacaccagcagcgagttcacgaacgccgacttaccagaaccggtggaaccagccacaagaaggtgaggcattttctgcacggagtaggacacgaagtcgccttcaatatccttacccaaaccaatgagcatggagtctttgttttccacggtggcacgcgcattgagcacatcacccaggcgaaccatctcacggtcagagtttggcacctcaataccgactgctgatttacctggaattggggtcagcagacgaacattctcagtcgccacagcgtaggcaatattggattgcaggttggtgattttagaaaccttcacaccaggtcccagctcaatttcatagcgcgtgactgtcgggccacgggagaaaccagtcacggtcgcatcaacattgaactcactgaacacgtcagtaatggcctcgatcatgcgatcgttggtctctgagtgaagcttcgctggctcgcctggaatcagcagatcggcactcggcaacacataagtgctgtcgccatcgctgacaatgtcggcaggggtcggcgctacaggagcaggtgccgcaggcttcttctccacgacgggatccttgcccgatcgcgcaataatcgcctgacgcatgctttccctcgacgctgccaccgcatccgacgccggcgccggcgccagatcttcctcggtcaccgctgggaactcatcagtttcggtgacgctgggcttcttcaagatgcttgtcgacgcctccctctgcttcacctgcggttccgcgggggcctcggccttcgcgtcatccacgggatacttatccagcgaggccgctgggcggcgcgcaggtgttggggctggcgcaggaactggtgccggtggcggagtcagaggtggggtgcgacgtggcgcagccttaggcagcgctcggctaggggttctacttggtgcacgaccgctcgcgcgggattccagctcgcgttccacgtgtccgtagagatcatcgtcttcctcgtcgaattcatcttcatcgcggttaaatcctgcgaagccaaagaagccacccgcaaattcgatgaactcacgaatcgaaattcccgtggttttcaacgctccccagaacagcagcagaagcaggatcggcaccgccaagaacacggagaatcccagttccaacggggttccaatccacgcaccgatggcaccgccagcagtctttcggccctcccactcagctgggttaccagcaaagaggtgaatcaaggccagcatgcacacgatgatcacaccgatgcccaacatcaccctgccctgagcttgacgctctggagtgtaacgaagcatgagcgcgacagcccacccaatgaggccgaccggcaagatccaagcaccagcgccaatagcgaggtgaacgatatcggcgatgaacgtgccaatcggtccaccaatgcccagccacaccgcagcgcccaagacaattgcaattccaaccaggcttaatgcaatgccgtctgcgtgctcttccacgtaggcagaagtgcggtttcctgattgctcatcaaaatcctcatcgaattccggctcaggttcaacagccttgctccgcgattttcgtgtggcgggtttcgttgcgatctcctcctcgaaatcatcaaaatcgtcgagtacatcttcgtttcgacgacgaccaagttcaccaatggaacgggtcatcttacccaagccactcgcggtggcaccaaatagcgttccgataccggatcccacagcgcgaaatgcgctgccggtccgttcttcagaagtatcagcagcgcgtcgagcggtcatcgatgttgtaaacgcagcagtctctgaccggccaccccgagaggtgctggttgttggtttgcttcgcctggtcgtcgcggtggtttttggccccgtcgactttcccgatgatcgtgagcttccccgcttgggtgcgccgtttctgacagtcatggccttaactctagtcgctcaaacaactctattcacagaagcaccacgcgattcgtccaagttttctataaacttccccgaacaacaccctcttgattgccttcaaatgttagtttcacaacatcacggccagacagccacaacagcagctcccctaccccaccgctaatccgacagacgttttcaccatcggccgacactccccgaccttcatgaagaacaatccgcggaaaacccaccggagctagaaccactggacgcggtgatttaatcatgcgtggagcaagaagttttaaaatgcggtgcagctctttgccatgtgcgtgctccatggggcgtacttctacctcatcacctggctgcaacgcgccacgcaggacatcttcatgatggatgaaatgctccatgctattgccaatagagtcaagggctcgccatggattcagcccctgcgggccttcagcccacgcgttgacaacatcctcatatggtcgggtaagcgcttcttcaaactcttcctttgcaggatcctgctttccaggaagcatgctgcgcagcgctgctcctggcttttgctcacggacataaaggtgtgccgcaagatctttggtggtccattcgccgcacaaggttggtgcgtctggccccttttccaacagtgatgcttgaagtgctgctcgttctgtttgtgcgagattcatgcaaccaagactagatcaatgtgtagaaacgcgttgagcccgcggcacccaggttgggtgctgcgggctcgcgacgtcgaaaagcgaaatgcttttacagggactcgcgtgaagcgcgaacctcatcgtcaccgatgtgcgtggtttccgcagtcatcggaatgacggttggcatgatgaccggctggcgcttccacttctgctcgacgaagcgagagagcttgcggcgcagctgctgaaccatgcggtaaggatcgttttcaccttcagctgcaagatcattcatggtggtttcggacagctcagtgacctcacccatcatggactttgcatcctcagagaaaccgctggtctgaacggttgggcgctccaacagacggccagtgcggttgtcgatgacagcagtgatcgagatcaagccaccctcaccaagcgaggtacggtctgcaaggatgtccgcgtcaatatcacccatggtgacaccgtcgacgtaaaggttaccaactggaatctgaccaacaacctgtgcgcgaccgttgaccatatcaaccacaacaccgttttgtgcaagcacaacgttgtcgcggttaacaccagtggagatagccagttccttgttggcgcgcaggtggcgccactcgccgtggacaggcatagcgttcttcggacgagcggcgttgtacaagaacaacagctctccggagtagccgtggcccgaggtgtgcaccttggcgtcgcgaccggtaacaacagttgcaccgatctgagccagcatgttgatgacaccgaacactgcttcttcgttacctggaaccagggaggaagaaaggataatcaagtctccatcacggacagtgatctgtcggtgctcacgacgcgccatgcgagacagcgcagccataggctcaccctgagtaccagtggtaatcagcatgaccttgtgaggagccatacgagaagcatcatccatggaaataatggttccgcgaggtgccttcaggtaaccaagcttctccgcaatctccatgttgcgaatcatggaacgaccgttgaatgcaaccttacggttggacgcaacggcagcatccacagctgcctgaacgcggtacacgttggaagcaaacgacgccaaaatgacgcgctgcttagcatcgccgaccaaacgcttcagggttggagcaacatcagcttcagatccagaaacaccaggggtggtggcgttggtggagtcacacagcatcaagtccacgccctcgtcaccgaaacgggacaatgcaggcaggtcagttgggcgtccatcaggaggagtctgatccagcttgatgtcaccggtgtggatgaccaaaccagcaggagtcttgatagcaagaccaaggcagtctgggatggagtggttaacagcccagaagcgaatgttgaacggtccgcggtcctcattggactgctcgttgacctcgatcagcttcggacgctgacggtgttccttacacttagctgcaatcagagccaaggtgaaacgggatgccaagattgggatatcgttgcgcagcttcagcagccagggaatagcaccaatgtggtcttcgtgtccgtgagtaaccaccaatgcatcgacgcggtgcaggtgatcctcaattgggccgaagtcaggaagaatcaggtcaacgcctggctcacctgaagatgggaagagcacaccacagtccacgatgagcagacggttgttgtactcaaacacggtcatgttgcgaccgatttcggaaatgccaccaagtgcgtaaatacgcagaccgtttgccggtgcctttggtggctctggcaggcgctgggtcagatccgcaccctgcatcgacttaacaacgtttcggcgtccgccaccgcggttgccacggtttccgccctgacggttctggttaccgctgttgttgttcgcgccctcattggcgtttccggatccacgacgtccacgaccaccgcgacggttgttgttggaacggttgcggttgttgtttccggactcgcggttctgggaaccttgagcgttctgggaaccctgagaatcttgggatccttgagcaccttgcgcagcatcccgattgtcgtttccggcggtctcagcttttacagcgctctggttagaggaagcatctggtgcctgaaagacaggggtatccagatggttttcctgaccagcttctggtgggcccgccttgcgggtaaccttccggccgcgatttcgggaatcattcatatttatagaactccagcttttttcatgtcttctcggagagcctcaagttcctgctcatttggagccataattggaagtcgaggatctcctacgttgatgccctgcagacgcagagcagcttttgccaagctgactccacccaagcgaccttgggcagctaccagcggtgatagtttggcgttgatttcccgcgcacggacgaggtcgccttcctcgaagcttgtgtacaactcacgtaatgctgtgggggctgcatgtccaattacggaaatgaaacctgatccgcccaaagcaagccaaacaaggtttagtgggtcatcgcctgaataccaggcaagtcccgtttctttgatcaatgacgtggctgcaacgaggtcacccttggcgtccttgaccgccaaaatcgtaggtaattcactcaggcgtctcatggtatcagactcaattggaatacctgaccgaccaggaatgtcatagagacaaattggaacctctgttgctgcagcaattgcaccgaagtgcgccagcaatccctcttggctcggcttggagtaataaggagttacaactaaaaggccgtctgcgccagcagaagcagcagcttccgcaagttccacagatgtccgcgtgttgttggttccgacaccggcgatgagcttcgcccgatccccaacttcctcacgaacggccttgagcagttctagtttttcagcggcggttgtcgttggggattcaccagtggtgcccgcgagaaccaaagaatccaagcccttatcaaccaaataagccgcgacttcgcggccagcagcgatatcgatgtctccggattccgtgaatggagtaaccattgctactccaacggtgccgaagtgctctactccggtcttagctgttaaacctgtgctcatagagttcaaggttaccttcttccctcatttgggggttaaacaaccccgcaaaaaacctaacaacttttgcataacaatcgcccaagccacattccgataagaacaattgacacgagcaagaggtttttacggctgtcttttacagccaaaaatgttgtcttaactatatgaatttttagctcgtgggtgtgagctttgcgttaaaagtccatgacatacgggcttgttgccatttgcgatccgtctgccaaagtttcaatctcaaaatcaccgaaaacagttggcgctgctacctgcagctttcttaaacattctaccgctacttcgcggatttcgacgtctgcatgttcactggctcgcatgccaatgaaatgcctccaggtgcggaagtttccagacaccacgattctggactctgtagcgttgggcagcacagcgcgagctgcttgacgagcctgctttttccttaaaagtgcattcggttcatcgccaagtttttcttccagcgcattaagcagctcattgaaagcgaaccgagactcatccatggcgtgcatgaaaagttcacgcaactgcggatcttcatcgatgagagtgggcaccactacttccgattctccgctgtgcacgaaacgctgagacagttgagagaaggaaaaatggcggtgtcggaccaattcatgggtcgcggaccgagaaatgcctcggatatacatcgtggcattggcatgctcaagcaaagcagtgtgccccacttccatgatgtggcgcagatacgcagcattggaagcagttcgagggttcggcttatcaaaagtttcgtagcaggcacgacccgcaaactcgacgagtgcttccgcgccctcaacatcagttgaccactcaacatcagcgggtggagtaaaagaactgcacgctatcaactccacgctcaatttaacttgttcggccacagcctttaaacgctccttttaaaaaattccacccgctgctgaaatgagcctttacaggcctaggtaatgctcaagtcctacgactaggcctgggtgctgtgcaatgttgcgcacacccaccaagacacctggtgcaaatgagttgcgatcataggagtcctgcttgatggtcaaggtctgaccctgggtgccaaagataacttgctcgtgagcaaccatgccggacatgcggactgcatgaaccgggattccatctacgcttgcgccacgggaaccctcaagtgcctgctcggtcgcatctggctgtgcgtccatgcctgcttctttgcgtgccgcagcaatgccctgagcagtgtggatcgcggtgcctgaaggtgcatccagcttgttggggtggtgcagctcaataacttcagctgattcgaagaagcgggcagcctgcttggaaaagaccatggtcaacaccgcagagatagcaaagttaggtgcgatcagaacaccgacattgtcttttccttcaagccagtcgcgaacctgctccaaacgagcatcatcgaagcccgtggttccaacaaccgcagaaatgccgttgttgatgcagaactccaggttgcccatcacagcgttaggagtggtgaagtcaacgacaacttcagcgccgttgtctaccagaaggctcaaatcatcgtcgacgccgatctctgcaacaagctccagatcgtcggactcattgactgctgccacaatagtttgaccaacacggcctttggctccgagaacgccaaccttgattcccattatgctccttcattttcgtggggcgaagagtttttcaaacgcccaccagtctagacgtacccgttcagaaggtgctgatatccatacctaactgaccgttttggtctgtgttgttaacgattgttcatcagtttgttccgttctagggattaatcacacaggtggaactatgtttgaaatatgagacttaagttgcccttcaccgcccgttccgcaggtagttccttggcgcttgtggtttccgcctctttacttttaagtgcttgtgatggaagcggctcaacgcctacaacctctgctagtcctgctccagttgtgacagaaactgaaaccgctaacccggtcaccacaactcgcacgccttcagatgctgccccgtcgcctaccacttcagagcccactggttcagagtccaccaactccccttcccccactgctttgccgccgttgggttccccgtcgatggatcagaagcagcaggctcaagttggtgactccgatatgtcgatcgctggcatccgcgttgccgagcacgaaacgttcacacgagttgtttttgatatcgccggtaatggccaacctggttggtgggtcgattgggccactgatccaattcagcaggcgtcaggtcttccagttgagatggctggtgattccttcctcaacgtcaatattcaaggcactggatatcctgatcaggttgtcgttccaggtatcgataccggatcatatcctggtgcaggcattgttgaagacatcaacttcaccagtatttttgaagcccgttcccaagttctcattggtgtatctggtcaaccccgaaattactcggtctcattgctgcaggaaccaaccaggcttgtggtggacatcgttcactagcgctggaacgccgtcaactacagatagaaaaatgtggcgctaaaacctcgcaataaggttttagcgccacatttatttttagcccgatctagcccgatctagccagaactaattagtcctcttcaacaactgggaccaaggagatcttgccgcggttgtcgatgtcagcgatttcgacctgaatcttctcgccaaccttcaccacatcgtcgaccttttctactcgcttgccgttacccagcttggagatgtgaacaaggccgtcgcggcctgggagcaaggaaacgaatgctccgaatgcggtggtcttgacgacggttccgaggaagcgctcgccaacctttggcagctgtgggttcgccagagcgttgatcttttcgatcgccgcttcagcagatgcgccgtcagctgcagagatgaacacggtgccgtcatcttcgatggagatgtttgcgccggtctcttcggtaagagcgttgatgttcttaccctttggtccgatcagctcaccgatctttgccactgggatcttcacggtggtgatgcgaggagcgaacttgctcatctcatcaggtccgttgatgacatcagccatggtgttcaggatggtcagtcgggcatcgcgtgcctgctcaagcgcatcggagagcaccttggaaggaatgccgtccagcttggtgtccagctgaagtgcggtgatgaagtctgcggtgccggcaaccttgaagtccatgtcgccgaatgcgtcttctgcgccgaggatgtcggtcagtgcaacgtactcggtcttgccgtcgatttcaccggaaacaagtcccatggcgatacctgcaacaggtgccttcagtggaacaccagcgttgtacagggacagagtggatgcacagacagagcccatggaggtggagccgttggagcccagagcttcagagacctgacggattgcgtatgggaattcctcacgggatgggattactggcaaaactgcgcgttctgcaagtgcaccgtggccgatttcgcggcgctttggtgagcccacacgtccggtttcaccggtggagtatggagggaagttgtagtggtgcatgtagcgcttcgcatcgcctggtgccagggagtcgatttgctgttccatcttgagcatgtccagggtggtgacaccaaggatctgggtctcgccacgctcgaagagggaggaaccgtgcgcacgtgggatgagctcaacttctactgccaggtcacggatgtcggtgactccgcggccgtcgatgcggaagtgatcggtgaggatcatgcggcgcacgatggccttcatgacagcgttgtatcctgcacggatttccttggacgcttcagctgctgagctgtaggaagcctcgaactttggaagcagttcggcttcgatttcttccatgtaggcgttggtagcgtcgtcgcgctcttgctttgccttcagggtcagcaaagaagctagcttcttggataccttgcgctccactgcggagtacacctcgtcggtgtatggagggaacagtgggaattccttggctgcgtttccaacgcgctgtgccagaccttcctgtgcgcggcacaggatgtcgatgaatggcttagctgcttcaaggccgtcggagacgatcttttcggttggtgctggtgcaccgtccttgacgcggttgacaacgttttcggaagcgccagcttccaccatcatcactgcgacgtcggagaaggtcttgttgccgcgcttgcgctcgacgaggcgaccagccacaacgatttcaaatacggactgctcatgttgagcgtgggttgggaatgcaacccattggccttctgggtgcttttcatcaacaaccagtgccatgcgaacgccaccgacagcgccggagacaggaagtccggagatgcgggttgctgcggaagctccgttgattgctacgacatcgtagtaatcctcagggttcatggacatgacggtgacaacgatctgaacctcattgcgcaggcccttaacaaaggttgggcgcagtgggcggtcgatgagacggcaagccaggatagcttcggtggatgggcgaccctcccgacggaagaaagagccagggatgcgaccagctgcgtacatacgctcttcaacgtccacggtcagtgggaagaagtcaaagccctcgcgtggctggttggatgcggtggtggttgccagcagcatcgtgtcatcgtcgaggtaggtggtcactgcaccatctgcctggcgggcaagttggccggtttcaaaacggatggtgcgggttccgaagtcaccgttgtcgatggttgcgacggcctcgatcaggccaaattcggtgtcttcgaagtactttacatcgctcatatgcgagtaggtctcctcatgtttagttctgctcggcgatcatcggtgtcgccgcgaagatttctgcggtctagaacggtaaaaaccttaccagttctctccagttttccccactatcagttttagcgctactcgacacgagttttattcaccaaaaccggtggcaggaaacgcgagaaaacccgcttccccaccactttaagaggcaaggaaacgggtttaaaagactggaaaaaccaggcttatcgacgcaggccgaggcgtgcgatcagatcacggtagcgatcaacgttgttgtcagccaggtacttcagcagaccacgacgacgaccaacgagcagcagcagaccacgacgggagtggtgatcgtgcttgtggaacttgaggtgctcggtgaggttgttgatgcggttggtcagaagcgcgatctgtgcttctggggaaccggtgtcggtctcgtggaggccgaactcggaaaggatggacttcttctgctcagaagtaagagccatggtgtctcctaaaagttatttcagtccgcatgaaaaattttcactcattcatccaagataaacccggatgatgtgtgtacttttcacaactgctgcggaccgcagtcgcaaaaccaccttggaagcttaacagcttggtggtacttctccaaaaaccttcaccagagctgcttttactgctgtgctgcgactcggccgatgcgggtcatgaattcagaaaggaaacgatccacgtctacggcgacagctgcgcgggaggtgcgcactggatcgttgaggcggacttcatcgccaatggtgcgtccacgggtctcgccctcaatgtctaccttgaggttgatggggagcaaagtgaccaggcttgggtccactgcaacgcctactgccagtgggtcgtgcaggccgcaaccgcccaggtgtggtgcggtggtctcatatgccttgatgtagtaatcagtcatgtcggccagtgcgatagcagctggagtgcccagttcgcgccactgcgcagtgtgcttcttggtaagaagggtctgcagggtgacatcaagaccgatcatggtgacatctgcaccggaacggaacagatcgtttgctgcatctgggtcctggttgatgtttgcttctgcccatgtgctgacgttgcctgggacagtcaaggcgccacccatgatgaccacgtgagccttggaagcaaagcttggatcctttgcgattgccgcagacaggttggtcatgggaccagttgcgatgatcaccaggtcatcgccgtgggtgttgacggaatcaatgaggaaatccactgcgccggggagtgcctttgactcgcttgctggcagctcgacttcgccgatgccgttttgtccgtgaatgaacgcggagatctcaagaacttcaaagccatccttggtctgtgcgtgtggctcacccaagtacacaggtacttctggtgcaccgaacagatcaagcagtgccaggtcattgactgcaccggtttcgagtagcacgttaccgtaggtggtggtgacaccaatgagctctagttcaggtgagcccagtgcgtaggcaagtgcgagggcatcatcgatgccggtgtcgatatcaaggatggcttttttgctcatgcgtttttaacctttcaggtttttatttttaaggtcgggcaccatcataaggcacccgatgtgacaagcttgatggccggtgaccggccttaagcgctgggctgggtgtcggcgtcgagaagcaatttgtctttggcaaggatgtcgcgggcgttggtgacatctcgggccatggcgtctagtagctcgtcgacgccgttgaatttgaccatgtcgcgcaagtgtcccacgaattccaccatgacatggtgaccgtacaggtcggcttcctggtcgaggatgaatgcctcgacgctgcgtcgctcatcgccgaaggtgggattggtgcccacggaaatggcagtttggtaacgcacgcctggaaccatggtgccgtcgatatcgcgggagatttccttgtcgatttcgcggtcatcggtgatggtgaaccagcctgcatacacgccatcggcgggcagcgccacagaggtcggcaggtagagattcgcggtgggatagcccaattctttgccgccacggccagcaccacggacaacttcgccgcgcacggcatagcgtcgaccaagcgcccagttcgcgcgctcaacctcgccctgatccaagtaatcgcgcaccaaggtggagcaaatacgctggtcatcatcatgcagcagcggagcaatcgtgacattcacgccaaacttttgtcccaattcccgcatcgtggactcagtgccagcgccattgacaccgaaggtgaagttctcccccaccacaactgaacgcgcatgcagcgtatccacgatcatggttgtgaaatactcttcagcgctcagacctgcgagttctttagtgaaatcaataaccaacgcagcatcgacgccacattccgcagccaaattaaggcgataatccaaaggagccaaacgggttggctctttacctggcaaaaacacagcgatcggatgcgggtcaaaggtcaccatgacacaaggcacacccagctcctcggcctgcttcttggcctcgccgattaaactttgatgcccccggtggagcccatcaaacacaccaatggtgactactgatccttgaagatcagccggaacgctgtctagtccactccaaatatccactgttttagactacggcatagactcaacagacatgaatgctcctgcccctaaacctggactcgtgatcgtcgacaagcccgccggaatgacatcccatgacgtggtgtccaaattgcgccgcgcattttccacccgcaaagtaggccacgcaggcaccctcgaccccatggcaaccggcgtgttagtcgtcggaattgagcgcggaacccgcttcctggcacacatggtggcctccaccaaagcctacgacgccaccattcgactcggcgccgccaccagcaccgatgatgcagaaggcgaggttatctccacaacagacgcatccggcctcgaccacagcaccatccttgctgaaatcgtcaacctcaccggcgacatcatgcaaaaacccaccaaagtctccgccatcaaaatcgacggcaaacgcgcccacgaacgcgtccgcgacggcgaagaagtagacattcccgcacgtcccgtcaccgtcagcgtctttgacgtgctcgactaccacgtcgacggtgaattttatgacttagatgtgcgcgtccactgctcctccggcacctacatccgcgcgctcgcccgcgacctcggcaacgctttgcaggtcggcggccacctgaccgcgcttaggcgcacagaggtcggcccttttacgcttaacgacgcgacccccctctccaaactccaagagaatccagaactctccctcaacctcgaccaggcactcacccgcagttacccagtccttgacatcaccgaagacgaaggcgttgacctgtccatgggcaaatggttggaacctcgcggactgaaaggcgtccacgctgcagtaacaccatcaggaaaagccgtggcgctcatcgaagaaaagggcaaacgcctggccaccgtgtttgttgctcaccccaacactctttagttggtctgccagaagccgatttaagaggtcgaatttcgctagataggtgtgagtgtggaaagagcggtttggagggcttaaacgcgattctgagagggcactatttcaggtgggctgtggaaataaaccaaaaccaactccgccaatccaagccttggtttcaaacgcacatttccagaccagcaaagtgtcattgcagaccaaagacgccccgaaaaaggggcctcttggtctaatattcacggttgctgtacgtgttgaaagctagaagcgcttcttaaacgccgtgccgtgcgaggcatccaccaacctggctttcagctcacccaggtatcctctccatccagttcaagtcactgcagtcgcagctatgacataaccatcacgcagtacccatttacctgaaataaacggcactggagttggtcgaaccagcaaataggacacaaaagtgccatcatcacgcaagtcgatctcagcttgttcaaaaccaagccacctatgcgtcagcgggaaccacgctttgtatgttgcttccttggcacaaaacagcaggcgatccgcgcagtgcacaccttgttcctccaagcgcttaagttgaggaatctcccccacccgagcgattgaacccaaaacatccttgggcaacggctccgcaggttcggcatccaatcccatagaacgcaccaacaatcgtggcgccacaacagcagctcggaatccgtcagtgtgggtcaatgaaccagacaccgaagaaggccacaatggcattcctcgttccccacgcaaaatgggatcaccgctatctcgtcccaaagcttggagtgcctgatgtgcacaccacctggcatctccaaactctgcttttctaatatcaaccgagtgcgctaccagtgccttttccaacggatgcaactgatggaaatggtctaaattaacagcatcgccagttttaatgaaagaaaactttgccgaatttggaaacaaagactcatccagcattgtccacctccatcactggatatggccacacatgctgcccagaccaatgctcccattcgcgcggataacccaacgacacttcaatgtgtttcacaccgttgacgttggttattccgggcatatgcagatgaccgtaaataacggcttccgcgttgtagcgttcggcccatcccctggtgtggcgagtaccgcaccacaatgcaagttcctgccagcgcatctgataagtcggttccaccaccagcggccagtggttaatcaaaattgttggcccgttgatcttgctcaaacgcttaatggaataggctaagcgatcccagcaccacgctcggatatcaacaaaaggcgcaatagaaaactcatcagtcatcatcacttgacgatcccgcgccgcttgcacagcctgctccacggtgaaaccaggtcgacggaacgagtagtcatagagtgtaaacaacggaacgatagtaaccccaccaaaggttaagtaagggtcctccggagtcaacacatcaatcttgcggcagccttcaacgagttcagagtacttatcgcgcccctgatagcggtccgcggagcgagaaaacaactcatggttacccggaacccagatcaccttggcaaagcgcctgcgcaaacgtgccaaaatttccagcaccaattcggtacgttccgccacgtcacctgcaacaatcaaccagtcagacggatccttaggctgaatattctcaattggatcagcgttagctttcaccgctgcatggaggtcagaaaccgcccacagagttgtggtcacctgtcacctccacatagttgttgctaaaagtctttgtccattatgcctgcagtccagcaaatgtggtttgccacgcgccgaagctaacgcgcccacttcatagacttaaaccgccaaatcaccgcaaatagtcggatcagaataaacgccagcaaaccacaccacacgcctgtcagccctgcatctaatgcataggaaatccagacgcctggtaagaatccgaccacaaccgccaagatagaggcatttcggaggaacaccgcgtcagcagcacccaacagcacaccatcaatagcaaagacaatgccacccaaaatgatcatcgcgaccatgatccaccacggggaagcaatcgcatctaaaacgtcggcgtcctgagtgaaaatacgcggaatccacgagtgtaagaccacgaacaccaaacctaagccaccagcgaaaatcagagagtacttaatcacctgattacccaccctgcgggcgaccttcgcagttccagcgcccagggctgcaccagttaaggtctgcgccgcgatagctagagaatccagcaccaatgtgatgaaattccacagctgaagcaacacctggtgggccgccaaggatgccgtgccaaatcgtgcagccacagcggccgcggaaagaaaagcaacctggaacgacattgaccgcatgatcaaatcacgtccaagaaccaactgatttttcatcaccgtccagctcggcttccacgaaccttcgtggtgcttgatcaatgcacccaaaaacagcgaagcagtaattgcttctgcaatgaggtttgcccaggcagagcccacaagtccaaacttagccacgaatatcggaatcaagatcgcgccggggatgactcccgccaaggtgaaatagagtggcagcttggtgttttgaatacctcttaaccaaccgttgccagccatgatcatgagaattagtggcaccgcaaaagcagcgacccggagccaatgccctgcttcttgggctagagcttcatcaccactgagccacaacgcgaaagtcggggctccaatgagcatcagcgttaagatgcccaagcctacaaagagtgccacccaggttgcttgcacaccttcggcaattgctccccggcgatcacccattccgaaaattctcgatgatctcgcggtagttccataggacaagaatgtcagctgtgttgtcacttgagcttgaattgttgttgctgcgcccaacgcagccaattcgaagccacccaaagtgccaacaaccgctgtatccaacaagagatacagcggcatcgcagctagaacacccagtgcggggaacgcgagcccgaagatctgctttgcagaaacatcatgggactcatgctcaaagtcgttgttagacatcgacatgcgccgagcttcgcaaagactcccccaaggtaacggttgcttcaatcaacgtatcgagggcttcgatttccgtaccacgagcggtatagcctgcagcaggaatgtgtccgccaccgccaagatgcactgccaaggaagcgacactcaaattggaggaacgcagtgacacggtatagacgccacgttcatattctttgaatactgctccgaagtctgcgccttccacagcgcgaaccatttcgatcaagccttccacaacggcgcgtgaacggccgttgatggtatcgaagtctgccacgagaacagcaagagtatatggccctgcttcccgcagctcgatccgagagacaatctggccaacaagacgcaaatcatccacggaggtttgatcaagcaatgctgatgaaatggcacgaatgtctagaccgaactccatgagttctttagccatgtcatgcatgactggtcgaccccacctgaagcacccggtatcggtgagcagtccagcataaaggccgtgggcgatatcgggagtaatttgcaccgacatcgcatcaaaccagtcatataaaatcgtggtggtggattctgcctccacatcgattaagttgacggcaccaaacccaggattggtggcgtggtgatcaaccaccaatactttgtcaggattgttgacgatgatgctttcaaacgcaccggtgcgttcgattgacccacaatcaacaacaatgatgaggtcagattccggcagtgaatcgccaaacttaatgtttgatgccccaggaatggtgtacaagttctcgggcatcgaatctagctggccgattgcacctacggcgtctttaccaagttgctgtagtgccgccactgtggcagctacactgccgattgcatcagcatcgggtcgcagatgccccacaacgctaaccgtgtgagctgcctggactaatgctgaagcagcatgaaactgactattatccgtcactggtgttattcctcagattcagacttggatgaagtcttgtaaggatctgcatcacctgcaggcgctgcaccttcgcgcaatttagccagctcctcatcgcgcttgcgagcacgatccaacaaagcttccatgtgtgcggatgcctctgggacggtatcgatgctgtaagtcagggtcggggtaaaccgaacacccagctgctggccaacgatcttcctcagctggccgcgtgctcggtgaagagcctctgctgctgcctcaagatctggttcttcttcaatggaagctccacgaacggtgtaaaacacctttgcatcgtgcaggtcaccggtcatggtcacatcagtaattgtgacgaactcaagtcggcggtccttgatatcgcgttcaatggcgctggccacgatagtttgaatgcgctttgccatacgagccgcgcgggcgttgtcagccatggtggaccactcctcatcttcacagagtcgaaataattcttttggaattctaccctgaattggaaaaattttaataagtttatctaccctgctattcctagcttaaaaggtaggaacaaaacaggtgtgcaaaggggctggccttccgttggaaagccagccccacgtgcatgaccccgggctagttatgccccgagccggaaatgcttaagcttcgcgtggaacctcaaccatttcgtagacctcgatcttgtcgtcgacggagatgtctgggtaagacagaaccataccgcactcgtagcctgcagagacttcggtggcatcgtccttctcacggcgaagggacacgatctttgcattctcggcgatgacgttgccgtcgcgaataatgcggactgtggcgtttcggcgcaccttgccgtcttcaaccatgcaacctgcgatgaggccgacagaggaagccttgaagatcgcacggatctcagcatgtccgataacgcgctcttcgtagattggcttgagcatgcccttgagggccgcctcgacctcttcgatagcacggtagatgatcgtgtagtaacgaacatcgacgccttctgcgtttgcttcctcagttgccttaccttcagcgcgaacgttgaaggcgatgatgacagcgtcggatgcagctgcaagggtgacgttggtctgggtaactgcacccacaccgcggtcgatgatgttgagctggacttcatcgtccatctcaatctttagcaatgcttcttccagtgcttccacggaacctgcgttgtcgcccttaagaatgaggttaagggtgctatgttccttaagaactgaatccagatcctcgagggagacgcgcttacgggagcgtgctgccagagcgttacgcttgcgggcgttgcgctggttagcaatctgacgtgcaatgcggtcatcttcaacaaccagaaggttgtcgccggcgcctgggacaccgttaagaccctgaacctgaacaggacgggaaggtccggcctcttcaacgtcgcgtccgtattcgtccaccatgcggcgaacacgtccgtaggtatcgcctgcaacgatggagtcaccgacgcgcagggtaccgcgctggacgataacggttgccactggtccacgaccacggtcgaggtgagcttcaattgcaacaccctgtgcgtccatttctgggttagcaacaaggtcaagctcagcgtctgcggtcaggcagacagaagcgagcagctcatcgatgttcagtccctgctttgcagagatgtcaacgaagatggtgtcgccaccgtactcttcagggatcaatccgtattcggtcagctgaccacggatcttctctggagaagcttctggcttatcaatcttgttcactgcaaccacgattggtacatctgcagccttagcgtggttgattgcttccacagtctgaggcataacgccgtcgtctgctgcaacaaccagaaccgcgatatctgtggactttgcaccacgggcacgcattgcggtgaaggcctcgtgacctggggtatccaggaaggtgatcgtgcgctcagtgtcctcgacatttaccttgacctggtatgcaccaatgccctgggtaatgccgccggcttcgtcggagcccacatttgccttacggatagtatccagcaaacgagtcttaccgtggtcaacgtgacccatgacggtaaccactggaggacgcttagcaaggtcagcctcgccaccttcgtcctcaccgaactgaaggtcgaagctttcgagcagctcacggtcttcatcttctggggaaacaacctgaaccttgtagttcatttcctcaccgagcagctgcaaggtttcatcagaaaccgatgcagttgcggtgaccatttcacccaagttgaacagagcctgaaccaatgctgctgcgtctgcgccgatcttgtcagcgaagtcagccaaagatgcaccgcgcgcgaggcggatggttgcacccttgccgtctggcaaacgaacgccaccaatgacgttcggtgcctgcattgattcgtactcgttgcgcttctgacgcttcgacttacgtcccctgcgtggagcaccacctggacggccgaatgcacctgcggtaccgccacgacgaccgccacggcctgcgccgccaccggttccgccaccacggttgaatccgccaccagcgccaccgccggcttggccaccacgaccacccttgccaggtgccttagcaggcatctgacctggggttggaggcatcattgctggggatggacgacgtccgccaccttgacgctcctgggaaggtgctccctgagcaccctgagcggagccaccctgtgggcgtgaaccgccctgagggcgtggtccaccctgtgggcgtggtccacctgcgccagcgccttgacgctgaccgccgcggttaccctgaccatcacgctgtccgtcgcgctgaccatctcgctggccacctggacgaccctggccctgtggacgtggtccaccgcctgggcgaggtccgccaccaggacgtgggccgccacctgggcgaggagctggacgctcgccaccaccggtggagaatgggttgttagctacacgtggtgcacgtgcgcctggctttggagcaggcttgcccattggacgtggcatgccgcctgggcgaggtgcttccgcgcctggcttagctgctggctctgccttcttagctgcatcgcctggagttgggccagaaaatgctggcttagctgctgctgcaggctttggagctgaacctgacttagcggcagaaggagctgcaggtgctgctggctttgctggagcgcctggcttagcggctgctgcaggctttgcctgaacgcctggcttaggtgctgcgcctggctttgctgcagaagctgcagaaggagcagctggggcaggctttgctgcaggtgctgcaggttttgctggagcacctggctttggagctgctgacgcagctggttttggcgcagcaggctttgccgctgcaggcttcgcagcggtgtcggacttatccgaaccgctcgaaccgtagtgctcctgcatcctcttcacaactgggggttcaattgtggatgatgcggttttaacaaactcgcctttatccttaagggtggcaagtagttccttgctggtaataccgagttgcttagcaagctcatgtacacgtagctttccgggcacttctctcctctagttcttgccagaggttcgaaggcccttaaaaggtaagggacctttgacctctagcgttaattattgacgttcatcgctgatgcttcatcgtgtgctcatcagtgttcagtcttccttacaaaaatcgggtccggcgttttccgccaggtacgtgcgtacgtgacctgtatccacggttgtggacaccctcagcgctcggccaaaggcgcgacgctgttcagcaaggtccagtgcgtcgatggaaggggtcaaccatgctcccctgccaggcatccgacgtttcggatctggaaggataactcccggaagctccggggattgaactacgcggagcagttcagaatcaggtttacgttccctggtggcaatgcaagtacggatccgaattgggttgaagcgagacagttgtccagatgaagcttttaatgcatcgtcatggaacatctgctgcgttcaatccctttcaccgtttttcatttgaccagaacgtgaatgcacgtcctccacagcccgcacatgggccttgaacaatattacgctacattgacccaaaattggaacctgcaactaattacaaagttcctatatggccttgtgagcccaaaaccggtacgagattttcatgccggttcaagcgacttttaatcgatgtcagagtggatgtcgatcttccagccggtcaggcgggcagccaagcgggcgttttgaccttctttaccgattgctagtgaaagctggtagtcagggacagttacgcgcgcggtttgagcttcaagatcggtgacctctacgttgacaaccttggatggtgccagtgcatttccaacgaaggttgctggatcttcggagtaatcgatgatgtcgattttttctccaccgagttcacgcatgatgttggacacacgctgtccacgtgggccaatgcaagcgcccttggcgttgaggttcttcaccttggcttgaacagcaaccttggagcggtgtccggcttcgcgggagatagcaacaatttccacggatccgtcagcaacttctgggatttccagttcaaacagtcggcgcaccagctcagggtgagtacgagacaggttgatctggatgtcagtgttgcccttgcccacgccaacgacgaagcacttgacgcggtcgccgtgcttgagcttttcgccagggatctgctcggctgggagcaaaacgccgtcttggttgtccgcttcggtacccagctgcacgatgatgattccgcgttcagctgcgcgggcatctgcttgaacgatgccggacacaacggtgccttcataatctgcgtacgcatcgaatgctcggcttgcttctgcttcgcgcagggacttaacgatcgcgtcgcgaacagcgcgggcgctgactcgtccgaagttggatggggtgtcgtcgtattcggaagcgagctctccgttttcgtcgaattctgagacgatgacgttgaccgtgccagttgtggaatcgatgtccacgcgtggtttcaggttcgcagacgcaacagtttcgcgattatccatgtacgaatgcaaaagtgcagaggcgatggtgcgcagcaagtctggaactgggattcctttttcagactcgatggcttttaaagcctggacatcaatattcacttgtcttcctctcaagcttccaccacgtactgtttacgcggtggcttcgtcgaatgtgctttctgcgagggcagtctcatcctgcgcaggtttagcgaattcaatttctaccactgctcgaggggaatgtgctaattcaagggttgtgacctcgagcaactttttattccgctcgatcaaaacaacgtgagtttcggcgtcgttaagcgccccgatgcgtgctacgcgctttttgccatcctgatcaagcgcaaccaggcgaccgcggtttctgcgccaatggcgcggcagcgtcagtgggttgtccacgcccggcgtggacacttcgagcgtgtaacccgctccgaagttgagctctccgcgctgctcggcggcgtcgaaaagctctccgatttcttggctgaatacttccagctggtcgagatcggggcgggaatccgaatctaccttgatggcgacggcggattttggacctgctttggtcactttcaggccctcgaggtcgaatttgtgggatgcggcgagcggctcgatgagcgcagacagaatttcagtggttggaaaagccataaagacaaggataacctgccggcaaaaatcatcgggctattacactgtgaagccatgcgtaggcgtatcccctctgtccttggtgtttctcttctggctgcctttttggtggcgtgcaccccctcccccaatccgaatgcggcgttggcccagatgtatcaggatgcgctttttgattcccaggcgatgtcagaggccgagcctgagcttgccactttgcgcagtcagcacgcagatgaattattggccgagattcggcgtatttgtggctttgatgaaggccaggttccggaatcgtgccaggtaacggttcctgcgatcgctattctgcccaccgatgatccagagaagtatgtcaacgacagtcaggcgttgatccttgataatttggatgacattccggaagattccgtggctttagtggttgagcaatacatcgcgcaggcggaatttgctgaaggatctgaggtgtccgttcctgttgatttggagctcaccgaggcagaattagctgctgcgaaggacttggcggaccgcgagttttccgccgcgtggtctttgggcgtggctttggctcagcttccggaaaccgaccgcgaggaggtggaaacggcgatcagcaaccaccatgaccgcgcgtcgcagctgcaaattattacctccggcactaccccagcgccaggttacgtgagcgagctgcccgaccccaccgacgagacttcagcgcgaagcaacattgaaaccgtcgaaaacaacgtcacccaggcctggcatgcagctgcaagcgccgcaaccaccgacgcctggcgtgtcttctgcgcgcacatcgccggcgataccgcacgcgaattaacgcttatcgacgtctcctagcagtttcactgccaattttttaagcctaaccctctgcataattttctttaagccgtgtaatatacacggcttttctgctttcaggccaagttttcctccgcaaattcacgaaagtttgcgcaatcgttttcgcccacgccttccccagtacacattccgttcacactatttcgggggtagggcaaataacgattcatctcacaaatttctatcaaactatagaaagatatttgcaaaattggcacaaactcccagctcgctccgaaaaacctagcaacttagttaattttccctcacaaaaatttaggacacagatctccattcaagtttggctgtgactcatgtcgcacatagtatttcaatcaccggatccgcacgattgcaaaatcctggggaatattcataacaacggaggtcactcatgactttgaagaagtctctcgctgtaaccacggcggctgcacttgctttgagccttgccgcttgctcgtccgactcctcgtccgacagctcctcatcctcatcaggcagcgaaggcggcgacaactacgtcctcgtcaacggcactgagccacagaacccgctcgtcccaggcaacaccaacgaagtaggtggcggtcgcatcgtcgacagcatcttctccggcctggtctactacgacgtcgacggctcccctgtcaacgatgttgcagagtccatcgaactcgaaggtgacaagacctaccgcatcaccatcaaagacggccagaccttcaccgatggcaccccagttaccgctgagagctttgtcaacgcatggaactacaacgtagctaacagcacgctgtcctcctacttctttgagtccatcctcggctacgaagaaggcgtcgagtccatggaaggcctccaggtcgtcgacgacaccaccttcaccgtcgagctcacccagcctgagtccgacttcccactgcgcctgggatactccgcattcttcccgcttcctgaatccgcatttgacgacatggacgcattcggtgagaacccaatcggcaacggtccatacaagctccaagagtggaaccacaaccaggacgccaccatcgttcctaacgcggactacaccggtggacgccaggctcagaacgacggcgtgaagttcatcttctacccaaccttcgactccgcttacgcggacctgctctccgacaacttggatgtgctggacgctatcccagactccgcgttctcctccttcgaggacgagctctctggccgttccatcaaccagccttccgctgtgttccagtccttcaccatcccggagagccttgagcacttctccggcgaagaaggcgtgctgcgtcgccaggccatctccttggccgtcaaccgcgacgagatcacccaaaccatcttcgaaggcacccgcaccccagcgacggacttcacctcccctgtcatcgacggacactctgattccctccagggcgcagatgtcttgacctacgatccagagcgcgctcaggaactgtgggcacaggcagacgagatcagcccttggtccggcgagttctccatctcctacaacgcagacggtggacaccaggcatgggtggacgcaaccgccaattccatccgcaacaccctgggtatcgacgccatcggcaacccatacccagacttcaagtccctgcgtgacgatgtcaccaaccgcaccatcaacggcgcattccgcaccggctggcaggcagactacccgtccttgggcaacttcctcggacctttgtacggcaccggtgcaggctccaacgatggtgactactccaacccagatttcgatgccaagctcgccgaagcagcaaacgcggccgatgttgacgcatcaaccccgctatacaacgaagcacaggaaatcctgctccaggatctcccagcgatcccaacttggtactccaacgcagttggtggatactccaccaacgtggacaacgtggaattccagtggaactcgcaacctgcgtactaccagatcaccaagaactagtagcttcgcaccacccgctcatcttgtgtgagctctagaagaaaggcccaggttaatgttcaccccgacctgggcctttcaccttgaacacttaaaacataacttcatccggcgctttattagcttgaagcgccccgcaccataatccattccccagcaagcaaggacacccacgctcatgcttcgttacgtcgggcgacgtttgctccaaatgattccggtctttttcggagcgaccttactgatttacgccctcgtgttcctcatgcctggtgacccagtccaggcattgggaggtgaccgcggcctaaccgaggctgcggccgagaaaatccgtcaagaatacaatcttgataaacccttcatcgttcaatacctcctgtacatcaagggcatcttcgtcttagattttggaacaaccttctctggtcagccagttattgatgtgatggccagggccttccccgtcaccatcaaactcgccatcatggccctgctgtttgaatcaatcctcggcattatctttggtgtcatcgcaggtattcgccgcggaggaatcttcgactccaccgtgctggtcctttctctgatagtcatcgcagtccccaccttcgtcattggtttcgtgctgcagttcttagtcggcgtgaaatggggcttactgcccgtcaccgtaggttccaacacatcaataacggcgctgatcatgccggctgtcgtactgggtgcagtatcgttcgcctacgttcttcgcctcaccagacaatccgtgagcgaaaacctccgcgctgattacgttcgaaccgctcgagcaaaaggcatgtccggattcaacgtgatgaaccgccatgtgcttcgaaactcactgattcccgttgccaccttcctgggcgccgatctcggtgcactgatgggtggagcgattgtcaccgaaggtatcttcggcatcaacggtgtcggtggaacgctctaccaggccattttgaaaggtgaacccaccacggttgtctccattgtcactgtgctggtcatcgtctacatcatcgccaaccttctcgtggacttgatctacgccgttctcgatccgaggatccgctatgcctaataatgaattccacacaaaccactcgttgggccaagatgatcaaaccccagatcaggctcatttcttcccacaaggacgaggcgaggctctagttcgaccaggtcaagagcacttcatcgcagccactgatgaaaccggacttggtgccgtcgatgctgttgctgatgactctgcaccaacctccatgtggggcgaagcgtggcgagaccttcgtcgtcgaccactgttctgggtctctgcggtgttgattattttggcgcttctcctggccgcagttccgcagctgtttacctcaacggatccccagttctgtgtgctggcaaactctcttgatggtccacagtctggacatcccttcggattcgaccgtcaaggttgcgatatttttgctcgtaccgtctacggtgctcgtgcctcggtcgccgtcggtgtgttgaccacgttactggtcgccctcatcggtactgtatttggtgctttggctggcttctttggtggcatcatggataccatcctctcccgcatcaccgacatgttcttcgccattccactggttctggcagccatcgttgtgatgcagatgttcaaggaacaccgcaccatcgtcaccgtggttttggtgcttgggcttttcggctggaccaacattgcgcgtattacccgtggagcggtgatgaccgcaaagaatgaagagtatgtcacctccgcacgtgcgcttggtgcatcaaaagccaagatactgctgtctcacatcatgccaaacgccgcagcacccatcattgtgtatgcaactgtggcactgggaacattcatcgtggcagaggcgacgctctccttcctgggcattggccttccaccatcaattgtctcctggggtgctgatatcgcgaaggcacaaacctcccttcgtacccaacccatggtgctgttctaccccgcaatggcacttgcactaaccgttttgagcttcatcatgatgggcgatgtcgtccgcgacgctctggatcctaagtcgaggaagcgatgaccaccaacatcccacaaacccccaaccacgagggtgaacagccactgctcgagctgaaggatctaaagatttccttcacctcctccaccggtgttgtcgacgctgtccgtggcgcaaacctcaccatttatcctggccaatctgttgccatcgtgggtgaatccggttcaggtaaatcgaccacggcaatgtcgatcatcggtctgcttccaggcaccggcaaagtgaccgaaggttccatcatgtttgatggccaagacatcacaggcttgagtaacaagcagatggaaaagtaccgcggttcagaaatcggactggtcccccaggatccgatgaccaacttgaacccggtgtggcgcatcggcacccaggtcaaggaatccctccgagccaaccacgtggttccaggctcagagatggacaagcgcgtggcagaagttctggccgaggcaggtcttcctgatgctgagcgtcgcgcaaagcagtacccacatgagttctctggcggtatgcgccagcgcgcactgatcgccattggtttggcggcacgcccgaagctcttgatcgccgacgagcccacctctgcgctggatgtcaccgtgcagcgccaaatccttgatcaccttgaaacactgaccaaggatctcggcaccgcagtgctatttattacccacgacttgggccttgccgctgagcgcgcggagcacctcgtggtgatgcaccgcggacgcatcgtggagtccgggccatcattgaagattctgcgcaatccacagcacccatatacccaacgcttggttaaggctgcgccgtctctggcttctgcacgtattcaaagtgcgcaggaacaaggcattgaatctgcagaactgctctctgcaacggccgttgctgagggcactattccagagatggaagaaaaagttatcgaggtgaaaaacctcacccgcgaatttgatatccgcggtgcccgtggcgataagaagaagctgaaggccgttgatgatgtgtccttcttcgtacgtaaaggcaccaccaccgcacttgtgggtgaatccggttcgggtaaatccaccgtggccaacatggtgctcaaccttctcgagccaaccagcggagaggtgctctacaacggcaccgatcttacgtccttgagccacaaggaaatcttccaaatgcgacgcaaactgcaggtggtgttccagaacccctacggctcgcttgatccgatgtactccatctaccggtgtattgaggaaccgctgaccatccacaaggttggtggagaccgcaaggcacgcgaagctcgcgtcgctgaacttctcgatatggtgtccatgcccaggtccaccatgcgccgctaccccaacgagctttccggtggccaacgtcagcgcatcgccatcgcccgtgcattggcactgaatccagaagtgatcgtgttggatgaagcggtttccgctttggacgtgttggttcagaaccagatcctcaccctgcttgcagaacttcagcaggaactgaagctcacctatttgttcatcacccacgacttggccgttgttcgacaaaccgccgacgatgttgtggtgatgcaaaagggacgaatcgttgaaaagggtcgtaccgacgacatcttcaacgatcctcagcagcactacacccgcgatttgatcaatgcggtacctggtctgggaatcgagttgggtactggagaaaacctggtttaacccgcacagcctcactaaacccaaaaacacttctgccccggttcaagaaattcgatcttgaaccggggcagagctttattgttcagaagaactagttgcgggcttgagcaaccatctcgacgatctgggcgacagcctgatctgcgtcgagttcggacttctcgccaccgcggacacggagttcaaccttgccttcggcgtagccacggccaagaatcaaggcgaatggcatgccaagaagttcggcgtctttgaactttacgccagggctaaccttgggtcggtcgtcgaaaagcacgtccaagcctgcggcagacagctcagccgcaaagcgctctgctgcctcgatggctgcggcgtctttgttagctgcgacgacatggacctggtacggagcgacttcgacggaccagttgaggccagcgtcatcgtggcgctgttctgccaggacggcgagcaggcgggtgacaccgaggccgtaggagcccatggttgggatggcgcgcttgccgttttcgtccaggatttggacgtcgaaggcttcggtgtacttgcggccgagctggaagatatggccaatttcgatgccgcgagcaagggtgagggtgccctcgcctgctggcgctgggtcgccttccttgatttctgcagcttcgatgaagccgtctggggtgaaatcgcgtccggcgacgaggcctacgacgtggcgttccttttcatcggcgccggtgatccaggaggtaccggtgacaacgcgaggatcggcaaggaccttcacgccgttcttggccaggccaactggtccgacgtagcccttgaccaggaatgggttgtcggcaaagtcggattccactgcgagttcaacttctgctggctcaagtgatgcctcgaggcgcttcatgtctacttcgcggtcacctggaagcaagattccagtgagttctgcttcttcggcacctggctcgcggaccttcaccacgatgcacttgagggtgtcagctgcggtgacctcgcggccctcgatctgcacgtcgatggagttagcccaatcaaccaaagcatcgatggtttcagaaacaggagtttcgtaggtgactgcttctggcaggccttcgatgtcacgctcaacgcctggctgggtaacaacagcttccacgtttgcggcgtaattgccggaggtagagcgcacgaaggtatcttcgccgttttcagatactgcaaggaattcctcggaagcggatccgcccatggcaccagaggttgcctggcagatggcgtattccaagccaaggcggtcaaagatgcgctgatacgctgcgcggtgctttgcgtaggactcgtccaaaccagcatccgagatgtcgaaggagtaagaatccttcatcacaaattcgcgtccgcggagcacgcctgcgcgtgggcgttcctcatcgcggtacttggtctggatctggtacaaggtgactgggaagtccttgtaggagttgtacagatccttcaccgtggcggcgaacatttcctcgtgggttggtccgagcaggtagtcggcacccttgcggtccttcagacggaacagcgaatcgccgtattctgtccaacgctgtgtggtttcataaggctcacgtggcaggagtgctgggaagagcagctcctgtcctccgatcgcatccatttcctcgcgtacgacagcttcaatgttgcgcactgcgcgcaaacccagtggcaaccaggagtagatacctggggcaactcggcggatatatcctgcacggacaagcagcttgtggcttggaacttctgcatctgcagggtcttcgcgcagggtgcgcaaaaacagcgtggaaagacgtgtgatcataggtgacaaatataccctctcaacttggcttcgactgccctgccccctcgatttaagaggcaaggcttttacagtatcctctcatgcatgcttattgtgttgcctccctcagaaactaagacccacggcggttcaggaaaacctctggattttcaccatttgagtttcccgtcgctcaccaaggcacgccaaacaatactcgctgacctgcaagctttggaggtagatgaggcgctgaaagttttgggcatttctgaaaagctccgccctgaggccgaatccaatcgcgcgctggagaccagccctacgatgcctgcgatttttcggtattccggagtgctttatgatgcgctcgacgctgcaacgctgccggagaaagcactggaacgcctcgccatcggctcggcacttttcggcgtcatccacgccaccgatccgatcccgcattaccgcctgtccggcggcacaaaactgcccaccaaaagcggcgagctgcccaccatgaaggcgcgttggggcacaagcatcagcgaagcgcttatcgacgtcaaccagctggtgattgatcttcgcagcgggacctaccaacagttgggtcgcgtaaaagacgccgtcacggtacgcgtggaatcagtcatggaggatggctcccgcaaagtagtcagccactttaacaaacactacaaaggtgaactcgcccgcgtgctcgcgctctctgaaaaagaagcacacaacgcagaggacgtaatgagcattgcgcaggctgcgggccttgtggtggaggaaaaccccaaccacaaggaaaccctcactctggttgtctaggcgttaatcaccattttgatgtgctcggagttaagatcacgcaatctcacgcacacaccaccgagcatttcagccaacaccccggcgcgctctttgcgcactttgagtcggccttcgcagtcgatgaccacgttgccggacagtcgtgatttcaccactgtttccgccgcggtggcaatgcctgcttcgccggcatcggaggtgtcttggccatcggtcatcaccatgaggatcgcgcgtcggccgggttcctttcggagttcccttgccatgagatccttggccatgagcagcccctctgccagtggagtgcgaccacccatcggcatatcctttaatttctgctgagcttgctccacagaatttgttggattcaacaccagtgtcggcttgttgccgttgaccgcgataaccgcaaccttgtcgcggcgctggtaggcgtcgttaagcatagaggtaatagtcccggtgaccgcacgcaccctggaacgcgcagccatcgaccccgatgtgtcgacgacgaacacgatgaggttggcttcgcgcccacggcgcagcgaaccccgcaggtccgtgggccggaaatcgaccacgccttcaacaatgttggcgccgcgttccgtagccgccatgagcgtgcccactaagttgatgccgtgtccacccttcatggggcggacatcagcgccctggcgcgaatacgccttggaacgcctacctggggtggagtcctcctcccccatggacgccaggcgcaaatgcctaggagcgaaaggggtcgccggatccggcagtacctacctttccagtagtctgcgccttcgcctgcgcagttccttgcagaccgtcttcctcggtgggattgtcggtatcggtaaaggcctctgcaccggtttcctcatcggtgatcttggcggcaggtcctttatcttcattgtctttgaagaagtcccgagcttcctgcagggtttcctgaagcttgcgctcctccatttctggagcatcgaaaggattacggcgacggcggtgcggcaacgctaggcgagctgcgatctccacgtcttcttccgtaaccacagtgcgtccagcccacgcggcgtgagcaagtgcggtacgcgtgatcaccaggtcagcgcgcataccgtcgacttcaatacgtgcacacaaccacgcaatctgcgacaagatcagatccggcagctccacaccaggcagcaaatccttagccgccaaaatacggttggaggtgtccgcatcttgctcagcccacttagccatgaactgctcaggagcgttttcaaaatcaagccggcggcgaatgatctccacgcgcacctcagggttcgtagacgcagcaacgtccacagccaaaccgaaacggtccagcagctgcgggcgcagctcgccttcctccggattcatggtgcccaccaacacaaagtttgctggtgaagaatgcgaaataccgtcacgctcaatgctgacgcgaccgcttgcagctgcatcgagcagagcatccaccaggtgatccgccaagaggttgacctcatcgacatacagcacaccgccatcagcctgcgcgagcaaacctggctgatattccgcacggccggtggtcaacacagtttccatgttgagggaacccaccacacgatcctccgtggatccgagaggcaagttcaccaaaggggcatcacctaaaagaccagcaaaagcacgcacagtggtagttttcgctgtacccttctcacctcgaatcaccacgccaccaatgcgtggggaaatcgcagtgaggatcaacgcaagccgaagctcgtcttgtcccacaaccgcggagaatggatagcggatctgttgtgacgccattactgtcctttaatgtgagttttcttgagattttttggtgtgacctggcacatccataaagtgagaccttagtgggtttaaccacccaacttaaggttttcacaaaaccaacaacaaatccctggacaagtgtctataaaagggaggaaactacccccattcttaggcgatctgcttagaggccagcaacttgtccaatgacatacacagctggaggcttaatctcttcctccaccatgactgcacccaatgtgcccaaggtgcaccgaactgagcgttgtgcatcagtagtgccttcctgaataacagctgctggagtatctgcatcaagcccgccgtccatgagcgcctcggcaatcgcacccgcatttttcacacccatgatgatggacaaggtgccacccgatttggccaacgcagcccaatcaaccagtgacttcggatggcctggaggcaaatgtccagacaccacggtaaaggaatgcaccactccccgattagtaataggaatacctgccgccgctggaacggacaccgcactggtcacacccggaatgacctcgcattcaattccatgctcgcccaaaaactccaactcttcaaaaccccgaccgaagacataagggtcaccacctttaaggcgaaccacctttagtccctgctgtgcgtattcaacaagcatctcattagtacgctcctgagtgacctgccgcccatacggaagcttggacacatcaacaacagtcttcgagctgatgtcgcacaatttttccaactcatcagtgggccccaagtgatcagccaaaatgacatcagcctcctgaaggcgattcatcccacgcaccgtaattaagtcccatgcaccaggacctccaccaattaaggagactggctggattattggctggttttcttgggaaatcgtcatgggcattaatcctagtcccaacaattgccagaacccgaacactaggcttgaaccatgaatactgcacctttcaaactcgaagctgacttcgcatcagccctgcccaccatggcagccccctggcaaggtgaggaagcccccaaccctgagctcgtgattttaaatgacgacctcgcctacagcctcgggcttgatccgacatggcttcgcacacctgagggcgttcaatttcttctcggactcaaccccgagcccttaacaaaagcagttgcgcaggcctattccggccaccaattcggacagtttgtggcaagccttggtgatggccgagcgcttcttctcggcgaagcccgctcagctgacggcgtactgcatgatatccacctcaaaggatctggacgaacccaattctcccgaggagccgatggacgcgccgtccttggccccgtcttacgcgaatacatcatctccgaagcgatgcatgcacttggtgttcccaccaccaggtcacttgcagtaattagcaccggtaggaaaatccaacgaggaagcgtagccccaggcgcagtccttgttcgagtagcaaccagcctcattcgagtcggatccttccaatactccaacatctctggtggcatcgaactatctcaacacctggcgaactatacgatcaccaggcatttcccttcgttggtagctgaactatccgcaccaacccccgcaacttatgtatcactgtttaaagcgattcttcagcgccaagcagacaccgttggaaaatggaccaggctgggtttcgttcacggagccctcaacacagacaacacgttgatatccggagaaactgttgactacggcccatgcgctttcatggagcgctaccgtggcgacgcgaaatttagctccatcgacacttatggtcgctacaaatttgaaaaccaacctatgatcctcggatggaacatggcccgcctcgtagaaaccctcctcccactcctgggcgccacaccagacgaaggcatgacagcagcccaagaagctctcgtagaattcgatgacctctgcgaacaagcaatccgaaaagaattcgccactgcactgggccttgacgagtcagacaccggcacggtagagcagttccgtgaactgctctacctccataaccccgacatcaccacgctgctgcgcgcactcaccgacaacaccgcaccaccgagtggctttgaagcattcgttcacgactggaaaacccaagacccagatatcgaagcaatgcgagcagtaaatccacttttcattccacgcaatcacctcgtggaagctgctctcgcagacgcagttgaagggaatctagaaaagttccacgaactcctcgctgctgtcaccaatccttttgatccaactgcgggccccgatgaactacgcctgccaagcgaagaaggatttgaagaagactacatgaccttctgcggtacctaggacagatggtggggcagacgtcggggtcgctgcgtggagcgcttagaactgctagaactccgcgatattgatcttcttcatcgcaagaagcttttcatacgcgccgggtttagccatgagctcctccatgttgtcgggaacaatctgccagctcacgccgaacttgtccttcaaccaaccacaagcctcagcttctggaactgccgagagtgcattccagatggcatcgagttcttcttgaccatgagcttcatacatcaatgagacaccctcactgaaggtgaaatcttgctcaactccggaatccatcgcgaaaatccactgaccgtcgagttggaactgggaaaacatgagggcctcaggagtggcaggacctgtttgctgtccataaggtgcacgatcaccaagttgggagttcgggaacacctcaacgtagttttcttgagctgggcctgcctgattttgagctgccccaccaaataagagcgttgggattactgcgggacctggcttttcttctgggcggctgagcatcaattgccagctcacaccatatttgtcttgtacccacccgtagtattccgaaaatgggtaagtatcgactggcatcagtgtgctgccgccttcatggagtttttcccacaccgcatcaaggtgctctttggcattttcatcacgcaccgcatcaaaattcaccatgaagctgatcgatgggttgggagtgaactcttcaccagcattgatcaagatgatcttaaagcctgagatagcgagttccaccgtcaaggtttttcctgcgaaaggctcctggaagtccagcaagccagcttcgggatacttaactgtggtgagtacttctgcgccacccggaaactcagaaaacgcattgacgtagaattcggctgcttcgtctgcggtgccttggcaccagatgtttggggtgattttttgcatgccgccaggatagaacacgtggtggacatggcttttcgaatacgtaatttgcagtgctcacagcggtaattggtggatacccaataaattattggtgtcgcctaaatcacactggcaaagaatacgcaaagcacccgacatgccttcaactgtgtcagttccaacccatgaaggcggagattgtctccgcaggtgaaacctcaacagacatgtgcgggtgctttaaagaaagcagttagaagatttaggcttcctcaagcttcagggtcttctgggtgcgtgcccactgctgctcaaacagtgctggctcggaagcaagcttcttgccgtaggaagggatcatgtccttcagcttgtcgccccactcgatcatgcggtcaccgaagcaacgctcaagcagctcgatcattgcggaaggtgcgatggatgctccaggggaagcaccgagcaatccggcgatggtgccttcggagttgttgatcaaggtggtgccgaattccagggaaccgaacttagggaatcctgcaggcttaataacctgaacacgctgtccggcaacgatggtctcccaatcgccgttttgtgcctctggcatgtactcgcgaagagcatccatacgcttgtcctggtccttgagaacttcagtgacaaggtacttggtcagatcaaattcctgagcagcaacgccaaggtaggaaggaatgttgtctgggcggatggacttgaacaggtccaggtaggagccttccttcaagaacttaggggtccagccaccgtaaggtccaaagagcagacccttttcaccctcgataacgcgggtgtcaaggtgaggaacagacattggaggagcgccaacagatgccttgccatataccttggctgcgtgctgctcgatcagttcctcgttggtgcaacgaagccacaggccggatactgggaatccagcgaagcccttgacctgtgggatgcctgcgctgcgaagcagatccagtgcgtatccgcctgcgccgacgaacacgaagtttgccttgatggtcttggtgtcgccagtgtgtacgttcttgacggtcacgatccactttgcgccatcagccttgatgctcttgacttcgtggccatagcggatttcagtgccttcaacttcagctgcatccaggtactgcttggtctgagcaccgtagttgatgtcggtgccttcatcgatccaagagattgctactggatcagagaagtcacggccctttgccatcaaaggcagcttctcggtgaaggtagcttcatcgtcagcgtaggtcatgccctggaagagtgggtgatccttcaaagcttcgtagcgagccttgatgtatgcaacctgatctgcgccctggccgaaagatacgtgaggaacagggttgatgaattccttaggatcagacagcactccctcttcaacgaggtgagaccagaactgacgggaaacctggaacttctcgttgattcctacagccttggcaatttcaaccttgcccttaacctctggggtgtagttcagctcgcatagagcagagtggccggttcctgcattgttccacggggaggacgactcttgtgccggtccatccaaacgctcgaagacgatctgagtccagcttggctccagctgacgcagcattgcacccagcgtggagctcatgataccggcaccaatgagaactacatctgcctcatcggtaatcctcggtgcgttcttcggggaatctgacatgttcaacttccttttatctccgcgagttctctgccgaacaccaacacaaggcgtcatctcataaatgatcgccagcacccgaatgcaagtgttggccatatttttgactgacgcgtggggcgttacccttcttgtttcttacaagaaagcgtgggtacacattgtccgtgaatatagagtgtacgcctgccacctcgagctgaataaacaagcacgggatattcccctttctcatgcgaattcctcccccgcgctaccccctcccccaatttgcaaagttagtaaatgtgcaattcgcaaacatgagtagtatcgcggaagtttcaccacgtgaacatttcagtcgactcgcgcacaccacaccaacaatcgacctatcgttatacgtatgaatcagatgcagcagtggaaaccagacttcctgggagagggctaccaaaacctcaccatcgagctcggcgacgacccggataatgaaacagatgttgtgacaacggttgtgcgctacaacccagacaatcacgcggacgagtcttttgctgcccgcccagcgttgctgtgggttcacggcatgacggactacttcttccacactgaattcgcggagtttttccacaatgccggttttgctgtgtacggcattgatcttagaaaatgtggacgctcctaccgtccaggacagcagtggcactacacctctgatcttgcccattacttccctgacttaacagctgctgccgaggtcatctcttccacccaccctgagctagtccccgtcgcccattccactggtggactcatcgttcctctgtggatgtcccagatgcgcacaagcaatccagctgccattgagaagattccagcgctggtcctcaacagtccgtggctggacatgatgtatccaccactgttcatcaagctgatcacccctatggtgagggtgttgggcaaacgctcccccacaaccatcatcccaggcggaggtttgggagcatacggaaaatcgatccataagaacttttacggcgaatgggactttgacaccaccatcaagcctgtagaaggacataaaaagagcatcggatggcttcgggcagtcatggctggccaagcagaaatccatcacgaccacgtgaatgtcggagtggacgtgctcacgctgtgttcaaataagtcctggttgaagtctgaatacacagaggacaccaacacttcagacgcggttttggatgtgaaacacattcaaaagtgggctcctcatttgagctcgccatcgtccagggttgatgttgagatcatcgacaacgctcgccacgatattttcctctcaaggaaacccgccagagatcacgcctctgaagtactcaacaactggctgcaatcgaagctttccagcctcaaaccatctcaataacaccgcgaattatagactgaactggtacttgggaagctttttatagtcatatgcgttgagatacgtggacgacaaagcaccagttagttgccttcccagtccagcccacatccgatttctaaattaggagcacatcttatgtctgagcagccagcttccattaagcattatgacctcatcatcattggtaccggctctggaaactccattcctggaccagagtttgatgataaatcaattgccatcgtggaaaagggtgctttcggcggaacttgcctcaatgtgggctgcatccctaccaagatgtacgtttacgctgcggatatcgctcaagaaattcaggagtctgctcgcctgggtatcgatgcgacggtcaacagcgtggattggccttccatcgtcagccgcgttttcgacaagcgcatcgacctcatcgcgcaaggcggcgaggcttatcgacgtggccccgaaactccaaacatcgatgtgtatgacatgcacgcatcgtttgttgattccaagacaatctccactggtattgccggccaagaacagctgatcagcggtactgacattgtaatcgcaaccggctcccgcccttacatccctgaagctattgcagagtccggcgcacgctactacaccaacgaagacatcatgcgcctggcacagcagcctgaatctttggtgattgttggtggcggtttcatcgctttggaatttgctcacgtttttgaagcgcttggcaccaaggtcaccatcctcaaccgctctgacgtgctgctgcgcgaggcagatgcagacatctccgcgaaaatcctcgagctttccaaaaagcgtttcgacgtccgcctcagcactgcggtcaccgcagtacacaacaaggccgacggcggcgtgaagatctccaccgacaccggcgacgacatcgaggcagatattttgctcgttgccactggtcgcacccctaacggcaaccaaatgaacttggacgccgcaggcatcgagatgaacggtcgttccatcaaggttgatgaattcggtcgcaccagtgttgaaggcgtgtgggcgcttggcgatgtctcctccccttacaagctcaagcacgtagccaatgcggaaatgcgagcaatcaagcacaaccttgccaaccctaatgacctgcagaagatgccacatgatttcgtgccatcagctgttttcaccaaccctcagatctcgcaggtcggcatgactgagcaggaggcgcgtgaagctggcctcgacatcactgtgaagatccagaactactctgatgtggcttatggctgggccatggaagataaggatggattcgttaagctcattgccgataaggacaccggcaagttggtcggcgcgcacatcattggtgctcaagcctcaacactgatccagcaactgatcactgtcatggcatttggaatcgatgcacgagaagctgcaaccaagcagtactggattcaccctgctcttccagaagtcatcgaaaacgctcttctggggctagagttttagaagcttacgcagccgtaagttttgagtatcgaaaaatttccacgtcaagttaactgcgttaataaaggtggagaataagttgtttccaagatcaattcaaggaaagttgcattttcgcaggtcagtgttaccccctaagactacccctttccattgcatacaaaggaaatacatatagacttttgggcattagattacctcgataaaagtttagggaatctaaattcattgatcaagacttgctgtcgcctagctctaattcacttgagcccggctgctaaaggtcaagatcattgaatgcactacttgctagcagtcatctgaaaaaacgacgttggttcgtagtcgctggaaatttaataattcctccgtccccttcaactagggggtggaaacccgactatttccgaaggactattctcatgcgttctttccgtaccgcggcagttgcaggccttactgcagttgcactttccgtaggttccgccaccgtggcaactgcggaagaatctgatcaaaacctctcatccggcttctcagcactttcttccggtggcgcagcggccgtaggtgaggactgggatgcagaccagcccgtcacaggtgaagacatctttggtgaagagcacgagcgcgataacgaaaacaccccagcgtgggctaagaacatgtacgatctaaccgtcttgggtggcattgcttcccttctcggtgtcatcgtattccccgcttacaactacttggtttacaccggtgttatcaagggctaaatcgcctaacctctatcttcatctatagcttagctttactgaaaggcttttcatcatgcgtaaattccgcaacactgcaattgcactagtttctgcagctgcaatcaccttgggtggcgttaccgctgctaccgctcaggaagacgaaactcctcctgcagcagagaccgagaccacttctccttccggttcctcaggctcttcctggaacgactacaacgaagagtacgaaggcgaccaagagggctacggaatcgacggctttggttcttcccgcgatgactccggagaagaagttccacgttggttggagacctggggcaaggtatttgacgctttgaccattacctccgttcttggtcttgttgtcttccctgttgttaacttcctgaagtacaacggcctcattaagtaatctgcaatttcctgtcaaattgctaaaggcattaatcacatgtggttaatgccttttttgattgcgtagactaggaaggtacgtcaacttccatatctttagtttgcgaaagcgatcaacttaaaacacgtgtccggttttcttactcccccagctacaccccatattcggacggcaactgccagtattgctaccgcagttgccgtagcactgtcagtgttcgctgctgcactcattccaggaagcgctctgtattctgtgctgaccgctggaggggtggcacttggagcagcatcaggcgttgccgcgttacgccatcgcggagggcttcgcatttttcaatggctgtctgcgcttggtggaatcgtcattttgctgatcggtatcgtagtggcagttgcaaagtttggggcctcggcaaaacttgccacgttaggcctggtgacctcgtattatctcatgccgtctgcggcattggcctgttatatcggagggcttggccagctaccagccaaatggattgcgccagcgtttatggctacggctggtgcaggtgctgcgggatggttttcattgggggcaggcaccggttttgaacggttcctcattgctgttgcagcggtgttttcactgatgggatgtgtatacccagtgtggggatgcgtcgtaaagcgtccacgtcaagtggctgcatggctggtcgcgctggcggccctggtgcttggggcgctcatgctttttatggtgagcatggtggtggcgccgggtttgctgtggctgcagcccacgacggtcgcatggggttttatgattgccggggttcttgcgacggtcgcaggcttgtggcctaggcgtttttagacggaatcgtctgggagggtgaggatctcattgccgtcttcggtgatgacaatggtgtgctcgaactgcgcgctgaacttacggtcaacgttttggacagtccaatcatcttcccagatctcgtagtcgagggaaccaaggttgatcattggctcgatggtcaaggtcatgcctggcacgagcagatcgcggtactgagtgttgtcgtagtgcagcaccacaaggccgttgtggaaagttgggccgatgccgtgtccggtgaaatcgcggaccacgttgtagccaaaacgcttggcgtaagactcaatgacacgcccaatgacgttgatttcacgtccaggctttgctgcacggatggaacgcatcatggcttcttcggtgcgctcaaccagcaggcggtgttcttcagaaacatcacccgctaagaaggtggcattgcagtcgccgtggacgccgtgcttgaacgcggtgacatcgatgttaacaatatcgccctcttcaatgacggtggaatcaggaataccgtggcacacgatctcattgagggaaatgcatgaggacttggtgaatccccggtaaccaagatctgaagggtatgcgcccatatcgcaggtgtactcatgcacaatgcgatcaagttcatcagtggtcacgcctggcttgacggcttcgcccgcgattttcagtgagtttgcagcgatgcgagatgtctcacgcatcttctcgatgacctcaggggcctgcacaaaaggctcaccgattgcttcttggacttcgtccttccacacatattctggacgttcaatatgtgcaggtacttccctgattggggtaggaattccgggtacaagtggtgcgcgcattttagacatggtcaccatgctagtcgcctgaagcgatgacaggtaaagcgggttggatggaggctattttttagccgactggctgctcttcagcttcactgactgcaacttctccccctgcgcgaagctcatcgagtttcacaaagaactgatctgtcacagcggcagccgcttcggagcctccgcccaacaccacgagggtggcaaaagcgatgtcatcttcgcggtagccggtgaaccacgcatgggagccttcgttgatttcggcttcacctgtctttgcgtagatctggccaccggtttggcgcatgccacgagcggtaccgtcattgaccacggatttcatcatccgctgcacattggcaaggacttctggatcaagcgccagaacttcttcactggcaacagtttcatgtccagaaatcagcgttggcgtgggaactgaaccggtggctgcagtggaggcgaccaacgccatgccaaagggacttgctaggtcaagaccctggccgtaaccagattcggtacggtccaacacgatgtcaccttcaggcaccgatcccgtcatggtgtcaaggcctgggatttgataatcaattccgaggccaaactgcttagccacatttttcagttggcctggctccaagttggtggaaatatccgcgaaagtggtgttgcatgaattggcaaaagcatcatccaatgaggtgttgcccaaggagaagctgttgtagttggtgacaattcggccgtagatattcatggtgccagggcatggcacaatgctgtctggagttaatccttcatgcgccaaccccgcggctgcagtgatgatcttgaatgtcgatcccggtgggtattgtcccatcagcgcaacatcgccgtctttgtcagcttcatctgtttgggccactgcgaggatttcaccagtggatggcctcatgaccaccatcatggctttcatctcagcgcgcaggtctacggcttcttccgctgctcgttgaacgttgtgatccaggctgatcctcacgctgggggcaagctctggggcgtcgtaggcgatatcatcaatcaccgcaccattggaagtgacaatggaggcgcgccaaccattggatccttctaattcatcttccacaatgcgcgcaacgcgagacacaatatccggagcaaaacctgggtcggtggctaccatggatgcttcctcattgaacgtcagccccggaatccccgctagatcctgttccatgcgggcacccaaattggcatcaactgtggtgagtgaataggtggaatcgccaagattgctcataatgtcttcgacatcaagggtgttcacattctcatcagtcgcatgggcttcattcaaataatctgccaccctcttgaccaccacatcggcatcccctgcgctgggatcaaccaaaactcggtagatacttcccggcgcgagaaccggagctccatcggaggaaattacgttggctcgctgcgcttcaatggcgcgcaattccaggtgctggttggcgcccagtttggggtgcacgagggaaggttcccaacgcactgtccattcgttgcgcatcttggtcagcgtcatcgatgagtcgtaggaaacttctctgtctcggggaagcttccacaccacggagaaattggcggtggcgatggtgtcccgggaatccacggaatccaaagtcagttcaacgctgtctgcttgcagaccatcgaaactggtgctgagcatttctgtggcaaggtcagcttggtcggtgatgtccgcaatagtgtcgaaatcttgcgatgcccaagcttgaaggaattcctctgcgatggggtctgcggtatcaggacgaggtgtgcacgcggtcaggcttcctccagcaaatgccaccgtcatgcacaacgccatcagtgacctgcgctgcaccttgttcatggagtgaagattagcagcgtgcgctggtgtgatcggttaccaacacgtgtgcgtctagataattccgcgctgtctggcttcagctaccgcagctgttctagaggtgacatccagcttgttgaacacatgccccatgtgacttttcaccgtggcctcagtgaggaaaagtttcttgccgatttctctattgctttgcccttgcgccaccaaggacagcacttcaatttctctggcactgagagcagtcatggggttgttcatccgccccatgatcttgctggcgacctgctttgaaagcactgattctccccgcgcggcatcgcgaacaccggcaatgagatcttctggggagctatctttgagcaaataccccacggcaccagcagatactgcgcccaccacatcgccgtctgtggagtagttggtcaccaccagtacctgtggcgggttgtccagcgcacggatgcgacgcgttgcctctaccccgccggcgacctcgatgcctggttgatcaccaaaacgcagatccatcaacaccacatccaccccgccttccgcggcgcgcgcaacggcatcatctggggtgcccaccatgtccactatctcaaaatcatcttcactcaccagcaaggaggcaaggcctgcgcgaacaacgggatgatcatcagccaacagaatacggatcacttatcttggtccttttgtggatagggaaaacgggcggaaattccagttcccgatccgattgtagattcaataattattgttccgcccagcccttcagcccggcgttgcgctgtgggcagtccaatggattttttacggatcacttctgccacatcaaatccctgcccattatcgatgacatctagaagtatttgatcatcttgatatgtcagggtcatttttgcagaatctgcctgtgcatgccgcaccacatttcccagcagcgtttgggcaattcgtacgatctctgcctccatcgcatcaggtaatacccgtggggatccgtcgacttcaaacgtgatgttctgtcccatcggggtggtcgacgacagtctggccaacgccaccggcagatccgccccaatgagtggagtcggttgcagcgcagcaatgatctgcctggtctccgccaaattatcagctgtcgtttgcctggccaaccgtatatggcttaacgcctgcggatcatccacccgtttttccgccgcatgcaacaacatctgaatcgaggacaacccctgcgccacagtgtcatgtatttcgcccgctatgcgggctcgttctgcctgctcgccagcgcttttcgacgcccggatcgccgacgcacgtgcgtcgacaagctcctttaaggcttgtgccaataactgaaaacacgtacccattacccacgccaccaacgcgccaaggatcggaccggtgacaacgccaacagaaaaccccaggtgcatagccaacgtaaccaccgcgatcgccgtcagtattgcaatgatgatcgcggatttcagcggtgtcgtgatcaacactgcgaggaaaaacatcggaaacaccaaatacgcaggctccggtccatcccaaatcaggctcgcccacaacaaactcagcacaagaaaccacgccatagggtgattcttaaacggcgaattcgggaccacacccgccacataaaccacgccatagccaaaagcgagcacccacacaccccaatggctggcacgccaacacaccaacaccaacaaaacggcaatgagtaaatgcaatccccaaatgagaactctctcaattcgggcgatggtcgcttggctagttttcacgccaccacgatagatcaactaagtatgaacgcgaatccgactttggtcgtactgcaagaatcgaccagagcccgattaaaaaatgcccccgcgcaacgaaactagtaatcatgtttcaaggactaaaagaactcaccgcagcaaaaggccgcacgctgctgatcaccgtcaccgtcgggctgatcgccgtgctggttactttcctctctgccctcaccgccgggcttggccaccaatcagtatccgcactgaaatacctagcgggtgataatgaacttatcctcgccgattccggatccaccacgctttccgcgtccacgctttctgatcaagcagttgcccaactcgaagacgaaggcgcacagatgctgtggcaggtccgcgaccgagtagcagacacccccaccatgctcctcaactcccctgaccttgcgcctggtgaagtatcccttcctgccgaactcgctgattcggaactcgctactgcgcatgatgtagtggattcttccaacgatctgtacctcgatcacctgcccgtggtattgatgaacacctccgatttagcctcactcgcgcaagtccgaggcgtgacaggaccagcaggcgcattcgcctctgacgttgcgctcccctccgacaccgttgcgctctctggatccgaacggtggaacgcatccgcctcctaccagggcgaacagatgtcactcaacctcatgatcgtcatgctgtatgtcatctccgcactcgtgctcggcgcattcttcaccgtctggaccatccaacgcctccgcggcatcgccatctctagtgctttgggagcagcccgccgagtacttatcgccgacgctctcggccaagccatcatcgtcttaggaatcggcatcaccgcaggcacattgatcacagtcatctccgcattcggcatgggagacgcaatgcccgtggtcatctcctcctccaccacgctcttccccgcacttatcctcgccgcagcaggactcatcggtgccgccatttcactcggccccatccttcgcgtcgaaccacgctccgcactcatgaacgcataagaaaaggaacctcacatgactctccacgtttcaaatctcaatctgaccgtcgccgacggatccacctcacgcaccctgctcaacaacatcacttttgatgtccaaccaggcgaagtcgtcggtatcaccggcccatccggctccggaaaatccaccctactcgccgtcctcggctgcctccaaagcgccgattccggcaccgcgacgctcggcgacatcgacctgctcaacccccaaaaccgagctgctttacgacgcaaccacctaggaattgtcttccaacagccaaacctgctcccctcgttgactgtcctcgaccaactgctgctcattccccggctcggcaggatcctcccgcccagccgcagcgcacgcacccaacacaaagacaaagccctttcacttctgaactccatcggactcggcgacttagcaaaacgcaaggtcagcgaactatccggtggacaacaagcccgcgtcaacttggcccgcgcgctgatgaactcccccaagctcctgcttgtcgatgaacccaccgccgccctcgatcaacattccgccagcgaagtcaccgaactaatcgtctcgatggcccaccaatacaacgcccccacactgtttgtcagccacgacatggatgcagtcaacacccttgaccgcagcatcgaacttgtcgacggtcacctcctcacaccccacaccctgtagccaaactaaactggtgtgcccgcggatctcattttttagatccgtgggcactcctgtctggtgtttttcttgatgagtcctaatccgccatttaagaggtcgaaaatctgaatgggtcaaagtatggttccgaccgtttgagtcgctcagaggcgattctgagcggtcactttttccaggctccggtgcagtttttctgaagtcccgccacagaccaaaccaggtgaccgaaaaacttccgccgatcgattttcggccatataggacggtattgctcagccaaaaccaaaccaggtgaccaagaattccctcgggaacttttcttggtcacctggtttggtttccctctgccgcttcaggggggaactgtcgaaataggccaaaaccgcctccgcagtcctagcttttggtctccaatacacatttcccgaccgacaaagtgtcattgcagaccaaagacgcctcgaaaaaggcgcctcttggtttaatactcacgttccccaccagtcatctggtttagtttacggaatttacccatcaaaaaagcacccgactaaccaaaccagtcgggtgccttaattaaccaaaacttacttggttaccttcacttcagccttcataccggaagcacttgctgcagcgaggacttctgggtccatttcctctgcgatacgcattgcttcttcgatgagggtttccacgatctgggattctgggacagtcttgatgacttcgcccttgacaaagatctggcccttgccgttaccggatgcaacaccgaggtcagcgtcgcgagcctcacctgggccgttaacaacgcaacccatgacagcgacgcgcagtggaacttccatgccgtcgagtgcttcggtgacttcttcagcaagtgagtacacatcgacctgtgcgcggccacatgatgggcaggacacgatttccagcttgcgtgggcgcaggttgagggactgcagaatctggtcgccaaccttgatttcttccactgggtcagcagaaagagacacacggatagtgtcgccgatgccctgggacagcagagcgccgaatgctacggaagacttgattgttcccatgaacttgggaccagcttcagtaacaccgaggtgcagtgggtagtcgctttgttcagcgagctggcggtaggcctccaccatgagtactgggtcggagtgcttcacagagattgcgatgtcgccgaagccgtgctcttcaaacaggccggcttcccacattgcggattccacgagagcttctggggtggctttgccgtggtatttgtccaggatgcgcttatccagggatccgccgttgacaccaatacgaattggaattccggcatcgcctgcagcttttgctacttctttaacgcgaccatcgaattccttgatgttgcctgggttcacacgaacggcggcgcaacctgcatcgattgccgcgaagatgtacttgggctggaagtggatatctgcgatcactgggatcggagacttctttgcgatgatcggcagtgcttccgcatcaacagtctttgggcaggcaacgcggacgatgtcacaaccggtggctgtcaactgtgcgatctgttgcagggtgccgttgatgtcgtgggttttggtggtggtcatcgactggacggaaatcgggtgatccgaaccaacgcccactttgccgaccatgagttggcgtgttttacgacgtggcgccaacactggaggtggggtcggaggaaggccaaggccgattggggtagacaagttacatgctcctagaaaaggaagccgcacaaaggtctgtgtgcttccggacaacgttctgggttaagtcagttatggcaaaattgtatcaccgtcacctcttttaacatcggtgccggcagttcaattccgtatcgttagccaaagagtcggatgggattgaccacatcggcgacaatgaccaggcctcccactgtcatcagcaaggctgcgacagctacggtgacgggcattagtttggtgtaatccgctgggccgcccgctggttttccgcgcagtttgcggaagaagtcgcggattttttcatagatcaccacggcaatgtgtccgccatcaagtggtggcagcggcacgaggttaaacagcgcgaggaagaagttcaggctggccagcatcatcatgaacatgtcccacatggaacgttcgacaaattcgccgccgatgcgtgacgcgcccaccacactcatggggctttctacatctcgttctgcaccgaagatggatgcgacgacccctgggattttcgccgggaaggctttgaggccatcccacgtggcgctgatcatgtcgccggtgaaacgtgcagttgctcccacaccctcgattgggccgtattttttgtacacatcggtcggtggaaggctcgacatgcccaccgcgccgacggtaatttctgaaccgtcagaggcgagacgggtgacagaggcaacctggaggtcgacgtcgaaaagcgttccctcccgttcaatcgtcagcgttgccgtttcgcctgggagctcgaggatcgcatcgcggatggcggtgaagcttgccatctcttggccgttgacggccaaaatcttatcgccgtgctcaatgccggcgtcgcccgctgggcctgaacctacgcaggaggacagttcagttgcggaaatttgggtttccggcacgcactgaacggtgtcgactgtcgcggtggtatccacatccggattcgggattccggagctcaccgccacgccgtaaagcaccaaaaagccgacgatcagattcatgatcacgccgccggaaagcacaattatgcgctgccaccagggctttagatacatggcgcgcggcaggtcttccggatcaagttcatcttgggcagtcatccccgcgatgtcacaaaaaccgccgaccggaatcgctttaaggccgtacacggtttcgccgcgtcttttggcaaacaccgtcgggccgaaaccgatgaagaaacgccgcactttcattccgaaaatgcgcgctgtgatgaagtgcccccactcgtgaagcgcgatggttactgcgatgccgaggaaaaataatacgacaccaagaagataggctgccacgaggcggaagctccttagcttacaagttggttgccaaccggttgatcaaagcattcgcacgcgcgcgtgcctcagattcggttgccaaaatatcatcgacgtgtgatgctacaccagcaaactgagaagctccttggaggacctcgtccaccacgtccacgatctgcggaaacttgattcgcccgcgcaaaaacgcctcagccgcctcctcgttggcggcgttatacaccgcggggtacgtgcctttttgctttgcgacgtgcctagccagctgcaccgcagggaatgcggcatcatccaccggctcaaaagcccaggtatgagcagcggtgaaatccagcgccggctgagccttcggcacccgatgtggccaatcaagcgccaacgcgatcggcagtttcatcgatggtggcgacgcctgcgcgatggtcgcaccatccgtaaacgtgatcatggagtggatgatcgactgcggatgcaccgtcacatcaatgagatccgcatccgtttcaaacagcagggtcgcctcgatgagttcgaggcctttattaataagggtggcggagttcaacgtgttcatctgccccatcgcccacgttgggtgcgctgctgcctgctcgggagtcacctcccacatcttctccctggtccagcccctgaaaggtccgcccgaagctgtcagcacaatccgcgcaacctcatcacgagtacccgaacgcaaacactgcgccatggcagagtgctccgaatcgaccggaatgatctgccccagctttgcctttgaggtaacaaactcaccaccggcaaccagcgattctttgttagccaaggcaagatgcgcaccagattccagagtggccagcgttgccgcaagccccaaagaaccaaccagagcattaagcacagtgtcggcctttgtggtttccaccagaatcttcgcagcatcggttccagagatgatctcgccgccgagagccttcgaaattactgcggcagcctgtgcatcagcaaccgcaaccttgtctgcagccagccccaactgctgcgcctgcgaaataacgaggtctggctgagaaccgcccgcagcgatacccaccacctcaaacttgtctgaattatcagcaataacgtccagcgcctgagttccaatcgaaccagtgcttcccaaaataaggatctttttagtcacgactcccattcttgcacttgttgggtaaacgcacccactacacccatttggggcaatccaaacggatgggtttcaggttatgcctgcatgatgactgcgaaagcgcagttggaaacctcacaacaccactggttttttcgcttgaccgcgcaaaatatgagaacatagtgagagttaaaccaagttctgtaggtgcttgttgcagcgggcgcgaaggcgtaccactgcaacttgcgaataaaggagtaaaacgtggctggttcctcccacacgattgagcctgagatctaccgcggtgtatccacccttgatgagccttcggctgcatggggatggcacggtctcaagcgcaacaccatccaactcgctggctggatttccgttctgttcatgcttggatacaacttcggtaaccacaagggccacgttgaaaccatctggcttctcgtcatcaccgcccttctggtcatcggcctgctgatccacctgttcgagccaaagctctcccaggttcgcaccatcacttcccgcaacaagcctgtcggccacgtcgagccagactggacctacgaccaggcaaccctcaccggcacctggggtaacctcactgactcccagcttcgctccgtcaacatcgagccaagccgtgtcgctcacctgcgtgctgcagattctgcgaaagaactagacaactagttttttaaaaagaaaatgcgggtgcttcgagattttctcgaagcacccgcatttttctatttcacgtgagttttcaccttgtcgaagatctccggaagatccttctccaccttgcgaatacacaccttagcaacgccgatgtacacagctactgggagaataatggccagcacctccgcgaggatgatcatccacatctgatcggtaaccagaccaaagatacccaatgcgatagtaggaatcgtcgggatccatcccagtaacagtgcggcaaatgctcccacgaacgcagcaccggaatagccacttcgatcgccccaaggactcgtgcctggcttagaagtcggatacggattaaatgtggtgaccaacaacgctacagccgcactggagataaagatccccaggccaataaaacagatcagcacagcggtggtcttattctccgcgagcacaatggtgatgatcataaacaccacaattgacacacttcccggcagcattgatgcccagtgcctgggcatcaacaacgttcgggctttgacaccagcaacgatatttagccacaacgaagggccgtcatagccaaaatcattggtagcaacggatcctgcgaacactgccatcatgatcaacccaacatagatcatgaaaaactcaacggtgaagctctggaaaataaacagcacgccaagaagcgggaacacaatcattgatcccaacaacctggagtccctgaacatataacgcagcgacctcgagaaaatggcacctccaactgaccaaggaatacctggcagaaagagaaccttcttgccttcaccggcgctgtctttagcgctttgcccttgcccaccttggtccagcggcgcagtgagcgcgcgattaatcagctgtgaccataaccagaaaccagcagcaacataaacaaaagccagcaatgttaacaggcctgcctcaccccacaaaccaacagcaaaagcctcaatagcacctgcacccgccccaaatggtgtccactttgtataagccccaatggcatcgattcgactcattccatccgcgccaatcagcatgttatagccaacaacaaacaccatgaagacaacggaagtaagaactgtacggcgatcattactcaccctagaagaagaacccgaggtcaacgccccaagcaactcacccaaaagcaacgtagtaaccagcgataccgccatcatgaacacgatcatcggccacgaaccaacaggtaaaaacaccgcagcaataatggatgtcgccaccgtacaaatcaccgcaataatcccccgtgactgcaggagcgtaccgatagcgaatccaggcaataattgcttcgccgatagcggcatggtggaaaatgcagtcggatccagctgcccctcacctgacggccacataaacgcagcaatgcaataagccaccatgccgaccgagacaacaccagcaaggatgcccatgtggtcttgcccaagcccaagagccaaaaagatgccgaaaccaaacaaacccatcaaggcgtaaaaagatatcagcgacatcatcactattgccgctttatttcctttaatagttcttccccacaacgtcagctgtagtttcagaagtgttttagtcatttactcagcccgatcctcgttctgattttggccttcgctatggccttcggacgcacccaaccaagatagtgacccctcttgaagagcagcgcctccaaccgcatcaacgaagacatccgtcaaagatctgccccgacgaacctcatccacatgtccggcaatctccaccactcccctgttgatgatggcaacgtgatcgcacaacccctcaaccaattccatgacatgcgaactcaaaacgacggttccacccgtttgcgcaaagttcttcaaaatctgctgaatcaaacgaccagacaccggatcaaccgcttccaaaggttcatcaaggatgagcactttcggattgtgaatgagggcctgggccaaaagaatcttcttcgtcatgccggcggaatagtcgacgactctcttgcccgctgcttctttaagcccgagggcctccagcaattcctcactacgttgatcaacaatgccttcatccaactcacgcaatgccccgacatatgtgagcagttctttgccagtcaagcgatcaaagatgggcaagccatctgccaacaatcccatgcttcgttttgcatcgtttggctcttcccacacattgaaacccgaaatccacgcggtgcctttattcggcctcagtaaacccgttgccatggacagcatggtggttttacctgcaccattaggtccaacgatgccgtaaatggctcctttggggatgtccagattgatattgttcactactgttgcatcaccataggacttggttaagccccgaactgctaatgcttgcgtagtcggatcagtcggacaaatctgtggggttccttgcgagttttcaggatcagtcatcggagatgaacttctttcgattcacgtgtcggcggctatgtgcgttagtgcattgctattagtgaaaagcaccaataatacatgcgacgctaccagctgaagcacagatgttcaggagcacctcaccaacgacaaaagcccgttgttttcgcatttttgcaaaaacaacgggcttttgagctttgagggcttaagcagattcctccgcagcaagctgtccacaagccgcagcgatttcttgtcccttggtatcacgcacagtgcatggaacacccttggcgatcacacgacgcacaaactcatcctgacgagcctttggtgcagcatcccacttagaaccaggagttgggttcaatggaatcaagttgacgtgcacacgggagcccaaagccttatgcagcttctcgcccagcatatctgcgcgccaatcctggtcattcacatcgcgaatgagcgcatactcgatggagacgcgacggccagacttatctgcgtagtaacgagcagcgtccagtacctcagcgacaggccaacgattgttgactggcacgagagtgtcacgcaactcatcgtctggagtgtgcaaggaaactgccaaagttacggacatctcttcgtcggcaagcttcctgatagctggagcgaggcccacggtggagacagtcacactgcgctgggaaatgccgaagcccgcagggcttggctgcgtgatctgacgaacagccgacaccacgcgcttgtagttagcgagaggctcgcccattcccatgaacacaatgttggacagacgaccgccctctgactgcatcgttgcagcagcattacgaacctgatccacgatctcaccgattgaaaggttacggtccaaaccgccctgaccagttgcacagaatgggcacgccatgccgcaaccagcctgcgaagaaatacacagcgtggagcgatctgaatagcgcatgagaacagactcaagcaaagtgccatcatggagcttccataacgtcttctgagttgtatcgtcatcggtttcgacgacgcgcagaggagacatcaacgttggaaaaagagcatccttgacttcttgacgagcaccttcaggcaggtccgtcatagtgagtgggtcagcctcgaggcgaccatagtagtgtcgagcgatctgattgagtcggaatttgggcaagccgagctctttaagagcctcaatgcgagcctcatcattaagatccgcaaagtgggttgggggcatgccacgcttaggtgcgttaaaaaccagtggtacaggtgtagccataatgtccctattctttcagatgttatgtaattgttgaacttattgggctgatttgggtggcggaacggtgattctacgagttcaatggctgtatgagcaacagacctgtggatccatttgagaccaacccaaacgaccttcccaccggtttagacccagcatacgaaggtaacagtgagttaaacccgcttggaggaaaaaatattcccgacgagcctgaggtgactgcaaacacacctgcagttcaagaagaacctgcttactcggagccagaaactgccgttgagtcgaagcgtcaggcgaagcagaacacaaagaagtccgaacctgttgtggctccaaaacaaacacttgccggtggcacgtgggtagctctcatcgtaggcgcacttttgctaatcctactgttggtcttcatcatgcagaaccaaaccaccgtagagcttaacctttttgcgtggaccttccaattcccagccggaatcggtttcctactagcagccattaccggtgcattgattatggcgcttgttggtggcgtgcgcatgtttgagtaccgtcgccagttaagaaaaatccgtaaagccctttaaactttgacagccaaaaaggcgctgaggtgcacacgttatgcacctcagcgcctttcaagttttttgaacttaaagctggcccaagctttacgacggatacgagctgctgatcacactcaggatcaaccacgtcaccatcgcggccgggagcatgccatccaaacggtccatcaatccgccgtggcctggaagaaggttcgacatatccttgatgcccaaatcgcgtttgaactgcgactcaaccaagtcacccaacgtggcgcacacaactagggcacaacccaagatcacacccatccaccagtggtgatcgagcaggaagtgaacactgagtgcaccagtgaccgatcctaagacaatggagccggcaaagccttcccaagacttcttcggactcaccaacggcgccattgggtgcgatccaaagaacacacccgcgatatacccgcccacatccgatgcgatcacacacagcatgaacgtcaaaatgaaatatgtacccgggatggaattgttttgcatcagcgacagcatcgcagcgaagcttccgaacaatggaatccaggtgagcacgaagatgcccacagaggtgtccctcaaatagttgcgggcttctttttccgtgccattgtagaaaattcggaaatacatcagcaccaacacagtggccacaaaagacgccaaaatgcccatcgtgccaaatggccatgacagccagatgattgcctgaccgccgatgatcataatcggcagtggcaaatgatagccgccttctttaagtctgctaccaacttcccatgttgctgcagccataaaacctgcaacgaggatgtaccaaccccatgggcttaggacaatccccaaaagaaccaggacccccagtccgatccccacagcaatggcagctttgagatctcgacccgcattatttttgggtttgggcatcctcatggaccggtgatgttgctccggttcattcatgggttctccttgaagtttctaacaatgtcactgttgatggtgccagcattttcgaaaaaattcttccaaacactcttgcaagcaaaagaaagcgtcgtttccccgcccaatcgacgttgaaacgacgtaattcttaagccattgcgataaaggtcttctagacctccatcagttccttttccttgcgagcaacgacttcatcgacctgcgcaacaaaaccagcggtgactttatctagttctttttctgctgcctgtacttcatcttcgccagcgtcgccatctttttgcagcttctttagctggtccatgcccttgcggcggatgttacgaatggcaatcttgccgtcttcgcccttacccttagcaagcttgaccatgtccttacgacgctcttcagtaagctgtgggatggtcacacgcagcacctggccatcgttggtggggttaacaccaaggtcagagttacggatagcattctcaatgacctgcatggaagacatctcataaggcttgatcagcagcatgcgaggctctggaacagtgatgcctgacatctgagtaataggagtaggcacgccgtagtattcagccatgacaccgttgaacatagccgggtttgcgcgaccggtacgaatggtggtcaagtcttcgcgggtgtgctcgaccgttgcggtcatgcgctcttccgcttcgaacagaatttcatcaatcatttattcactcctgtgtttttctaacagcgtggattctgatggatcctagaatcgaacctagataagccacgctgtttataagactaaatgtatcaggactcgaccagagtaccgatacgttcaccgctgatggcgcgagcaatgttgccttcagtaagcaggttaaacaccaagataggcatcttgttgtccatgcagaggctgaatgcagttgcatcggcaaccttcaggcccttctcaattacttcctttggagtaatttcggtgaagagctcagcatctgggttggtacgaggatcatcgctgtacacaccgtcaacagccttagccatcagtaggacgtcacagccgatttccaacgcacgctgtgcagcagtggtgtccgtggaaaagtacggcatacccatgccagcaccgaagatgacaacgcggcccttttccaggtggcgttctgcgcgcagtggcagatatggttctgcgacctgtgccatgttgatggcggtctggacacggcattcaacgccatgctgaccgaggaagtcctgcaaggcgaggcagttcatgactgtgccgagcatacccatgtaatcggaccgtgcgcggtccatgccacgctgctgaagctcagctccgcggaagaagtttccgccaccgataacaacggcaatctctgctccagttttagcaacttcagcgatctgacgtgcaacattgtctactacatcaggatcgacgccgactttgccaccaccaaacatttcacctccgagctttaacatcactcgcttgtatcctgtacggggttgttcactcgaggtggtcacagtggtgttctccttcagtaggggttgtgccaaccgcttttaacatcggccacggggtacgccttgaaaaaatcacagcaaccaagaagccactgagacccaaattcagggcacccctattcctgggattcgatcttacatcgacccttgtattcaatgcggaaagactaggggtttaggttaagaagttatagaaaaataactccacgcagaatgaagccccacgcacctgaatcgatgcgcggggcaaccttctaaagtgtttaagtctttttcaaaacttaaaaaggcgaggtggggatcaacagacacccacccacaaccttcaagtggccttaagcctggccgacctcgaagcgagcgaaggaggtgacggtaacgccagcctcgtccagaagagccttaacggtcttcttgctgtcagctaccgaggactgctcaagaagtacgttctccttgtagaagccattcaaacgaccctcaacgatcttagggatagcctgctctggcttgccctcttcgcgagtgatctgctcagcgatggagcgctccttctcgatgatctctgcaggaacgtcctcacgggtgaggtaagaagccttcagagcagcaatctgcattgcagcctgacgtgcagctgcctcagctgcttcaccttcaccggtgaaagcaaccaaaacgccaactgctggtggcaggtcagcggaacgctggtggaggtaaacagcggtcttgtcgccctcgagggttactgcgcgacgaagctcaagcttctcgccgatctttgcggagaactcctgcagagctgcgtctgcggtctgtccgtccacgtcaactgctgcgagctcttcctgggagttagcctttgcagctgctgctgcgtctgcaacctttgcagcgaattccttgaagtcagagttctttgcaacgaagtcggtctcagagttgacctcgaccatggtgttgccagaaactgcaacgagaccttcggtagcgttacgctctgcacgctttccgacgtcctttgcgcccttgacgcgcaggatctcaacagccttgtcgaagtcgccagcggactcctccagagccttcttgcaatcgagcatgccggaaccggtgagttcgcggagcttcttaacatccgcagcggtgtagttcgccattacggggcgatcctccttatgtatggataattaatgctttacaagcttaggttagggcacagtagccctacccgcccgtctaaaaagtgatcgtacaggtattcagtcgattacgttgcgacacggcgggctggctgcccaaaaagcccccacggcgatgaaattttaaaagtcaaagttccattgtcgtgggggctttaaattggtcagctaactgcagaaactgcagttaagggcagcttactcagctgcaggtgcctcttcagcctcagctgcaggtgcctcttcagcctcagctgctgctggtgcttcctctgcctcaggctttgcgtcgcctgctgcatccttagcagctgccagctgacgctcctcgcgtgccttcttaccctcttccacagcggtggagataacgcgggaaagcagtgcggtggagcggattgcgtcgtcgttaccaggaactgggaagtcaacaacgtctgggtcacagttggtgtccaggatggcaacaactgggatgttcagcttgtgagcctcagcgacagcgatgtgctccttgttggtgtcaatgatccacagtgcggaaggcacgcgggtcatctctgcgataccaccgaggacgcgctccagcttggtgcgctcacgggtcagcatgagaacttcgcgcttggtgcgaccctcgtagccgttttctgcagcatccattgcctgcagttccttcatgcggttcagacgcttggaaacggtctggaagttggtcagcatgccgccgagccaacggtggttcacgtaaggcataccaacgcggtctgcctcaacctgaacagcttcctgagcctgcttcttggtaccaacgaaaagaacggtgccaccgtgagcaacggtttccttgacgaactcgaaagcctgatcgatgtaggtcagggtctgctgaaggtcaatgatgtagatgccgttacgctcggtgaagatgaaacgacgcatctttgggttccagcggcgggtctggtggccaaagtgcacaccagcatcgagaagctctcgcatggttacgactgccatgttaagcccctttctaagtcttagggtttcggttttgaaaatttgtgcaggtttttatcctgcaccctagcggtggtttcccaggtcaacaccctaaaactcgaatgagctgtttgggacctcgttgctccggagttgaatgtgcattcaacgccaccgcgcgtagtcagtagttaaaattacccctcaccatgctttcaggcatgatgaaacacaattcggacacactgctgccgacaagtttacatactttgacctgcaatcccaaaccctcccgcaggtgctgtggattgtttcaggacatgtcttttactactaccccaattgccccactttccacaggggtcagattgtttgatggacggagcgcttgagtccagcaatgctgaatttcatgccctttcgactgatgtggattctggcccttacgttcaccctcaccctgctcacatccccagcgttggcccacccttacgtaaatcctgcgacaggcagtgaccgtgcaggccctattcttcggggctttgataagcccgagaagaattggcttccaggtcaccgcggcgtggatctacccctaaacattggagaaacagtgttggccagtggctcgggcactgtcgcttttgccggcatcgttgttggaactccgaccatttccattgatcacgccgatggcgttcgaaccacataccaaccagttcacgcccacgtgtcagttggcgaacacgtggaagaaggcgatgccataggcatccttggccatccaaccactaaattccctggacttcagtggggcgcaaaaataggtgaagaatatatcaatcccctatcgctacttccccggccaaccattcgccttaaacctcttaactaggcacgtggatgcgctttattaaacgcttcaagcagtctcttattactgacgtgggtatagatctgcgtcgtttgcattgacgagtgccctaatagttcttgaacctggcgaaggtccgccccaccgtccagcaagtgagttgccgcagtatgccgcagcgagtgtggtgacaaatggtcaacgccagtgacttttgccgctcgatcaacaatccttcgaacttggcgcgcattaattcgctgaccccgcaccccaacaaagagcgctttgggatcttccgtcatctcatcgcgcacatctagccaatttcttaacgccttgtgtgccgattccccgaatgggacaacgcgctctttatttcctttacccagcactcgtaccattttgcggtcgtagtcaatgtctgaaagatcgattccacagagttcagcaacacgcattcccgtggcataaagaagctccagaatcgcggaatcacgcaggaactcttcttcatttgtggaagctgcgttttccacaaagtctcctgcctgctgttccccgagaatcttaggtagatccctcgtgatcttcggtgaaatgagtcgggctgcttcatcagctttgaggtggccgtttttctgagcccatgaagaaaacgccttgacagatgcagttcttctggcgagtgttgccctggactttccctcatctaccgctataccaagccattggcgcagagtcggcagggagaaattgtcgatatcttcgattgtgtcagccatggcataaaggtctgatcgatatccgcgaattgttgcggctgaacgacccaccacaaggtctagatgctcacagaaatcgtcgataagcgtatgcagcttggacggcgcgtcggcgccggaaataccagaaggtggcgcgttccgcccggaacgcgccaccttcttttttgactcacccatagtgctaaccctagcgcgatgtccccccacagttgtggagccacattgcggaaccgtcttcaaggaaccagcccgaaccttgaagaagtttacttaggcttgcctcacacacactatctttcggttgatgcggatgcaacctttttgtgaagttttttatataacccccaggttttatggcatttccgcatttctcgaccaagcagttccgtcgcgtttcacgattccgcgcttgttcaatgcaatgagaaggaaaattgttaactgcaaggtcaacccggcttcggtagcgatactcgccgcttccctcccctctcctcggtcgtctaacgcatcaaaaactcgcagctcatttctggttaaaccctgtactggagtggccgcgaagtttaattcatactgagtttggctatccattgcacccactgcacccagaagtgaccgaacgtcatccgcactggtgaccatttgtgcgctgccgtttcgaatcctttcgtggcacccaagtgatccagcagtatttaccggcccagggaccgccatagcaatcctgcctaaaccagcacaccagctcaaagtgtttagcgcgcctgacctccaggctgcctccaccacgacagttccttgagatagagcagcaacgagacgattgcgagtgagaaagcggtggcgttgaggtggagttcccggtggatattcactcaccaacgccccctttccggatttggcaatctggttgaacagatctcgattgtggctggggtacgagcgatccaatccgcatgctgcgatcgcgatggtggagccttgtgcacgtacggcttcactatgggcgacgctatcaactcccaaggcaccacctgagatgattgtccactgatgagacacaaggttttgggtgaattcccgagttacttccgtgccatattggcttattgccctggtgcccacgagtgtgacggactgtgcactgagtgttctgagatttcctcccctaatccacaacgcatgcggtggcagcgcatcatcttgataggtacgcacatgatcactcatgccagaagcggcaaatccaaaagcatggtctaattcttccatcggccattcgtcgtcttcaggtgtgatgagccgcccaccgagtttggcgatagtttccagatcagtttgcgcggtatcaatcgagtaccgggaatcggtgtttttcagcagaccttcgccaatccactcttcgcggtgtttaataccaaatgcgatccgctctacatcatgaccttctttcaggagcttttgcaggtgtgcattgggaccctccaccacttttgagagatacgcccatgccagcaagcgggagtcaatcatgctgctacctcactgtatgtagtgccccgaagctccatggctcgcgcaatatggtcaagattgggctgctgttccccatccaaatcgcacaaggtccaacccagttttatggcccgatcgcagccacgttgggagattgttccttccgccaggaacgcgccgaggtacaccatggcgtcttctgttgcggcaaaattcctccgcaagaagtgtggatctacgtgtgcattaacaagatttcccagtccagaacggcgccatcggaaagctgccctctcacgagcttgtgccacccgatcagcaatgggagcagatgcctcaacgtcatcactacgcagcactgcacctttagagtgggtggcaacaaccatgtccaagcgatccctcaacggacccgaaagattattaaggtacgtcgcgcgagctgagccagaacagacacattcttgaggctgttctgcaccgcatctacacggattggccgcgaggatgagctggaactgtgcggggaaggtgacatcatggcgggatctgatgatgcggatcgagccgtattccaatggagtcctcaaagaatcaaggattgacgctggaatctcactaacctcatccaggaacaacacaccatgatgcgccaggctgatagcacccggaagaggagatcccgagccacctccgagcagagcagccttgctgacattgtggtgtggggaaataaacggagccctcgacaccggccctgaaaaggttcgccccacaacggaatgcactgccgtcgcctcgatcatttgttggggcgacagttcgggaagcaagctgggaatccgctcggcgatcatggattttccagaaccgggagggccaatcatcagcatgtggtgaccaccggcagcagctacttctgcagcaaacctagcttctggttgtcccaccacatcacgcatatcaggcagtttgaggctattttcatcattgaatagtccaggctgaggcaacgcctcttccccatcaagccatcgcaagacctggtcgatggaatgtgccaaaaagactgaaggatcctcaaccagtcctgcttcttgggcatttccctccgggatcacaatcttgccaataccttcctccttcgcggccaacagcgctggaagaactccagtaacagggagcaaggttccatcaagcgccacctcacccagaaataacgtgttctgcgcatgaaacttcgctttggggttagagccatgggcaacgagaactgcaacggtcatcgcgagatcacactgcgaaccttgtttacgcatggaagccggcgagaggttaatgatcactttggtctttggccacatcaagccactgttttgcaccgcagttttaatacgatcccgagattctgaaatggcagtatctgctaatccaacaatgtaggtaccaggcaatcctgggccaacattagcctccacacgaacgatttttgcctgcacacctaattgcgcagtggatatagttctaccgagcgccatgttccacatcctcataaacagtgatctctgggcgccccgtgtgcggatccaaaacgattgccaccacatcaaaacgaatcggagtataaggtttaccctccagccacagtgcagctgcacgcctcatccgcaacattttctgattgttcacagccgctgctgaatcaaaagccgacccccgccgagtcttcacttctacaaaaacaacaactccgcttgccgagcgaacaatgaggtcaagttcgccacatgaatagcgaacatttcgatctagcagcgttgcttgatcatctaaatattgttgtagcgcaacatcttccccgaacgcgcccagatattgtttttgtgttttcatctgtcccccacgattgtttaaaagtctgattaagctgtgctttcagattcaacgtggttttatcgcgggcttcaaacatctccagtcctcacctgtggataaccagtccccatccagggttgtccacaggctgagcccactaagggttgacaaaagacgcattcgatcaatctcgaatacgtcttttcaataagcaatcccgcccaatcaaagcaagatcaaagcaagattgagacgggattaatgtgggattccctagtgcataagctcgagccaaacaattgaatatcccattgtccagcgattttaaacctaagaactactcaggcatgatgatgtcaggcttatctaattcttcgatgttgacgtccttgtaggtgatcactcggacgtagcgaacgaagcgtgctgagcggtacatgtcccatacccaggcgtcagacatgcggacttcgtagtagacatcgtttccgctgttgtgtggaataagctgcactgcatttgctaagtagaagcgacgttcagtttctacaacataggaaaactggctgactacgtcgcggtattcgcggtaaagagagagttcaacctctgcttcgtagttgtcgagttcttcagcgctcatgctccaccttccgtcgtgtcattatctgcagcgtgtagccattcttggtgtgccttggccacatttgcataactatatctgtgctcgggacttgcgccgtggtggcgcaccgcatccatgtggatcttcgtactgtagcctttgtgaatttcgagaccgtagtgcgggtagtcgttggccatgtcggtcatgatgtcgtcgcgggtttgtttggctaatacacttgcggcggcgatgcatcgggcggaggcgtctccgccgatgatgggtaggtatgggactgtgaagccggggactttcatggcgtcggtaagtacgtagccgggttgggtgcctagggcggctacggctcgtcgcatgccggagatgtttgcgtgttggatgccaaatcggtcgatgtcttgggcggagatcacgatgactgaccaagcgagtgcgtgttttttgatcagtggcatgagtttttcgcgggtgctggcactgagctttttggagtctgtcagtgcggctagctcctggatgggtttgtccgggagtatgcatgcggcaattgaaatgggtccgcagcaggcaccgcgtccagcttcgtctactcctgcaacgggccctagcccgttgcgtgacaaggtgacctcaaaggtccgtagatgctttaagcgtcgcattgaggggggcgtcgaaaagcgaattactagcctttgatggcagggtcgtcgacgccaccgattcggctaaatggcaggataattgcttgaactttgcccttgatgttttcctcagggatggttccttggtactgatcgcccaggtggtagcgggaatccatggagttggtgcggttgtcacccatcatgaagtagttgccgccaggcacggtgatggggccgaaatagttgccgccgcattcggtggaaccggaggtctcatcgatggggaattgcgcaggttgcagcgtgtagctgtcatcgacttccttgccgtcaaccatgattccaggatcaccggcttggcacgaaacagtctgaccgccggtggcgataatgcgcttgaccaggtcattttcatcaggtgcgacaagacccacgtaagaacccaggttctgcaggccgcggatcaccgaattatcggaacgctgcgtagtgaatccaacgttccaggaatcagtacccttgaacaccacaacatcgcccggctctggatccgtgaagtagtaagaaaccttctccaccaggatgcggtcacccgtgcagccctcacatccgtgcaaagtaggttccatcgaaccactcggaatcatgtacatgcgtccgacaaacgtctggagcacgaaaatcagcgcgagggtcaaaaccacaaccactggaatttcgatgtaccacggagttggcttcgattccttcttagactttccagcacgtcgaccaggacgaccgtcctgcgtggaatcgtcagcatttgaagcactagaaaaatcagtcacgggagttcactctagcagcattacattaaggctgacctgaatcacacgtgtgccgaaaaatacttcttcgcccaaagctgcacctcggcgccatgcgccttccaaaaaggcattgcttttcgacgtccccctacgcttcgattttgcaaaattatttaggcaaggctaccttttgcctatgcatatgaagattagccggcgcgcattcctcggcacactgctcggcgccaccacccttgctgtaactgcctgcgcgcaatcctctcaaaaccaaaactcctccgcttcctcatcttcttcatcctcagcggaatcaagcacctcttcatcctcctccgatgaacagcgcatcgtcgccctcaacaccggtcagttggacaacctcctccttctcggcatcaccccagtgggcgtcgccgctgcaaaaaactctgacctgatcccacagttcctcaaggatcgcttcggtgcagacatggacttggacagcatcgccgactgcggtctccgccaatctccagacatcgaagccatcgcgaacctcaaccccaccctgatctgcgcaaactcccgcgccgacgaagaggtcctcaacaaactccgcacgatcgcccccgtggtcaccggcgaaggtggcggtgaaaactggaagcaagacctcctcaccatcgcagaggcagcaggccagaaggaaaaggctgaaaccctcctgaaatcatacgaggactcagcagccgaaatcgccgcaaaccagcctgcgaacccaccaaccgtttccttcctgcgcaccaaagatcaggaattccagatgtacggcgcacaatccatggccggaacggttgctgccgattgcggttacgcccgcccagaaaaccagcagttcaccgacacggcaggtcaagacctctccgctgagctcattgcccaagctgatgccgactggcttttctacggcatcaaagaaggcaacatcaaccctgaagacaccccattgtggacttcactcaaagcggttcagtccaaccaagcaatcccagttgacggcgattcctggtacctcaacgcatccctcgtgtcggctgaaatcatcctccaaggcctcaaagacaacgtcaccgtctaagccgatttaagggcctcaaatttccgaatgggcgttcccctcatcatgacaccgaagggcccttagaatcgattctatgaggtcactttttgtgggcccaaactcaaattttagtttgctccagaggaaaccagacaggcgtgcccatagttgtcgaaatcgacaagttttggcacgtgtatccggttatcggagcctcaaaccaaacaggcgtgcccaaatcccccaaatcacggaagttttggcacccctgtttggtttttccttttggtcgccccgaaatgaccccacccaagtcttatccgagtttcctgcgggatgaacgcgggataaatgcgggataaaccccacaaaaccccacaaaacccaccccaagaaacaaagaaacccccaaccaatcacttaaagtgactggtcaggggtctgttaagtactagaagcacctaacaaacgctaaataattagcgcttctccttaatacgtgcagccttgccgcgcagttcgcgcaggtagtacagcttcgcacgacgaacgtcaccacgacgaatgacctcgatcttctcgatgtttggggagtgtactgggaaggtacgctcaacaccgatgccgaaggaaaccttacgtacggtgaaggtctcgcggattccgccgccctgacggcgaatgacaacacccttgaacagctgggtacgggtggtggtgccttcgatgaccttgacgtgtacgtcgagggtgtcgccggcgcggaatgcaggaacgtcgtcgcgcagggatgctgcgtcgatcttatccagaatgttcatataaacaatccttttactagtagggaaagaggaccctggcggcacttccccaggtttggggtgctcggccggttcgtttccgtttcaattttcgaggctgtcacgtttgcccaacgtgagttggggtttgcacagtcaactgaaatattctttcacatgtgcgccttggttttcaaactggggtctgctcccctcacttgggtgcactaaccgttgacaaatcttggttgtcgggcttgactggtggcgacttaccccacgggtgcccaatgcattgggctgagattgcgcgctgttgctgcgcgggaccgttcgaacctgtctggttaacaccagcgaaggaagcgaggattgattgtcccgtgtttgaaaatcgttttgacctgcgttgttatgttgtgactggtgcgggctcggtggatgaggttgtgcacactgcgtctgctgcggctcgtggtggcgcgggtgtggtgcaggtgcgttcaaagcctatttcgccagaagcgatgagggagttggcatcaaaggttgcgcttgaggttgcgcggtgcagcccaacaacgagggtgcttatcgacgaccacctccacgttgcttcttccttaatgcgcgaaggactcccgattcacggtgtgcatcttgggcaggatgatatgtcggtgcttgaggctcgtgagttgttggggcctgaggcgatcattgggttgactactggaaccctagaacttgtggcggcggcgaatgagctgtccgatgtgttggattacatcggtgctgggccgtttcggaagactcccaccaaggattcaggtcggccaccgattggccttgcgggttatccccctttggtggaattgtccaaggtgccgatcgttgcgattggtgatgtcacccctgccgatgtgcgcgctctcagcgcaaccggtgtggctggcgttgccatggtgcgggctttttctgaatctgatgatccacagcaggtcgctgaaaatgtggtggctaactttgaattaggaaggctctcatgaagaagcatgcgattattatcggcggcggaatcattgggttgaccacctgctttgaattccaggaggctggttaccaagtcacgttgattgatcctgacccaatttccggtgcgactcatcatgccggcggaatgttggcccccaccgcggaggtgcagtatcagcaacatgatctgattttgttgatgaaggaatccgctcgcctatacccagacctcctccaaagagtgtctaaatacactgacttgcccactgggtatcgcactgatggaacccttcttatcggtgcggaccgcgcggatggcatgcatgttgcggagttgattaagtacatgcatttgaaggatttgcctgtcgatgtgttgactactcgtcaggcaagggctgcggagccagcgttgtcgccgaggatttctaaggtggtcagcattgatggggatcatcagctgtcgccgcgtctgtatgcccgggcgttattggatgccattttgcaacgcggtgcggagcatattgccgacgctgtgatctctattgatggccacgatccgtgtttgaccgtgacgatgaattcgggggtgagggttgcgtcgaaaagcgttgttgttttggcggcgggcctgggcgccgcaagcattcccggctggtttgagggcgcgaacccattgcagttgaggccggtgtacggcgatattgtgcgcgtgcgcgtgccggagcgactgcagccgatggtcaccaaggtggtgcgcgggtttgtggaagatcgtcagatttatatcattccgcgtaccgatggcaccctcgcgatcggcgcgacaagccgtgaggatcacccgcaacctcgaacgggcgcagtgcatgatttgctacgcgatgctatccgtttgattccgggcattgaagaaaccgaatttatcgaagtcacctgcggcgcccgccccggcaccccggatgacctgccgtacctgggatgggttggatccaatgtgattgcgtccacaggatatttccgccatggaattttgctgtcagcccttggtgcacgcgctgccgttgatatggcaaccaaccagccactgttccccactcttgatgtgtgcgatccgtttcgccaccaaatttaaggatttttcacaagtgattacctacaccttcaatggcacatctatgcgctcttccgaattgaccgtggagcaattggtccaccaagaaatcggccacgacactggagtcgccgtggcaatcaacgccgcggtcgtacccagatcccagtggtcacgcgccatttgtgacaacgattccgtagaagttctcaccgcaattcagggaggttaaaatgctgcatattgctgataaaactttcgattcccacctcatcatgggcaccggcggagccacctctcaggcgttgctggaggaatcccttgtcgccagtggaactcaattgaccaccgtggcgatgcgtcgacaccaagcaaccacctctagcggagaatccatctttgccatgctgcgccgcctcgagatcgcccttctccccaatactgcaggctgccgcactgcccgcgacgccgtcctcactgcacaattggctcgggaagccctcgataccaactgggtgaaagtggaggtcatcgccgatgaacacacattgctgcccgacaccgttgagcttcttgatgcctgcgaactcctcgtccacgacggcttcaccgttctggcttacacctctgacgatcccatcactgccagccgactagaagactgtggcgttgcagctgtcatgccattgggctccccgatcggaaccggcctgggcattctcaacccgcacaacattgaactgatttgcagccgcgcgagcgtacccgtgatcctcgacgccggtgtaggcactgcctctgatgccacactcgcaatggaactcggctgcgacggcgtccttctggcctccgctatcaaccgcgcccaaaatcccgtcgcgatggccgaatccatgttccacgccgttgaagccggaagattagccgcccaagcaggccggatcccgcaacgccaacatgcggtggcctcatcaagttttgaaggtttggcatcctgggcggagcaggtgctttaacatggcgcagcttcccacatctgagcttcaccgcacggcccgccaactcgcgctccccggatatggtattgagcagcaggaacgacttttcaacgcccacgttctagtcatcggcgcaggcggtctcggctgcccagtcatgcagtcgctggcttccgcaggcgttggaaccatcacggtcatcgatgacgacaccgtcgacatttccaacattcaccgccaaatcctcttcggcgcaagcgatgtcggtcgacccaaggtcgaggttgccgccgagcgcctcaaagaactccaaccagacatcaccgtcaacgcgttgcacgaacggatcactccagaaaacgcctgcgagctgctcaattccgtggacctcgtcttagacggctccgattctttctccacaaaatacttagtgtctgatgccgccgaaatcaccggaactcccctcatctgggcaacggtactgcgctttcacggcgaactggcactcttcaactctggccccgaccaccgcggagtcggcctgcgcgacgtcttccccgaacaaccctccgccgatttcgtccctgactgcgccaccgctggtgttcttggcgccaccacagccaccatcggcgcactcatggccactcacgccatcggatttctcacagaaatcggcgacgtccaaccaggcacaatcctctcctacgacgcattccccgccgccacgcgcagcttccgcgtctccgccgacccggcgcgcccactggtcacccgcctccgcgcctcctacgaggcagcgcgcaccgatacaacttcgcttatcgacgccaccctcaacggctccctcaccgccctcgatatccgagagccacatgaagttctgctcaaagacctccccgagggcgcaacgtcactgaagctccccttaagccagatcacctcggacagcgacattttagaggcactgtctggaatcgacggcgacattttggtctactgcgcttcgggaatccgcagttccgacttcatcgacaactactcccacctcggccacaaatttgtgaatcttcccggtggggtcaacgcgctgtagctgtcaatttaagaggccagaattctgggacgagtcaaagcatggcctgcgcactttgaggcgctcagaggcgattctgtgaggtcactttctcgtgcccccaactcattttttgcggtacttcacggcaggctgcctgattagaccaagacgccccctggcgaatcagtccttggcctaatactgcactaatccgctctcgaaatgtgagattcagaccaaggggagcttgagaacactcccgcttggtttgaaagttgccttagccaccgaggccggcgcgtcgtaaagcatctgccatggaacctgtggcgggcttagcggactgtttttgcggagctcgctgctgtttggctggtcggtttccgcgcttttgcggagctggggcaccgggttcatcggtcaagcggagggaaaggccgatgcgtttgcggtcgacgtcaacttccatgacctttaccttcacgacctcaccagagcgaacaacttcgtgggggttggagatgaatttgtcgctcatcgcggaaacgtgaacgaggccatcttggtgcactcccacgtcaacgaatgcgccgaacgccgcaacgttggtgacagttccttccaggatcatgccgggtgtgaggtcggagattttctccacgccttctttgaagctggcggttttgaattctgggcgggggtcacgtccgggtttatccagctcggcgatgatgtcggtgacggtggggatgccgaatcgttcatcagcgaaatcagcgggcttcaatttggtgagcaccgcagagtttccgatcagtcccgagacatccaatcctgtggctttcgcaatgttgcgaacaactgggtacgcctcggggtgaacagcggaggcgtcgagagggtcggtggatccagaaatgcggaggaagccagcacactgttcaaaggctttgggtcccaggcgaggaactttgttcagttcttttcgggaggagaatccaccgttttcgttgcggtaggccacgatattgtttgccaaggtggaggtcactccggcaactcgggtaagaagtggtgcggatgcggtgttgaggttaactccgactgcgtttactgcgtcttcgacgacaccatcaagggttttggcaagtgcaacctggttgacatcgtgttggtactggccgactccgatggctttgggctcaatcttgacgagctccgccagtggatcctggagtcgcctcgcgatagaaactgcaccgcggagggagacgtccatgtcggggaattcttcggctgcgatcggtgatgccgagtacacggatgcgcccgattcggagaccaccacgggggttggtcgcgtgccacctgcggctttgatcatgtcagctacttcgccggcgagtttttccgtttccctcgaggcggttccgttgccgatcgccatgagttccacaccgtgggtcgcgcacaggttagccagttcggatacggcttccttccagcggttttggggctggtgtgggtagacgatcgtggtggcaacatccttaccggtggaatccacgacagctactttcacaccgttgcggaatcccgggtcaaggccaattgtggagcgctgaccagcgggagctgcaaggagaacgtcgcggaggttggtggcaaacacatcgagtgcgccttcctctgctttttctttcagacgcatgcgcacatccaatccggaggacacatacagtttggtgcgccaaccccagcgcacagcctcagccagccagctagaagtgtgggtgtccagggagaatcggtcggcgatcaaaccttcgtagattatgtcgtcgcccgcatcgaggttgaggctcagcacaccttcgttttcaccgcgcagcagcgccaaaattcggtgagatggaagcttgtcaaaaggttcggaaaactcaaagtagtccttgaactttgcgccttcctgctccttgcccgccaccaccgatgccgccatggaacccgcgcgatacatttgctcacgcacctcgcccaccaaatcggcatcgagcgcgaagcggtcaatcaaaatggcgcgagcgccatccaaaacttttttggaatcctcaaagccctcagtcgtaaatgcagctgcctgcgctgcggcgtcgagggacggggcgtcgataagcttatcgacgagcccctccaggcccgcctccctagcgatatcggccttcgtcttgcgccgttttttgaacggcaggtacagatcctccaggcgagccttggtgtcgcatcccaaaatcagcgagcgtaaatcgtcggtgagtttgccttgttcctcaatcgcggcgaggatgctttgtttacgatcctccagctcacggaggtaactgaggcgttcttccaggtcacgcagttgggtatcatcgagtcccccagtgatttccttgcggtacctggcgatgaacggaacggtgtttccttcatccaagagcttgatggcggcctcgacttgttcatctttgacgccgagttcgagagcaatcgttcgagaaattgatgacatttgggcaattctacccggaatgtgtgctcgacccccgaaggatcacctgcccctgcaaaaccacatcgccggtgggaagttcgggattttcaatcagatctaccaacaagcgcacggcctctttccccatctcctcatgcggtggaacaaacgtggtaatccccgcgccgacaaagctgtaccactcaggatcgtcataaccaccaatcaccacatcgtggggaacgcggacattcaggcgagtaaaagcacgcatcaccccagccatcagccgaggagacgccacaatcaatgcatcgggaaggccgttgttaaacaccacctgagccatctcttcgccagattcgacagaatagtggccaaaatggaacgtcacctcagccccatatatcgacgccgcatgactaataccgcgcattcgttcctgcgtggtggaaagtgattcttcaccaaccaaagcagcaatgttcattccgctgccgcccagcaccgactcggtcagctgaaaaaacccagcctcatcatcacacaacacccgagggaaaccaggacccaattcaccacgagtcaactgcaccatggggattccttcaggagcaattgagccgaccactggaacgtggataattcctgcagcttgaatcgagatcaacgattccatcaccacgtcctgcgcctgcacactgttggcctccgcaaccagcatttgatagccagcagctttcagatcctgctgaatagtctgcagcgattccgaataatactcattggacaaatccggaacaatgacccccaccaaggcactgcgatgttcccgcaacgccttggccagctgatttggtacatagttcagctctttagccgccgcctgaactttctcccgcgtctgcggggacacataccccttgccagatagtgccctcgaggctgtggcataaccgactccagctaactcagcaacttccttgaggctcgattttgctgacatctccacacccccttacctttaattttcaattaccagagtccgatgacattcatccacaaaccaccgataaccaaccagattgtaatcgataccgcgccagcaattgccgaggtccgccaccactcacccaccgtgatgtagttcaaaccaaacaatgttggcgaaggaccaccagaatactgagtgagtgaagagaacaaattggaggtgtacgccaacaccagggccgccatcaacgggggtgcaccaatcgcaatcgcagcacccaggaaggccaagtacatcgcagaaatatgcgctgttgccgaggcaaagaaatagtgactgaagaagtaaatcagcaccaacacaaccaaagcaacgacccagttcatgccacccaaactggaagcaattacctcagagatccatgcgatgaatccgtactgcgataacgctgttgccatcatgtatagcaccgcgaaccacaccatggtgtcccacgcagtcttttcttgaatgatgtcctcccacgtcagcacgtgagccactagcaagatgatgacgccaacgaaagcggtggtagttgccgagattcccaagaccaaatcgccacctgtccagagcagcagcaacacaacaaaggttcccgccagcaccttctcaccataagtaaacccacccaattgcttgagctcatcagaagccattttcttgacctcaggggtgtccttcaactcaggtggatagatcttgtataccacccacggcaccacaataagcgccaccagaccaggcacaatcgcacccacagcccagtttgtccacgtgatattgacatccatctgcgaagccaaagaggcgatcaaggggtttcctgccattgcagttagaaacatcgcgcacgtaatcgcatttacctgtcccacattcagcgccaagaacgcgccagccctgcgacgagttgggccaggagtggaatcataagtcaatgccaccgacttcataatcggagccataatgccaccacctcgggcagttgctgatggaatcgcaggagccaacaccaaatcagcgagcgccaaaccataggtcacacccagcatttttccgccgactttagacacaaagaacaacgctattcgacgtccaagccccgtcttgatgaatccacgcgaaatcaggaacgccatcacaatcagccaaatggtgccgttactgaaaccaataaggccatacaccgcgccgggatcatcagaagacgccgtcaacggcaccaaaccagtcaacaccgcggcgatcatgccgataattgtcacggcacccattggcattggcttgagaataatcgccacaatcgtcgcgatgaacaggccaaacatccgccacgcttgatccgtgagtgcttcagggtgcgggcaaaccacatggcaaccacaatcaacgctggaattcccaacttgattaaaagattgctccaatgggacctggcaggtgcattaacaccttgggattggttcttgatcggtgtactcatcgtgcgtaaactcctgaacgattcgagttgttaaagttttgggttgttaaagttgggcattccaggcggcgacagctgcattcaccatggattgtgcttcgccgacgtagtctgcaggctgcgcaaaattcttaggcaacaggtcttcgaccccatgttgaactgcaattatcggcagttcttctgccagcgtggtgtgctcttcacgagtctttgtggatgcttcataaaccaagtcatgagctttctcacgccccagagctggagctagttgaatcatctgagcttccgccatgatcaatccaccagcaaaagccaagttcgaggacatacgatctgtatccactcgcattccttcagccaccacaatggcttcatcgagtgcagcgccagctagattggccaacgttggaatgacaagccattctccctgccactctcctgctgctcgttcatgtcccgattcctgaagccgtggcaaagtcgaggtcaaggcacccgccaccactgaaataccaatcatgagctcggaagaaatcgggttgactttctgaggcatcatggaagatgcaccccgatgggagttgtaaggctcaaaaacttctccgatttcagttcgggaaagatccacgatgtttcggccaaattttgccatcgatccacacagcgttgagcacacccatccgaagtccccaagcacatcgcgttccacatgccatgacaccaccgggtccttcagatccaacaggcgggccatctctgcacgaaccgttgccgcttgttcgccttgtgctgcgttgtttccaccagcaccaaacagcgaaatgactcgcacgcgctcgagtgcttcctcaagtcgttccctctgcctgcggatttgatccaaaaaggtagcgagggttgctccaaatgtagtgggaattgcctgctgagcatgggtgcgtcccggcatcacggtgtctttgtgctcttcagcccgtgctgccagtgcattccccagacgcacgatctgtttatcaagggcgttcaaagaggcagtcatttgcaacaccagtccagtgtccatgatgacttgggtcgtggcgccgtagtggactcgcccgttggggccttctggaaggtgactggcgatttgtcttaccaagccaaggatggggtagccgacatttttggcatcttcccacagcttctcgcggtcaatgttggaaaggactgccgcctggttgatctgtgcagcatcgtcttcagtgatcacaccatggcgggcttgagcagttgagagtgctctctccgcagccaaccagctttcgattgtggcatctgaagaaaagatttctagttgagtgtcatttcctgcgtactgccaaagttaggagaatggggctttgtcagtgggatacattgtgcgcgctcctagcacctatgggcttgtgtggaatcgtatccacaaaggtatgatgatcgttattcctggagccgaaaagtaggaaaactcacacctgccccacgcggcgttttaagcgctcagatttgagaaacgcacccgagggtcaatctggtcgagttacctccttaaacggtcatataaaacatcatcatttccgcatgtaatgggcgattttgacacctgtgagatccctgatcaagaatccgaccagctagcatacctgaagctctaaatcgaacgaatttttgcatggaacctcggctttcgtgcaaattttcgactgatttcgggtccccaccacccaaatcggtcggatttttgcatctcaccatccaccgcggtgcggatccagcattttcgacagtgcccctcccgaaaagcatttccgccagaacggcgggctaactgactaaacgcggaaaactagccccgatgctgccacgcgcatgatgcgttaacgccaggttcggtcgcaccttcaagggaagttccataccagtaggtcccctgaggcaacgcccccaccacctttttggtgaggtctttaagctccaggtcggaggagccgttaattactaggcggtggagcacttccacaattggtgggtggccctctagctgggagaactgggtgacaagcatgttgtcgggttcgcaggtgaggtcgacgatctgggagtggatttcagaggctacgaatccggactcactcaatgtcgctggtaggttttctagtactttttcccattcgctggggacgatgaggatgttgaggtcggttgaaacttctcgcatggtggtcatattcctttcaaccatttacttggcaaattgcttccgtgcgcggaaaaacatcagcgccagcaatcctaaggttatccaaagcatgtagcggttgaccacgttgacgatgtcgaggacttgttcgccgaaggtgtatcccagccagatgaatagtccgttgaccgatagtacgcagatcgcattccaggccatgatgatccagaagcggattttcaccaggccagccactgcgttgaggatggttcccggcactggtcctgggaggtatgcgagtggaatgaggccgatgatccaggcgtagaggcgggtggattcggagtcgacggattttttgaacatgcggtggaagcggggcatgtattggagggacatgtcgataaattccatgccccagcgcttacccatcagccaatagacgggcatgaacttcagcgcgccgatcagggtgcagagccagtagacccaccagatgccgttttctaccgaagcgttcgcgccgcccacgactgcactggtgtaaccaccgacgatgagggtgtaggccagaggttgggtgagcatccaggcgcgcagtgggatcatgcagagggagaaaatgcccatcacaatgagtgcgatgaacaaaatgatgtcggcgcgttctgggttgctgagaaatttcgggagctcgggctctggctttgggggttgaggtgtggtctctgtcatttgtccagtcccaatactttgaggtcggtggaatcgaggagggatgcgtcgataagctcaggcctaattgcctgggtgcgtaggagcgcctgatcgcgtcgccagcgatcgaccttggcgtggttgcccgagaatagtacttcggggacgtcaagtccgcgccaggtgcgcggctttgtgtacgacgggccttcgagcaggccatcggagaagctgtcttcttcgtggctacgacggtttccgagcacgccagggatcaggcgcacgacggcttccgcgatgaccaggactgccacttccccgccgatcagcacataatcgccgatcgatacctcgcgcacgcggtagcggttggcggcatcatcaataacgcgctggtcaatgccctcgtagcgcccgcacgcgaacacaatgtgctcctcgttggaccacgcctgcgcatccgcctgcgtgaacggcttgccagccggggtgggcaccagcaacagcggcaggtcgcggtcttcttccacgacataagcacgcttttcgacgccacccagctcatcatggcgcacatttttcaggtgcagcgaggccgaatcgagttccgcaccgctcacccggcctgcggcgacatcatcaagcgctggcccccagacctctggcttcatcaccatgcccgggccaccgccatacggggtatcgtcgacggccttgtgtccgccggtcgcccaattccgaagatcatgaacaccgacttccaaaatgccatcctcaatcgccttacccagcagggcatggcgcagaggatccaggtattcggggaaaatggtcacgacatcaagccgcagacggtgggaatcaagattttcggagctagtcacggacttcaatctaccaagaggtctacgctggaggcatgaagcctcacacacttttgcgacaagctttagcaatcggcagcgtgggtgggctcttggtgctcagtgcctgtggcaattctgattcaacttctcctactgtttcggaaactgtcacagaaattgtcactgaaacttcggcccctgattccacggcagccccgatagaatcctcgcctgctacctcttcagatgctgtgccttcagaagttgtgccttcagaaggcgtgcccaagcaatgcacaacctcggaactcaacatctcaaccggtacgcaacaaggcgctgcaggaagcgtgctgattgacctgaacttcaccaatgctggctccacagactgcacactccatggctttccgggcgtgagctttgtgggaatggataacggcacgcagattggcgcgccagcggttcgggaaggagacgccttccctgcggtcacgcttggacccggtgagaacacaatcgccgctctgaaaatttccagggcagaaaactacgactcggacgcatgctcactgcaaccagttgatgggctacgcgtctacccgccaggtgaaaccgcatccgaatatcttccgctggaaggattcaatggatgcgacaatgatggtcttaagctgctgactattaaatctgtcggagcctaaagatctaacaagccctctggaggggtgatcgttgcggttccttcttccagatccacctcaggaacaatggcgtgcacaaaaggaatcagtgtttccttgcctgaggtcaggcggacttccaggatctcaccggctgggccatgcatcacgccggtgacttcaccgatatcctcgccctcgtgaatgacgcgcagaccttccaactcatggtcgtagaagccatcctcatcgtcttcatcctcaagaggtgccgcaaagaatcgagttccacgcaaagaatcagcagcggtacgatctgggacctctgcgaacttcaccaagagtcgaccttggtgcatgcgcgctgcatcgatggtcagtgaatgctccttgcctgcctgcttgccgttgagaacttccccaatggcgaagcgaatgtctggatcatcggtgctcaattccaccacgacttcaccccgaatgccgtgggattttacaacttttccgatttgcagttcctgctctgtactcatgtatagaaagtttatgtcacgagcccacatccgccctatttcagcaatgtttaataccggtggaatcgtttttattaggatgggtggatacctatctttagtgagccgtactagcgagaaagctgccccatgactgttttcaatgttctccatgacgcacccgcaccacagccggataaaaaccgccccggtgtcaaacgtctcctccaaggtgatggcgcaaacctcatcgccttcactttcagccctggacagtcacttcccgaccaccgcgccgcacatcccatcaccgtgaccgcattttctggccagctcaccttcagctatggcgaggaaacctttgagctctcccccggtgtgacagtgcacttggaagcaggagttacccaccgcgtggactgcccgccagaagcaccaggcgatgcagtaatgctgttaactatgctcactggtgaaaaacactcagtcaaccaggcctaacaactaaaaaaccacccgcccacgatcactcgtgtgcgggtggtttttaaagaagtacaaacaaaagtggcttatgcctcttctgcagcagcttcctcagctggagcctcttcggactctgcagcggcagccttttcagcagcagccttctcagctgcttccttagcttccttgtcctcgcgagccttcttcttcttttcagtgatggcttcagcggttgggccgttgttagcctcagaaagagcctggttgaacagctcaagcttggatggcttaggctctgcaacacggagggtgccttctgcgccctcgatgcccttgaacttctgccagtcgccggtcaccttgagcagcgctgcaacagcctcggttggctgagcgccaacggagagccagtgctgcgcacgctcggagttgatcttgattacggaaggctcagcctttggctcgtagataccgatgttctcgataaccttgccgtcgcgcttggtgcgtgcatcagcgatgacaacgcggtagtgcggggtacggatcttgccgaggcgctggagcttaatctttacagccatgtgaattttcctcactaggtcactgggcagtacagtcactcaccgtgtgctggtgagccggttcagcccttcttgtttaacctgcgcgtgactcctccggacgaccggggtcgttggcggcaatacgcaggaaagtctgttagacgttgccacgcccattcgagcgcagacaacctgaacaatcttagcggtaactgaccaagaaataaaattgtggtgtcttcttgtcaaataaccactgtttatagggcaattctttggcaatgtacccaactcattacccacctgctgattcaaagagtagatttaaatagtgtgcttccgattgcctccggtaacgatgaccggaatttaatccgttatgtcgacggtggtcgatttgatgaaatcatgctcaccggagacctcactggcctgagcagttttcttaccaacgctggcccgaacgcccgggatgattttgatctcacggtgctcatgcgcgctgccgaggcaggcaacctcatggttgttgcccgcttgttagatttaggtgccaatccccgactcaccaatcctcgtggtgtcacggccctacatatcgcagcgatcgccggggacgatggcattgtggaatgcctcattgatgcaggcgctgaagtcgatgctgtagatgatcaaggtcgcactcccctatggaacgcagcggctcatcatctgcctgattctgcggtggtggatgtgctgcttcgcgcaggtgcgaatgtgaatctgcgcgattgcaatggagtcagcccagaagacatgctgtagaagcattctttagcaggatttatcgcaccacgcttttcattttgaacgcggcaatgagtccaaacaccactccccatgaggcaacaattcctactgccacccatgtagaaacgggttccccaaacatttccagtttgagtccgtatccgaattggaagatatcgaaggcttcgggtggaagtgaaatcgcgtccaatgctggggcaaccacaatttgtctgatcaacattccagctggggtaaacgggaggaagttcaacacgtttgtcactgcttcaggcaatgcgatgggtggaatataagcagcagataaaaagcccgccagggtgcctaccaggcttgaaagcgcagacattccgccttgagatttcaccaaggtgatcagaaatgctgcaattgcggaaaacaccagggtgagcagaagcaaggcgactaccaattcgagcacgcgagcaatgctcatgctgaagtgccccaaaatagctaaaccaatacttcccaccacgatttcaaagatcaaaatcgtcatggcgacaatgactgctgcgaagatataggacaccgtcagcgtcgttctggatacgggtgccacgaggaaatctttgatgcctccgcgggtgcgatcttcaaccagcactccaagtgctgcttgcggaacagtgattgcggacgtgatgagaattccggaaaacacccaattgaagacgaatccttcaacatcgtctcgggctgagtcaggtagatccaccatgagaccgtcaatttgcagttttcctaaaaacagcacgtacaggaccaaaaggatgagcgcacccatgatggaaaacagcactgccatgcggtcgcggaaaaagcagcgcaagtgtctgcgtgtcagaactgtaatcatgatcgtttccgttcagctgtaactgctagaaatacatcgtccatggaaccgtggcggatctctacgtcgagaaccccatctagttctgttgccaggcgcgcagcttcgagcccattttccaacttgatccgcagtcggtcaccgtcgatttctgggctcaagtgggccaactctttacccgaatgagtagggtcgtttgttctaagagtcaattctgttgtggtgtaacgggcgcgcagttccatcggggttcctgatgcgacctctttgccacggtcaatgattagaactgaatcagccagttctgtttcttccatgtagtgagtggtcaaaaagacagtgaggcccacatcgttacgcagggaattgatggtgtcccaaacttggcgtcgtgatctggggtcgaggcctgctgtgggttcatcaagaaaaagaatgtctgggctgtgcagtaaagctcgtgcgatgtcggtgcgacgtttttcaccgcccgacaacactccgtatcggcggtccgcaaacccttccatcccgatttgctcaatgagctgtgcaacccgctgcttccccacccctgggtacagctgtccgcgtgtttccaagttttctttggcactcagcaaagggtctaagacggattgttgaaacaccactccaagtttttcagaatctacttggccaccctgcagttcgatctccccagaggtggcttgatcaatgccaatcaggcatgaaatcgtggttgtttttcctgcgccgttctcccctagaaaggcaaaaatttccccttgtgaaacatcaaaatttaaaccgtcaaccgcaacggtgtcgccatagcgtttgacgaggtcccgcacttttaggatgggtgacatagttaaatttgtagcaaaaacaagtaatcggcgcatcgcttagggaaagtgatgcgccgaccaactaaagcaaagttacttcttaccgaagtctaggttgttgagatctatgttctccatgcctttaggcggctttggcatgcccgggagtccgccaccaaggcctcccataccgccacctgctccaccaagctgcttctgtagttcagcaaggtcaggcattccggctccacccatacccggcatcccaggcattcctggcataccgcccattggcatctttggctgggttgggcccttcttggctggtttacgcttgccgttcttacccttgcggcccttggcttgcttcttggttgcactgcgggatccaggacccatgccaaactggccagccatttgacccatcatcttgcgagcctcgaagaagcgttcaacaagtttgtttacttcggacacggtcacaccggaaccgttggcgatgcgcttgcgcctggaagcgttgaggatctttggattatcgcgctcggccggggtcataccgcggataatcgcctggatgcggtcgagttgcttctcatcaaccatgtccgccatttgggacatctgcttgccaccaggcagcatcttgaggatgttgccgattggtcccatgcggcggatcatcagcatttggtcaaggaagtcttccagggtgagctcgccggagcccaacttctgggcagcgacctctgccttttcctgatccatgactgcttcggcctgctcgatgagtgacagtacgtcacccatgcccaggattcggctggccatgcgctctgggtggaagacgtcgaagtcgtcgagtttttcaccagtggaggcaaacatgatgggcttgccggtgacttcacggatggatagtgcagcaccaccgcgggcgtcgccatcaagcttggtcaggacaacaccggtgaagtcgacgccgtcgcggaatgcttcggcggtgtctacggcgtcttgaccaatcatggagtcaatgacaaagagcacttcatcagggttgatggcttcgcggatgttgcgtgcctgagtcatcagggtttcatcgataccgaggcgacctgcggtatccacgatcacgatgtcgtgctgggtgcgcttggcttcttcgatacctgcgcgcgctacctcgactggatcaccgtgggaggtgcccatttcgtgctcgagggagtcgatgctggtgcctggatccggtgcgaaagtggtaacgcctgcgcgttcacccacaatttgcagctgctgaactgcgcctggacgctgaaggtcacaggcaacaagcataggagtgtgaccctgcttgaccaggtgcttggacagtttacctgcgagggtggtcttacctgcaccctgcagacctgccagcatgatgacggtcggtgggtttttggccagtgacagtcggcgggtttcgccaccgaggatctgaaccagttcctcgttgacgatcttgatgacttgctgcgcggggttgagtgcctgagaaacttctgcaccaacggcgcgttccttgattcggttaatgaaggcacgaacaaccgttaatgaaacgtcagcttccagcagcgcgagacggatctcgcgtgtggttgcattgatgtctgcctcggtgagctttcctttgccgcgcaggccggaaagcgcgctattcaaccgatcggacagtgactcaaacacgaatgaactcccagtaggttctagagtgcggggttgctaatccctacatgttagccggttgcccccgctcaggtcacgtcagctacctgccaacgacctgactacggagcgttccaccgttgctcgatcgaagccgggcttcagtgctgcctggataatcagggtcgcaccgcgggtcacagcgttgatccagagggcatcgggcaatgttctgagcagggcaaaaatagctcctgtgcgaagctcagtgcgcacttctaaagtgttcccgtgccaaaatgtggctgttatcccaagtgctggaatgggaacctcggaaaacacaccggattgatatgcctgcaggaaatgctgcggatcaaaatcttgggggccgtttgcgcggacatcaaattccgcactccattgaccattggccagcatgcgcgccgcggtgattgtccatcctttggcataaattacgccaagaatccgatgtaagtcttcgccgtgccattgcactgtgaacacgccatcgcgttccaccaaaccaatttcactacgtggcgcaatcatcggcgcaaccgggcgaatatcggtgaggcgatcacgcgcacgcttgcacacaatccgcagcgcatgctccaaacgcgccgtccacacgccaggccccgtggctttcgcatcagcttctgttagcacctcaagcagattcaatgtcaccaggtcatacctaacagcatcaagcagcttatcgacggcgccctccgaggagggatcaaggcgcgcggcgattttggccaccgcggtgtgctcggcgaccagcgtttgcacgctggcacgatcgcgaaggttcaatcccatgcggcttgcagccctcgccaccatctctgcacctacttgttcgtgtggacgcgggaagcccttgccaatgtcgtggtacaaggctcccaaaactaaaagatcggggcgcgcgacggtcacagtttctagcgcacatcctgcaacagtgttcagactatgttcatcgatggtggaaatatggctgggttcacggggcataagccctttgatgcggtcccattctggaacaaaacgcgaccacaatccgtggcgatccatatttttcaccactcggcgtgagtttttcggactggagagaatccgaaagaagtcccctgctgcattggcaggccatggctcaggaagtggcgggcattcattaagtcgaacccaggttgattctgccaccggaagtccggtggttgctgcggctgcggccactcgaagtggaagtgcgggatcattaagatctggttttttggacaattcgatggtgccgttggcgtcgacgacatcaagatcaagtgggcgtcgagaagcattcctgaatgcaaaacctgtgcgacgtggcaaaatgccacgggcggtggccagcgcggtggtcaggccatcatcaatggcgcgggctgcatcggcgatctcccggcccaggtgatagcggtcaacaaagcccaaatccatggccacatccaccgcaaattcggggtcaaggacgtcgcgggagcgtcgcgcgtggacgtgcagcaaggtgcgggcgtcgagaagcagctggtgttgcgcatcaagctgtggaaggttgcataggtggccgagcgcgagggccttgatcagttcgaaatcgcgcagccctcccctgccgtgtttaagatctggccgcgtcattgccacgacgggtccggagcggcgccaacgggcaatcgcggtgtccacaacggcatcgaagtttttgttgagttcctggcgccacttctccacgatgcgccggcgcgttttggcacacagatcctcatcgccagcgacaaaccgcaggtcaagcatggcaagggctgcagtggaatccgcagaaatcatagccacacactcatctggggtgcgcacggagtagtcgagacgcttttttgcgtcccaaatcgggtaccacaaatcctccacgccatccggggtggctcctggtggatggatcaaaatgaggtccaaatcggaatacggcgtgagttcggacctggccaaagatccggtggcggcaagcgcggtgccggcgggtaaaaccaaagagcccagcaacgccaggacttccttttcagtatcttggcgcagctgggctggattattcataagtttttaaagggctgcttcgccgcgctcaccggtacgaacacgaaccagctcttcgatgttagtcatccacactttgccgtcgccgactttgccggtgcgtgcggtctcgacgataatgttgatgacttcctcagcctgagcatcggagataataacttcaatcttgaccttaggcacaaaatcgacagcgtattcagcaccacggtacacctcggtgtggcctttctgctggccaaagccttgggtttcggtgacagtcatgccctgcacacctgcctgctcgagagcatctttaatgtcggtgagggtaaacggcttgacaattgcggtgatgagtttcatgatcgtctccttcaaaaagacattcggaataatgtcagagtggtttaggtatttttaaacaaacttaacgaatttccggacccgtggtgtcataagcggattctgcgtgttcgtgagtatcaatgccttgctgctccacatcatcatcaacgcgccatcctactgtggccttcagggcgaatgcgatgagcgcagtaatcacacctgcgaaaactacagcgactagcgcgatgacgatctggacaataaagagtttaagtccatccatgccaccaccactaaaccatccgatgtcagtggcaagaagtcctacacccacggtgccccacaggccagcgaccaggtgcacaccaactacgtcgagggagtcatcgaaaccgaagcggtacttcagccccacgcccaagcacgccaagatgccgccgattgcaccgaggatcagggaggtcactggggtcagtgcgccagctgctggagtaattgcgaccagaccggcgacgacaccagaagcagcacccaaggaggttgcgtgtccatcgcggaatttttcagtagccaaccagccaagcatcgcagctgcggttgccgccgtggtgttcacccaggccaggcccgcaaggccgtcggctgcgaacgccgagccaccgttgaacccgaaccaaccaaaccacaacagcgcagcgccgagcatgaccatgggcaggttgtgcggcctggcaattgccttgccaaacgtctttcgcttgccgacgataaaagccagcacaagggccgctgtgcccgccgaaatgtgaacaacggtaccaccagcaaagtcgatcggagcgatattggcttcaccatcggtagaaccaaacaaccacgaagcaaaaccagtgacattatggcccaacaatccgccaccccacaccatgtgtgccagtgggaagtacaccaaagtcacccacgcgccgctgaaaataagccaggtggaaaacttcacacgctctgccaacgcaccggagatcagtgcagtggagataacggcgaaggtaagctggaatccgatatcaataatgtttgggtagccagctgcgccctcaatgtagttgccgtctgcatcaacgatggaatctttaagaccgaagaactcaaaagggttagcaaagattcccgcgattgattgggttccataagacatcgaccatccccacaagaggtaaataacagtaacgacgcccaatgctccaaaggacatcatcatcatgttgagcacggacttttgacgagacatgccgccatagaaaagtgccagtgctggtgtcattagcagcacgagcgacgcggacatcagcatccaagctgaattgccggagactgctgcaatttgatctgcacccatagcgtggatgacctcctttgacgttgaagttttgtcaagctttttcatgagttcaaggagtgccttttgggattgacaccccttgaaccagctctaactatagacctacagaaactaatttcaatagatctatagaataggttttggagggttttggatattttctatagtttaacaggtaatttaatgaattgttaagtgcatcacagctgctttttggtggtacccaggcaaaagaaaaccacctgccagacaacatccgacaggtggttctcgcttatcgggtttctagcccagcaaagcgtccacgaagccctcaacctcaaacggtgccaaatcatccgcaccttcaccaagaccaacaagcttcacaggaacacccaactcttcctgcacctggaacacgattccgcccttcgcagtaccatccagcttggtcaacaccacacccgtaatatccacaacttcacggaaaatacgagcctgctgcataccgttctgaccaaccgtggcatccaaaaccagcagcacttcatccaccactgccttcttctccaccacgcgcttaaccttgcccaactgatccatcaaaccagtcgacgtgtgcaaacgacccgcagtgtcaaccaaaacgacatccgcctgacgctcaacacccttagccacagcatcaaacgcaatagatgcaggatccgcgccctcagcgccacgaacagtctccgcacccacacggcgaccccacgtctccaactgatccgcagccgccgcacggaacgtatccgcagcaccaagaatcaccttatgacccatggacaccaacacacgagcaagcttgccagtagtcgtcgtcttaccggtaccgttcacaccaacaaccaacaccaccgctggcttaccctcatacggcatagccttaatggagcgatcaaggtcaggacggcaagcatcaatcagcgaagcacgcagcatcgcacgcgcctctgcctcactaccaacaccatgctctgcgatcttgtcacgcagctcatccaccacacgcgcagtgatcttggcgcccaaatccgccttgatcaacatcgcttcgatgtcttcccatgcgtcttcatccaagtcacccgcagacaaaatgcccaacactgacttaccgaaaacactctgtgaccgagaaagacgaccacgcagcttaccgatacgacccgccgccggcacgatctcatcaataggctccgcagctggctccggctccacatctggaactggagtttcctccagcgcagcttccgcagattccacagcaacctgagcagcctctgcagcctcggtgacctcagcaactgccgcaagttcttcaactgcaggttcttcgattgtttcgggaacttccgctactgcaggttcctcaacaactgcaggttcctctgctactgcaggttcctcaacaattgctggttcctctgctactgcaggttcctctgctactgcaggttcctctgctactgcaggttcctcaacaattgctggttcctctgctactgcaggttcttcaacaactgctggctcttcagtttcgacctctggctcaacagcgacaacttctttaacctcaggctccttaacttctggttcctcgacaacatcatcagaggtttctggttcaggagttgcaggtgcttcttcagcaggcttttgagctgcgaaagtttcagtcgattgctccggcgccttttcctcttcaggagctgccggcggaataactactggtggaacaatcggtgttgtttcagcctttggtgcgccaagatcttggccttcacgcagcactggctcttctgtttgtttagctggggcgaagttgaatccaccttgggcttggtaatttccagacttctcttgctgggttagttcttttttattctcttcaggtttttcaaaactaacggtctttgatttacctcgctgatttcctacgatcaatacaatgatgatcgcgagaaccacgaggactactagtccaatgatccaaaaagtcgcatccataccctctatagtggcaggtttgaccccgatgcacacaggtaccccacgttaaatgtggtgaaactcttgctttcatggagtcgaggtcgccgaaatggggtctcgttttcgcttttggagcgaaacgattccagtttgagcaggtcagaaggcctgactcccccagcgccgttttaagccactcattttatagaacgagtgtttgtatcggcaaagtcgttctatgccgttagaagcgaatctgttgagtcgactttttgggtccaggtgccagaaattggggtagaccaaacctgaatgcccaagaatcctaaatgtgaagttcgtgggcatctgtgtccgatttgaagccctgaaaaccacactagaatgcccaagatctagaaatcagcgtttggtgggcactgtggtttggtctcggcttgccaatacccaatcagaccagacaagcatgccaacgaatctgaaattccactgtttttgtcacgtgtgtccggtttatcaaacaaaaaaccggacaggcgtgccaaaacttccgacaaatcgaaaatcttgtcacgcctgtctggtgcccgctaggtgccctccgatgaaatcagggactaatcgacgagtcctgggtttcgagctcccaaaaccattgcctccgcggagatcaagtcaccggtgacaaggtctggcaccagatcagcgattcgaccccaaccggcagatgcacgatcgagagttcgggtcttgccgatcaattcgtgtgcatgcaaacgggatgacaacgcgaacaccagtgacacaactggggtgagtgcccacatgttttctgggttgtcagtgttgacaccatcgagcttgtcgaatcgaatacgtgcggaggaatacagctgacgctgggttccacgcatggcacgaagaagttctacagcggtcttaatcaagccttcagtctggagaacctcacggagtgcatcgcgcttcttgaaggtttcgaacactgccatgaggcgggtgttgtcttccattagtggtccaggaacgatgtcggcgttgctgaagaacatgtccagcagggctttttgctgggtttcgttcatgccggcaatcgcaacggtggattggtcgatgcatgcggtgtccaaagtggagtcacggccagttgcaagggtggacaggatgttcttgccggcgacttcctcaagttgtccgaggattggcagcagtggtgtgcggttgccaagctcttcggcttccttgaatgcgcttggcagtgcacccaggagttgcagggttccgatccatgcggtgcggtgcacttctgttgctggtgattccgtggtgaacggtgaggctgccagtccggaggaaatgacttttccaggtagtgcctgtgcgggaaccagcgaagcggacagacccttcagtgctgcggctggtgaggagcgcagggcggcatggactactggaagatgctcggtgtttccctgttcggtccagatatgggaaacatcccaaagtgcggggaccacagcgtcactgattggtggttcttctacttccccaccgaagaatgctgaaagctgtgcatattcttcggtttgtgctgagtagtagccttcttgctcaacggtgaccgcagcttttcctggtgacagtggggtcacggaggtagtgaatgggtcagcggtgtggagttgaacaatcaggttgcctgcgccgacgagaacttcagggagttccagctctggtccggtgacagcaagttccactgcgcttacccacggtgcggtttgtggccacacccatgcagcgagttggcgaccggctgcgagttcttcgaatacgagctttccatcttcgatggtgatgccagtaaagttctcagttttgtcaatgacagcaatcgtcacggaaacgcgacggtcaaccttgcggtcagtccactcaaattcgatggatccgcgtggcatcacaaaggtactggctgcgatttccttcatgctggcaatccaggtacggccgttgtcaggggtgaccattttcacggttcgcagtggtgaaccgtggtggttgcgcacactgacctttggatcgccgacatcgacaccggtgcggatgcggagttcgcctgcaccgtcgaggtcgcgtggtccacagacagtacgggtgacgcgccaggttggtggctcggtggtcagtggaagttcgatggcgatttgtggtggcacaaatcgcaatggcatttgatcgccttcatcggtggtgaccacgaatgatgcgttggggtcggttgcttcaacggtgaccaggcgtggctctgcggtgaagtgcttttcaccggaacgcacgcgtaggctggcttcgctgagaccagtggtggttgggattcgaaatgatgcacctgaggcgacttcgaattcggtggtcatgtcttcgacgatggcgaattcgtgtcggaaggattcattgcgtgggccgcggagtcggaccaggtattcacccacccatggggcgtcgtatatttctgggtcgaagatggcgaaaaggccaccgtcggcagggacttccaaaggctctggctcggcgatttcttcaccagcagcgcctacacctgcgaaagccgagatggagagcatccaggtttcgtcttgtccgctcagggttggtgggaactcggcgatcagggactgcgcgtgtacggggagtccggaaatggatcgtacgtgagggaccaattcggctgggtggtggaaggcaacgcgtcgacgtgggtcaatgcatcggacttctttgttgaccttcagagaggacaggccacgggcgtccacgcgggagcacacccatgagttccagccctctacgaggaattgctcaataactggtactggctggccagtgaccatgtcttcgagttttgcttccgctggcgcgagaacgtaaatctcttgatggtgcagggagaccttgtcggtgaggttttcaccgcgcgcggaaaacaccagcactgggtcgttgaagtccacgactgggacaacccaggtgatttggtttgaggtgtcggtgacggtggtttcgcggatttgacgctcgacagtgatgtcgagggcttcggagtatccagaagtatcgccccatgctcggcgggtggagaaaatccgggtggtgccttctaggctgactcgccagttgatttcatcgtcgctgacgcgctgttcaggtagacgcaggcagactttgcggcgttctgcatccaggatgaggcgtgggcgaagctcacgaagtgccacaccaacggagttttcacggtcggcagtaccaactgggcgttcccgaagttccgccacaacgatctcatcgatcatggctggcagtgaggattcgcgctggcggtctgaccaagaagttcggtgggtggtggcaaattcaatgagttcttgaactccgccgataagggtctgtgcccactcaggggttaggcgcaggacagcgtcgaacatgaatggatattcggtggtgccgttttccacttcggtcagcactgcggccacttcgtggttactaatgcctgcgtggatggataacaactccaatggagatgcaattccctcaggaacgagcaggccagcctgtgcgaagagcttttcggtcaacccttcaacaactgctgcgtgttctgcgctaagtcccagtcctccgatgtattcaccgaagaaatctgctggatcgctgatccgtgacgcccgagacaccaaggtggtgactgtcaggcatggggtcatttcaaaaagatccccaaggcttgcgcccgcgcctacctggcgggacaaaaaggtgccgtaaaaccgatgaatgcgctcgagctcatcgtgtcgcagctgaatttgtggaaagtactctacccctgcaagacgctggttcagatccagctcagtttgtgatgcccatccgagcaatgaatctgtcatgtctgcgatgccagccggcatgtatacactctccccgcgcaaaaaatgcgttttcctctagaactaattgtgatgtttaaacacactaccccactgcaagcgctgaaacatctgtagccaacctgcgctgtgagctggaacatcatccgtgctcagcgcaggttttaccccgccacagtttccattgcagaagcaggttccatgcgttgggagatcacgcgggtaacgccatcgccacgcatggtgacgccgtagagtacgttagccacatccatggtgggtttttggtgggtgatcacaatgagctgggagtcgcggcgcaactcttcaaacagtgcgataagtcggcgaaggttgacatcatcgagtgctgcttccacctcatccatcacgtagaaagggctgggtcgggcgcggaaaatcgcgacgagcatggctagtgcggtgagggatttttcgccaccggatagcagcgataggcgcttgacgcgttttcctggtgggcgggcttccacttcgatgccggttgccagcaaatcatcgggctcggtgaggatcagtttgccttcgccacctgggaacaaggtgttgaacacgcgtgggaattctgcttccacgtcgttccaggcatcggtgaaaagctgcagaattttcgcatcgacttcttcaatcacgccgctcagatcggcgcgggcttgttccacatcggccaattgggtggagaggaactcgtagcgctcttccaaggctttgaattcttccaaggccagggggttgactttgcctagtgcggcgaggtctttttcggcttgtttgaggcgtgcccgttggaacttttcatcaaagttttcatctggggtgtaatcgcgcagcaattctgcgaccggaatgccaagttgctcggtgattttggcaacggcttcctccatgcgcacttgagcttggctgcgcgcaagttccatggagtgggcgttgtcgctgagtcgattgaggtgctggcgtgcagcactcacagcatctttggcgcgcgctaagtgtgaggtcagcagcgctttgtcgcggttgtgctgatctctttcgatggctgcttgggcaagggcagctgagacacgctcggccacatcgcgtgcgccattttgcacggctgcagccaattgggtgcgcctgcgacgggcttccatggcttgttcatgccggattttggcttggcgctcatgctcggcctggcgtcgcagactatcgcccttgccccgctgctgcccggcgcgctcttcggcggtgcgttgggcaaggcgtgcttccatttccatggcgcggatttgttgcagctcggcatttgcttggtcgcgggcggtggttgagggttcgtcagcgtcttcttcgtcttccacgcgggagagtcgatcgacgatgtcttctaactgttcgcgcagctcttcacggcgtgtttccgcagcatgcaggcgtccaacatggcggacgcgctcggattcggcggcctcatgttgtttgtccaagcgcgcgagatcgcgggtgatggaatccctggtcatgtcgagttcgcgcagggctgcggtgcgggcagccacctcgacgcgagtgttgtcggcagcgtggagggcgccatcaaaagtgccggcaatgtcgtccaaggcggcagaggccgcagcaagttgagcttctgcttcctcaatttgagctgtgatttccacagtcgaggtttcggtgccgacctgaatccacccagcgccgatgagcacaccattgcggtcaacggcacgcagacggggatcatcctcgattgcttggcggccgagggaggggtcgtcgacaagcacaacgtcggcaagcagccggtttaccgggccggcaatcgccggatccagatcaacatggtcgagcagccagctcgccccggccggaatgttcgcgtccaggcgccatgcgccgccagcctgcgtgccatcaacgatgatggtgcgtgcaacgccggcgtcgataagcttctcgacgagcccttccgcagcctcgccagccagcgcctcggcatgcgcacccagggcggcagcgagagccttatcgacgtttcgttgcggtcgaatcaacgtggccagctgcgggtaatccaccacatcagcagcatcggaacgtggcctattttggttaagcgtctcaatgcgcgactgcaacctggatacttctttttccagatcgctgcgcttagtacgaagctcctcaagacgagtctctgctgcttcggcttcatgttttgcctgtttgagggcttcttccaagggcgcacgatccgtgtcaacgccctgtttacgctcatcggtgaggcgacgttcacgttccacatccaaaatgcggccgatgaactcctcaagctgctcactgagtcgctcagcttcctcctctgctgacgtgtgctgggtgcgcaaagattcctcagatgcaagcaggcgcacaacaccttcacgacgatcagaaatcgccctgacctgcgccaagtgttcacgctcagcctcacgagcctgcgcggccttatcctcggcttcctcttgaatggaggtcaaacgctcggtggtcatttccacggccatctcgagttcttctaattctttgtcagcagtttcggcccgaccaagcaactcatcaggatcctggcccgcatacggcacatccgcggcacctgaactcgcacggtctgcagcaatacgcatcgttgccgacacccgctcagccagcgaagacaaatcaaaccacaactgttgcgcagcttcagcctgcggagtgatctccgccaactccatctccacttccatctgagttgtggtggcttcttccagctgctcttgtgctgcttccgcctgctcacgaatcattttctcgcgctcagtagaggtttccagcttttccgagagcttcacgatctcaaagccagcaatctggaaacgcgcatcacgcaaatcagcctgcaccgtcgccgcacgctgcgctgcttccgcctgcctagccaacggcttgagctgcttggccaactcatgggtcagatcctgcaaacgatcaagattgacctgcatgccctgaagtttgcgctgcgccttttctttcctgcgccggtgcttgagcacacccgcagcttcttcgatatacgctcggcgctcttcggggcgggactccaaaatctctgcgagctttccctgccccaccatgatgtgcatttcacggccaataccggtatccgacaacagctcctggatatccatcaatcgagctttcgccccattgatctcatattcacttgcaccatcacggaacatccgtctggtcaccgacacttcggtgtactcaatgggcagtgcgccatcagagttatcaatggtcagcgtgacttctgcgcgacccaacggtttacgatcgcccgcgccagcaaaaatgacatcttccattttgccgccacgcaaggtcttcgcagaaccttcacccatcacccaggccagcgcatcaaccacattggatttgcctgaaccattcggacccaccacggcacaaatgcctggctcaaatttcagggtcgtcgcagacgcgaaagacttaaaccccttgagcgtcaacgatttcaaatacataacggggttaaagtctagcgctccacaaagccttcaacgtcacgcggctcgccccattgctcaataactgtgtccacatgacctggtctgcgatacgagctggggttttccttcaaccttctcagcagttcttcgcactgtgtttgtggcccttcagcaaccacgcacacccggccgtcacttaaattactggcagaacctgcaagttttaattctcgtgcctgcgaggtagtccaccatcgaaaacccacgccctggacatgaccatgaacaaaagcagtcagacgaactttctccattgtgtttctcctaatcagttttcttagcccgcagttttagaaacggtgttggggctggtggttcgagttcttcaaaccagccaggttccatcccatgatcgctcaaatacttcaacgcccgctcaatagtcgaacgctgctgctcgaaagctttcaaaatgggcgaagaactatccgacacgtttttcacacgcgtgtgctcccgcacaatcagacgttctgcctccgcgaattcttcccacacctcatgagttctatctatctcatggcgctgccacaaaatagccaaacttagcttctgtacaacgagcgcttcgatctcttccgtggtgttcaccgagctcaacaccccagcggttaaactgccgccaccaactgtgagcagtgttcctgcagtgaccaaaccgcccatcatcccacctggaccaaatgctgcgagtgtcgaggcaacagtggctactccagcaacagtcggcacagccgccaaagccaaaccacccgttgcagcggtcaaagctgcagcccccacaccaaacgctccccatttgcgccaattgctcttcgcgcttcccgacaccaccccaacagccatttgcaatgcatcaaaaatatcagcgcccacggtggaacccaattgagtttccgccgtgaaatccctcagtgcttcccgctgaattttctccggcacctcgatctcaaaaggcagcagcaggttctgtccaatgatctctaaaagccgctcaattgcctgctctttgggcataaatgggctcaaacctggaacaggagctgctgcgtttggatcaccgttatcaaaatccaggcgtgcgatttccttcggaatcggccggccctcttcggcgtttctggatttaatctcctcaatcaggcgatcctgagtctcccgaagtgcgtactcataccttaaggcttcatcgcctttgagccgttgcaaaatgaggtaacaataacgcagcgcctgcagcacaaaaatctccgcgtcattgagcggaatctgcagatttttctccgcaaggacgatttctttgctgcgcgatccgaacagcccaaacccaattgcttccgccactgcatcattggcacagtattcccgcgaagaatgcccagggcctgggaccagtgaggttttcacacgaaaatccaatacccacggaacagccaccgacactccgcgttttgctgcaacaggatcagatccactccaaaaattcacccaccacgacacattgctcaacggcgtgcgcagcaacttaaacaaatcatccacattgaattgaccatttgccaacggactaccgatggtgacaaatcccttcaccgtaagctctggcggcaatcgcctcaaaaggtctgcagcaattaccgaccccaaactgtgccccaacagcacaatctctccctcggttggaagctgctccaaaatacggcgatgcacttgagctctgatctgctgattgttgaggaaattccgggcctgtacaaaaagtggcaactccacgcttcgagacaccaccgcctcaggaaatgcgccacccgctccccgattatgccgaccaagcctggtttccatcgcagctgttcgacgctcgaactctaaaagctccaagccacttaacgtcatatgtttttgtaccggtggcaccgcaaaattatgttgagcttccggatcttcccacaaatcatctgcgtataccggatttaagacagtgacatcatccaggctcggaaacccaatcctggccaacccctgcgaaagctggtctttccactcttgtttgagatctccccgacccaccccatgcaaatagacaagagttggtgttgtcacaattgccccactttccaccgttttccgccgttggagttaatgattaatcaacgctcgaccggtccaattagttccactgatgttggtttatgcctttagggttctacttaggattcctcgtcccgaaagctcaacagggcgtctataaaagatttttctacgtcagctaatgtgcgtccttccttcaccaacatccatgcatcgcgttgtgcccaaggttcctcgatgggaagtacattctttgtccggatccctaatcttctcgtagttccaagcggaagaattgccgatcctgctccagtactagcaaccgcataaaccgcacttaacgtgggcaaacggactcggtagttgggagtgattccatctcttctaaggtgcgcatcaatataggtttgaagtgggatcccagcagataaaccaatcattggaccctttagtgcttccactgatgtcttagctgacgtgctgacaatcatcaaaggatcttcccataataagtgtgcttctaaacctgttcgagactccagcactgacaccacccctaaatcagcagtgccttctcgaacccgtcgtgcaacctcactgcttgactcttcttccaaatcaacgttgagctctggatacttattaagcgttgctgccagaaactctgtcagtgaatccaccgcggaggtattactcaccaatttgatgtgcgttttttggtgctgttggaaagcactagtgagcaggtcggcttgctcaagaagtctccggctttgaattaggactacttcgccagcttcagtgggaaccactccgctacgtagtctctgcaatagggacacaccatgtttcttctccagagccgtgatcctggagctagctgccgacagtgaaagccccactgcctgggcacctcctgtaatcgacctacaatccacggcagctaccaaaagcttaatgtctcgcagatcgatgctcacctaatgttgcctttcgtaaattcgaagcgagcttctaattctagcaagcttggtgatggagtatcctgccaaaatttgtcctgttgcttattgtgcaggaattcggaggcggacatgtcaatcgagtggttacaaattgttgaattaggagcgatctttggtgcaggtttcctcgcaggaagcatcaatgtaattgtcggagcaggaacattagtgtcgtttcctattctcgtgttcctgggccttccaccgttgactgccaccatcgccaacaccatcggcatcgttcctggaagtatttcgggtgtggttgcttatagacgtgaactacacgcccatgtaaaaaccatcagatttctgctgccagcatcaatcctcggagggatcaccggcgcctcgctcttgctgcatttctccgcagatgtttttacagcagtaattccctggctgattggattcggcacgctgttggttatcgcaggtccatcaattaagaagcatgttggcgctcatacttcaggtggcatctctgctgggtttaggcaattgcctttcccgagccgaaccaccttcatcgtctcagtatgtggtgccctgttgctgggcatgtatggagggtacttcagcgcagctcaaggcattcttctcatcgcattgcttggcatcacatcaacgctgcagatgcaggaactcaacgccatcaaaaacctcacagtggcggcagttaatctcatcgcagccagtgtttttataatcatctcccctgagttgatctcctggccgaccgttgccttaatcgcgcttggctcagctttaggtggatacatcggcggacggtacgcccgccgacttcgccccagtgtttttagagcatttgtggtcatcgtcggaatcaccacggtcatcgttatgacgatcggttaatgcagcagactagtaacccctctagttgtgaagggaactacctcgatgctggcggttccaacaagcgtgatcaacgcaagaacaacatctagagcaattactgcagcagctcaaaagagggcgtctgaatcgcttgagttttcttcgcctgagcattcaaattgccactccaacttggatatacccgaaatccccgtttaccgggacgcttagtggaacgagtaattccctgctgttcaagctgctctcgcgtgaatcgaaatactccgaaattactctcatcttggacaaaaatcagaaggcctgcgcaggcctcagaggaatcaaacgggcaaatttcgccttgttcattgcgcatccaaaatgcaacgaaggcaccaggttttgtcggggtgactcgagcggttctgatatgccaggtctccgatcctaagagaacagtccccgcttcataatcgctgtgctgttcttcgctgtgcggtgtacctggcttgccatagcgatttgcaacgagcccaataaactgctcaaatccagaaaagctcatactgctcccctaatcgatggcttccccagcaagggctttggaggcgaggcgttcttcctcactgacttcccacacctcgtgagcggcgtgcagtgcgagcagaatgatgaaacaacctaggatcaaatctggccatccagacgtcgtccatgcggtaattaaggccatcatgatgatggcaatgttgatcaggacgtcatttcgggcggataggaaggcagcttggccaagcgagccaccatgttgtcgcactcgagaaataatgatggcactcgcgccgttgatcacgacggcgcccagagaagcgacgatgatcggaaacacttcgggcgcttgcggtgcggaaaaccgttgaatcgctgcccacgcagcaaaagcagcaggtgcaagaatcacaatcgccataagtttgcccatcactgcgcgcctcgccaacggccatcctagggcaatgaaaatgagcaggttgatggaggtgtcttcaagaaaatcgacactgtcagccagtagagaaacggagcctgcgcttaatgcaataaagaattctacaaagaaataagcgaagttaagcagcgcgacggtgagcacagctttgcgcactttggttgcatcaaaagcttcgctcatcagctagcgccgcttctggcagtttgggcagtagtgggagccgcggttcatgaaactctcccggatgattaatgttccgcagcgtccgcacggctccccggtttgcgcataagcattcaatgacagcgcaaagtagccggagttgccattgacgttgacatagagcgcgtcgaaagaggtgccaccttgagcaagtgctttggtcatcacgtctttgccagcttgaagaagttcttccaagcgagctagggacagtcgatcggcacgttgcaatgggtgaatttttgcttgccagagcatttcatcggcatagatatttccgatgccggagacgatctcttggttaagcaggaggcgtttgatctccgatttccgagatttcaaattccgcgcaatcgcagagaaatcagcagactcatccaatacatctgtggcaatgtgagagacgcgttcgggtactccatcaactaggtcgccgagccaccaataaccgaaggtgcgttgatcgacaaaccacacttcatcgccattatctagctcgactttggctcgaaggtgtggactaattggtgcatctggttctttgatgagcatttgtccactcatcccaaggtgaaccagtagccctaaatcgggacgggtttcgccggagggtgcgtcgataagctcaagccagaggaatttgccgcgtcgcttggcagcgctgaccctaagccctgcgatgttggcctcgatttcggggccaccgccgagttgattgcgggctgcgcgcgggtgaagcactgtggcggacacgatggtgtggccgaccatatgatcttctaaaccgcggcgcaccacctcaacttcaggcagttcaggcacgggactcccgaagctttcggaatgcctggtgcgctgcttcctgctcggccagcttcttgttcgggccttctccccgacccatttcttcaccttccagcgtcacgatggcggtgaacactagatcgtgatccggaccgactgaggtggcggaatattcagccatggggcgcttgcgctgagcaagttcctcctgcagcgtggtcttccagtcctggtgaatgcccctggccgatgcgttatcgatcttgtaggcaaacaggcgcaaaattacgtcgcgggcggtttcaaaaccgtgctggcggaaaatcgcgccgaacaacgcctctgtggtgtccgcaagaatggaatccttactgcgaccttcggtgagcaattcgcctttgcccagcaaaatgtggttgccaagatcaatttcgcgagcgatatctgccaggccgtaacggctgacaattgaagcgcgcatcttggagacatcagattcagggctgctggggtactgctcatagagcttgttggccacggagagacccaagacggcgtcgccgaggaactccaagcgctcattattgggcagcatgccgttttcgttggcgaaagagcggtgagtcaacgcaagcaccaacagatcgcgctggatgtccacaccaaggtggtcaagcagcggctgatgatctactgcatcgaatgcttcattgagtgcgtctaccccggtgaggcgattctttttcctgctcacaggaacttctccaaaccagcccagcgcggatcgaccttttcctcgtcttctacttcttcagagacaccgtcaggagctggcgtttcatcatcctggcatgcgccgtacccaagttcttcgcagacagggttaaacggcaaggtcagaccagcttcatcaatgacagactgaagcagatcaatctggtcttggttaaccattggcagctcatcttcgtcatctgctgcatcttcaccagtaacaaagtctggatcggcagcaaaaacctcagagacgtgcagcgtcttggttggggtgagttcgcggaggcagcgggagcactgtcccagaagctgcgcttcgatatctgcttcgacggccaggcctccaccgagtggaatgatctgggcttctacgataacttttccgccctcggggatcgcgatcatttccggaccaatgcgggtcgggcttggacctgattgggtgaggtgttccggaagggcacttccacgaaggagtgcggcgacatcaaaaataaatggagatttcatgaccaggaagatcctactcgtacctcatcgtgactacatacatcagatgaggatcgctagacggaaaggtgaaaaagcctaaatggtttcttggaaactagtagtctcgatcgtcgcgttcgtagcctcgttcataatcacgctcgtagtcccgctcatattcaccacgcgctgccggttgctcatcgcgcagctcgcggccagtagctccagctcctcggcgtagtgcggaacgatcagcagtgacagaacgcaacgtggtggacagcgaggtttcaaactctgccaacttggtatccacgtagtcatcgcattcattgcgcagcttgttggagtcagcgtgcgctgcatccacaatgcggtgtgcttcttccgtggagcgacgcaccacttctgcctcgctgaccaggcgatcctgctcggcctggccttcagcaaccgcgcggcgatacgcatcattgccggagttgaccaggcgctcagattcagcctgggcgcgctcggtgacgctgtttgcttctcgacgagcgtcactcacgatgcgatccgctgtgtcattagccttagcaacgacagaatgcgcatgcttggtggcgtcttccaccatggcatctgactcctcagttgcgcgtgcaaggaggtttcgggcctcgttttctgcatcgtcgaccaaggcaatggccttttcttcagcttcacggatcacaccatcacggtggtccagcacatcttgtgcatcatcaagttctacaggaagcgcatcacgtaaatcatcgagaagcgcaagcacttcctgacggggaaccacgcaatttccggtcatgggaacgccgtatgcgcgttgaacggcttgaactaaatcatccagtgcttcgaagaccttgtacatggggttaatcgtactgaaatcctgtgaaccatgcgtatggcgcgcctaggtctcggtgcgtattttccgcaaagctccacgtagacggtattcgaaaacttttccgatcagccccgggggaaggccgtgtcgcatgctcgggctagccttggatctcaagaagaattcgactggtttaaagtctgggctttaagtgcagaaaggttgtggattgatgcgctccctgcttcgtgatatccctgcggtgggttggctaatcaccgcgacgattgttgtgcgcacgctcgttgttgcgctggtcatcgttgggatcggcttgcttatcgacgtcccctcgcccgctcattcagccatgttgtggtgggttctggcaggtgccacggcagcagctgcgctgctgtgcgcggaagcggtgctcccccaacgtattcgtgcacgagttgaacgatcctggcggcggcagttggctgctaaaaatctggagctgaattccagttcgtcagatgatgcccagttgatcacactggcaactgaagccacctcaaaagcatccacttacacagtgatgtttctggggccttactttgcagtatttttggccccactgacagttattgccgttgtcggcgcggctatttcctggccgattgcggggatactgtgcctcgggttgtgcgtgatacctttcgttatttcttgggcacagcgcatgttgaaaggcgctggcgcgggatacgggcgagcatctgggcagttggcaggcgtgtttttggaatcggtgcgcacactaggcaccacgatgatgctgaatgccgctgggcagcgcaggcagatcatcacacagcgcgcagagaatatgcgctcccaagtgatgtcattgctgtaccgaaatcagttgatgattctggtgaccgacggcgtgtttggagttgccaccacaatggttgctgcggtgtttgccattggaggattcttttcaggctctcttactctcggccaagctgtagcactcgtattgctggccaggctgcttattgatcccatcaaccgcatgggtcgcacgttttacaccggcatggcaggcaaaccctcgctgatcgccattgaaaaagccctcgcgacaacctttactgatcagccaactcaacagggacagcgccacgatggggatctggtggtcaacaacttgaagatcgcccgcgatcacagggacattgtgcacggtatctctttcagcattccccgcggttcccacatcgcggtggtaggtcccagtggcgctggtaaatcctctgtggctctagcgttgtccggacttttagagtttgatggtgcgatttccctcggcggccacaactgtgagatgttagatcttcgcgcctcagtcagtttcgtgccccaatcccccacgctgtttagcggaagcatcaaaagcaatatcgatctggcgcgcacgggtgttgattctgatcacatccacgcagcacttttaggcgaagaactccccgcggacctcaaagtcggtgaaaccggcaaaggtgtctccggcggccaagcagcacgcatttccattgcccgaggtttagtaaagaatgctgccgtgattgttctcgacgaggcgaccgcacaactcgactacaccaacgcccgccaggttcgacatcttgccaaatcccttgagtgcacgttggttgagatcacccaccgcccatcagaagccctcgatgcagacttcatcattgttttagaggatggccaattgaccatgatggatacacccagcaacgtttcccagcacaatgcgtttttccgcaccgctgtgatggaggaagaacaatgatttcccgacttctccaattggctaagaaagtatggccggaacttggagcctccacgctcctgcgactgctcaatcagctactcaccgcagcactcattgtgttccccgcctgggtgctaagccgcaaaccagacatctccctgctcgccgtcgccatcatcatggcgctcatcgcgctgacagcagctgtctgtcgctggggtgagcaggtatgcggccaccgcgctgcctttgggctgcttgcccacatgcgcgttatgctttacgacgccctcgtccacaaaggttccccctcgccgatccacggcagcggttcgatcatgtctgttgccacccgtgacattaactccatcgaagtattcttcgcgcacaccattgggcctacagtcaccgcagtgctgctcagtgcgggaggcgtgatcacgctggcaacgctcgatcccgttgctggtctaattggtttactcggtgtcctcatcgcgtggttgatccccttgattggaaaacaatcctcaagcagtgaagccacatcacgtggacacatcgcccagcacctcaccgaagatgccgccggcaggcttgaaatcaactcacatggagcgcaagccacacggttaaatgcgctcgaggtgaaagagcaacaactggaacaagttgtgacccgacagggcttgatcgtcggtatccgtcagggcgcagcacttttatggccgtggatatcagctgtgttgttggttgctctggttcctcatgtgggcattgttgcagccgcgattatcctgggcatctcccctgcgttggatgcagttgagggatttgctcgcaccatgcctaccgcgttaaacagtgcgcagcggtatttccagatcatcgatgcccctgttgctatcgctgaacctgacgagccgaagcctttgcccaaaggcccgcttaagctgcgaatttctagagttccagtcagcgcaaagggcaccgtgtctttagaggttgcagctggtgaacacatcggcatcatcggatccagcggtagtggaaaatccactttggccaaactcatcctcaagctggcgcaactacggtctggaaccatcaccatcggtggtgttgatatcgcagaggtttcatcggcggagcttcgcaaatccgtcacgctggttgagcagaaatctgtgctgtttagagcaagcgtgctggagaatttacggatgggcaatccagagctgtctgaagatgaagcaagggaagccttgaggttggcgtcgataagcgaactgcctttagatgctgacgccctgcgcctatctggcggacagcaacaacggctctgcctggcgcgtgctttggcacgcacccctcaggtactgattgtcgatgaagccaccagccaccaagatgcgctcaatcaagcggatctttcccagactctggccacgcttaaagacaccacggtgatcatcattgcgcaccgcacagctgcattaacccatgtggatcggataattgacctggaagaaatcaaaaatccctgatccttaacgcggatcaggggtttaagtaaagcgcaggggtcttagatgacgccctgtgccagcatcgcgtcagctaccttcttgaagccagcaatgttagcgccgacaacgtaatcgttctcgtgtccatactctgctgcggtctctgcacaggtcttgaagatgttcttcatgatcacctggaggcgctcgtcggtgtactcgaagctccaggaatcgcgcgaagcgttctgctgcatctccagagcggaggttgcaacgccaccagcgttagctgccttgcctggtccgaagcggatgtcgcgctcacggaagacctcaacagcctcaggggtggaaggcatgttcgcgccttcagcaacgaaacggcagccgttgtctgcaagagtcttagcgttctcgccgttgagctcgttctgagttgcacaaggaagagcgatatcgcacttgagatcccagatggaaccgtcggtgtggtaggttgcgccttcaacttcgtcggcgtacacggatacgcgtgcgcgacgaacttccttgatttcgcggagcttagccacgtcaacgccgttaggggtatgaacccaaccgctggaatcggagaaaccaataacggttgcgccgagttcctgagccttttcaatcgcgtaggttgctacgttgccggaaccggaaacgatgatcttctggccgctgatgctctcgcccttagccttgatcatttcactcacgaagtaaacgcagccgtagccagttgcctcggtgcggaccagggatccaccccaggtcaggcccttaccggtcaaaacgccggactcgtgctggttagccatgcgacggtagtggccaaacaggtaaccgatctcgcggccaccaactccgatgtcacctgcaggaacgtcgcggtactcaccgatgtggcggtgtagctcggtcatgaaggactggcagaaacgcatgatttccagatcggacttgcccttagggtcgaagtcggatccacccttgccaccaccgattggcaggccggttagggagtttttaaagatctgctcaaagcccaggaacttcacaatgcccaggtttacagatgggtggaagcgcaggccgcccttgtatggtccaagtgcagagttgaactgcacgcggaaaccacggttgacgtggacctggccctggtcatcaacccaaggcacacggaagatgagctgacgctcaggctcgcacaggcgctggatgagaccgtaatcagcgtaatgagggtccttttccaggacgatcttcaaagattccaaaacctctgccactgcctggtgaaattcaggctcgccagcattgcgcttcagaagcatgtcgtaatagttagagacctgctcatcaactgtcatgatttcctcgttcccatctcggctgcatgcgcgcacgattttaaagtgtgtacctgggccatttagtgatgttggtggttcccattgagggcaccatgtacatcctaggcgtttgctggagcaaaatgcctgtgaaaaatctgatcctgaaacttttaaaaactgcgttcacatcaaccggcttgtcatacctaacggttaatagttttaaactacggatgccctaaagagcaacttcttgctttgagacttaactcactgcgggcatttaggctggtaaatgctcacgttcaattatggcagtgtcgcacagatatgaccacaaagaattaaaattgtttgaaaatttctttaggtttatcaattttgtatcgccaaaacgcgcggtaactgcatgaagtctcttctttaattaaattcatccgaccagcgaatgagaccagttgactgactggttatataacctggccacaattgagcgccctcaaatggaattggtacgacttttataggcgctacatcggagaaatttgacccgtttttcacgatctcctagagctcccgaggctagctagaacaacgcacattcgggcactttccgaccttttcgatagccgtatatgccatggacccactcctcaattgggcgaccgttagacttgaaacactaaggctagagattttaactaaagagtctcctcatggattcccatttggagccttatttacacaggccacctggcttgtttcccaccgcgatgtgccacaataacgccataacagaaaggcatactgacacaatgtccaactcccccaccgacgtttcaacgagcgcacctcgaattatgatcgcgccagattcctacaaaggaaccgctaccgcatcagaagctgcgcaatacttaggcgaaggcgtgttggaaattttgcccaacgcctccattacgttggcacccatggccgacggtggcgaaggaacatcctcagttttcggcgggcaggtcataacattacccacgacaaatgccgcgggacgcctcaccgaagccagctacaccttagattccgaaacaaacactgcctacattgacatcgccgcagcctccggtttgcccgccgttgcagacgatctagtccccaccaccggcgatacctacggcaccggcgttttgatcgcagacgcggtcacccgtggcgcaactcgcattgctttaggccttggcggatcagccacaactgacgccggctcaggaattctcatcgccctcggcgccgtcccacgcaacaaagagggctacgcactacgaaccggtggcgccgacctcatcaacctcgattacatcgataccgccgaactcaacatccccgcagccgccgtcgaatggatcctgctcaccgatgtcgacgcccccgccaccggcccgcagggcgcggccaccgtattcgggccccaaaaaggtgccaccgaaaaagacatttcgcttctcgacgccgccctccaccacgcctgcgcccaactggaagttgatggcacaaagccaggtatgggcgcagccgggggcattgcaatcggactgacgtggctgtccaccctcatgcacggcaacgaccaacagatccatatcctccccggcgcgccactgattgcccgctccaacggaatcgaggatgcgctgccagaaactgacttgttgatcaccggtgaaggccgactagattcccaatcgttcaccggaaaggttgtgggcaccctccacggtttagctaaagcccacgatgtggatctcgctgttgcggccggcatcgtggaaggcggtattcccgatgatttcctagcggtagaaatgattaaatcctccgacgttgcagcacaattacgtgatgcaggccgaaggatcgctcaagaatacgtagctcaaaactagcgaaggatctccacagtccatgggtagactgcaggaacttcataggcaagttcctgctccaggaggaaagcgtcctttggcaactctgctggcggggtgagcaaacgggcaaaaatcatggtcacttggttaacggagcctttaactccatcaacttcaatgaggtaacggttgaccgaggattcttccaagtctgcatcttcatgctcgtcgcggtaagtctggcgaagctgctcttccacagcttctgcgattttcgctgctggatcatggacaacaacgccatgatccatgaggcctttttcgatcaaaaggttggcgactacggtaaaacgtcccgctagtgcgatggaatctgtgtcggggactaaaacatcaaactgaatcttcggcataacaccacagtagacaatagccttggtgttatgactagcccccattctttttctgtcacccccattcgcaccatggctgacggcacgatcaaacagattcaccctttcacaggcaccgaagtgtggacggtccctgggcgtggaaatcgacctctgtcacatcccgcttctacgatcgtcgaactatctgcacacgatcacacctcttactgtgcattttgttccgacaatatgctctccactccgcctgagaaatcgcgcatcatcattgatagctccggcgactttgacatccttcccggagcattgcctggtgagctttcagaaaccactccggaatttcgacgagtccccaatctgtttgagattgtctcttttgactactggcaccagaattttggtttcgatatggattcagaaaccgccatgcgcatggcgcaatacttggcgattccagaaggtcgcgaacatgttttagccattgtgcgcacccgactttctgccgctggtgaagatcccgcgcacatgaccgatggcgagttgttagaaaaagctcccagctactttgctggtggtcatgacgtcatcatcggacgccgacactttgtcgatgacgcaaccaccagtgatcaattggcctcatctggaacactgaccgttaaagagcatgaggcgttcatccgcctgactgtcgatggcatcagggatttgtaccaccgcaaccgttacgcaccgtatgtagtggcgtttcaaaactggttgaaacccgccggcgcgtcttttgaccatcttcataaacagctcgtcgccattgatgaacgcggccgacttattgccgatgaactgcatcatctacgtggcaatcccaatatgtacaacgaacttgctgttgattacgccggataccacaacctgatcatcgcggaaaacgatcacgccgtggccttcgcaggtttcggtcaccgctaccccaccattgagatttactctaagtccgctattcctgaaccctggcttcaaagcgacgaggaaatccaagcgatgagcaacctcatccatgcatgccatgctgcaaccggcgcagatgtaccctgcaatgaggaatgggtacacaaaccaatcgatgttgatatgccaatgccctggcatgtgatgatcaaatggcgtgtttctaccctggcaggttttgaaggtggcaccaaggtgtatctcaatacgctgtctccacacaaggtccgagaccgtgtggtgaaagaaatgtaccgactacgcgatgaagaactcatcgcatctgatctgcgcatcgccatggaatgctccgttgaacgcaacagccttaaatacaatcccctcctataagccaagagttttagtgtcgctgcgcaggtactctactatctaatccatgagccgcatttcagaacttctaaacaatcatggtgttgatctgtcgtggcaagaggccgcatatcaggatttccacgaacatcctgagctctccggcttcgaatcagagaccgcagatcgcattcagaaatacctcgagcgttttgattgtgaggtgattccaaatgttggcggttacggcattctggccgtgttccgaaatgggtcgacagatcctggtgcccctgttgcgttaatgcgcgcagatttcgatggccttcccgtcaaggaaatcaccggagttccgtttgcttccactcgtatgcgtccgcatgatggggcaaatgtccatgtcatgcacgcatgcggccacgatgtccacgtcaccgcgctgcttggtgcgtgtgccattttagatgagcgtcgcgatgcatgggaaggcacgttcatcgcgttgttccagccatcggaggaaaactcccaaggcgctaacaagatggtcgccggcggtttagttgatctgatcccacgccctgatgtgtgctttggccagcatgtagtccccggtgctgcaggaaccgtgatgagcatgcctggcggtgctctcgctgcctgcgattccattgaaatccgcattcagggtcgcagcgcccatggttccatgcctcataattccatcgatcccacttatgttgcagcgatgattgtcgtgcgactccaaggaatcgtgggccgcgaggtttctccagaggatttcgccgttatttctgtgggcaccctccagtcgggcaacaccaacaacaccattccagcaagtgctcgtttggtgttgaactgccgtttctacaacgacaaagtcaagcacaaggtctaccgagccatcgaacgtgttgtccgtggtgaatgccttgcttccggtattgaggaagaacctgtcattgagtacttcgcccacggtgatctcaccaacaacacccctgttgtcttcgatactgtgcgccctgtcttcgacgatgttttcggcgaggattctattgacgcttaccggtggactgcgtcggaggatttcccctccattcctaaggcattcaacagcccttacctgtactggacgattggtgtcacgccgcgcgatcagtggacagaagccgtagaaagagaccgcgtggcatcggatgtgccagccaatcacatgggagatttcctccctgattatgcgccgacgatgtccgctgccacccgcgcagccgcagccgcgctgctgacctacttgggaactaactaatcatctagttttctgcgacgacggattcgaaaagagacaacggcaatggtcagcgccactccaatggcgatgagggcgaaattaactagaccataaagccacagatcaaggtcattgaatttcagtggaaggcccgatggcgtcagcccgaaagccccttgatctgtggccccgccgaaaccgccgtctcctgccatccacgccagaaacacggctagtgtctggaacgtgaagaagattgattcgatcgcgaggaagagcactacagcgctcaaccgagaccgaacaaaataaccgatgagcgctgccagaatagggatgaacaagatattcacgagtttctcctcagcaacggctggtttttaacgtccttttacagcgtgctccacagacaaactgcgaacattccaaaccatccaagcgcgccgatgatggcgtgaagtgcgggaatgggtcgtgaaaaactaagcacgtcttttgcgacagccacgtaacttcccgctttggacacgcggtgtcatgcacggtaactggaaaacatcagcagatctccaaatacctgacctaccgtgatggttgcgaacgtcagccacgcaatccacggttgcatgaaaaccataaaaaccacccacatcacgatgctggtactttgcagcacaatgtgagtggtgactttcttttctggaaaatcctgtgatcggtgttgccaccacttggctagcgatgcaattccaagtcctgctgttgcgccaaggaagatgagcaccactcccgcgaagaacccaatcgggaacatagcactaattctacttttgccccttgccctctgtcaccatctaagtcagacaggtgcttaaacgccgaaaggccgagacacacgtagtgtcccggccttttggtaaagctagtttcgccctagttctccaagtaggtgatcaggcgggtttccgctgggctgaccagcatcctgttgtttggaacaacgcgggcagtgatgccgtagttgcctggcaggtcagtgctgacctttgccgcgtaggcgccatcgccgcgtggggtcaaaacggtgatttctggatcttcgatgtcaccgttgtgtccgagcgcaccaaagagtgcctgagcttggaactcgtcgtcgttaagcgaaccggaatcaacgcgaacgctgacttcaagctcctgcgccgtgatggcgctctcgctgatcttcaggtctgagaccttgacgccagcccactctgctttgatgtgctcaagccatgccgcgtaatccgctgcttctgcaggctgcgcaatgagctctgcctggtgtttggttgggcggtagtactgggtggtgtagtcgcgcaccatgcgggtggaggtgaccattggtgacagggtggtccaggattcgcgaaccaggtccagccagtcctgtgggatgccgttcttgtcgcgcttgtaaaacagcggtgcaacttcgttttccagcaggtcgtacagcgcctgggattccaggtggtcgcggcattccaagtcctgggactcaacggttgggatggtccagccggtggtctccttaggcatttcatcccaccaaccatcagagatggacagggtcaggccaccattcatgacggccttcataccggaggttcccgatgcttcctgagggcgcactgggttgttcagccacacgtcagcaccagagatcaggtagctggccaggttgatgtcgtaatcaggcaggaagaggaaacggtcacggacaccagcttgatcagcgaagtggacgatttcctgcatgagcttcttgccacccatgtcatgtgggtgtgccttaccagcaataacgaactgaactgggcgttcctcattaagcaagatggaacgcaggcgttcagggttgcgcagcatcaaggtcaagcgcttgtaggtggatacgcgacgtgcgaaaccaatggtcagcacgtttggatccagaacgcgggaggtccacgcaagttctgcttcggtgtgtccacggtgagaccaggactttgcagttgcagcgcgagcaacctccactaggtcagcacggaacttgttgcgcaccttccagatcttctcagactcgacagcctgtgggtttgaccaagaatcagcaaccgcaagatcagcgccgccagtgacgcgatcgatgagttccttcatctctggcttgacccacgtcggcaggtgaacaccgttggtgacgtgcccgatgggcacttcacgaggctcatatccggggtacaggccggcgaacatgtcacggcttacttcaccatgaagctttgcgacgccattagcatgttggctcgcgcgaaggcccatatgagccatgttgaagcggtgtggatcggactcttgaccaagctcaagtgccttctcaattggaacaccaacgcacagctgctgatcttctggctgaccgccaccgagataacgacgcaccatctccatgtcgaagcggtcgatgcctgctgggactggggtgtgggtggtgaagatgttggacgcacgaacctgctcgaatgctgctgggtactccatgccctctgcgatgcgctcgcggatacgctccagggtcaggaaacctgcgtggccttcgttgaggtgtgcaacagatgagcgcttcagaccacgagcttcgcagaatgcgttgacagcgcggacgccaccaacaccgagaacgagttcctgcttgatgcggtgctcattgtcgccaccgtacaggcggtcagtaacgttgcggagctcttctgggtttgcctcgatgttggtatcaagcagcagcaatgggatgcggccaacgtttgctacccacagtgcaatctttacttcctgcgcacctgggtaggtgacagaaacagtgacctgctcgccgttcttatctttaactgcctcaatcggcagttctgctggatcgtggtacttgtactcttcctgctgccaaccgtcaccggacagtgactgggtgaagtagccgtgggtgtagagcaaaccaacaccgatcagtggcacacccaagtcagatgcagacttcatgttctcgcccgcaagcacaccaagtccgccagagtagattggcaggcttgggtgaatgccaaactccatggagaagtacgcaacgagtggatctccgacagcatcggttgcatctgcggtgtcctggtaccacagcttgtcgctgaggtattcgctgaggttttgctcctcggcgttgactcgacctaggtactcatcatcgcctgcgaggaactgcaaacgagttgctggtgcctggagaagcatctgcttaggatcttcgtcgagctgttcccacaattctgggtcgatgtcgcggaaaagctgctttgcttcctcacgccatgaccagcgcagattatgcgccagcttcacgagtggctggagttgagttgggagctgattcttgaactgtactgtgcctactggtttcaaagccctaaactaagcctaagattggggttcctgctaccagaatgagttatcggttcagaagttcatctgttgagacacccggaagtgaaacggtgatgtgcgttccccatggatcacgggtcacaacagaggtgccgttgtcaaagaattcctccccctttaggcgtgagaccagcatgtccagatcctcacggactggaacgatcactgctacatcagcaagacccaaggttgctgcgcgtggacctgcacctgctgagttccaggtgttcatggccacatggtggtgatatccacctgcggaggcaaacagtgcattggggattgatgtggtggcatcaaaaccaatcttgtccacatagaattgacgggctcgctcgacgttgcctacctgaaggtgaacgtgtccgatgctcgcagggagaatagcggtgttgttcaaaacggtttcgctgagatgactctgaaggtactggtttggatccaagtagatggtgtccatgcggacatcgccgttgtctgcatacttccatgcacttcgagggcggtcaacatagagctcaatgccgtttccctcaggatcggtgaagtaaaaagcttcagagactaggtgatctgaagaacccacaaaacgtgagcgtgattcttgcgctgcgcggtaaacggtggcagccaagctctcttgggtatcgaagaggaaagcggtgtgataaaggccagcttgacgaggatctaccgcaggaagacctggggtagaaatcaggcgaagcagtggggtgccattgcgaccgagtacacggtgaacttcttttccgtgaactttttcttccattggttcaacgctaaggattgaagagtagtaactagtcataccctctaggtcgccgacgcgaaggctaactgcatccatgaaggtgtcgctattgatgctctgctcaagaagtgccatggtgtttcatcctttaagtgttggtggctgttttgctgttgaacaccattgttcaccaatttactttccgtgtcaagtaaattcttaaatgaggcggatttcccctgccctagccacgaaaaatgcgctgacaccacgtacagtgtcaacgcattttttgaaagatttaagcgattagagctttgcaatccttgtgtcgtcaccaagaaggtggacgtgaatcatgttggtgttaccggtaacaccaggaggggaacctgcaacaacaaccatcatgtcacccttgttgtactcaggcattgctaaaagagcacggtcgacttcgcgcatcatgtcatcggtatcgctgacaggtggacacaggaaggtggttgcaccccaggtcagcgccagctcagagcgaactgcctcatttggagtgaacacgagcagtggcaggtggctgtgcagacgagccacacgctttgcggtatcaccagaggtggtgaacgcaaccaatgcacgagcgttgaggcgctcggcgatatcacgtgcagagtaggaaataacgccacgcttagtgcgagggatgtgggtcaggtctgggacgcgaccgtcggtttcagcgaagcgaacaatgcgagacatggtgcgcacaacgttgtgcggatctttgcccactgaagtttcaccagaaagcatgacagcatctgcgccatcgagcacagcgtttgccacgtcagaagcttccgcacgggttgggcgggagttctcaatcatggaatccagcatctgggttgccacgataactggctttgcgttctcacgggcaatctggattgcgcgcttctgaaccagtggaacctcctccagaggaacctcaacgccgaggtcaccacgagcaaccatgacggcgtcgaatgccaacacgattggctcgagggaggtgacagcctctggcttttccagcttggcgatcacaggaacacgacgaccttcttcgtccatgatcttgtgaacgagttcagcatctgctggggaacgtacgaaggacagtgcaataaagtccacgccgagcttcagggcgaagcgcaggtcacggatatccttttcggacagtgcaggtacggaaatatccatacctggcagggaaacacccttgttgttggagactggtccgccctcaacaacctcacagatgacgtcgttaccttcgacggaaacgcagacgaggccaaccttgccgtcatcaacgagcaggcggtcgcctggcttcgcgtcttttgccagattcttgtaggtggtggacacacgatcgtgcgttccctctacatcgtcaacggtgatccgaatggtctcgccgttttcccacacggttgcgccgtcagtgaaacggccaagacggatcttcggtccttggaggtctgcgagaataccgactgcacggccagtcttctccgccgcctcgcggacccacttgtagttttgctcatgatctgggtggtcaccatgggagaagttgaggcgagcaacatccatgccgtcttctaccaaacgcagaattccatctgcactagccaccgctgggcctagggtacatacaatcttagttcgtctatccacgcccataagcctagtacgtcattccccctcaagccacaggtactaccattaattctcgatgaatcttgcgacccagagtgtgaacagacaatgttctacgcctctgacgtgcttaaatcagaaaaaaccgggcacccacaaaacaattcgggcactcggtttttctaccaaaaacatctcagccaggtcaggcctatggttgaaacctatcgcgttgagggcgtttctccatcaatgccctcccctgctttcggcaagggttttccatccggcgaagctacagcatctgctgcaacagacgctgcgaaagtcggatctacctcttcgggagtttccctacccttcttcaacaggaagaacacgatgatcgcgccggcaaacactactgcggagacgatggtgttgattcggatgccgccaataagcgtggcttcatcaacgcgcatttgttcaatccagaaacggcccaaggtataaccagctacgtagagtgcaaatactcggccatgtcccagcttgaatcgcttgtcagcccacatcaacaaagcgaagatcagtaggttccacaacagttcatagaggaatgttggatgaacagtagccattacttcaccggtggatgttcctgtcaccggtgcgaattttccattttcatctacccgatagtagatttccaaagcccatggaacggtagtttctgcaccgtagagctcctggttaaaccagttgcccagacgaccaattccctgcgccaggataactgcaggtgccacggcatctgcgaaaggtgcaagaggaagctttttgtaccggaagaatacggccactgccaggccaccgaggatcactgcaccccagatgcccagaccaccgttggtgattttgaaggcgtcgacggggttacaggtatcgcagaagtacttttggttgtcggtaatgacgtgataaatgcgtccaccgatgattccggcaggaactgccacgatcgctgcatcaaggacgatttcagggtttccaccgcgggcggcgtagcgctttctcgtcagccaaatggcaacaataatgccagcgatgatgcacatcgcataggccctaatcggaatgggacccaagtaccacacaccctgcggtggtgagggaatcgtggccaaagtcatgacatccacaacaacgtaaacctaacagtcaggcgacaagtaatgcacttcaatctagcaagacttgtccgcccaccgcccgctaccccggtcagctgaccacagagcacctcttcaacgcgatgggcacgctggatgcatacctgctgtcacaagagattttgtggtggcgaggtctgcatgtggaacaaagatggcgtctgcagaatgtcgtgcaaaccgcatgagttctttagggctgctgcaacctccgagcacaatgcgggctacctctttgggcatgaattgggtgatacccgaaaacgcttcaggcaaagtgagtgagccggtataaccagtaatatcaattgctaccactgtcgctcctgcgtccactgcacgatgcgcttcttcgtggtttcgcacagacacgatggctgtcatgcccaatgattcggtgcggtccaccaaagattccagtcgagcttgttccatcgcccatacggggaattgaagagcgtcgatgcccatgacgcgggcttcgtggatttgatacggatcgatgatgggatcatgaagcagaatgggaatgtctacttcagatttgatgtccctgatatcgcgtactgcggtatcaaactgtcccctgcgcaccgtatatgcaagcattgatgcgccaaaacccgcaacctgtgcagcgtagtccacatgatccgaatgatcagaccaattggatgcaaaacgatcaaaggcgactacgacattacatccagacgaaaaaaagactgaagcaatatcgaaagccgccgtgagacctgctgatcgagatttagttttgacttcttgaaaaccaagcgttgcttcccgagccgatatttccgcagcgatttccatcaacatgcggttctctgttgcaaccatgccccaacctccttccaaccaatgctgtgtttaaggttatcccgaacacacatggcgaaagaaatcagggtgccacaccctagctttgacctggggtttctttggatttctgagtcttctcggtgaagtcaatgtcttcatcgagtgcgtcccacatcacacgaccggagtctggatcttgggccaaatcggtgtggattttctcagcgcgagcctgtttacgctcatactgattgcttttcgctgtgtcctcgccagggcgcatggcaaggacaacgccaccgactagggctagcgcgcagccaatcatggctaccactgccgccagtggatgggtggtggtattgatgatctccgcccaatcagacagcagggttccggaattagccttctgtgaggccacaccggaggtcagcagggttcgggcccgttctgcgtctgggtcttgggtgagaagcgcgagtggagacaggctggcacccaccgcgatcagcgccgaaataccaccaatgatgcgccgacccatgcgcttgagcaccaacgcggcggcgaaggcagcgagcaaagcaagtgcaagcgccatgatttctgtagaccaggttgcacccacaatagattgggtgacactacctgatttatcgtcgaaagcctcgatggttacccagttcatgcgtgagctgatccagacaaccagggcgccagctccaatgcctaatgctgacagcacgcgtggcttcataagatttcttccttaatcgttgttgcttttacagcaaaacgtcattgtcgaaacatgtgtgggcaccagtgtggcacgcaccgccggtttgtttcacggtcagaaggacggtgtcgccgtcgcagtcgagggcaagtccggtgacttcttggacgtttccagaggtcaggcccttgatccagtactcgttgcgggacctagaaaaataggttccacggcgggtcgccaaagtataggctagcgcgtgggtatccatccaggccatcatgaggacctcgttggtcccgtcggcctggacgattgccggcaccaggccggcgtcgttaagctttaatcgcttttcgacgtcccaatccagctcatactcttgtggattgtcactcatttccgcacctcaaatcctgcatctttaatggctccctttacttcggcgatggttacttcgcggaagtggaaaatggtcgcggcaagcactgcgttggcgccagctgcaacagctggtgggaaatgctccgccttgccagcgccgccggaggcgattacaggaatggatacggctgcgcgaactttttccagcagctctaggtcaaagccgtttttggtgccgtcgccgtccatggagttgagcagaatttcgccaacgcccagctcttcgccgcgctttgcccactcgattgcatcaagttctgcggacttggaaccgccgtgggtggtgacttcaaaaccagatggctgaggagttccaccttcaggaacgcgcctggcatccacagacaacacgatgcactgagcaccaaaacgcttggacagctctgacagcagttctggacgggcaatcgcagacgtgttcaccgaaaccttgtcggcgccagcgcgcagcaattgatcaacatcttcttcgctgcgcacgccgccaccgacagtcagagggatgaacacctgatcagcggtgcgtcgaacaacatccagcatggtgccgcgaccatgcttcgaggcggtgacatccaggaaggtcagctcatctgccccttcctcgtcatagcgctttgccaactccacaggatcgccagcatcgcggaggttttcaaagttcacgcctttaacaacccggccgttgtccacgtccaggcaaggaataactcgaattgccacgcccattttacttgtactcctcatttaacgactggtcattacctgcatctgcatgcatcaaccgaactttttcaatcttacttaacagcacatcgtgagccctttttgttccggccacgactcccctacctggtgcccacggatggccttcggtgtcagtaacttgtgcaccagcagcgcgcatcaacatcacgcctgcggaattgtcccaaacatgaggactaaacgatacgcatgctccaaaaatgccctgcgcagtgaacgcgagatcaacacccaccgaacctgtaatgcggggacgaagatacgattccgtgagctcggtcagaagatcccgacgcaactccacaggaaacgctgtattgcgcggggaggccatggaactaaaaccaatgtgggataccaaactggattgttcttgcaatggttcctgaggttcaccgttgatcatcagcggtgaaccttcaaaagcggtgaggcgtttacccagcatgggcatggaggtaatacccaggacgggctggtcgtcgacaagcaaagacaccaggatcgcgctcatcgggttggacgccgcgaagttggcggtgccgtcgatgggatcaatcacccagcgcgtgccggaggtcgcaccgccaccttcttcaccgatgacagcaatgcctgtcatcatgttcagcatcgaacgcatatgggattcgatggccatatccacttccgtggcaaaatcccccggggatttcatatgggcaggtgcagctccgaagccctgcatgaagagggcttcggcatcatctacaacggcctccgcaatggccaacatcccacgagcatccatgtattaaccgagcttttctactgcagccaaagcctcttcgagggtgaacttgtgctcataaagtgccttgccaatgatgacggaatcaatgccctcatcctggtacttggctagttccaaaacatcttccaaaacagaaattccaccagatgccacgataggtgcgtctgtagctgcagcaacctcacgcagcagctcaacatttggaccactcaaggtgccgtccttggacacatcggtaaccacgaaacgtgcacaaccttgggaatccaaacgctcgagaacttcccacagatcgccaccatcggagacccaaccgtttccacgggtgcgccattcaccatcttccaaacgcacagcgatatcgacagcaatcttctcgccatagcgttgaatcgcagaagcaatccactctggcttctccagagcagcggtaccaatgtttacacgacgtgcaccggttgccagcgcgcgctccagagactcatcatcacggataccgccagtgagctccacatcaacatcgagcttgccgacaatttccgccatcatctcatggttggaaccacggttgaacgctgcgtccaggtccacaaagtgcaaccactttgcaccctgctcctgccacttcagtgcggattccaaaggggtgccataagacttttcagtgccggcctcgccctgatctaggcgaactgcttgtccgttaactacatcgactgcaggaagaatagtgaaggtcatgaatattgatcctatctgttagatgtagttgatccagtttcgcagtagctgtgcgcctgcgtcacctgatttttctgggtggaattgagtagcccacagcgtgccgttttccacagctgccacaaaacgatcattttcgtgcttcgcccacacaacctctggaggcgtggtcagatcgtcggtttccaacgtccacttgcgcacaccataggagtgcacgaagtagaaacgctcatcaggtgaaattccctcaaacattggtgagttggtaggcatttcaagtgtgttccaccccatgtgaggcaggatctccgcttggaggcgttccactttgccaggccactcgccgcaaccagctgacttaatgccgtgctcatcgccttcatcgaacaggatctgcatgcccacacaaatacccatcactggacgtccaccagcaagacgctgtccgataatgcgatgtccgaagacgtttttcaaacccttcatgcaggcatcaaatgcgcccactccaggaactaggaggccatcagcgttggtgcaaacttctggatcggagctcacgataacttctgcaccggcacgctctagtgcgcgttgagcagaacgaaggtttccagatccgtagtcgagaagggcgacagttttggtcatgccgatagtttatgtcacgtgctttcaggatcaagaaccgcagtcgagtttctttctccccaaaagggttttatatccaccacactggcctagctgcgataaaaggcgataagcatctctcaagtgggttcctttagatttaaaacccgcggtacgcaaaaccccaatggcgttacaaagaaaactaaccgccttcccttcctgagaatgacggctagtcgtgattctaaaattctatcccagtagaaacaaagcctctaatctaagacaagatatacgccttacaacggtattttggcgagactcctgcgctcgtcaagtttttgagacagcttgattgatttttcttcttacgctgctgctaatccatactgctgctgatatgcggtcaaagcactagccggtgagagcccctggttattgctatgcgggcggcgccggttgtgacctgcccctcgatgtactccatcaccgcggttcgggcgcatctaaacttggttgctcttcatagtccagcccctcttttaatacctgagaccttagttagcgatgaaggtataaatccgtagataggttagcaattttcatctcaccagactgagatcacttctttattggtttcaagaaacgacttaaggccgggaaagagtccagatggtttctcgatggtcattatttcattgcctagacagatttctgggcgcgaggaaaacacactctccagatctttagaaacagaccaaggacctcatttcactccgcaaataggggtttgcatttcaaaatgccagatcacattcccccacctaacacatctacacctaactcaattcagtatggattaagggaagtagacggaatatttcaccttggcgaactaccgccgggataccttggtggacgcattcctaaagtccacatcagcaattttcgcatttccgagtttaatgaggctctgagttcagtgtcgccataagttcatcaattcgcgggtttatgccagcgggttggtgggccaagtaaggggtggcgtcgaaaagcgttttagcgatctttgcgcctgttgcgcagcccttgcactgcacgccgagcgactggcacctggcgcaaacgcgcgcgggtgttgttgtattcagtaatgcggtgccgcccaatgattcgatcggcggtggtcaaaacgattccaaacaaaatcaccacggctccggaaccaaaagcaccactgtaagcaagcgatgcggcaactatgccaaggaggaagcttccgattcctgttcccgaatcaaaggcgatattccagatggcggaggcttcggagactctagtgcgaggaagccggaaaaacattgaaagcaacgcttcgttttgcaccatgccaaaagcaccaccaaacatcactgcacctataatcaaaagccacacggaccagccttggaagattgtgacggtgattaaaacgacacctaagaacccaatgatctgagcaggaatcatcgtggtaccaggcacaccgcggcggtcagcgataacgccggacaggtagcggaacaccattgaagaaccaccggtaatggataaaataatacccgctaatgcagcacctaatcctggatctaactcaatgactgcagctggaaggaatgaagacactgcgccaaaagtcattgacaaactggtaacagccaaggagggaaccagcaccaacttccaggtggaaacagaacgctcctgttcgctcacctgtggttgctgctttgccgctgccttaacctgcggaatacgcagacacatcaccgctgcaactagtgcgataacggcacctaaaacatagaccacgttgtagccaaattggtcacctaacgccaacccggcaggcaggaaaagcatttgggaaaggccaataaatacgcccaacattccagaagctttgcccaagaagcgtacgggaacgagttcagccaccaacgcagattctgcgacggtgagcgcaccgaacccaattcctcgaagtgcggacactaccagcactggaattggctcgacgctgaagatgtacccgatggctggcacacccagcatgaatgcggcgaaagccatcactggggtgtagccaattttccgcagcgcagcgggagtgaaaatctgagtgatcactgtagctgccatgaagatgccagtggtggcaccggcgacagcgcttgatccgccgttgttgaggaccgctagcggtacgacgggaagaaggagtgaccaactgccgaacgctgctgcaaccgccacgaggacagccacgaaacctgggcttttccacatgctgggaagttgctcaatgtcagcgcgtgttaaagcccgtgattccaaattaagtcatctctcccaacaaccatagaattcctccagccactgccagcactgcgatgaggccggctgcaaccatgaggattttgttttctgatttatatgcagaccaggcaccgccaaagaaaagcccggcgatgaggaacaaaccataaataaaccatcggtcgcccgcatctggttcgttctgcacagccgcagtgaccatatcagagatgggagaagagttcatgtctagagcgctcccttagtggatgggattcctgtttgacgaggatccatctctacggcaccgcgcagcgcacgggcaacagccttgtactctgcttcggtgatgtggtgagggtcgcggccgtagtggcagatcacgtggagggtgattcgggagttgagcgcgagggtttcaaagaagtgctcgttgatcacggttgcgtagtgtccaccgatcacggaggtgatcatgtggtctggttcgccggagatcacgaagtatgggcgaccggagatatccaccacggactccactaatgcctcatccatgggcagctggcaggatgcgaaacggcggatgcctttcttgtcgccaatagcgtcaaggagtgcttggccgagcacgatggcggtatcttccacggtgtggtgtgcgtcgatctcgatgtcgcccttggcatggactttcagatcaaaactgccgtgcacgccgaatgcagtgagcatgtggtcgaaaaatggcaggccggtatcgatatctactttgccggtgccgtccaggttgatctcgacggtgatgtcggattcgctggtggtgcgggttgcggtaccaattcttggtgcgacagtcatgaaaaattcttctctcttacaggttcagcttgatgatctctgcagctgcgtccaaaaacgcatcattttcctcaggcacaccaatggtagtgcgcaagtgcccagcgattcccacatcgcggatgagcactcccctatccaaaaatgcctgccatgccgcgtgctgatcggagaaatctccaaagaacacaaagttggactcacttggaaccacagcgtagcccagttcctccaagcgtgctgccacgcgaacacgctctacagagagcttttcgacggttcccagcgtgtcagcggagtgacgcagcgctacgattgcggctgcttggctcagcgctgaaagatgatacggaaggcggactagcatcacggcgtcgataaacgctgggttggccacgaagtagccgaggcgtccacctgcgaaatcaaaagccttactcatggtgcgggacaccaccagcttggttgggtacttctccagaagagtggttgctgaaggtgatggggagaattccgcataagcttcatccacgatcacgatgcctggggcaacgttgatgatgcgctcaacatcgtccagcgaggtcacatcaccggtcgggttgttcggggtggtgacaaaaacaatgtcaggctgctttgcacgaatttcttccagcgccacatccatatcgatgcggaaatcagcacctcgggacaccgcaatgaattcagtgtgggtgcctttagccaaaattgggtgcatggaatagctgggttggaatcccaacgcggtgcgtccaggtccaccaaaagcctgcagcagctgctgcagaatttcattggaaccattggcagcccacaggttatccctggtgacagccacgccggtttgcttggtgatgtacgcagccaactcatcacgcagttccacagcatcgcgctctgggtagcggttcagctcggtggcgatcttatccacggtggcaaccaagtcagcgaccaatgcctctgacggtgggtaagggttttcgttggtgttgaggcgaatatcaacgttgagctggggtgcgccgtaagcgtgctcaccgcgcagttcttcacgcaatggcaaatcgctcaaagtaattttggtcatttttcttaggcctcgtcggtggtggggaggttttcaaagcgtgcacggattgcttcgccgtgcgctggaagatcttcggcgttggcaaagttgatgacaacctgcgagacgtccttcagagcagcctcatcgtattcaatgaggttgactgggcgaaggaacgtgtgcgtggatagacctgcggagaaacgagcggatccagaggttggcagcacgtggttggatcctgcggagtaatcacccagtggtactggtgagaaatcgcccacgaagatcgcacccgcgttggtgatctgctctgctacggcgcgcgcgttctcagtgtggatttccaggtgttccgctgcgtattgatcggctacttggatacccacggaaatgtcgtcgacaagcacgatgccactctgggccccgcgcaaagcttctgcgacgcgctcggcgttgcgcgtgattgagtaacgcgcctcgatttccctgtttacgtccttggcaagctgctcggagtcagtgatgagcacggacgcagccatgacatcgtgttctgcttggctgatcagatcgtaggcaacgttgacggcgttggcagaggcatcagcaagcacagcgatttctgtagggccagcctcagaatcagtacctaccactcccctgaccaggcgcttcgcagcggtgacaaagatattgccaggtccagtgatcatatccacaggctcgagacctgcagcgtcatcaccataagccagcaacgccacggcctgaccgccgccgacagcccacacctcatcaacacccaagatggaacacgccgccaaaatggtggggtgaggccagccaccgtgctcagcctgaggaggcgacgcaaccacaagggagttcacaccagcctcttgagctgggacagtattcataatcacgcttgatgggtacaccgcattgccgcctggaacgtacagtcccacgcgatcaatcggcatgaaacgctcagtgacggtgccacctggtgaaagttcagtggtgtgctcggatggcttttgctcagcgtgaaccttgcggacgcgacgaatcgactcttcaatcgattcacgcaccaacggatctaaggtgttttctgctgcagcaataacctcagctggcacccgcaccgaggcggggcgaatatggtcgaacttctcgccgtaatccaaagcagcttcagcgccgcggttttggacatcttctacaacaggctgcactatgggaagcacagaccacacgtcagtgccaccacgtggcaaagcacgtcggatgtcgctcttggatggtgtttgacctcgcaggtcagtgacattcaacatggcgaaaagttctcccttaaaaggttgaatcgaaattcttcgagctcggtgcccgaatccaagcggcctcaacacaagttcttaagcccgcatgtttacctattgtattccccacgtaacaagtttctgatttgggtacatcagagttcatttgaattagacttaaaacttaaaatgaccaccccagatttacctgaattaaacccgctttcacctttgagatactggaaggaatggatttcacctctgtgaatgatcgaaacgtccctgcacccaacacctccattcctttcccagttgacctgaatcgagtgacggaggctgttgattccttgggctaccactatttgagctcagaagatcgcatcatcgtgccgtggcaagatcaccgcatttcgatgtacttcagccacgaatcagggcaaatgctcaccatccttggtcgcacgcgccttaatttggacatgtttgccatcaacgatgcggcgcgagctgtcaccgaatggaatgccgaacgcatcgggccaacagccctcgtccatctgggcaacgacggcgaagtggaattgaaattccgcacgaccatctgcatcgatgaagggttaagcacccaacagctacgccaattcatcaacctgtccttggacaccaccgccatggctgtgacctatattctggagcgtttttcagaacttaacttcagcgacaccggaagccctgacgacacgaacaatgccgatgaactcagcgacgaacaagaccaagcagatctcgtagagaaaatccgggggctgtacgttcccactccagttgaagagctcatcgaatccctagaagacgcagagtgggaagaatcagacatggcagacgaggatgcagaagacgactacctagacgatgactcagaaatcgaatgggaaacagacgatgactacttcgaacctgaagaagtcgacatggacgaactcctcaacggtttcctcgaagattctgacatcccccaggaagtcaccttggaacgcattcgggcacaactgcatgccatcggcgtggtaaaaaccagcggcgaagacgatttcatcatcgcgtggatcaacgaagtgtttttaggcttcttcgttgataatggccccactttcctggtgaaaggtcactgggatcccagcatggaccccacacgcgacttcatgaaactgttcatgatgtgcaatcagtggaacgaaaactctctgactaccaaagctttttgccatactgatgacaagggtctccaggtccgggtagagttcgcggtctctgtcgctgaaggcctcaacgacgatcaactacagcacaacatcgcactgtcaattcatcatattttgcaagcgattgattccatcagcacagaagccactggatcatcaacggtggaatggccggagaaaaaccgctgatcattaaggtcttccaagaatggtcgcttagctttagtgcccacacacctgatcatgaggtgtgtgggtacttttgtttgcgcacatctagcccctagccactagccccagtcatctcagaccccgatgctttcgaagtcccctggcctgcgtcgtcctggtctatctcttcttcaggtgtcacaaatgccgcgcaccaatacatgcacacactcaaaaatggagcgaccccaaacgcaacaccaggggtaatagtgggtgctacctggaaagacgcaccgatcgctgaggcgtaatcagatggtgaaccatgaagcatcgtcgaggccacgtttccaaacaccaggaatgccacggaacctgcgatagatacaattcccagccataggagcataactgggcctcgatgttgaggggtgcgcaggaaaacgaataatgcgattgctgctgcaagcacaccggtggcgatcgcaaaccaggcatagccggcaaaagaagtgttggtttccaccgctatggaggctgtttcagcgtcttcaacataagcggtataagtgggtcggagcagtccccatgcggctcccccaatggcgtataaagccaatgttagggcaaacacaccagcgtaaactcccaccgatttgtttattttctttcggtttgggaggttgcgcttgtttccggccccgtcatcgcctgtgtatccatcataaggattgtggtcagaggtgatgccggggtatgtcatggctctaaagaatacagccgttgactgttaactttgcaacctgaactgacaaccggagttttaagctctgtggattagtcgcagaacttccactggccaccttcgttgaagaagcgctgggttgcagagtcggtggttccaccggcggttgctacgacccatgcggatgcttcctggccgttgaccacaacatcggtgatggaatcaacagttccggtgccttcgccacccagtgggatatcagggatggtgttgagatcaagctgggtagcgtcagcgccgctggcttcaagaacgcgggtgcaggtgttgttgatggtgtacgcaagggagctacgcaaggtgttggtgtcagtgtatccgcgaaccagagcctcgatggcagctgtgtcttctggggaagcggtctcgccgttttcaactggcgcagcttcagcgaaggtaattgggttctcagacagctcttgagacagtacatcaagctgtgcttgctgctcttcgttgatggttgttgcttcggaagattcagattcggacgaggtggtttctgctgcttccgccgaggtcgctgcgctggatgaggaagaatttgtcgtcgtcgctgcgctggatgaggctgcttcagtatcagatgaatcactgccacatgcggtcaagagaagtggggtgaccatgagtgctgcgaaagcaaccttctttgaggaaaggctaatagacaaagttctgctcctgataaatcatcgacatgctccggaaaacttaaaaattcccggacggttcacgcagattaccctagcaaagcaatctagctgacgacccaatatagtcctgtcattatgctggcaattgtgcagctatcaaaagaatctattattggcgcagccgtttcgatcttgagcgaattcggtttgtcggatatgaccatgcgccgcgtcgcaaagcagttaaatgtcgcgccgggcgcgctgtattggcattttaaaaataagcaggagcttatcgacgccacctcgcgctatctcctcgcgcctgtcttggggcgcaacgacgagcagcgagcaagcatttccgcgcaggaaacctgcgcggaaatgcgttcgctgatgatgcaaaccaaagatggtgcggaagtcatcagtgccgcactgagtaatcagcaattgcgccaagaattggaatcactcatttctgactctttaaaggaacctaatgaggttggcgcttttacgctgctacattttgtggtgggtgcagtattaacagaacaaactcagctgcagatgcacgagttcacggctggcgcgggagatgacacgcaagaaaaccctgccgatgcaaactttgaggagagattcaatcaaggaatagaaatcattctggtgggtctagacgcgcttgggcatataagatgacgttccatgacatcaacgattgagcactcgtaccaagtttggcctggacatgcttatcctctgggttcaacctatgacggtgctggaacgaacttcgcactcttctccgacgttgcagagcgtgttgagctgtgtctattagatgcagataacaacgagactcgaattccactcgaagagcgcgatgcccacatttggcattgctaccttcctggcgttcaacctggacagcgctacggattccgagttcatggcccgtggaacccagatgagggtaagcggtgcgacgcgaacaaacttctagttgatccctatgctcgtgctttcgatggagattttgatggacatccgtcactattttcttacgacatcaccaatccaaatgaccccaacggtcgcaataccgaagacagcattgatcacacaatgaagtctgtcgtggtgaacccattcttcgactggggcaacgatcgtgcaccgcgtattccttacaacgaaacagtcatttacgaagcccacgtcaagggcatgacgatgacccacccggatgttcctgaagaactccgtggcacctacgcgggccttgcccacccaaccatcattcaatacttgagtgatctgggagtgactgccattgaattgatgccggtccaccagttcctgcaggatgatcgtctccgcgacctaggaatgcgcaactactggggctacaactctttcggcttctttgcgccctacaacgattacgctgccaacaagaaccccggtggcgccgtggccgagttcaaaggcttggtgcgcagctaccacgaagcgggcctcgaagtaattttggatgtggtctacaaccacaccgccgagggcaaccacatgggccccaccatcgcgttccgaggcattgacaacgaggcgtactaccgactggttgagggcgatcgccgtcattacatggactacaccggtactggtaactccctcaatgtccgcgacccgcactcactgcagctgattatggattcgctgcgctactgggtcaccgagatgcatgtcgacggcttccgcttcgaccttgcctctacccttgctcgtgaatttgatgatgttgaccgcctggcaaccttcttcgacctggtccaacaagacccggtggtctcccaggtcaagctcattgctgagccgtgggatgttggcgaaggcggataccaagtgggtaacttcccaccactgtggactgagtggaacggtaaataccgcgacactgtccgtgatttctggcgtggtgagccagcaaccttgggtgaattcgcttcccgactaactggttcctctgatttgtatgcaaacaacggccgtcgccccactgcatcgatcaactttgtgactgctcacgacggcttcaccctcaatgacttggtcagttacaacgagaagcacaacatggccaacggtgaagacggtcgggacggtgaatcacacaaccgttcctggaactgtggcgtcgaaggaccaactgacgatcctgagattatgcagctgcgtgctcagcaacgacgcaacttcctcaccaccttgttgctgtcccagggcacccctatgttgtcccacggtgatgaaatggcccgtacccaaaacggcaacaacaacgtctactgccaagacaatgaactggcgtgggtgaattgggatcaggctgaagaaaacgctgacttggtgagcttcaccaggcgtttgctgcgtatccgagcaaaccacccagtatttaggcgcaggcagttccttgccggtggccctttgggcgccgatgttcgtgaccgcgatatcgcatggctggtaccaaatggaaccttgatgactcaagatgactgggacttcgctttcggtaaatcactgcaggtgttcttcaacggcgatgccatcgaagagcctgattatcgaggacagaaaatccacgatgactccttcatcttgatgttcaacgctcacttcgaacctatcgatttcaatctccctcctgagcatttcggtatgaagtggaagcttttggtcgataccaccgaagcggtgggccacccgctggaggatctcaccatcgaagctggcggaaccatcactgttcctgcccgttccacgatgctgctgcgccaggtggaggctccggactacaccaagcttgaggaaaagatcgctgctgaaaagcgtgagcaagaacttgcggcagagaaggaagctgctgagaagcgcgaattggaactggcggcagcaaaggaagctgaagatgctgctgaggctctccaccttgcggcagaacgtgcttcgactcaggaagctgaattggcccatcaacacggtgctgatgcgattgccgatgaggtagcggaagaaccacaagagctgccacaagatgaagtagcggcagaggtcgagactgagcccgacaccgagcctgacactgaatctgactccgagcaggctgaggtagcttcagaggagcctgaagcggacgaagaagagaagtagtacaccgaaagtggcgtcgcagggatgttcctgcggcaccatttttgctgaggtggaactcacggattaaacacggatttttctaaggttaatcaagtaaggtttaccttatgactacgaaacctatcatcccagaatcaacccactccgcagaacgtgctggtggacattggatccttgccaggcttggaaagaaagtgctgcgccctggaggtcgtgaaacaacgcagttcctgctggagaacctttctttgaccggtgctaccgtggtggaatttgctccaggacttggcgtgactgcacgtgacatccttggcaagggtccggctcgctacatcggagtggatagcgacgcggatgcatgcgcgaatgtacgtgcgatcttacctgcgggtcctcacgaggtgcgcaatacaaatgccaccgatactggccttgaaagcgactcgtttgatgttgtcatcggcgaagcgatgttgaccatgcagaccgataagcacaagttggagctgatgcgcgaggcagctcgaattctgaaaccaggcgggctgtacggcattcacgagctgtcgctggtgcctgacaatgtctccactgcggtgaaagaggatattgctaaggcgctggctcgttccatcaaagtcaatgcccgccccatcacggtgccggaatgggctgcgttggcgcgtgaggcagggttcgatgtgattaatattcgccaagccgacatggcccttctatccctcaagcggaacctgaaggatgaagggctaaaaggtgtcttcacgattgtgaggaacgtgattagccaaccggatctgcgcaagcgagtgctcggaatgcgaaagactttcaccgagcataaagatcacttaggtgcggttggcatcattttgcagaagagagcccaatagggatctgaaatggaggggtgcgtcgataagcaatttagaccgtgaacgctgacttcaacgcctgcagcgcgtcgctggagtcgcccgatgcccacgcctccatgccgatgacgccgtcgtagcccatcgcggcgagagctttcgcgacgccctggtagttgatctcgccggtgccgggttccatgcggccggggacatcggcaacctggatttcgccgatgaatggctgcgcctcacggagcagctcaatgaggtttccttcgccaatctgggcgtggtacaaatccaggttgaggcgcagattcgggtgattgacagccttgaccagcgccaaagtgtcagtggccttggcaaaaggagtgccggggtgatcgactgcgaggttgaggttttccagcacgaaaaccttgcctgcgcgctcccccagctcagcgatctggcggagcgtttcagcagcgtagagccacatttctggggtaaccacttcaatgggagtaacaggtagtccctgcggtccaaggccagttccatgcagattcagccgggggcagttgagcttttccgccaccgccaaggactccgaagcggttgccaagagctccgcgcggccctgttcagtaatcagatccccgcgcaggtagcccgtcatggaggaaaattccgcgcctgttgccacgagcgcatcgatgtcttttgtggaccagtcccaaatttccacgaggaatccctgatcagagatcgtcttgaccctctcctcgaaaggcaggtcctggtagatcatctctgcgcatgctgcgagtttaaaagtcatggttaaacctcgatgctttcagcaaggttgatggttgcgccggtttctacgcttcggatggcgccgagtgcgatgagtagtgcggtgcgtgcagcttcgcctggaaccttggaaggggtgttggtacggatggagtcgacgaaagcttggaattcagctcggtaagcatcggagagcagatcggtatccgcgcgtgaggtggcagccgcgatgccctcagcgccgtagaaagtcatgttggttgcgcgcgcgtcgcctgcggtcatcatgcccttggatccgaagacttcaccgcgaacgtcataaccataggctgcgctgaagcttgcttctgcagtaccaattgctccgttatcaaaacggacagtcaccactgcggtgtcgaggaagccagtgccagcagcttctggaacgacgaggcaatcagcgtgagcggttacttccactggggttgcgcctgggttgaggtagcacagcgcatcgaaatcgtggatgagggtttccaggaagatggtccactgagggatcttgttggggtcagcggtgaatggtcctggatcgcgggtcacggaacgaagcagctgtggggtgccgatatcgcctgcgtcaatgcgtgcgcgtgctgcagcgaaacctgccgcgaaacgacgattgaagcccacctgcaggacagtgtttgcttcgcgtgctgcgttgatggcacgatctgcgtcctcgagggtgacggccatgggcttttccacaaacacgtgcttgcccgctgccgctgctttgaccacgagatccgcgtgggttcgtgctggtgtagcaatcaaaaccgcgtcaatgtcatcgcgggtcaggacgtcatctgggttagagaacgcaacggcgcccaattcatcagcgagggtttctgcgttgggagttgggtcaacgacggcgaccagttcagagccgatcacgtggtttgtgatcaggcgtgcgtgatttgatccgatgcgtccagcaccgatgagggcaagtttgactgacatttttcatccttccaagttttactagaacgttctactataacgttctagtagatactagataccacccattgatgccgtcaaggggtttcctgtaaagatgtaagagattaagaaaaagaggtagatatggcgtcaaagcgaccgacaatggctgatgtggcaaaagctgctggagtatccactgcgctggtctccatcgtgtttcgcgatgcccccggagcaagtgaatccacccgcaaccatgtgaaagaaaaagccgccgaactcggatacattcctgatcgacgagcccaaaaacttcgccaaaaccgctccggactcatcggtgtggcattcgaaatgcaccaagcattccacggcgatatcgtcgaacacctctatcccaccgcccgaaaacatggcttcgacctgtaccttagcgcgatcacaccgactcgcactgaaaaagatgccgtcaacgccctgatcagggaacgatgcgaagcagtaattcttctaggatctcgcatgtcacctagtgatttggaaacaatcgcacagcaacttcccgtccaagtaattgcccgcggttccggaacccccaaagtcagttccgtccatgtcgacgacgcagttggcgcccaattagccctcaaccacctcatcgaattaggccacgaacacatcatctacatcgatggtggcgacgcccctggcacccaggaacgatcagaagtgttcaaagcgcacattgattccttcgccggcaccacccgcatagtccctggtggcagcagcgaagcagcaggagcccaagcaatctcagagattctggattccggaactgacgccaccgccatcctcgcattcaatgaccgagtagccctcggcgtgctcgacatcttatggcagcgcggcatccacgtccccgaagaaatctccgtggtgggatacgacaactcaagccttgccagcctcgaccacatcggcttgaccaccatcgcgcaggactccgaagcaatcgcggcgaaagccattgatgtcacgatcaatcagatcaacaatcacaccgaaacttctgcggtgctgaccccaacattgatcacacggcgcaccacaggccctcggccacagaaggcgatttaagaggtcgaaaataccgaaggtgcacaccgtctggagttgccagttccaatcctttagacgcgcatggaggcctatgtatttttagcgcaattggagctggaatcgctgagttttcagctcgaccacaccaggtgaccgaaaatcctccggcgcatcgaattcggtcaaatagtctggtctgccacaacaggtcagtgcgaccgctgcggaatcaccacgggacgcccatcaataacctcaacaatcacagtggcatcataaatctccgaaatccgctgcgcggtgagcacttcggctgcagtgccctcgaaaactttgcggccaccattcatcatgagcacccgatcgccgtattgcgcagtcagggtgaggtcatgcatcgccgcgatcacggtgaggccgagtcggtgccggatggcgtcgataagctcaagcgtttcctgcgcatggccgatgtcaagcgcggaggtcggctcgtcgagaagcacgatgcgcggttcttgggcgagcgcgcgggcaaggctgacgcgttgacgctcgccgccggacaattcgtctaagccgcggtcgctgaaatgctccaatttcagatcagcgaggcaccgcttcacgatctcatcatcagcacgccccggcgcgtaactgtgcggatgacgccccagcagcacataatcaaaaacgctcagacctgcaggaatagtaggattctgtggcatgagggccacggtacgcgcgaaaaagcgacgctgcttcgcagctttaagaccaaaagcaaaatgcttttcgacgtccccctcccccattttcagccttcccgattccagtgacagtacctgagcaaaagcgtgcagcaacgtactctttccgcagccgttgggacctacgatattaagccattccccttgttctacaaaggtgctcaacccagaaaccgcaggtgtgggcgcatgtgggtggcgaaccgtgatgtcttcgcattcaatgatcgccacttaagcactcctttttggaactcgttgtctgctggttctgcgcaaaataaataagaagaacggtgcgccgagtgcagctgtcaccacacccacgggaagttcctgaggagccatcaatgttcgccctgcggtatctgccaacacgaggaaaatggcaccccatacgaaagacagtggcagtaaaatccgatgccccgggccaacaattaggcgcagggcgtgcggaacaatgatgcccacaaacccgatgagaccggaaatggataccactgcagctgtaccaagggttgccacgatgacaatgccaatgcgtacgaggcctggatcgacgcccaatgtgcgggcttccacatcaccaacagccatcacgtctaacaacctggcgcaggacatgatcacggccgcgcatagtcccgccaccacagccacgatgaagatcgacatccagttggtgacattgaggttgcccaacatccacacatatacgcgcgccaccgtatcgatgtgtcgttgctgaatataggtctggatggaactggcaaaagcagcaaccgccacgcccgccaaaataaccacggtggttgatgatccctgtcctactccccgactcaccatcagcgtggcaagtactgcggcaacaccacctacaaatgctgcaccaatcacgccgatgctcggtgcagaaaatcccagcacggtaccgccaacaatcactgccgtgacaccaaggccagaacctgcggacacacccaacaaataaggatcagccagcgggtttctaaataccgcttggtaagaagcaccagaaatagccagcgttgctccgacaatgacaccagcgataattcgaggcagccggatatcaaagaagatggcctgatctcgaggggtgagcgtgtcctgcccactcaaatgtctaatcactgctgtggggcttaaatcaataacaccgctaaaacctgaaaacagcaccacaaaccccaaaatgactaccgacaacgcggtagccacccaggggttgaggaaaattctcttcagcacgaaaacttaagcagcggccggcacagcttcagaagaagcaagctgattcaactgcgctgcgatttcttccaccagctgggatacgcgaggtccccacctggaagcaatatcatcgtccaaaatgtagatacgtccattggctactgcatcaatggtgtcccagcctggacgcgccgcaatatcttctgcagtgaggttttcggccttggcatcgctgaggaaaatcagatcagggtttgccgcaatgattgcttcgttggatagctgcgagtaagcgtcgccaccgtcagcaatagaggtgagaccaaacatgtcgtaaatctgaccgatgtaggtttgctctgacacagtgaacaaatcactgcccagctcgtggaagtaggttaagccctgctcttttacctcttcaggaatgtggcaactgcagcatcaatggcggttttcatctgatcaacaaccgttgttgcttgatcttcaaatccggtggctcgacctacttgttcaatctgggagtaggtctcatccaagttctctgctgcggggatcactaaagtatccactcctgcagcatccaggccggtcaaaatggaatcatctgcagacatcaacacgaccaggtcaggatcgtaatccaagatggactccacattgggagtaaaaccagacagaccctgcaccagcggtgcgtcctctgggtagtttgagtattcatccactgcgacgacatgatcccctgccccgacagcgaacaaggtttctgtaatcgctggggacaaactgacgatgcgctctggttgatcctcaatggtcacaggtgcttctggggcaaacgtgacggtgacaggaaaaccttccttgctttgggttgtggtgacctctgtgctgctccccgagtcaaccgtcccatcctctgcggaactacagccagcgattagtgctgttgccacaagcactgacagtccagcgattgagcgagatgttgtggttgaaaccatgagaatgcacagcccttctatgtttggatttgtctcacaacatcttaactggtggaaaccgtgaggtttgccaagtgttcttatgctgagcggtaggcctccacttgcttaatgttctccactgcccaggaatacatcgcacggcaaggctcaatgacagaagcacccagatcggtgagctgataatccacacgaggcggcacaactgcgtgggaggtgcgagtgaccagtccgtcttccaccaacactccaagacgctgggtgagcatctttggggtaattccttggacctgatctttgatttcaccattgcgctgtggaccattttccatgctgagcaggatcagcaccgcccacttgtcactgatggtgtcgagcaaggtgcggctcgggcaattcttcttaaacggcgttactgaatcaagctgggttgttttacgcttggcatcacgaatgtcggtgacggtagcttccatggtgtttcctggttggacggccatgtctgattcaaactgtacgttcattgaaaagctctttcatcctcaaaaatgaaacaatccgaagttgttgttcggagttcttaatttaagtctctgttacttaatgcgtcgtgatttttggtttgaacgttacacacccacgtccagaatcttcttgaattccccggcgcgcttaaatgatgtccaccccacctagtagggtggtgtccattgattcagatcgaaaggaccacacctgtgatcgcggcttacggcgcatccatctctttggatgattccaccctcaccatctcttattcccctcttcttgctgctctttctaagtccagcgcacaatcggaatcggttgatctgacacaggtctctggagtatctgtgcaggatcccactgcttttactcacggctttttaaacctggagggcgtggataaatccatcgcctttgccccaaatagttcggcagatttagctgcgctggcagctgatattgatgctgtgttgaagggtgaaaagccacagcacctgggtggcggagccccagtagtgccttcagctccatctactgttgctggtctgaatttcgtgggctttgacgtagagacggccaatgatgattggggttccatctgccagattggtttggtcaagtacgtcgatggtgtggaggaatcttcggagtcatggttgtgtactcctcctgagagcctgaatttcttcaatgagatcaacattggtattcacggcatcaccccagagatggttgctgatcagcctcgttttgcagaccttgtgcccaagatggtggagttcgttggggatttgccgttggttgctcacaatgcgcagtttgatttcaccgcattgtcgcgcgcgtgtgctgcctcagggatcgatgtcccagagatgatttatggctgctcgttgacgttggcacgcaatgagaagctgcaggtggaaaaccataagcttccaacggtggctagtcatttagggtttgagctgaaaaaccaccacgatgctgctgaagatgctcgcgcgtgtgctgcgattaccattgcgttggcaaagcgccacagctttgagggcagctttgtggatttcgttcacagccgtggtttcaccatgggaaccgtggataacgcccgggtgtatccggtgctgaaggatcgttctggagctaacgttgcgttgcagcgtcgaaactttggtttggatgcaggcaagaccgaagtccccgtgcagccagctgttgatccagcgtgggaaaccccgaaggcggagccaaaaaagcaatctggccgccgtgcaccgtgggacaaggtggctacccctgaggtcattccagatcccaatcccgatgctgatccgtcgagcattctctatggccagaatgtgaccttgactggtgatttcgagccatatgaaaagggtgcgctgtggcagcggatcgctgatcaaggtgcgctgatcggtaagaacgtgactaagaagaccaccattttggttgctggcccgtgggcaacgattaccagtaagcaaaaacgtgctgaggagttgaaagaaaaaggacaggacatccagatctgggatgaaaagcagctgtttacggctctggggttagatgaacagcccccgttttaaaagaattttctaaaactcgggaacctttagccaacttttcaagtccaacccttttaagaacacatttttcttaaaggggacgacatgaaagtacctattcgagcatcaaagattcagcctcgactgcacaatcaccaatgggcccacaccgcacgtttaagcacagatggtttctgcgataacccagcaatgctgaacctttcccacgatctgtgtatggggttgcacagcgggaaagtcacactcagttaccgggctctcgctgaagtggggctgaccaccaggcaagcgtgggatcaatcagccaccaatttattaaagtgtgctactactcctgagggtattcgatttgatcttcgggacgcagaaacgaccacaaccatcgcctcgtctgcattagaaatcagagttcccggcgcgccaattactgcatggttggcgcatcctcaaacctttacagtgttgaatcgtcatcttgaattacgactgggaccagcaccgctgtatcttgctccgaattcacacacactcatcgctattcctgctggtgatccagggatctttgaatttgaacggtgggcgcgaagcttgctggaagtgggtggtgtggagggtatcgtcgataagcttcttgtttataggcacggctttccttgcccttaccagccagcctttgtagcacttgctgcgtaaatctttttcccacgccgggaatgcgtgaacactaagatcgaggacgtaccgcacgattttgcctaacttttaagggtgtttcatcatggcacgtccaatttccgcaacgtacaggcttcaaatgcgaggacctcaagcagatagcgccgggcgttcatttggttttgcgcaggccaaagcccagcttccctatctgaagaagctaggcatcagccacctgtacctctcccctatttttacggccatgccagattccaatcatggctacgatgtcattgatcccaccaccatcaatgaagagctcggtggcatggagggtcttcgagatcttgccgcagctacacacgagttgggcatgggcatcatcattgatattgttcccaaccatttaggtgttgccgttccacatttgaatccttggtggtgggatgttctaaaaaacggcaaagattccgcttttgagttctatttcgatattgactggcacgaagacaacggttctggtggcaagctgggcatgccgattctgggtgctgaaggcgatgaagacaagctggaattcgcggagcttgatggagagaaagtgctcaaatattttgaccacctcttcccaatcgcgcctggtaccgaagaagggacaccgcaagaagtctacaagcgccagcattaccgcctgcagttctggcgcgatggcgtgatcaacttccgtcgcttcttttccgtgaatacgttggctggcatcaggcaagaagatcccttagtgtttgaacatactcatcgtctgctgcgcgaattggtggcggaagacctcattgacggcgtgcgcgtcgatcaccccgacgggctttccgatccttttggatatctgcacagactccgcgacctcattggacctgaccgctggctgatcatcgaaaagatcttgagcgttgatgaaccactcgatccccgcctggccgttgatggcaccactggctacgacgccctccgtgaactcgacggcgtgtttatctcccgagaatctgaggacaaattctccatgctggcgctgacccacagtggatccacctgggatgaacgcgccctcaaatccacggaggaaagcctcaaacgagtcgtcgcccaacaagaactcgcagccgaaatcttaaggctcgcccgcgccatgcgccgcgataacttctccaccgcaggcaccaacgtcaccgaagacaaacttagcgaaaccatcatcgaattagtcgccgccatgcccgtctaccgcgccgactacatctccctctcacgcaccaccgccaccgtcatcgcggagatgtccaaacgcttcccctcccggcgtgacgcactcgacctcatcgcggccgccctacttggcaatggcgaggccaaaatccgcttcgctcaagtctgcggcgccgtcatggctaaaggtgtggaagacaccaccttctaccgcgcatctaggctcgttgcattgcaagaagtcggtggcgcgccggggagattcggcgtctccgctgcagaattccacttgctgcaggaagaacgcagcctgctgtggccacgcaccatgaccaccttgtccacgcatgacaccaaacgtggcgaagatacccgcgcccgcatcatctccctgtctgaagtccccgatatgtactccgagctggtcaatcgtgttttcgcggtgctccccgcgccagacggcgcaacgggcagtttcctcctacaaaacctgctgggcgtatggcccgccgacggcgtgatcaccgatgcgctgcgcgatcgattcagggaatacgccctaaaagctatccgcgaagcatccacaaaaaccacgtgggtggaccccaacgagtccttcgaggctgcggtctgcgattgggtggaagcgcttttcgacggaccctccacctcactaatcaccgaatttgtctcccacatcaaccgtggctctgtgcaaatctccttaggcaggaaactgctgcaaatggtgggcgctggaatccccgacacttaccaaggaactgagtttttagaagactccctggtagatcccgataaccgacgctttgttgattacaccgccagagaacaagtcctggagcgcctgcaaacctgggattggacgcaggttaattcggtagaagacttggtggataacgccgacatcgccaaaatggccgtggtccataaatccctcgagttgcgtgctgaatttcgtgcaagctttgttggtggagatcatcaggcagtatttggcgaaggtcgcgcagaatcccacatcatgggcatcgcccgcggtacagaccgaaaccacctcaacatcattgctcttgctacccgtcgaccactgatcttggaagaccgtggcggatggtatgacaccaccgtcacgcttcctggtggacaatgggaagacaggctcaccgggcaacgcttcagtggtgttgtcccagccaccgatttgttctcacatctacccgtatctttgttggttttagtacccgatagtgagttttgatccctgcacaggaaagttagcggcgctactatgaacgatcgatatgtctgacaacactctctcccaatttggcagttactaccacgaattccgacgtgcccatcccatggccgacgtcgaattcctcctagcaattgaagaattacttacggacggtggtgtcaccttcgatcgcgtcaccacacgcatcaaagaatggtcaagcctgaaagccaaggctcgcaagcgtcgcaacgatggctcgttgatctaccctgatccgcgcaaagacatccacgacatgatcggtgttcggatcaccacgtaccactccacggaaatacccgtggccctaaaagtgctccaagactccttcatcgtccacaaatccgtagacaaagccgctgaaactcgcatctcaggcggctttggttacggctcccaccacctgattctggaagtcgatgacacctccgatgacctccaggactacaaaggcctcgtctttgaagttcaggtgcgcaccgtgctgcaacacgcctgggcagagttcgaacacgatatccgctataaacgcgccgatgtgtccaacccagaagacttcagcgcagaagtagaccgcatgttcaccctcgctgccggactcatcgaattagcggaccaacaattcgaccaaatcgccgcactcaaagaaaccagccgagttgctgatgaatccgtcgaactcaccgcagagacacttcccggcgttcttgccatgctcattggcaaccgcttcccccgcccacgctccacaaactaccgcttcctcgaagacatcctggtggccaactccattacctctgtggtgcagctgcgcgagctgctcaaccccaccgacattgaagtgctgttgaaagtaatgaactaccgcttccacccaggccagatccgcatcatcgacgatttactactcaaacgatttggccaatcacacatcgatgccaccgtcgccaccgactcccaaccactcaacgccaaacgccacaggcagctaaaacgcaagctagagctcatgacccaagctcatcttgtggaaccaccaaactaaagttcccccaaagttagccccggctaaaacacgcggagtcccacaacctacaatgcactaaaacacctgttacgctagtgcagcagatcatttttatataccaagcaaggagccaaatactatggggtcatccatcactgacttcccgatgctcgcagacttcctccacgtgtggggcctgaccgtcgctgatttcttccgtccaatgggcatcaatttcccaccagctgactggagcctgagctctatctaggacactccttgacttaaaaagtctgcgaacttaaacgcagcggcaccacccatactttgtggggtggtgctttttctttttctacaacatgatctgggtgctggcatggacagtgcttgggaaacgatccactcgcacataagggtcatccataatcagatgctccattgttcggtcataaacctcatctgaatcatctaggttcaccacggtgacaacaaagtacaagttgtgaccagtgggatacaggccttcttgctcaatctgatactgctcagcaaggcttccccaaatatcctggtctacttccatccgtaggccatctgccactgaaactacgtcagcgccgttcaatgctgccaaagagttcattcggctgcgataagtttggtacgcctcgtcttcatcctcgggtgcagcgatgaaataagtggtacatacgtattgagtcttcatgaacttccacattcctatgcttttcaacgttgaagtgacccgaataaatgcacaggagcactaaatcctcgaagctctccagtctgctcttctgggtctggctattgtttctccaagttaccggcttctctcgctggcctgcatgagatggccaatagcgattgaagtgtgggattcggccttagatatttccgacgaatacagaccaccaccgtatacttagagcagcgcggggccgaaagagcttagtcggtaccgcgcaattacaccgacgaaatctagaattccagctgatccgaagcaatctgggcgaccccttggacgctgcgaggaactggacaaactgttcgaagtttgtcaccatggttatcaaaagccccggaacgatccctggtttggctggactcaaaagtctggaatacgaactaaatcgccggggttaatgcatttttaggggtctccagtcttgatcttcctgggtctggctatggtttctccaggttaccggctcccctagctcaactacatcagtaagccaataggtttgcccaggatcccagccagccagtattccggctcgattgccatcggtaacaaccactcgcccagctgtagctagatagccttgaatgttcaaatgcacgccatcataatgcttggctacttgtacatagtctgggataacccatttgtgaggatagccagttgccatcgtccaatttggcgcgttggacattggtaaatcgagtgggaagcgtctgcataaggatgcccaatcatctggtccattgattgtaaatacctgagcttcgggcaatattgtggcttgccgtatctgtcctgtgttccatccgaagccatcttccacgaatcgtaaactccctggaatcctgtcttccaacttcccagaggtccggatcagtgtctgtggtggcgttgaccaccataaagatggattcatttcctccacccgccatgtgtttagaacctcatggactgatgacggtcgatgattggaccccgtagccttccaactcacgctggattgcccacctggacgaaactgctctgcccatgacttcaaaagtggtgatcgctgcaagtgcaaagcgatgcgacgaagacctggtctcatgggccgagtagccaagagtaaatctgtattcgtcagcggttgccaatacgcagcgttagtcaccgtagagtcaagcgcgtcgtacatcagcttcggagtcagctcgatcaacggaacctgctctaataacggtgcaaccttcttagctctagctaacacggtgtattgaggtgcaattccgcgtctccgcgtgttgtattcagcttccctgtctaaccaccacgaggcatgttctagcgggcgaagtcctgatccttcaacggaaccgtcgtcaaaagccactgcaaggttcatcaggaagtttcgtccccgtggcccccaaaccatatcgtttgctgctttcacagcccccaccttaggcactttcttccaccgccaaatgagaacacctaaaaaccttgcgggaataccaccaaccccatattgttgatatatctacaaactcttttaataagtctgatcaacaacgtgaggaaagcaatgaaaaacgtctccttcggcctcgacaccttcggcgacaacgccatcgacctgcagggcaacccggtctcccctgcacaaacacttcgaaacatcattgatgaagccaagatggcagacaaagtcggggtggatatcatcggcatcggagagcaccaccgtgaggaatactcagtttctgcacctgacatcgtcatgacagctatcctcgcatccactgagcgactcaaagtcacctcttccgtgactgtgctgtcctctgatgatcctgttcgcctgtttgagcgttattccaccatgaatgcactgtccaacggtcgcgccgaaatcaccttgggacgcggttccttcattgagtctttcccattgtttggttttgatcttcaggactacgagcagctgtttagtgaacgccttgatttgttcgcgaagattcttgaggccgacagccgtggtcagggcgtgacctggcatggtgagacccgctcggcgttggaaaaccagatgctttacccaccaactgagaatggcattcacgcttgggttgcagtgggtggcagcccagaatcagtcgtgcgcgctgctaagtatcgtttcccgttgatgcttgccatcatcggcggtgctcctgagcgtttccgcccgtatgtggatctgtacaagcgtgccaacgaacagttcgggcagcctcaaaagcccattggtgtgcactcccctggactcattgcggcaactgatgaggaagcccgtgagctagcacttaatgattggttggaactccaacgcaagatcggtgctgaacgcggttgggctcctgcggatgcaatgcagtttgaacgcgaaatcgatcacggttccttatacatcggttcccctgagacggtcgcaaagaagatcgccaaaaccatttcagtgcttgatcttgatcgctttaccctcaaatacgccagtggccagacccctcatgagtacttgctgaagtccattgagttgtatggcactgaggttattccgctggtgaaggacatcttgaccaagcaggcttaagaaggtcttaggacattcccctgaactgttccatttctcgccgttccttcttggtgggccgtccggctccacggtcacggcgaggaatcgacgccagcacttccatcggtggtggtggcggggtgtggtcaacgtagcaggttcgggccaccgaggctccgactcgcttcttgatggtgcgcagcacctccacatcaaactcgcggtggtttacccacacgcgcacgcggtcacctggcaccacttgttgggcaggtttgaccgcgttgttgtttagcttgacgtgccctgccctgcaggcttcggcagcctctgaccgggttttatataaacgaactgcccacacccacgcgtcgatgcggacaggtaatccatcagtgtctgacatagatttctaactagtaacggtctttttcgttaatgatcttttggaccttgttgtagtaataaaaaccgccgaccacggcgatgatcaatccaagtcccataaagaatgcagagccgaacactagccacagagccgcaccgcctacgatgccaccgccaacactgacaactgcgttgcgggagttcttgcgtacttcttgcttacgtttttcgattgggttgcgggggtatggttgcatgctcatagttgaacagtctagtgctcttacaccgcactagtcactcggggattccacccacatgtgcccggattctttcaattcaatttctgcacccatcatggatgacaattgagattccaccgcagcctgttcaccaggcaataaagccaaggtgtatgtgacttctgcaccatattcagtgtcagtaatgatgatgcccatgccgcgcagattcgcttcaatgcgccccgcatcagaatgcggaaggtcaatcttgaaaatctcccgaacagagcgggtgacttgcaaaacctcaggtagaagctccgtcaccgcgttggtgtaggcattaactaatccgccagtgcccagttttacgccaccgaaataacgcaccaccacagcggcaatatctttcattcccgagccacgcaacgcctctagcatgggttttcccgcggtaccggaaggttcgccatcatcagaggaacgctccacatcatttgagccatccacatggaaaataaaggcactgcaatgatgacgcgcatccggatacagctccttgatggagtgaataaattcgcgagcctgctcctgatcttgcacacgcgtgatataggtcagaaatcgcgagcgcttgatctctagttcatgctcaaagacttgaccggcctgagggagttggtattgcgtgagatgtgccatagcatctcacatcttagctcgccaaccggcagcattttcactagcctggtggccatgttgacctcgcaaagcttttcagtgtgggctccacttccccacgatgtacatctgatcctcaacggcgaaaccctccccatgcacaaaacggagggcagctggtggcgcgccgagatcgcgcccaaggccggcgatcgttacggtttttcgcttttcgacggctcctcctggtcaaaaaccctccccgatccccgctccacatctcaaccagacggggttcatggtttaagtgaagtctccgatgattcctatctgtggggtgaccagcagtggactggccgaattctccctggctcggtgttatatgagctgcatgtgggcacctttagtgaagatggaacgtttgagggagtcgtcgacaagcttccttatctgcgcgacctcggcgtgaccgccatcgaacttttacccgtgcagccctttggcggcaaccgcaattggggctacgacggggtgctgtggcacgccgtccatgcaggctacggcggtccggcgggcttgaaaaagcttatcgacgcctcccaccaggccggcatcgccgtctacttagacgtcgtgtacaaccacttcggccccgacggcaactacaacgggcaatttggcccctacacctctggcggcagcaccggctggggcgacgtggtcaacatcaacggccatgattcagatgaagtccgcaattatattctcgacgccgcacgccagtggttcgaagattttcacgttgatgggctccgcctcgatgcggtgcattctctcgatgatcgcggcgcctattccctacttgcgcagctgaccatggtggccgaggatgtctccgcacaaacaggcatcccacgctcattgattgcagaatctgaactcaatgaccccaagttcgttacctcccgcgaggccggcggttttggcctggatgcacagtgggttgacgatatccaccacgccctccatgccctcgtttctggcgaacgcaatggttattacagcgatttcggatctgtcgacacattagccaaaaccctgcgtgaagtatttgaacacaccggaaactactccacgtaccgcggacgcaaccacggccgccctgtgcaccccgatatcacccctgcctcgcgctttgtcacctacaccaccacccatgatcagaccggcaaccgcgcaatcggcgaccgtccttccacgactctcaccccggaacagcaggtgttgaaggcagccattatctacagctcgccgtataccccgatgttgtttatgggtgaagaattcggagccaccaccccattcgccttcttttgctcccacaccgaccccgagctcaaccgcctaacctccgagggccgcaaacgggaattcgcacgccttggctggaacgccgacgacatcccctcccccgagctggaatccaccttcacctcctccaaactcgattgggagttcactgcggagcagcgccgcatcaacgacgcttacaagcagctgttgcacctgcggcacaccttgggcttctcccaaccaaacttgctcacactcgaggttgagcacggcgagaactggctatcgatggccaatggtcgcggccgaattctggcgaatttctccgacgacaccatcaccgtcccgcttggcggcgagctgatttacagcttcacttcccccaccgtcaccgacacctccacaacccttcagccgtggggctttgcgatcctgacccgaaactagaaaaaggccacctcgattgaggtggccttcagctatgtttaggtcaagtattcgtactcaggggtgcccggctcgaggcgacgggaatcaattgccgattcctccatacgttccagcaaagaatccaatcctgatgcttcactcaagtgaatacccaccaacgcagtaccggtctcacggttgttgcgcttgaggtactcaaacagcgtgatgtcatcatccggtcccaggatatcttccaggaagtgacgcaactgaccaggcttttgcgggaagttcaccaagaagtagtgcttcaaaccgcggtgcaccaaggagcgctcagcgatttccgcataacgcagcacatcgttgttgccaccagagatgatgcacaccacgacagaaccaggtgcaaaggacatttccttcaacccagcgatagacagcgcgccagcaggctccgcgatgatgccttcgttttggtaaagatcgagcatctcagtacacacagcgccctcggtcgcgctcatcatgtgcacgcgaccctggttcttctccacgatggtgtagttgagatctccgacacgtttgactgctgcgccgtccacaaagggatcaacagtctccaaagtgattggtccaccattgtgcaatgcagcctgcatggatgctgctcccgctggttcgataccaacgatcgcagtgcgaggtgccatatcagccatgtagctgaccacacctgcaagaagtccgccaccgccgactggaaccatcacgtgatctgcactcttgcccatggaagtcagctgcgacaagatctcagcagccacggtgccctgaccgatgacggtgttgcgagcatcgaaaggctcgatcagcgttgcgccggtgcgctctgcatcttcatgcgctgcagccgatgcttcgtcgaagttattgccagtgaccaccaaggagacaaactctccgccgtgaaccatgatgcggtcacgcttttgctttggagtctgcacaggaacatagatgcgtccctgaacgcccaaggacttgcacacataggccacgccctgggcatggttacctgcagatgcggcaacgatacctgcatcgcgctgctcttgggtgagctgcgctccagagttcagcgcaccgcggatcttgtaggaacgaacatcctgcagatcctcacgcttaaggtagatttccgctccggtttcctcagaaagacgagggcaatactgcaatggagttggtgcaatgacggaggaaattcgtgcctgcgccgtttgaatgtcggcggcacgaatcagctccgctccgctagccatcactcctggacttttctcagacacgtatgtttcactcatggttgactagtgtaatcttctcctagaattgcacctactttggcataggttttatttccaacaagctctttgtagaacaatgctatagattgttttctagccaatactgtggttgtggcactacactttccacgagttgaggatagctttcgctatccaatcttctatcttgtttccatagtaaatccgcatatttattgccaggagaaaagttttgtctttgcgtcgaagtactttgacccttgttacagcaagcgctgtggcattgtccgtgttcactccagttgcccaggctcagtcctctgacgcactgacacagctctcagacaacatcacctcatcacagatccttgatgatgatggaaatccagtcgatggaaacgaaacctggccaggcagctctgaaggcagctcaatgctcagcaatggcgacattcctgcggccccaagcttgagctcctccggcaaagacaccagcgatgatgacgatgaaatcagcgaagagcagcaagcactgatcgatcggttgtccgaaatgccagtgattggttccattgtctccccaccagaatggcttgccattccttttgcggtactgcagggattgctcgcaatcaccactcttgcttccaccgcagcatccttcatggtgaccgtcgacccatcgttcaagcagactctgcgtgacatgctcacccagtttggcatcaacgtcgacgcttaaaagcacactgacataaaatgagcggctattgttccttcagataattttcctgaaggaacaacagccgctcattttgctgcttagactagcaaccctcgttgtctagcttagaacagttcctttgatgcaatgcgagcgccctctactagggactccagctttgcccatgcgatctgggaatgcagacgtccgcccagaccacagtcagtggacgcaatgacgttctcagggccaacaagcttggcgaactgaacgatacgatcagcaaccaggcgtgggtgctccacagcgttgatggagtgagacacaacaccagggtagataacagagccttcaggaagcttgttttcttcccatacacgccactcgtgtgcgtgacgaggagatgcgccttcgaaggagaagccaccgacctctgcgcgcaggatctcaccaatgatgtcaccgaatgggatgtcagtgacgtgtggtccgtgccaagagccccagcagatgtgcaggcgggtctgttcctttggaaggcccttcactgcactgttgatggcatcgatgcgtgtaccgatccagtccaagtaatccttcacgcttggctctgggttgatctgatcccatgcttctgccaagtccggtgcgtcgagctgaacggtcagacctgcatcggtgatgatcttgtattcctgggaaagcgcatcagcacatgctgcgacgacttcttcatcagtgtcgtagaacttgttggtcaatcgagctgcagatcctggggatagtgctgcaacgaagccgtcggtagctcccgctgcgttcatgcccttcttcagcagatcaacatccgtctgagtttcttcctggccaatgtaggtaataggtccggtgaactctgggttgcccacagaagcgcgaccggtgaagatgccagatactggatcctcgtatgcttcgctgaacaatgcgcggtcgcgacgatcagagaagctggtcagcttgatgttgccaggggtggaacgcactgcttcctggcttgcccaacggtcggtatcggtcatggtcagtccgcccaggcgggtgaaggagtagttccaccatgcaccgaagtcaactgcaccggaggtgacgtggccgtattcgccctcgttaaggatgtcgatacccaggtcaacctggcgcttgatcacgtcatctacagaagactgcagaatctggaagaattcctcctccccaatctcaccgttagaacgcttgatgtttgcatcaagtagctctggggtacggggcaaggaaccaacgtgagtggtcctgatgcggttctggctcattgaaaatccaatctaaaagtcgaaagaaagtatcaaactctcattcgactctaaccgcgtttacctcacctacggtcactgcacccggaattttattcatcattcgggttttcacccctacacggggtaatcccagtgtgatgtgattaaccgaggatgcctggccccatcgttgccttgaggtcgcccatcaaacttgcggatcggttgactcttaagtgatcacccaaaatcatgaccgtggagttatccccatcgatcaaattgaggtacacatcagattcacccttgttgtccaccagcacctgcttgagcttggcaatgttggacatggtgcactgatcagtacgcatggacaaacgaagcggaagtccttgcccgtttcctggcccaagctctggaacgcggagatcatcacagaaaaggctcatacgatcatctcgaatggagatgtgtgccttggccaagatgatgttgtcttccacaatcatggatccaacgatggaatacaccttgttgaagaccaacaattcaacggacgcgccgttgtgatcttcaatggtgacaatcgcccaaggggaaccgtccttcttggagaaccgtcgatccacaccagagataatgccacccacggtcacttctgcgccgtgcttgagttcaccggcaacaatggtggtcagtgctgtatcaacctgggcagcaatggcatcttcatagccatcgagtgggtgtccagaaacatacagacccagcatttctcgctcgagtgcgagctcatgcttacggtcccattcgtcatcaggaacggtgatctggaagaaacttgccacatcgtcgttgttatccgagtcgaaagctgcaaagagatcaaattgtcccttgtcagcagcttttttggtagcgatgacggaatcaacggcatcttcgaagaccagcatgaggccttttcgtgcgtgtccaagggagtcaaaagcgccacccttgatcaaagactcggtgatgcgcttgttacacggcagggtatcgatcttgtccaagtagtctgagaagtccttaaataggcccttttccttgcgggtatccaaaatggaatccacaacttcagcacccacgtttctaatggctcccaggccatagcgaatatcggtgccaacaggaaggaagttcaacgaggactcgttaatatccggcgaaagcactcgaattccaaggtgtcggcaatcagaaaggtagatcgccgatttgtccttgttatcacccacagaagtcagcagtgctgccatgtattccggcgcgtagtgcgccttcaaataggcagtccagaaggatacaagtccataacctgcggcgtgagacttgttgaacgcgtagccggcgaacggcagaatggtatcccacaaagtcttaatcgcggcatctgaatagccgttcgccttcattccaccttcgaagtttgcgaactccttttccaggacctcgggcttcttcttacccatggctttacggaaaccatctgcttgaccagcggtgtagtttgcgaccttctgggagatcctcatgatctgctcctggtacacaatcagaccataggtttcaccaaggatttcttccagagcttcctccaactctgggtgaattggagtaatgggcttgcgtccgtttttacggtcggcgtaatcccagtgcgcgttcacacccatggggcctgggcgatacagcgcaagcgctgcgacgatgtcattgaagccggttggctgcatacgcttcagcagctcctgcatgccaccaccatcaagctggaacacaccaagggtttctccacggcctagcagcttgtaggtttcttcatcctcgatcgctaggttttctagatcaagcacttccccatcgcggttggccttaatgttttcaatcgcatcgccaataacggtaaggtttcgaagtcccaggaagtccatcttcaacaggccaatggcctcacatgctgggtaatcccagcctgtaatcagtgcgccgtcggctggccgcttccacatcggaatgcagtccagcagcggtacagaagacataatcacggcacacgcgtgcacgccagattggcgcaccacgccttccaaaccacgagcggtgtcgtaaatgcgcttcacatcagggtcggtttcgatcagctggcgcaccgcacctgcttcattaaaacgagggtgatccggatcggtgataccggacaacggaatatccttcgccataatggcaggtggaagctccttgatcacgcggtcagcgatttgatagcctggctgccccatttgcacacgggcggagtctttcagtgcctgctttgttttcaccgtaccgaaggtgatcacctgagcaatcttgtcctcgccccaacggtcagctgcgtaacggatcatttcaccgcggcggcgatcatcgaagtcaatatcgatatcgggtgcggatggtcgttctgggttgaggaatctctcgaacagcaatccgtgttccatggggtcaatgttggtgatggtcaacgcgtaggcaaccaatgcacctgcagccgaaccacggccaggtcctacacggatgccaatggaacgagcgtgcttgataatttcagcaacgatgaggaagtaggaagggtagcccttcatatcaataacggagatctcatactccgcgcgctcaatataatcctcaggaacttgctgtccagagaaacgatcctccaagccagccatcacttcatggtgcaaccaagtggttggggtgtagccttctggaacatcagcgataggcatgcggtcgtgtgagtgttcttcccagatttcgtcataggactgcacacgttcagcgatccacagggtgttgtcgcagccatctggaaccatgtcgtcccagagtgcacgcatttgttctgcagatttaacgtaatagccggttccgccgaatttgaatcggtcttcatcatgaagcgtcttgcctgtttgcacgcagagcattgcctcgtgggcttgcgcctgagattccagcacatagtggcagtcgttggtgaccaggggtggcaaattgagcttgcgtccgatttcgagcagctcactgcgcacacgggtttcaatgtcgagcccgtggtccatcaactcgaggaagtagttgtcgcgaccatagatgtcctgccacatggcggctgcttcaagggcttcgtcgaactggcccaagcgcaggcgtgtttgcacatcgccggaagggcaacccgtggtggcgatgatgccttcggcgtgctcagcgatgatatcggcgtccatgcggggccacttgcctagctggccttcgtacgatgccatcgaagatagataaaagaggtttcttaaacctgtggtgttttctgcaagcatcgtctggtgcaaatacgcaccggaaccagaaacatcatctgatttttggtgtggttcgccccaacgcacacgctctttcttaaaacgagactcaggtgccatatacgtttcaatgccaatgatgggcttaatgcccatctctgtcatcttgcgataaaaggggttggagccatacatattgccgtggtcggtgattccgaccgcaggcattccctgggctttaacctcatcggccaacatatcgatcttggccattccatcaagcatggaaaactcggtgtggttgtgaagatgtacaaatgaggattgcttggccatgtgggacagtctagccatctccttacacccgtgaaactcctatttcattaacgcattgatctcggcttttctaacctaggtataaggtaacagctatgattttcggcgtactcgcatacttgggatggggcatgttcccggcctttttcccactacttcttccggcaggaccgttcgaaattttagcgcatcggatcctatggactgctgtattaatgatgattatcattagtttcacgtcgggatggaaagagcttaagtccgctgatcgcggtacatggttacgcattatattgtcatcgttgtttattgccgggaactggctgatctatgtcatcgctgtcaattctgggcaagttactgaagccgctctcggatactttattaaccccctgttaagtgtcgtgcttggcattgtgttcttcaaagaacagttacgaaaactgcaaattagtgcggtggttattgctgctgcgggggttttggtactaacatttctaggtgataagccaccgtatttagcgataacactagcatttacattcggcatctatggagcgttgaaaaaacaagtcaagatgtctgctgctagttctttgtgcgctgaaactttagtactgctgcccatcgcagtcatatacctgattgggctcgaagcttccggtcacagtacctttttcaacaatggcagtgggcacatggcgttattaatctgctcgggtttggtcacagccgtcccgctgttgatgtttgcattggccgccaaggcaatacctctttccactgtcggcatgctgcaatatctgaccccaacgatgcagatgctgtgggcattgtttgtggtcaacgaatcagtagaaccaatgcgttggttcggattcgttttcatttggatcgcagttactatttacatcacagatagcctacttaagaagtaggtaatagcagtattgatatgtatccacgtttattaggaatctattcgcattttgaaaccgcatcataaaaaaattggaaccttgtttacacctaagaagctaaaggggcgttccccttaaaatcgaaaatccacgacacccgaatcttgaatctgtgcgaaaattccagtgggagagaaaactgaaccacacctccgagcgtgaaaatattgtattagccccaaaagcatatgctaggttataagagaatcggctttcgacacacttgaattataccgctgaaatccttttcagtgacttagcttggcttttgagatttcgaggatccgacaatgaataagtccagctttcgtagagccttttatataataatttgctctatatctctctactcctgtgcttccttccctgtagattcggaaggcactttggatcgtgctcgcggcgatgaactcgtagttggaatatcggaaaacaaaccttggacgcagactagcggaactggtagatattcaggcatagaagtcgatctcattgaaggcttcgcagacacaatcgacgcagatgtgcaatggctacatgccccagaatcagtactggccgagaaaatcaaaaatggccaacttgatctcatgattggggggttatcttcttcatctccttggtcttctcatatggcactgtctcgcccataccaccaattcgatggagaagaaaaagtcatgggggtcaggctaggagaaaatgatctcatgatggctttggaacggtacctcgctcacgagtttggtgaaattagatgagtccagaagccaaagaagcccaagattctaggcgcaacgagatgcccgagaaaaagcgagcggtgctacgtaaagcgattaagttggaatgggcaacgatcgcatgggttcttttttcgatcgttttggtaggtgttgtcgctggtcaatcgcaggccatgcgtagtgcatggattgaagacatgctttctttggtaccacctatcgcttttcttttagcctcccgaatcagcaaagctgtggcaaccagaaaacatccatacggcaagcaccggtcgattgctatcgggcaccaagctgcagcactggccctgcttatcatgggaagccttttaatttatgaagcggtatctgcactgatcaagggagaaaggcctccgataggtttagctattttatttggccatgacgtgtggtcaggttggttaatgatcggggttatgatttcagtgtcgatcccgatggtgattgtagggcgagtaaaaataaacttagctaaagatctccacgataaactcctctatgcagacgcggatatggccaaggctgactggggcacagcagtcgctagcacagtaggcgtgctcggaataggactgggtttttggtgggcggatgcagttgcagctctagtaatatcagcttcaattctcagagatggcgtgataaatatgaaagctgctatatctgacttaggtgatggacgagccatgacttatgacaattccgcccctcacccattaaatgatgatgtggaaaaggctgccctagagatgcattgggtcaaacacgcccgcgctaggatacgcgaccaaggccgctgtttccacacagagttatttgtcgaaccagtagaaggatacacacctgctccggaagaaataacttctctagttaagcgaatccaaaaccttgactggaagctgcaagatgtcgtagcttccgtcgtcgaaaaaatcgaccggtttcaggccccttcgtaaaacttaactgagaaagtgattccgcttgtaccgactatggggtgggcgtcccacctgtgactcccagggtttctcctaccacatagctggcttcgtcagaagcgagaaaaacgtacgcacctgccaactcaacagggtgacccgctcttccaatcggagcgtgctggccaaatccttctattttctcttgtggctgaccatggctgggttgcaacggcgtccagaaaggacctggggctacagaatttacccgaatgccatcgcctatcagactacttgccaagccctttgacaaattgttcaatgccgccttagtcatggcgtaatccaagagggtttccgaaggttggtacgcctgaatggacgatgtaaagattatcgatgatccgggcttcagatgaggtatagctgctttggtaacccgaaaactaccatagaggttaacctgcaaagtctggtcgaagttttcgtcggtaatttcggtcaaaccaggtgcccacacctgacgtgacgcgttgttgaccaagatgtctaggccacctaaagcgttcaccgtctcttggaccagcgagcgacagtattctggatcacggagatcaccagggaaagaaaaagctttttgacctgtttcctcgattgcttggagcactctgtcagcatcggcttgttcttcgggcaagtaagcgatcgcaacatctgccccctcgcgagcataagcgattgctacggcagctccaatcccagaatcgccaccagtaataagagccttgcggcccttaagccttccacttccttgatagctggagagaccaatatcggcttggggggaaagttttatatctaggcctggttccggctggctttgctttgggggatcgactttcgggaatagcgtacgtggatcatttagcaatgaaatcatgcctttctcgacgttgtcctcgaacgaactaccgtacctctcccacgataagggatctttattaggatttcgaggattgctgtataaatttccgaaaataattaaaggggatgaaaagaaatccccacctcagaaggggcgtcgaaagattagcgaatggttatgtcttaatccgcatcgatatcgtctaactgcccctccggccacactacatttttcgccaacgggatttggtgcgatgcactttccaagatatgcatgaagtatcctgcggtgttaggaattccgatgatatctcctggtttgactcctctcgggaagcggattcgccggcgtaaaatcagctcatcttcgatgcagtaggcacccactagatatgcttcgatttcctcgcctacatcaccgtcagtgatatgcaggggatcaatgagaaaatcatcggatgtagtccggcactgcgttcggttcatagccagtcccactagaggcaacccgtcacttcgggttttcacaaaagcaacttcggcaagagtgacgccacacccatctagtaaacttcgaccaggctctaggtgtaaccgcaatccccggtcaatgagcatctgagctacccccttagaaagcacgtctttcaaccaattaccgcgcactggggtctgatagaacgggtacgtattagataacggatcgtctttccacgtaaaggattcggcatacccggctgaagtcgcagatttagcggattgataacggatccaatcttcctcagattcaatgtagctcataggcacccctcctccaaggtcaataaactgtggggaatgcccgcattctctgagagaatcgacgagttggcaacattcctgcagagccagagcacggtcttttgcagcatagccatggaggtgaacgtgaagacccacaatatccacgccgggtatcacctcggtaagccgattaccccagtctgcagcacgctcaccaaatctagttggaggtaagactgcaggatctggagctactctaggcgcaactcgtgcaacgcggtcaccaaccaaagccgaaatgcgatctaattcatcacgcgaatccacagagatgatcacgccattttcgatcgctaatgccaatagtctgtccggtttgatagctgcggatagaatgatccgctctcctgggactccacgattaagcacctgagataactctcgttcactggctacatctacaccatgaccggtgtctttaacggcatcaacgaaggtaagacccttattcgctttgcgggcaaaaaatattcgagtatccacccccatctgaatgccggcgtcaaccaactcatttatattacgaggcatagaacctgaatggagtacattcacaggactcccgaattcttcaatcaggtggcggcatgtggccggatctgaagtgagcttttccgcccagggttccaaccgtgccggaagcggtggagtaccatgtaccctatcgggatacgtgctcgcgtcgcggataactcgacgagcccacttcgggattatgtcatgtaatgatcgcgacaatgtgtcattacccaaaaccacatcttccgtcatccgtccgactgcagccaaatgtcgttgcccttgaacggtgccgtcagccgctacatctaacccccgagtcccaggacgcattctggcatatccctcttttaccaaattgtgcaccaatgtgcctggcactactcccggcgggggaagaacagcgtctatcaccacagttatttcaagttcacgaactaaatctgtcagtggttcccggccacgatgcaggtgagtgatgtctaccactccggattttacgagttcttggaggtattcaaaactttcggatggtgggccgaaggctaatctttccatttcccgggctaagtgatcaaatccgattaggctgtcacgcccttcgtaggaagcgcgttccacgatgctggggtacagctcccgccaagtggcccccattccccattcttcatcttttttcccagctcgttcctgaatttgggaggaaacctcttttagaactgtcctaagttcggaaagatccttggcggaccgaatcttttccgaaccctcatttaagaggtcctctaaatataagtcggtcacgtcgggcttcggtatcattagtttccctgtgcgggttattggaatgaatacggccggtgagcatactcgagtgatgtcgatgaaagtgagagctgccccacgcactaacactctgtctgtggacttgatcccgtctagattattagcaggataaggagatgcgatcagacgcactgacccggggaaatcttcttgcgataaggatccaggccaatcgtgtgcatgtccagtagctaaaagaatttcatcaaactcttgttcctgcactaaccaacgttcactctttttaccgcagggtttgattgtgtctacatgtttagtgtgcatcgtaagagaacacccctgaggtacatattcaagaagcgcatcccaagattcttccaggaactcccctactaatcgtcgaggtgggaaagatgaatctacattgcgttttcgtagccattgactgaagtcgctgaactgtgtattaatcgtggaagatcgtacatttatcagccattcttcaggctgatcaggttgatatgccacaccgagaccatcattaaaaacatgaagatcaatgctggctcctctctccctagcaagagctagtaattcttcagcagcccacaacccgcgcggtccgccaccaatgatagctaccttgaacaaaggttttcctccacccattcgtcgttataaatcgtatctaaatacttatttccgtcatcatgaagaattactactacattgctacccgcagggatgtcggggcgtaatatctccatagcagcgaggacggccccaccagacgctccgggcaagatggcttctgtctgagccatctttcgggctgcttctactgaagtcctatcatcaatacgaaaaaccctgtggggcgataagtgtttcgataattccgggaccatgccagcaccgaaacctggtaaatggcgtgggccagcatttccatcaaacagaactgatcccaccgcatcaactgctataacttgagtggacaacccgtgtgcagctacgtaccctaaacaacccccaatcgttcccgtggtgcttaccgccactagaagataatcaggggcaccgccaagctgttcgacgatttcagtcattgttccttgttcgtgtgcctgaaaagccgctgtgtttgaatattggtcaagacagatcgcttcagacatctgagcacgtagctgcgccacacgttttcttcgtgctaccagccaatctccagtttcgtaatctggttctgtaatctcatgcactatggttcctagtgccttcatgtgcgctattgtgttgcggttagcacgcgaatctacaacgcaatgaaaagtccagccacctaggaccgcttctcgagacaaggcaattcctagattgccagaacttgattccactacggtgtcacccgggcggagatcgctggccagtaccattgcatgagccgtacggtctttagcactcccacctgggttataggactccatcttcgcccacaaattgatactcgtgtttgcattgaatcggcccaacctaacgagaggggtttttccgatcaactcatcgatgctttgaaatgagtccctgttcatgaagcgagcctagcaatcttccagtctcctcgcccgaccgaaacacgctcctctgttctactagttttaagaaaagatggccgctggggcatctggaattttcttctaaaaattagtacccgaagtatcgactggtcgaataccgaaactgccccacgccgcgtcaggtggcagggtttcgacactataaaccagcgagctctcggacaacacacgaactttctgaggaatatcccaaaccactaccccgttgagttcgcccggcgcgcggacgttgccgataccggataactgggcgtcgacaagctttatttgacggttaaaaacatcttcacgggtctcgcctgcgatgggttcgggtagatccatggcaggagccgagagcataaccatggcattgacgcgaccgactcctttaagaaggttagaggcctcggaaggcgaaagcggctgtgtgaacgtcaccagtgaataggcttcttcgccgaccgcggcattttccaatgattccgatgcccgctgacggtactcgacggaagtttccgtgttgtcttggccgagcatgtcaccgttgagctgcatgggtttcgcggtgcggtcgctgaaactcaagatcgcaaccacgacaaccaatgcgagaattgctaggagggcgacgatgcgtcgccctttatcgacaccatccattattgctcgcggagaacgtctaaagcgtgttggagatcagttggatatggggagacgatttccatccatcggccatctgctgggtggttgaatccaagcgagacggcgtgcagccactgacggttaaggccaaggcgctcggacaacgcaggatcagagccgtacatggggtcgccacagcatgggtggtgcagcgcggagaaatgcacgcggatctggtgggtgcggccagtttccaggtggattttcagcagggttgcctcttggaaggcctccagggtttcgtagtgtgtgacggcgtgtttgccttcagttgttactgcgaaacgccaacctgctgaggggtggcggccgatcggtgcttcgatggttccggtcagcggatcagggtggccttgcaccaacgcgtggtaggtcttgtccacggtgcggtcccggaaagcgcgcttgagcacggtgtatccacgttcagaggcagcaaccaccatcacgccagacgtgccaacgtcaaggcgctgcacaatacccttgcgctctggtgggccggaggtggaaatgcggaaacctgcagctgcaagtccgcccaccacagttgggccttcccaacccacggtgggatgtgccgccacgccgacgggtttgttgactgcgatgacatcgtcatcagagtacaaaatatccaggccgggaacgatttcttccttgggcatcaacggagctgctggttcaggcagcaagacatccagcatggaatcggcaacgagccgctcgcttttacctaccacagccccatcaacgctgacatcgccggcggtggcgagttctgcagctacggtgcgtgaaattcccagcaacttggacagtgctgcgtccacacgcatgcctgccagtccttctggtacgggaagggttctgctttgtcggttgttcatcaggcctcatccttctcgtcagttgctttggcatgctgggcgttttcacggtcctcaaggaacattccgatcaggaacaccacgacgccgcaagaaatcgaggcatcggcgatattaaatactgcaaagtttcctacggagatgtaatcaacaacatgtccgaagaagaaggaaggatctctgaacaaccggtccaacacgtttcccaaggctccaccggcaacaagggcaagtcctgccgcgatccacttgtgtttgatgcgtggggcataaattgcgataccgatgacgaagctcaactggatggttgtaaagatccaggtgctgttttccccacccatcgaaaatgcggctccggggttaaacaggaggtagaagcggaaccaatccccaatgatgggaacgggaacgccaggttccaaccaactaagcataatctgcttgactatttggtctagggacgcaatcaccacaacgatggcggccatcaaggcaaccacctgtttaacggttgtcctcttttctttcttactcatgggggtcacgtttgcccctgcatcctttgaggtcacgttgaccatctttccccatgagcggtagaaacttccacccaggctcaattaagggtgaaaggtgatctttaattcagcgctggtttttacacagttgcagcaaaaattcggccattccgattgcttttgacagctaaactttgcatttgttctttttggcgccgatgccgataggtttaaaggcgtgctaaaacgattctctcaccactccagcccgcaagttctttcacggaaagttgtcgcgtccgcattagctttaacaaccgcgctggctttagccgcgtgtagttcctcagccgagccggactcccctgaagttgagcaggcggtgggtcttgcggtggatacgccacgtgtggtggttgtggatccaggcactggcgatttgcagcgcttgcaatacaaagacatcgcccctgatgccacacaggaacagaccatcaatattgctgaaggttttgcccaatcggtggtgaatgcggacagcgtggatccgcaggcaccagccggtggcgatgtcaccacattccaccttcctgttaaagccaccaccgaggaagcggagttcagcgatcaggaaatggtgagcgcgactcgcgatatctctctacttttcggtaaacctacctacaccgatctttcccaagttgaagatgtgaattccaccgagggattcacgctgggaatccgcgcaacagatagtggacagcacaccaccttaagtttcgcagcccctgttgattccactgaaactggtcgcatgctcatggagcaatacttactcacgtttacgtcccttcccattgtgttcccctctgacgatattggcgtgggcgcgaagtggactgtggatagccgtgtgacaggcgaatcaacgctgctacaaaccgtgacctacacgatcacagggatcgacggcgacaaagtaaacctcgatgtggaagtctctcagcgccccagcatgggtgcgttggagatcaccgatgaagaatcggacgagaccaccgggcagctcactgtccttaattccaacaccacctccgtgggcaccttggaagtcgatctgactcagcctttacccacgtcaggacaggtttcttggaccactcgcgtgatttacggcggttccaatgagcaggtgcgtgtggtgcaggattccacctcttcggtgagcttcggagaccagtaatttaccaattagggttgccaaaatccccaactgtggttcatacttgtctgcatggatcttcaatagtcaaaaccagcaaactaattttttaagttttacgtaactggccccaccgcttgtggcaggccttgcgttttgacattgaaggaccctttttatgcgcacttttgccgcttatattgccattgatggcctcagcttttcctaccccaacacccacgttttaagcgatatttcgctcaccgttgccaatggcgatatcgccggactgattggtgaaaacggcgcaggaaaatccaccctgctcagcctcatcgctggcgtcatggaacccgaccagggcaggatttacctccccgaacgcaccggattcatcgcccaagaaacagacttaccgtttgaacaacccgtgcagtcgcttatcgacgccgccgtcgccccagtgcgcgcggtcgatgccgcgattacagatttgtccaccaagcttggcgacgcctccctcagcgccgaagagcaggcgcaagtcgccacagatttcgatgcagcgctaggcgctgcagaagaactcggactgtgggaattagatgcacgtattgaaaccatcgtcgcgggtctcggccttgccgaggtggatcgcagcactcccattggtgagctttccggcggtcagcgccgcagattcgcattggcagcgctgctgttggaaccacacgatgctctgattttcgatgagcccaccaaccacctcgacgacacagccgtagatttcctcatctcggagatttcccgtttcaaaggtccagtgctgatcgccagccacgatcgcttcttcctcgactccgtctgtaccgagttaatcgacctcgatcctgcacttggacctgagggcggatccggcgaagaagtaaaacaagccgtgtcttttggtggtggattttctgaatacatcaaagaacgcgagacccgccgcacccgctgggctcagttgtacaccgcacaagaaaccgagcgggaaaaactcgaagaaaccaccggcaccaccgaatcggatattttccacagctcggtttccaaatcggaagctaaaatcaccgcgaaattttacgcagaccgggcagctaaaactcaaggcaaccgcgtccgctccgccaaaaaccgcctgaaggaattggaacgctatgaaatcccagcacctccaaagccactggaattccaaggcatcccagaagcctccggaaacggtcacggtgaaacactagaagtgcgggctattgctgtggaaaacaggcttcaacccttgactttccacatcgatcccggcgaccacatcctggtcgaaggccccaacggtgtcggtaaatccaccctgctgagcgttctggaaggcgtgcttgaaccaaccgaaggtgaattgatcgtccccgaagggctgaaagttgcgcgcctgaaacaggacgatcagtggacggaaaagcagttgaacacccccgtcgacgaactgttcgccgccctatcgaaaggtccggtcggactcaacctcgtggagatggggctgttgagggagacgtcgcaaagcagcccgctacgggccctatcgctcggccaacgccggcgcgtctcgctcgggctcatcctggcgagcccaccagatcttttgcttcttgacgagcccaccaaccacctctccctcgcgctgagcgaagaactcgagtcggcgatagaaaaattccccggtcgcgttattctggccagccacgataggtggatcagaaaacgttggacggggaagaaaatcagcctgagccgttaaaccctactgaacaggaacctcttcaacaggggcttcctcaacaacagcaccctcttcagctggggcctcttcaataccagcggaagaagcatcagttccaacacacattgcaggaacctgctcaggagcaacagtattggtgatcaagatacaagcccaatcctgggacagctgccaattaccatcagtgttcacaaactccacgccttcagcttcctgctcagcgcggtccggaagctggaacatgacggtggtcagaacctcagaggttgggtcatagccaggaagcacagaaccaacaacctggaactcagcacccgactccacctttgcctgagtcatggtctcaaacagctcaggagcgttctcagaaccctgaacagtcttcaccttctcctcgattggtgcctcagggtcggttgccacagccaaaattgcattcagttcctcagcagttgggtactgagtcgcagcatcagacgcagccgaagaggtggaagaagaggtgcttgactccgaagaggaatcatcactgctggagcacgcgctgagcgccaatgctgctgcaacagtaaaagtaactgcggttgccttgaaaagcttcacgatgaaaatgatcctttgctctaatctctggtcaccaaatatctatcagcattcgacagctacccattctatggaaccgacgatggatgatctcgtgcctcatccccacactaaatgcacccagtttaggttatctgcacaatttaggcgtgcgccttctgcatgcgacttaggtgtgcgacgttttcaatgactttcccaccaaagggtacacgtgattcatttgtgaccaacaaccgaaactgagccagaagactgtcaatcccctgctgtgcacataacaactgcagctagttgatacgctagagcgcatgtcgaagcagcactccacaccattaaacaatgatgaagaacacacttccgctcctcaaaaggttgcggtaatcaccacgggcggaaccatcgcctgtacttccgacgcaaatgggcatctgcttcccaccgtcagcggtgcagacctgcttgcgccaatcgcaccacggttcaatggagcgcagatcgctttcgaaatccacgaaatcaaccgccttgattcctcctccatgacgtttgaggatctcgattccatcatcgccacggttcataaggtgttggaggatccggatgttgttggcgtagtagttacccacggcaccgattccatggaagagtccgccatcgccgtagacaccttccttgatgatccccgcccagtcattttcaccggcgcccaaaaacccttcgatcatcccgaagccgacggcccaaacaaccttttcgaagcctgcctcatcgcatccgacccctccgctcgcggaattggtgcactcattgtcttcggtcacgccgtcatccctgctcgcggctgcgttaaatggcacacctctgatgagctggcgtttgcaaccaacggccctgaagaaccagagcgccccgatgcgctgcccgtagctaaattggcggatgtctctgtcgaaatcatccccgcataccctggtgccaccggcgcaatggtggaagctgccatcgctgccggtgctcaaggacttgtagtggaagcaatgggatcaggcaatgttggttcccgcatgggtgatgccctaggtaaagcacttgacgctggaattcccgtggtgatgagcactagggttcctcgtggtgaagtatccggagtgtatggcggtgcaggtggaggtgcgactttggctgcgaagggcgctgtgggatctcgctacttcagagctggtcaggcacgtattttgctcgcgattgccattgcgacgggcgcacatccggtgacgctttactaatttcgcccttggtcttgcattaggttgggcagtgaagacccctttggctcgagaaggcgatttaaagggtcggattttcacatggacctttggtgtggatggggtgcattcaggcgcttaaaagtgattctgaaagggctctattttgttaccaggatgacaggtgtgattcctgtggatgcgctaatcaagaactcgtcacggacctgtggccagaccattaaatcgaacgaatttttgcatatccccctcgaattagcgcaaattttcgatcagaattggcctctcacgccggactgaggacggatttttgcaacccacctccccttagggcccaacggggatttctgaatgtttgccgaggttctatggcaaggatccaccacaaactgccacctttcggcagcaatttgtggtgaatattagaacattctttccctttgcgtctattcatgggcaaccaccgcccaaaagcaccccgaaacccgatgaaaccctattcgtcatcccccgtttcaccattttcagcaaaccagtcagcccaatccaaactatctagagggtctgccggggtgaggtccgggtcatccatggaaaaacttttagttcgcccttttgtggtgctgcgggtttcaaaacgtactgatacaacaccgtgaccggcaccttgtacccaaccgtggccatattctgggtggtagacatcttgcgttgcgcaccacatactcaacgcgacatcttgcggcgcttcaacttgagtactttcggaactagaagaggattgcacgcctacctcataatcggtgtcgggtgctggtggtacgatgatttgttggtcaagttccgggaagaggatgtcttggcgggattcttccaaaccagaaaaacttactccgacaaggcggatggggcctacttctccggggtagcgggcaagtcggaatgctgttgcctcaagagttgcgtaatcatcggtggcataggacaaggtgtaggaacgagactcaatacgaaagtcggccatccgcagtttcacgctgacagttctggcaccgcgtccgtctttgaggagccgtcggtgtgcgccttcggctgatcgaatgatggcagcatctacttgttgcctggtgaggaggtctttttcataggtgtgctcttgggagatctgttttgcttcggcgcggggttccacagggcggtcgtcgattcctcgggcaaggttccacagtgatattccgatggttgcaccgaggctgatttctacttctttttgggttagcgctgctagatcaccaattgtttccacccccattgaggcaagcttggagcctgtcacaggacccactccccaaagtgcgcccacaggaagtggatcaagcaagtcatgttgcttgtctactggcacgacaaacacaccatctggctttgcttcgcctgaaccaattttggcgatctgcttaccggagccagcaccaaccgaggagggtaagccagtaacttctttaatttccgcgcgtaattcttccgcccactgtttcacctcttctggggtggctccaacgagagcctctggttccatgaagccttcatcgatgctgaggcgttcgacaattccggcgcgtttttccacgatttggaacacccggcgcgaggctgcggagtaaacgatatgacggggtgtcaccaccactgccccaaaacctactcgggctttggcttggtgcatgggcatcgctgagcgggcgccaaattttctggcttcataggatgctccggcgacaactcccctaccggagactccaccgaccaagacggggcggcctcttaaagtgggccgggtcagttgttcgcaggatgcgaagaaggcatccatatcgatgtgaagcacccagcgttgcatgctttttatggtagttgaccagccgaaaattaggttaatcgaacaggtcaacgattagtttgagaagactggcggtgtgggaaaccgctaggaggggcgtcgcaaagcaactgcgatgacaaccagcacaatgccgacaagctcagccaccgacaacatttggcccagcgcaagcgctcccatgagcgcggcgctgatcggcaaaatagccaggagcagcgcaaagtaggatcgcccggccatgcggagcacaatctggtcaaggccataaggaatcaccgccgacagcacgcccaaaccaagtgctaatccgatgacctcgattaacgtaagttccgttgctcccagacccggccaccaccagatcgccaacggcaaagacaacactgatgcccacgtgaatcccaccgccatgccggttctacttgaggaggcatcgcctgcaatgcggtttcccgcgatgatgtacgcagcccacagtaatgctgctgccagtgcaaacatgacgcccacgctgttggccgaccactgcgcaccgctaataattatcactccgatgccagctaaaaccaacgcagcccaatcccgcagcgtcttactgcccaacgcggccactgcaataggtcccaagaactcaatggccaccgcggtacccatcggaatgcgggcgatcgcctcatagaacgtgatgttcatggcaagcgtggaaacgccatacaccgccgcataaaacccggtctgcccaataaaatttcgcactgcaggccgatacagcacaagcaaaatcaccgcagccgctgctactcgcatccacgcaaccaacgcgggtgggaaactctcaaacagccccaccgccaacgctgctccggcataaagggacacgccgttaaccaccatcaaaatgggggcaagcaccgggtttcgcgtcttcaagccagcatcattcacatcacgacaccttacttcagccccttggctttgataatcgcagccgcagtaaaagcaaccgtcggattgtcatcatcaactagctgctcaaccaaaaacgccacaggcgcaagattaaactccgccaacgcttgcgcaatccgaccacgcgtcggggacattgtttcctcatcatccagcgtccgcgcaaatttcttgaacacatctaactgcacgggctccccaaatccggcaagcaattcggctgcctccacgtcccgaagaccggtgagaaccatggacacgagctgctcaactgcactctcatcgcctgattttcccaacgccaacgcagtttcagcacgcacgagagcatcgggatcgcgaatcattggccgtagccactctactcgatccgcaacagcactcggcgcgctcgccacaatccttacagcccgcagccgcaccgccgcatcccttgagcgcaaacctcgtgccgccaatgcaacagcttcctcaccacgctgcacaaccgcccacgacagcgccccctccgcgttcaaatgcgactcaccgagcgccgattccaccaaggtttctagcgcaactgcttctttaccagagacagagtcataggccacggcttgacgttgcgccggatcccccgatcgcaggcgacgtaaaatctgcaccgcatccaacgccgattcccaatccgaggcctgcgcatgacgcaccgctttcagcctggcaagcaactcccgttccatagaaatccgcgcagaagtctcagcaatcatctcggaaatgactgcctgaggatcaaagtctggatcctcaagcgcgtctccaacctgcttcaaactaagacccaagctgcgcaaaccttcgatatggaaaatcctgcgcacatcgccttctgagtattcccgataccccgccgtcgactgcttcggctcgaccaaacccagcttttcgtagtgccgcaacatgcgcgcactcaccccactgagcttggacacctcaccgatcagcatgcacccatattatccacgcgccgcgcttcctccagatcagccatgaaatcggagtccggatccgcaatgagcttggcggtggccaccgcgtgcgcgctcgttaaagcgcctagaagcacgcttatcgacgcctccctcccctccaattccgccatcgcccgacttaaactccgctgaatttcaggcgttcctttatccaattcttggagcaattggtgcgccaaccatgcggtctgatcatctgggaccagtcccacaaaggttcgccacgcagtttgggcggtgtcctcccggtgcaaaagccaaggccgtgcttgcaattcctgccacgactgcgcgacccttaacttggagagtgtgtggagtgcttgacttgcaccgaatggtcgatcaggtacctcagaatccaaatcagcgaccagtgaggtaaacacgtcatcaactggcatgcgggtgagcgcccacgtgatcatgtcgcgcacaaagaagtcttcttctaccccactgcggtacaaaagaatatcgatcgcagtggtgtcctcagcagttcctgcggccaacgctgcttgtaaacggatagatgcatttgaatgttcgaagttgtccatggcacttatgttcatggcacttattcaatgccttgacacagtgacaaggtcaatatctgggcatgagaaaacccgccacaccgatgtgcagcgggctttctcaacaaaacaactcttagttcttagtaaccttcgcggtcacaccagcgacaatgtcgtgggtttcgccgtcgagggcatcagtgacgatctcaaaggaggttgccaaaacttccgctgcgatgtgatcagcgtgagtggtgatccattccttcttgtcctcaggaacgctgacgacaacagaaatgcggtcagaaacctcaaagccggagttctttcgagcatcctgcaggccacggatcgcgtccgctgcccagccttctgcttcaagttcttccgtgacttccatgtccagaaccacgagtccatccacgccgtcgatctgcgcggtggaatcagggtttgctgctacgagacgctcggtgaattcaccctcgttgagctcgatgccatcggcaacaacgacgtcgccttcgcgggtgtagttgccagccttcacagccttgatcacgcgctggacgtccttgcccaagcgaggacctgcaaccttagcgttaacaacaacctcgaaggttcccacggaatccacgtcagaggtcagatccacgttcttcacgttgacctcatcgcggatgatcgaagcgaagtctgccaggcgagcagagtctggaagagcaacagtcaggcctggaagtggcagacggttacgcagcttgtgagccttacgaacagaggaagccgcagagcacacgccacggatctcatccatggtgcgaaccaaatcagcatctgctgggaaagactcagcggatgggaaatcagtcaggtgcacagaacgctcgccggtcagtccacgccagatcacttcggtggtcattggcagcagtggagctgccacgcgggtgagggtttccagcacggtgtacaaggtgttgaaagcctctgggtgtgcttcatcaccagcccagaaacggtcgcgggaacgacgcacgtaccagttggtcaacgcatcacagaagttacgaaccaagtcgcaagcctttgcaatgtcagtgccgtcgagtgccgcctgggtctctgccaccaaatcgtgcagcttcgccaggatgtagcggtccagcacgtcagtggagtcgactgaccaggttgcgttcttggaggtgtacagctgcaggaaggagtatgcgttccacattggaagctgtgcttggcgcacaccttcgcggatgcccttttcggtgacaatcaagttgccgccgcgcaggattggggaactcatgaggaaccaacgcatggcgtcggaaccgtcgcggtcgaagacctcgttgacgttcgggtagttgcccttggacttggacatcttcagtccgtcatcacccaagacgatgccgtgtgcgacaaccttcttgaaagctgggcggtcaaacagtgcggtggacagcacgtgcagcaggtagaaccaaccgcgggtctgaccgatgtactccacgatgaagtctgctggtgcgtgggtatcaaaccattctttgttctcgaatgggtagtgcacctgggcaaacggcatggaaccggagtcgaaccacacgtccaaaacatcggtgacgcgtcgcatggtggacttgccggttggatcgtctgggtttggacgagttagttcatcgatgtctggacggtgcagggactttggacgcacgccaaagtcagcctcaagctcatcgagggaaccataaacatcaacgcgtgggtattcgtcgttgtcggagacccatgctggaattggtgaaccccagtaacgggaacgggagatgttccagtcgcgggcaccttctagccacttgccgaactggccgtcgcggatgtgcgctggcatccactcgatgtcctggttgacctcaaccatgcggtcgcggatttcggtgacattcacaaaccaagatggcagagccatgtagatcagtggctcaccggaacgccaagagtgtgggtaggagtgttcgatggtctggtggcgaaccacgcgacctgcagccttcaagtccttgatgatgtccttgttggcatcgaaaacaagctgaccttggtattcaggaaccaaaccggtgaacttgccgtcgatgtccactgggatgactggctcaatgccggcagcgttacaggtgttcatatcgtcttcaccgaaagctggtgcctggtggacgataccggtgccgtcttcggtggtgacgtactctgcaccgaggatctggaatccgttcgcgtgatcgcggaaatatccaaagattggctcgtaggtcagtccgaccagttcagagcctgggtgctcagaaacgataacagcctcagcaccgagttccttggcgtaggaaccaacgaggtccttagccaaaagcacacgcttgccgacgaattctgcctcaccgtcttcagcaacctcaaccaatgcgtaggtcaccgctgggttcacagccaacgcaaggttggatggaagggtccacggggtagtcgtccacgcaagagccaacgctcccaccaggccagcgtttgcagaagaaccttcgacgacaccggtgactgggaacgtgacggtcagggttggatcctggcgcagcttgtaggagtcatccagtcgggtttcctggttggacagtggggtgtgctctgcccaggagtaaggaagaacgcggaaaccctggtagatcaggcccttgtcgtagagttccttgaacgcccagatcacggactccatgaaagaaaggtccatggtcttgtagccgttttcaaagtccacccaacgagcctggcgggtgacgtactcttcccattccttggtgtactgcaacacggaggttgcacagtactcgttgaacttggcaagacccatggcctcgatctcgcccttgtccttgatgccgagctgcttttcagcctcaagttcagctggcagaccgtgggtatcccaaccgaagacacgaggaacgcggtagccacgcatggtctggtagcgaggaacaatgtccttgacgtaaccagtcagtaggtggccgtagtgtggcagaccgtttgcaaaaggagggccatcgtaaaagacgtagtcttcagcaccatcgcgctgatcgatgctggcctggaaggtgtcatccttcttccagtagctcagtacattctcttccatctctggaaatctggatgacccaccagataaatcaacctgtgggtaaactccgccaacggcttcagacatgtgtgttcggtcccatccttcacgcaagtaacaataattatcgttctacctgcggggacgccctaaaaaacggacgcggtaccacccagcttgagctaaattaactagctccacttcgttgacacaaaaggtctttcacggtcccacccgttcggttctactaggcatttcccactaagggaaggtgccgttcttccgaaaagctccccggtgattgccggatcataacctccgccacaacgagtgaaaagattgctacaaccgttgcgcgactgtggactattatagcgcaccttagaaaatccaaaagtcgtgcagtctcagtgggctttacgcttgttccacatgtctatgccaaaacatataagtccagctaccacgacgataatcagcaacaccgtccacgtatgggagggttcgatcacggtgatgaccaacagaataaaaccgacaagagacaaaattattgcggcgaagaacaccagagtcacagttccttggagtgcgatatggacgatgttggaatgaaagccgaacaaaaagctcccggatccggatgcttacgcatatagtccggacccgggagccgggtgaaagataactaatctttctttttactcaccagatggcttgttgttggttggtgcagaggagccacgtgcgttgagttcttccagctggccctcgaggagggacttcagacgggtgcggtactcacgctcgaaggtctgcagttccgcgatgcgggtctccagagcattctgctgttccttgactgcagccatggtttcggtgtgcttgcgctctgcgtctgcctggagggcgtttgccttgtcctcggcttgacggatctgagcttctgcacgagaggtggatgcggccagggtggctgcggacttcttctcggcttcggaaaccaggttcttagccttagcgtcagcttcgttgaccagagtgtcagcgcggttctgcgcttcagcgatctgcttctcagcgtttgcgcgagcatcttccagagtgcggttggaggtgctgtttgcttcctcgatctgcttctctgctgcttcgcgagcctcgtccagcatggacttggattcggagcgagcctctgaggtcaggcggtctgccatttcctgtgcgagtcccagaaccttcgctgcctgcatgtgggtgtccacatttgcagcacctgtagcaactgctgctccggtgccagcgccgacagcgccaaccgctgctgccttagtggtgctggaggatgctgctgacttagcttcagccttggccttttcagcttcgtcgcgagctgcctttgcgtcagcttgtgcacgctgtagctgatcttgagcggacttcgcatcgttttgagccttctgagcggccttggaggcatcatcgagcttggatgcgtattcggagcgcagcttctcttcgatttccttgcgcagcgctgcctcgtcaacagacttggaagctgcagctgtggctgcacctgcagttgaggaactagcagcggaagaagtaccaccggcaacctgcgcctctagctcttcgacctgctgctttaggtcttcgttttcctcttggaactgaacgagggcgtcctcaacgagatctaggaactgatcaacctcgtcttcgttgtagccacgcttgccgataggcggcttattaaaagcgacgttatgcacatcagctggagtcaacggcatttgcggattcccttcgatttaacggtggccccaggcagggccgggactcagccacaagaatctctcatgactggaatttccatttatcatactgttcttcacgtgccattgtagccagcagttattttttatctgacatacgcgccgaaaactccaaagagaattcaaaaatcctgcacactttcaaggccacaaggaccccaaaagcttcatgccaatgacagtgaagggaacgtggccaaccctacccgtcagggttacagatttgtgatttgaattgcgtgtttacaaaactttgcacccccaatgatgcaacttaaaccacgctcacctatatcaattcgttaccgttgttatccttgtcacaattccaaagagcacgcttttcgacgcccggttgcgggtgtgcgcgaagggggtaaaagcccgaaaatcccgcatgcctaacggcatccgggatttttctccagaggtgtttttagggtcttttaagccaaaaccagaactaccgaccgcaggatcgaaaggatgaaaaagagcacaaggacggaaagatcaaggcgcacattacctagcggcagcggtggaatgacccggcgaagcagtttcaccggtggatcggtgaccatgaaaactggctcggcaatgtagtagaaccactttggtggcgtgaacgatctagaaaatgactggatcatctcgatcacgatgcgtgccacaagcacccatgtgtaaataccgatgagccaggcgatcaatattgcaatgttacccacgaggaaacagcctaactgaagtgttgagaagatgaaattaactggaaacgatcacgaagatcatcgacaccttcatgatagacgcaaaaacccgccccagaccttggaaaagagccgtagaggtctgtgacgggctgagggattaccccttaaagatttccgatcacgctgcacatgtggcgatggtgttagacactcatcgctgtagtgacccggtaaatccacaccacgagggtgtgtttagcggatgcgtgcggcgcgctcgagctcggaagtgctgatgttggacagctctggaacgacagcgaaggtgacgctgtcaatcttctgcatcttgccacgcaatgcgaagcacaggcctgcagcgaagtccacaatgcggcgtgcttcctcacgggaaagcaagctcatgtcgaaaacaactgcgtcgccgtcgcgaaatgctccaccaataacctgagcgtcttcaaaggaatgaagctctactggaacgatggtggactggtaagagcgaggtgctggcgatggagcaacaggggctggtgcctctggtgcatagccgtagtcacgctcacggtattcaggtgcgtacgcagcggtgccctcgtaacgtggttcatctgcatagtaagcatcctcgtgctccgcttcgtatggagcgagtccgaagaattctttagtcttcttgagcatggacatggcagtttcccttcacctggaatgtcttaaatttcatgtgcagctggggtgctcgtcacacccttaacttgattttctacgctagcggtcggttcccaagaatttcagttccgacacgcacgattgttgagccgtgtttaatcgcagcaactaggtctccagacatacctgccgaaaattccaaagacctgtcaaagtgttcctctaaacctgaaagtacgtctcttgcctgggaaaaagctttttcagggccccaaccaagcggtgggacgcacatgaggccctcaaaacgcagatgtgtggtgtcactgatgcaatcggcaagttgtgtgacctggctcaatggagttccacctcggctcgggtcaccatccaaactcagttgaataaaacacggaagctcgtcactggtgcggtcgcctctatccaatgcaagggctactcccctgcccaatgcttcggcgattttctcgctatcaacggagtgcactgcagctgcccacctggcgatcgagttggctttctttgattggatttggccaatcatatgaaagtccatgtcgggaagttcgagtgctttggcgcgtgcttcttgttcgcggttctctcccactgcggtgacaccaaactcttgtaagatcttgatgtcttccacggggtggaatttggtgaccggcaacagacgtacactgccctcggggcggttgtgttcgttgagggtcgcgtcgatacgcgcttgcacctgctgcagtcgtacctgcagctcttcgcggcgctccaatttatgcctcctttggcagccacaccacgccggcctggcggcctgtcgtgccttcgcggcggtaagaaaacagatcttcgtcttcgatggtgcagcgtggatcagaatcaatcatttgcacacccaggctgagcatttgacgcagcagccctgcgcggatgtccagtcctgtggtgccttttgtcgtacgcgcaatggaacctggaagtttggcttccacatcgcgcgccatggcctctgggacctcgtagttcgcacccgatgccgctgcacccatgagcgcatgaatgcggctgggtttcgcgccgagctcctccatcttcgcaatggttttagctacgatgccattgcgggctcccatgcggcctgcatgcactgccgcaatcacgccagcgtcggtgtctgacagcagcactggcacgcaatcagcaaccaaaacggccagcgctagccctcgttgcgtggtcactagcgcatcggtggcctctacagcctggccatccgctggggcttcatcaatgactgtgacggtattggaatgaatttgctccatgtacaccaccttgtctggggacaaaccgatgatgtcagccaagcgattgcggttggatgccacagcttgaggatcgtcgccgacgtgatcaccaaggttgaaggaagcatacggggactgcgaaaccccgccggcacgggtcgtgaagaccttgcggacggggcggttgcgggggtcaagactatccatagtggataagtctattctccttcttaattactggaggaagctgggtacatccaggtcgtctccgcggtcatcgcggcgatcgtcacgacgatcatcacggcggtcgtaggaacggtcatcgcggcgctcatcgcggcgctcgtcacggtgatcttcgcggcgctcatcacgacggtaatcgcgatcattgccggtggtgaagagtccaccgccggagcgggtctcctcaatgcgatgacgtgcaccagcagagcgggacaggtaaggatcgttctcctcacgtgcaccaccgaagatgctttccttctctggtggaagggttgcgttggtggttgggacctgctgctggactggctcagctgcaggtgcagctgagatgcctgcgcggcggttctcagcggcgcttgcgcgagctgcgtcaaaaccggtcgcgatgacggttacgcggacttcgtcgcccaggttgtcgtcgatgatggtaccgaagatgaggttgacatcttcatcggaacgctcacggaccatggatgcagctgcgttgacttccatgaggcccaggtcggatccaccagcaaaggacagcaggacgccagttgcgccgtccattgttgcttcgagaagtggagagttgatggcctgctcggttgcagagacaacgcggttgtccccacgtgcagagcccacacccatgagtgcggaaccagcttcggacatgacggagcgaacgtccgcgaagtccacgttgatcacaccagggatggtgatcaggttggtaataccctgaacaccattgtggagaacttcatcggctgcgcggaacgcttccatgatggacaggttcgcatcgcccagctcaagcaggcggtcgtttggaataacgatgagggtgtcgcagacctccttcagtgctgcgatgccttcttctgcctggcgagtacggcgacggccttcgaactcgaaaggcttggtcacaacaccaatggtcagtgcgcccatcttcttggcgatccctgccacgactggtgcagcaccagttccggtgccaccaccttcgccggcggtaacgaagaccatgtcggcgcccttgatggtttcttcgatttcgttcttgtgatcctctgccgaggcacgtccaacttctgggttcgcgccggcaccaagaccacgggtagcttcacgtccgatatcgagctttacgtcggcatcagagaacatgagagcctgcgagtcggtgttcaccgcgatgaactccacgcctttgaggccttcttcaatcatgcggttgacggcgttgactccgccgccgcccacgccgacgaccttaatcttggcgaggtagttgttcggtgaggtcattgtcgatgtctcgcctttcgaagagttgatactaaaaaaaattttgcttttattttcatctcagataagcagtcagcactgtgagagcttatctaaaagtgttaatccggctgacatatatcttgtgcgaaaaacacgtcaatgtgtcggacatttacagcggcgtgtcgctaccctcaacctttactttagggttgttgaggtgggcaaacgcgttgtggaaacgggtgaaccggaactacccagccactttagcggactgtcaccattgagggtgagctaatgttccaacgttggccttcccgcttcaaaacagtcgacattgccaccgctttatcgtggttgttttccgaggatccccagtagatttcccggccatcattcattttcagcaagatatcaaattgatccggagcttccactacctggatactttctgtcatctgcgcatcttgcgctttaattgcgttgattacagcaataaccgcaggaagcacttctgagtttccttcatccgcgccagaaacttctactgttcccaccgggggtgttccaatgataatttctttaccctcggtgtcaatgacatggtcaccatcagcacgcttgatgaacactgcaggctcacgctctgtcagctccacggtgatggtgcttggcagggcacggttaacggtcaccgatttcacccagggcaattccacaatgttttgccctgctgcagtcgcatcgacgcggaagaggttttcgccctcaacaatcccggagacttccagtacttgatccggatctgtgcgcgttgcaccggttacttcaatgtttcccaccttgaggatgggaacgaaccaggcaacaacgcccaggattgccacgaggacaacaaccacacccacaacaatggcgatgacttttttgttcacgctagtcctgccttgttcacttacgtcctaattgttttgcagctgatccaggatttctggagcaagcatggtcacggaacctgcacccatggtgagcacgatgtcattaggtcctgcgatttctgcaatgcgttctgggactgcagagaaattaggttcgtacaccactggaatggtcatcgcatcggtgatgatttccgaggacacgccatccaccggttgttcgcgcgctccgtaaatctcaagcaccacggcagcgtctgccagtgacagtgcccccgcgaactccttttggaattctatggtgcgtgagtataaatgtggttggaacgcgacgatgacacggccctttccagcggccttcacccgggtgcgcgcagcgctgagcactgcagttacttccgttgggtggtgtgcgtaatcatcataaatagcagcgccattaaatttgccgccctcgatagcaccgtggaactcaaagcggcgtcgcacgccggagaaatccgacaagccttcaacaagcttgtcgacgtccccacccaccaggtatccggccagcagggcggctgcaccgttgagtaccatgtgatcaccagggatttgaagaatcacagatacttcctgtccatcgatgttgatggtggcgcgggtgccttctgcgacaacttgggaatccacgatggtagccatcgctggaacctcagggtgtgcctgtacggcgtcagcggtaccgtaaccaacagtcttgatacccttgcggacagacctctcccccagctccgctgcgtgaggatcgttcaggcacacaaccagcttgccgttcggggtgatgcgtcctgcgaaatcgtcgaacacttggaagtaggcttcaggggttttaaagaagtccaggtggtctggttccacattggtgaccactgcaacatttggcttgtagcgcagcagcgatgcgtcagattcatctgcttcagcgataaagacctcaccagttccatggtgcgcattggtgccagccttgttgagctgtccgccgatagcaaagcttggatccatgcccgctgcctgcatagctaccacagacatagaggtggtggaggtcttaccgtgggtacccgcgatcaagacctgggtggagccttccagcaattcgcccaacagatcggagcgacgaataaccggaatgccttcttcacgtgcacgaacaagttccgggttgtcttgcggaatggcggcaaaagaggtcaccacgacggtgggaagttcgccggaaagctcaaggttttccgcagcgtgtcccactgcgatggtggctcccacggcgcggagtggaagcaaggtgcgggaatctttggcatcggaaccagtgactgtcttaccgcgggcaagcaggattcgggcaacgccagacattccggctccgccaataccgatgaggtggacgcgggacagatcaatatcttgtgcagaatccaagtgtggagtggtcacctttaaactattcctttgcgttgagctggtcgttttagttgtgttggctattgatagttgcagcaatcatgtctgcaatcaccgtggaggcgttacctgcggtggaggttttagctgcgtccgacatcgattggtgtgtggagggatgaaggagaatgtcaagggtggcgtcgataagcgtctgggcggtgaagtccgcgtcgtcgatctggcgtgcggcaccagctttaatgacagcctgggcgttgagagcctgctcaccgttgccgtgaggcagcgggacataaatcgcggggacgccggcggcggtgacctctgcaaccgtcatcgcgccggagcggcacacgataagatcagcaacggtgtaggcagcctgcatatcgtcgataaacggaacgggatggtagccgggtttcgctgcaggcaactcgtttttcttacccacggcgtggagcacctggaaacctgcctccaccagctgatctacagcttgctcgacggccttgttgatactcacagagccctgcgaaccaccggtgacaaaaatggtttggcggtccttgtccaaaccccaagtgtccctggctcggtcagctgcggactcatcccgcgcgccacttaaaacagcacgaatcggaatgcccaccacgtcgccgtccatgccggaaccagcaacagcattaaggccaacgccaccgagcttgacgcccaatttgttggccatgcctgcacgggcgttggcttcgtggacaaaaaatggcaagcccaaagacttcgccgccatataagccggagcagatacataaccgccaaagccgatgaccgcttgagcgtctgtgtccttcagtgccttgcgtgcttggcctaatgccttagctacccggaatgggagcttcaacaaatccatattgggcttgcgtgggactggaaccggctcgatgagatgaagctcaaacccacgatcaggcaccagggttgtttccaaaccacgagcagtacctaaagccgaaactgttgcaccgtgcttatcgcgcagcgcttcagccactgccaacgcaggctcaatatgtcctgcggtaccgccaccagcaacgacaacccgcatgggttttggggagttagccatctttattcgtagttctcctgatttcacatttatctgcggttgcggttgtcacgccaatcatcgcgcgactcggaacggcgctcggtaggcctgctttgacgacttcgatcaacgctgcgatcggctgcgcgcccaccagtagttgattggctacgcgccgtaccttcgttgcttcgaccgttgtcctgaccactgcttcgacctttgacgctaccagtcgagcgtcgcggagcttccgattgtactccagctcgcccacttcgtggcgcctgcgctcggcgtgcggtcacaggctcgccgaagcggtcccgagactctttctgaggactcggcttttgtttagcggccttggttttgttggaacgcaaggatgcattactggtggtcaaagtacttgaaggctcacgcaatcccagaagtcgatcgattgcggggcgtccataggaagccatcgcagaaactgtctctggttcgtggcgtgcacagctaatgagcaagcccatggaagccaaggtaatgatcgcggaggtaccaccggcggaaatcatgggcagctgaataccggtaactggcagcagaccaaccacgtagccaatgttgatgaacgcctgcgacaccacggatgccgtcaaggttgcagccatcaagcccaagaatggatcgtggctcttcttggctgtgcgcagaccgaagtacagcagccccgcgaaaagtgcgatgaccagagcgccaccccacagccccagctcctcaccaatgatggcaaagatgaagtcatttttagcttcgggcaggtagaaccacttcgcccttgattggcccaaaccaactcccaagccggaaccatctgcaagagagaggaagccctgataggactggaaggcaatgcctcgcacatcgtggaaattgccaaacagcgcatcgaaatacacctcgaatcggcttgaacggaagcctccgcccaatgccaggactgcgagggctgcgataatcagtacgccggcaatcgcgatccaacccatggcgatgcccgcaaaaaacagcatgaacaatacaaccagcacgaaagacatcgccatgccggcgtcgccttccatgaagatcaaaaacgccatgaatgcaccgacgccaccaaaacgcatcaagtgattattgaaccagtgctgcacagggcccttgcctgcgaggtagtgcgctccccacacggcaatggccactttggcgatctccgaaggctgaaactgaataggtccaagagcaatccacgactgcgacccgacctcttctttacctgtaccaatgccaggaatctgcacggcaagcagcaagacaatagacacaatcaatatcaggttggataggtttctaatggtttgcgggcgcgtcatcaacgccacccacatggcaaagaaacccaacacgatcatgatgccctggcgcacggcagtaccccacacggagccaccttccctcaacgaccatgtcattgaggaggaatacaccatgactacaccgaggcacgacaaaatgaccacgatgcacaagatcatgatgtagtcagttaaagggcgcgcgagaagatcattccatgcaccggaaatacgctccctaattcccagccccgttctggttttagcgccagtgttcggacgtgcgggtttttttgaggctccggtggtcatgatcagcctttctcttccgttaatcctttgattgtgccaatgatgttgtgtgcaaagaggtcgccacgctggcccatgcctttgaacatgtccaaagacgcagcggcaggggcaagcaacacggtatcgccgggttcgctgatgctaaatgcctcagtgacgatttcttccattgcctcaaatggctccgtcttgtcagtgacaaatacagaggcctgcgacgcgtgttccttcaacgctgccacgatttcagcacgatctgcgcccaacaccaatgctgccttgatgcgctgttcgtgctttttcaccagtggcgcaatgtccgcgcctttgagctgtccgccgacaacccaaatgactgaatcatgcccagctagcgcagaatcagcagcgtgggggttggtcgccttggagttgtcaatgaaatgaacaccgtcatgctcggcgacgacctggccacggtggcctgccacctcaaaagaatccaacgcacgcgcgatcgcctcaggtgccacgccctgcgagcgcgccaccgcagctgcagccaaagcgtccaaaacaccggcagggccggcgggattaatgccgtcagcggatgcaagcaccacattattgccgtaggcattatcgacgagctcccccgctttcacacccaactggccggttgcaggctcattgacggtaaatccaatgagaccactcaagtctgcttcagaagtcagctgcaccaaataaggatcgtctgccccaatgatggcgaccttgcccttgagcacttccatcttggccaacgcataatcacgcatggaaccgtgccaatcgatgtgatcctcagccaagttgagcaccacgccagcatcaggggtgaaggttggagaccagtgcaattggaaactagacagctctgcaactaacacatcaatgcggtttttcgctaccaaagcctcagacaccgggatgccgatattgcccactgccttggcagtaaaaccgccctcattcatcatcgcggcgagcattgatgtggtggtggttttaccgttggtgccggtgactgcgagccacgtatgtggctcgccgaaaacacctgcctggtccaggcgccaagcaagctcgacgtcaccgataacctcaaggccctggcggtgggcgtcgacaagcaaagtgcttgttgggcgccagcccggggaggtgaccacaatggagaaagaatccagctgttcctgagcctgcgcggtgctgatatctgcaacgtctactacttcaatgagcatgtgacgtgcagtttcgttatcgtcggcgaccacaacatcgcaatgcaactcactgagcatctttgcaatggacaggccggaaacaccagcgccggccacaagaatacggccctgcagcgcctgaggtaaatgggacagagaaaccataattatttatacctccgctaagtggagccagtcgctgtaaaacacaccgacacccgccaacacagccatgatcgcgatcagccagaaacggatggtcacggtagtttcagcccacccaagggcctcgaagtggtggtggatcggagccattttgaacacacgcttaccgcgggtcttaaacacgccgatctggatcgcaacagaagcgatctcaatgacaaacagcgcgccgatgataaccatgagcagctcggtgcgactaaccacagaaatacctgcaaccaaaccgcccagtgccaaagaaccagtatcgcccatgaagatctttgccggcgccgcattccaccacagaaagcccaaggtggcgcccagaccagcagcacacaacacggacaaatccagtggatcacgcaccgtatagcaacccgcttccactgcagtatcgcaggagtttcggaactgccagaacgtgatcaaggtgtaagcacccatgacaaatgctgtggtacctgcggccaaaccatccaaaccgtcagtgatgttcacggcattcgaccacgcgctgaccacaacgtagataaagatgaggaacacgatgatgccaaaaacgctgcccccgaagccaaggtcaatggtgtcgatatcgcgaatgaatgacaggtgggttgatgctggggtcagaccgttttcatcgggaaactgcagtaccaaaaaaccaaagatcaacgcaatggccagctgagacaccagcttagcggtcttgttcaaaccaaggtttcggttcatgtacagcttgatgaagtcatcggcgaaaccagtggcaccaaggcccaaggtcagacccaacacgagcaagccggagactgtgaatccaccaacgccttggatcatggccaagatattggtaaacacataggccacaacaatgcccgcgataatcgcaatgccacccatggttggagtgccacgcttacgcaagtgagactgcaggccttcttcacggatttcctggcccaactggcggttagtgaaataacggatcaacaccggggtgagaaagattgagacgaggaacgcaaccgttccactgaccataatctgttgcattgttttctactgtccttccacgttccgacgagaatcgtcgttgaccgagccacctgtgtttttgaggcccggcaccatgccatgtagtgcttctgcgaccctccacaggcgatcagcatttgaagccttaaccagcactacatcatcccgcttaatatggcctgcgagcaactcgagcgctgcatcaacgtctgaaactacgtgagtactcacacccaggctcgctgcggactctgcaagtgctgcacagttagggttctcccccactgcgacaagttcttgaacattgtatttagccagctcagcaccaagttcggcatgggcttccgaggcgtcatcgccaagctcacccatttggccaagcactgcccagcttgttgcttcagaacgaccactagctgtgtacgcaagagccgcgatacctgcacgcatagaatcaggattcgcgttgtaagaatcgttgatgatggtcacgccgtcggcacgggtctttacatccatgcggtgcgcggaagcagctgaatgtgcttccaatccagcaaccaccaattctggggcgacgccagcttccatggcaatggcagcagcagcaagtgcattagcaacctggtgctcaccaaaaacctgcagggtgaccggccaagagccgtccttcgtgttcagcgtaaagcttgcccgcgcaacagcgtccagtgaaatactcgttgcccaataatcagacttttttgcttggcctgcatcggtggtaaaccacaccacgcgcgccttagtgcgtggagccatccgggcgacaaaaggatcgtcagcgttaaggactgctaccccacccgttttcttcgagggcagcgcttcaatgatctcgccttttgcctgcgcgatattctcgcgggatccaaattcacccaggtgcgcatggccgacgttgagcacagctgcaatccgtggcggagcaatctctgtcaggtgcttaatatgtccaatgccacgcgcggacatctcagccaccaaatacttagtatcggttgtgcagcggagcgcggtgtgtggcaaaccaagctcattgttaaacgagcccggaggagccacagttggcccatcttggtcaagaaccgtcgcgatgaaatccttcgtagaagtctttcccgcagaaccagtaatagccacaacgttcaattgatggccagccacgcagatatccaccacgtggcgagccaaccgagacaacgcctccactaccgccgcgccatgcccatctggatcatgagcataaatgtcagcattggattcctggatttttactggaggcacgacgatcgcaggtacgtcaacctcacgggctgccaatactgcaaccgcacctttctcaattgcagttgcagcaaaatcatggccgtctacacgagcacccggaagtgctaaaaacaagccacccggtgtgagggatcgagaatcaaactccacgctggagctcacaagcgtatcttcttgagcaccgccagtaagcctgcctccaacgatgtcagcgatttccccaagggtcattgtgatcatgactgtggcctatccttcttccgtagtaaggggaagtttattgttgagcttttctgtcaaagcagcgcgaacttcttcgcggtcatcaaaatggtgggtgacaccagcaactagttgtccaacttcatggccttttccagctactacaatgccatctccaggctgtgcccactcgaccaaaacgcgaattgcttctgcacggtcaccaatttctaggacttccaccggtcgttcggactctgaagcaccctgctgtgctcctgcagtgactgctgcgcgaatcgtggcaggcacctctgaacgagggttgtcatcagtgacaataactagatcagcacgctgtgcggacaactgccccatggggccacgcttggtggaatcgcggtctccaccagcaccgataaccactccgaggcgcccgtcaatctgggtcctcaacgtatccaacacagcagccactgcagcaggcttgtgggcataatccaccactgcaaggaagtcttgtccctcatcaatgcgttccatacggcctggaaccgcgaccttggacatgcctcgagcaaacgcttcgccatcaacacccacgcgtgccgcagcggcaaatgccaacgtggcgttagcaacgttgaacgcacctggaagagctagctcgacctggtaggactggtttgagggggcgttgatcttaaaactctgggcgccagagtcgctgacattgatgtctgtagcgctgaagtctgcttcttgcccaagggtggatactgtttgcacatccgctgccacgctggccatgcgctgaccccaagaatcatccacgcacacgacctgtttgtcagccacaagtggagaatctgcgcggaagaacaatgccttcgcgtcaaagtaatcatccatggtggggtggaaatcaaggtgatcctgcgacaggttggtaaacgcagctacatcaaagtgggaacccgcaactctgcccaatgacaatgcatggctggatacttccatcaccacgtgggtgacaccgtgatcgcgcattcgagcaaacaatgcctgcagagtcggcgcttctggagtggtgagctttgtgggtacttcttccccgtcaatacgtgtacctgtggtgccgatcaaaccaactttgtggcctgcctccatgagtcctttttccaagaggtagctggtggtggttttacctgaggttccagtgactccaatgagcgtgaaatcttttgaaggatcgccataaatgcttgatgatgctgcgccaagtactgcgcggacatcatcaacaacgatgactgggcgggtctctcctgcttcgttgagcacctcaagtccagctgcgtcagtcaaaatggccacagctttcgcagcgttatccgtacctgcaaactgtgcgccgtgagtgcgggttcctggaactgcagcaaaaatagcgtccgaggtaggtaagctggaggagtcaagaccaatagccgcgattgcttgttcccctactgcgtgagcgggaacgccctgggcagagcccttgaggatgccatcgataagtttggtgaggtccagcaacgtggttgccatggttttctctcctccacaggtttctaggtgttaataattcggacgcggcacgtgggtgatgccgaaaagagttcaaacaaaagttcagattatgaaattctacaaaagacacttctgtttgagttattgagcttgaaggatgatcggttcggtggctgcagacagtgggatgttgtcgcggttgagcaaccaggtggcgatgtctttgaacaaaggtgctgcggtttggccgccaccaccgtggactccgcgttctggctcatcaagcatgatggctacaacaaatcgaggatcatcagcgggtgcaatacccgcgaaggtaatccagtattgcgagttagagtacgcgcccgtgttggggtcaactttctgcgccgtacctgtcttacctgagatttgataaccctcaatggaggcgtctggagcggtaccttgttgcactccagttggatcaacctgggtgacagacctaaacatatccaccgtggtgcgggcagcttcagcgctgacaacctggattttatcgggttctggctgctctaggactgttccgtcagaatcagtcacgctcttgatgatccgcggttgaatgcgttcaccatcgttggccaaggcttggtagattccagccatttgcaacgtggtgatcgacataccctgaccgatgggcaggttagcaaaagtaccgccagaccactgctcacgtgcgggcagcaggccttgggattcgctcggaagctcaatacccgttggctgtcccacaccgaatcgttccaggtaatcagcaaatttatcttcaccaagacgctgcgcaagcatcagagtgcctacattcgaggacttaccaaaaattcctgcagtggtgtagggaacgacaccgtggtcccacgcatcaccgacagaaacaccggccatttcaatactgcccggtacctgcaacacttcatctggagtagtcaagccctcttgaattacgcctgctgcagtaatcaccttggctacagaaccaggctcgaaggggtgggtgacagaaggattgtcaaagctcttgccctgctcaatctgctttcccgtgtcttcgttggggttgatggtatcggtgtttgccatcgccaaaacctcagcggtcttggcatcaagaaccacagcggaggcgttttctgcaccggagttagctttcgcctgctccaatgcctgctgcacataggtttgcagatccagatcaacggtgagttcaacgctggcaccatcaatggctggaatttgatccctcaacgtgcccgggattgcttgtcccaaaatggacatgtcctgggttgagcgaccgttgtttcctgccaacagggaatcgttggaagcctcaaagccgaactggccttcgccgtccatgctgattcgaccgatgatgttttcaccaatcgcgccgtttgggtattggcggatgtcttgatgatcagctgcgacgctgggcatctcatcggtgatttctgacgctacatcgggatcaacattgcggacgagcacctcatactggctatcagcattgagcttgtccaggatctcctcagaggaaattccagtgacatcttggtcatgggatttgatgatctcagggatccgatccgcaatgctttgaatgcgctcttctaccttgtcggacagaatggtttcgcgctgttcttcagacgcaaaaacatacgcgttgccttcttcgatggtcacatagctggccacgttttccggatcggtttcttcagccgccaaacgcaaggccaaatcagttccggtctttaattcctcacgcatgatgttcggagaaaccgtcagcgaacgtgcctgcatcgtgtacgccatctggtttccttcgcggtccacgatgcttccacgacgtgcaggatctacgtacacgcgggtgcgctgttccgaagcattgagggacagttctggtccccagacaacttggacccagccgaggcgaatgatcagtacgccagcgatgaccaatgcgatagcggtaaccatgttcacacgtcgcttgcgtgcgccgccctgggttgaagatttaggccggtaggtcactccttcttcttggtttacgcctttagctttaccgctgcgtcgcgtaagttcgcgctctctagcggctcttctgctttcgtcctgatacgccgaacggcgggacgtatcttcacgtcccgcacgctcgccccgacttctgccattgctggggaaagtcactgccctgcgccacctgcttgtccggtggttgcagcataaggaacagtgttggtctgatacggcggagctgctgcttcttgtggaatcgcctggaggttttcagtcactgcgttagtctcgtcagggttgcttgatgcccgatttggtcgggtctgttgtccattgatgtcaactatagggcgtgtctctggatttgcttcgcgctcctccacaacatcaccgttttcctgcactgcgagcacgccaggttccactggggataccaagcccatctccgtagcattcgctgccaaggttgctgctgagcgagcatcttccacatctcggttgagcgactcaatgcgattgctcaaatccgtttcagttgcctgaagttcctgcaactggaaagtctgctgtgtagacgttccggacagacccatggtcgcgccaacaccaacgcacagcaggataaccaccagcacagacagctggatcaccttaggatcagcacgttttgcctcaacgcggcgaccacgcaccgacataacctgctgagagcccagcttgtgctgcatcaaacgcttacgcgttggttgcacgccagggttcactagggcccgggttgtgtggcgcctttccggcgccatgtcacgacgaggttgcgtgcttatcgacgcgcccctccccgaagcttccgctgtggagaaatccctactcaccgagacgcgacggccataccgtggatcagcgtcagcgacacgtcgatcgcgaatctttcccgactctgtgcgggagccatttgtcatggtcatgagaggtctcctgagttgttgccgattctttcgattgcgcgcaccttcacaggtgcggcacgtgggttttcttcaatttcagcttccgaagccgtttcagcaccgcgagtaacctgcttaaactgtggtgcagttccaggaagatcaacaggcaagcccggaggggtcttagaggtggtcagatccgtgaagaacttcttcaccagcttgtcctcatgagactggtagctcataaacactgcacgtcccccaacattgagggcgtcagtgatttgaggaagcacattcttcagggaatcaagctcgttgttcacctcaacgcgcaacgcctggaaagtacgtttcgcggggtgtccaccggttcggcgggtcgctgcagggatggcgtcgtacagaagctccaccaaacgagcagaggtagtgaacggctctttttcacgttctttcagcaccgcagaagcaatcttgccggcgaagcgttcatcgccgtaagtcttcaagattcgagcgatgtcaccatgcgaataagtgttgaggatatctgcagccgtaataccctgagttgcatccatgcgcatgtccagaggcgcgtccgtgcggtaggcaaagccacgctccacctgatcaagctgcatcgaggagacacccagatcaaacagagcgccagcgataccgtgctcgcgagctaaatcaatgatgtcgccctcgacagattccaacacctcgcggagtccgtcgaaacgcgtctggacgccaatgaaccgctccccgaaaggagcaagtcgcgcgcgagcatcccgcaacgcattttggtcacgatcaaggccaatcaggcgcgctttggggaacgtgttcaggaagaactccgcatgcccgcctgcgccaagggttgcgtcaacaatgacagcgttttctcccaatgcttccacgtgttcggcgatcaaagccgccatacgatcacgcattacgggaacgtgtccgtggttgccatccaaggaaaaatcttccatgtgcgtgttccccccttttcctgccggcctagatgtccaatgtcttgtacttatgtttgtggataaaaaaactgcgcgacaatgtcatagccacatatcacgcagtccgttttccacaaatcacggagtgcgtacagggccccactcgaaaagtctcgatctgatgtcggggaagtacaccagagccactcctcgagcagagtccatacacgcgctccctgccatttcgaagcattgcccaactatcagagcaatcctccaaggacgtcatcttcagctgctgagaaggcagcctccgtctcttcctgatacgcggcccaggcttgagcgtcccaaatctccagaaaatccaccgaaccgataacgacacactcttttgtcagccccgcatatgtgcggtgcgctgccgaaagggtgatgcgcccctggccgtcgggtcgttgttcatccgcgcttgctgcaaggtttcggataaacgcacgagcctcagggtttgtcctagaaactgcagctgccttgcgagcccttgctgcaaattcttccttcggataaaccgcgagactgtggtcttgacctttagtgaccatcaatccccccgcaaggtcctcacggaactttgctggaagagtcagcctgcctttgtcatcgagtttcggggtataggtaccaaggaacatccttgaagtccccttcccagcaactcagtggcataaacagaaccaaccattcagtttgtctctgagggtgcgtagtggcctctcatgcaagaccaccgcgcaccgctgcagcccacaataccccactttcccccacctgaatcaagtgttaggttcactttcccccactttcccaatatccatgcaggtcacccacacaaaaacaaagtggggcaaatttcgtgtcgcccccttattttttcacgccccccatgtcatacccactcaaatcgcggttttgagcaacttcaccaactttctcttgttacccaaaaccatcgatcttgcaggggaaatggcaggtaaaatctgaagaactcttaaggttcccaacgaactctcaggattccacatcggccagaatcggcggctcttcaagtgggggaaggtggggagtctcggtgggagaaagtggggagtgtgaattgaaggctttcagctccgagggaacccagtcgccacctctactagcccggtcccccaatagctaattcctagcccgccgcggaagaagaattcccacccatccccgtacccacttcatacatgcccaattcatgccaaaaaataacggcgaggggcgacagcttagatagctgttgcccctcgcacgtttactcctgggcgctaccaggagtgagaagacttattcagttacttcttacttattgccctcgaatcgtcgacggaagttttcttccattttgtccccaatggtggaattgccctgttggcgattcttcgcattggaagtgcgggatgtgacggagattttgttggagccgccccccgcgcagcatccacactcccgatccgaacatgactaagaatccgataattccgagcgcaacgaaccacaatgtttgctggcttaatgcgacgccggcaacaagaaggacaagtccgagtacgaaaagtgcgattccccgaagggtaaacccaccgcctgctaggccattgttacttgcaaccgcttttccaaatttcggatcatctgccatgagcgcttgctcaatttcgcgcagtgcgcgttgctcctgctctgaaagcgacacgatgtcctcccggtggttagtagagacattttttcttctatgccttattaacgcccagaatatccagaatgttccccgttatgccaataacgacaaaaacgagggggataccccggccgatcatggtggatctttttgacacacactcccctctaggcgcccgtcagttgagacgaatttgttaaaacagcaggttaaacagcactttttcacgattgttacgaatccaaaacagtctggttaactacccccgttctgccgcaaacgaaggtttataagacaaagatcacatgtcggcgcgggcgttaaaaaataggattacgcagcacctatgcagcatccacgcttggactaaagccgtgttgcgcctcctccaggaacagggcaactcgagccataaagcgatctaagtccgccgcagaaagggtgatatccagcccactgcttgctcttgatctaatggtggagaattgggaaagttcagccgcccactccgctgcctcatctcccaccaattggagctgatcccaagcactcttaggcttccgctttctggcagctacgtcgcttcccgccaccaccgcaccggccgttcggagagcggattgataggacatctctagagccagcagaagatcaccttcgccgcggtaggtatgtgcctgctctaaaaggatgtgcgccttggagaaaaactgggccctttttcctcccactctctcaaacctcgttgttgctgaaattacgtcacccattgtcttcctctcctttcaatccgctctagctttgaaggcctagaaaccttcgtttcttttgttagccctcactatatggacaggggtggacatcaaaatcgattattcgaacacatatttgaataatggattttggggtgtaaactacttcagttcggccgattcctgcatagatttctgcggaacacccaactcacatcaccacttctggtttgatggggagcgtgtcaccgatcattcgtaaattgagtatccccgagttcaccaccaacaccccagtgttggtggatatctacatcgcagcgatgaactatgacaaagcaatcagggatacccggatcgaagtctggcggagaaactcccagaaccccggattcacagcagtggcagcgctgatggatgatcaggtcgtgggcgtggcctatggcttcaatggcagcccagatcattggtggcaacaccaattacgccggggactccgacaacaaggaggcccgacggaagaggaaatccatatcatccacaactactttgaggttgcggaagttcatgttcagcctggcttccaaggtcacggcattggccgaaagctgatgcatgaactgttaaaagacaaacaaaacacttttgccattttgtctacacccgaggtcgacgatgaggcgaaccatgcgtttagcctgtatcgctctctcggcttcactgacttgctcaggcagtttaggtttgacggggatcaacggccgtttgccgtattgatcaccgccctcccccttcatgattcctaagagggcttaacgcaccgcgtcttggccgtgctctgctccccaagcaggcgccatgccaaggttgtacaacacttcttgggttgcacgggtgaagttaagcgtcatgaagtgcagatcttccgcaccttcggcaatgagtcgctctgccatattggtggaatattcaatgcccaccttgcggatctcgtctttgttcgcttcttcattgccgtttgcagctcgaacaagtgattcttctagttggctcggcaattgagcaccagagagttcgacctgtcgacgcacagaccgcaggctcgtaatgggcatgatgccaggaatgattggcttcgcaccatgaatggggtctgcagcgacaaggcgatcacgaagtcgcaggtagtcttccacatcaaagaacatctgcgtgatggagtactctgcccctccacgcagcttcgccagagtgtatttggtgtcttcttctagagttttcgcccggaaatgcccttcggggaaggaggcgataccgaggtcgaattcccggaactcaggagtggacttaataagatcgatgagctcagaggcatagttcagtcctccatcggtgctcacccaatcgcctaatgggtctccaggcggatctcctcgaagcgccaacaggtttgttaatcccagctctaggtattcccgaagaattgccttcatctcttcgcgagtgtggttaaccagggtcaggtgcaccagagtggtcaacggttgtttcgctaatcgtcgagcaatacgtgaggttctctcacgggttgatccgccagcaccataagtcacggagacaaacgatgcaccgaggtcatggaagacctctgctgcgcggtaaagacgctcttcagctgcatcgtcgcggggtggcataaactcgacagaaaaaggtactcggccgggtgaaggacgcttcaaaacgtcgctaattgcccattgagatgaggctgggatgttcgttagggacatgcctgggtatcttagtgtgatgagagtgttttgttgggactgcctctggcatttattcacctccaccaaaattcagcccgcatccccctattcgattgaaggacgtctccttgagcagtttcgatgcccatgaccttgacctcgacaaatttccggaggtcgtgcgagatcgtttgacgcagttcctcgatgctcaagagctaacaattgctgatatcggcgctcctgtcacagatgctgtggcccatcttcgcagtttcgtgctcaatggaggaaagcgaatccgtcctctttatgcgtgggctggtttcctggcggcgcaaggccataagaattcttctgaaaaacttgagtccgtccttgacgccgcagcgagtctcgaattcatccaggcttgtgccttgattcatgacgatattatcgattcttctgatacccggcgcggagcccccacagttcaccgggctgtggaagctgatcaccgcgccaataatttcgaaggcgatcccgagcactttggcgtttcagtctcgattttggctggcgatatggcattggtgtgggcagaagacatgctgcaggattccggtttgagtgcagaggcattggcccgcacgagggatgcttggcgtggcatgcgtactgaggttattggcggccagctgcttgatatttatctagagtcgcacgccaacgagtcggtggagcttgcggattctgtcaaccgcttcaaaacggccgcttacacgattgcgcgcccattgcacctgggcgcctccattgctggcggttcgccgcagcttatcgacgcgctcctccactacggccacgacatcggcattgcattccagttgagggatgatctgcttggtgtgtttggggatcccgctatcaccggcaaaccagctggagacgatatccgtgaaggcaagcgcactgttcttcttgcgctcgctctacaacgcgctgataagcaatctcctgaagctgcaacggccattcgcgcaggtgttggaaaggtgacttcaccagaagatattgctgtcattacagagcatattcgagctactggtgctgaagaagaagttgagcagcgaatttcccagctgactgaatccggtttggctcacctcgatgatgtagacatccccgatgaggtgcgcgcacagttgcgggcactggctatccgctcaaccgaacgtcggatgtagtagacgcgtatgacactttttcaacgtttaaccaaccctgtagtgctcggcggcctagcaggtgttttgcttctgctcggctctttcggtggcggtgccattcggtaccgtggcggagtgctcgatgcgttggggcttaacttccttgcttttggccacgcgcagggtatttccaataccgtgttgtgggttgggcagctgctgctgattggcgcgtgggttcaccttggacgtcggttgttcaagaaaaaagtcgctgatgacaccgcagacgctgctgacttaggtcttgtaaagcgcacgttgtatgccatggtggtgcccctcatttttgcggcaccaatgatgtcgcgtgatgtttattcctatctcatgcagggcgcgatgctgcgtgatggcttcgatccctacactgagggcgctgcggtaaaccctggccccatgttgcttgaggtctctcatgattggcgcaacaccacgacgccgtatggtccactacacctgtggattggagacatgatcaccacggttgtgggcgataatgtcaccttgggcgtcgtcgcttacaagatcttgtcgatcattggccttgctgtgacaggctggagcattgtccgcattgcacaacattttggagccaacccagcaattgcattgtggattggtgtggccaatcctgtgatgatcatccacatgatcggcggcatgcacaatgaatccctcatggtgggattggtcagcgtcggcttgttgctagcactgaagaagcgtttcgtggcaggtgtggcactcattgcagtggctgtgtcgctgaaagctacagcggcgattgcacttccttttgtggtgtggatcggcatgcatcatttcgcaggattcttagccaccaaaaagggcaaagactcccctacccttaagcaacaggtccccgcgttctttgccactggagctgcaggtgttgctgtcactggtgttgttgtcagtgcgatcacttgggcgtctggcgcttcgtggggctggatcagtgagatcagtggcaacagcaaggtaatcaacccgctggctttcccttctttggtggccagtgtgatcaccatggtggctgaagtgttcgttgacgatttcgactacaacgcagtggttaatgttgtgcgctcaatctccatgctgatcatgcttggcgggttggtcgtatgttggtggctgttccgccagaacgaacgcagggcggtcactggtacagcagcggcttatgccgtggcttttgtgttcaattctgtgaccttgccgtggtactacgccagcttgatctctttgctcggcacatttaaaccaccgatgtggttgattcgcttcgcagcgggtgcttcggtgtttatcgcgctgatgtttaccggaagtggaaaccaccagctgtacaacatcgttacggtgatcatcgcagcaattatcgcgtggcttgccaccgtggtgatctttgatgacactgaccctgcaacaacggccacggagaaaccctccccgcataccgtttcctagttgcataaggtaaaccgccaccccactaacaaaatgggatggcggttttttagatcttttagaaagcgcttagaacgccattgcttgagcgcgtcgcataacttcacgagccaactggccatgaagtgcatcgatggggcgaccaggaagggtctcgtcttcggtaaacaggaacgcgaggatttcctcgtcgctgaagccaccgtcggcaagcaaggcaataactccagggatgaaacggttggtgttttccttcttggtgctcaggaaagcttctggaatgtagcgaataccgtcgcgccggaccacgatcaatttgtgttcattgaccagatccatcaccttggtgacaacaacgccgaggcgctcggctgtctccggaagggtcagcaatggttcattgtcgggcagggcgaaggaagattcattgttggaactcacagtcttaatttagctggttcgagctctaatggagaatctttagggtatttctgcgcgtgccgggaatgaaagcaccttcttgacctttgaaaacaggatgtcactaccactttttgtgtaccttccgacatactggaacgcatggcaaacttgaaggtcggtgacgttttagaggacaggtatcggattgaaactccgattgcccggggtggtatgtctaccgtgtacaggtgccttgatcttcgtttaggacgttccatggcgcttaaagtcatggaagaagatttcgttgatgatcccattttccggcagcgtttccgtagggaagctcggtcaatggcgcagctaaatcatccaaatttggtcaatgtgtatgatttttccgctactgacggtttggtgtatctggtgatggagttaatcactggtggcaccttgcgtgagttgctggctgagcggggacctatgcccccgcatgctgctgtgggcgttatgcgtggggtgctcacgggtctcgcggctgcccaccgggcgggcatggtgcaccgggatatcaagcctgacaacgtgttgatcaatagtgatcaccaggtgaaactgtctgatttcggcttggttcgagcggctcacgccggccagtctcaggacaatcagattgtgggcacggtggcttatctttcccctgagcaggttgagggcggtgagatcgggccggccagcgacgtgtattcggcaggcattgtgctctttgagctgctcacaggcaccacgcctttttcgggcgaggatgatctcgaccatgcatacgcccgccttacggaagtcgtgccggcaccgagttcgcttatcgacggcgtcccctccctcatcgatgagcttgtcgcgacagctacctccattaatcctgaggatcgtttcgatgattctggagagtttttgtccgcactggaagatgtcgcaacagagttgagcttgccggctttccgggtccctgtgccggttaattccgcagccaatagggctaatgcccaggtcccggatgctcagccaactgatatgtttaccacccatatccccaagactcctgagcctgatcacactgcgatcattccggtggcctcagcaaatgagacgtcgattctgcctgcgcaaaacatggcacaaaatatggcgcagaatccgctgcaacctccggaacctgatttcgccccggagccacctccggacacagcgctgaatattcaagatcaagagcttgcgcgcgccgatgagccagaaattaataccgtcagcaatcgttccaaattgaagctgacgttgtggtcaattttcgtggtcgcagtgatcgctgctgttgctgttggcggttggtggttcggttcaggccgttacggtgagattccgcaggtgttgggcatggatgaggtccaggcagtagctgttgtagaggaagctggtttcgtggcagtggctgaacctcagtatgacaatgaggttcccactggttcgattattgggactgaaccttcttttggtgagcgccttcctcgcggcgaggatgtttctgtcctcgtctctcaagggcgtcccgtggtgccggatcttagcgaggatcgatccttaagcaccgttcgtgaagagttggaacagcgcacgttcgtctgggttgatggcccaggtgaatattctgacgatgttccagaaggacaagtagtttcttttacaccgtcgtcaggcacgcagcttgatgttggtgaaaccgtgcagatccatttgagccgaggccccgccccggttgagattcctgatgtctctggcatgggagtggatcaggcaacacgtgtgttggagcgcgcaggtttgagcgtcgagcgtactgaagaaggctttgatgctgagacaccaaatggtgatgtctacgggacttcgcccaaggtatctactgaggtcaagcgcggaacctctgttgtgctgcaggtgtccaatgctatttcggtaccggatgtggtgggtatgaccaaggacgaagccaccgcggcgcttgcggaagaaggattggtcgtggcgtcgacaagcattattcctggtgaggcggcgagctccgctgacgccgtcgtgaccgtcgagcctgaatccggcagccgcgttgatccagcgcatccgcaggtcagcctcgggttagctggggagattcaagttccaagcgtggttggacgtaaggttagcgatgctcgaagcattctggaagaagccggtttaacgctgacaactgatgcggacgacaacgatcgaatttatagtcaaacccctcgtgcacgcagcgaagtctcggtagggggagaagttacagtaagggcgttttagtggttccctcgttgcagcaatggcgaaaacctgctctcatcctggccattttgacggtgctaggcgtactcctgacccattggttcgcctggccactcacctggccgctggggctgcgtcttcccgttgatgtagaggtgtactggcagggtgcgcgcgagttttggctcgccgatgatctctacgacatcaggtatgacaccactttcgacaacttgccgttcacctatccccctttcggtgcgttggtgttcaccccattgtggtggattcatgacctctttggtcttctcgtcaccgaacgtgtcttcgcgctaatcacgctgctcaccacctacgctgtggcagttttcctgctccgcctggccggcgtgcgcgatcgtgtgtgggaattcgtcgcattcgcagccctgctcgtgtccgcgccggtgtatttcacactcaatattgggcaaataaacgtcatgctcatggctttaacgcttttcgacgtcgccctcccccgcagcacgcgccattcaggcgtgctcaaatacgtgccactcggcgtactcaccggcattgccgctgcgatcaaactaaccccactagtgttcgggctgtatttcctcatcctgtgggtcgtgactaaatcaccacgcggactgtttggaatgattggtggcttcctcggggcatccgggcttgcaattattttccgaccatccattagcatccaatatttcaccgacgtgctgtttaccgcagaacgcatcggcgacctccacttcgcacgcaatgtctccatccgtgcggttttggaacgactccccgaacttggttccgcagcatctatcatgtggcttgttgctgtggcgctagtgatcatcgcagtcgcagttgctgcttaccgaatcctgcggacggatctctccgcgcacaatcgtctgctggctgtttccctcgtgtcgctcgttgcactgttgtgctcccccgtcagttggtaccaccactgggtgtggcttggtccgttaatcgtcgctctctggctaactcaacaccgctggctggctctatggggcgcattcgccgtgacattcggatcattccacaatttcctaccctcagaaaacaatatggagctcacctggccgtggtggatgcatgtcctcgcagcacattatttgatcttctccgcagtggttactgccgtatttagttgtgggaaaatgccccaaaaaacagagctttcccactaatcgatcaggagtatcacatctccatgatttaagattaaaactttgtctaaacacgaacggtgttttcatgtttaagaaaaggactcctggttttgacgaacccccagacagcacatgctgccgcgtctgactccgcatcccagaaggaggctcctaatccttcactctccatcactgtaggtattaaagatctgctggggctgctttcagttcttggcattgcagcggggctgatagccaacaagattctcatcgaacgctacaactggcgcatcgatgccgcagtttaccgcgaaggcgcgttagcgctggtcaacggggaatcactgtacgcgcagccgtttgatatgggtgatatttcactaccctttatctacccaccgattggtgccatcctgtttgcgccttgggggtactttgatttcatcacagttgaacttgcgggaaaccttgttgtcataggctcatccctgctgttattactgtgcctgtatcttgtcaccaacgctgttcttagcggtcgagacaagctgttggccttcaccatcgctgcgatttcctggccgatcgctctctttgcagagccagtgtttttgaacgctgacttgggccaaatcaacattttgatcatggctttggttgtcatggacctgcttccgattaagcgcagaatcccccgaggtgtcctgattggccttgcagccgccatcaaaatcactccgctggccatgctgttgtatttcctggtgaagaaggatttccgcggaatcatcaatgcggtgatctcactacttgccttcactgctatcggtgctgtgctcgcatgggaaaacaccaaagagttcttctcttcaacccttctcaacttaagtgctgaaggcgattcaggcgtagacaccacgttccaatccaacagctcgattcaggccatgctgtatcgctggtggacctcaaaggcagatgccgaagcatcctcactgcccaccatcttgtggatcgtactgtccctgattgctgtggcggccgttgcctacctaatgcaccaactcttctccagaggattgcacgttgaggcagtcatggttaacgccatgctcatgctacttatctcccccatctcatggtctcaccactgggtgtggctaccgctgtgggctgtggtgttcttcgttcgataccgccagcaccgctctcacccgaagttcttgttgtggagcggagttatcttgagcgtcatgctgctgatgctgccaccaaaatggtggtttggccgcgatggcgtcaacgtcttcgaactgaatttctgggagaaactactcatctctgactggacgtggctctccatcgggctcatgatcaccttgggtcttgggctgaaagcatttcccaaaatatccaaatagataaaggtgtgggggctgacaacaattgttgtcagcccccacacctatttttagagttggtctaaaagcttagttacgcagcatttctgcaacgaggaaagccaactccaaagactgctgagtgttcaggcgaggatcgcatgcggactcgtagcggcctggcagatcaacatcggtgatgtcttcagcgccaccgaggcactcggtgacatcttcaccagtgaactcaatgtggattccgcctgggtgggtgcccaatgcgcggtggacctcgaagaagccctggacctcatcgataaccttgtcgaagtgacgggtcttgtagccattggatgcggtgaaagtgttgccgtgcatcggatcggactgccaaataaccttgtgtccggatgcctcaacagcctggataacaccaggaagtacggagcgaaccttgtcgtggcccatgcgagcaacgatggtcaaacggccaggctcgaagttcggatcgagcttgtcagcgtatgcaacagcctcttcaggggtgataccaggaccaatcttgatgccgattgggttagagatcatggatgcgaagttcacatggaaatcatccatgccacgggtgcgctcgccgatccacagctggtgagctgaaagatcgtaaagttcctcgttgccttcctcatcggttgcaagacgcagcatggaacgctcgtaatccaccagcaaagcctcgtgggagcagtagatatctgcagcacgcagggactcatcggacacgccacatgcttccatgaagcgcagaccggagtcgatctcacgagcaagagcctcgtagcgtgcaccagctggggagttcgcaacgaactcgcggttccactcgctgagacggtaaagatcagcggtgccagagctggtgagcgcgcgcaccaagttcatcgcagcagaagcgttagcgtaagcacggatcatgcgggcaggatcgtggcgacgagcctctggggttgcctccacaccgttgacgatatcgccacggtagtttggcagaccatttccatccagatcagaagagcgaggctttgcgtactgaccagcaatacgagccatcttgatcacaggagtggatgcaccgtaggtcaaaacaactgccatctgcagcagagtctttacgttggcgcgaatgtgcggctcagtgtttgactcgaaagtttccgcacagtcaccaccctgcaagaggaaggccttaccgttggcaacatcagcaagcttctgcttcagctcaagtacctcaggggcaacaacgattggaggaaccgactcaaggatcttgcgcacgttttctgcctgtgcacgatcccacgtaggttgctgcttagcgtcacgggaaatggtgtcctcgaactgctgctgcatgccttctggcaatggtggcaaatcagggagaacttctttagggatatcaactgtccaactcacacccctattcatagcacgatatcggtgttttaaggaatggaataacagttaagttttctcccaacctatggaatgggagcagatcgactaagagacgcgatcccttttacccaaaggcagcgctgccatgcacactttgaacttggctaaattatgacgcgcatcaatcaacgcatcgtggttgccgttcggcagctctggcagcgttgggcggccagccatgtcccaatactggcgaagctcgcgggtaaaacgagggatctcccgaggaagccccgccatatcgccccacatttgtgccaacaacacgtggtcatatgcgcccacccaggcccacagttcaggggttggtccggtggaggtgagaaactcataaacttcgcgctttatagtgtctgcagatttccacactttggaggaaggattaggcaatttgtccaacacgttggcgcgcacccaagcgttcgccttggaggaatcaaactgtgtgctaactgcgtaatactcgcgaccgtcttctgcgacgattccaatagagaccaattcgatcgtgcgcccatcttcaatgaactcagtatcgtaaaaataacgcactagcaattagtccttcacagcgtcgaaaacgtcggtttgttgttcatcgtagccgtaaagcattgagcagtgtcacaaaaggtcacaaggtgcacagctcagttccttaaaaaccgctggatacggatacactatttttcatgcacggtgaaaaacttgtggatggcactgagggaaatctcagtcaattccaatggcgcgatatggctacaaatcagacgctgagaaaagcactgttagtgctttctaccatcgctctactcttgactttatggccttcaattttcaatgttcgggccatcgagtcttttgttttcttcttccatattgatactgacgtgtaccgcgccggtgctaatgcattcttgcatggcgagaatctgtatacccaggactaccaagttggtagcattcaacttcccttcacgtacccaccgatttctgctgcgctgtttgttccacttgcaatccttgcaagcagtgtagccggaatagcattaacgcttatttccacggtgttgctgtggtggagcgtagctatcgtcttgcgccgagtgctcaagggtctcacggatgctgattccaggtttgtgtcctatttgattctgcctatggcattgtccacggaacctgtattccagaccctgcagtttggccaggtcaacatcattttgatggcgctggttctcatggataccttcaccaaaaagccctggttgccacgtggtttttggattggtttggcggcatccatcaagctgacccccgcagtctttggcctttacttcctagtgaagaaggactggaagggcgctggagtagcaattgcttctggcgtaggtttttccgccttggcgtttatcctctcaccttcaagttccaagatttactggactgaaacactcaacgacccttctcgcatcggcaacctatcttatattgctaaccaatctgtgcgtggaacgctcagccgaatgatgcatgaacagcaggatctcgtcgaaaagctttggcttgtggcagttgtcttgtgccttgccgctgtcgccgtcgccatgtggcgcgtggtacgcgccggcaacccgtacggcgccgtcatgctcaactcgttgattgctctgctgtgctcccctgtttcatggtctcaccactgggtatggctgattccaatcgctattggtttgggggcaagtgcgtggaaccagcggcggactgctccaggaattgccgcgacggctggagtcttggcgcttctgaccacgattccgatgttcatcacaacattttggaacatgccatacgattcagagtcttacccattttggccattgattctgcagccgtcgggcaacgcgtatgtagtagtggtcatcgctattttgatcgtcgcgattgtgaatccaacagttttgggcagtggcaataaagctgtttcaggccaggcagagaagaagtcctcccctgcgttgcttgttgttttagcgattgccattttctacctctttgccaatatttggtttaagggaaacaatcaaaacaaagcgctcattcagtacccactgcagactatggaaggtcgcggtctcactgacttcggcgagcttatttttgaattcgcggcttcctccaaccagcttgtttccctctggataatcggcgccctcaacgccatcgcattggctattaccctgtggttcctccttcagcgttttgctgggaagaagagctcctggctgatttatctcagcaccgtggctgttgcgctgatgatgttctcagtgcaggatgccttgcagtttggttcgctgactctcgttgcactcgcattgatcactgttgatgtgttgagtgtcagagagattggccgccgcgggctgctcacaggacttgcagcagccctgtttggatggccaattctgattgttatcggattcctcattcaccgacgttatgcagcaacaatcacaaccactgtcaccgcagctgtgctgtggatcttaggaattctgctcaatccagacgccttcaacctcaacctgctgcgtcaatggttcagcgggcgcgatggtcgggacaatttgtccttctatgctttccttgccaggtgggtcagcgaatccccagtcatgatgttcgtatggttcatcgtcgccctaggacttggtgcctgggcaatccaccgcacctggtcacatggattcaaggacctctccgctgcactgagcatcgcactaccaaccttggtgctccccatagtggaactccaccacctcgtgctacttcttccactgatcgcagtgttgcttcgtcaaggacgcgtggcaatttcctacctcatcggatttatctacctagtctcatggactccgcaacacctgtcctactccacggtattcccacttaatgatccagcaccagaagggtacgtcgcccactttggatggtatttactcgttgaaccaatggcggtagcaccggcagctataatcctcggagcatttattgcctgtgctgcaaccacacctaaaacaagtcagctcgtgcaggtcgacaagtcaagcgcggaaaacaccaagtaagccttacagtccgacagcctcatagcggatgggataagttccaaacacgttcaaatccgttaaagtgcctgtttaaaactatgcattcaaaggaagagttaacagtgcgtaaaggaatttcccgcgtcctctcggtagcggttgctagttcaatcggattcggaactgtactgacaggcaccggcatcgcagcagctcaagactctgcatttgactacggtatggatccaaacatgaactacaacccgatcgatgacatcaaggatcgtcccgaaggattgtccaatcttccctacttcggaagtaaattgaccagctggggctcatcagatgccaccgcctcatccggcgtcgtgacctccgcgctcccgcagtacaccgatccgcgctaccccctcggcaaagacgacctgcccaaggcaaccatcgacatggagccagaagttcttgcgcgccttgagcgattcgtcggcgttgacggtgatcgcatccgccaaatcaacgcgtactcgccatcaatgggacgcaccattcctctagtctgggttgttccagaagacaacaccgtgcctggcccaacggtctacgcactcggcggcggtgacggtggacaaggcggccagaactgggtcacccgcaccgaccttgaggaattaaccagtgacaacaacatcaacctcatcatgccgatgctcggatcttttagtttctacgctgactgggcaggcgaaagcgaatccatgggtggtgcgcaacagtgggaaacattcctcatgcacgaactgccagagccgctagaagcggccatcggcgcagacgggcaacgcagcatcgtcggcatgtccatgtccgggggatcagtgctgaactttgcgacgcatgaccccaacttttactcctcggtcggctcattttctggatgtgccgaaaccaactcctggatgggacgccgtggcatcgcagccaccgcctacaacggcaatgtcgtgcctgagcaaatctttggtgaagtagacagtgattactcccgctataacgatcctttgctcaacgctgcgaagctcgaagaacaagacaacctctacatcttcgccggttccggtgtgttctctgaactagatgtcattggtgacaacgcaccgattgatgaggatgcgtttaaaaaccgcgttctggtcggatttgaaatcgaagctatgtccaacacctgcacccataatcttaaggctgcgactgatcaaatgggcattgacaacattaactatgatttccgaccaaccggtactcatgcttgggactattggaatgaggcactgcaccgtttcttcccgttgatgatgcagggcttcgggcttgatggtggtccgatcccggtttataaccctaacggtgtgtcctctagtgagtcttcttctgagctgtcgtctgatgtgagtcttggcaccgtgatcggtagtgtggcgggaagctccggatcaagtgaaggcagcagcgtccgagagttccttgcaggaagttccggatcaagccaatcaacaggaagcttctacgaatagctagggctgcgcaagattccaatgagaaaacctctgacatcaaatgtgtcagaggttttgacgtttcccagctttcaagatttcagcagcgtgcagaaggcctattctttgtcagcagactgcttcttttttgaaccccgtgggacaaacacagcggccgcgacaccgacaatgatgaacggtgcgacgatctcccgcgataagtccaacgctgcaacaatcacataaagcacaatcaggattgcaacaatgagaagtcggatacgcatgaacttattcacggggaaaatagatcctttactgtttaactaattcttcaaaaggcagcggtgctctaatgctctggatgattccacgctcgaaagcaaaaggcttgtaggttagaaggctgacaagcagaatcacacaggttatgcttcagttatataccgtacgtcttagaagaggtagaagcattcataggcttcgcagactgagctttaacgtgagaatcagcttgtgctttagctggagttttatctggttctggcagtttagggggaacaagagtccatcccagcactggaactcgcgagatcagataggtcaggtacccgccgagcatcgcgcaggcaaacgcgatgaccatccacgtattggtgtggtgccacaaactgtcagagaagttatcaatctccatgaaattccagcgcaagccgaaaccaaaaatcagcgatagtcctgttgcatgcccaatgtagatgggaagggtgtgcctaccaataagtttcaaaaactcccctactggctttattcggccaagccatacgcacaacacaattcctgcaggcagggaaacaatccgaatgatcattccaggaaggtgatccatatcgaatccagtgaggttgccgccgagtgcatgagcaaaagtatcgcggaggttcatcagccacagcacgcttgcgccatggttttcgctgtcgcgcagcccatttgagatcacgcccaaagcaagtcccgagacataaaggaccgctgcaaacactattgcttttggccttgttgcggcttctgcaaaacgcgaaatcagtgggcggaagtaagcgccaatgaggaatgtaggcaagtaaataatggacttgcgtagaatctcaatctcgctataagccggcataagtagccacagtgaggccaccaacgccacaattgcccaagctgggagttttctcgttgcccataaaaataggttgaagatgaccaagaagtagaggaaccagtacatattggtggccgagagcatcgagccgctgtaccattcccatgttcccggtgctctaccggtaaaaactgtgccctcgaggcggtgtagataaagattcactggagtccacagcaaatatggaaccaggtagaaccacagtcgcccgcggaaaagttcaccaaagctttgattcagaactttaactgcaaaaaatccactcaccataaaaaataatggcatccgaagtggatcaagcagtgcgttcaggtgggacatcatggtgtcctggccacctggaattgccaacgacacgtgtagtaacacgacacctaggatggatattcccttggcgatgtctggccaatccatacgagccttgttctggggagccgtcacctgctgtggggctgggtttaagtttccagttttcacggtggcggacaactcctaaaaaagacgatgcgctcatttcgcagcgcaaccgtccgactcgatgtatgccaaaaagattaacaattagttaaatcttgaagcctaaccggtacaaccataccgttctgccacccgaatacgaaaagactcacacaaaaaccccaaggtttttaacagaaaagacccgattactgtgaaggagctgtgccctccgggtatccttttccttcctccagagcgtttttcacatctttagagtacgcatcaacatacggctgaccagtgagatcagcaagaatgaacataacgtgatctgtcagcttgcgcgctgcttcgtaggttccaggcttcaacccatgttctttgacgaatgcgaggggatcaattgggcttcctaccttgatcctgacttttgcgggtttcggaaaccaacttccgatagggttcgcgtcccggctgccaatcatggcaacggggataactgtcgtaccagtttccatcgcaacataggccattccggttttgcccttgtagatgcgaccatcgggcgaacgagatccttcagggtaaataccgaagaggtctccccgatccagcaccattttggcggtattcatcaaagaatccatggcattatctgcggtgcggtccaggggtacttgccccacagaagtaaaaaaccacttctgcatcttgcctttaatacctggtgatgtgaagtattcggccttcgctgggaaggtcagctgccgtgggcacagcaggggaaaataaaaggaatccatcactgcttcgtggttggacgccatgatcgcggcaccttctgcagggatgttttctttgccttcgatctccgggcggttgtacacacgcaaaaacgggccaattagcacatacttgaaaagccgataccagttgtttttcatgatgtttgggtttaccccttcttcgcgctttactgctgtaggaacttctaagaatacgttacccacgatgtgtattttgctgcgaagctaccaaaaccactttttaatttctttaaggggtggctcttttggtggacatgcgtcatcgcagcccaccgaaaaacacctagttggcttccactacagagcgtcgagctagatcagcgacaccgatcatgccagcatccgcacccaactgagctgtggcaacgcgtgccaaagggcgatatcctgcgccgacgatgcgggtggaatagtggttgaccgagcgatccaaataaaggtcggcagcattggacagtccgccaccaatgatgatcatgcctgggtcaaggacatcagcaatgatcgccaaagtttcgcccagccactcgctgaaatcttccagaacggcgagagcaagtgggtcttcttggcgcgctgccgcagtgatcgtttttccattgatggaattcggatcggctttgatcttgtcaaacagcccgctgttgcggaatgagccatgcgaagccaattcacgcgcagtgtaaaccaaggcagtaccggaacagtaacgctccaggcagccttctttgccacacgcacatgcgcgtccgccacgaacaacacgcaaatgaccaaattctggtgccgtgccatatgcaccacggtaaatttcgcctttttcaatcagcgctgcaccaattccagtgccgagtgccaacaaaacccagttgtcagcgccttgagctgcaccaaaacgatgctcaccccacgctgctgagttggcatcatgttccaaacgaacaggcaggcccaaaaggttttccaacttttcacgcactggctcatcgcgccaaggaaggtgcggggcaaatcgaacaacctcgcactcaggatccaaaaatcccgcgacggcaagtcccacagcaccaaccgggtattcggccttgagctgttcgactagatcaaaaatcccctgttccattgcctgcgtcgtgcgcggcgacggcgccgacaaactggtcacgatgcgcccggattcgtcgacaagcccggctcgcatgttggtgccgccgatgtcaaagcccaccgcgaaactggccggtttttgtggcataagagtgcccctcgcgttctacacaggatttaggtgaatttaatctttcaaagtatagctatcaacagctgtccaaccatcatcgtggttcactctgcaaaatattggtcaaccgctcccccatgatttcccacgaccattcggcctccacatgcgccctacctgcagcgcccatcgcggcgcggcggatcggatcgtcgagaagctcaattaaaagctcagacagcttatcgacgtccgacccctccacaaccaggccagttgccggagtcaccgtctctggcgcgccgccagaggtgccggctatcaccggcactccgcaggcttgtgcctcgagatagacaatgcccaagccttcaacatcaagtccgccaccgcgggtgcgcgctggcatcgcgaaaatatctgcggcggcaagcgtgttgatcatatcttgatattcaaggcgcccaaggaatttcacgttctggctcacgtcagtggcaaggcgccgcaaagtcgactcgtatcgcccactgcccacaatgagcaactgcgcatctgggcgcgccgcaatcacctgtggcatcgccttgatcagcgagtcctggcctttcctcggcactaaacgcgagttacaggcaataaccggggtggtgtccgtgaatcctagctttttccttgttgcgcttttgtcctctggcgtggccggagtgaatctcttaacgtccacgccggaaggcaaatgttcaaaagtcgggtgcgatccaaaagcacttttgaatctgcgcagcgtgtactgcgagatataagtcagcacgtccacctcagtgccgattttgcgcaacgattgtctcgatccaggaagcattgaccaccccacctcatgcccatgagtggaggcaataaccttgctcgcacctgcctgcttcgctgtgcctgccatcaacgccaacggagccgcagcaccgaaccacacattatcgatctctcgctcacgaatgatctccgccatagcgtgtgccgttgttggggtgggcagcatcaccgaacgaggccacctaatgacctcatagtccaaagtcttgtcgtaggcatgcgcttcctcagcgttttgagtcgacgcaaacaccacgatcgactcaggatcttgagtagcgatgaaatccctcaaatagctttggattccgccgatccgtggaggaaaatcattggtcacaacgagagtttttcgggatgcagacacaaagattctcctgacgaactatttcttagtagcgacgcgcaccataaaacggtgctgaatcaacagataccacctgcacagggattccgtagtctgaggcgtgcacaatctttccgtccccaatatacagtcccacgtgagtagcacctgggtaatatccaatgacatcgccaggctgcagctcatctctgctcaccggcgttccgccagccatctgagcttgagacgtacgtggcaaagtcttacccatctgctgatacgcccaatagatcaaacctgagcaatcaaactcatttgggccaatgccaccccaaccataagggcttcccaacttagacaaggcagcatccaccgcacccgaagtcgcagcggaaagaccaagcaaatcagtcagatcaatgtccaatggaccattcttagcaacccacatttcccgctcctgtggcgtcagggcatccacccggtctcggatctccgattttcgaccatccaatgcttccttttcagattcaagctccgcctggcgtaccttcagctgccccaactggaactccgcttccgccttagtacggtttgcttgatacacagcttctgcggacttctcagtctccgcgttgagggattcaaccacatcactagtggacttagtcaacgttgaaaggtagctcatccgatcaatcacgttttgtggatcttctgcagacaccgcaatgctcaaaggatccgtgactgtgccacgatacttcgcctgagcgatccgattgatctccgaacgataagcttcgacattctccgatgcttgatcagccgcctcacggtagcttaccgactgctcctgaacttccttgatcgtgacctcacgagcctcaatatcaatctcaagctgtttgacttcctcattctgggcagacgtttcctgagagacatgctcgatatcagcaatcagttgatcgacttcctccgcaccggaatgcgaaggcaccagaatcagcgtgcttgcgataacacatgacgccacaacgctcacccaacggcgaccaaacatcttcaaaaatcccctatcaacctcattcaagcaactccactactctaacccgattacaaaagcctagccaaggaaaagaagcaagccgctctcaactttttcaaggagtgcggcttgcttcaaaagcttaagactttatgcagattagaaacgaactgcagagtggaatggcatgtaatccaaggagtgctcagacagaggggtgctgctgttcagtgcgtggataacggtgccgtggccggagtagataccaacgtgggtagcgccggagtagaacgcaacgatgtcgccagcctgaaggtcagagtaagcaacaggggtgccctgtgcagcctgagcctgggaggtacgtgggatggacttgccaacctggctgtatgcccatgaggtaaggccggagcagtcgaaagcgttaggaccggtagcaccccaaccgtatggggaaccaatcttggtgcgcgctgcatcaacgattgcctgaccggtgcttgctgcaggtgcagcctgtgctgcaggtgcatcaatgacggctgcgtaagcagtaggagctgcctggctgctaagggaagggatccactgatcgattcctggaacgttgttaagacctggagtggtctcgatgccagcgatgtcaacgctgattccggtgccaggaacaacaacctcagctgcctgtgctggggaggcgatagctgcggttgctccaagcgcaactgcagatgctgctacagccttgcgagttgcgtttgaattgttgcgacggtgcttacccactgatgaaactccaaattcttcctgtttgctgaccgagttagctgtcgggttcggagcggaaggcccctatccccactccttctctctctgcgagagaacccttgtgggaaactcaccccaggaacacgtttggttccccggctcgccgcacgatttaaagaatttctctaaactatgcttgcgattaagcgtctatttgtttctgtaatgctggcggaaattcggtgtccgtcccgcaatgtctcaataaggttacgaaaccgcaacaacacttgtctagcccaagcgaaaaaattggtcgttatcgaaccgttatcgcggattaatttgaccgagacgcaagtcctccactcagaccccaactactaagggttctcccctagaaccctgagaaggctagatgacctgcaatttcaggaaacttccagtagtcaaatcgttttcacagagccgaaaaatcggcactagtttcagcaatgatctcactatgtgacattaatcaccattggcggcttatgctttgagatttggagttatgaaaacaatttttaagccacaccgagctggattttgagcggaatttgagcgaagttgacactgaccccaggcgacctagggcgtaatgctcacgacgaagaacactccttatatatataaggagaagaaaactctacgctttccacgcgcctgcacgttgcttcacaccgccacaagctacatataaggcaactacaggctctacgccactcctcgtgtgtcaaagagccctctcccttatcttcagcctcgtctgaatagagaaaaactccccgatgcggagacctttcgattcaggtccctacagcggggagtttcagagatgaagtcctagaaactagttcttgccctcattcttgtcacgctcaatgtttgcctcgttgagtgcacgaagagtgttcgcttcctcaatgtggtttgcgtgctcaatttccttagccttcgcacggatgtcttctggatcaggtccgaagaatccaccgcgggtttcaacctcagcgtaaccaagctggttcatctgctttggaaccgcagcgccagcgtatggcagtgggattgggtgaccatggtcatcaactgggccaagtggctggtgaacttcaatgaaggcaccatttggcatctgcttgatgataccggtctcgatgccgtgctccaggacctcgcggtcagagcgctgcaagccgatgcacagtcggtaagtgatgaagtatgcaatagctggtccaacgatgaggccgatacgaccgatccaggtcatcgcgttcagtgaaacatggaactgcattgcgtaaacatcgttaccaccagaaacggtaagcaggatgtagaagacaagcgccatgacaccgagtgaggtgcggactggaacatcgcgaggacgctgcagcaagttgtggtgtgcatcgtcgccggtgaacttacgctcaatgaatgggtaagtcacaagcagaaccacgaggatacccagcatcacagcaacccagaagactgctggaatagtgtagttaccgaggtagagctcccatgccggcatgacacgagcagcaccatctgtccacagcatgtaaacgtcaggctgggaaccagcagacacctgtgaagggttgtacggtccaagattccaaattgcgttaatggtggtgacaccagcaagcagtgcgaggaaaccgaagacgatgaggccgaaagcaacagccttaactgcgaacagaggcatgattcggataccgatcacgttgttctcagtgcggccagcgcctgggaactgggtgtgcttctggtaccaaacaagtgccaggtgagctgcgatcaagccaagcaggatagctgggatgattagaacgtgtgcgatgtagaagcggtccagcatcagatcggatgggaagtctccaccgaagatcagccagtgcatccaggtacctatgatcggaagaccaacgatgatggcggacatgattcgaagaccaacaccagagagcaggtcatcaggcagggagtaacccatgaagccttcagccatacccaggatgatcagaacaacaccgatgatccagtttgcttcacgtgggcgacggaacgcaccggtgaagaaaatacggagcatgtgaaccagcatggatacaacgaacagcagggctgcccagtggtgcatctggcggatgaacagaccaccgcgaacctcgaaggaaatatccaacgcagttgcgtatgcacgggacatctccacaccgttcagtgggaggtagccgccgtcataaatgaccttggtgattgatgggtcgaagaacagggtcaggtagacaccagtcagcagcaagacgatgaagctgtaaagcgcaatctcgccgagcatgaaggaccagtgagttgggaagaccttgttgatctggcgacggatacccgacgccatggtgtaacgggaatcaagattgtttcccacggtagctagactcatgacttacgctcccagaatgcagggccgagtggctcaatgaagttaccagcggcgatgaggtagccctcttcatcaacggtaattggcagctgtggcagtgcacgggcagcaggtccaaagactggctttccgtagtgcaatgcgtcaaactgcgactggtgacatgggcacagaatacgattggtctgagcctcgtacagtgaggttgggcaaccaatgtgtgtacaaatcttggagtaagcgtagtagtcaccgtagtggaaggactcctggccttcgcgttcgataaccttttcagcgtcagcggtacggagacggatcaacataactgcgttgcgtgggccgtgcaccgagtgcatttggtgctcgtagacgtccttcgcaggatcgtattcagcaccgtcgttcaccatttcagctggaagtgggaagacagtttccatggatgctgctgccagatcttctgggcgcatacgaaccaggcgggaaacaccagtggttgaccagtgctcaccggttgcatcggtgtgggactccgcaattgctgcagtgtcgcggccgaggtaaaccttgacgtcgttctcaacgagagtccaaccggaagtccacagggtgccgtcaccctgaacgtccattgggccttccttaggattccaagggttcttgatcataccgcccattggagcgatgatggtcaggccggccagtactgctccgccacctgcaagtcccatgatcagcttgcgacgaccaagagtagaggtctgccaagagtcattgagaagtgcaacgatggtgcggcggtcaacttcttcagaaggaccgtcgtggcgacgctgtactgcgatttcctctggaatgaacttcttgacataaaggacaactgcaaatcccagggacaggatgcaaagaccggaagtaatacccagcattggggtgtacaaggtgtacgccaggagaccttcatctccgtgtgccttgtactcccaaggccagaaaatgtaggtagccaggaacccaagtccaccaatgatgccgaggactagccagaaagtaactgcacgtgcagcgcgcttctcagctgggtcattagcgattgggaaacgttccttgcggtatgcaatggtaacgtcgtccagctctgtaccaagtcgtgcaagatcctcattgctcatcgcgttgagttcttgggttgtgtactgtttgtcgttgttgttactcatgaacgtgatccaatccacatagcggcggccacgaggaccaagatgccgaatacccacatgaacagaccctcagccactgggcccaagctaccgagtgagtaaccacctggtgatggggtctccttggtggacttgatgaaggcgatgatgtccttcttctcatctgcggagagctgacgatcggagaacttaggcatgttctgaggaccggtaagcatagcctggtagatttcctgctcgtttgcagcatccaggtttggtgcgtacttaccagaggacagtgcgccaccacgaccagtgaagttgtggcaggatgcacagttcaggcggaacagatctccgccgcgagcgacgtcggcggaggtaatctgtccgtcgtagttttcgccacggagctcctccatggcgagggtgccgtcctcgttgtaaacgagtcctgggccaccgccattagctgcaacatatgcagcgatcgcaagggtctgtgcctcggtgtaacgaggagccttgcgctcagcctgagcctcgttacgcagtattggcatacggccggagtgaacttggaagtacactgcgccttcgccaacacctacgagggaaggaccgcggtcctcaacaccttggaggtttacgccgtggcaggtgatgcaggcgacatcgtagaggtctttaccctcggagataagtgcctgatcgtcacgctgagcggtagcaacttgagcatctggagtgatcgcggttgcgaggattcctgctccgctcagtccaatggtcagagccaatgcacctgcgacggtgcgccggaccttgcggcgattcttgaccttcttagcagagggtttagccatgctatttccctctggggtctgcgggttggtttccatcatttccctttgaatctcgactgtggaagtgaagggcatagggaacctcaacaacgttgaggattccttactgcctactgaatgaagtaaatagtgatgaagaggccgatccagaccacgtcaacgaagtgccagtaataagacacaaccattgctgcggttgcctgtgccggagtgaacttcgacttatggattctcataagaaccacaacgaaggccataacacccgcgatcacgtgcagtgcgtggaaaccggttgtaataaagaatgccgatccgtagacactgctctggattgtaagtccgtgacctacgagagtgatgtactcgtagccctgtccgatcacgaagattgatccgaggataatcgtgaccaagaaccacttgcggaggccgtaaacgtcacccctttcagccgcaaaaactccgaactggcaagtcactgaggaagacaccagaatgaccgtaatcaacagtgcgtagggcacgttgaggtgatctgtctgctctccccatgatccatttgccagtccgttcgcacgggacacgaagtacatcgcgaatagcccggcgaagaacattaattcctgagacaggaacacaatggtgccgacactgaccatattcggacggttcagtgccgcaacacgttgtggtgctgccatacctgtatttccaactgcgctcgtcacgctatctagtatggctgtttggttggccaaagtcacttcaagccccccgtttcaattgaaagtttgaactcggcttttgatgcgaattttcccccaattcgcaaacttttcaatcgaccttccgggaacttttcgtagcccttttacgacagttacataattgcaggttaaagggttcacaggcagttccaatctgccccaaatcacactcgtcccattttgaagaactctcagagtgtgcccaaagtggtttccgcaggtttttgcctgagagacacgtcacagagtttttcaccccattggagccccacatacaacttttggttgaacccgaataaaaggcgtttttgcagcttaatgcgattcatgtccgcccactcccccacttttccgctttcagaaacttttctcgattttgcgggaactttttcaattttgccgattttcgtatttcacagcgcctcggtctgccctgttggatagtttcgtcacggtgatcaaagttggaaaagcctgtgaaaacgacaaaatgctcaaccctatcggacagccaatagggttgagcatatgtggttttagtactagtgcttttcttttggcacgccgtactgaaggttgagcttggtgatcgtgaagatcaggagcatcagaccaactgcgatcatccagtagtggaagtacacaacgccgaatgcaaggaatccaaccgcaccggacatagctgccggccaaatggagcttgggctgaagaacccgagggttcctgccttgtcggcaacctcagcctcttcccagtcctctggaagaacatctacgcggacttcagtgaagtgaaggtagacaccgagcataagcgtcagacctgctgacaggaccagggccacagaaccgacccactcaacacctttaacgctgccgccatcactaacgtgcattgttgcgaagatgtagatgacagccattgcggccatgaatacggtcgggccgtacatgagttttgctgaagacttcattttttcgccactccttcttaagcgttgctctgagtgttttcgccgtcgcgggttgcggtgcgatcggaaacgaatgggctagtggaagtagcgtaaggagcttgaccaatgtgctcaagtgcctgagcgttggttgcgtctgggttggagtcacggaagctgatgtactcagcgaaggaatcgcgatcgacgacacgaagctcgaagttcatcattgcgtggtaagtaccgcacatttctgcacagcgaccaacgaatgcgccttcctcagtgatctcttcaatctggaagacacgctgggacttgtttgcctcagggtgtgcgtaagcatctcgcttgaagaggaactctggaacccagaaggagtgtgcaacgtcagcagatgcgaggttgaactcgattggggtgttcacaggaagaaccatcactgggatttcatcagtggttccgagggtttcaattcggttgaactcaaggtaagaaacgtcagactttgagttgccgtgaattgggttatctccagaaggatccttcttggaagcctcggcagctgcctgacgctccgggtcgcttccttggtaatcctgtccaccaggtgccagtgagccatcaatttcggagtatccgaacttccagttccactggtaagcggtgacgtccacggtaacctctgggttcttatccagagcggtgaccttgtcctgagtttgaacggtgaagaagaacagcaccataacaatgatgatcggaacgatcgtcagaacgagctcaagtggaacgttgtactggagctgcttagggaattcaccctcgccgcgcttttcagccctctttgcgccccaggcaaagatggcggtgaggaatagaccccacatgatgatgccgatgatccaggcagcaacccagacccatgaccagaagttacccatggccactgcttcaggggtaatgccatcaggccaacccatacgtaggaaatctccaagcacaccgccaggaggggcgacttcacagcctgccatggcgaggccacctaagcccaagacaccgccaagcagggccttgcgctttaaaccacgcttattttgctgttccacgtgtgttctgccttcctgtccacacaaaaaccagagaccttacggtcatttctatcttcgcagaatagcctatttgccagccgattccatatcttgtgtttggtggaaatatcttcgtgggtttcgtttttaggggcgtcaaatgtctttcaactgcaacgatatgcccgaatcctcaggtggaatacctaaagtctaggcaattggtgtatgccacgtcacagaccatcaaccttttgattgcccttgaaattcccccacccttaccccctacgttcctacaaggtgcatgtattaggaaatcaatctggttttcaggaacctttgagaatgctgcaatagtcagctgacgcacgttgcttgagggagctttcgtcaattttggcgtgcccttttcacctcagatgtaacttcgccgtatcgttgacacgagatttaacaaatgcagcgtcttatttcttccaacaaaatttctttgcgatttaaggcgccttttatttcaggaggatttttcaatcatgtgcggccttcttggcatattgactgcaaatgggaacgctgaagcattcgttcctgcactcgagcgggccttgccatgcatgcgccaccgtggtcctgacgatgccggcacttggcatgacgccgatgcagcgtttggattcaaccgcctctccatcattgatattgcacactcccaccaaccactgcgttggggacctgcggatgaacccgaccgctacgcaatgactttcaacggtgagatctacaactacgttgagctgcgtaaagagctctcggatttgggatatgcctttaatacttctggcgatggcgagccaattgttgtcggtttccaccactggggcgagtccgtggtcgagcatctccgcggaatgttcggcattgccatttgggatacaaaggaaaagtcgcttttccttgcgcgtgatcagttcggcattaagccactgttctacgcaaccaccgagcatggcaccgtgttctcctcagagaagaagaccatcttggagatggccgaggagatgaatctagatctgggccttgataagcgcaccattgagcactacgtggacttgcagtacgtgcccgagccagatacccttcacgcgcagatttcccgcttggagtcaggctgcaccgcaacagttcgtccgggcggcaagctggaacagaagcgttacttcaagcctcagttcccagtacagaaggtcgtaaagggtaaggagcaggacctcttcgatcgcattgcccaggtgttggaggatagcgtcgaaaagcatatgcgtgccgacgtgaccgtaggctcgttcctttccggcggcattgactcaaccgcaattgcggcgcttgcaaagcgccacaaccctgacctgctcaccttcaccaccggtttcgagcgtgaaggctactcggaggtcgatgtggctgcggagtccgccgctgcgattggcgctgagcacatcgtgaagattgtctcgcctgaggaatacgccaacgcgattcctaagatcatgtggtacttggatgatcctgtagctgacccatcattggtcccgctgtacttcgtggcagcggaagcacgtaagcacgtcaaggttgtgctgtctggcgagggcgcagatgagctgttcggtggatacaccatttacaaggagccgctatcgcttgctccatttgagaagatcccttccccactacgtaaaggcctgggaaagctcagcaaggttctgccagacggcatgaagggcaagtcccttcttgagcgtggctccatgaccatggaagagcgctactacggcaacgctcgctccttcaatttcgagcagatgcaacgcgttattccatgggcaaagcgcgaatgggaccaccgcgaagtcactgcgccgatctacgcacagtcccgcaactttgatccagtagcccgcatgcaacacctggatctgttcacctggatgcgcggcgacatcctggtcaaggctgacaagatcaacatggcgaactcccttgagctgcgagttccattcttggataaggaagttttcaaggttgcagagaccattccttacgacctgaagattgccaacggtaccaccaagtacgcgctgcgcagggcactcgagcagattgttccgcctcacgttttgcaccgcaagaagctgggcttccctgttcccatgcgccactggcttgccggcgatgagctgttcggttgggcgcaggacaccatcaaggaatccggtactgaagatatcttcaacaagcaggctgtgctggatatgctgaacgagcaccgcgatggcgtgtcagatcattcccgtcgactgtggactgttctgtcatttatggtgtggcacggcatttttgtggaaaaccgcattgatccacagattgaggaccgctcctacccagtcgagctttaagtcttaaagcctaaaccccctccttctcaaggagggggtttcactatttcctgaggacaaagcaattacgccagcaaacacaaaagctcggccgtaaacaatgcgtccagggccgagcctttattcctacataacggaatctctttagttgaaggagtcaccacaagcgcaagagctgcctgcgtttgggttgtcgatggtgaagccctgctgctcgatggtgtcagcgaagtcgatctgagcgccgagcaagtatggggtgctcatcttgtcaacgacaaggcgaacgccaccgacgatgtcttccttatcgccatcaagggtgcggtcgtcgaagtaaagctggtaacgaaggccagagcagccgccaggctgaacggcgatacgcagagagaggtcgtcgcggccttcctgatcgatgagtgccttagctttggacgctgcggactcggtcaagataacaccggtgttggttgatggagcggtcatcgctttagtctccttaactgttggccctttgaattacttttaggccgggacatcataggcttgcagtgtactcccctttttacggatctccggcgagtgatgctggattacgttcatatgggaagcggatgggtgttccccagcctactcaccgtccacagatgagtaaacccggaaaaacccgtatttagttattggttttacctgcgtgggctgaaagtcttcacttttaatccttacagatggtcgttctgattcctttcaacgatgaagtgtgcacccctattcccgatttgggaggttttccttgtagcctattgagtgtgaaacttccttgggataaaaataagaacaacgaaggggctgacgctgcaggccaagacgccagctccacccctgagaccgctacgcctgacgctactgagcagaaattgccaaaggggcacacggcaccgaagggccgtcccactccgaagcgtcgtgaagttgagttagagcgaggtgtcgttggcggccagtctttggcgcctactgatacttatgcgcagcagcgccagaagcgtaaagaatttaaagcttctatgaccaaggaagaattcaaggcatacaagcagaaagagcgcgatgcccgagttaagcgtcagcgcgaaacccaagctgcaatggatcgcggcgaagatgcttatttgatggatcgcgataagggcgaggttcgccgttttgcgcgtgactgggtggattcccgcaggttcttgtctaactttgtgatgccagtagctattgctttgctggttgtcatgctgatcggtaacttcaacccatcattcgctgcgacttcttccatggttgccatggttttgatgttgggcttcctgattgagggcatcaccactggtcgtcgtgtgaacaaggctgctcgcacgaggttccctggtaccaccgagactggttttggtctgggttactacgcgtattcccgcaccattcagcctcgtaagtggcgtacccctcgtgcacgcgttgaaattggtgctgaagtctagcgcatgcgcacgttagttcttggcggggccaggtctggtaagtctgcttttgcagaatcacttgttggatctggtcccgttttgtatgtcgcaacggcaaggccttcgggagatgatcctgaattcgccgagcgcattgcggttcatgcggagcggcgcccaacgtcttgggtgttggacgaggagggggacgtcgataagcttcttgcctcgccaccggccatgccggtgctcgttgatgacctgggcacctggctcacgcacgccaccgatgcgtgcgacggttgggaggcgagttcggcgcagcttgaggccaagatggatttgcttatcgacgccatcctccactttcagggcgaagatctggtaattgtttcacctgaagttggtatgggaatcgtcccggaatataaatctgggcgcctttttcgtgatcgcatcggcacacttaatcagcgtgtcgcagcgatttgcgagagggttgtcttcgtggttgctggtctgccactagagttgaaaacgttttaagaaaacagtcggtttgaaggagttgttaatggttccagcagagctttttgcgcgtgtggaatttccggatcataaaatcctggctcagacgaaggatttccatgactccctcaccaagccacccggatctttgggcaagttggagcagatcggctgtttcatttccgcatgccagggccagattccgccacgtccactcaacaactcaaagatcgttgttttcgctggcgatcacggcgttgcaactaaaggcgtgtccgcgtacccatcctcagtaagcttgcagatggctgaaaacattacaaacggtggcgccgccatcaacgtgattgcacgcaccaccggcacgtccgtccgacttattgatacctccctcgaccacgaagcatggggcgacgagcgcgtatctaggtcctgcggatccatcgatgttgaagacgccatgacccaagaacaggtcgaacgcgcactgaagatcggtaagcgcattgcggatcaagaagtggacgcaggcgccgacattttaatccccggcgatttaggaattggcaacaccaccaccgccgctgccctcgttggaacgttcaccctcgcagagcctgttgttgtcgtaggccgcggcaccggaatcgacgatgaagcctggaaactcaaagtctccgcgatccgcgacgccatgttccgcgcccgcgacctgcgccaagaccccatcgccatcgcccggaaaatctcttccccagaccttgcagccatggcagcattcattgcccaagcagcagttcgacgcacccccgtgcttctcgacggcgttgtagtcaccgccgcagccctcctagccaacaaactggccccaggtgccaggcgttggttcatcgcaggacaccgctccaccgaaccagcgcattccgtagctctaaacgcactggcccttgatcccatcctggaacttggaatgtcccttggcgaaggctccggcgcagccaccgcactccccctggtcaagattgccgttgacctgatgaacgacatgtcgacattttcttccgccggcgtcgatggacccctaaacgcctcttccgaagcgcccgagcaaaacacggagtaactttctaagcgatgtccggcaaagcaggctttacccccgaagatcccgaagactcagacaaccgccacgggaacccccttttcgaaggtatctttaccgcacttaattggatgaccgttctccccgtccccggcgcatcagtttttgatcgcaccacgggcgcccgggtaatggcctctttgccctttgttggcttcgttttcggaatgttcaccgcgatcatcatgtgggctatcggccccatttcaggggtgatccacgtcgatggacttttagttgccgttctgatcgtcgcgttctgggaacttcttaatcggtttatgcacctcgacggcctcgcagatgtctccgatgctttgggttcctacgcagccccaccacgcgcacgagaaatccttgccgatccccgcaccggacttttcggcctcgccaccgccatgctttccgttctcctgcaggtcgctgcagtcgcatcgcttgtcgattcaaccgtgtggtggatgatctgcttcatccccgttctcggccgcatcgctggacaagtaaccgcactgaaaaaccacaacgccttctcccccaccggctttggcgcactagtcatcggaacggtgaaattttggtggatcgcgctgtggctcttggttactgctgcgttggctttttggtgcgcagaattaatttctccactttcaccgctgaccagtgttaacactccctttgtcgctggacctttccccgctgcaatcaaccccgcctggcttggaggctgggttgcgataaccgcagtcgtggcatgtgttttcgcagcacttttcagccgccgcttatcacgaagtttcggtggactcaacggagactgcatcggcgcatgcattcatctcggggcgtcgatttctgcagtgatgtttgctgttgtcgccaatgcaatggtgtaaagcggtggcgtcttttgggaatgggtggatttcatgacatctccctgggtcgatttaggccgtgccagtttgtcccaggtgtattcccttagctttagctttgttggtcgcttagacgccattctgagaggcctacttttaccagtcctcgcgtgaaaagtgagttgtttccgaagcaaccaaactggcgtgccaagacttcggaaattccgacttttctgtcacgtgtgtctggtatcgccccctcaaaaccggacaggcgtgccaaaacttccaacttttcgccaatcttgtcacgtgtgtctggtttggcttgagccgaccatcggaaccgaccaggccccacccaaaccgaccaacacccaccaactcagaccgatatgcgccccgaccgcgccccacctttaagccgctcaaacaacaatccccctgccccatcacccaatcaaggatgcggaacaaaaggatttcaaaagagtgcgggttttagacctgatcgcgaggtgtaatacgcatgcggtcaatgttcatgtgctttggaaggctcgcgacccaacgcacagactctgcgatgtcttcagcggtgaggttgaggacgtcgtcatagactgcttctgcgcgttctttatctccgccgaaacgaacgagggagaattcttccgtggcaactcgacctggatcgatctcagatacgcgaagggtctgctggtgggtttccaagcgaagcacacggttgaatgctgctacaccgaattttgctgcgttgtatccagctccgccaatgtaggggttttctcctgcaatggaaccaatgttgatcacgtgaccgtcacgtgcgatgaggccgtccatgagggctttggtgacgcgcaaagtgcccagcacgttggtttcgtacatccaggtccaatcatcaatgttggcgtcatggatgctgtctaggcctttggcaccgcctgcgttgttgaccaacagatcgacttccccaacggtgactgaaaatgcgttgactgattcttggtcagtgacatcgagtgccactgcagttccgccgatttcctgagcgagtgcttccaagcgctcgaggcgacgtgctgccacaattactttccaaccgtcagctgccaatgctcgagctgaagctgcgccaattccgcttgatccaccagttacgaccgcaactttttgcccattttcagccactgcattctccttaaagtcacctacgttttgtacagaaaccagcatgccacttgggctggacacgtcctacccctgcttccaccccctacgtctcataagagcttgtcaacgcaaaaaccccgctgcaataaatcagggtttaatgcagcggggtcttaaaaccggttgatttagccaaccagtgggtaaagccatccgttttggtcttcaacgtttccttgctgaattccggtgagggtttcacgaagcttcatcgtgatttctccgacttcattgttgttcacttcgaaggtgccgtgagctgatttcacggtgccaacaggggtgataacagctgcagtaccgcaagcaaatgcctcggtcatggcgccagactttgcgtcttcttcccactcggtggtggtgatctttcgctcttctacttcgtatcccaagtcgcgtgctacttgtagaagtgacttgcgggtgatgcctggaagtagtgagccggaaagttcaggggtgactagcttgacttggtcgccgttgcggtagatgaacccaaggttcatgccacccatttcttcgatgtacttgtgctcgatggcatccaaccatacgacctggtcacagcccttttccgcagcctgggactgggcaagcaaagaagccgcgtagttgccagcaaatttggcgtcaccagttccgccgggtgcagcgcggacgtaatcttcgctcagccagacggaaacaggcttgattccaccggtgaagtaagcgccgactggggatgcgatgaccaggaacttgtaggcatcagctgggctgacacccaagccaatttcggtggagatcatgaatgggcgcaggtagagggaagcttctccgccgtactcaggaacccaatcctgatccgcgtctaccagcagttcaagtgctttaataaagtcctcggttggcaactgtggcattgccattcgagctgctgaacgctgcatacgctcggcgttttcatcaggacggaaagtcttgatggtttcgtccgaatggcggtaggccttaattccctcaaaaattgcctgtccgtagtggaatacggtggtggcaggatccataggaatcggcgcgtatggcactaattgggcgttgtgccagccttccgactcgttccagtcaatggtcaccatgtggtcggtgaagaacttaccgaacttcggtgcggcaagaatttccttcagacgatcgggtgacgtcggattttcggtacgggttactgtgaactctaatgacgtcatggattttaaggtacacctgctacctgacagatacactagtcagccccattttatgggatgaatagccaatttcgtctcacggttttgaggaatggctaggcttgttaaaagttagtttcaatttgatgcctcccccaaccaaagcggagacacaacttcaacgagaggactcagctttcaatggcgaaaaatgcctacagcacaacagcaccaaccaaggtgtccaaggatgccactcttccagttcgtggaacggtcgctgaactcaagctcgaaaagaagttgccaaagaagattgatgccatcatcgtcgcgatttttgaaggcgaagattccatcgaactcgccggcggcgaaatcctcgatttcatcttcagtaccgagcagcaggccgacatcctcactcagctcgaagctgtcggcgcaaaggccaccgcaaacagcatcacccgcgtcccaggcaccgacgttgcgcctgtcattgcggttggtttgggcaaggctgatttgcttgacgacgagaccctccgccgcgcttccggcacggcggcccgctccctcggtggttttgaaaatgtcgccaccaccattggcgatttgggacttgcagcagcggttaccggtttcggcctcggttcttactcctacgcgggtctgcgcaaagaaaccgaagaatccaaggacaagaccaccacagtcactttcatcagcaccggcaaggacgacaaggatgtctttgtggaagctcagatcatcgtggaatctgtcctgctcgctcgcgacttggtgaacaccccttcatcacacctgtacccagagtcctactcagtaattgcatccaacgaagcgtccaagcacggcttgcagaccaccatcctggatgagaagcagcttgctgatcaaggtttcggcggcatcctcgcagtcggtaacggctcctcccgcaagcctcgtctgctgcgcatcgattggaagccacgcaaggctaagaagtcgatcgctttggttggcaagggcatcacctttgacaccggcggaatttccatcaagcctggcgcaagcatggagaacatgatctccgacatgggtggatccgcatccgtattggccaccattatcgctgcagctcgtttgaacctgtcgatcaacgtctccgcgttcctaccaatggctgagaacatgccatccggtgacgctttccgccccggcgatgtcatcactcatttcggtggtatcacctccgaaatcttgaacaccgacgctgaaggccgcctcattctggcagatgccattgcttacgcttctgaagataagcctgactacctcattgatgcggcaaccctgactggtgctcaattagtcgctttaggcctgcgtacttcaggtgtcatgggtaccgatgagttccgcgacagcgttgccaagactggccgcgaggttggcgagcaagcatgggcaatgcctcttcctgaagagctcgatgagcaggttaagtcccctgtcgctgacctgcgcaatgtcaccaattcccgtttcgcaggaatgtctgctgcgggtcgttacttgcaggaattcgttggtgccgacatcgagtgggctcacgtcgatatcgctggccctgcatacaacactgctggtgaattcggttacacgccaaagcgcgcaaccggacaaccagtgcgcaccttcgttcaggttctgaaggatctgtcggaaagctaaacgctagttaaagatcaggattctcgccgcgctcaaatttagcgcggcgagctttttgttcctcacgctttcttaagatgcgctcatattcaatgcgttcgcgcatcctttgggggtaaccggtctcctcaacatcataaaccggaacgccgagctttttcgcgataacatcaatccctttgggaccgccgatccttcggcggacaaaaaccccatgagcatcaaccaaaacgacagacatctcattgaccagcgtttccggttcaacgaatgcctcaacaaatggcttatcctgcacccattgcatcaagaattttaaatcttccgggcgcacagtatcgcccggaccgcgtggtgggcggaggttagagcgaggagttttacgaccaaataaattgaacacaagcctattgtagggggcatctgtttagcttgatatgacccgaacaccacacatcacaaattgaatcggtatcctttggggtattagtttccgttttaacgacacgacttgcgaggagtcttaaaataatggcgttctccgtagagatgcccgagctgggcgaatcagtaaccgaaggcacgatcacccagtggttgaagtctgttggtgacactgttgaggtagatgagccgttgctcgaggtctcaactgacaaggtcgacaccgagattccctctcctgtcgccggtgtcatcctagagattaaggctgaagaggatgacaccgtcgacgtcggcggtgtcattgcaataatcggcgatgctgatgagactcctgccaacgaagctcctgccgacgaggcaccagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaggaaccagttaaggaagagccaaagaaggaagagcccaagaaggaagagcccaagaaggaagcagctactacacctgctgcggcatccgcaactgtgtccgcttctggcgacaacgttccatacgtcaccccactggtgcgcaagcttgctgaaaagcacggcgttgacttgaacaccgtgaccggtaccggtatcggtggccgtatccgcaagcaggatgttttggctgctgcgaacggcgaggctgcacctgctgaggctgctgctcctgtttccgcttggtccactaagtctgttgaccctgagaaggctaagctccgtggtaccactcagaaggtcaaccgcatccgtgagatcaccgcgatgaagaccgtcgaggctctgcagatttctgctcagctcacccagctgcacgaggtcgatatgactcgcgttgctgagctgcgtaagaagaacaagcccgcgttcatcgagaagcacggtgtgaacctcacttacctgccattcttcgtgaaggcagttgtcgaggctttggtttcccatccaaacgtcaacgcgtctttcaacgcgaagaccaaggagatgacctaccactcctccgttaacctctccatcgctgttgataccccagctggtctgttgaccccagtcattcacgatgctcaggatctctccatcccagagatcgcaaaggcaattgttgacctggctgatcgttcacgcaacaacaagctgaagccaaacgatctgtccggtggcaccttcaccatcaccaacattggttctgaaggcgcactgtctgataccccaatcctggttccaccacaggctggcatcttgggcaccggcgcgatcgtgaagcgtccagttgtcatcaccgaggatggaattgattccatcgcgatccgtcagatggtcttcctaccactgacctacgaccaccaggttgtagatggcgcagatgctggtcgcttcctgaccaccatcaaggaccgccttgagaccgctaacttcgaaggcgatctgcagctctaagatctctgcaagttaaaaccgccactcccctttcactggggagtggcggttttgtcgtttcatgcatgcagtgtgtgacttatcaaccttgttagggctagggtggatatctatcatgactgcaccaagagatccttttttccccgcagatctttctatccgcgcgtctgcagagcccattgaaattcagcggttgggtttgatcgattatcaagaggcctgggattatcaagcagagcttgctacccgtagggctaatgatgaaatccctgatcagctgcttattttggagcacccgtcggtgtataccgcaggtaagcgcacccagccggaagatcttcccaccaacggactgccggtgatcaatgctgatcgtggtggtcgcatcacgtggcatggtcctggccaattggtgatctatccgatcatcaaattagccgatccgatcgatgtggttgattacgtaagacgcctcgaggaagcgctcatccaagttgtcggcgatatgggtgttgccggcgctgggcgcattgatgggcgttcgggtgtgtgggtgccagctcatgatggttgggtggacagcaaggttgcggccatcggcattcgaataactcgtggtgttgcaatgcacggtgtggccatcaactgcaacaacacgttggatttctatgagcacatcattccgtgtggcattgctgatgcaggcttgagcacactctcgagggaactgaaaagggacgtttcagttgaggaattagtcgagccatcgatccgcgcattggatgatgctttggctggtcggctggttgtttctgatcattctttcggcagcgcgcccgacccaactaagaatctccctaaacgggggtagtacgaggaattttgtcggtggggcgcctcgttgaagcgaagtagagccgattgcagaatcggcggaatgagacgtcgaaaagcgtttaagctttccctaaaaatatcactaactcgaaagatgtaaggttgcatttgtgactatcgcacctgaaggacgacgactgctacgcgtcgaagctcgaaactcagaaaccccgattgagacgaagcctcgatggattagaaaccaggtcaaaaacggacctgagtatcaggatatgaaggaacgtgtcgctggcgcatcactacacactgtgtgtcaggaggctggctgtcctaatatccatgagtgttgggaatcccgtgaggcaaccttcctcattggtggcgccaactgctctcgccgctgtgatttctgcatgatcaactcggctcgccctgagccactcgaccgcggtgagccactgcgtgtcgctgagtctgttcgtgagatgcagctgaattactccaccatcaccggtgttacccgtgatgatctggatgatgaaggcgcatggctgtactcagaagtggttcgtaagatccacgagctgaacccacacaccggtgtggaaaacctggtgcctgatttctccggcaagaaggatctgctgcaggaagtttttgaatcccgcccagaggttttcgctcacaacgtggaaactgtgccacgtattttcaagcgcattcgcccagcattccgctacgagcgttcacttgatgtgatccgtcaggctcgcgatttcggtctggtgaccaagtccaacctgattttgggcatgggtgaaaccaaggaagaaatcaccgaggcgctgcaggatctgcacgacgctggctgtgacatcatcaccatcacccagtacctgcgtcctggtcctttgttccaccccatcgagcgttgggtgaagcctgaggagttcctcgagcacgctgatgctgcaaaggaaatgggcttcgctgctgttatgtccggcccattggttcgttcctcttaccgtgcaggccgtctgtacgcgcaggccatggagttccgtggcgaggaaatcccagcacacctcgcgcacctgaaggatacttccggaggatccaccgcccaggaagcatctacacttctggagcgttacggtgcttccgaagacaccccagtggtgtccttcaactaagcccgaagttttttaaccgccgcattcgatcaccaaatgtggcggttttgcgtcgaaaagcgtgctctttctacacctctttgaggttcattttcgcggtttcctcacaatcgcctattgttaagtacatggcagacgcgaaaaagcaggcggataaagccgccaagaagcaggtaagagcagccaagaaggcacagcgcaaggagactcgctcacaaatgtggcaggtcttcaacatgcaacgcaagcaggataaggctcttattccgcttctgttgctcgctattcttggtatcccgctggtccttttcctcatcggtttgatttggggtggtcagtggtggatgcttccgatcggcattgctgcaggtgttgtagctgcaatgtttattttcacccgtcgcgttgagcgtgacgtgtacaagcgcgccgaaggtcagcagggtgctgctggttgggctgtggagaacctccgctctggcgtgggcatgacctggcgcaccaagaccgctgttgcagtgaccactcagatggatgcagtgcaccgcgtcattggtctgtgtggtgttgtgctggtcggcgagggctcccctcaccgcctgaagccaatgcttgcgcagcaaaagaagcgcctgaaccgcgtggcacctggtgttccagtgtatgaaatcatcacgggcaacggcgaaggccagacccctatcgcgaagctgcagcgtgaactggtcaagctgcctcgcaactacaagaagaacgacgtcgctgccctggccgctcgcattgaggctatggacaatgtcggaaacgctcctggcggatctttgcctaagggtccattgccaaagggcgcaagcatgtccggtatgaaccgccgcgctcgccgacaggctgaacgcaagggcgaggcttaaagccttttcgctttcgcgtcggcgccgaagttttttaaaagccgcacttcaccaacttgggtgtggtgcggtttttgcgtgctctggtttagggactggttttgggaacgtgcccagttccacatcaaataacgctgaggtcgtacttaatccatgagatcatgaatgggtgagcttccttgtagaaaatcaattactcgcgttggttgtcatcatgacggtcggactattgctcggccgcatcaaaattttcgggttccgtctcggcgtcgccgctgtactgtttgtaggtctagcgctatccaccattgagccggatatttccgtcccatccctcatttacgtggttggactgtcgctttttgtctacacgatcggtctggaagccggccctggattcttcacctccatgaaaaccactggtctgcgcaacaacgcactgaccttgggcgccatcatcgccaccacggcactcgcatgggcactcatcacagttttgaacatcgatgccgcctccggcgccggcatgctcaccggcgcgctcaccaacaccccagccatggccgcagttgttgacgcacttccttcgcttatcgacgacaccggccagcttcacctcatcgccgagctgcccgtcgtcgcatattccttggcataccccctcggtgtgctcatcgttattctctccatcgccatcttcagctctgtgttcaaagtcgaccacaacaaagaagccgaagaagcgggcgttgcggtccaggaactcaaaggccgtcgcatccgcgtcaccgtcgctgatcttccagccctggagaacatcccagagctgctcaacctccacgtcattgtgtcccgagtggaacgagacggtgagcaattcatcccgctttatggcgaacacgcacgcatcggcgatgtcttaacagtggtgggtgccgatgaagaactcaaccgcgcggaaaaagccatcggtgaactcattgacggcgacccctacagcaatgtggaacttgattaccgacgcatcttcgtctcaaacacagcagtcgtgggcactcccctatccaagctccagccactgtttaaagacatgctgatcacccgcatcaggcgcggcgacacagatttggtggcctcctccgacatgactttgcagctcggtgaccgtgtccgcgttgtcgcaccagcagaaaaactccgcgaagcaacccaattgctcggcgattcctacaagaaactctccgatttcaacctgctcccactcgctgccggcctcatgatcggtgtgcttgtcggcatggtggagttcccactaccaggtggaagctccctgaaactgggtaacgcaggtggaccgctagttgttgcgctgctgctcggcatgatcaatcgcacaggcaagttcgtctggcaaatcccctacggagcaaaccttgcccttcgccaactgggcatcacactatttttggctgccatcggtacctcagcgggcgcaggatttcgatcagcgatcagcgacccccaatcactcaccatcatcggcttcggtgcgctgctcactttgttcatctccatcacggtgctgttcgttggccacaaactgatgaaaatccccttcggtgaaaccgctggcatcctcgccggtacgcaaacccaccctgctgtgctgagttatgtgtcagatgcctcccgcaacgagctccctgccatgggttatacctctgtgtatccgctggcgatgatcgcaaagatcctggccgcccaaacgttgttgttcctacttatctagcattgaccccttaagcgcagaaggcgatttaaggggttgggttttcccgatgactagttggtccagatcgtgtatttgaggcccttaggggcgattctggggctgatgtttttgtgtccattggggctggtgtgaatactgaggagttgctgcaagattgctgttcaacttctcggcatagatcgccgagatgcctctaaatcgaacgaatttttgcataatagggacggcgaattcaatcggtggatgcaccaactacgattttttcatatacctgcgtcgcgcttttaaaaccatgcattttccgcggccggtaattcagcagatcctgtgcccgctgaacttcttcgtcacttactttagcaaaattagtgcccttcgggaaaaaatccctgaccaatccattcgtattctcattcgacccacgctgccacggcgaatgaggatcacagaaaaacaccggacacttggtcaccacgctaaaccgcgcatgctctgccatctccacaccctgatcccacgtcaaactccgacgcaacgcctgcggcaaatcacccatcatctccaccaacgcatccgtcacagtcgacgcctcatgattaacccccaaccgcttaatcaacgtcaaccggctcgtgcgctccaccaacgtcaccaacgctgtcgcttggttttcaccaccaattactaaatcgccctcccagtgcccaggcacagcacgatcagcaacttctgctgggcgttgactaatcaacgcaccctccacccacggcttacctctcgatggcaacttcgactgcggtttacgtcccttccgaccggtacgaagaaatttctccaccttcaattcatcacgcaacgcccctttaccttgaacatataacgcctggtaaatagtttcatgactaatctgcatagagctatcgttagcatgctcggtggctaaaagaccagaaatctgctccggagataatttattattcaacgcctcgaccaccacagcccgaagcctacgattggcatcaagtttcggtgttttcggacgcgctagtttcctgatcgcaccttcataggagtcgcgtgcacgataacgtccatcatcatcttgaccacgtcgaagttccctggaaattgtttgccgacaccgacccaggcgtcgaccgatttctgctgcactgaccccggtgtcatggaaacgttggatcatcattttctcttctaacgataatcgtgtgccttgtcctacgactttgatttcatcagcaaataacggcactacacacgacatataagaaaagcgtaatgatggtggtggagcaagatgaagtaaggccccacacacctgtgctggcaaccccaacgcagataactcgtcaaacagtgttgtgtagtcctcacgcaacacttgatggagtgtgcgtggcccataataagggcccatcaccggggcgtggatgaattcagctgctcgcttgccggtgcgcaaggtggctgcgcgttggcgaagcttgtctgggccttgtttgcgccatagggatatattggcccgagtcatgccgacatactcgccgatttctcggggtaggcatcctttctctagcatgctggctgcaatctcaagtttctcggcggtgtcaaaagcattgccacctcgcgggccgcgggtcagtttcaccccggcggccttcgcccactttcgcccggtgaattcactgaccccgaccgctgtagacgcagcaagacctgacataccttgattgatcatgtcgaggaaagccgtacggctttcctctgggattgttctacgaatgcccacttcgcacccttcgggttgctcgtggtgcattcaccccctgaacccgccgactaattggagccaatactcgattaggatcagcgattcagctctgtgcggggacgaaaatttgcaactctcgctttggctagctagatcaaccccaaccaagcacgaagggcgtcgatccccgcaaagatcggcgcccataaatttcactcaagacaaattacccgcggataactgcagttcccgttgccttgtcgtggagcccacggccgtcagcatccaccatcacggcaggcagaatcaagatcgtcagcagtgggcgaaccagcgcacgccaccagcccacacgttcctctgcatccacacgcgcaaggcccatgccaaacacggcatgacctggggtgcgagcaaagatccaaccggtaagccaacccaggatcacgaaaataatgagcgtggatgtcgctacatcgcccagcacatccgtgaaattggacagcacaatagcaataacccaggaaacaccccagtccacgcagaccccgccgatacgacgagccactgaggacagagagccggccccttcttgaggaagccccaacttttcgccaggccacctgccgggtgcatcaggatcgtcaaaatcagctggaatttcgggtccgtcaagccaacttctcttcggctttgccattgttacaatcaaatccaaacatgtagagggcggatactgcagtcaaaaggcgttgcttttcgacgtcgcaaagcgcaatttcctacctttaagatcctaatctgttgaggtcagccacaatttttcagaaaagttttgatagatcgacaggtaatgcattatactgacaacgtcgcaaggactacatttgcagccaagtctactacttgatcttcaaaggtcagcaattgtgaacaaagctacaaataaaccgttccgcccatgtcaatgaggagtcaccgtggcgtttgaaaccccggaagaaattgtcaagttcatcaaggatgaaaacgtcgagttcgttgacgttcgattcaccgaccttcccggcaccgagcagcacttcagcatcccagctgccagcttcgatgcagatacaatcgaagaaggtctcgcattcgacggatcctcgatccgtggcttcaccacgatcgacgaatctgacatgaatctcctgccagacctcggaacggccacccttgatccattccgcaaggcaaagaccctgaacgttaagttcttcgttcacgatcctttcacccgcgaggcattctcccgcgacccacgcaacgtggcacgcaaggcagagcagtacctggcatccaccggcattgcagacacctgcaacttcggcgccgaggctgagttctacctcttcgactccgttcgctactccaccgagatgaactccggcttctacgaagtagataccgaagaaggctggtggaaccgtggcaaggaaaccaacctcgacggcaccccaaacctgggcgcaaagaaccgcgtcaagggtggctacttcccagtagcaccatacgaccaaaccgttgacgtgcgcgatgacatggttcgcaacctcgcagcttccggcttcgctcttgagcgtttccaccacgaagtcggtggcggacagcaggaaatcaactaccgcttcaacaccatgctccacgcggcagatgatatccagaccttcaagtacatcatcaagaacaccgctcgcctccacggcaaggctgcaaccttcatgcctaagccactggctggcgacaacggttccggcatgcacgctcaccagtccctctggaaggacggcaagccactcttccacgatgagtccggctacgcaggcctgtccgacatcgcccgctactacatcggcggcatcctgcaccacgcaggcgctgttctggcgttcaccaacgcaaccctgaactcctaccaccgtctggttccaggcttcgaggctccaatcaacctggtgtactcacagcgcaaccgttccgctgctgtccgtatcccaatcaccggatccaacccgaaggcaaagcgcatcgaattccgcgctccagacccatcaggcaacccatacctgggctttgcagcgatgatgatggccggcctcgacggcatcaagaaccgcatcgagccacacgctccagtggacaaggacctctacgaactaccaccagaggaagctgcatccattccacaggcaccaacctccctggaagcatccctgaaggcactgcaggaagacaccgacttcctcaccgagtctgacgtcttcaccgaggatctcatcgaggcgtacatccagtacaagtacgacaacgagatctccccagttcgcctgcgcccaaccccgcaggaattcgaattgtacttcgactgctaattcacttagctagccgatagcggaaaccccctgaaattcttcattgaatttcagggggtttcttttttacattccacctaaaaggaaagcgccggatcctccatcatggtggatccggcgcttttatttattagtttttgggctagatgccgatcagttcagatgcaactacatcggacagtgagacggttccgtgtggttcgccacggaacaggagaaggtgatcagcgttgataattacttccaactggcgttccagggtgaatgtctcccagaccttcatttcatttgggcgaattcgtaatcccatttccttctcctttcgaaactgtttcgaaccaaaaagtttgtggttcaaatcactttatttgtttcttgcgttacacatcatcttagggggtagtttcctaaataactaagcgaggggcgcaaatcactacatatcaaccccgaaaaatacccctgatcaggtgagatgtgagggtttgctcatgtttcaaacccaaatcgcacaaacaaaaacaaacataacgggggtactgtttccttttcgatagcaaaaaagccaccctcaatccgaacaacatcggatcgaaagtggcttggaaagacgtgaaacactagaagtggacgtcgaaaagcatttttatctttgtagctccgcgctcacgctgcggtagtgctcctcgtcgaccggctcctcccaatcgacggtctcgccgtcgatgcctttgaggttaaccaccacgtggaacatcggtgcaccagacacggcgccgtgccagtggcgaaccccggcggctgcgaaaacaacatcgccaggctccaggagtcgagcaggctccccctccgcctcataaatgcccaagcccgacagcacaattatgttttgaccgactgggtgagtgtgccaattggtgcgaccgcctgcctcaaaagacacgttcacagtctcaatctgcacgttgtcatcaagcttggccatatggacctcgccagaaaaccactgtgcaggcgctggattacctaacggaaattcaatactcatcgtgcattccttttctcatatcccatgcggggcttataaccttgcggatgcttcaactgtgccaccgcatcagcgatgaccatgcggaaacgctgattagtgacaggcatcttagaaatcgggaaccatgcaacatccacgttctcgtcatcgccgacgtgaggctcatcggaatcaccagaaacaacgcaacgcatggtcgtatccatgtagctcgccacatcaccattttgataggtcacaggccccaccgcgcccacgccaagcaacgcctcaacgctgacatcaaggccggtttcctccttgacttcacgcaccgcagtcacatgaggctgctcatccggatcacaaataccggtcggtggagtccactcaccagtatcagcgcgcttgaccaacaacacatccggaaccacatggaaaggagaccccggaggaacatcacgaataacaaccgcagttacagccggcaaccacaacggatcctgaccgaccttctcccgcaaactaacaatgaactctggaaccgccatgcagcaaaacctctccaattggtaatctttgactcccaggttacgccagccctgcgacaccaccatctagggttagagtatggccttcaacaaagcgtacgatgcacttcgcgcccctcaaatcaccctcggactcatgacaccaaacggccctgaactagggcgcagtgaaatggttccaaccgaaaatagcatcgaactagccatacaagcagaagctcaaggattcagaggcatgtgggttcgagacgttccactcgcagttcctcaaggaatcactgttaccgataaacaggctacgtatttagatgatccattcttaatgctcggtgcgatggcctctgtgacctctacaatcgcgctgggcactgcagcgaccgtgcttccactcagacatccgctacatgtggcgaaatccgcgctcacccttgatcgactcagccacggacgtttcgttttaggcatcggctctggcgacaggcctgaagaattcgagatttttggcaaaagcttagacaatcgacgcgctgatattcagtctgggtgggcaattttgcgtgcagctttgtcgccggatcctgcgatgcgggccgaccttgaatttgcgccaaccacgccacctgaagctcagatccccatgatcgctgtaggttctgcccgacaaacagtgcaatggatcgcccgaaacgccgacggatgggcaacctactaccgccccgctgaagctcaagtcggacgcctcgatctctgggacaaagcccgtggtggcacccgccccttgttgatttcctccatggggctcaacctcaccgaaggaaacacccacaaagaaatcactctgggcgtagaggtaggcagccaggaactcatcgaacacctccaccgcctttcggaacttggcatcgaccacgtcatcttcaacatccagcgccgaccagcaagcgaagtactgacccagatttacgaagaagtgctcccccacctctaaaatgcctgttccggcacttcccttcggggaaacagctatggttggccacatgtcgaatgatcacccatactcccccgcaaaacgcgtcggaaatttcatcttcgtctccggcgctctttcagtagacaaggactaccaaccagtcgtcggtcgtaaagaagcagttgatgcagcacttgaacgcatgcgtgaacgcctcgccaccgctggtggtgaactcaaagacgttgtgaaactcacttactttgtcaccgacatcagcctgcgcgaagaatgcaacgagcaattccgagagcatttcctcgaaggccgcccggcacgctctttcgtgggtgcatcatcgcttccttatggtgcaactgtggaaattgatgcgattgcgatgatcgaggactaaccagagcatttttcgcacgactcggaccggggaatcaaatattctggggtcgcagacacttccatttggcgcgatctgtgtcgttcaagggactcgctcgcaccgacaagagggaaaccagacaggcgtgacaaaacttcaggtttttagccaatcttgtcacgcctgtctggttcccatcagttcagcggaaattcgacctccaactccgaaaaacttgccctcccagaatcgcttctaacggcttgactgtgacccctccatgtcaaacacccgttctaagaattggaggccttaaaacgccactcaatgcgaaaggcctggttccatcccataaagagaggaatcaggccttggcgtaaagcaagttacttcacggaagtgtttgcaatcgcatcgactatgtactgcttaactgcatcggtgtcgtttggtaggtcggaaaccttgaatggagcatccatgatcgcggcgaaacgctctggagtttgaggtgcttcaccaattgcttcgacgatggtgtcggcaaatttcactgggagtgcagtttctaggacgatgattggggtgttgacctcgtccctccactggcgtgccacgtgaacgccgtcggcggtgtggggatcgattagtacgtcgaggcgggaatgcacgtcagcgatggttgccacacggtcagcatgggtggatcgtccggaggcgaaaccgtattctgctgcagccttctcaaagttggcgtcatcagccagtgagaatccgccttggcgaacctgggtaccaaatagatcgttgacgcgggtggcgtcgcggccgagcaggtcgaagatgaaacgctcgaagttggaggcgcgggagatatccatcgaaggtgaggaggtctcgtgggtgtctgcggagctgcggactcggtagtcgccggtacggaagaactcgtcgagcacatcgttttcgttggtggccacgatgaggcgatcgatgggaagtcccatttggcgggcgatgtggcctgcgcaaatgtcaccgaagttgccggttggtacggagaagctgaccttttggtcattgctggttgtggtgcggatccatgaggaaacgtagtacacaacctgtgccataaggcgtgcccagttgatggagttcacggcaccgatgcggttgtcttttttgaattctgcgtcggcggagacagccttgactacgtcttggcaatcgtcgaaaacgccgtcgagggcgatgttgaagatgtttggatcgtcaaggccaaacatctgtgcttgctggaatggggtcatgcggccagctggggtcagcatgaatacgcggattccctcgcggccgcgcatggcgtattccgcagaggagccggtatcgccagaggtagcgcccaggatgttgatggtttcgttgcggcggcgaagctcgtattcgaaaagttcgccgagcagctgcatggccatgtctttgaatgcagcggttgggccttcggaaaggtggcccaggtaaatgttgtcctcgagttcggtgacaggaacgatgtcttcgctgttgaacttcgggtaggtgtaggcgcgtgcggtgatcgccttgatgtcttctactgggatgtcatcaacaaacagggagataacttcagcagccaaagctgcgtatccttcgttggctaatacctcacgccatttactcagctgggcatcatctagttgagggtaggttgcaggcaggtacaggccgccgtctggtgctagaccgcccagcaaaatatcactgaagcgggcaggggtacggctggcatcacgcgtcgaaatgtagtccacggatataaccctatcccaaggggtgacacaatactcccccacaccgtctcaaatatgttgaaaaaggtgacttcgcccacgcgataccctaaagtgttgctgatcactttcaattgtcggttttaggatgtgctttaaagatgacagctcccgattaccccagcttctcgaaactcgaggacaacaacaagaagaatctcaccgcagttgaaatccttaatccagcgccggtgtccaagtggaacctgtatgttctcattggttgttcggtgctcgcggtcgggctggtgctgctcgggccgtggctttacccctacgttgaggcacacatcgacggtttctgggctcaattccagtaggtctccataacgggtgatttcattcggtcgatcgaacaattatctaaatgatcacacttagccatggattgggaatcaaagtcccatattttcctgtaagagggctaccctgatcctctgtgaagaacaatgatcaacggccttcgccaagaccgcatcccagagagaaagtaactacccgcgccctcatagtttgggcagcagcctgtcttgtgtatatggcagccattaccagccgcaccagctttggtgtggctggagtggaggccattgatcgttttcaggtagacgccacacgcattgcagtattcacttctgttcaggttggtgtgtacgcgtttgctcagattccgatgggcattttgatcgataagtttggtcctcggaagctccttgccattggtgctttggtgatgggtatcggccagctcattttgggctttacggatagctattccatcgcgattattgcccgcgtgtttatcggcgccggcgatgcatcgatcttcctttcggttatgcgcatcctgccgttttggttcccactgaagcacacccctattttcacgcagttaactacctgccttggccagttgggccagttcttttctgcggtgcctttcatggcgttgttgggtgcgcagggttggcctgtggcgtttgtcagccttggttccgtggtggcactcattgcgatcgcagcgctggtggccgttcgggatactccagatcctcagccaaaacctgtcgaatcagctcaggaagcagataaaccaagcctgcgcgcgagtttgaagttgattgtccgcaatccgattacgtggcagggtttcttcattcactacgtattgatggtgtggcagaccgtgttctccatgatgtggggcgtcccgctgatgactttgggcatgggactgtctgcaacgacggctggtttggtgttgagcatcaacacgctgtgcatggtggtatcggcgccaatcatcggaataatttccgcacgccttgggtatcgccgtgacgtggtcgccattgcgctgtcgtttgttcaatccgcagtatggctggtgttcttggcctccgatgcacctcgtggtttgatggctatcatcttggtcaacatcgtcatgggtctgactactgcggcttctggttatggctttgacaccattcgtgagcgcctagatcgcaagattttggctgcgggcacgggactggcaaacatgggtggattcttgtcatcgatggttgcagcgcaggttatggggttccttcttgatcacagcgcgcatggtagcacctatacttgggtggacttccgttttggtttccttgcgattcttgtcacatgggccgtcggagtcacgggatttgttgtagcccgactcaagggtggaccgggccgcagattactcgcccagattaggtctaccaaggacttttaaagatcgggtaaaacctgtgggcgttgaaaggggcaaggtctctgccaaggcactagttgtctggttgacggcaatgtgcgtgtacatcgtggccattgctggtcgaacatcatttggtgtcgccggagtgcatgcgatcgatcgctttgatatcgacgcctcccggttggccgtgttcacttctgttcaggttggagtctatgttctcgcgcagattcccatgggcatgctggtggacaggttcgacgcccggaaactcttgctggctggcgctttaattttggcagctggccagctcattttgggtttcactgattcttatatgatcgccatttttgcccgagtgctcatcagtgttggcgattcttctgcatttttgtccgtgatgcgactgttgcccaactggttcccgatgtcttggacacctgtgttgcagcagctcacgggcgcttttggctttgtggggcagttttctccgcggtgccgtttttgcacatactcaacaccttagggtggacaattcctttcgcatcccttggcgcggtaggcatcatcgtggcgatcgcggcggccatcttggtgcgcgacgctcctgcaagcagtgagcctgtgaggcgtggggaggcgtcgataagcatcgcttttaggcttaaatccgtgctgaccagcctttattgctggcagggcgtgtttaatcactgggtgagcatgggacctgtgatggtatttttgctactgtggggcacgccgacgctgacgctggggctggacataagcagcggcgaagtgggcacggttctaacgattttcgccgtcgcaaccgtgatcaccggtcgctttccggcatcgtgtcgtcgcggctagggggccaggcgcgggatgattgggtttgtcacgccgatgattcaggcggcgttgtggatcgtgctctttttattcgctgatcgcctgtccaatccgctggtttttgtcagcgccatcatgttcgcgatttcctttagctcccccgtggcgaacttcggtttcgatacgatctgcgaaaaactcgaccgccgcgtcatggtcgccggcaccggcatggccaacatgagcgcctacatttgcgcgatgctggccacacaaatcatcggatttttactcgactggaacgccgacggccacgcctacacctggtcgaatttccaggtggcgtggcttggtctgggcgcggtgtggctggcaggcatgatcgggcttgcagtctgcctcctgctgcagcgtcgaaaaaatattgcttttcgacgctaaaacccgaccgtaaccgctagaaacgcggaccgcggtatcccggaccgaatggtccaaatgggccgaatggaccgtcattgcgtggaccgcgagggccgcgtggcccaccgaaatcaccgtaacgtccaccgcggcgaccctggccaaggccatttacgatgccatcaacgaagcttgaaataccatcgcggatctcgttgataacctcgtcgttgatctggctcttggtctgtgcgcggtagtcctcatcctcatcgatcagatcatctgcgtagatggggccgtcttcgcgagggttgtcgagctcaatttccgcctcatcaaaggcatcaaaaacatcatcaaactgaaggtcgccgtcgaattcaatgttaaggactgtaccttcaaaggtgagcttctcatccgcatcaacacccaactgatgtgcgtaaccgatgactgccgaaagttctgcgaatgttgcatctgataggtcaatggacagcttgattgccatggtggaattcctaacttcctgtcgagtaccgaagtgtgctttacacccgagactacgtaccattttccagcccgtaaaccacttaggggcaaagatcagggaactccccgactcttcgccaagacttcaccttcggttaagcaagagcctgaaaaacttgctgattaaacctgaacgcatcagatgcttcatccagcaacgcagcacgctcctctgctgttaattccaaagcatcaagctctgcacggtaattatccttgtacggtttgagcttgccaagatcttcaaagcagtagaagctcaacgcctcttccgaaactccatattccctgttcaccagacgtgcaataacctgcccaccggacaaatcacccaggtagcggacatagtgatgagcaaccaaacgagggaaatccttggccgcttcgatgctttcaagacgttccacataagacgctgtcgctgcagtggccgtgacgttgtcacgccaggtggtgttttcgtgcagcttatccagatcagcttccaacgtttccttgcgctcgaggcgtgggtccagcagaccagccgcacgggaatcctctgcacatgcacgagctgcagcttccaaagcggtgtagaacaaccatgattgctcctgcaacttgataaatgcctgcgcatcgagcttcccggtgagcagatcattcataaacgttgagtgctcggcctcttcatgggcctgcgcagtgtgggtgcgcagcgcctccgataggtcgctgttgcttgcaataatgcttgtcatagtggtgtcctttgtgagcctgcgtggccgcaaccgcggtgttatcccggtcgctgccaagcggaagttaatctgcgtctagattcctcagagaaatcctcacgctcacaaaagattaacttaggttacccacacctacatatagtcccttagttggaacaattttccgcaactttggggctcccaccacctacctaaaactcacgttgctccatagagtccacaccccagaagacttcatcaacaacctgacgactcttcctggtcactttcagatagttttccaaatactcctggtactcatttggatcccaaccagacgcaccagccacctgcgcaaggtgcggaccaggagtaggtaactgatctaatctcttacccctgaccagcacaagcgcattcctagcagccgttgccgtcagccacgcttcccgaagcgtctgcacctgcacagggttaataatctgatgcttttccagcacttcaagaacttccaacgtcgacgtattgtgcagctccggaatctcatgagcatgcatcatggtcaacaactgcacagtccactcgatgtcagttaacgctccccgacccagcttggtatgggtatttcgatcagccccgcgcggaagcctctcattatccaccctcgccttaattcgacgaacttcacgaagctgcgcctgcgttgccccgtcaactgggtagcggaaacgatcaatcgactccaagaacttaatacccagctcacgatcaccagcaacccacgcagccctcagcagcgcctgaatctcccaagtttcaccccacttttcgtagtacttcacataggaatcaacggtgcgcacaatcgcaccagatctcccttcaggacgcagccccagatccacctccaaaggtggatcaccggaaggctgcgcaagcctcgaccgcatggaatcacagatagcaatagaccatgtgacggcctcatgctcttccacaccggctaccggctcgcatacaaacatcacatcggcatcagaaccgtatccaagttctgctccacccaaacggcccatgccgatcacagaaatattggccagaggctgatctggtttctgtggatcgttaagtgcagcacggatttccgcatccaaggcagcatccaacaccgcatcccagactagtgacaagctttggcatacttcctgaacagtgagcatgttgagcaaatcagcagaggcaatgcgtgccagctcctgcctcctcagcgatcgtgcagcctggatcgcccgatcaggtgactcatgacgcgacaccgttgccttgattgctttcacaacctgagtcggtgcagtagcaagcaatttaggaccagacgccgcatcacccagctgtttcataaagtccggagtggagataatcagttcagaaatatagggagaatttcccaaaatacgcatcaaccgctgccccactacgccctcatcacgcagcatgcgcaaaaaccagctgcgatcataggaagcatcagaaagcttgcggtaattcagcaatcccgcatctggttcagctgtttgagacagccactccatcaacgtgggcagcaacatcgcctgaatcttggctttacggctagctcctgatgcaagagcagtcaggtgttcataagcacgtgatggatgcaggtatcccaatgccgccaattgtagctttgcagcatccggagacaacctgatggcatccgcgctcaagttgaccacagagttcagcagtggccgataaaacagctgactatgcaacgactgaatctgcaaacgaaccttacgcaaatgccgttccatagctttggccgaactttgctccatcgaaccagtaaacccagaagcgcgcgccaaccagcgcatattcattcggtcatcaggtttcggtaacaagtgagtgcgcttgatccgctccaattgaaggcgatgctccaacagacgcaaaaactcatacgactcaatgagattatgcccgtcttcacgacccacatatccctgatcaaccaacacatgcaaagcatttaccgttgaccgaacccgcaacgtctcatcaatgcgaccatgcaccatctgaaggagctggacagcaaactccacatccctcaaaccaccgcgaccaagcttcagctcacgatcacgcaagtcttccggaacattgtccaacactcgacggcgcatagcttggacatctgtgacaaatgattcccgctggctagccgtccaaatcaacggtgaaagagcatccacataggactgcccaaggttaatatcacccgtcatgggacgagctttcagcagtgcctgaaactcccaggtttccgcccagcgcttgtaatacgccatatgggaatccaaagagcgcacaagagcgccacttttaccttctgggcgaagtgctgcatccacctcaaagaacgagttgctaccgatgcgaatgagctctgctgcggtgcgtgttgatttagagtttgccggctctgcaacaaacaccacgtccacatctgaaatgtagttcaattcctgcgcgccacatttgcccatcgcgatgacagataaagctgaatcaaccggcttttcaccataaacattggcaattgccacagctaaagcagcagtcaaagcagcatcagctaggtcgctgagctgcatggtcactgtgctaaacggaacaggatcgccaccttttctccgcatgtcggtgggataggtacccgctaaatcatgcgcagcaatccgggtcagcaacgtgcgataagtccatttcaagactcgctctgcttcaggcccggtaacactagccgtgtaaaaaccaggcgtgctcaaatcgtctcgggcaatgttgtgtgcatcgctgaaatcctcaacctcaagcacagcaggctgagctttcacagattccagcagcgcctgaaacatctcttccctcgatggcgcatcaagttttaagagtttccactgcaaaggattggcgaccaagtgatcaccgacagccgaggaaccacccaacaatgcaaaaaggcggactcgtagtttttcatcctggcgaatctcttgatcaagctcgtttcgagcatcctcgccgattgcttcaagtgcctgatacagccgaataagaaggttcagcgcgacatcgggatcgcctgcacctgacaagccccacaacaaatccaaagactcaacattgcgccaacccaaatgctctagatctgcttgggcatgctcagatttcagcgataaagaaccaacttttggcagtgggtctctgacaaagccaacgactttacgttcacttcttaacggtcctgacatagcttctcccctccttcatcgggtcgcaattgggtcgccgtagggtttccattggagtgcaaaagtctagtaatcaagattgtttcggagctcccacggagtgatctgctcttggtagtcacgccattcacgccacttattgcgcaagaaaaactcaaaaacgtgctcaccgaggatgtcagcaacaagctctgacttttccatttggcgcagtgcctgatcaaggctgcttggcagatcgttgtagcccatggcgcgacgttcccggaagctcaagttggagatatcgtcctcagctggctcgtcgagctcataaccttctttaatgcctttcaaaccagcgccgagcatcactgaaaacgccaaatatgggttacaagcggtatcaggaagacgcacctccacccggcgcgactcctccttattcaaacggtaggtaggaacacgaaccagcgcagaacgattagatacaccccaggttgccgcagttggagcttcgtttccgtacacgatgcgtttgtaggaattgacccactggttggtcacagcggtgaattctggagcgtgatgcaagattccagcgatgaactgttttgcggttttggacagcatgtaagaatcgtctggatcgtggaacgcgttggtatcgccctcaaataaggacatgtgcgtgtgcatggcggagcctgcatgttcttggaatggcttgggcataaatgatgccccgacgccttggtcccttgccacctgtttcatgatgtagcggaaggtcatgatgttgtcggccatggtgagcgcatccgcatggcgtaaatcgatttcttgctggccaggtgcagtttcatggtgggagaactcgacagggatgccgagttcctccagcgctaccatcgcgtttcgacggaaattcggcgcctcattgaatgtggcttggtcgaaatatccgccgttgtcagtgggcacaggtggcagtccgttggtgcgaaggctttgcaccaaatagaactcaatctctggtgagatcatgcaggtcaagccttcatctgcagctagttggacctgcctgcgcagcacttggcgcgggtcagaaaaagatggctgtccgtctggcatcgtgacatcgcaaaacaggcgtgctgcctgcagttttgagatgcccgcttctagtgggaggacctggaatgtcgatggatctgggcgggcaatggtgtccgcttccgagatacgcgcgtagccctcaatggctgagccatcgaatccgatgccttcttccaacgcagactctagttctgcaggagccacaaccactgacttcaagtggccaagaatgtcagtgaaccatagacgcacaaacttaatgtcgcgttcttcaatggcgctgagtacaaattcctgttcgctgttcatgaaaactaatctacgcagcgatgggacatcgactgcgcatttgccacttttatactcccatcgggggtagtttttctcagagttactcaaggatgtcgcggttttttgatgacacgggggtgggaggtgtccagcttgggtggttcactgagaaccgcaccgaaattagaacactcctacgaataaggaaaccgcaatgactctctcccacttctccgacaacgtcaccgacgcacaagactcttaccgtcagattttagaagaaagcatcatcagccacctaggtttctgtgcgcttcgtgggtggactcccgccgatctccgccatgagttttccgccgatattgatccactcctgtttcacgcgctacctgagattgcttactcctgctccgatgagatgtacacactgtgggtgaacggaacgcgtgccgccgaaactagccacttgccggtgatgaccctggagaagattctcaccgagctaccgaagctaagtaccttgcctgactgggcaatgctcgcagagctccacgccttagacaatcaagacaccagcccaatgaccccggcacaggccaaagcgcatcatcgtatcaccgcacttttgaaaaaggcagagtccaccaacttcgaagaagaagccgaagcattgatccttaaagcagagacacttcgacagcagtaccggattgaatcactgctgattaattcctatgaccaagatgtccaagctcgatcttctacgattcgtgcatctcgggtgtatctggaagctccatggatccgacaccaatacaaactgctcaatgccattgctcgggtgcattccagcgaagcgctgctgatcaccaaatctggcatctgcaccctcttcggcgagcaagatgacgtagcccacattattgatctgttcaacagtcttaatcgacaacgtgcccacttcatgaaaacgtcagcaggtgcccgaattgcccaattaaatggcgaaacaagctcatatcgccgtagttttatgatctcctacgccagccaaatctctagacttctcatctcagcaaaagaggatgcattcaacgaactagctggtcaggcaccactagctcacagcgccatcgttcctgtcctagagaacagaagtgtgaggtcaaaggaagcactgaaggaaaccttcccgaatatgcggacaatgaccttcaaatcgaccaaccgacgaggcattattgacggatttaatgctgccaatgaatcccaccttggcggggaatctgccagcttggaagactcaacattcatgttctagagcgggtgaaagccccatttcccgcgtaacatgaggtgggcaaagacaacacaggttccctatgaaaacggggaacctgtttcacctactttttaatcacgcttcacaatcacataagtctttaaaggatggatacaacaatgggccagcatctagaagtggaaactaagttttccgtcagtgaatcaactcagattccacaacttgaggctatcgcagaagtcgaccacattgatcgcaccgaaatccaccaactaagcgctgtttactttgacaccgtagatttgcgcctcacccgcgcaaaaattaccctccgtcgccgcaccggtggaaacgatgccggctggcacattaagttccccggaaccatcggtcgccgtgaagtccaagccccacttgatggcgaaggcgcaacagaaaccctccctccacgtgagctcttgggacacatccgagcgctgatccaaggccgtgagctgacccctatcgcccaggtggataatgaacgccacatgtcttacctcgcggatgaggacggcgcagtcatcgcagaattctgcgacgatcatgtatccaccgtgtcccaccttccaggtggcgtgcgcaagcagtggcgtgagtgggaattcgaactcgctgatggcaccctcgccgaagaagccatctcagtactgctgcaatctgcacagtcagtcctgaccgcagctggagcttttgtctccaacagcccatccaaacttgtttcggcgctggacgaatcagtcaaccacgcgccaaagcctccacagatggcgcagctggacaagaatgacccagcacgtggtgttcttgcagcaatcgcagccaacgcctcaaagatcgccgaatacgatcctcgagtacgcgccgatgaatatgattcagtccaccagatgcgcgtagctacccgagaactacgcagccacctccaaacctttgagggcatcctcggcggcgaagactacctcaacctggaaaaggaactgaaggttctcgccaacatcttgggtcgcgcacgcgatgctgaagttgtggaagagcgcctcagcaacctgattaacactgaggttggcgactccatcgaggaggagactaagaaggaactgcttgaagatcttggtgcagaataccgtcgtgagcatgagcgagtagttcgtgcgctggataatgatcgctacactgatcttcttcaggcactggaaaacctccttgttgatccaccgctgatcacagaagtcgaagaacccgaagctaccgaagcccctgagtccgctgagactaccgagtccactgacgtctctgaagcaaccgaagaagcagacgcagaagctgagtctgtcgaagaagctactgagcaggaagaatcagcagacgcgcctgaatctgcagatctggacgctctcgatgaggagtactcccctggttcccaagcgccggtggaggagccgaaggaaccgaagaaggttgatgctgctctcgtacttctagagcaccttgataaggcgcacgtgaagctcgtcaagctggaaaagaaggctcgctcacagtgggatgatctcagcattccgatgctggagcgggaagaaaacttccacaacctgcgcaaggctgccaagaagcttcgctacagtgcagaggcagtgggcaaagcaaccaccgttgagacgaagaaactgtacaaggcgtgcagtggtttgcagtcagttcttggcgattaccaagatgccattacttcccgtaatgagctgttgcgccgagctcaggttgcccgccgccaaggccgggataccttcgcatacggaatcctctaccagcacgaacaaaccctgtcgagggaatacctgactggttattccgatgcgttcaagagcgtagaaaaagcctatgcaaagctggctgaagataccgccaagcgttcaaagaagaacaagcgtaagtaaacgcaggcaataaaaaactggggtcgcatctgaaagtgtgaccccagttttttttagtcttccttgtcgtcccaaatttcggctgccttggttcgggctgccgcaatggagatggcgtgatgggcttcctcttcagtgtcatatgggcccatgcgggtttcaaagccggaaaccttgccttgaaaaaccttgccggttgccagatcgtagaaccacttcaaatcttctttagccatgtgggctcagctccaatcacgaaacaaatcacggtttgtagtgtgtagcaccccactatagacctcaataagaacccgcaacggctagagtgggtctgttatttatttgtgatttctatctgtggaggcttctctcacatggccatttggcagccaactctcaccggcccgcacggcgcacaagttggatcgtctcccactgaacttcttgaagcctgcgtggctttccaccgcactttctttgacgtcaatcccaaaggcgctgctaccgcaccggcaacatggacgcttattggtgagcattcggattacgccggtggtgtggtgctggcggctaatgcgaattggcggactgcggttgccgtcaataagaaccgcgacgatgttgttaacgtatgcgttgtggatgtggagggaggcgtcgaaaagcattctttaagcactgcggacattgcagctcgcgcacacgcccatatgaaatcccatgatgttttggggcggcagactacgccgcctcagccggagggcggcgttgctgcccggttgggcgggattgcgtggacaatgatccataagcaaatgctttcgcgtgacacaaaaggcctggatatcaccgtgttgagcaccattcctgagggggtggggctgggtgaaaattccgccatggatgtggcgctcgcattggcgctgtatcgggaaaatattgaggaagcccccacgaaggcgcgcattgcggagatttgttcgcagtccgcattcatgttcagtgagacttcagtgttgcgtgcgcggcacaccgtggcgttgcggggtgaaactggacagatttcggtggttgattacgccgatggttcggtcactcaggcgccacatccggtgagtcgttccgctggtttgtcggcatttgttgttgctgcgcaaactgaaactgatccgagcatttaccgcgagatctatgctcgacatgcgtttatcgatgaagctgcgcgcgctttcagtgtggaatctttgcggttgcttcccgacgcttccactcgtgttgtggattggttgcaggccgtgattgaggtgactggtcgagaggatctgccctcgattgaacaagcccagcgctggttgaatctgtgggaaaacgaaacccggcgcgctcagaggacagccaatgccctgcgttcgagaaggctgagtgagttttctgagctgctgatggaatcccaagatgatttgagcgacaccttcgatttcccccctgctgatttggcgcttgctcgtttgtgcgtcgagcggggtgccacagctgctcggtccacgtcagcgcgcggtgtgattgcgttggttgatgcccatcatgcgcacaattttgctgcggatctcagcgaggatggcttgttggtggttcctctcgggcacggggacgtcgcggaacagggctagcacgcctacttaaccagcctgcatgcttagtcagccggccacgcaaacaaaacttcacgcttcttcaagttcgcagtcaccagtgtgacatcttggtttgttccctgttctggggcgccaatacactttgccaacactggcggtttgtacacaaaaagtcgagcagagttcttttcaggttcgctcgctacaaccaccgcgttgaagttttggccctcccagtatttcaacacggtggcttctgtgaggtcgaggcaggcattatccacttggctggccaaaatggaggagtatttcatggtgtcgagaacttgctcttccaccctggtcacccattcaggaacgtccgttccggaggcaatcgcaaggcaatgttcggtggcgaaacggtcgataagtcggcgcagcggtgcggtgacgtgagcatagtaaccaccaacaccggaatgcacttccgagtccccatttttcacgctggcgtagccggagccccgcaagagtttctgtgcttccctctgaatggccatccctttgggcgtattgggatccacactttgaagaaactcaccgatgggttgttcgggcgcgatctcaaaaccaagggcttgcgcctctgatctgaaagtagcttcggattctttggtcgccggggcgagtgtacgcagcaaaccgtgccccgctttcaccatcatctcccccgctaccatgcctgtgagcagggaaatctcggaattgtaatccatgatgtgcgggcgtggctcgatgacaatttcatagtgttcaccggcgtcatcattgggcactttcaccactcgctggctgggaatagaaagattcacggcttcgcgccgtagcgcgctttcctgcctcagctgcccgaccttgggcaataagcttatcgacggatgcaaccgaccattctcggcatctatttgagcctgatcataatccaaacgcgcccgggatttcaccaacccgcgacgcaccttggtggctgtgacttcgccacgttcatctagatcaatcgaccacacaaccgctggtctcgtttgtccctccagcaggcttgccgcatcttcggataattcctcagggtgcagtcgcgctggggaatccggcagataaatagtctgcccgcggtgaagggaaatcttttccaattcactgcccggctccacgaaggctgcgacatctgcaatcgcgtaatgcacccgaaatccgctgtcgatctcctcaatcagcacagcttgatcgaggtctctggaacctacgggatcgatggtgacaaagggcatgtgcaggagatcttcccgctcttgcgcatacctatcgacacttgacgcggcttcgtcgtggatatgagggtcaaaacctcgctccacaccgaactcttgtgccactggttcaaagtcgaggactgctgcatagagcttcatgcgctcccattgttccacagcggaaaagtatatgcaggggtgttgagtttccttgggcacagaagggtcgaggttccccagataggtcttggtatgggtcgagctcatttagcccgttaaaagcgattctgagagggttccattttgggactggtggggcaaatgtgatttctgcaggtttactgatcaaggactcaccacattcccgtggtcagaccttcaaatcgaacatatttttgcagtcaaatgacccaaacttgcaaaaatccacgacaatcggccaagtcaaggcgatttgtggtgtatattcgcacattcattccactcccggcaagcccaaggatgagcattccatcccccagcaaccagagcgccaaaaacacaaataaaaagggcgaatgagccaacctataagccggattctgtaccagttgcaaaaacaaccggcggcgatcatccatctcgtcgcagccattgctgactgcctctagcagctacctgcaggcttggcgagcagccttcaacacctgcacagacataccattggatacgtcctcatgccttgctcccggtggggtttacctggccaaatcagtcacctgacctgccggtgcgctcttaccgcaccctttcacccttaccaccaaactaagttgatggcggtttactctctgttgcactttcccgcggatcgctccgggttgttgttaacaaccaccgtgctctgtggagtccggactttcctcggccgacgcttgggagcaatcccccagttcgtcgaacgcaatcacccggttgcctcattcgcaacgttttactttacacctcgagggtggaaaaacttaaaaactccggcgagcttcgccgagcttccgtcagactgtcgtcacgcttccaggtgtgaggtgtcgttgaacagtcttacgcaggttgggccgtcttcgtaaaactctgcgatcgacagcgacgccaagtcaaggtgtgccttctgaaagaaggatgggcctgcgtccaatgcttgcctcatgatggctttgattggggtgacgtggctgaccaccaaaacattcgctgcaccgtattcgcgttggaggctttcacgagcctttttcacacgtcgattaaccgtctgcagggactcaccaccgggtggggctacagatgagtcagtgagccacttggtgtgcagttctggatcttgttcgtgggcttctgaaaatgattttccatcccacagtccaaagtcagtttcgatgagatcatcgataacacgtactttcattcccagtgcggccgctgctgcttctgcggtttgcatcgtgcgggtgagcggagaactcacaatagcgtcgatgccaccggtttgagcgagtcgtcgtgctgccgctgctgcttgtttttcaccaagttcagacagctctgggttggacctaccggagtaaaggcgtgccactgacatagcagtttggccgtggcgaagcaacaagaaacgagtgggatctgtggttgcgccgttccagttggtgggtttggtttcggtgcagttgaggtcttctttctctgagcccgcaaccgaagaagcagaagatacagaagcagaatcccctacaacacctaccggcttacctgccgctgcagcatccatcgccacgttggacaatgcgtcagctcgtttgtttttctcacgcggaatccacgtataagaaacggacccgatttcggaagcaatctccttggcttcgatcgctagaactttcatgtcggggtgtttgattttccaccggccggacatttgttcaacgacaagtttggagtccatgtagacatccacggaggtagcgccgagctcgcgggctgctttgaggccttcgagtagtccgcggtattcggcgacgttgttggtggcttttgttccgacaacataggcgatttctttgagaacttctgctttgttgtcggagtacaccacggtgccggagccggcgacgccggggtttccgcgggagccgccgtcggcctcgatgactaatttcactgggtggtctttctaagagatgtcagtgatgaggtaagagccacattctgggcactgtggaacctcatctttgggggtgttgcggatgtcggagataccggttgcagggagaaccatggcgcatccgctgcaggagcggccgttgaagagtgctgcgcctacgccgttttcgaggcgttgtgcatggaattctgccagtgcttcggagggaagtttctcttccaggtgtgcgatgactactgctgggtcttcaccttctggggttgctgctgcggcggcttctgcggctgcgcgggcgtcggcaactttgcgttcggtgtctttgacgcgagactgtgcgaggtcgcggttgttgcgcagcgcatggatttcattgtgagcttcttgcagttcgctcatgaggtcagcgatgcgggacttcgcagtgtagacgtcgtggttgaggtcgcggcgacgctcttcgtcagtttctgcaccgagtgcgtcctggccgtctttcttgcggcggcgcagtttgcgttcgtcggactgaatgcgcaggatttcgttttccatgtcatcgacagccatttgtgcagcggatgcagcgtcgcggttgcgggaaagttcagcgacagccttgtctacagcttcctgctccggggtggtcttcggtgcggagttggcgttttgggtgcgcagggtggtggcgagctgcagcagggttttgtgcagagatgggtccagcttcattgaagttctccttttttagttctcaagaatttagttcactgctcgcgcagacatggtccaggggtctgtgcggatcgaaatcacatcaacttcaacctgtggggctttgtcctgcaaaatttcttgggcttgggaagtccatggaaattcgctggcccagtgtgcagtatcgattactgcagggccaccttctcggagatattcatcaactggatggtggcgcagatcagaagtgacataaacgtccactccgagcttaatcacatcgtttaagaaactgtcacccgaccctgatgaaaccgccacacgggacaccatttgttcaggatcgccggtagcgcgcacgccccattcggtgacaggcaggttgttggccacttgttgcacgaaatccgcgaggcgcatcggctccggcaattcacccacacgacccaatccggtcgcattttctaaactctcagcgctgtgcatttcaacaatatcgaaggcaggctcctcatacggatgagcctcccgcagcaccgacgtgagccgggcgcgcaggttgcgcggtgcaacaaactcgatgcgcagctcaagggatttaaaaagcttatcgacgtccccctctgccggattcgccccctccacgggcctaaactgcccggttccttcgatctcaaaggcacactctcggtagtcgccgatcgcaccggcacctgcgtcgaaaagcatcttctttaggtacgctgcatccttgggcagaacgtgcacgccccatttgtccatgccgcctaaaagccgtgtcgcgatgggtcgcccggccgtgatgccgacgagctcggcgagtttatcgttgacacctgggcgcgcggaatccgcattagtgtgcgcggaaaacagtgccaccccgccgcgaattagggtgtgaatgaccttgccttttggctcatccgcagcaacagacgtcaccccacgcagcagcaatgggtggtgaatgatcagcatgtccaaacccatgtccacagccttgtcggccactgcctgggtgcaatcgagtgctaaaccgacacgcttcaccgactctgttggatcaccgcagatcagccccactttgtcccagctttccgccaacgccggcggataagcctcatccaaaatgcggcgaatatcgccaacggttacatcactcacgcattaactcccctggttggtaccgcatgttcgtttcccaagtctagccaagccttgaaaaattctggcaaggttaatggtgtgactacgccttctaagaaaactctgctctttgatctcgacggaaccctcgtcgattctttccccggtatccgcacttcattccttcacaccctgcacgaaaagaactgggaaatcccctctgaggaacgcatctcgcaagttccaggacctcccatggaatggacgttccaggatttgggcatgactccagagcaggcacaagacgctctgcagacctaccttgagcattacggccaggtgggttgggatctttccgaagcattccccggcatgcgagatttgctgatccgcttgaaatacgaaggtttccgtctgtgcaccgccacctccaagggcgagttctttgcggagaaggtacttcgcaaattcgagatgttcgatctcttcgaattcatgggtgccgccaccgacaacggcaaccgacgcagcaaatctgccgtgatcaaacatgtcctcgacagcgttgggttggacgaaccaaatgatattttgatgattggtgatcgatcacacgatattgaaggttcgagtgaattcggcatcgattgtgttgccgtaacctggggctacggcagcaaaactgaatgggacgctgcccgctacaccgtgagcaccgcagaagaattagaaaggatcatccatgactgggcctaaaacttcgctacctgtggaaattgttttcgtatgcaccggaaacatttgccgatcccccatgtcggaagtcatcgcgaaggcaaaagcggaagaagctggcttggaagacaacgtcattttctcctcctgtggcatgggcaattggcacgttggccaacctgctgacaagcgagctctcgcggaactgaaatcagccggttacaacggcgacacccaccgcgcagcacaacttggtcccgagcacatgcgcgcagatctcttcgtcgcgctagattccggccacgccggtgagctcgccgcaacgggtgttcccaacgacaaaatccgcctcatgcgttccttcgacccagagtccaaccccaccgacgatgtcgcagacccttactacggcacatcccaggatttcgtgctcacccgtgaaaacatcgaagatgctatgccgggccttttggagtgggtcagagatcacatccgcactgattcttaggtctttgagctaaaaagtcctaaggtagacaagtgtggacagcaaggtaaatagcccttccgggcacgataagcatgacgtgagctcccgctattccggaaattcacggtcaagaaccaaaccaaagggttggagagcattcctctcccccggttggattatctctgccttgctcatcgtctccttctcctacgcggcaatttccatgctggcgccatggcagctccacaaagacgacgacatcgtcgcccgcaacgagcagatcaccgaagccttcgagcgcgacgtcgtcccatacgcggagcttttcgacgcctccggccagattccttcatcgcaggagttcttccgcgtgtcactcaccggacagtatcttccagacagtgaggttttgctgcgccttcgccccgtcgactccggcccagcattccaatcgttaacccccttcgaacttgaaaacggacagattgtcctcgtcaaccgtggttacgaatcatcagagggcacaatcgtcccagagatcgagcctgctccttccacaccagtaaccatcaccggattcgcccgcaagaacgagggcctcccaggttctgcacctatggaagacagcggctacacccaggtctacggaattaacaccgaacagatcagtgacgtcaccggccttgatcttggcaccgactacgtccaggtcgcagaaggcgaacctggtgttttgaacccaatgccactgcctcaaatggaccgcggtaaccacctctcatacggcttccagtggatcgccttcggcatcatggcacctttagggcttggatacttcatctgggctgaaatgcgcgaacgacgccgcgacaaagcagaacgcgaacagatggccgagctaaacactcttgaaccagtggtggaaacccctgaagttgttgaaactgcagaaccaaccatcaccccggctgcatccaaacgacgttcacgctacggcgatcaacaccgcaatcactacgagaagatctccaaacgagaccaagagcgcttctaagcccgtctcatttttgcacctgccattccgtgaggatatggcaggtgctttttcatgccactatctggggttctcggtgttagatcttctgataaaaacccgatagttttcttgcgctagacactaattacggcaccgcttaagcatggtcgtgacacgtaaaacctgacttaggccattttggtgtggtgtagatcatattgacgtccaggcctgtgaaaacaggtcctcccagggctgaaatgtcagactaagagattgtgcggataggttaaggtctgtggcccggtcgggtgtcccagcggtaactagtccaggcctgtttgataagccgacgcagaatgatcaccgcgttggctaaagcgataaacgcttccacgacccgggtacatcgttcggtgcagatactaagtttcttaaaaccccggttatgccaagagttagtacgctccaccacccaccgagccccagcctgcagcggcttacctttagtgctgatcacccagctataaccacgttcgctgagtagcctgcgggttttcttcgagtcatacccagcatcgagatgcaccgtgatctgatcgggaagacaacctccaaaccggccgagcgtgtccaaggttgcagctaacaacggtgaatcatgccgattggctccggcgaccacgcacccgatcgggattttatgtccattaagttttctaggtctaacccgatgaaacggtcgtaggactccagacagatctgttctaaattcttaaatatcccggcagtgatccactcgtctcggcgggtgcgtagcgtggtggctgagcatgtggaatcgaaaaatcttgatataggaggcaccgaggacaagcactgcgatgagtttgtcgaagatgatccggtcagcaatgcgtggacggtggcaccctagtgggtgggtgttgataaccggtgggattaaggcggagaactggcgccagagggggtcgatgatagatgatgaaagggcaggcacgagcgttcctggatgatgatgaattcttggtcgaattcttatgtaccaggcctcgtgcttgttctatttcatgacccctgtgtttttccttttatccacctatccgcgcaatctcttaatcggggactcgtcgaccgccttcacgaaagagctcatagctaaaatgaatgaagtgactaactccgccgaatccacatcgtctaaaaggcctgggcgaccacgtaaagacgggcacgacgagaagatcatcgacgcaactttacggctcatcgacagcaatcgtcccgtcacggtcaatgcagttgtcaaagaaagcggagtgtcacgtgcagcggtttatcgacgctggcccgggctagtggatctagtagcggaagctttagatgccgggcgagctccagttgaaatagatacctcaggggacatcaaagagaccttgattgatgggctgtttacaaatcaggcgaaaaccactggagtctcctatcctcgtcagcgatttcgcaaacggctcgagttggtgatgtcagatcaagaattacagctcgcctaatggaattcacatgtgaggagacgtcgagaagcaaatattcgcgcgctgcaagtcgtgcaagaaaaaggccaaatccgggcggatctagacatcgaggcgtgcctcgatgcaatccttggggtgttttattaccaatcggtcgcgcgtggagtaaatttcaccgaccaaggcacaatgcaacgatgcaacgatgcagagaagctttcgaggtgatctggcatggaatggaaccttaaattcaggttctgacgaggtgcgaagcaagttgtcgcgcgccgcacctcagtatccggatcaacttaatttcgaagtgctgggttttctcatgcatacccaatgcgtaccgatgtgcccatgagcgaaaaacaggccacgataagtttcttaaaacctatcgtggcctgcttctatatttgtgcgccctgacgggctcgaaccgccgacctgctgggtgtaaaccagctgctcttccagctgagctaaaggcgcgcacgtgcttttctagaaccaccttggtggcctcgaaagcaacgagtgaaatactaacacacaatctccacagacctaaaatcgctgctcaggccgtggaaattagcgattgttaaggcttcttgtttccacgctggacgaggcaagaaccttgccaattaccgagacgttctgccttggtctgcacgagacctgccagttgagctgattcagagataactccaggagccagggctccttctttaccaatgccaggagtcaacacccagatacgaccattctcagcgagggagcggatggaatccacaagtccgtcgacgagatcgccgtcatcctcgcgccaccagagcagcacgacatcgcacagctcgtcggtttcttcatcgagtagttcctcaccgattgcatcttcgatggactcgctgatcagcgtgtcggaatcttcatcccatccaatttcttgaacgatatgacccgattgaatgccgagtagttgagcataatcctgggcaccttgcttgactgcgcccggagcgtcggccactttaataatcctcctcgtgtgggccccgatgtgtttttcgattacatggattcaacatgaaaccgcggggctattgatatatccgaattgcacattaccgtccaaccggtactttgaaccacctttccctggaattttttccttttcctccccctttacgctcaagaatcaatgaattcaatcactggccagcgattaacttttcgagttttcagtcttggatttccacaattctcttcaaaataatggtggctagatttttcatcaaaccctcaccaaaaggacatcagacctgtagttttatgcgattcgcgtcaaacgtgagagaaacatcacatctcgcgggaaactacccgataattctttgcaaaactttgcaaagcggaatgaacatgcagctagtttccgtagaaatgttctttaaaaaatccacaacaattgccaggaagcacaccgattgatggatacctgaaatcccagtgagcgcaccgctccccttacgtcacagtctgtaaaacaaatcttcggtgttgcgtatccttgttaataacttatgcgttgactcattcgtgcacttcggcgtgtcacaattaggtacgaccaagaatgggaccgggaaaccgggacgtataaacgaaataaaacattccaacaggaggtgtggaaatggccgatcaagcaaaacttggtggcaagccctcggatgactctaacttcgcgatgatccgcgatggcgtggcatcttatttgaacgactcagatccggaggagaccaacgagtggatggattcactcgacggattactccaggagtcttctccagaacgtgctcgttacctcatgcttcgtttgcttgagcgtgcatctgcaaagcgcgtatctcttcccccaatgacgtcaaccgactacgtcaacaccattccaacctctatggaacctgaattcccaggcgatgaggaaatggagaagcgttaccgtcgttggattcgctggaacgcagccatcatggttcaccgcgctcagcgaccaggcatcggcgtcggcggacacatttccacttacgcaggcgcagcccctctgtacgaagttggcttcaaccacttcttccgcggcaaggatcacccaggcggcggcgaccagatcttcttccagggccacgcatcaccaggtatgtacgcacgtgcattcatggagggtcgcctttctgaagacgatctcgatggcttccgtcaggaagtttcccgtgagcagggtggcattccgtcctaccctcacccacacggtatgaaggacttctgggagttcccaactgtgtccatgggtcttggcccaatggatgccatttaccaggcacgtttcaaccgctacctcgaaaaccgtggcatcaaggacacctctgaccagcacgtctgggccttccttggcgacggcgaaatggacgagccagaatcacgtggtctcatccagcaggctgcactgaacaacctggacaacctgaccttcgtggttaactgcaacctgcagcgtctcgacggacctgtccgcggtaacaccaagatcatccaggaactcgagtccttcttccgtggcgcaggctggtctgtgatcaaggttgtttggggtcgcgagtgggatgaacttctggagaaggaccaggatggtgcacttgttgagatcatgaacaacacctccgatggtgactaccagaccttcaaggctaacgacggcgcatatgttcgtgagcacttcttcggacgtgacccacgcaccgcaaagctcgttgagaacatgaccgacgaagaaatctggaagcttccacgtggcggccacgattaccgcaaggtttacgcagcctacaagcgagctcttgagaccaaggatcgcccaaccgtcatccttgctcacaccattaagggctacggactcggccacaacttcgaaggccgtaacgcaacccaccagatgaagaagctgacgcttgatgatctgaagttgttccgcgacaagcagggcatcccaatcaccgatgagcagctggagaaggatccttaccttcctccttactaccacccaggtgaagacgctcctgaaatcaagtacatgaaggaacgtcgcgcagcgctcggtggctacctgccagagcgtcgtgagaactacgatccaattcaggttccaccactggataagcttcgctctgtccgtaagggctccggcaagcagcagatcgctaccaccatggcgactgttcgtaccttcaaggaactgatgcgcgataagggcttggctgatcgccttgtcccaatcattcctgatgaggcacgtaccttcggtcttgactcttggttcccaaccttgaagatctacaacccgcacggtcagaactacgtgcctgttgaccacgacctgatgctctcctaccgtgaggcacctgaaggacagatcctgcacgaaggcatcaacgaggctggttccgtggcatcgttcatcgctgcgggtacctcctacgccacccacggcaaggccatgattccgctgtacatcttctactcgatgttcggattccagcgcaccggtgactccatctgggcagcagccgatcagatggcacgtggcttcctcttgggcgctaccgcaggtcgcaccaccctgaccggtgaaggcctccagcacatggatggacactcccctgtcttggcttccaccaacgagggtgtcgagacctacgacccatcctttgcgtacgagatcgcacacctggttcaccgtggcatcgaccgcatgtacggcccaggcaagggtgaagatgttatctactacatcaccatctacaacgagccaaccccacagccagctgagccagaaggactggacgtagaaggcctgcacaagggcatctacctctactcccgcggtgaaggcaccggccatgaggcaaacatcttggcttccggtgttggtatgcagtgggctctcaaggctgcatccatccttgaggctgactacggagttcgtgccaacatttactccgctacttcttgggttaacttggctcgcgatggcgctgctcgtaacaaggcacagctgcgcaacccaggtgcagatgctggcgaggcattcgtaaccacccagctgaagcagacctccggcccatacgttgcagtgtctgacttctccactgatctgccaaaccagatccgtgaatgggtcccaggcgactacaccgttctcggtgcagatggcttcggtttctctgatacccgcccagctgctcgtcgcttcttcaacatcgacgctgagtccattgttgttgcagtgctgaactccctggcacgcgaaggcaagatcgacgtctccgttgctgctcaggctgctgagaagttcaagttggatgatcctacgagtgtttccgtagatccaaacgctcctgaggaataaatcacctcaagggacagataaatcccgccgccagacgttagtctggcggcgggattcgtcgtaaagcaagctctttttagccgaggaacgccttgtcagacaatgttgcgcccttgatgttggcgaactcctgcagcaaatcgcgcacagtcaacttcgacttggtagcctgatctgcctggtagacaatctggccttcatgcatcatgatcaggcgattgcccaggcgaattgcctgttccatgttgtgcgtgaccataagcgtagtcagatttccatctgccacgatcttttcggtcaaggtggtcacaagctctgcacgctgtggatcaagcgctgcggtgtgctcatccaacagcatgattttaggttgagtaaaaccagccatcagcagggacaatgcctgacgctgaccgccagagagcaaaccaactttggcagtgagcctgttttccagacccagctcaaggcgctcaagttcctgcttgaattgctcacggcgcttcgaggtcagtgcaaagcccaatccacggcgcttgccgcgcagcaacgcgatggccagattctcttcaatggtgagattcggcgcggtgccggccagaggatcctggaaaacgcggccgatgtagcgggcacgcttgtgctctgacatcttgtttaccttgttgccgtcgatggaaatctcgccggaatcaacaagcaaacggccagaaacagcgttgagcagcgtggatttacccgcaccgttagaaccgatgacggtgacaaaatcgccctcagccatatcgagtttgagctgctgcaacgcgcggcgctcattcacagtgccggggaagaacgtcttagaaattccgttgatggataacatgtcttaagcctccactgctactggttgcttaggcttcggtgccttggagaacttcgcacgccacctcggcagcagcatggcgacaaccaccaagatcgcagaaattgccttcatatcgttggggtcaaggccaacgcgcagtgctgcgaaaatgatcaggcggtacgcgatggcaccgacgatgacagccaacacagccaaccacacgcgacgctgaccgaagatggcctggcccaaaataaccgatgcgagaccgatcacgatgaggccaatacccatcgaaatatctgcgaagccctggtactgagcgatgagtgcaccggcaagaccaacaaaaccattggacagggagatggtgaggattttggtgaaatccgttgaaacaccaaaggactgcaccatcggcccgttgtcgccggtggatcgcagcgacagtccgatatcagtgttgaggaaccagatgacgatgagtcccaaaattcccactgcaacggcgaggatcgccgggcctgcccatgtgccgaggaggccggcgtcgcgaagcggggtgaagaggttatcggtgcgcaacaatggcacgttcgcgccacccatgatgcgcaagttaaccgaccacaacgcaatcatggtcaaaatacctgcgagcaaaccatcgatcttgcccttggtgtgcagcaaaccggtgatcatgccagcgataaagccagtaacgaaaccagcggcagtagccataaggggaggccagccagacataagagctgtcgcagctgttgccgcgccagtggtcaggctgccgtcaacggtgaggtcgggaaagttgagcacacggaacgtcaaatagacgcccaatgcgacaactccgtacaacaatccgaactcaaaagcgccgatcatacgcgttcggccttatccaaaatctcttgagggatctccacgccctggcgctctgctgcatcttcgttgatcacgtaggtgaactcagttgcagtctccacaggcatggttgctgggtcttcgccgtcctgcagaatacgcagagccatctcaccagtctggcggccaagctcggtgtaatcgatacccagggttgccagtgcgccaccctcaacagtgccggactcagcgccgatcacagggatctgcttctgctcagcaacctgaaccagagaagaaataccggaaacaaccatgttgtcagttggaacgtagatgacatcaacatcgccgagagcttcaacagcctgctgaatctcgttcacggtagtgacagtctgagtattaacggacagccccagtggctcagcagccttggtgacctcatcgacctgcacctgagagttgacctcaccagacgcgtagacgatgccgatggactttgcgtcaggaaccagctgctgcaaaagctccaactgctgctcaatcggtgcgatatcagaagtaccggtgacgtttccgccaggtgcttcattagaatccaccagctctgccgacactgcatcggtaactgcggtgaacaggactgggatatcagtgatattctgcgcagttgcctgtgctgctggagttgcaacagccaacacgagatccaaattgtcagaagcgaactgctgagaaatagtcagtgcagtgccctgctcgccgttagcgttttgctcatcaaaggtgacgtcaacgcctgcctcttcaaaagcttccttgaaaccagtggtcgctgcatcaagtgcagggtgctgaacaagctggttgatgccaactcggtaagagtcgccacctgcagcatcagtggaggtggagctgtcactggaatcgcttgagcacgaagccaacgccaaggcgccaacagtaaagatgcttgcgagtaccttcgaacgggaagaaaacatggcacatctccttaaagtgttattttcaaaaaggggcagacagcgtcaacacatgtctcggataaagaaccatatgtgaaatgtctcatgatttaaactacttgttctaccagtcatatgcgcaattccccctggatatcccgcaggacatggacaaaatgggtggatagcgggtgcaccaattcaatcttttagaggccctagacaccgcggtttccttaatcgatcattaaagagggatcctctcccctaacaaacctccaaagactagagtggggaacaccatgaacgtttcctcaaataaacccagtgactctgaccgcgaatatcttcaatcagaactcacccggctcgttggccaggggcgactcgatctagatacttaccaagacgtggttgataccgtttggtctactgatgatctaggcgagttgatgaggatccgtgcccgcttcctgggagggccgcaggtttcgcagcagcggccccagcagccgccacagcattatggacaacccggctacggccaatcacctcaatatccaccgcagcagcctccgcataatcagcccggctattaccccgatcccggccctggccagcagcaaccaccgatgcaccagccaccaacgcgtccaaatcaatatcagcctggcccacaaggtggaattccagtgggtggccatctgccacaaccaggtgcagggcacatgccggaaccagaaacctccacgatgggctccatccaaaagtccggtgaatggctcgttcctgcatattcggcatacaagctcaacggtgctgaccttttcttagatatccgccatgccaccgcggctgctcctgtcattacctttgatgtcaacatgaccatgggttctatgacgctgattgttccaccgggtgtgtatgtggaagtgcagatggcttccaagaactggtcggatttcaaggttcaaacaaccaatcctctccccggtgctccccgagtgttcatcactggtgttgcacgcgcatcagggttgaaggttttcaccaagcatcctcatgagccttttgggttctggcagaaaatgtttgagtagcctcgggccacgcccgaaccaggttcctcagcccagcccgtccaaaatgttgccgatcgcattattgaggattcctggcgcttcaagcggaagcatatgacctgctccttctgcgatttgaaggcgtgcgccgggccagacttcgcagatgcggtcggcttggctaattggggtgacatcatctaattcgccggcaaggacgtagcctttgaggccttccaatgctggtgcggcatcgagttcgtcgtgttcttggaggtcgtcgaagaaaccgacgaaggtatccaagggggtttcgtggatcatggcggcgtggaaatcgatgacttcatcgtttgtgtctcgttggaagactgcggtggccagggtgggggctagaaatgtggtggcgtattggcggaatttttgggcatcgttgggggctgcttcgacggcgtttttgatgttgtcggcaaggggtgatgccaggacttgtggtagaccttgggtggataatgattcgatcgatgtggcgactagaaccatgccgacgatcctcttccgaagtgagtgatctgcccgtttaaccaggttaagtgccgtgagtccgccgagggaatgcccaaccaaaatgagcgggccggtcggtgcgtgttcgtggatggctgcgagaacatcgttcgctgttccttcgatggtgcagagctctgggcggatctggccggtggcgccgtggccgcgggcgtcgataagcacgcttttaatatttgggtaaaaggtttgtaggtagtcgacctgcatgtaatacacttcggcggcgagggtgaagccgtggatgaacacgaccgttgccgtggcattttcggcatggccaaccatgtacgtgtggatgctgaggccgtcggagtccacgatggtgtggcggtcgacgtgttttagacccggggtacggtttttgctaaatgctgcgccacgctccaggaggagttgcctgcgaccatttggcgtcatctttagccttgctttatgagcttttccccgcaatgagccgcgttgtgtatccataagtcttagcctacaagcgctttgaggtagtttgggatcatggatttcaacgacaaagccgcttcagaaaacgctgtaaagactggcgcagaaggccccaacgttttcgcgagcgtggccaagattttgcaggatgttggcggaatttcagccgaagacgtcactccggaatctcgttttactgaggatttggcagtgagctcactcaattacatcgagttgattgtcaatgcggaggacgcatttggtgttcgcattgaggacgccgatgccaaggatttgaccaccgtgcaggatttgattgactttattaacaccaataaggctgattagcgggaaaatttcgcccaaaacagggacaatggtgttatgacagtgaacatttcatatctgaccgacatggacggcgtcctcatcaaagagggcgagataattccgggtgcagatcgttttcttcagtctctcaccgataacaatgtggagtttatggttttgaccaacaactccattttcaccccgagggatctttctgcacgtcttaagacttccggtttggatatcccgccggagcgtatttggacttctgcaaccgccactgctcacttcctgaaatcccaggtcaaggagggcacagcctatgttgttggcgagtccggtctgaccactgcgttgcataccgcgggttggattttgacggatgcaaatcctgagtttgttgtcctgggcgaaacccgcacatattccttcgaggcaatcactactgcgataaatctgattttgggtggcgctcgctttatttgcaccaacccggatgtcactggaccttcaccaagtggcattttgcctgctactggctctgtcgccgcacttattaccgcagctactggcgctgagccttattacatcggcaagccaaaccctgtgatgatgcgcagtgcgctgaacaccatcggggcgcattccgagcacactgtcatgatcggcgaccgcatggacaccgacgtgaaatctggtttggaagccggcctgagcaccgtgctggttcgaagcggaatttccgacgacgccgagatccgccgctaccccttccgcccaactcacgtgatcaattccatcgccgatcttgccgattgctgggacgatcctttcggtgacggtgcatttcacgtaccagatgagcagcagttcactgactagtattctgtaggtcatggcatttgcagacattgtgcgcagcgtcgaaaaccgcaccaacgcagcgaccctcaactggtccatcaaaaatggctggaagcccgaagtcaccggattttccgggtacggctccgggcgtcgagtgcgcgtccttgcgcgcgtgctcatgtccaaccccgaaaatttgcttgtcgacgccccctcccaatcaattacccaacaagcacagcgcggttggcgccagttcttcaccatccaagtgcccaacctgccagtaactgtcaccgttggtgggaaaacagttacctcatccaccaacgacaacggctacgttgacctcctggtggaagaccacaaccttgaccccggctggcacaccatccagatccaagccgaaggttccacccccgccgaagcccgcgtcctcatcgtggaaaacaccgcccgaatcggactcatctccgacatcgacgacaccatcatggtcacctggcttccccgagcactcctcgccgcatggaactcgtgggttttgcacaccaacacccgcaaaccagtccccggaatgaaccgcttctacgaagaactcctcaaagaccaccccgacgcacccgtgttctacctctccaccggcgcatggaacacctttgaaaccctccaagagttcatcaacaaacacgcactccccgacggccccatgctgctcaccgactggggaccaacccccacaggactattccgctcaggtcaagagcacaagaaagtccaactgcgcaacctgtttatcgaataccccgacatgaaatggatcctcgtcggcgacgatggccaacacgatcccctcatctacggcgaagcagtcgaagaacaccccaaccgcatcgcaggcgttgcaatccgtgagctctcccccggcgaacatgtgctctcccacggaacaactgcgtcactgtccaccatcacgaccaacgggggccaaggagtcccagtagttcacggccgcgatggatatgagttgctgcagcgctacgagacgaagccgttcgcctgagtcctactgggtgtctcatgaaccaaaccgggtgaccagcgtcgccttaattttgggttcctcggtcacctagtttggtccttggttgcgttcgcgtatggcataaatgggcactgactatttttggggcggggccccgaggtaaaaggcgatttaagaggttgagatccccaaataggcttttggtatggaggacgcccgttgaggctcttaaaaccgattctgagagacctcggctttgtgaccagtgggacagatgagattcctgcgagcttgctgatcaagaactcaccacaattgtgtggccagaccgtcaaatcgaacatatttttgcactaactagacccaaacttgcaaaaacccaccacaaacactgtctcgccagcaatctgtggtgaattttcgcataattgttcgaccaagagtccgacggtaatcaacacgtcacaaaccaccccacaaagtgcgccaaaaacccgtggggcctccctcttcctctagagaggccccacgggctggtctatttacaccccgccgagctaaagaatcactggctttctagtcaacgattcgcagctcaacttcaaaacggtattcatcagccagagattccagcactcctcgaagtttgtcgagttcgcgtggagttccggtgatcacctctcgacactcagtgaggccaagttcgaatgggtcacggcgccatgcagtgaaccatcgtgcggtgagcgggtccctgttggagccggacagctccgaaggactcggaatacacacaaccattgcggattccacggtctgacgcagttcctttggcattccgctgatttctagaacagcggtatgcattgggagggctacatcgtcgatggattcttcgatggtagttttcagttggggcaaccccatgtcttcccagaagtctgccgtgagcaaatccgcctgatgacgggtccgggttggcacggttaatgcattgttcgtcatgttcggtttccttcggcaacacttaactgccttcaattcccgcacacatatacaagtagatatgtgcagttactaaaggaagtaagacgaggttcgtcttccccaacggcctcgagctcgcttcaaaatcccttgaatgactacacaggcgattgtggttgagtaagtggaccccggcaaccctcaacttaagctttatcccccatttactaaagctaaagttaaggtttaaacttcataacatttcggacattttcccacgtcacagaagtaacatctgtaacactggccataattaagcaccgtaattacggcaaaagtttatgaatttaactcggcccagacttcgtcattgaaggcagtccacaacggtttagcccaaggaccgaaatttcggtcagtcaaaacaaccccgacttgacctgagcctggaacagtccaaaagaatgttcccgactgtccaaagtgtccagcagtgttctccggcatcaagtcacctgtccagtgcggcgacttctgtcccttaatttcaaagcccaatccccacggacacggcttctgcatgccataaccggggacggtgccaatcagttccgggaattgcacctggaaagcctctgcaagggtttctggtgagatcagagttggtgcggtgagctcttggccgaacttggtcagatcagccactgtgctgcgcgcctcgtggcccgcagaaccccatagttcagagttctccattcccaaaggctcgaacacagcctcgcggagatactctgcaaacggcatttcagcttcagcggcaacagcatccgccaagatgtccatgccagcagaggagtaaatgcggcgctcccccactcccttttccgctaccggcttatcgaatgccacgccggaagcatgtgagagcagatgcctcactgtggatccttcaggacccatcggtgaatcgagctcaaaaacaccttcttcgatggcaacaaggaaaccgtaggtggccaggagttttgtcacactcatgagttcaaaaacacgatcgacgtcgccgtaaaagtgcacggcgccgtcggagatgacactggccgaaacattgtcgacaggccaagattcaagcgtcttaaaactctgcatggagacagaccttagcaactaatctgttaaacccctggcaacacaacgatgtatgttaagaaatttcttctacaaccttttttatagctctggttggaggaaagcttcctcgaaattcttgagcgcaaatttggttttcccggcgcggattttgcgctgacggtcggtcaaagaagggtcctcgaggttgaaaaatcccgtgtcgaaacggttggcgccccgaggataggtctgcttgcggagcccttcgaccagtgtggtgcagtagtccatgattctgtcgaattctgctgggtcgttttctgcggtgctggcgtacaactcggcgatcgctgattcttcgtcggagtggtggatttgggcggtttcatcgatgtcccaaaacaggcgaagggctagcgctcggtcgcatttggggtgtcggactactgcaaggggaaccgcgaagccgtcgtcccagttgtattcgttgatgatttcccacagtgcggtttcatcggagaggtccgcgatttcggcaggcaggtttgcttggttcatggcgaggatcctccatttttccgcgacggtttccaccgagtgtaattacgtcgataagcgtgcttgtaaataggcgcgcaagtccggcgcgtggacgtgctcgttctcaaacgcccagatctcaggctcgggcgcggcgaagacgaagtaggcgcggttgtagggcgcgcgtgcaagtgcgtcgagcgagaacagcgcgcaccgggcagggtcgagcgggcgattttgcttatcgacgagcacccccacccgttcaaactcattatccagaagatcctgcaaatgaaggcgagggtcggtgagatgatcgaggtagtcatcgggatcaatgacgtttcccaaggcctcactgtttgtccaggatcgggcgtagctatagaactccgtcagctgcgggctaagcggtagctttgtgtgcccgtctaaagccgtgagatacgccggcggttggttcgctgggccgcacagtagtggtccgaattctgcagcccattccgcttgctcgggagaaaatcggagggcatccaacgtgtcggtgatcgacacggtttctgcagcatcctcaaggacttggatccagccgtcgccaaaagagaccgtatggctcatgggctttattgtattctggcgggcgtgaataacactcccgcatggctcgttacccaagatgattccgaggatctgggttttgcgttcgattgcctcatcgttgatgcaatcactcttgatgaactcaaagaatggatttatcgagtcatcgtggaaatggatgaattcccagactatttgatcgacatcaccgatgtcagtcataagcacgatcttattcttggctaccaggatattgttggtttttggccctactcgacactataacgcaccgaggaaactgcattggtgggaattgcttacgcccgtttccctgatacccgcgacgattccatcagccgcggcaaagcacgatcagcgttggagaaatccacgggccttaaagagcgtttcgcgcgtcattttcctgcaatttccatacctgtcgatacgggtgatgctgcagatattctcgtatcgggttggtggctttcaggttctaaaaagaagatcctgactgcagcggaaatccagaccttatttatcaaccgattggccacaggtccattgagcactcaattggaaactgctaccgggttgaaactgcaggtggtgaccaatcgagagcgtatgaagatcactctcattgaacccaaaggcacatcaggacatgccatcgacccccaagctggcaagggttcaaggggtggcttcctcctggacaatggccaagaagatgaatacgacgatgtcgacaccgtcacaatccccgatgcactcaatgtcatcggttacattcttacccatggaactccacctcaagaaggctggaaggtagacgtgttggagcgttagtcctcgatgaattcttctcccatcacgatcgcctgctgaatttcttctgggctagcttctgctgcttcgcatagtttttccagcgcaacaacgatatcttcgcgcaccccggcatcaatgaaattcttctttgcggcgagctggttgatgcttgcgatgaagctgcgcagggtttcttttaagggatcctggtctggggtctttgttgaggctctcatggttcgaagggtctctttgtaaatatttccagcctttttcgcagcagacaccgggatatgaggattatcgccccagtgtctcagcggattatcgatattttccgccaaccactcgggcttccgcggaccgcgaatatcaacccacgcatcgatgcgcggttcaaaacatgcagaatagtcacctgcggaaaacccttggatgctcattcccccaaaaactactacgggtgtgaatccaatgtgcacgaatactattcgcagaactgcctgacgaataaaagccgtattgcgactacattgagatccaagaaatttcgcacctcaggagtagcgatacttcgtaaatttgggaagaaggagtagccacatgacgttgatcgacctcactgctggagtgagcgcatgagcgattcaccgtgcaccgtcgtcatcctgaaccgcacagctactgcgacttccatcctgagagatattaaagccctcaccggttacggcctgtctgagatcaggtcgcgcatcgttgcgggacttcccgtcgtgatcgaggagatgttctcaaacgcctggtacgacgaacgcgcacaactgttgctggcactgctgaccaaatggcagaacgaaggaatcacattcgagattcgggaagtcgctgaggatgatcccatcgaagcaggggcattgatctctctagaagtgctgcgaaacatcattgagccagacgataatgaatcgagggacggtatctagtggtgaacgtaaacccccggccagacgaccgggggtaaaacattcaatattggtggggccaccggggctcgaacccgggaccaatggattatgagtccacggctctaaccgactgagctatagcccctaccgctgcacgttcatgcaacgagaatcagtataactaggtccactttctaatttgaattaagccctcttcaattttccgctttcgctgcgaggtgtgccaatgtggcgcattatttaatgcatactcggcgctattttgaggagcctcatgccacagttaagcagacgccagttcttgcagacaaccgccgttactgcaggtctagccacttttgcgggcacacctgcacgcgctgaagaacgccaattccagcatggcgtggcttccggggaccccaccgcaacctctgccattttgtggactcggctgaccccaattcccgacgccacacctggaagtggccttggccccgactctcctgtcacctgggaagtctcccccactcctgatttcgccagcatcacgcgctcgggaaccgtaatcacctccgcagcaagcgatcacaccgtccacgcgcacgccacgggtttgagcccatccacccgctatttctaccgcttcatctcctccaccggcgaggtctcccctgtggggcgcacgcaaacaacatcgcttgtcgacgctcccctcccgcaccttcgctttgcccttgcgtcgtgtgccaattgggaggcaggattttttgccgcctacggcgacatcgcccggcgcgctgacgccggcgaattggagatgttgatttttttgggtgattacatctacgagtacgccaccggtatgttcgccggaaaggacggtgtggtgcgcccgcatcagcctcttcatgaaaccatcacgttggagcactaccgcactcgttatggccattaccgcagtgacaatcacttgcaggcagcgcatgcggcgttgccgtggattgtcatgtgggatgaccatgagtcggccaacaactctaatcgtgagggcgcgcagaatcattccgctgatgagggttcgtgggtggatcgtcaaaatgctgctcggcaggtctttttggagtggatgccgatccgccaggaggacacgctctatcgttccttcacttttggtgacctcgccacgctgtcacttcttgatcttcgaagtttcagagatccagcaccctcccagcaacagtggctggagggtcaacgtgcggacaccatgatggggtcgcagcagtttgagtggctgaaatccaacgtggaacacaccaccacgacgtggaatatcatcggcagctcagtgatgtttgcccccatggcaattaccgggcagcctcttttccagatccctgaacctattcccgccaatttggatcagtgggacggctactcccgtgagcgcgaccgactcctagctgtacttgccgatttcgccactccaacgctttttctatctggcgatatccactccgaatgggcaaacgccatccggtttaatggtcgagaaatcggtgtcgaggcagtatgcagctccatcacctcagctaatgtcaacgacttcgccaaactccctgaggacaatccggtctccctgcaagcggaacaagtaatccgagccaacagttcgcatgtgcgccacgttgatcttgacgcccacggctacgccacggtgaatctcacccaagatggcgcgcacatggtctggcaccgcgtcgccgatctctcccttccggactcagaagttgctccggcaattgcacttgagtggaaaccaggcgtcggattcactacttgagctgctgatttgtaggttttaagaccttgaagatatagttaattctcgttgcaaggaaccagattccaagcaatgcttattcctccatagctcagttggcagagcattcgactgttaatcgaagggtcactggttcgagcccagttggaggagcaaattgaaacccactgttttttaacagtgggttttttgcatgttccatacagttaacgaaccccaattttgtaacttccactctcctagctatgatgagtactcgttgcaaggaagtaatttctttccaatacttattcctccatagctcagttggcagagcattcgactgttaatcgaagggtcactggttcgagcccagttggaggagcaatacacacagcccgccgtttttcttaaaacggcgggttttgttgtggaggggcgcgtcgaaaagcaattttttttccaagatagctcactttattggagtcacctggcctgaaatcctctactctgggcgcatgaccattccaggagcttccacacagactgatatccctctggacacacttcttgaggattacgcgctactgtcagacactcacaccggcgctctgctgtccaacatgggcagtttggactggttgtgcctgcctcgttttgattcccaagccatgttcaccaggctgcttggtgatcgcgagcacggacactggagtttgcgtgtcccaggtggtgaggtgatcagccaaaactacctcggcgattccttcgtggtgcagaccgtgtggcgttcagagaccggtactgcccgggttgttgatttcatgccaattcacggtcaagaacaacccgatatcaccgacctggtgcgctctgtgcactgcgtggaaggcgaagtggatgtggaatcgatcctgcgcctgcgttttgattatggcgagtccactccgtatttccgcaccagcactgtcgacggcatcagcatcgtgcaggctgtcgccggccccaatgcggtatatgttcgtggacctgagatgccacaccgccctgcaaaggattgtcacagtggcaccttccacctgacggccggcgaatccgtggaatgggttctcacctgggcaccgtcgttcgaaccgcatccccccatgccggattacacccgctctttggagagcaccttgagcttctgggcatcatgggttgaagagctcccccaccagcgcctctacgacgctgaagtccgccgctccatgctcgtactgcgcgccttgaccgatctacaaaccggtggcatcgtggccgcaccgaccacctcactaccagaggatttcggaggcatccgtaactgggactaccgctacgtgtggctgcgcgactccgcactcaccattgaagccctcgtggaatacggattctcccaagcagccctccaatggcgcacctggctgctgcgcgccatcgcaggcgacccggaaaacctccgcatcatgtatggcctcggcggcgaacgacacctccctgaacgcgaactccaacacctgcgcggatacgaaaactccgtgcctgttcgcgttggcaatggagccgccgaacaataccaagcagatgtcgtcggcgaagtaatggtcgcgcttgaaaccatccgccgcgccgggtgcctcgaggacgaattctcctggggcatgcaaaaagccatcctcgatttccaagaagccaacttcgaccgcaaggatcaaggcatctgggaaatgcgctccgaaccgcaatatttcacccacggccgcgccatgatgtgggccggcttcgaccgcggcatcaaagccatcgaagaattcaacctcgacggccccatcgagcgctggcgtgaactccgcgccaaactccgcgaagaaatcatgaccaacggcttcaacgaagagatccaatccttcacccagtgctacgacaacacccaagtcgacgcctcgctgcttcagctcgcccaaataggcttcatcggcttcgacgatccaaaaatgctcagcaccgtagcgcgcattgagcaagagcttctcgacgcccacggctttcttcacaggtaccacaccgacgggtctgacggccttgccggcgacgaataccccttcctcatctgttcattctggctggtagaacaatacgcaagctccaaccgcctcgacgaggccaaagaaaagatgaaccgcatccttgccgtccaaagcccacttggcctactggctgaggaatactccacccaccatggcaggctcgctggaaactaccctcaggccttttcccacattggtctgatcagcgctgcccgtgccataaatttcgaagaagcgcgaaacaggtagagtctaaggtgtcattcttggtacaagttttatatttagggagagttatccacacatgatccagttagtgataggcgctgcagcaggctacgtgcttggcacaaaggccggccgcaagcgttaccaccagatcaaaaagggatatgaggcagcgattaactcccctgccaccaaatctgcagtaaacgccgcccgcaaagccattgccaacaagctggatccgcagccccgcatgaaggaagtaaaaaacctgcggactgcggacgggcatgaagtcctcgagcaagaccaggactaaattaccctctaaacgcccgggccaacagctcccggcgcgcctgttccagggcaaccagatcggaaaacagcgagttgtaggcttgctcatcttcagacggacgcattctttgcagctgtcctttcaagatggcgatctggttgcccactcgtgtttcctgcagcctggacaacacaccatcggtatatgattccaggtcttgcgcttccacctcgatgggttccatcgccagctctgacaccaacgacgtgcccaaaatatcagtcatattttccgatacggcaggcaaccaatcagtgccatcgagggcacgttcacatcccccagcagccgaaatggcatcgcgtaccatgcggtaggcagggttggtgaagctatcggttggcagtccatcaaagtacgatcccgcgagctccggatattgcagggcgatcttgagtgattcccgttcctgccacagcacagggttccgcggattaggcagcgccatggtgggtcgcaggctttgatcctcgagcggttgatcgaaacgctttgcacgcacaggcttcttatcgcgcttggggcgacgtgcttcctcgtgaacctgacgcagcacctctgaaggatcagaccagccgacccaaccagacagcaggcgggcgtattcagactgcagcgtcttatcgcgaatatccgccacgatggggactgcccgacgaagcgcagccagacggccttccacggtgtcgagggtgtattcgctgatgatcgattggatgacgaactcaaacatcgggatgcgtcgtgccacaagatcacgcaccgccgcatcgccacgctcaaggcgcagatcacacggatccatgccgttgggtgccacagacacaaatgattgtcctgtgaacttctgatcgccctcaaaggcacgcatggcggccttctggccggcctcatcaccatcgaaggtgtaaatcagttcaccgcggaagtagttatcatccagcatgagtcgacgaagcatctgcaagtgttcttcaccaaacgcagtgccacacgatgccacggctgtatcaatgcccgcggcatgcatggccatcacatcggtgtagccttccaccactactgcttggtggccagctgcaatggccttctttgcagaatctagaccaaagagcaccttggactttttgtacaacaacgtctcaggcgtattcatgtacttgcccattttgtcgtcatcgaaaagcttgcgggcgccaaaaccaatgacatcaccagacaggttcttgatcggccacagcaacctgcgctggaactgatcaatcggaccgcgcttacccatcttgcttagaccggcagcttctaattccttgaactcaaagcccttcttcagcaaatgcttggtcaaggtatcccagccggcaggcgcatagccacattcgaaatgataaatgtgctgctgtccgaatccacgctgcagcaaaaactccctgccaggttgtgcttcgggggtttctaattgctcgcgataaaactggtgcgcagccttattagccaaaataaggcgctggcgagttccaggttcctcacggcgccccgggccaccaccttggtaattgatctgataaccaattttctccgcacacacttccacagcctcagggaaagagatgtgttccatctccatgaggaaggagaacacatctccacctttgccggtggagaaacagtggtagtaaccacggttggggcgcacatggaacgatggtgttttttcatctttaaagggagaaagccccttgagcgaatcagcacctgccgatttcagctgcacataatcacccacgatctcctcgatcggggtgcgctcgcggattgcctgaatgtcactttccggaatacgtccctttgccatgaccatcactttagcccgtccctttagtgtgcctatattggttgtatgcaaaacagcaagaagaccctcggcggagtgctcggagtcatcgttgtcctcgctgctgcatggtttggaattgatctgtccacttcaggtgaagccaccagccaagcatcaagctcagcaactactaccactattactagctctaacactccaacatctgagtccatctccagcaacagcgacttagacggtgacagctgctccatgagtgagctgccacaagaagctgatgaggtggtcgacgatatcctcgccggtggtccttttgattacccagacaatgacggcgtgcgctttggaaactacgaaggcgtactaccgaaagagtccagcaactactaccgcgaatacaccgtggaaaccccaggacttagccaccgcggtccactgcgcattgtcaccggtggatcaaacccaactgatccagaggtgtggtactacacctcagatcactatgaaactttctgtgccatcaccgatgcggagaactaaatgaatatcgtcttgcagggatcgtttagcactcgacaggagttctttgatctcctcggtgccgctgcctggggtgtggaacgaccagcgccaaccaatctggacggcatggtcgatctgatccgggaaactggactggacacaatcaccgtcaaaggtcactggcttgtaccggcagaggaaacagaacggattgaagaagtctgcgatgatctaggcgttgatctgcgcttcaaccgtcgctaaaaacaccacaagtgccgccccttggggcggcacttggcgtcgagaagcgaaatctttttattcgacggtgacagactttgccaggttacgaggctgatccacgttgtagccctttgcggttgccacagcgcacgcaaagatctgcagaggcacggtggacagcagaggctgcatcagggttggggcctgaggaatgcggatgatgaagttggcgtaatcgttgacagcctcatcgccttcctctgcaatcacgatggtgacagcgccacgtgcacggatctcctgaatgttggagacaaccttggagtgcagggaatcgcgaccacgaggtgaaggcacgataacgaagatcggctggccttcctcaaccaaagcaattgggccgtgcttgagctcgcctgcagcgaaaccttcagcgtgcaggtatgcgatctccttgagcttcaacgcaccctcaagcgcaactgggaaaccaacgtggcggcccaggaacagcacagacttagcatctgccatatcttggccaagcttcttgatctgctcttctgcatcgatgacctgctgaatcttctcaggcatctcacgcaggctgtccagaatggaagaaacctcatcagcgaacttgttgccgcgcagctgagccaagtacaggccaagcaagtaagaagcagtgatctgagccaagaacgccttggtggacgccacagcgatctcagggccagcgtaggtgtacagggacgcatctgcttcacgtggaagagtggatccaacagtgttacaaatagcaacaaccttggcaccctgctcacgtgcgtggcgaacagccatgagggtatccatggtctcgccggactgggacaatgccacaacaagggtcttctcgttgaggattgggtcgcggtaacggaactcgtgagccagctccacctcggttgggatgcggcaccagtgctcaatggcgtaacgagcaacctggcctgcataagctgcagtaccacaagcaacaatgacgatcttgtcgacactacgcagaatagcttcatcgatgcgcagctcatcaagaacgagcttgccatcttcatcaagacggcccatcagggtatcgcgaacagctgctggctgatcgtggatttccttctccatgaaggaaccgaagccacccttttcagcagctgcagcgtcccactccacgtcgaaaggcttgccaactgcttctgatccatcaaagttggtgatggcgtaatcatcagcggtgatggtaacaacctggtcattagccagctctacagccttgcgggtgtaatcaataaagccagaaacgtcagatccgaggaagttctcgccctcgccgacgccgataaccaaaggagagttacgacgagctgcaacgatgcggtcatcgtgatcagcatgaatagctagcagggtgaaagcaccctcaaggcgctgaccggtcagctgcatagcaagggtgaggtcaccgtttgcctgagtattgtaaatttcagcaagcaaagaagcagcaacttcggtatcggtatcggatacaaagttgtagcccttagcggaaagctcagagcgcagttccgcaaagttttcgatgatgccgttgtgtactacggcaagcttgccattggaaacaacgtgggggtgagcgttgacatcggttgggccaccatgagttgcccaacgggtgtgtccaattcccaaaatagaatctggaagaggtgctttagcgatttctgcatctagtgcagcaacctttccggccttctttcggtagctaatctcaccattggcgtgaatagcaatacctgcggagtcatatccgcggtattccaggcgacgtagtccttcaacaactacatctagagcaaagtaatcacgggagtcgcccgcttggccaatatatccaacaattccacacatgcgcatgactttacaacaactttttctcgatcacttaatggacgagaataaacaatccacacagcacactgagctgggaggaccataattaagttgcagcacgcaatgtgttcaggaacgaaaaacgcactcctctagtagtgcgattttacggtagttggcagcttttttacgaaatcttgagaagcttaggattgagcggaaacttcagacaagcactgaccaacggatgattagcagtgacaccagtcagctcagaaactagagcatccgatgcttcagggttcccccgtgcttgggaaagacgcgcttgcagatcaacagcctctgcatcaccttccacatcaaacgctaatgctgctgcaaacggcagacctcagattatttgggttatgtccgtgttctgccagctctgcagcggggccaatgaatcgctcgttggcagaaatctcacggattggtacgtcccacacgattgaccgtgtcaggcaatgaggggctcgtgagacgatgcaggatcttttctacataagcctttcgaacctccggttcaaatcggaaaccgtggccgaagatttgagacccacaaaatttataaaattttatttacttggcagaaaccgactgatccgacaaatcacttttctaaaccctcgatatgtaagcaataagctaaatgggtttgacccgcttctggggaattgtgacttttggggtttcgacccagaacgaacgcccgatcacaccagggtgcataacgtgctgatactttacagcggtaaacgactcagacacccacaaaccttaaaggcgaaatttttgggcagcgtgatttgatccctgtttagtccccgagcacgaattcatgttcgctagccttaaggccactacttcacccccatctgacacgacacaggtttaagccagaacattttattagcctcactgaaacttactgctgctctaaccaattatcccaaaaatcctgagatgtcagcagcattccgggcaaggcgttccagacgagactccgtcatcgacgcaatctgatcaacaatcacacggatctgttccgattctgaatccgcttcaataaaccactggcgatacatcggatccaacgatcccggagcccccagcaccaggtagtcaaaaacccggaagatacgatcccgttgcctgttttggcgcgcaaggtgccctgggtcatccatcacgtagagaaccgctaacgttttgagcagttttacttcactggccgctgtttctggaatgatcaaatcgccgtgcatgcgtcccacatcaatgccagcgtgtgttttctttgttgactcgatggtagagccaacgtatcttcccactagttctgaagtcatcgccttcagcgcagcgtaggaacgcagtgagaaatcaaaatccgcagcggcagccaccaccggaagttcccgcaacgatgctgcaccctcgatgagctctgcaggcgaacctccgaaagcagctgctcctttgtctgccaaagctgctaattcaaccaggtcccacagcacttttaagtcgatacgcccggatacaataccgtcttccacatcgtgcaccgagtaggcaatgtcatcagaaaagtccatgacctgcgcttcgatcggtgggcgaagatcctcatggccttgtctaatccaagcgaggatttctgcgtcctcgtcataagcactgtatttcttattgacactgccatccgcatttgttttagcccacggatacttacatgcagcatcaagagcagcccgcgacaagttcagcccaaagctctccccctcatcagagacaatttttggctccagacgcgtgagaatacgcaaggtttgggcgttgccctcaaatcctccacaggccgcagcaacttcattcaacgcgttttcaccgttgtgtccatacggcggatgcccaatgtcatggcacagccctgccagatcgcacagatcaggatccaaatccagtccagctccgattccccgtgcaatttgagctacttccaaagagtgcgtcagccgggtgcgcggagtatcaccatcattggggccaaccacttgggttttatccgcgaggcgtcgaagagcagcagaatgcagcacgcgagcccggtcgcgggcgaacgcgctgcgggtgtctacggcgctggtacgcagttggctggacttggcgcgctcaggctggcgtcgaaaagcgtctgcgtcggaataggggtacatctactttttcagcctccgaagttgctcatggcgtgcacgccgcgaagggcgcagcagaccttggattgcgcgcaaagatgcttccaccttatcggccacccgttcacccaagagccgcgacacgtcctgtactactaccccgccccactcatgggacaaggtcagaaaataaactatcgacggaaacttcgcgggactataggttgtcggggaaggtttcgcgtcaaagcccatgcgtcgcgcgatgcgcaccgcccgatacgaatggttcggatcagtaacaatcagcacccgaccaagcttttccggatcaagcgcctcataggaggagacagtgtcattgccaactgcagagacaaaaatcagatccggatccacgccctctttgatcaaatactcccgcgcgacttctgcttcggtgaaacgatcgccaggaagttttccgccgacagtatatacatgctggatttcatgaagacgccacagcttcgcggcatgcctcaaacgagcagcaaactgcctcgatggaactccatcatattgagctgtgcccaacaccaaaattgaatcaattttgtgccgattattaggcgttctgagcatcgaatacgccaccaccctcagggctggctgcactactgcggttaagagtaaactcttggctaaaaatcttctcacgttaactagtgtgccagctggactcgtctaaggtggggaccatgaactttagtttggtgcatcttcgggaaaacgtccgccgtgtatcggtcactgtggcaattggagctggcgcgctccttatcagtggaccattttttactgctcacactgcagaagccacagaaacatatgtcttggctgaatcaccagaattttaccaagacaatgtcactgactacaccggccagatttcctcgtccgatatcaccaacattcaggctgccatcgatgatgtaaaggcatctgaacaaaaggttattttcgttgttttcctaagctctttcgacggagttgaccctgaaacgtggacgcagcaagcactccaagccaacggcggcggaaacgtcttgatttatgcactcgctcccgaggaacggcagtacggcatccaaggtggtactcaatggaccgacgctgaactcgacgccgccaacaacgctgctttccaggcactttcccaagaagattgggcaggctctgcactagcgctggcagaatcagttggttctagttcttccagctcttcgggctcgtccagctcttccgatttttccggcgcttggttggctgctgcgggcgttggcacagtggccgctggtggcggaatttgggcctattcccgcagccgcaagaagaaaacaagtgctgcaaccttggaagatgcacgcgaaatcgacccgcgcgataccaaccgcctcatgcagcttcccatggaaactctcgaacaccttgcccaagaagagctcacctccactgatgactccatccgtcgcggaaaagaagagctcgctatcgctacctccgagttcggaccagagcgcacccgcagcttcaaccgcgccatgaaccactccaccggcaccctgcaaaaagcctttgagattcagcagcgcctcaacgattctatcccagaatccgaagccgaacgtcaatccatgctggtagaaatcatttcatcctgtggccaagccgacgatgccctcgacgccgaagcccaaaactttgccgatatgcgcaacctgctgatcaacgcgggcagcaaattggatgctctcacccaaaaatccgtcgacctgcgcacccgcctccccaaggcccaagaaacactcgctggcctgcgcactcgctactcagcagaggtccttgaaagcatcgacgacaacgtcgacctcgccagcgcttcgctcgacgaagcagaagaagtcctgccacaggcgtacgagatagagtccatgcccgcaggcgagcagggcgggcttatcgacgcgatccgtcacatcgagcacgccatcactaccgcagacaaactcctcgcgggcgtcgagcatgccgatgaaaacatctccacagccaaagcaaacgttgccgatctgatccaagaaatctcagacgaaatcaacgaagccggccaactcaaacaaagcgcaggagccgacggtgcccgtgccgactgggcctccctcgacgatgctgtccgcgcagccagcgcagcactaatcaccgcatcagcagacgccgaaaaggatccgctcggaacctacacagaacttgtcgatgtcgactccgccctcgacactcaacttgacacacttcgcgccaccgcagctgatcaagcccgccagctacgcgtattcgaccaacagctgcaatctgcaagaagccaaatccaaaaggccgaagacctcatctccacccgcggtcgcatcgtaaaatccgaagcccgcacccacctggccaacgcacaaaagctgtacgccatggcacaacaaaaccgcacccgcgacacccgtgcaggaattgattacggacgtcaagcagcagtcgcagcccaacgcgccagcaagtcagcacaaaacgacatcaccacctacaacaatcgccacaattccggtggcggaaccaccggtgcgattgtcaccggcatggtgatcaactcgattctcaacagcggccgcggtggcggtttcggtggaggcggaggctttggtggaggcggtggcggcttcagcggtggtggcggtggcggaggagggttccgcggaggccgcttctagcctgaaacgagcaaaaccaagtgaccgaagagacctcgcataggacattttcggtcacctgggatggcagcaaacttgaacttggctcaaattagtgccgaaggcgagtcaacgaccctaatcctccacttctttaaatgagatagaggtctttacggaactctttccttcacaccgagggcaacttagtgcggaaaacctatgattcaccagcccaaacatcctggtcagggcgccaatgtgatcttccacaacacaaaatgagcaaagtcattacacggcggtttaagcggttgggatcgtggaacgggtatttgcgtcggttagtgggtgggaggctcttaaacgcgattctgagagggcactttctgggcctcccaatgggagtttacggccgaagttggagggggctgcattttgaggccaaacgccggttggggaatggggatcttggtttgatattgcagtatcggcgccggaaagtgttcatttaaggccaaacgcggggtcggcataagcagttttggttcgaaacgaacgtggcctagctgacttggctcaaattagtgccgaaagcgagtccacgaccctaatcctccacttctacagatgagatagaggtctttacggaacgatttctttcacaccgaaggaaactaagtgcggagattggatccttcaaaggaaatgatcccccggctacaaaaaacaggtggaggggtgcgtcgataagcaaaaagcttttaaattttcggccggcgcacggccgaatccaccaggacgcacgcccagctcaaaaatactgcgtcgacgaacggcaacgcctcgctgcccgcggtgcccacaatgaattcgactttaccgctggtcatcgggcgaagccgcgccacttccaccccattgttggtgatcaggcgttctttacgccacggcgacaccctttttagtgaatacgtccggcgcccgcacaccgcagtgagatcccccacagtgaaagaattctgagtcatcgtatagacctcacccccggacagtgttgcgcggcaacgaaaacgcatggtgccgggggtggattcgatgagtagtcgttcgcgatccacgtagaggacgtcggagcgaacgtcggcgatgacctcgccggactcgtcgaaaagttcattaccgagccacacccatgtttcttctgtgtggctaccgaagatgcctgctttggggcgctgagcgtctaccattgcatggtccttttagctgaaagtgaggaaaataatgattggcgtcaaaatgatcaaaaacagagtcagtccccaactggagcccaacatgcgggattccagagttttccgagcaacccacgacaagaaaatttcctgctcctgggtgacttctacgtcaggctcaaactccacaatcgcgcgacgcacaccgttgttcataccggtaaactgagcgactttattctcttcagaatcgtcgataatccaattgtttttatcttcattaacagcagccatcgcggtgccgtccatgtcgatttcaatccgcttggacttggtaaaggtcttctcacctgcattcgcgctgaacacacgaccatcaggaagcttggcagttgccgttccatcaatactgaaggacagttcccactgctgctcatcaaccgttgcggtggtttcaaatgatttgctgggaacttcaccgaaagtggctaaaaccttttcatcagcactatcagtggtgctgcgaagtaggttaataaaaagcttcccgtcattcttgaaacgcttgccccaagacgtataggaggtcacaatcagatccttcgaagtcatgcgaacagaatagcaccggcctgttaagccggtgctatatgttgctgcgattacattcgccttagcgaattatcgctctattggttgccgtttagcagccgatgaggcgctgagccaagtaaccctgcagctcatcaagtggaacacgaacctgctccatggtgtcgcgctcacgcacggtcacagcgttgtcctcgagagaatcaaagtcaacggtgacgcagaatggagtaccgatctcgtcctgacgacggtaacggcgaccaatcgcacctgaagtgtcgtaatcaacgttccagaattcacgcagctctgctgcgagcttttccgccaaaggcgtcaaagtgtccttctttgacagcggcaagaccgcaaccttaaccggcgcaaggcgacggtcaagcttcagaacaacacgcttatcgacgccaccctttgagtttggtgcttcgtcctcgtgataagcatccatcaggaacatcatcattgcgcgaccaagacctgcagcaggctcgattacgaaaggaatccaacgctcattggtctcctgatcgaagaatgacaggtcctcaccagagccctcagagtgcacgcgaagatcgtaatcagtacggttcgcgatcccctccaactcgccccacttggtgttagcaaagttgaatgcgtactcaatatcaacagtgcgcttggagtagtgagacagcttctcctgagggtgctcgtacagacgcaggttctcaggcttaatgcccaggttgatgtaccactgcaggcgagtatcaatccagtgctggtgccactcttcgtcctcaccaggcttgacgaagaactccatctccatctgctcgaactcacgagtacggaaaatgaagttacctggggtgatctcgttacggaaagacttaccgatgttcgcgataccgaaaggtggcttcatacgtgaagtgttcatcacgttcttgaagttcacgaagataccctgagcagtttcagggcgcaggtagtgcagaccctcttcgtcgtccacaggtcccaagaaagtcttcagaagaccagagaacgccttaggctcagtccagttacctggctggccggtctctggatcgttgatgtcagccaagccgtttacaggtgggtgaccatgcttctcttcgtactgctccagcaggtggtccgcacggtaacgcttgtgggtgttcaaagactcaaccagtgggtcagtgaagacctcaacgtggccggaagttacccacacctggcgaggaaggatgacagaagtatcaacacccacaacatctgggcgggaagtaaccatagaacgccaccactggcgcttgatgttttccttcagctccacacccagcgggccgtagtcccacgcagagcgggtaccgccgtagatctcaccacaggggtacaccagtccacgtcgtttacacaggttaaccacggtgtcgatgatcgattgctgagccacgtcggatgctctcctccacgtcgaatgaaaaaataaccgtcccttttaggacatacccaaccaatcctagcccaactaacgatgttgcttccgctgaccccgtcattttgcggtcttcgcgatgtaaactagttctaataactattttttcatttccctcataaaaggtttatatagaaggtaaaatagcaagcgtgctagatccattccagacctagcctaaggacggaaggacttccccgtggctcaacactcaaatcggaatttcgtcacccctgcagaagagtccgaatccacagcatcagctgagcttcagaaacttgcaacagcaaaaaacatcaaagcgatcagcctgctgattagggcactagattcccccttaagaatcgaaatcatcctcgccctcaatgaaaggccccactacgtccacgaattggtcaagctagtaaaaagttcgcaaccactagtgagccagcacctcaaagtccttaaaactgcaggtatcgtcgacgcagaacgtcaaggccggcaaatgacttattcacttgccgaaccactcgtcctcgacatacttctcctggcactaaacgcaggggttgacacatctgggtagactatcgaagtacattttgtgtcattgaggaggatcaacggtgggtatcaatcgcatcagccaaggctctgccccgaagctgggagtgcgaagcaccagacagcgaaaagccgtaattgacgttcttgaggaaatcgataacttcgcttccgccaaagaaatccatcacgagctatccaccagggaacacaacgtcggcctcacaaccgtctaccgaaccctccaatccctcgccgacatcggagcagtcgacgtacttaccgtcacgggtggagaaactctgtaccgccaatgccacgacgagggacaccaccatcacctggtctgcaccaattgcggtcgcacagtcgaaatcgatggcggtccagtagagacatgggcacaggaaattgccactaaaaacggctttgctctcagtagtcacgaggctgaaatctttggactttgcgctgattgtaaggaaaaagttacgtagttcaaggacatatgaagctgtcgaacatgtgagtgctcgacagcttttctatttcgaaaaatagccttgtattcgaaaatttgatcgggtatggtggttggtattagcacagggaactaaacgggaaagggggaagacaccatgagcatcaccacacacgtccaagcactcaccacagcactcaacgccatcgacaaccatttggccagcatgcttgaccatggtgtcaccccagaccaatacaaggccatcgagcccgacctcatcgccctagaacacaccatcaaccaccacgccaccatcgccgcccaaaccaccgccctcgccgaacgcaccaatgctgcgcagtcgattggctccacccacctcatcgactacctcaccaccaccttcggcctatctaaagcacgcgcccaccaccgcatcaatctcgcccactccctctaccccataccgaagccaaactctggatctggcaacggcggtaatggtggcaatcccgatggcggtcctgatggtggcgactcgggtgatgacgactccggcgatgatgaccccgaccccgaaccggacaagcctgaagacggcaaacctgatagtgataagccccgtaggccacggatcagcgcggaaaaacacgccatcatcaccgacgaactcgcccgcctcaacccgaataccacacccagcgccgaggaactacgcacccaagccctgagtcaagcgatctggcgcaccccagaagacctccgcacgtggctacgccaccaggtcaccaccgcgaacaaaaacaaccccaaccccatcaccgccatgaaaaggcgctacctctcagtaggtaaacccgatgccgacaacatggtccgcatcagcggcctcgtgcccgcagccaccgcagcactgatcaccgcgaacaccgcaccgttaaccaaacgtggcaacctcgtggatctaccagcagcagaagatatgcgcacccgcgggcaacgccatgcggatgcgttgcatcacatcatggagatctacaaccacggtattgtcaccccagctcgtggtggaacagccagcatcatcatctccatgaccaccgatgatcttgacgagatcaaccacggtgatcatggcgatggcagtctacttaacaacctgtaccccacgaacacgggttactcattgaacttggcggagatcatgaacctcatcgctgcgaaatacgacttcgctgtgctcctcgatggtgagacggggcagccgttgaacgtcaataggatgcagcgctcagcgaacctgactcaacgcatcgcgttgtttgcttctgagttggtgtgctcggcacccaattgtgacaggccgcagttagagtgcgaggttcatcatttagatccctggatgagaggtgggctgaccaacctggtcaatctcacgcatcagtgctttaatcaccacccacgcaacgatgattccaggagtggggtcaatggtaaagggtttatggaccgcgatcctgctactggaagagtggggcactacccagtgggtggtgaggggccggtgtttaaccggtcggctgctgctgatagttcgggtggtgcgtgggccagacgtaaacatcatggcccaccacccgaaccgccgagcccgccggatccacctggtcctgagccggatcctggtgatgagggcagattgttctagcccttgttattgctgagttgttgtcatgttgttgtgcctgttgtcagtcgccccagtgtgtctgataccggacacacccatgccttgcatcaacataccgacaagccagcacaccccgaactggccagccgggcccgggccgcctgcaacctgacgtcgagaagcaagagcttttaaaggatcatgccgaacaggaggccgagcacgtaggtgaccagcgccgcgccgtagccgatcgacagctgacgcaccgcgcggattcccggtggctttcccgatagcaggccggtggtcgcgcccgttgccatcagtgatagtccgacgaggactagggacaccactgccccggcgaggccttccatgccgaagacgtatgggacgatcgggaggaatgcgccgatggcaaaggacaggaagctgaatgtggcggccgaacgagcggagccggcgctttggatttcggtgctgccgaggacgttgtcgctgatgcgtttttggtcgctgattctttggaaaacttgtgacgcttttgcccgcgcttcgtcttcgctcattccgcgggctcggtagacgagttccagttcgttggattcgacgtcgagggcgtggagggcttcgcgggctttggggtctgggagggaggcgtcgagaagctctgtttgggagcgcactgagatgtattcgccggcggccatggatagcgcgccggagagcagaccggaaatgccggtgatgagaacaatttgggcgggcacgccggtggccatgacacccatgacgagggcgacgttggagaccaggccgtcgttgattccgaatacggcggcacggaagttgccgctcatgcgttctctgccgcggctggctaggcctcgaacgacttcggcgtggatgcgttcgtcggcgctgatttggcgggaggcgtcggcatcgtcgtcgtaggggctgcgcgtttcggcggactgcatgagtgccagggtgaacacggagccgaatcggcgtgctagaaaaccgagcaggcgggttttgacgtcggcttttggtgggttttcggcatcagggccgagcttttccacccagtaagcggcgtgtcggtgttcagcgtcggcgagcgctaggaggatgtctcgctcttcgccttcgcgtcgtttggccaggtcgcggtaggctgcggcctctgcttgctcattggccaggtatccgcgccagcgtttgatttgggctggcgtcggctggttggtgggcattatgcgcttccgaatctgcgatcccgcttggcgtattccaggaccgcgtcgtacagatcttgctgcgtgaaatcagggaacagcttgtcttggtagaccatttccgcgtaggcagactgccacagcaggaagtttgacgtgcgcttctcaccggatgggcgcaggaacaggtcgacgtctggcatgtcaggttcgtcgaggaagttcgggaaggtcttctcagtgatttgttccgggcgcagtttgccttcagctgcaaggcgggcgatgtcgcgggctgcgtcgatgatttcggcgcgtccaccatagttcacacacatggccaaggtcatggtggtgttgtctttggttagctcttccgcagtttccagctcacggataaccgaacgccacaggcggggacgacggccaacccaacgcacacgaacgcccttttcatgtaggtcatcgcgttgtcgtcgcagcacatctcggttgaatcccatgaggaaacggacctcatcggtggaacgacgccagttttcagtagagaaggcataagcagaaaggtacggaacaccaagttcaatgcatgcatcaacaacatcaagcaggactgcctcgccacgcttatggccttcggtgcgcttcatgccacgctcggtagcccagcgtccatttccatccatgacaagcgcaatatgcttgggtaggaattgggcagggatttcgggtacttggaattcactcacctaagctattctgccatgcaaactatttgtgtttgccatttagcctgatctcagggtctggaggggctgcagttcagccaggcacctcggccttaaagccggacgcctaagcctaagcactaggcctgatccagcaccgccagcgtgggcagctttctttcaatatgccactgcagatgcgcggttgtcagttggtgaatggtggtttgctgctctgggtgttcccggggaatgcgggctgcttggccgttggcgaccaaccacatcatgtgtagtgcttctggtgggacttcggcgcttcccggcggtcggcagtacaggcacactgccccgccgacgcctgggtggaatgcgttgtgaggtcctggtcggccgcaggctgcgcagtcgaaaaggcttggtgcccagccggcgtggttcatggcgcggagcatgaactcgtctaggttgaggatgggttctggggagtcctgaatgtttttcaacgcccgggtggtttcttcaaacaggtgcggatcgttttccagtcctgcgatgtgggtggcgatttccaggatggcggacgcacaggaataccgagtgaagtcctcgatgatgcctgatgcgtagtagccgacggtgtccgcgccagagatggtggacagttttctacctgggtagagctgcacgtcgagttccacaaaaagctgcagccttgacccaaaccgggatttggatcggcgtactcctttggcaactccgcgcacgatgccgtggtctcgggtgagcagcacaataatgcggtcggcttcgccaaaatcataagttttgactactagcgcgcggtcccgaaaactgtccctacgcatgaactcacccccttaaagctagaagcccaggcggttcaaagcctttggatcggattgccagttcttcagcaccttgatgcgcaggtcaaggaatacgttttggccgaggatcttgatgatgtcttggcgtgaggtgtggatgatgcgccccaggcgctgtcccttgtgtccgacgatgatgtctttctgaccaacacgctcgacgtagatgatggcgtgcacagccaggacaccgttgcgttctgggtctggcaggatttcatcaacctcaactgcgacggagtgcggcagttcgttcttcaagccagacagtgctgcttcgcggatggcttccgcgatgcgggtgttggtgtcctcatcggtgatgtgatcatccgggtagaacttggggccttcaggcagcaggtcggtcatgaccttaataagcgtttcgacgttttcccccgaggtggaagacactgggactacctcgctgtttccgccgagcagctcatggacagccatcagttgggccgcaaccaagtcacgtgagacgctgtctgctttggtgatgatgccgaggataggagttttaggcgataccttgcggactgcttcaaggatccagcggtcgccaggaccaatcttctcgtttgctggaacggtgaaaccgatcaggtcgacgtcagcgtaggtgtctttaactgcttcgttgaggcgctcacccagcaaggtgcgtgggcggtgcaggcctggggtgtccacgacgatgatctgtgcgttgtcgcggtggaccaagccacggattgggtggcgggtggtttctggctggtttgcggtgatggcgattttctcgccgaccagcgcgttggtcagggtggacttgccggtgttgggacgtcccacgaagctgacgaagccggagcggaagccatcaggggtatcggtaaagctcataaatcctctttgaaagtttgggatgatcgaaccagccacttcttggcaaaaaagggccggtttccttggacgtcccagcatagtcccctactgctgtaaaaaactaaccttcgttgtcctcgctgggctcgccaacttctacgactgctgaatgcatgcgcaaacgaccccggcggttcttggctccctcggcggtgagctttagtccgcaggtttccacagtggcacccggcagaggcactcggccaagttcaaaggcaataaggccaccgacagtgtcgacctgatcttcaatttcatcaccgaattcgatttctaggtcgagttcttcttcgatgtggtctttgagatcttccagcgagagtcgggagaccacgcggtaggtgcggtcgccgattttctcgatgggggctacttcgcgggcgtcatattcatcagcgatttcaccgacgatttcttccaaaatatcctcaatggaaataagacctgccacgccgccgtattcatcaaccaggattgcgatgtgtttgtggtcttcctgcatttcctgcagcagcgcatcaagggacttggagtctggcacgaaggtagcttcgcgcatgacctcgtctacaagcacagactttccgccatcagtggcgtagtaggttttttggaccaagtctttgaggtagacgatgccgatgatgtcgtcgacgttttcaccgatgactgggatgcgcgaatgaccagagcgcacgcacagcgcggttgcttgcccggctgtttttccagattcaatccagatcatttcaggacgtggcaccatcacctggcgaaccgtcgtggatgccaggtcgaacaccgactggatcatgcggcgctcttcaatttccacgatgccgtgttcttgggcgatatcgaccatctcacgcagttccacttcagtggcgtaagggccattgcggaaacctgggccgggcgcgatgatgttgccgatccagatgaggccacgtgcaatggggccaaggattttagctaaaccgctcagcacgactgcggagcgaagcatcactgaatatgggtttttgcggccaacggtgcggccaaacacgcccactactgcgaaggtcaggagggaaaccaccacgatggccaggacgatgccccacgcccagctgtccatcacattgactgcgattgccccggcgaagactgctgcggaggcatccagcaaggtgcgcaacatgatgagcatgttgatgtggagtgcgcgttcgtcgatgactcgcagcaaggacgcggacccggaggcttcatccttgagcatttgttcaacgcgggcgcgggaaacagaagaaagcgcagattcaaccgcacctaataaaccggagaagagcaacgcaacgactgtggcgatgctcaaccatataactgaggattccacctaggactcaacgcctccaaagccagagtcatccgcttccatcttttcgtccaattccagacgatcagcagcggtggggaatgcaccggcgccggatggttttggctggtaggtgacgccacgggcttcgacgttgtcgtaccaatcggcaagcagctcgttttgaagggcgaacatttcacgctcttcggctggatcgacgtggtcgtagccaagcaggtgcaggctgccgtgcacggtcagcaaagctagctcgtgggctaagtcgtggcctgctttggtcgcttgctttgccgcgaactctgggcacagcacaatgtcgcccagcatggcggggccgggggtggcgccgtcggggcgggagtagccgggggtgagctcatccatcgggaagctcatcacgtcggttgggccttcaagatcaagccatttcacgtggagatcggcgatggtgtcgacgtcgacgatgtggatggatgcttcggcgtcggggtggatgtccatttccccgagtgcgaaggagaggacatcaatgagcatttcttcattgacgccgtcgtatcctgattcgttgaatacctcaatgctcatggccgtgtctcctggcgtttgcgtttcaattcgcgggcctcgcgttcttcatagtcttcgtatgcatccacaatgtgtccaaccagttggtggcggaccacgtcggatgaggtgagctcggagaagtgcacatcgtctactccgcgcaggatgtggcgaaccaggcgcaggccggacttttggcctcctgggaggtccacctgggtgatgtcacctgtgactaccattttggaaccgaatcccaggcgggtgaggaacatcttcatctgtgctggggtggtgttctgggcttcatccaggatcacgaatgcatcgttgagggtgcgtccgcgcatgtaggcaagtggggcgacttctacgatgccggcttccatgagttttggaatgacttctggttcgaccatgtcgcgcagcgcgtcgtgaagcgggcgcaggtaggggtcgatcttttcgttcagggtgccgggcaagaagccgagtttctcgccggcttccactgcggggcgggtcaagatgatgcggctgacctgctttgattgcagcgcttggacggcttttgccatggccagataggttttaccggaaccggctgggcccagaccgaacacaatcgtgttggtatcaatcgcgtccacgtagtgcttttggccaagcgtcttagggcggatcactttgccacggcgagcaaggatatcgccggtcaagatttcagagacggtttgcggcgtctccacgttaatcatgctgatgacattttttactgtctcagggctaatcacatgtcctcgacgggcaatcgcctgcagttcctcaaatattttcgaggcgcgggagacttcgtgggctggcccggtgagttccacgtgggtgccacgcacgtgaatatcgcaatcaatttgattgtccaacacacgcaggttttcgtcgttgattcctaaaacggtttgcgcgagcgtgcgttctagattgaggacagtggtgattacttctgtgcgggtttttcgcggggcagtcacagtgctagttcggcctgctttcggaatgttcaagaaaggttatgtcagagaaatgttaccagcggtcagacagcacgccgatagctgcgagcgccaccatgcctgcggaggcagtgcgcaacacctcagggcctagtttcacggtgtgtgcgccagcgtcgacgaagcgtgaaatttccgatggcgcgacgccaccttcgggtccgatgatcaccacgacgttgccggaaaattccagttcacggatcgcggcggttgcttcttcgtgcaggatgatggccaggtcggattcgtcgataagcttttcgacgccctcctcccccactacgccaagaatttcagggatcgttgcgcgccgcgattgcttggcggctgcttccgcagccacctgccatttagccagtgattttgcttccttgccgccccattttgctacgcagcgcgatgcttgccacgcaacaatccgatcggcgccagcttgggtgagcaggtcgatggtcagctcggaacgctctgatttggggatagcctgcacgatggtgacctgtgggttcggtgcggggatttcctcgaccaaatccaccacagcgttcaggcggtctttgccctgcaaggcggtgaccgtgcaggtgcgcgctgtaccccggccgtcgataagcgaaatcttttcgcctacctggatccgtttgacggtgacggcgtgccggccttccggaccggcgagctcaatggtttcgcctggtccggctgcggaatcagagataaatactggcagtgacattatttgcggaacttgtttcggagcttgtcaaagaaaccggattcttctccgccttcgcgatgcacggaagcgttgtcgctgcgatggttgcggatttcttcaagcaattcgcgggtgcggtcatccaaatcggttggcacaaatagatcgacatgcgccatgaggttgccgtggccttctgcgcgcagcttcggcatgccttcaccatccaaggtgatcacatcgttgggctgagtacctgcagggatggtaattttcacctcttcgccggtgagggattccacgtccaattcggtgccaagcgctgcatcgaacattggaaccttgatgctggcgtgcagatcgtcgccatcgcgggtgaagatggcgtgcgggcgcaccatgacttcaatgtagaggtcacccgcaggaccgccaccagcgccaacctcaccttggcctgccatgcggatgcgcatgccggactggatgccagctgggatgttggccacgatgtcgcggcgagcacgcacacgaccatctcctgcacactcagtgcaaggatctgggatgatctcaccggtgccatcgcaggtgtggcatgggcgggacgtcatgacgttgcccaggaagctgcgctgcacttcctgaatttcaccagcgccattacaggtgccacaggtaacaggcttcttgtcggatgcagatccagaaccatgacacttggtacacagcactgcggtgtcaagggtgagatctttcttagcgcccttgtaagcctcttccaaggtgatggaggtgcgccacaaggtgtcactgcctggctgcacgcgggaacgtggtccacgggaaccgcccgcgccaccgccgaagaaggcatcgaagatatcgcccagtccaccgctgccgccgaagcctccaccgaagccaccagcgccagctccgccgccttgctccattgggtcaccgcccatatcaacaatgcggcgcttatccggatcagtgagtacctcatgcgcaacagaagcctcgcggaatttctccgctgcttcctcacctgggtttacgtccgggtggtatttgcgggcaagctttcggtatgcctttttgatctctgattcggttgcattgcgatcgacgccgagaatgccgtaatagtcacgtgccacggtgggtgatacttcctttagcttctaaacagattaatcaaaacaaatggccaactatacccgcagctattcgccagcgagcacacgaccaacatacttagcaacggcggacaccttagaaattgttcccgagtagtccatataggtggggccaaccacccccaatccgcccagtgcgctgccctgggagccgtaaccggtggtaatcaccgttgcgctgcgcagctcaatgtcttcattttcgccgccaatatgcacgcgcacttggtcaagatcagtgacattggacagcagtttcaacatgaccacctgctcttccaaggcttctaaaaccatgggcaggctcgcggaggtttcccggcttaagcgggtgaggtttgaggtgccggcgaggatcaggcggtcagagggttgatcgacaagcgtgttcaccagcacatcgcagcagcggcgcatggcatcacgaatatcggttggggcttgctgagccaactcttccagcgcatctgatgcagccgtcagcgttttctcccctagcgcgccgttgagcagatcgcgcagcacattaacttcttccgccgccagcggttcctcaagttccacgttgcgctgatctacacggccagtatcggtaatgagcaccagcagcaagcgcatcggcgacagcggcaccacctcgcagtgcttcacgcgcgctgttttcagggtgggcagctgcaccacggcagcctgatgggtgagctgagacaacagctgcacagatctgcgcagcacgtcctctaagtccactcccccttcaaggaagcccaaaatagcgcgccgttccgccagcgacagcggtttgatgtcatggatggaatcaacaaaaaggcggtaacccctttcggttggtacccggccagaacttgcatgctcctggacgataaagccatcggattccagcaccgacatatcgttgcggatcgtcgcagaactcacgttgagcttatggcgctcgaggagtgacttcgatccgacaggttcctgagacgcaatgtaatcagcgacgatggcccgcaacacttcgtatctacgtttctctgttgcactcaccatgtctgtaaccctactaaatatttagtcttcttcactaagcaaaatgtcggcgatgatgccgtcggcaagcaaacgtcccgcatcggtcaccgccaggttgcccagcgcattgacgtgcagcaggccccctgcgatatgacggtcgatgaccgggcgcgctgcgggtgcgaaaaggttcagcggcacgccttgtttcaggcgcaaaccaagcatgacgcgctcggtgtggtgatcttccgccgtcagccgctctgtttccttaatgggcagctcgccggccgcaatctgcgcggagtaacgcgctgggtgcttgatgttgtagaagcggcggtcgccgatgtgcgagtgcgcgcccgggcccgcgccccaccagtcgccgtcgacccaatagcccatgttgtgcttgcattctccgccgggtttcgcccagttggacacctcgtaccaatcgaaaccagctgagcgcaggcgagcgtcgataagctcaaaacgatcagcgtagacatcctcgtccggcgctggcagctcgcccttgcgcaccttgcgcgccatcgccgtgccatcttccacgatcaaggaataggcagacacgtgatccacgttcgcttcgagcaccgcatccagcgtcttgcggacatcatcatcggtctctgtcggcgtgccataaatcatgtccaaattgacatgctcaaaccccgcctcacgtgcctccttggccgccgccaccgggcgccctggggtgtgcgtgcggtccagcaccttcaaaacgcttgacgacgccgactgcatccctaacgaaatcctgttgtagcccgcctcacgcaggccatcgaaaaactcaggcgaggtagactccggattggactccgtggtgacttccgcaccatccgcaatgccaaaagtattgcgcacagcccccaaaaccctggccaaaccgtccgcaccaatcaacgacggggtacccccgccaataaagatagtttccgcctgccgaggattatccagcgaagccacagccatctccaactcaacttccaacgagtcaagataggtgtccgggcctgcagtactacctaattccccagcagtataggtgttgaaatcgcaataaccgcaccgagttgaacaaaacggcacatgaatatacacaccaaaaactgacatgccccaagcctagtgcctgccccctatacatgattaattgatgttaaacatagcgaattcctaagaacagggtagagtgcagggtatgaaacggaagatggtcgcagcggcgctggcaacagcgcttctttttggggctgcacctgcgcacgcttccgaattggtagagcccaccacagttgcagagtcagtggcactcgatcccaacaaagcaatcaatattctcaccccagatctctgggaagacattgaggcaaaaccaggcgatatcgtccacatcccctaccagggcacccgaaactacgaggacctcaccgtagaagtcgcgaaacctttcgaagatttccaaatcctcgtcggactcgacaacagcatcgtcatcgcagtgccaaagaacttaagtggcgcagcatcagtcgccccagttttcactgtctctgacaaaaacggtgagatcgactctttcaccatcaaagtaagcgtcgagccacgccgccaaagcgacgaagaaaagcgctccgcactatttgatgtcatctctgagcttgcctaccgcatgcctcatctgccattcgtgtcagagttgctgaagtactagaacagtaacgagaaaaccccgggagtcgcgttgagcgcccggggttttagtttttgctgcaccgagatttctaggaaacagcgttgcgcttttgcgcaagcttgtctgcaacccgggccacgacagcgtcgatacgcgcacgctcaagcaggaaacgtggcgggttgctgcctcgcatggtgcgcacatacgccggattggcggtgcccactgcgttgatccatgcgctggtggcgctttcgatcaccgctgcaacgcggccataaagcagtggcagagacagggaatccagatcgttggccaccttgtcagtttccgccagcacccactccacagtggcctccaggcgcttaaccacagcgtctgtgcgcgcattgagcgcggtcgacagatcgcgtacatcaacgaggccggcatcaatatcgaagtcgcgctccagctcggaggcggtcaggcgttccggcttatcgacgtccacctccaccgtggctctagcgctcacggtgccctgacggataccagtggttagtgcgtgacgcaggcctgaaagttcagccacaacagtgcgggagtcatcgcgggcttcagtgatgatctcatcgaattcagcgaggcaatcttccacgagctccagatcccagtcggagactgcttccatgatgtgctcaatgtattcagcgacctcgtcgccgatgttgtagatctcctgggtcagctctcggtggcgtagctgtgcggttgtactgctcatcgcgttccaacacaccttccttttcttgcctcgtagctaaagttctagccggtcttgatccggtttgctagccgtcctctagccaatttctcagctattttccagctaacattcgcaccaaacacgacaggagtcacacggttaacaaccatgtttttcaagctctttagtgcattttcacaccttgagaccctcaagtaacacttgagagtttcccttaacgggttctgactttatgtgaaacagcttggaatgtcgtgacggcgcgccggtgtgtcggaaatttgaggtcgtgagatgaagcaagagctgacagcgattgcggttacctcactaaagcccgagaaaaatcaccacggcaatgccggcaactccatcgccgagaccaattcattgagaatccgcgtgggttcgccacgtgactcctcatcagatagtcgcgacaaatatttatctacaaccttcagggctgccggctcggttccctgctggccaatgcactccaccacatactgcggattatcctgagcgaaaagccactcgggatcaccaaacgtcagacccggatttgagcccaaagtaaagaactcttcatccccgtccgtgccagtggctgcaatgtaggcgaaatcctccatcacgcccacagcgaagcgtgttggtgcttcgccgacttcggtgcgggtccatgtcgatccatcccaatcaaattgggtctctgtgttactcatcggttgtagatgtggtcgatggcgtctgcgtaacggcgaacaacaacgttgcgcttgaccttcagcgttggggtcagctcgtcggcttcctcggtcaggtcgcgatcaaggatgtagaaccgcttgatcgcctctgaatgagacaccgtggcattagcgttgttgactgcatcctggatttccgcacgcagtgcaggatcagtagcaatctcagaaaccgtgcgggattccgcaatgttgtggttcagcttccaccgcttcaacatatctggatccaaggtcaccagcaggccaacgaatggtttaccatcgcccaccaccatggcctggctgaccagtgggtgtgcgcggatgatgtcttccatgggtcctggggaaacgttcttgccgcccgcggtcacgatcagatctttcttacgtccggtgatcaccaggtgtccagactccaacagctcacccagatcgccggtgttgaaccaaccgtcgtggagggcttctgctgtggcttctgggttgttccaatatccctggaacaacatctcgccttttagcatgatttcgccatcttcattgatcttgatggtcatgccacccatcggcttacccacagtgccgatcttttgatcagtgaagtccaccgctgcagcagccgcagattccgtcagaccataaccttcgtagatggtcatgcccacaccgcggaagaagtgcagcagctcctgccccatcgctgaaccaccggtgatggcgtactgcacatcgccaccgacagctgcacggatcttggagtacaccagcttgtcaaacgctttatgtgccataacctgggacttgcttgggccttctgcagtatcaagagccatggagtattcaatggccgccttttcggcacgctcaaacatgatgcgcttgattgcgccaccgtcagcagcattagcagcagcggcgttgcggaccttttcaaacacgcgtggaacacccaaaatcaggttcgggcgggaacgctgcagttccaaagtaagggtgctgaaatcagaccagtgggactgggttgcaccggtgacagcgaaggccaagtgcactgcgcgagcaagaacgtgcgccaaaggaaggaaggtgagcaaccttgaacctggcatcgcgatcgctccgatgtcattggtgatcagcgctcggacctcagccaaccagtggtagtgggacaactcgcagcccttcggcctaccagttgtgccagaggtgtacaccaaagacgccaggtcagcggccttggttgcatgaatgcgttcccacaccagctcatcagaaagctcgcggccctcaaacttcaaggtctccaacgccgaagagttgatctctagaatgcggcgcagcttggaaggtgaacccttaatcgctggagttccgtcttcaccgatgaccaggttcttcatcaagtcggtatgatcaggggtttcggtaatggccaaaacagcgccggaatcctcaatgatccactcaatttgggacagtgaagaggagctgtagataggcacgctcactgcgccagcggcccagatagcgaaatcaagcacagcccactcatagcgagtattggacagcagcgcgacacggtctccctgctctacgccgactgaaataattccttttgcaaccgcaaaaacctcgtcctgaaattctttggcagttacattcacccactcatagttggcaggcttgctgaacaaaactccgtaaggtcgagtcttaatctgatctagaagggcggtcaggcaggtttcagattctccgatggtgtacttggcaggttcagtgtattcctgcagggtattaggtgaagtcatggtcaaattcaacctttcctttaatttggctgtacttgtgtcgtcacgtctttagtcacgtttttggtcagatctttaggcatatctttaaccacatggaatttttctctatgtattcagtgtgtcaataacttcttatatctgcaccaatcagggtgtataaaagccaccccaaagcccaatccaaaagatgtattttctaacaaacttaccctcacgctacaaatatgctgtgcccacacgctattagtggcataatgttgtgttgtgactgctcgcagatttttgaatgaactcgccgatctctacggcgtagcaacttcctacactgattacaaaggtgcccatattgaggtcagcgatgacacattagtgaaaatcctgcgtgctctgggtgtgaatttagatacaagcaacctccccaacgatgacgctatccaacgccaaattgccctcttccatgatcgagagttcactcgcccactgcctccatcggtggttgcagttgaaggtgatgaactagttttcccggtgcatgtgcacgacggttcccctgcagatgtccacatcgaattggaagacggcacgcagcgggatgtttctcaggtggaaaactggacagcgccacgggaaattgatgggattaggtggggcgaggcatcgtttaagattcctggtgatctccccttgggttggcacaagcttcaccttaaatccaatgaacgctcagctgagtgcggtttgatcatcaccccggctcgtctgtctactgctgataagtatcttgattcccctcgcagtggtgtcatggcgcagatctactctgtgcgttccacgttgtcgtggggcatgggtgatttcaatgatttaggaaacttggcaagtgtggttgcccaggatggagcagacttcctgctcatcaaccccatgcacgctgcagagccgctgcctcctactgaggactctccttatctgcccacaaccaggcgctttatcaacccgatctacattcgggtagaagatattccggagtttaatcagcttgagattgatctacgcgatgatatcgcagagatggctgcggaattccgcgaacgcaatctgacctcagacatcattgagcgcaatgacgtctacgctgcaaagcttcaagtgctgcgcgccatttttgaaatgcctcgttccagcgaacgtgaagccaactttgtctccttcgtgcaacgggaaggccaaggtcttattgatttcgccacctggtgcgcggaccgcgaaactgcacagtctgaatctgtccacggaactgagccagaccgcgatgagctgaccatgttctacatgtggttgcagtggctatgtgatgagcagctggcggcagctcaaaagcgcgctgtcgatgccggaatgtcgatcggcatcatggcagacctggcagttggtgtgcatccaggtggtgctgatgcccagaacctcagccacgtacttgctccggatgcgtcagtgggcgccccaccagatggatacaaccagcagggccaagactggtcccagccaccatggcatccagtgcgtcttgcagaggaaggctacattccgtggcgtaatctgctgcgcactgtgctgcgtcactccggcggaatccgcgtggaccacgttcttggtttgttcaggctctttgtcatgccacgcatgcaatcccctgctacgggcacctatatccgcttcgaccataatgcgttggtaggcattctagccctagaagcagaactcgcaggcgccgttgtcattggtgaagatctgggaacgtttgagccttgggtacaagatgcattggctcagcgtggcatcatgggcacctcgatcctatggttcgagcattccccaagccagccgggtcctcgccgccaggaagagtatcgtccgctggccttgaccactgtgaccactcatgatctccctccgactgctggttatttggagggcgagcacattgctcttcgtgagcgattgggggtgctcaacactgatcctgctgcagaactcgctgaggatctgcagtggcaagcggagatccttgatgtcgcagcatctgccaacgcattgccagcccgggaatacgtgggactcgaacgcgatcagcgcggtgagttggctgagctgttggaaggcctgcacactttcgttgcgaaaaccccttcagcactgacctgtgtctgcttggtagacatggtcggtgaaaagcgggcacagaatcagccgggcacaacgagggatatgtatcccaactggtgtatcccactgtgtgacagcgaaggcaactccgtgctcattgaatcgctgcgtgaaaatgagctgtatcaccgtgtggcaaaggcaagcaagcgagattaggtccgcttcagttgtggtggctccgaatctgatgaacaatgatcattcctaattcatttacatctttatcaaagagagccaccacctactaatgcgacttcttggtcgaattttaaaaaccacgtctgcgctttggccctactatctcggaattatcgtcgtatccattgtgatcgcggcgttgtcgctgctgtcgccgtttattctccgcgaagcaacagattccattgtttctgcagtaaccggatctaacaccgtcgatgcagttactcgcactattattttcttagctttagccctgtttgtcgcaagcttcctcaatacggtgatgaccaacatcggtggctacatcggtgatgtcatggcatctcgtatgcgccagattctggccacgcgctattacgcaaagctgttggcgctgcctcagaagtattttgataatcaggtcaccggcaccatcatcgcccgccttgatcgatcaatcaacggcatcacgcagttcatgcagagcttctccaacaacttcttccccatgctcatcaccatggtggcagtgctgattatttccgcgattttctactggcctctggcaattctgctggccatgttgttcccgatttacatgtggctgacggcgttgacatcgaaacgctggcagaaatatgagggcgagaaaaaccatgaaatcgacgtggctaacggccgcttcgctgaggttgtcggccaggtcaaggttgttaaatcattcgtcgcagagacccgcgagctggctgatttcggtgggcgttacggcaaaacagtagcgattacccggccgcaatccggttggtggcaccgcatggatactctccgtggcgcggcactaaatatcatcttcctggccattcacctgctgattttctaccgcaccttgcacggccatttcaccatcggcgacatggtcatgctcatccagcttgtcaccatggcgcagcaaccggtgtacatgatgagctacatcgtcgactccgcgcagcgcgccatcgccggctcccgcgactacttcgaggtcatggcgcagcaggtcgagcccaccgccaataaggagcttgtcgacgccaccctcgcctcagacactccacgcatcagtgtgggcacgcccgccgcgctgcccgctggagaaccagcgatggaattcaaaaacgtcaccttcgcctacgaagaaggcaagccggttatttccgacgtgtccattaccgcccgccacggcgagcgcatcgcgttggtcggtgaatccggcggcggtaaatccaccctggtcaaccttctgttaggtctgtacaaaccaaacagcggcagccttgcagtatgtggcgtggatgttaaagatctgacttccgaggaacttcgcgcatccgtgggtgtggtcttccaggacgccagcttgttctctggatctattgcagaaaacatcgcctacggtcgcccaggtgccacccgcgaagagatcatcgaagtggctaagaaagccaacgcacatgagttcatttccgccttccctgaaggatatgaaaccgtcgtcggtgaacgcggactcaaactttctggtggccagaagcagcgcgtctctgtggcacgggccatgcttaaagatgccccacttcttgttctcgatgaagccacctctgcactggataccaagtctgagcaggcagtccaagccggtttggaacagctgatggaaaaccgcaccaccttaatgatcgcccaccgcctgtccaccatcgcaggcgtcgataccatcgtgaccatccaaaacggacgggttgaagaggtcggatctcctaccgagctcgcagtctcaggcggtatctattccgaactgctgcgcctgaccaactccacagcagaagccgaccgggagcgtctgcgcgcctttggtttcactggcgatgcaccagctgaagaagaggactagccccgcgaaagaacaatcccccagtgcccaaaggtaccaggggatttttcttaattccatgctctagatcaaggaaacaagccacgcaataacaacgatgaccagcaacaccacgagcgcttgggtaacgcgtgactgtgggtacttgcgcttacgcttcgggagttcttggtctctcttgcggagctcttctgggttagccatggtgtggttcttgtccctttccggaggattgtggtgttccaattcgctgcacccaggcgccgaggatgtcgactacgcggagcagaagtactgctagcaacgcgcagaccactactgatcctaggatgacgatcggtgactggatccacagcggtgatgttgtaagcagctgtgagatccggtcgaggaatgcagtcatgggttattagcctacaccgggttgtttagattgccccagccagacctcggcggcgcagaagtgggccgaggtctttggaacggccacggagttcttcgaaggcgttgctgtagtcggaggctgcgccgcgggataagaccaggtcacggaatttctggccggcggtgcgggctgcgtcgagggaagccacggatccggctgcgccttcttcgcgaaaccagtcgaagccgtcggcgtcgagtgcttccgcccacaggtaggagtagtagccggctgagtagccgccagcaaagatgtggttgaagtaggtggatcggtagcgcggtgcaatgttgtccacgtcgaggcctgctgcggctagtgcgtcggcttcgaattggtcaatgtcattgactgctgcggcttccgctgtggacagggagtgccaggccaggtcgataatcgatgctgccaagtattcggaggtggcaaaaccttgtccgaattggcgggatgcttccactgcctcaagcagggagtctggaatgatgtcgccggtgtccacgtggcgggcgtagttgcggactactgcagggtcgaatgcccagttttcgttgatctgggaggggaattctacgtagtcgcggggcacggaggttccggagaagcttgggtagcgcaccttggacagcaagccgtgcaggccgtggccgaattcgtggaagatggtggttacttcatcgaggctgagtagtgcttcgccggtggttggtttggtaatacccataacgttgaccacgactggcttggtgcctagcagctcggattggtcgacaaagctggacatccaagcgccgccccgcttggatggtcggccgtagtagtcggtaaggatcaggccgatgccggagccgtcagaatcgaggacttcccagacgtccacgccctcggcgtaaccgcgcaggtcagggcgtggttccacggtgattccgtagaggcggttagcagcgaagaagacgccgtcacggagtacttggttcaatgggaagtagttgcgcagttcggtttcgtccagggcgtagtcgcgggcgcggactttggcttcccagaagctccagtcagctgcgccgactttttggccgtgttcttctgcttcttctgcggagagtttgtattcggctttcgcattggcagaggcggctggggcgagatcataaagcaaggcgcgcacggctgcgacgtcatcggcggtttcttcttcgatgacgtaatcggcgtgggtgtcgtagcctaaaagtgtggcgcgttcagcacgcagacgcacggtttcgagcagcacgtccttgttcaggctggcgccacgcttctgggaggcttcataaagctttgcacgcgaggcggattcggttaatactgcctgctctgactgcacggtgggcagttccagtggaaccacgtagccttcggtgccaactgctgctgcgtagtcagcggcggcggatatgcgggcttcgctaaaaccggcaagttcagattcttcaaagttgaccgccagatcgcgggtgtcctgaagcaggttgcggccgaactgttcggacagtgccgataggcgctggttgatggtgctcagtcgggccttgccgtcggcgttgagtgctgcaccgcgacgtcgaaaagcgcgcttggtgtgggacaacaggcgttgcgattcctcgtcggccggtgcttctacggcctcaatgcgcgcgaaaagcgcagcattgtggaaaatcgcatccgaatgcgcggagagtttcggcgcgatagtggctgcgatttcatccatttcaggggaggaatcggtgccctgcaagttgaagaatacggcggcgacgcggttgagggacaggcctgcgcgttccagggcctcaatggtgttctcccaggtaggagcgtcctcattggtagcgatcgctgtaatttcagcatcgtgttcagctaatgcgagttcgaaggcgggcgggaaatcagccaccttgatcgctgcgaaatcgggcagctggtagggcaaggtgctgggcttgagcaggtgttcaacagtcatagtgaccgatactagttgctagagttttcatcatgtctgccacctcttccgtcaccgttgaatgcccggcgggaaccatcaccggcgagccccattatttccgctcgattccctacgcaaaggcgcgcccgtttgctgatgccgaaaagctagaacccctgcgcattgatgcgaccggcaagcacgagggtctctatttaacgttggcaaccccggaggcacggttcggcgcggatgccccggtgatcgtttatatccacggcggaggatatgacggtggcacgcgtttcgatgcccgcaccgagcccactttcttccgtgagcagggctttgtggtggtctccatcgattaccgcgtcggcctggagggctttgcgcgcttccacgacgacgaggccaatcgttaccgcggcatcgatgattgcgtgctcgcgctggagtgggtgcagaaaaacatcgagcatttcggcggcgatcccaccaacgtcaccctcatcgggcagtccgcgggcgccggcatcgcgctctggctcacgcgcctagaccactataaaggtgcttttcgacgcctggttgcgctctcccccagcttcccgcgccagccattcgctgcccgaaaaggtgctttacgacgcgccctgggcaaacccgtcacccgcgcctcgctggcgggcatcaagcccgcacgcttggacaaaggctaccgtcgctttgctcgccgctacttcaccgacctggcactcggccctaccccatacgacccgaatgagctggccgacatcgatttgatcatctcctccacccgcgatgaaatgtacggacaccgcgcaggcttatggttcgaccagcgtggcttcggcgcaaaactggccgcgcgactttttggcctggagaattcggatacctatattaaggaagcccgcaagatcgacaaccgcgttgtaggccgcatgattggtgatgccgtgatccgccgctacgtcgcgcaaaccgaaaaaggttggtggatggaatttcccggcaagcactgcgatgacctgtccttggtcttcttggaagattccgaagcacatcaccacatcgcctccttcgcccgcggggctacgccatcgtggcctcaatattccgaagaaaaccgcgcagctctctcactagtctcaggtgaggcgaaagtggtgaaagacccgctacgcatggtgcgcctggctttttagaatgtgctgcaaacctcctggcatttctctatcctggcaggcatgactgatacctctccgttgaattctcagccgagtgcagatcaccaccctgatcacgcggctcgcccagttcttgatgcccacggcttgatcgttgagcacgaatcggaagagtttccagtccccgcacccgctcccggtgaacagccctgggagaagaaaaaccgcgagtggtacaaagacgccgttttctacgaagtgctggttcgtgccttctacgatccagaaggcaacggagtcggatcgttgaaaggcctgaccgaaaaactggattacatccagtggctcggcgtggattgcatttggatcccaccgttttatgattccccactgcgcgacggcggttacgatatccgcaacttccgtgaaatcctgcccgaattcggcaccgtcgatgacttcgtggaactcgttgaccacgcccaccgccgtggcctgcgtgttatcaccgacttggtcatgaatcacacctccgaccagcacgcatggttccaagaatcccggcgcgacccaaccggcccctacggagatttctatgtgtggagcgatgatcccaccctgtacaacgaagcccgcatcatctttgtagatacagaagaatccaactggacctatgatccggtgcgtggccagtacttctggcaccgcttcttctcccaccaaccagacctcaactacgacaaccccgcagtccaagaggccatgctagatgtcttgcgtttctggctggacctgggacttgatggtttccgactagatgccgttccttatctttttgaacgcgaaggcaccaacggcgaaaacctcaaagaaacccacgatttcctcaaactgtgtcgctctgtcattgagaaggaataccccggccgaatcctgctcgcagaagccaaccaatggccccaagatgtggtcgaatacttcggtgaaaaagacaaaggcgatgaatgccacatggccttccacttccctttgatgccgcgcatcttcatgggagttcgccaaggttcacgcaccccgatcagtgagatcctggccaacaccccggagattcccaagactgcccaatggggtattttcctgcgtaatcatgatgagctcacccttgaaatggtctccgatgaggaacgcagctacatgtactcccaattcgcctccgaacctcgcatgcgcgccaacgtaggaatccgcaggcgcctttccccactgcttgaaggcgaccgcaaccagctggaactccttcacggtttgttgctgtctctacctggctcacccgtgttgtattacggtgatgaaattggcatgggcgacaatatctggctccacgaccgcgacggagtgcgcacccccatgcagtggtccaacgaccgcaacggtggtttctccaaagctgatcctgaacgcctgtaccttccagcgatccaaaatgatcaatacggctacgcccaagtaaacgtggaaagccaactcaaccgcgaaaactccctgctgcgctggctccgaaaccaaatccttatccgcaagcagtaccgcgcatttggtgccggaacctaccgtgaagtgtcctccaccaatgagtcagtgttgacatttttacgagaacacaagggccaaaccattttgtgtgtcaacaacatgagcaaatatcctcaggcagtctcgcttgatttgcgtgaatttgcaggacacacccctcgagagatgtcgggcgggcagctgttccctaccattgctgaacgggagtggattgtcactttagcccctcacggattcttctggtttgatctcaccgccgatgaaaaggacgatatggaatgagcattggccaacacatcatcaccgagcgtttctacggcgccaagtcccacaccatcgacaacgtagatattgtgttgtcccgcgaatgtggcgagaacactttggctgtagtgcgcatcaacaatgcgctgtatcagttgttggtcaatgatgatggcaaagatgttctcaacgaccacgtagaagaggtcggtgcgagtttcggagcatggactggcagctctgcttttcccattggccctttcactccactcggcacagaacaatccaatagctctttcatcaccgccgacaataaagcgatcgtgaaatacttccgcaaattagaatccgggcaaaaccccgatgtggagctaatttctaaaatttcctcctgccccaacatcgcgcccatcctgggtttttcctccgctgagatctccggggctaactacaccctggtcatggcgcagcagtacgttccaggtttggatggctggtcacacgcgctgactactacctctggcagctttgcagaggatgcagaaaagatcggcgaagccacccgcaatgttcacactgctcttgcatcggccttccctactcgggtagttcccgtagaagcactcgccgatgcgctcactacccgccttaatgaactaatctcccaagcacccgaaatcgcccgcttcaaagaagcagccatcgacctctaccaatcgttggaaggcgaagcccacatccaacgcatccacggtgacctccacttggggcagctcatcaaaacccccgaacgctacatcctcatcgatttcgaaggcgaacctgcccgcccacttaatcaacgacgcctccccgactctcccctgaaagatctcgccggcatcatcagatccatcgactacgcagcctacttcgacggcgaacacacccaatgggccaacgaagccaccgcgctattcctcgacggctacggatcaattgaagaccaagaactcctcaatgcctacattctggacaaggcgttgtacgaggttgcctatgaaataaacaaccgccccgactgggtgaaaatcccactcgaggcggtcgaaaggcttctagactagttagttactctgcgtcaaacgcttccaggatggcttggcgcagctcaggggcgctaagctgatccactagccatggagaaaacacaaatggtgtggcatcaacagcgtcgaaaagcttctgcggttccgcccactcgaactcctccacctcatcatccagtggctccacaaattcccccaccgctaaacgcacgaggtggaccgggcacaactcccactccacaatgccggacgcgtcgacagcacggtactggtaatcaggcagaatctcttgaatatccaagaaagaatctacctccagccccaactcatcgacacccctgcgacgaatcgcatccgcgtttgtctcatccggaccagggtgcccacacatagagttcgtccacacaccaggccatgtcttcttcgacaatgcacgacgcgtcaccaacagctccccacgcgggttcaaaatataggtggaaaacgcgaaatgcagaggcgtgtccttagtgtgcaccgtagctttcggcgcagtaccaataggattgccctcggaatcagctaaaacaaccagttcaacctcagtagtcatgcccctaagcttagacacattgttgcgttagcccctcacccagtcaccaatcacacccggaacaaccggcccccgatcacccagcagcgccgccaaattgcggtcttcctccaccgcagacgtcaccgttttcaccttgccggtattcttctgcccaccgccggcgcctcccatgggcatcatgggcatcatcggcatcatgccgcgcccaaaattgcttatcgacggcttcccactccctgatcccaccatccccaggccagaacccgactgcgaactagatccaaccgacgatccagtctggcgcgcatacttgctctgagaaccagtaccacctgcaccaacgacgccaccagacattccgccagcaccacccatcatcggagcgacagctcccgcggaagaagcaccatgagttcgagctcccatcaacgaatccgaggtaatccccggcgcgccaggaccaccagtcattcccggtaccgaaccacctgcggatccggccgctcgactactgatcgctccaggtgccgaagatccaatcgagccaccctgtgcgcccaaccctgcaccgctgccaaacgcaccaagcggcgatgccgcagacatcgaggaaggaatcgcaccggacgccgaattaggcgtagaagtaggcatcgccaaaccattcgcaaggctctgcccagctgaggcagcagaggtcaacatatccccaatattgatgccatccaactgatcagtgacagtgccaaaacttccaaccccactctgccccgcagcaccttgaaccgctgcatccggcgcgatactgcccgcattggcgacaccaccctgcgcagcccccgacggagtcaaccccgccgcagaccatgcctgcccactgccagcaatctcatccatccccagagcaatttcccccgcagaaccattcgcccccttcatctgcatcaaattgctcacaggaggcatacccgtcaacacatccgcctgaaaagtagcctgaaacgacgccaaaaacgccctctccgcagcaagcctctgcaccggatccaaaatcgccttaatcgacgtcgcagccataaacacctgcatgcgatgccccatataaatccgattcagcgtccccaccgacgcccccatcattttcgcattcgcagcaaacgtcgcccccgcagccgccacctcattaatccgagcagcagcctgctcaaacgtttcgcctgagttctccgccaaaatctcaccagcaatcgacgacaacgaagccgacacattgctaatagccgacgccatagagccccaagacccctgcgcctccaaaaccgcccccgagttggttccggaaaactgactacacaacgcatccaacgacaacgaaggactaacagctggtggattaaaaacgaaagactcaaaccgaggtgccggccgcgccgggaacattactgactcttctacaaccctgccaccggtatccgctacatccatacccctagcgaataattcatcctggccagtcaaagccgcaccagaagcctgcaaagccgcagacaaccactcgatttgttcggcataggaattcagcacagagtttgctgcgcctgccccaccattaatcacattcccgtgaccggaacccaattgatcgagtccagagacgggcgaaaacgcggatagaattgttgatttcattcccacttgagatgcagtaatagcttgatgctgaagctcattcaagcgagacacagcactactgatggacgagggatcaattttcaatgtcatggaattccccttagttccttgatgagattttctaaaatttcaacagcatcagagcacaaaatttctggctcccagccctcacctaattcgagatagtcaaccgtaagccggccccagtcatagtcaactgctgcctcacattgacgacccgtctcggacatttgatgcacatacagatctggattgtcattggatccccaatccaatgtctctagatcttggttttcaacaaattgtcggtttgcttggtcagttgaaatgagccacgtacctgaaaaatcctctctgtctgctttcccgaaactgcaacctaaacctgtcgagccgaggtaagcgtcttcaacaatcaagactcccaatccgacttcttcgaactgttcctgcgtgagtacttcacacggatgaaattggctggcaagtatgtcgttggtcggctccgtggatgcagcctcctccgacgttggcgttgcggttaccgtgacggttgtgggagtggtggatccactcgtgcagccggcgacagtcaatgcgatgccgcatacgagcagccagattcgtcgcataaaataccccgatctttgtagtcgtaacgagggccgtgaaaaggcactcataagcgttagactgcaaaagttcggggtaggttccctaaaattcaaattattttttgaacttacgccaagctgttcaaattgcctgagtagatgacgtttccgatctggaatttagcattcgacaatgagccgtttgaggtgttgaacgcgtattgcaggttcgttgtcgcgccggcacccagtggtaggtcgagtgggatgttgtcgtcgccggagagggtttcgatgttggttttgttgccgttgtagtcttcgatgtccagggtgggtggatcgatggcgtcggctggcagggctacgtcgtttaggtttttcaccgcgatgtgaataattgagccaccgttggtgccgtagcgggtgcctcggaagataaattcaacattgagacctgggtcttcaaccctgatatcgccgcttgggactgtgattgggcttacctctttggcttcgaacaccggggttgaggtagtggttacttccatggtttcctcagcggaaacggcttggctatcagcactttcacccgaacagcctgcaagaagtgcgacggctaacagggctgggattgtcctcaacttcacttcgggctccttcttagtaataggttcgtagaaaagtttactagcctagagagtatgcgatttcctgaactcgaagaattgaagaatcgccggaccttgaaatggacccggtttccagaagacgtgcttcctttgtgggttgcggaaagtgattttggcacctgcccgcagttgaaggaagctatggcagatgccgttgagcgcgaggtcttcggatacccaccagatgctactgggttgaatgatgcgttgactggattctacgagcgtcgctatgggtttggcccaaatccggaaagtgttttcgccattccggatgtggttcgtggcctgaagcttgccattgagcatttcactaagcctggttcggcgatcattgtgccgttgcctgcataccctcctttcattgagttgcctaaggtgactggtcgtcaggcgatctacattgatgcgcatgagtacgatttgaaggaaattgagaaggccttcgctgacggtgcgggatcactgttgttctgcaatccacacaacccactgggcacggtcttttctgaagagtacatccgcgagctcaccgatattgcggcgaagtacgatgcccgcatcatcgtcgatgagatccacgcgccactggtttatgaaggcacccatgtggttgctgctggtgtttctgagaacgctgcaaacacttgcatcaccatcaccgcaacttctaaggcgtggaacactgctggtttgaagtgtgctcagatcttcttcagtaatgaagccgatgtgaaggcctggaagaatttgtcggatattacccgtgacggtgtgtccatccttggattgatcgctgcggagacagtgtacaacgagggcgaagaattccttgatgagtcaattcagattctcaaggacaaccgtgactttgcggctgctgaactggaaaagcttggcgtgaaggtctacgcaccggactccacttatttgatgtggttggacttcgctggcaccaagatcgaagaggcgccttctaaaattcttcgtgaggagggtaaggtcatgctgaatgatggcgcagcttttggtggtttcaccacctgcgctcgtcttaattttgcgtgttccagagagacccttgaggaggggctgcgccgtatcgccagcgtgttgtaaataatgagtaaaaagtctgtcctgattacttctttgatgctgttttccatgttcttcggagctggaaacctcatcttcccgccgatgcttggattgtcggcaggaaccaactatctaccagctatcttaggatttctagcaacgagtgttctgctcccggtgctggcgattatcgcggtggtgttgtcgggagaaaatgtcaaggacatggcttctcgtggcggtaagatctttggcctggtgtttcctattgctgcctatttgtctatcggcgcgttttacgcgctgccgaggactggggcggtgagctattcgacggcggttggcgtcgataatgcgctttattcgggcttgtttaactttgtgttttttgcggtggcactggcgttgtcgtggaatccgaatggcattgcagacaagttgggtaagtggctcacgccagcgttgctcacgttgattgtggtgctggtggtgttgtcggtagccaagttggatggcacgccaggtgagccaagtagtgcgtatgcgcagcagcctgcgggggcgggtttgcttgagggctacatgacgatggatgcgattgctgcgttggcgtttggcatcgtggtgatttctgcgttcaagtaccaaaaggttaacaaggtccgcacggcaactgtcgtgtcggcgttcattgccggaattttgttggcgctggtttatcttggtttgggctcaatcggtcaagtagtaaacggtgagttcgctgatggcaccgcaattttgaactacgctgcactgtccacgatgggtcaggctggtcgcatcatgttcgtggctattttgatccttgcatgtatgaccaccgcagttggtctgatcagtgcgacgtctgagtttttcaattcgctgctgccaggtgtcaagtaccacgtctgggccactgttttcgcgctgatttcctttggcgttgccaccatgggtttggatacggtgttggccgttgcggctccagtgattagtttcatttacccatcggccatcaccttggtgttcttgtcgctcatcgagcccctgctgttccgtctcaagtggacctacctattcggcatttggactgcagttgtgtgggcgctgttcatgtctatccctgcgctgaatccattcatcgaatgggcgccgctgcacagcatgtctttgggttgggttgtcccagttctcgtggcctctgccatcggtttggctattgattggaacaagaaaggtgcccagtctgttgcaaagaaggaatccatttccgtctaatcgctaattgcgaggagtctttgcatgtctatcccactttcactgattgattttgccaccatttttgagggcgaaaggcctggtgacagcttcaaacgatcagtggcattggcgcaaaaagctgaaggtttaggcttcaagcgcatttggtacgcagagcatcacaacatggagagcatttcttcagctgctcctgcagtgcttatttctcacatcggtgcgaacaccaagactattcgtctgggtgccggcggcgtcatgctgcccaaccactccccatatgtcatcgctgagcagttcggcaccttggcggagttgtacccagaccgcatcgacctcggcctgggccgtgcccctggcacggacatgaataccttgcgcgctttacgacgcgaccctcagtccgccgagaacttcccgtccgacgttgtcgagctgaactcttacctcaccggccgttcccgtctcccaggggttaacgcaattccaggcaagggcaccaacgtaccgctgtacatcttgggttcatccctctttggtgcacaattggcagcacagttgggtatgccttattccttcgcatcccacttcgcaccaactcaccttgagcacgcggtgcaaacctaccgggataactaccagccttcagagcagcatcctgagccttatgtcattgcggccgtcaatgtcaccgcatctgattccactgaacaagcccacgatgatttctacaaggtagcgcgtgcacgcgtgaagaacatggcattgcgtggccgacaagttactgatgagcaacttgatgaactcatggattcaccagctgctcgccaaattgtcgacatgcttcactacaccgctataggcactggatccgaagttaaagaatacctagacggttttgtaaagacggcacaggctgatgaactgatgatctccctgcaatcccccaacactgaagcaaccacgcgcaatatggaaattcttgcggatgcgtggattaattagtaccgatgggccggtagacaacccgggggtctgctatttaaattttctccgctcgtcctgtcatgattgttcggttatcttttaaaatcaaacaggcgtgtcaaagattccatttttaggaattcttggcacgcctgcaaggtttaccgaacgtgtggctttaagccctcctcgcaatatccctgtaaaatcgcccagcagcgcttctagaaggtgtgacgttcaggttttccacaaggctgggtttttaccaacgattctctgccgtcccaccccacgcgggatacttaaacagggtgggaggtgcgtcgaaaagcaatcgtttaaatatcgtattcgtccctggactggggccgagtttgctcgacgatcttaaaacgagaccccatctcttgggcttcctcaggatcgtcgaccacatcaccaactaccccaagatcaccttcaatgactacgttgcctgggataacaatgttaccgtcctcatcatgttcgagggcaggcattggcaaggggttgccctcgtcatcatagcccggggctggttgggacgaatgctcttcaagtttttctggtgtatcagtcttttcccactgacgagtctgcacacgacgaaccgcagcagcatcttcactcatgcctttaagcaaagaaaacatcatgacaaattgcacgaggaagaatgggaaagccacgatgataaccacttcttgcagcgtggcaataccagaggatggggaaatgatcagcaaggaacctgcgaccgccccaatggtgcaggcccacatcacgcggtaactagtcggtgtttgattttctgcaccggtagcgaacatatcgttaactagcgctgcggaatcgatggaggtgataaagaaaatcacaataattacaagtgcaaacgcggagacaattccagtcagcggatactcttgcagcacattaaaaagcgctgctggcacgtcaccttcaacaacagttggctgggtcaagaaacctgggttactcagttccacttcgatgcctgcacgaccaaagatagagaaccaaactacgccaaagatcgctggcagagctagaaccccaccgataaattcacggacggtacgtccacgcgaaatacgcgccacgaacatgccgacatatggcgaccaacaaatagtccatgcccaatagaacaccgtccatttgccctgccagcctgggttatcttggaaagagtcagtccaaaacatcagattaggcatccaggatgcatagattccgaaggattctacgagaaagcgcagcaatgtgagggttggaccagtgaacaagatgaagaacatcaacgcaacggccattgcaatattaatgttggacagtaacttaatgcccttatccaaaccggaagcaacggaaatacatgcaaccgcggtgatgatcaagatgatcaaaagctgaacccacgatacttgcggggtgctccatagtttgttcatacctgcattgatttgcagcacaccaagacctactgacacagcaataccaaacgtggtgcctacgatggccagtacatcgatgagcttgccgggtgtggaataaatgtgcttacccaagatcggagaaaacacagaggatagacggggaggtagcttacgtttgtaaataaagtatcccaatgataatcctgggagtgccatgattacccacatgtgaataccgaagtgatagaaagtataagcaaaagcctgcacaattgcggcttcactcatggattcttcattagccattggcacgttgaacgcgtggttaatcggttcggcaacaccccaaaacattaagactgcaccgacaccgccagcaaaaagcatacagaaccacacgattagggtgtgctcggggtcatcatcgtcatcaccaagttttacccggccataccgggacgcaaagatacccatgaggaaaatgaaaaccaaggagacacccccgatatacatccaccctaaattttctaagagccagccggcaatcgcggaaaaggttgttcgagctttctcgcctagcgcaattgtggcgatgacaaacaccacgataaaaccgacagaaatggaaaaaatgaacgggtctgatttgagaccctttttatttttcccttcaggctcggtcgtgatagctatatttgagctcatctcattcttccaatcagtggataactacgaatctgaaagagtaccgagaaattcccagattctcaccttcatgaagaattttaaccagaacttgtctaaagtcttaccctggaatatttgggagcatgatcagttatcacagtgaaatcaaagtcgccccaagcgatccaaatttaactcaggtttttcacttaacaaaatctccgccaactcaaacggctgtggttgtgcaccggacggaaaattaacaatatatggttgtaccgaatgtacacctgtcacatttgcacgttccttgatgtggtgaggcagtagcgccatatacgaacctgatttcaggtctgaccataattgcactgtatctaattcttctatagcaaagcttatgccactgccggggatccgcacctgatcatcaacgattaatactgcttgtcgacgccgcccccacaccacgcacatagacccgatggcggccacaatgccgcagcccggcagcgtagctgccaccaaataaagggtatgcatggttccttcagcgctttggagagcgatgaggaaaaacagcagaaaaggcgcgcacatgagcacaaaaaggatgcacgtaaacatcgctttagatctcatcagcgccggcacaccggtgcgcactttgactgcattcatgaccactaatgctaaccctaagatccaaagataatggagaccgccaccaatacggggaaggaaatgagtgtggtgaccacccctgtgtctctcgccatcgattcagctgttctaaatcgcaacgcgtaggtgtagacattctgcgctgttggcagtgcaccgagaatcaccgccgacaacaaggcagtaccttccataccaaaggctaaggctaaaagtcccgcaacaattgggtgcagaacattcttgaacagtgccgccgtaaacacatcgcgcctggatacctgccccttttccaggatcttgctcttggacaaggacagtccgaacaccaccaaagccagtggcactgaagcattcgccaacatttccactggctgagcaatcaccacgggcacgctcatcgaagtcaaagacacagcaataccggcaatcgctgcgagcaccatggtgttggttagtggcgtgaccaggaggttgcgcaccaagttggtggatttcttgttggtcagcatctccatgatggtcatggtgatcggtgcgtagaacgccacctggaacaaaatcacgggaatcaccacggtgaaatcatccaaaatataggctgccaaagggatacccaggttaccggcgttggcgtaggacgcagctagcatgccgatcaccgatactgcggcagttcttttgatcacgaaccgcatgagtaggaaaaacaggaaacctacgatcaacgcagagagtgcaatgaccacgaagttcagagagaaaatcgtcgaggtatctgacttggtgacccgatcaaacaacaacgctggggtggccacgtaatagacaaacaggctcaaaggtttctgggcatgtgtgcccaaggtgtctcttctaccgagaatccaacctattccgatgacgatgaacaccaccgtgaaacccatgagcacctgttgcatgatcgttattgtgccatgttgttttgctccaagatgcttaagaccacctctgcaaggtgcgttgcttgttttccggtgccttgttcgatctgggtgcggcaggagaaaccgtcagcaatcacatgtccttctgcttttctgaccttggggaacagctctcgttcaccaagtgcgaaggacatttcagcgtggtctttttcaaagccccagtttccggcaagcccgcaacaaccagtggcaatttgttcatcttttacacccaaagcttcaagaacgagtgccgattgttgtgggtcgcctagcgaacgctcgtggcagtgcacctgggtaagcgcagttgattctgttagctggaggcttccagactcgactagctcggtgatctttggtgcgatgacctcagcgaatggtttggtcagtgctgcaaggcgtgccagatcagggttatcggagagttctgttgcctcatcttgaagcatgacggtgcacgaaggttccaaaccaacgactgttagaccttggtccaggtagggtttcatcactttcgccgtttgttctaggactttctttgtcatgctcaattggccggtggaatgccaggtgagtccacagcagacgaagccatctgggatgaccacgttgtaaccgagggcttcaagagttttgatcgctgcgtgagctggtccggtgtcgaggttggtgttgaaggaatcgggccacagcaccaccgtttcacctgagtttttcttcggcttgtacttgcgcagcgagcggtgggcgaaggaaatcaacgggcgatcagcgagcccgccgaccttgcgcaccactggggcggtgagtgctgactgcatggtggcgtcgataagcgtaggaagaagcggtattttatgggcaacgtgtcccagaagcggcagccagcccatgacgtaatgggccatggggcgaagtcggccggcgtagtgtttgtccaggaattcggctttgtaggtggacatgtcgacgttgactggacattccgatgcgcatgctttgcaggaaaggcacaggtcaagggcttcattgacttcttcgctgcggtagccgtcggcgatggattcaccgcggaacatctcagagagcaagcgggcgcggcctctggtggaatgtacttcgtcgccggtgatttggaaggacgggcacatcgcgtcggattctgagcggcatgcggatacacccacgcagcgattcaccgcgttgatcatggaacctttgtctttagagaatttgtgtacgggcgtgatgtcgagggcgcgctggcccgggtccatgcgaagtccttgcatgacaggatctgcccagaccaacactcccggattgaagatgcgctggggatcgaaaatcagcttgaattcttcgaagagtgcacgcatttctgctgaatacatgcggtcaaggaaggatgagcgggcgcgaccgtctccatgctcgcccgagaggctgccaccataagacgccaccaaggtggaggcttcattcatgaacgcctcgaatttcttcaggccttccttggtagagaaatcaaaactgatgcgaacgtggacgcagccttctccaaagtgtccaaatggaataccctggtaatcgaacttatccatcagcgcataaagatcgcggagataatcagctaaattctctggaggcaccgccgagtcttcccaattcggccacgcttccccaccatcagctaagcgcgtgacaatgcccgccgaggattcacggatgcgccacaattcccgcatttcagaaggctcagacacgaccacgtaatcaatggtgtcaacggcggttgcgacttcctcggcggcttgtaccgcggcctgcagggtgtcacttcctgtctcgcagtacaaccatccgccggcttcaatgccgatgcggtttcctggaagattctgcccagcttctgattgtccctgtttactgcgcagcgcagcgaggagatctccgcccatgccttcaatggttgctaccccaggcagtcgcaatttggcggctgctcgggcggcgtcaaaaaccgtgtcgaaagccaggacagcaagcgctttcactttgggtgttggaaccaacttcaccgtcaaccgagtaatgattccaatggttccctcggtgcccgccattgctttggccatgtcgtgggcaagataatgcaaaccgtagcccgacacttggcgagggaaacgacccagttctttactaataaggtcctgattcttggacgctaagtcggtgagcttctgattgatctcagcatcatcgcagccatcttttgtcacagtgacttctcggccatcgctgagcatgagcgtgacatccacgagattttccgcagctgtaccgaatgcaaccgagtgtgaaccacacgcattgttggcaaccatgccaccgatcgtgcaccgggaatgcgtggaaggatccgggccgtaagttaatccgaattctgcggctgcatcgcgcaaggcatcacacaccacaccgggttccacaactgcagtttgtgcaactggatcaatatctaaaatgcggttgaaatagcgtgacgtatcgatgatcaaaccttcaccgatcgcatttccagcaaccgagcttcctccaccgcgcccaacaacagaccaccctcgtgccaccgcaacagcaatggcatcacgaatttgttccacattttctggttcagctacagctgcagggacgcgtctaaaaattcctgcatcagaagaatatgctgcacgggttgtcatatccgtgcgcagcttcgcgcgagaatgctggctaaatacttctgggtcgagtctgttgaatttgatggtgtgagtcatggtgggtccttttgtgaaattcgatccaagcgggctttgagtaacatgttaccggttactgtggtgaattgtgcgataatgtcagacatgccaacaaaaagggttgcccccgcacgctcactcaccgaccaagtcatggatttcgtccgcgaatccacccttgataaaacaatggtcaccggagagtggtacagcgtttaccaggtcagcgaccaattaggcatttcccgctcccccgtcagagacgcgctgctccgcctggaagaagcagggctcatccgcttcaccaggaaccgcggattccaaattgtcgaaaccaaaccctctgatgtcgccgaaatttttgcccttcgtctaggcattgaacccgccgcagcataccgggcagcacagctacgcaccgaagaacagctccacgaagcagatgacatcattgcactcatggcgcaagccgaggccgacaatgacgaagaagcatttttcacccatgaccggcagtttcaccgacaaattatgaccatgggacactcccaacgcggggctgacctggtagaaaaactacgcgcacacacccgtatcctcggtgcttctactgccgggaacaaacgcacccttggcgatattttggaagaacacgaaccaatcttggatgccatcaaacgacaatcagcagaaatggcacgagccaccatgcgggagcatatccaagtcaccggaaagctactactagaacaagcagtggaaaaatccggcgaaggagctgctcagaagatttgggatcagtacacggcgggagtttaggcatatttacctaatcaatttcatgctgaacagtatcggagccagttggacggccgggccggtacctcaacacaaatgcgcacactgcacaaagtgtcgcggagccaaacgcccacggagcaatattccgagtggcaccagtaactaggtcttcactcagcaagatcactcccactgtttgaacaccgacaataagggtgccaccaatgaggaaagccactagaaatacggcaaacagaacactaaatagtttgaaaattgagttcatttttacccctttaacccgtaggaacaatcactggtaagaatcccattccaactagccaagcaagcagaatcatggggacaacaaagtacgtaatcagtggtacgaacattttcgttgggtttgcatcggcgatcgcagcagaaaggtaaatcggcgcgcccaccggcggggatgcaccttcagtggaagtgcacagcaagatcactacgatcgccacagttggatcaatacctaccgcagccaacgcagcgacagcgggagcaccaatcgcagccgcggttgctgttgacgacagtggcgttgccaccacaatgcacatgatgcagacaatgatcaccatgacagacttaggtaggtccatggaatcaagccagttagacaactgcgggccaacacccagttcttccatgatgttcgctgctgcaagcgcagaaaacaacgaaattcctacggtggcaaattgtggcaagtccttggagatctgaaccctaaagtgtgccatgttgttagcaattcgtttacgcccttcaatcagagcaattgccgtaatcagaattggcacccacacgatgatcgacatcgatttaacaccagactccccaactccatgtgtctttaaccattcagacaatgggccgattgtgaggattacggggatcaaaattccaaggaagatcaacggtgaacgccatccagtcttcattgcctcaccgaatgacacccgttgatcatcaggggtggcaggaattttatctttacgtgtccagtaaaagacgaccgctaagcggtagagcactgcatacgcaccaccacaagccaaagcaatgtacacctgagaggccgaagaagctgctgcagctggcaatgccaaaatgatgaacattgttgaattgggaggcaacgcaacaccaaggccagagttgcccgcgactaacgttgcggacctttcagcagtccatcccgtctttttcatccaagggatcgtcactgagccaaccgtcgcggagtttccagccgttgatccagcgatgagtccaatgagcgcagatccaagagtggaaacataacctgcgccacctcgaagccgaccaaaaatcgagttaaggattgcgattaatcgatcaatcaatccagttgattgcacaacgatgcccatgaaaacaaaggccatacctgcgaaagtaacttccgactgagcagcatccactacagcatcaatcagtaatgtcggtgcatttacaccgccgacaagcgcagttcctactaatccaactagcaatgcttctgaaatatctcgtttcaaaaacacattcaatatcacggcaattgcgataaaaacgagcagagcaatgattcccataagcgcctcctttaagtgaccgaaaaaaccgtagcatgttacatgtgattgaattgacttaaagcggcattaacttcgtggaattttcacccaaaaagtggccccttatcccaaaatcccacgtcagtggattacgtcacacctttaaaaacggtgagacgtacctctatatgggggtgatagaaccgtttaaggccctcactccaaagagtcaggcacctctaggcagaaatggagagaaggagggaaacgtcgaaaagcgagagcctaattgctcaagcccgcagccctctcgcggaccttgcgcgcgacttggcggttgttgatgaacatggggatccagcccagaaagcacagacctgcgatgatgaaaagaatgagcgagacagtcatttcgaagccgacggaagtcgcggacgtgtagccgtcggcaatcgcagcctgcacgccggagcgaaatgcccaggcagtcaccgcgatgaatagtgcgggagcgatcaaacctatggcccacgcgccaaatacgcaggcggcgagggtactcatgaaggcggccggcatgaacagggataccaaatcgttggtggcgcagctgcctcccccgcagtcccaggagacggtgtcggcgaggtgcccaaaaggaatatgcacaccaccctccgagagccgccactgcagcagagatgagggcaacgaggattttccattggcggaggttcatgcggcgggtatccattgccttccattttagttttccatttagtttcccggatcacaccgactaatctcagaagccatgaagatcacgcgcggactcctgccatcattgctgttggcaagcacaatcgtggtgtcgtcatgctctgctggatcgactgcgtatcagcagccccctgctgttgatcaatcatccattgtcattgctaccacggctgctgcggcgtcacttgatttcaccaatgctgcgggcgctgctattccgcaggcgatgatgtccaatatttacgaggggcttgtgcgcatcgatgcggagggtgagattcagccgctgcttgccacgtcgtgggatatttcagacgatcgcaccgagtacattttccatttgcgggagggtgtgctgttttccaacggcgatcccttcaatgctgattctgcgaagttttccattgatcgggtaaaaactgactggaccaatggtttgaaaagtggcatggatgtggtggagtccaccgaggtgattgacgatcacacgctgaaagtttcgctggtcaggccgtccaaccaatggttgtggagcatgggtaccgcgatcggtgccatgatgacggaggggggcgtcgataagctggcaactgatcccgttggcaccggcccgtacacggtgacgcactgggcgccgggccgcgcaattgggttcggcgcgcgggccgattattgggggcagaagccgcttaacgacgccgcaaccatccgctacttcagcgatgcgacggcctcgaccaatgcgctgcaaagcggtgacgtggacgtgatttgggcgatgcaagcgcccgaacagctggctacgctgcaggaatacaccgtggaagtgggcacaaccaatggtgagatgttgctgtcgatgaataatcagcgtgcaccttttgatgatgtgcgtgtgcgccaggcggtgatgtttgcgattgatcgccaagccgtcattgataccgcgttggaaggttacggcaccgacactggtggcgtgcctgttccgccgactgatccgtggtacgagaaatccacgatgtacccctacgatccggaccgcgcacgggcattgttagaggaggccggcgccgagggaacgcggatcaccatgtccattccttcgttgccgtacgctcaggcagcctctgaaatcctgtactcgcaactgcgagatgttggttttgatcctgtgattgaatcaaccgagttcccagccgtctggttggcacaggtcatggggcaaaaagactacgacatgtcactaatcgcgcatgtggaaccccgcgacatccccacgctgtttagccccaactactatttgggctttgacgacaccgaaacccaagccctcctcgcagaggcagacagttcagcaaacgaagtggaattgatgcaacaagctgtcgatcgaatcatggaacaagccgtcgccgacaacctcatgaacgtggccaacatcgtggtgatgtcaccagagatcaccggcattgatcccaacgtggtgtccggggcgttggaattgtcgttgattggtcggaaagaatccggggtagcgcagtgagtaaaacaatcgcttggactgtgctgcggtacaccctgacttttgtgatcgccagcatcatcatttttgtgctgattcgagtcatccccggtgaccccgccgctgttgccctgggaattaccgcgacaccagaagcaatcgctgcgttgcaatcacaattaggtactgatcaaccgcttttccaacagtacttttcctggataggtggaatgctcactggcgatttcggcacctcgctgagctctggccaagacctttcccccatcatttttgaccgcttacaagtgagcctcattttggtgggatgctccattgtgttgtcgttgctcattgccattccacttggtgtgctttcggcccggcgcggtggcgtgatcatttccggcatcagccagattggcattgcgatccctagtttcctcgccggtattttgttggtcgctgtcttcgccgttggtttggggtggctgcccgccaatggctggattccgccgtcggaaaactttggaggtttcttagccaggctgatcctcccggttctggctcttactgctgttcaagcagcaattttgacccgctatgtccgctctgcagtaatggatgtaatggggcaagatttcatgcgcaccgcgaggtcgaaaggtatgagcttcaaccgcgcgttgatcatccacggtcttcggaatgctgctcttcctgtccttaccgtcactggtttgcagctaacaaccttggttatcggcgccgtggtgattgaacaagtctttgtcatccccggaatcggttcgatgctgctggagtccgtgtccaaccgtgatctcatcgctgtgcaatctattgtcatgctgctggtggcgttcacgttgctggttaatttggtggttgatctgctgtatcaggtggttgatccaagagtcggtgctgttggggttgctagcactaaggttccagggagcgtggcttaagtgacaacgatcaaaaacatgcccctttcagggaaaatcggcggcttcatcgttgccgttgtatttgttcttgctgcgctgtctttcatttggactccgtttgatccagttcaagctttcccacaggagcgccttgagggaagttctttgaggcacctgttgggaacggatcgttatggtcgcgatgttttatcccagatcatggttggttcccgcgtcacgttgttggtgggcatcattgcggtggcgatcgcagcattaatcggcacgccactgggtattgctgcgggaatgcgccgtggcatggtggaaacctttgtcatgcgtggtgccgatttaatgttggcgttcccagcactgttgttggcgattatttccggcgccgttttcggcgcctccacgtggtccgcgatggtcgcgatcggcatcgcaggcatccctagttttgcccgcgtggctcgtgcaggcacattgcaggtgaccagtcaggatttcatcgcagctgctcggctatcaaaagtaagttccgcccggatcgcgcttcgccatattttgcccaacatcaccagcatgttgatcgttcaggcatcagtagcttttgccctggcgatcctggcggaagccgcattgagtttcctcggtttgggcaccactcccccggatcccagctggggtcgcatgttgcaaaccgctcaagcatccatcggcgtcacccccatgttggcggtgtggcccggtgctgcgatcgctttgacggtccttggttttaatcttttcggtgatggtttacgcgatgccatcgatccaaagcgggaggtcggccgtgcttaaagtttctgatttaacggttggcaacaattttgtccacaacgtctccttcgaggtcaaccccggcgaacgcgtcggcatcatcggcgagtccggctcaggcaaatcactcaccgcgctatccatcatgggtttaactgacctgccgaccaccggccagatcaccttcaacggcaaaccctccgctacattccgtggcacccgcatcgccatggttttccaagaaccaatgagcgcactcaacccgctcatgcgcatcggccgccaaatcgaagaaatgatgaccctgcacggggcaagcaaaaaagacgcgcgggcgcgcttaaaaagcttgcttatcgacgtctccctccccgaacgcaccgcttcggcctacccacacgaactttcaggcgggcaacgccaacgcgcactaatcgcaatggcgctggccaatgatcctgacctgttgatctgcgatgaacccaccacggctttggatgtggttgtgcaaaaacaaatcgtcgatctgctgctgcgtctcaccaaagaacgtggcaccgctttattgttcatcacccacgatcttggactcatcgcgcgcacctgcgaacgcttattggtgatgaaatccggcgaaaccgtagaacgcggcgacaccgaggcaattcttcgctcccccgcccattcgtatacccaacagctccttgatgcttcaatccttgaccagccagaaatcgcctcagattctggcgcgccggtagtgattgatgtggaggaggcgtcgaaaagctttaaagaaaccaccgccctccacaaggtttcattggcggtgcgcaaaggtgacctgcttggaatagtcggcggatcaggttccggcaaaacgactctgctgaagctcatcgccggtttggataagcccacaaccggtaccgttgcggtaaccggtggtgtgcagatggtgtttcaggatccccaatcaagcctcaacccacggatgaaaatcaaagacattgtcgccgaaccactgcttggttggaacgcggcggagaaaaccacacgggttgcggaagtcatcacccaagtgggactgagccccgatgtcttagatcgctacccccacgaattctccggaggacagcgccaacgaatctccatcgccagagccctcgccatcaaaccagcgatcctgcttgccgacgaacctgtctccgccctcgatgtgtccgtacgtaaacaagtactggatcttctccaacaactcgtcgaagaatacggcatcaccttggtgttcgtctcccacgatctggcagtggtgagacacctgtgcacaaccgtgtgggtgatggaacagggacgagtccttgagcaagggcccatcgattcggtttatgatcacccacagaccgaatacaccaaggagctgcttgatgccgttccgcggttgagcctttaaaccagcgcagatgacaacgcaatggtggccacggttgtatacagtggcccaccgcttctgccttttccaggttcagaagacaccagttcaatctcatcgactggccattcggggccttcgtatatagagagagcgtggaccagatcggggatgacaggatcccaatcgcggctgcgctgtcgctgcgttggtttcgccacggtcaggtgtgcacgctggcgtcggcgttcctcaggatcaatcagacaatcagccatcagtcgccgcagatctttggtgtcaccaccaacacccatccacaaattcttccgattaaatgagcctgcgcctttgattctgatggtgaattcttcattgattcgggctgcacttgtcagatgctcaatgagatcttcgactgccccatcaggtaattctccatagaacgccaacgtgatgtgccaattgtctggatcagaccaccgcagatcatccttgtagggacgaagcgcgttgatcagatgctcggtgacttcaatcggcggagtgatagacgcgaacagtctcatgaagccataataaccaccttctacaaagatcgacgtagaatggaataaccccttatgaaaacgtttgcataactccgctaaggatgttccatgaataatcgaattgtcgtagtcggctccatcaacgctgatcttaatgttctcgttgaccgccacccagcacctggcgaaacactgttgggcagtggtggacacatcactgcaggaggcaaaggcgccaaccaggcagtagctgccgctcttcaaggtgcagacgtcgcctttgtcggcgctgtgggcaaggatccttacgctgccccagccttagaattccttcgttcgtcaggcgtcgaccttacggcagtatccgaagtagatgacaccaccgggcttgcagttatcaccgttgccaaagacggcgagaacaatatcgttgtcatccccggcgcgaattccctggtcaattgtgattatgtaagcagccaatccgctcttttagctgaagctggaatcctgttgctgcaaggtgagatccctgcggatggcttcaaagaggccattcaccacaccatgggtcgcgtcgtggtgaatctagcgcccgtcatcgaggtagagaagtccgcgttacttgaggctgatccgatcatcgccaatgagcacgaggccggcctgattctggatcaattcggggcaggcatcgattccatggatccccacgagctcgcgcaagctctcctcgacgccggtttcgcctctgttgttttaacgcttggatccgcaggcgcgttggtcgccgatgccaccggtatcacggacatcgccacaccaacggtgcaggcagttgacaccacgggagccggtgacgcttttgccggagccttctgcgcacgactaattaaaggcgattcgcttatcgacgccgccacccacgcagcacgcgtcggcgcttactcggtgcaaaccgccggagcgcaagcgtcctatccggacgcgagcgtttcacttccctctgtttaaaaaaactatttaagaagaggtgatgtgtaacaagatgtcatcgtggaggattcgctcctccgacacttcgaaaatctggttcaggtattccacctgagcatcaaaatcatgtgcattcatcattgctgatcatcatagacctgttggcaaatgaattcaccaattctttaaagctctcaccctctttagggaactgaatgcggtctgtactcgactactggatcatgactcttgcaccttccaccaatgcggtttcgcagcaaacaagaaggaacccttcccaagcgccgcgacttcttcatcgacttcacttctttgccggcattatctgcgcaccgttgattttcatcgctgcgctcaccggactggtgtatgcgttctcccccaccattgaaagcatctctaatcaggaaatgctcacggtctccaagtcggctagcgacacagctcttccggtgcgtgaacaagtgagcatcgcccaagaactccaccccgatttagatctctcaggtgtccggcttggcgatgattcctccaccacccgcgtcctcttcgccgacgagacgcttgctgaatccacagtccgcgccgtgtttgttgatccctacaccggcgagatcaccggtgataccacccaatacggaagctcagctgcactgccgtttcggcaatgggtctcgcaaggtcaccgcatgttgtggcttggtgaacctggacgtatttattccgaacttgcggcaagttggctcggagttttagccgtaggcggtttcgcattattgtggttgcgcaacaaaaagcccggccgcttgagaaagatggtgcgaactggtggccgtggtcgagtgaaaacgtatcgccgacatgcagcattgggcaccgtagcgggcttgggttttgtgttcctcacctttactggcctgacctggtcaacttatgcgggatccaacatcacggatttacgcacccaactcaattggacgcagccttccgttaacgcttctctaacagctgccccacaagtggacatgcatgatgaacacgcaggtcatcacatgcatatggagtcggcaacctcaggctcaggttctatagatctggtagcggccacggctatctccgaattacgcactcccctcaccattactcccccagcacaagatggcctcgcgtggactgccacagaaaaccgcgacgcctaccgattcaccactgacaccatcgctgttgatggcgacaccggaatgctgaccaaccgtttgaattccactgattggccattagctgctcaagcgagtgcatggctcatccagcttcacatgggcaccctgtttggccttcccaaccaggttgtacttgggctgttggctgcctcaataatcgtgatgatcggccttgggtattggatgctgtggcagcatcggccacgggaaggttggcctagcgctcccaagcgtgcaggatttgaaaaacccacctggggaactatcgcgttgggtgttgtggtgatcgcgtatgggcttctcgcgccactttttgcagtttcactgctcgtgtttattggattaagccttggagtgcggtttatttctcgtatgtccgggcgcgcggacacgtccaactaagaacaccaaaccacaccgcccacgaatcctggaaatgggatccgtgggcatctgtgactggttttaagacctcaaaaccggtcagaaatgcccacgaaactgaaaaacagttttcgtgggcagcgtggtttggtctggctcaaaaactagataagaactcgaaaaagtcgactctctgtatagccgttagaagctccaacatgagctcatccaagggcacgcccgtgtcaaaaactcagcgcctctaacgggcagcaaataagttagctggaaaccgcgacggattccttcttccttgatgccttagtcaaaggcctgtttcgtaccagcccaacataaactgcgccggtgatgttgtggaccaaggcagcgacagcacctggaagggctgcttctggggtgaagaatcgtcctgccattcccgatgcgaggcctgcggattgggttccgatttcaatcgccatggtgcggtttgctgcttctgggaatttgaatacacggccggtgaggtatcccacaacgtatccaagtacgttgtgcacgataactgcaacgaacacgatgagtccgacagacacgagtcgttccgcgttggctgcgactgcgccgaacaccacgccaccgataccgaggatggagagataaggaaggatcggcaaaatcttgtcgatccacttgttcaagaagacacgcagaactaggccgatgatcacaggcagcagcactgtttgtaccaaagtccacgccatgcctccaccatcgacggcggtttcagtacctgccagcatgagcatgaggaaaggcgtcatgattggggaaacaatggtggacacagaggtcatggtgaccgatagcgcgacatctcctcgggcgagaaacgcaatcacattggaggaggtgccacccggaacggatcccagcatgagaaggccaacggcgagtgctgggttgaggttgaacattttcgcaaccacgatcgccaggaatggcatgatgacaaactgcgctactacaccgatcaagataggcagtggacgtttaagcaccatctgaaaatcgggcaccgtcaaggtcaaacccatggtgaacatgatgatcgtgaggaagatattaatgtagtttgtcagcggaatgaatggttccgggaagataaacgcaatgatcgcgcccagcagaatgaaagttggaaacgcgtaaataattatggccgctgaacggccttcttctgttttggacactagaaaactccaagaaagttaaaactgaaatggtcgtgctagtggtgggcacagaattaaatcgctggtgtgcgaactttcataccttaacgcagtagtgatgcttaaggcacaacgtgggggcaattccggcctatactttggaagtatgactacttttattacctccggtggcttggaaatctcccccgctggcgctcatattgttcacgccgaatcacctgaaggtgagctgttgtttgttagctccgcttcccaatatggggagggaaatgcaattaggggtggtgtgcccatcattgctccatggtttggtggactgcttggtttggaccctgcacatggttgggcgaagcgttccgcgtgggacgtgactgaacatgacggccaaattcacgctgaatatggccgcgatggtttactgctggatattcgtgcgaacagcactaagaatggttttgagatcaccctgcgcgcttacaacgacaccgatgaggcacgcactgtgcagttggccttccacccttatttcaaggtggatgatgtagaaaagatcgaggtccgtggccttgatggggtggacattctcaatcgcctgaacaatgaggtggagacccaagatggtcccgttacttttgatggcgagttcgatcgcattgcgctagggactccggttgtgaggatttttgataccgatcgcatcatcaccattgagggcgatggtcatgattccactgtggtgtggaatccaggcgaaagtcgcgcctccaccgtggccgatattggcgaaggtgaatggcgcgactttgtgtgtgttgaaccggcgcttttgggtgctgaccaaaaaggagtgagggtggctccggggcagtcagtcaccgttgggatgcaggtaagcgtcgaaaagcgtgcttagttttttgctttgaactcgcggcggcgtgcgtgcaagatgggctcggtgtagcccgatggggacttggtgccttcgaaaatcaagtccttagccgcctggaaggcgagggaggcgtcgtagttcggcgccatatcgcggtaggcctcgtcgcccgcattttgcttgtcgacgaccactgccattcgttccagtgactccaagacctgctccttcgagacaacatcatggcggatccagttggccagcatctgcgaggaaatacgcagcgttgcgcggtcttccatgaggtcgatgtcatggatgtctggaaccttggagcaaccaacaccgtgctcaacccagcgcacaacgtatccgaggatggactggcagttgttgtccatctcttccttcttctcttcctcagaccaattggtgtttggtgcggttggaatggtgagaatgttgcgcaggctgtcgcggcggccggcagcacgcagttcgtcttgaaccttgaacacatcaaccaagtggtagtgcgttgcgtgcagcgtcgcaccagttggtgaaggaacccatgcagtgttggcgccttcgcgtggctggccgatcttcttctccagcatttctgccatgagttcagtcatcgcccacatgcccttaccgatctgagccttgccaggaagaccacgctgaatacctgcatcaacgttgttgttctcgtaggcctgcttccacggtgcggtctgcatatcagccttgcgcaccatggcgcctgcttccatggaggtgtggatttcatcgccggtgcggtccaggaagccagtgttgatgaatgccaagcggtcagcaacttccatgatgctggcatccaggttcacggacgtgcgacgctcctcatccataacaccaaccttcaaggtgtggcgtggcagatcaagcagatcctcaacgcggccgaagagctcgttggtgaacgcgacttcttcagggccgtgctgcttaggcttcacgatgtagatggagcccttgcgggaattgcgcatcttgttctgcggagcaattcctgggatggcacaaacagtggtcaagacagcatccatgatgccttcgaagatctcctcgccatcaatcaagatggatgggttttgcatgaggtgaccaacgttgcggacgaacagcagggaacgaccgtgcagaaccagctcggtaccattgcggccaatgtagacgcggtccttgttgagctcacgggtgaagatgcgtccgttcttggacatctcttctttcagttcgccggtgttgagtccgaaccagttagagtaacctaaggtcttgtcttcagcatcaacagctgcaacggagtcttcgaagtccatgatcgtggtgatcgcagattccaaaacgatgtctttgagaccagtcttgtctgccttgccgattgggtggacaggatcgatctgcagctcgatgtgcaggccgttggtttccagcaggattgcttctggatcaaggaagttgccggtgaagccacggtaggattcacggtttttcagtcggtagacgctatctccaatgtgggctgcaagctttccatcggtgatgttgtacttctcaacatcggcatgcgaagcaccgtccagtgggacaacgctgtcgaggaattcacgaccccactcgatgaccttctggccgcggaccgggttgtactccttgcccttttcagcgccatcagtttctgggatggcgttggtgccgtacaacgcatcgtagagggaaccccagcgagcattggcagcgttcagcgcgaagcgtgcgttcagaattggaacaaccagctgaggtcctgcggtgctggagatttccgtatcgacgttttgggtacggatttctgcagcttctggctcctcaaccaagtatccgatttctttgaggaaatcctcgtacgcctcttggtcgatggtgccggagttgttgcggtggtagtcgtcgataagcatctgcagttcatcgcggcgagcaagcagctcgcggttgcgtggggtgaggtcccgggcgatggcggcgaatccggaccagaacttttccgcatccacacccacgcgagggagtaccgcttcggttacaaagtcgtagagaacttttgcaacctgcattccgcccgcgtcaacgcgttcggtgctgtcagttccagcgttgtcggcagtctgagcagacaacagttcctgttcagtcattgaaggctccttttaaagcatgggttttagatgacctgtgcctaaaccagaagaatgcgaatccttcttgtttggctacgccgttaacggttgtgaaaactcttttaagaaaagcactctgactacctctggaatctaggtgccactcttctttcgatttcaacccttatcgtgtttggcgatgtgatcagactaagtgatcaccgtcaccagcaaaaggggtttgcgaactttactaagtcattacccccgcctaaccccgacttttatctaggtcacaccttcgaaacctacggaacgttgcggtgcctgcattttcccatttcagagcatttgcccagtacatccgtactagcaactcccccgcccactttttctgcgaagccagaactttgcaaacttcacaacaggggtgaccacccccgcacaaaacttaaaaacccaaaccgattgacgcaccaatgcccgatggagcaatgtgtgaaccacgccaccacgcaaaccgatgcacatcacgtcgaaacagtgacagtgcattagctcatactttgtggtcggcaccgcccattgcgaatcagcacttaaggaagtgactttgatgtcaaacgttggaaagccacgtaccgcacaggaaatccagcaggattgggacaccaaccctcgttggaacggcatcacccgcgactacaccgcagaccaggtagctgatctgcagggttccgtcatcgaggagcacactcttgctcgccgcggctcagagatcctctgggacgcagtcacccaggaaggtgacggatacatcaacgcgcttggcgcactcaccggtaaccaggctgttcagcaggttcgtgcaggcctgaaggctgtctacctgtccggttggcaggtcgcaggtgacgccaacctctccggccacacctaccctgaccagtccctctacccagcgaactccgttccaagcgtcgttcgtcgcatcaacaacgcactgctgcgttccgatgaaatcgcacgcaccgaaggcgacacctccgttgacaactgggttgtcccaatcgtcgcggacggcgaagctggcttcggtggagcactcaacgtctacgaactccagaaggcaatgatcgcagctggcgctgcaggcacccactgggaagaccagctcgcttctgaaaagaagtgtggccacctcggcggcaaggttctgatcccaacccagcagcacatccgcaccctgaactctgcccgccttgcagcagacgttgcaaacaccccaactgttgttatcgcacgtaccgacgctgaggcagcaaccctgatcacctctgacgttgatgagcgcgaccaaccattcatcaccggtgagcgcaccgcagaaggctactaccacgtcaagaatggtctcgagccatgtatcgcacgtgcaaagtcctacgcaccatacgcagatatgatctggatggagaccggcacccctgacctggagctcgctaagaagttcgctgaaggcgttcgctctgagttcccagaccagctgctgtcctacaactgctccccatccttcaactggtctgcacacctcgaggcagatgagatcgctaagttccagaaggaactcggcgcaatgggcttcaagttccagttcatcaccctcgcaggcttccactccctcaactacggcatgttcgacctggcttacggatacgctcgcgaaggcatgacctccttcgttgacctgcagaaccgtgagttcaaggcagctgaagagcgtggcttcaccgctgttaagcaccagcgtgaggttggcgcaggctacttcgaccagatcgcaaccaccgttgacccgaactcttctaccaccgctttgaagggttccactgaagaaggccagttccacaactaggacctacaggttctgacaatttaaatctccctacatctgtacaacggatgtagggagtttttccttatatatgccctccacaaatcccctatcgtgtgagatgtgtttcataggtgcccccaacgttgcctgttgactgcaaattttccgaaagaatccataaactacttctttaagtcgccagattaaagtcgtcaatgaaaggacatacatgtctatttcccgcaccgtcttcggcatcgcagccaccgcagccctgtctgcagctctcgttgcgtgttctccacctcaccagcaggattccccagtccagcgcaccaatgagatcttgactacttctcagaacccaacttctgcgagcagcacctcaacctcttccgcaacgactacttcctcagctcctgtggaagaggacgtagagatcgttgtttcaccagcagcgttggtggacggtgagcaggttaccttcgaaatctctggacttgatccagagggcggctactacgcagcgatctgcgattccgtagcgaaccctggtaacccagttccttcttgcaccggcgaaatggctgatttcacgtcccaggcatggttgagcaactcccagcccggcgcgactgtagagatcgcagaagacggcaccgcaactgtggagcttgaagctaccgcaaccggcactggcttggactgcaccactcaggcttgtgtagcgaaggtcttcggcgatcataccgaaggtttccgcgatgttgctgaagtcccagttactttcgcagccgcttaagttttcttaaaacgcactcaaggcgcatcgtcaaggttgattccttaggatgcgccttctttgtcttttaaatcttctcgctcagcgattcccacagcttgagctgcactaattcacgaggtgccggcttcaaaccccacgcctctaccccaacatcaacctgccccggccccgtcatggggaactgggaatgcaaatgcccatgaatcagcaaaggcacacgcaggcggagatcatcaaaccgcgattccatccccggatgatcttggcccggccgagggaaatgcgacaagtagacatcctcgtcgtcccatttcatccgctgaaacgcctgaaccgaatcaaaaacctccaaaaaccgccgctgtcgcttgtacgcatgccggtacatcgggtggcaagaatcgtggtttccaggaacaagatgcttgacgacgccgcccagccgctcagcaattaagcccagcgcgcgctcttcagcgcgatgggcaccagaggaaagatctcccagaatccacagcacatcatctgggccgatcgtgttctcaaaattgctcagtattacttcatcgtgttcatctggatcgtcgaaaccccgcatcgatgccacgaatttgtgacctaaatgaaggtcagagctaaaccacatgtcagtcatagacgccagtctagcttttgcgattgactccccatccgtgaatactagggagtccaattgcttataatacaaaaacaggaatatttaactcgacttcttaaaaaagctctatacgtaaatatcttgcccatccagcaccacctcattgtggtgcacaatggagaggacacacatgtccaccaactctggcaataacttgcctgaatcccaagagtcacccgaggaacctcattatcctcacgacacccacccaggcctagttcctggcatttcggtcgatgctcaacgcaacaagttcggactcgacaaaaccgttttcggcgtcaccgcagcattaattctggcgttcatcgcctggggcatttccagccctgattcggtttcttcagtatcgtccacgatgttcagttgggctatgacgaatactggttggctcctcaactttgtcatgctgatcggcattggcaccatgctctacatcgctttttcgcgctacggccgcatcaagctgggcacggacgaagacgaaccagaattctctcgcttttcctggattgcgatgatgttcggcgccggcatcggtgtcggtatcttcttcttcggtccttccgaaccgctgtggcattatctcagtcccccacctcacaccgtggaaggatctacacctgagtccttgcaccaagcacttgcgcagtcccacttccactggggcttatccgcctgggggctgtatgccttggtcggcggcgcgttggcgtactccagttaccgacgcggccgcgtaaccttgatcagctccaccttccggtcacttttcggtgagaaaaccgaaggtatcgcgggtcgcctcatcgacatgatggcgatcatcgccacgctgtttggaacggctgcaaccttgggcctttcagcaattcaggttggtcagggcgtgcagattatttctggcgcttcggaaatcaccaacaacatcttgatcgccatcatcgcgatcttgaccattggcttcatcatctcctcagtatctggcgtgtccaagggcattcgttatctttccaacctcaatatttccttgacgcttggattggtcctgtttgtgttcatcaccggccccaccttgttcctgctcaacttgatcccatcgagtgtgttggaatatggcagtgagttcttgtcaatggctggcaagtctttgtcgtggggtgaggaaaccattgaattccaagctggttggacggcgttctactgggcatggtggatcgcatggactccattcgtgggtatgttcatcgcgcgtatttctcgcggccgcaccttgcgtgaattcgcgctcatcaccatggctatcccctccttcattttgatcctggcgttcaccattttcggtggaactgccatcacgatgaaccgcgagaacgtagatggttttgacggcagttcatccaaggaacaggtgctgtttgatatgttcagcaaccttccgctgtactcgatcacaccgttcattttgatctttgtgctggcagtattctttgttacctctgccgattccgcctccgtggtgatgggaacgatgagctcccaaggtaaccctgcaccaaacaaattaatcgtggtgttctggggactgtgcatgatgggcatcgcggtggtcatgctgcttactggtggcgaatccgcgctgactggtctgcagaacctcaccattttgatcgccattccgtttgcgctggtgttgatcgtgatggctattgcctttattaaggacttatccacagacccagccgctattcgacaacgctatgcaaaggcagccatctctaacgcggtggttcgtggcttggaagaacacggcgacgacttcgagctctccatcgaacctgcagaggaaggtcgtggagcgggtgctaccttcgattccaccgctgatcacatcaccgactggtatcagcgcaccgacgaagaaggcaatgatgttgattatgacttcaccaccggcaaatgggccgatggttggacaccggaatcgaccgaagaaggcgaagtggacgcgaaaaaggattaaaaaataacgactggctgggattcacaccatgtgaatcccagctattttgtttgctcagtgccctcgtgaccgtcctatgtgaccgatgaggtgagtttcggggagtcttcggctgcctagtttggtgtccaaggcgtaatagccaaactaggtggctaagaaacaatccgaataggctttattggccgcttggtctgtatctggaaactctgagcacaagactaaaaactaaaggccgggattcacatcgagtgaatcccggcctttagttaatttatgggcagctaaaacttatgctgccatgccacggttgagggcaatgaagtcaagcaggtctgcgttaacgttgccagcaatctgctgaagtgcagcggttgcctcgcgagcgatgaaaatcttgctgaagacggtgatcttggcttcgcggttagatgcgacatggtccaaaattgcgtctacctggacaggatcgaccaggccatcgaagcgagcgtgaagatcctcacgtacgctccaaagagcatcttgctgtgctggacggatcgtggagatcttggaagctgtggtagccattgtcgtgttcctttctgtttccgagggagttaatacttgaacccccggctgttaacctgatgtttactttagtttactttctatcaacctacaagcactccaggcgaaaagtagtgggatcgggccaactaatttcaatccacccccacaaaatccttaaatcggcacaatttataccagaccgcaaaaaacataacagcaggtcagggctacttaagctacctaaaaagcaactcaggacaccttagctaaacttagtgactagaatcacccccagggtgtgaataaaacttgtttcctggtcatttcccctactgaactgcgcttatgcctatgcttagaaaccagagacaagcttaagaaggacaggggccggccatgaatgatttcgaaacaaccatcgatcggatctctaaagaacaagatcccgcagcccgaagccgcgtggaacagttcattgtggaaacagtacgtgcactacccaacttgaccaccaaacaaggtgcatcgttggctatccaacttcttgatgcggtacagctcgcggatgcggcgggaaccaaggggggtgcgtcgacaagcaatgcttcatcgctgcctgacacctttgacgcgctgaccagcctgattggcaagctcgatgtgcgcagcgattctgaatggcgctcgtttgggttccagccttctgaaactgcgcacccgctaatgatcgctatccctgagattgagattttttatcagcacaccgatgtggagccgggaagcgatgacgccgtggcgccggactttcaggaaaatcaggatatgtggcgcaggcgtctcggatctgtcaccgaaccaaaccttatatataaagagttttccggacccggcaaagcgcagcgtgccgtagaaatgctgggcaatctgtggaagatcggcgtggtggtgagtaggaatacggaaagtcgccttgggttaactcgtgtggaatacacccccacccctggcgaagtacccgtgccgctgatgtcggagaagaactgttggtacagcattcgggtgtctgaaaccattggtgagaaccaggttccggaaattgtgcgctgcttaggcgagattttctgtggctatcttccccagatgtggctcaaagaaccagtaaaggccggcaagttgcgaatccaagaatcggaagcagcagcgtatatcgcgatggcgcgactagatctttccccacgcaccggcaacaccacttggaccaacagctatatttccacgcgtcctctctcccccgcttttaggtgggacgtggtgctggaggcttcccaccaattggagaacctgctgcgtggagacacagggccggtcactgccacacaatcggcagctggttaaccaaaagttcacgtggagatcactcatcgatcaccaacttcccataggttttctgtgtccaatgaatgcgttcaataaatgccctctttaagcatattctctgagtgcattcattacaggcgttaattaaatgcgttcatagaagaacttgaaagtggttgaagtgaagaagcgtaatctcctcgtagctcccctcactgcttccctggtgttctgtaacttggctgttgcagcaaacgccgttgaagttgaggccgaatcaccagttgtcatcaatgaagttgaatccaacagcgacccagttggtgactgggtggagttggctaacaccgacaacaacaactccatcgacatttccggttggtccttagtcgatgacaaggaagacctggaaaatgccctcgtccttcctgaaggcactgagattgagtccggtggatactttgttatctacaccgactctgctgattacgtgcctaccaacaacacctttggtggccaggaatacttcggcctcggcaaagatgacactgttactctgcgcaacgctgaaggcgaagtagttgctacctattcctggaaggatctgggcgagcacgcagaaaacacctatggtcgcatcccagatatgactggtgatttcgcaaacaccggcgttccaaccccaggtgcaaagaatgttgctgctgaaggctccggcgaagaagaaggcgttgttgcaaacgcccagcttccattccacaacgttgaaatcaccccaattcacctcggtggagatttcaccggtgaagatatgtccggcgttgatttcgatgcaaacagcaccgcatggatcgccaacaatgacattggaaagatctactccctcgcccacgacatagctaacaacacctacaagctgactggcgaatgggaaaccggctacccagaaggcggcggagagccagacgctgaaggcatcgtcgcagctaccaacggtgacatctacctgtccaccgagcgcaacaacgctgacaagaacgtctctcgcccatccatcctgcgttttgctaccccaactggcaagactggcgtacaaaacgcagttcaggaatgggacctgtctgagttcgtcggcgacattcagcccaatggtggtcttgaggcaatcgcgcagctcgaggacaacatcttcgttgtcggtgtcgaagagacaggtgatgtcatcgttgttgatctttccgctgaccagccagttctggttcaaaggtacgaatcttccttcgacggtgtcatgtcgcttgattacaacgcagcaaccaagcagctcagcgttgtgtgcgacgaagcatgtgacggcttgtctgaaatcctcgaatgggatggcgagaagctgtacaagtccgacgacaagatctacgagcgtccagcaaacctgggcaactgggctaacgaaggcttcggcacctacacctcagagcttaaatgcgagaacggcaacaccgtttctgtcaccagctacctctgggctgacgatgcagcaaccaacgaaggcacctccctcaactccgcacaggtcatcaacggagattgcggcgacgtcaacatccctggagagtcctcttccgacaattcctcttctgactttgcaaccggcagcatcgcaggcgcctttgcaaccgcagtgctcgcagtcgtaggcattgcgggcgcactgggtggattcttccagcagatcctcgcagcgttcccagcattgcagcaggtcatccgtttctaaacccactgcttgaaacacttaaagcaccggcagccttcatggttaccggtgcttttctgctcttttacaaagcccccacctatgattggggagatcccctcccctgcactgaaagctaaaccccgtgccaccttcatttttcccacgccgccgcaaatcagaacccgaccttctggcactccccgctcaaatccgggacgtccatgccgacgttttagacatcttcatggcggaatctttagtgattatcaacatcgacgagaaaagcgccaagctgcttatcgacgccgcccgccaccacatccccacccgcttcaccgggcccaacgcccggccgctcagcgtcatccccatcgaggatccccgctcacgcccgacgctccacccagatcatggttggatgatgccgctaagcccaccagtggtggatgaactgcttggcggtggcttgaaaattggagaaacagaactagaaagcaccaacattgcgttcattgttgatgcttcctaaaaatcctgtgccgtgaggttttgtgaagtaaagccatgttggcattcctttcgtgcaaaaagaaaaccgccatcgctcccctctcgtcgaggtacagcggtggcggtttcttagctgatggctggaggtttagcctcccatcaatcccattgttgtgggcagccagatagagatctgcggtacgaaaacaaccacgaacagcgcaacaataatggcaatgagatacggccacagtcgtctgatcacagtttccacacgcagccctgccacttgcgaaccaacgaacaacacgttgcctactggtggggtaatcacgcccacggacaggttcattaccaccatcgcaccgaagtggactgggtccacaccaagttcggtaaccactggaaggaagatcgggacgaagatcaaaattgctggtgttgggtccattacggtaccgatgagtaacaggatgaacatcatgatcaacaagatgacaaccttggaatcggataccgaaagaagcgcatcagagatcatctgagggatcttggcaaaggccatcacccacgacagtgctgcagaaactgcaatgagcaacatgacaattgatgtggtgcgagttgccttgagcaaaatatctgccagatctcccaccttgattgtgcggtaaataaagcccaagaccaggcagtacactacagcaatagcagcggattcagttggagtgaaccagcccagcaagatacctccaacaacaatgacgatcatgagcagtgaaggcagcgccctccacagcacaacgagcgactgcttgaatgttggatgaatctgctcgcgcttgtagttttcctttcgcgctaaccaagttcccacgatgacacaggccagaatccagagcagaccgggtccaacaccggccataaatagtgctgcaattgatgtcgaggacaccaaggaatacacaataaaagtgtttgatggcgggatcagcatgcccgcaggtgctgaagccacgttgacggccgctgcgtaagcgcgcgagtagccctcttccttcatttttggtgtcatgacggttcccacggcagaagctgatgctaccgctgcccctgaaactgctccgaagagaccatttgctgcgatattcgtattggccatggaggcaggcatgcggccgacaagcaccttcgcggcgtcgataagccgcgtggcaataccacccgagttcatcagcaaacccgccaacacgaagaacggaatggcaaggagtgtaaaggagtttgtgccggtaaacatgcgctgcgcgacggcctgcgcggcgttttctgggccaagcacggccatcgcggcaaaaagtgatggcaaaccgatggcaatggcaacgggcactgatgcgatgatgagcaccacaatgccgatgacaagaattaaagctgctacagctgctggcgacaacatattagttcctaccttccgctgaacttgcagaatctatagcgctttgggcctctagctcgtccaaatctcgaggttcttctgattcatcaacaagggggtaaggctcttccttgcctgtggccacttcgatgagatcgatgatcgcgaacaacgcgatgaacacacccgcgatcgggatgacaacatacacccatcccaaggtaagtggcagcgcagtgagctgctgattccacgcgattgatgcagccaagtagccaccccagatcatgccgaggatcgcaaaaacaacaatcaacaactgaacaatgacctgcaggacccgctgcgcagaaacaggcagtttgcgcgcgatgaaatcaaccgcaatatgtccacgctctccaaagaggaacgcactacctgcgaaagatagccacacgaacaacagcttggatagttcttcagaccacgttgatgggctgtgcagcacctggcggctaaacacctgccaggcagtgacgcacacgatggacttaaaattcatcatgatgccgcacctcctgaagtatcagcggcgcgcactgcttcgtagagttcacgctggaattctgaggtcaagaattcgtctttgatgggagccagtgcatcggtaaatgcttgcgcatccacctcaacgaactccgctcccccagctttcgccttttcaataacggcatcagtttctgtgttccacagatccgtgtgctcagtcatcgcggcgtcccattcttccaggaacaattcacggtctggctcgctcatggcgtcaagcagatcgtgtcgcatgaccatgtaatccaaaccgacaaggtgattggtgttgctgttgtagcgagcaacctcgaagtggttttgggtaacgtaactgatctcgttattttccgcgccatccagcacaccagactgcatcgcggtatatacctcgccgtaagtcaacggggttgccgagccacccatgagttcaatcatgcggatgtgcatggcggattcctggacgcgaatcttctttccagccaggtcagcgggtcttttcaccggcgcatcagtggtgtacagatttcgggtgccttgggtaaatccaccaatgacagaaatattgtccgattccgcaagactttggaacagtggctccatcagatcctgatcccggatcacgctcatttggtgctcgatgctgccaataacccccacttcgggggtagtaaaccaatcaaacgaccttagatactttcgcttttcgacgctcccccacaccgaagcacgacaacgccccgctgagcttcaagctcagcggggcgctaaaagaggctaaagttttttatgcctcgtcggtagacagtgctgctacgaatgcttcctgaggaacctcgaccgaaccgatgttcttcatgcgcttcttaccagccttctgcttttccagaagcttgcgcttacgggaaatatcgccaccgtaacacttcgccaacacgtccttgcgcagtgcacgaatgttttcacgagcgataaccttggaaccaatggctgcctgcacaggaacttcgaactgctggcgagggatcagttccttcagcttcacagtcatcttgtttccgtaccactgcgcattatcgcggtgcacgatcgcagagaatgcatccacaggttcaccttggagcaagatatctaccttgaccaggtcggcagtctgctcgccagcttcctcgtagttcagcgaagcgtaacccttggtgcgagacttcaacatatcgaagaagtcaaagatgatctcacccaaaggcatggtgtagcgcagctccacgcggtcctccgaaaggtagtccatgccacccatctgaccacgcttagtctggcacagctccattgtcggtcccacaaattcgctaggaacaatgatggtgaccttcacgatgggctcgtaaacttcactgagctttccgccaggccagtcagatgggttgtggacgcggaattccttgcccgcctcatcaataacgcggtagttaacagatggcgcggtagaaatcagatcaaggccaaactcacgttcgagtcggtcacgggtgatttccatgtgcagcagtccgaggaagccacatcggaaaccaaagcccagtgctacggacgtttcgggttcgtacgtgagggaggcgtcgttaagctgcagcttttcaagcgcatcgcgcaagtcggggaaatccgcttgggaaatcgggaacaagcccgagtaaaccatcggtgttggttcctggtaaccgcgcagtggctgctcagctccatgaattgcccacgtgacggtatcgcccaccttagattggcgcacgtccttcacaccggtgatcaggtaaccaacctcgccaggtccaagacccacacactttttaggggtggggctcacgatgccgatttccagcaactcgtgggtggcgccggtggacatcatcttgatcttttggcgaggtgtcagcttgccgtccatcatgcggatgtaggtaaccacgccgcggtaggtgtcatagacagagtcgaaaatcatcgcacgagctggggcgtcttcctcaaattcagaggtaggtgctgggataagttcaacgaccttatccagaagctcagggacacccatgccagttttaccggacacgcgcaacacatcttcaggttcacaacccacaatgttggcgatctccaacgcgtacttgtctggatccgccgctggaaggtcaatcttgttcagcacagggatgatctcaagatcgttttccatagccaagtacaagtttgccaaggtctgggcttcaatgccctgcgctgcatcaacaagcaaaatcgcgccttcacacgcttcaagcgcccgagacacttcataggtgaagtccacgtggcctggcgtatcgatcatctgcatgacgatctgctggccctcgtactcaccactgcgaggaatccatggcaggcgaacgttctgagccttaatggtaatgccacgttcacgttcgatgtccatgttgtccaggtactgatcacgcatatcgcgggcatccacaacgttagacagctgcaggatacggtcagcgagcgtagatttaccgtggtcaatgtgggcaatgatgcagaagttacgaatcctggctggatccgtaaatgttgtttctgcaaatttctctgccatatgcgtcaggggtcccttcaattaaataacggtgtcctactctacctgagcaaacccaaacagttaaacagccctgaactgccaaaccatcagcagttttccactggttctctaaccccctaaactacccccttttgatgtaacacataactcagtcttgcgatattagataatgagtcagaaaatgaaggtagcactacttgctggattaattttcaaggttttctttcagaaattaatccatagccgatatttaaggtgagaacacatgagctccacgctcgcacgaaaagcttcaggcgacggttccgaaaagaagaagcctggcttgtttagacgtgcgcttcgtttcctcacccacccacctcacaaacaggtagacaacagccttgcggatatccgtgaaggattaggcctcggggtggacgattcccacgaaggatccaaacccagcaacgatcattctttgctgcatgaaaagcctgaaatttccgtcatgccgaccgaatcaatggcacggctgatcttttatgcgcctgatatggatgggcaaacagaccccggtgaagtagtgtggatttgggcaccagccgatggcccccagcaaccaccccgtaaacgtgccatcgttgttgttggaagaaaccgaaacgccattttaggtctgctcatttcctgcaaccccgagcaccgcactgatgaagactggatcgacattggatctggcagctgggaccctcgaggtcgccaaagttgggtacgactcgaccgcgttctggaggtacccgaattgggtatccggcgccaaggaacagtcgtccccccggggcgctttgagcgtatcgccaaccgcctccgcaacgatttcaactgggtctaacatttatttggtaattgggcaacatcactgatactcttgaacgctgttgtccatctttgatgtgagcattccagtgacatgcggacaggaccttgggttcgttgcactttatgccaagcagtttatttaaaactgcgggagaaacactcctcgatgggtttgtacacaactttaactagaaagttcaagaggtatttgcgatggcaaacatcaagtctcagatcaagcgtaacaagaccaacgagaaggctcgtctgcgtaaccaggcagttcgctccgcagtccgcaccgagatccgcaagttcaacgctgcgattgaagcaggcgacaaggatgcagctcaggctcagctccgtaccgcttcccgcgcactggacaaggcagtaaccaagggtgtcttccacatcaacaacgctgctaacaagaagtccaacatggctaccgctttcaacaagcttggctaatttttggctcttttgaaaatggcttcctatcagttttgattggaagccattttttatgcctttacccgagtaaaccggtcaggccttcatacagcagagtcacacccacaacgaggaagacaacgccagcaagcaggtcaaaccagggacctgcacgcagcattgctttgcgcacacgctccgtagagacaatgaggcacacagcagagaaggtaacaaaggtctgcactaaaatcgccacgatgatagagaacgccagcaccggtgatgggtgcgctggcatcaacggagccagaattgccgcgaagtacatgacaactttagggtttgacaggttggtggccaaaccttgtcgatatacctgagtgcgggttcccagtgcttctaccgcatccgggataggtcgggcatcggcgttgaaacggaactggcgggcgtcgataagctctctcgacgccgagcgcagcaacttgtacccaatgaagcttaggtacgtgccgccgacgagctggatgattccgagaatcgacggataagtggtgagcagcgccgctgctcccacgaccgtcagcgtcacccacaccgtgagtccggtgacgatgccggcgacgccagcgatcgcgtgcgctctggagcgggtggctaagcggaggaggaaaaaggtatcaggccccggggataaactgcccaccaaattgagcagaatcagggtgccaaaagcggtccactccaccggcctatgactcgaagcgagctacgagatcctcgcggccaaacatcttggcggtatcaacagcagttggagttccagcgtatgggtcagcaccaccagcaagcagtgcctcaatgacggcttcttccttcttaaagatcgcgcccgccagcggcgtctgattgcggttgttcacgcgatccacatcggcgccacgctcaatcaacgcctgcacgacatcagcatgtcctgcatatgctgcgagcatgagcaaagtgttgccatcttggttggacaggttaacgtcaacgccgttgtcgacatatgcaccgagggttgctgcggattctgctcccccatcacgtgccagtccaaagatcttagtgaccaattcctgaacatcatcgggtaaatctgattgtgtcatgctcaaatatcttacccgccgccgttcagcgttaccgcctcgccagctctgcaactcttctcacggcagattcgatggcaaattcaggatcgccactttgtccttttacagcggcatccagatcggccatcaaaatcacggcctcgctgaccgcatctcccgaccagtttcgggccactttcgcagtcttctccaccacgaacggcggcatgcccaattctttggccagctcaaaaccgttgatgcgtcccctggtggaatacagcctggcgatctggccaactttcatactcaacgcagctgccaatgcaaccgggctggtacccaattgaagggcacgtctggtgctggccacggcctttgacatttgaccggcgcatgcagaatcggcgatgtcgaaacccgatacctcagcaacacccacgtaataggcacggactttttccaccgtcacgttgccttgggtgtcctcaaccaattgggatacggcggacgccagctctctaagatctgaacccacgccctctaaaagagcatgaatgacatctggggtgacctggactttgtggtttttgaactcttgttttacccaacctggacgatcccggtctttcagctttgcggcatcgtgcaccaccgcgactttttccagcttcttcaccatcgacttagagcgtccaccgccagagtgcatgacgatcaagtaggtaccagggctgggatcaactgctgcggataaggctagatctacagcatcttggcctgcttgatccatgttggtaagcaccaccacacggtcttcagcaaacaaggatgggcttaacgcatccaacaattcaccctgagtaatttcgctggccttcaaggtggtgacctgaagcgaatcggggctagccatcgatgaacggatgtcatgcacgatgttgatacgcgcgcgttcggcaaggaactcatcctcgccgagaacaagatggaccgctggttgaactgaaataggtgctgaagccacgtgaccatcgtgccacaagtgtcgttaaaatctcccgtccgctgcatgctgggtgccatcaatatgaaggctgacctccccatcgcggtatggatacagcacagggattccttctctggtgacgatggggcgatcggacatgctgccgtgggggtcttccacgatgatcaattctgcatgttcgggcacatcagtgagctcagaatcatcggcgatgatgacaaaccgcagctctgtcggatctatttgggctggcagtctgttattccacgcgccgaaaagaaagaagcagacacaacacactgcaagggtgcgcacatatcctttgtagataatcaccaccacccacaccgctgccatacacgcccaggcaatccctgcccaaccagcacttatttccagcgtcgaattgggtaattgttggcaccacttggccacgtgatgaatccaccaggtgaagggctcaatgattttcaagagtgggtattccactggccagggaagaaggcttgccagcacggcaatcaacccaagcaacgtgatgggtggaacagctaattcaaccaacacgttggccagcactgccacgagggatatttggcgagccatcagagcgataatcgggatggtcaccagatcagcggcaatggacaccgcgaaagcgcgcaccacgatgtctggtactttccacaccgccagtggtggaccgatggcacggtacagcagtggttgaagcatcacaatgccagcagttgctgcacacgagagtaagaatccgtaatgcaccgccaggttggaatcataaaacagtaagcaaatcaccgaaagactcaacccatgcatcggctccatccgagaagagttgatgattgccagaagccccacgatgcctgtgaccgaagcacgaagcacacttggttcaaaccccacgagggagacaaaaataactaaggacagcaatgacgccaccaccctgatgcgtggcccagcggtgagaaaatacgacaacaccaccacagaggacaccacaatggctacattgcttccactaacagctgacaggtgagacaaccccgtatcaatataggtttgggcttcaattgacccctgcaaccgcgtatcccccaacaccatgcctggaatcagtccacgggaagactcccccacggtttcttccacggcttgggaaaacccgtcacgcacctggttcacccatgcgctataaccagtggtcggttccaactgatcaatgtcttcagtggaaatggtcagatcacccaccccagggaaactatctggtttaatccgaccggacactgcaatgagagaggctttctcaatggtgtcgctaccagagtaaaacactggaatcggcgctggatagccttctactctcaaaccgattagttgatcaccgctgtctaaaaacttgatggtttctgcggtacccacccaggtttgcggtgcttcaaatgccttcgcgctgctgattctcaacgcagccatcactacggcaccaacgcccagtgcagctatcaccacagcttgaccccagtgtttaaacacacaagcagcaatgatcgcgatgccaacaatccccaccgacaacacccacgaaccactgataatcaacgcagcgacagccatccacatcacagccgccaccggaaccaaacgcacctcaatcatggggacaccaatccagagatctgctcaaactttgagggcccaatccccttgacctgcagtaaatcctccacggtgctaaacccaccgttgctctcccgaaagtcaatgatcgcctgcgctgtcttctcccccaccccaggcagcgtcaccaaatcagcaacagtggcggtattcaaggaaatcaacccagaagcagaagtcgcagcagcatcaaccgaaataggttgtacctcgccgatagctaaaacatggatctgggtgccgtcgacaagcaattgcgccaagttgagcgccgtcagatcggcgtctggcaaggcacctgcaatggccagggcatcagccacccgcgagccctcagcgagcgtgaccaggccgggtttagccacgtgccccaccacagacaccaccacctgcgaactcggcgccggtgtttgataggtttccgccaacgccgccatggtgggtggattcacgggtttctcacgggtgaaaaaccaaccgacaaaagccacaacgagaacgatgcacacgatcaacgcatgcttgatggaaatctgaaaccgaggcgtgggatagttcacgcgcatgaggtcttctgtacccgtgggctgggtaagacctttaaggcgtgctgcaatatccggcttcatgcagcacagactaaatgcagtggcgcccttaatctagcaaggcgtcagcacggctgtggataactatttcgcgccggctttacctgtggacaactccggggcctggttggcaaacaccgcagaaactgataccgcgccggggccggaatgcacggcaagagtgggatcgatgtccacgctcatgaagctggagccttcaggcagtgcgtttcgcagcaattcttccaactgctttgctgcttcgcgggcctcgttttggccaatcgcaatgaatacgggttcaccatctgccctgatctgggctaattccaccaatttggcaaacgctttagattgggtgcgggtcttagcggcgatctccatgcgaccaccgttgaaacgcatgatggggcgggttgccagagccgttgacaccatggcggttgcagtggaaatccgtcccgacttccagatttcatcaatgcggtgcaggtagatccaggtttctgaacgcttcaaggtatccaccgcgatgtcgtagcattcctgcaaagacgcgccatctttagccatgcgggcagcagccatcgcggcagcacccacagccataccgagcgaactggtatccaccacgcgcacagaatcatcatcaaacacagcggctgctgtcaccgctgcggaccacgtggacgagagctctttagaaatatgcagcgcaagcacaccgtcatcgccaccgcgttcaagctggcgggcgtaacttgctgcaagttccaacgacgacaacccggatgtactgcgttcttcaccgttattcatcacgtgcaagttaatcaccgtgatgtcgaggtcctcggccacatgcgttggcaagcatgcggaggaatcaacaattacccgaactggcatcgcctttactcctccacatttttattgccatcttctttactgcgtaacacccatgttccagccgtcaagataccactgggcgttttccacattgttgccctcaaaatgagggctgttggaaaccgccgaagaaatcttgaggtcatcttctgggttctcactacctgcataatagcgaggtcgggcggtcaattgtgcccaacaggtatttccaagtccagagaacatggggtactgatcatacgccaggtccaaaagattcgaggtcagcgcattaatcgtgccaccgtgagccacgatgagcacggtgccttcatcccaatcatcaagcgacaccatcaactcgtcgacaacttggcgtgcccggcgcgcaacatccacgcgcgattcgccgccgggtggtgcccactgcggatcgtggcgccattgagcgcgcgcacctggatattcggaatccacctcagtgtgggttttggcctgccactcacccaaatgcgtttcccgaagacgcttatcgacgcgcacctccgcgtcaatcagcgccgcaaccgcgcttgcggtgttgaaggcgcgggaaagatccgagctgaacacatgggtgatgtttttttgaaccagcactgaggctgcgctggccgcctgttgaaagcccaggtcagacagctctgtgtccaattgtccctgcattcgggacgtggcgttgtattcagtctgcccgtgtcggagcagaatcaggcgacgagtcacaggactacctcttaatcgtcctcgtagccaggctcgtattcagctggcaaaggtgggagttcatcaatgctgtcgatgttgcggatatccgcctcatcagaccaggaggattcacgcttgaaggtttcaagtccttcaatttcaatgagtgggcagtcgcggtacagacgatccagtccgtagaactcgcgctctgcctgtcgctgaacgtggataacaaccaatccgtagtcaaggagaacccaacggttttcgcggttgccttcacggcgcttaggctcgaaaccagccttggtcatctcatcttcgatctcctcaacaatggcgcccacctggcgctcattgtcagcagatgcaacaacaaagcaatcggtgattgcgatcatgtcagagacatcgatgacagcgatgtcatcggccttcttttcatccgctgctttcgccgcgatggtcgcgatgcggatcgactcttcaagtgcagacacaaaattccttaaaacagctcatgtggttcctcacccttttttagggtccgaaccgacgctgcggagagattccgcaacgtcaacccttcccagttttccacgaagcagggtgattcacctacttttggcaagaagttgaaacttttgactagatttatgcttggttttggcccttgggatccatatccttatcggatccttcaggtcgatagagttggcgtttggcaatgtattgcaccacgccatcagggacaagataccaaacagggcgttcttcgctggagcgttctctgcagtccgtggaggaaatagccatggcggggatatccaccaatgagactcgatcttggtgcatttccggaatgatgtttccatccaattcataaccgggtcgagtcactccaacgaagtgggcaagttcgaaggttttctcccaatcgcgccacgtcacgatctgtgccagtgcatcggcaccggtgatgaagtacagctgggcgtccgggtattgcttgctcaaatcttgcagggtatcgatcgtgtaagtatcccctccccgatcaatatcaacccgcgataccataaaccgtggattagaggcagtggcgatcaccgtcatcaggtaacgatcttccgctgggctgactttcttgttcgccttttgccatggctgtccggtgggaacgtacaccaccagatcaagatcgaatcgatccgctacctctgagcccgccacaaggtgaccattatgaatggggtcaaatgtgccacccatgatgccaatgcgagcgcggcgtttcaccgttgtagtcatgagtggacagtatagtgttcgcacaccaccttgctgagcatgcgtcctcgcgagtttttaggcagcttcaatccacgatgcgacttcgtcaaaaatctgctcatcccacggttgggtggtaacgaagtattgcacgtgtactcgacctggacggatatttccggtgctcaattgcgcagctgctatagaggatcccgcagcagagaactgttcaaaagaacgatcgcacacgatgtctccaggcaggcagtagctcaccttgaaaggattgtcctcgacgggctccacggaactagccaagcctcccgtggttacttcatgcccaacaagtgttggatcatcaacttgttgcgctggattcgcgatgtgcagggtgccgaggtactgatccctcgcaatcaactcctcttcatagccatcaacgatgaggacaccttgagaataacccgccaacaggtacttcggcgtgcaccctgtcgctgattcaaagcgatcaatcgcgctgatgacattgtcgcgaccactagaaatggaagtgcccaattcaatggcgctgcttccctccgaagacagtggcaaagaagcagggtattcgatattattcagacccatcacgtagacgtctttcatcaacgactcgccagtcgattcacggtagtgtttttccattcggccaaagaaactacgaaagtttttttcctcaaatccattggatgtccatggagattcctcgctgtatcgcgcgggtcggatttgaaggttttgttcactgcctcgtgcgaccacagcaacaacggctgggcattcaccaatttgcggtggatcaaacacctcttcatacaggtctggggtgaggtcagggtgaatagatatatggctgtcatccaaaggatcaagaagccgctcgataaaagactcatgggattctggaaaaagtaaatcccacagcccgctagatcccgctgaagaaccagaggatccagaagagccactgctttgtgcctgagctgttggagtcgcagcaacacacgccgcgatgaccgctatgccagcaagaaaccgacggaagtttgtgacagacatgaaagctcccctgctgacaagttggtatgaaatcttttattaactaaataaaagactacaacgagtcctcacaggggagcttgattacttcttcaaacttaaggcctaatttgtcctgtgccctgcagaatccacttggtggaggtcagctctggcagggccattggtccacgtgcatgcagtttctgggtggaaatgccgatctccgcgcccatgccgtactgctccccatcggtgtaggcggtggatgcgtttatcatcaccgctgctgcatcgacgcgatctgcaaagcgctgagcggtttcaatgttttgggtggcgatcgcttcggtgtgcttggtgctgtacttagcgatgtgtgccagagctccatccacaccgtcaaccacagcgacagcgatatcgaaggacaggtactcagaatcccagtcagtttcagttgcttccaccacgtcggttgcaccgaatgcttccaattcggccacccgtccatgaattgtgactcctgcttcctggagcgcctggacgactgcaagcttgtctgagtcgctgagggcggcgtcgagaagcgcggtttcagtagcgttgcacacgctgcagcggcgggtcttgccgttgatgaccatggcgattgcctgatcaagcttggcttcggcatcgatgtagaagtggcagttgccggtgccggtttcaatggtgggcacggtcgcaccggtgaccactgcgttgattagtcctgcgccgccgcgtgggatgaccacgtcaacgaggccgcgtgcggtgatcaaatcttggacggatccgcgggtttggcaaggcagcaactgcacggtttcgcgtggcagctcgaaacgctcgaggacgtcctgcaggatttccacgagcttggtgttggaatgcacagctgtggaggaaccgcgcagcaaagctacgtttccggacttgagtgccaggccgaaggcgtcgacggtgacgttagggcgggcttcatagaccatgcccatcacgcccaaaggcacacggacctgcttcatctgaatgccgttttccatgacatgtccgcgcagtacttcacccactgggtcggtcaggccagcaacctggcgcaaaccgccagcgatgccctcaatgcgagattcatcaagggcaaggcgatcaatcatggattcttccatgccgtttgcgcgacccgcttcgatatcggaagcgttggcttcgatgatttctgcgctgcgtgcaacgagttcatctgccgccgcacgcaggattgcgttcttcggtccggtgcccaacactgcaatatccgggacgatgttcttagctgcagttgctttagctagaacttcggtccgctcattgtcgcgaatttggtcatcagttagggtcgttgaactcatggttgcccactatacagacccttaagaagcaacagtgtcggatcacaccataaaaggcctagtagccagccaccacatcgacctcggtggccatctgctcgcctgcctcaaacaactcaatgttgcgcaaggtgagttcgccggtcaaagcacgaatcctctcattcgtgtttgcagtatgaggagtgataaccacattgtccatctcccacagcgggtggctgtcaggaagtggctcaggatcggtaacgtccagcgcagcacccgcaatggtgccgttgttcaatgcatccaccagatcatcggtgttgatcagcgggccacgccccacattgaccaccacggcagaaggcttcatcttgcccaaagtttctgcattgacgatctgataagtggcatcagtcagcggcaggatgagcacaaacacatcagcctcagcccacacgtgctcagccttatccatggcgaaggtttcatctgcaccttccaccggacgaccagagttattaaccgcaatggtcttcacgttgaacggcttgagcatttccagcagacgcacgccaatgccaccggcgcccaaaatagcgacagttttattgtcatgcagccatgacttgttgttttccacctcaggccgcacgctccacgacttagccaaacgagtcgtcgcatgcatgtgcatctgcgccagaattaaaccaatggtggactcagcaacggtgtcagcgtacaggccagccgcgtttgcccaacgtgccttctcattgacgacaccacgcttgaccagcgcatcaatacccgccatggaggcctgcacgaacttgatgttctccggcaaatccgggaactccggcgctgaaccattaaagaaaatgaagtctgcatctttaatatcctcaacccgctcatgtccgccaccctcaatgacagcggtcgtggactcccacaaatgcggatacataacaaacttcatcgtcttaaactcctttaaaaatgcttttcgacgccacccgccaccagcaggcccgcgctttacgcgcggctggcgtagttggacagataatctgcatgcactaccgggcgctgcatgccatctggaaggtcctgcgtttgcataccaaccattgattgcaaggtatcagaatcgtaggacacctcgcctcgcccgatgatttggccggcaggtcccaagatctccacgatctcaccctgctggaaatcaccaatgatttcagtaatgcccacagccagcaaagatttaccaccggaggtcactgcttccaccgcgccgtcatcgagtcggatctttcctgcagtatctgcggcatacaaagcccagaacttccacgcggagaggcggttgtccttggggtggaatacagtgcccacctgggcgtcttccagtgctgggccaatgtttgccgcagaggtcaacagcacaggcacgccacttcgggaagccaaacgtgcagcagacacctttgatgccatgccaccggtgcccacttttccgccgtcgccggcaatgacacctttcaaatcattgccgtcacgaacctcggaaataaacttcgcggtgggatcagtagggtttttatcaaaaagtccatccacgtcactgagcagcaccaaagcatcagccgacaccaggtgcgccacaattgcagcaagtcggtcgttgtcaccaaaattcacaccggtggttgccacggtgtcattttcattgacgataggaaccgcgcccaaaatgcgcagcttgtcgatggtacgctgcgcattcctcgcacgatcacgctttcctgcatcagctgcggtaagaagcacctggccgatggggcgaccataccgggcaaaagaacgtccccactggtgcatgaggtgaacttgccccactgctgctgcagcctgcttgactgccaattccgtgggccgggtgctcaatccaagcggggccattcccgcggccactgcgccagaggacacaacgatgaggtccgagccagcttccatgcgtgcttgcaaggcattgacaatagtgttgatgcggttgggatcgacggtgtgtccgtcctcatcgttagtcaatgaggacgaaccaattttcaccaccactcgcttagcgttggagatgcgctcacgcattccggattcatgtccgtatgcggcgctgtctttggtgtccggatccactgccgggaagctcgcaccgatgcttgcttcctggctgtagggggtgacaggaagccctgtcaccggcgccatttgggttggcgttgggagattatcccgtaatcgaacgctttcaggtgtgttctgcgtatcattcatagcgttaccatcgtatacacgtagacctgaaaagtgctcggttttatccttcccagcgttcgcgggaagcctcttggtcctcgccataatccaactcatcgatgaggccacgacgtacctgagatgcgcgtttacgctctgcagcagagatacgagaggtctgttcaaggcgcacatcggtgccacgtccggtaaggactggatcgtcgccagcggtggtcattggctcccactcgaaggaaatgcctccgatggtgacgtttgcacccacatgtgctcctgccttacgaagcccgtcctcaatgcccaacttggccagacggtcagccaggtagccaactgcttcgtcgttttcaaagtcggtctgcaaaatccagcgctctggcttttcgccggtgatgatgaatccgccctgaacctctgggtcaggcttgatctggaactgccccttagtgcggtgatcaacagccttaggcttaatgatgacagactcagccttctcctttggacgcttctttcgggcatcctggacgatttccagcagcttgtacttcaaaggatccaagcccttgcgtgccactgcggagataatgaacacgggccatccgaattgcttctcaatatcttctttgaggaactcagcaagctcttcagcctcagggacatcagccttgttcaacacaacaaggcgagggcgctggctcaagtcaccaagtccggtgtcttcatccaaagccgactggtaggcggcaagttctgcttccaaagcctcaatatcagagatcggatcgcggcctggatccatcgttgcggtatcgacaacgtgaaccagcacggaggtgcgctcaatgtggcgcaagaaatccagacccaagcccttgccctcagaagcaccagggatcaaaccaggcacgtctgccatggtgaaagtctcatgaccaacgttaactacgccgaggtttggctgcagggtggtgaatgggtaatcaccgatctttggctttgctgcagacatcacagaaatcagtgatgatttgccggctgatgggaagcccaccaatcccacatctgccatggatttgagttcaagaatcaagtcgtgggcctcgcctggctcaccgatcagggcgaagcctggggccttacgagccttggaggcaagcgctgcgttacccaaaccgccgttaccgccagcagcagcgatgaacttcatgcccacgctggtcaggtctgccagagtctcgcccttttcattaagcacgacagttcctggtggaacttccaagacaaggtccttgcctcgggcaccgttgcgatgatcgccagcgccgttagcgccgcgctcggccttcacgtgtgggtggaagtggaagtcaagcagggtgtggacctgtgcggtgacttccaagatgatgtctccaccgtggccgccgttgccgccgtctggtccaccaagtggcttgaatttttcgcggtgcaccgagacacaaccattgccgccgtcacctgcggcgaggtgtagcacaacgcggtcaataaatcggttcataaaacggtgtcactcctgatcgggataaaacgggcgccgacgtataagtagaaaaataaagggggatgtgtgggcgccaaggttcttcgatcctaccagtgtcaacgcctatgtgaataactgaaaactaacgatcctatctgattattttgtgcggtgtaggaaaaagtggacaatactgatggataaatttcatatcgaggacgaagggacaaccccgaacgccgtgacaacatcaaccacaacccgggtgaaacatccggtagaccaggtgccacccgcacccaaacttgcagccctagggctccaacacgttcttgctttctacgcaggagccgtcattgttccgctgctgattgcacagtcgctgaacttggacactgcgaccaccattcacctgattaacgctgacttgttgacatgtggcatcgccacgttgattcagtctgtgggcattggtcgccacattggtgtgcgcctaccgatcgttcaaggtgtcaccactactgctgttgctcccatcatcgccattggtttgggcgttactgatggtcaaggtggcgttgcgtcgctgcctgccatttacggtgcagtcattgtctccggcattttcacgttctttgcagcgccggtgtttgcgcgtttcctcaagttcttcccaccagttgtcaccggtactgtgctgttggttatgggtgcttccctgctgtcggtatctgcaaatgactttgtgaactacgccgatggggtgcctgctgcccgcgatcttgcttacggttttggcaccttggcggtgatcattttggcgcagcgcttcttccgtggattcatgggcaccttggctgtgttgatcggcctggttggtggcaccgcagttgctctgatcttgggcgatgccaacttggatgaggtgggaaatgctgaagcgttcgacatcaccactccgttttattttggtgttccagaatttaacgctgttgccattttctccatgattatcgtcatgatcatcaccatggtggagaccaccggtgatgtgtttgcaacgggggaaatcgtcggcaagcgaactcgccgcagtgatgtcacccgcgcactgcgcgctgacggcctgtccaccctgatgggtggcgtcatgaactccttcccgtacacgtgcttcgcgcaaaacgttggcctggtgcgcatcacgggcgtgaaatctcgctgggttgcggcagctgctgccggcttcatgatcatcctcggtgtgctgcccaaggctggcgcgatcgtcgcttccatcccttccccagtcctcggtggcgcatccttggcactgttcgccaacgttgcatgggtgggcatccagaccatcgccaagtctgacctcgctgatagccgcaactccgtcatcgtgacctccgcacttggcctagccatgctggtgtccttccgccccgatgttgctcaggcgttccctgagtgggcgcgtatcttcgtctcctccggcatgtccgtcggcgcgatcaccgcgatcctgcttaacctgctgttcttccacgtcggacgccaatccggtggacaagtcgctacctcaaaatccggtgagcgcatcaatttggatgcggtcaacaagatggatcgcaccgacttcgtagaaaccttcgcaccgctgttcaacagcaagacctggcctttggaaaccgcatgggaatcccagccattcgccaacgtcacggaactgcgcgaagccatccaagtcgctgtgctcaccgcaccgttgtccgaccgcgaagagctcatccacgactaccccgacatggcacagctcattttggccaccgaagaggaagccgccaccatctctcaagaccgtggttcgatcggtcttgatgatctcgatgacgtggatcaagaaaagctcatcaccgtcaccgagcagtaccgcgaacggttcaacatgccgtatgttgcgtacttcgacaccatggattctgtggataccgtcgtagccgccggcttgcgccgcctcgacaactccgacgagcaggagcaccgccaagcgctatcggaaatcattgagattgccaatgaccgcttcgatatattgcttgccgacgctaacccagcccgttcagctttcgatcgcaagtttaccgagactgacttcctcggctaaaacaccaaaaacaaattaaggccctgcacttatgtggagtgcagggccttaccttatttctagttcagatcattcgggtgtgaaccaccacgatcattgcgctcaagagcagtgatcgcagccatctcctcatcactgagttcgaaatcaaacacgtcgatgttttccaccatgcggctcttagtcacagtcttggggaacacaacgaaaccgttctgcaggtgccaacggataacaacctgagctggggtctttccatggttcttcgctgcagctgcgattggttcctcagcgccaagatcaaaacgcccctgtcccagaggaccccacgactccacagtgatgcctgctgcaagagatgcctcaacagcatcgcgctgctgcaaagctgggtgcagctcaatctggttaatggcaggcacagtggttgcctctgccagcagcttttctaggtgctctggcaggaagttgcacacaccgatggaacgagcacggtcaccgagcttttccaagcccttccatgcagcaacataattatcgttcttcggtgccggccagtgcaccaagtacagatctacataatccaagcccagcttctgcagagactcctcaaaagcagcttctacatccaggtggcgatcgttccacaacttggtagtaataaacagctcttcacgaggaatgccggacttagcaatagctcggccgacaccttcctcattgccgtaaatcgcagcagtatcgatgtggcggtaacctacctcaagtgcttcggtaactacgcgctctgcttcatcgggatctaccttgaacacaccaaaaccaagctgaggaatggtttttccatcattcaaggtgaccaatgggataccttcagacttcgaaagcttattcttctgatccatcaaagattgcatcaacttatcccgctcttcctccggggatccaaagaataggccggtacccacaacagacatattttctccttgatgcgcaccaaaatgcgccttaggttgagatgaattggatagcccaccgtacgcctatctacactgaattaccatgagctatgactttgtcctctttgaaaccgatggcgacccaggtagcgcccgtatttccaaaaccccactgaccgaacgcatcgatttcgccacgccatctacaacccctgtgttggaatctctttcggcagggcttgccgaaacggtgccagacaccgtcaagcttgaagaagacgccatccacttatccggtgatcgttgcctttacgttgtgaccaactacaactccgccgaagaagcagccgaatggctcaccgccatcgctttcgattacggactgggccttgccgacatgaacgcggacaccatcctgcttttcggcgatgaagattccgacgctgtcgtccaaatcgatgactggttctcccccgctttctctgcgtacggccttccccacctcctggtggaagtcatgcgcctgaaggattccaaaaccccttatcttcgagtcacacttgctgcagatgactcgaaatttatccaaaccctttacgaaaccgacaacaaacaatggttggtggaaacctcttcctccacaggcacggacgaaacccacgtgaagaccattaatgatgtgctggaacgcatcgagacatggttcaaccaggagactgctgtctaaaccttttgtcgtgttctggggttaaccacccttcggccacctgggatggtttcaagcctttccaggtggccgaagaactaaaagggcataatcactgtatgggttaagtagaaagtgtcattttctgactgctctgaaccccaacaaacactcagcaccgttatttaaggagaaaacatggctttaggcggcgcagaactgttaattctttttatcctgtttattctgttcatgggcgggatcgcagcgattgtcatcgttatcgttaagttgacccagcggtctaacagtcgtggtgcctcaactacgtccacaattaacattgatccgagtattcatgctgcattgacagagatcgcagctagggacggggtaccggcgtctagcgtggttaacggtcttctgaacgattacatcaataagcgcaggtactggcctcctacgcaataacaccccatctaaaaggggctctctggcagatatgctctccggcagaagagcctcttaatccttgttgtacattacacagagcccccaaaagaaccccaaaaacaaaaaactgcccctcaccttcccaaaaggaaagcaaggagcagttttaaactcgttgagtgagtgtgacttaagcgtcaacagcctcggtctcgacgatgttcaccaagcgacggttgcgcttggtggaaaactggacagcgccagtcttcagtgcgaagagagtgtcgtcgccaccgcgaccaacattctcacctgggtggaacttggtgccgcgctgacgaacaaggatctcgcctgcggaaacctgctgaccaccgaaacgcttgacgccaaggcgcttagcctcggaatcacgaccgttgctggagctagatgcacccttcttgtgtgccatgtggtaattccctccttctaaaggaaaaactcatagaaagcccgagggcttacttgattccggttaccttcagaacggtcaggggctgacggtgtccctggcgcttcttgtatccggtcttgttcttgtacttcaggatcttgatcttcgggcccttggtgtgctcgacgatctcggtgttgacgctcacagaagcgagcttgtcagcggcggtggttacatcggcgccatcgacgagcagaaccggggtgagagccacggatgcacccggctcaccctcgatcttctcgaccttaacgaggtcaccttcggcaaccttgtactgctttccgccggtcttgacgatcgcgtacatagagggctaccccttatctgattctcggctcaggtactcggatgatgagtccctgattggacttacgttttacaattgcgttttagacatgcggagccaaaatgacctcacgtcattcacacattcgccgtgaaatgggcaaatgggcattactgacattgcctaaaacagcgactgtccaaggttacccctaaaggcggcttcaacacaaaccgcccttataccctagcttcgtgggcctcgtcgggtagcccgcctacggcggcctgggttggtggtgctcgccgcctgaggttccttcttcggcgcccgcgcattgcttgtcgacgccaccttcttctccaccggcgccgctgtcacgcgcacagcacgacgacgctttcggcggttgtctggctggtcgaattcaacctgaggctctgcaacctgttctggtgctgcttcaggtgctatctcaacgacggtctcaggagcttccaccagttgacggcgcactgcgcggcgacggttcctggtcgatggtgcagaggacggcgcaccggaactgagctcacttggacggttacggcgtggagccttccgcgcaggtgtcttcactggagtctcagcaacctcttcaactacaggtgcgaaatcctctggctttggagcatgatccgaacgtgaattgccacgagtcttgcggcgcctgcgtgggcttgcctcaaattcggcacgtgccttttcataatcagcggttggctcagccacaggttcagcagccttctcaactacaggtgcaataggctctgcctcaaagtcagacacatacgacgatcccgaaggctcatcagggtcttcttcagaagcaatgtccacggcagcagctgcaatcgcggcaatatcatccgcagcagattcctgacgttgacggcgggccctcctgcgtggtccttcctctggttccacggtggattcagcaagaatgcgctcaggctcgtcgagcttgtcgttgaccacatcatctagatcggagtcatcgaggacgatcactgatgcagcgagttcctcaaattcttgatccagatcgtgttcatcgctttccacgagatcacgcatggcaacaaccatcgggtgctccgcagctgccttgttagtgctattggaacgctggtgacgacggctacgctcttccgctttcgcctcaacgcgctcgtcaacggtgtctactggatcaacatgaacgatgatgcctcggccttcacagtgctcacacggtgaagagaaggtttccagcaggcccgcgccgatgcgtttgcgggtcatctgaacaagtcccagtgaggttacctcagagacttggtggcgggtgcgatcgttttctagcgcttcattgagtcggcgcaggaccaattcttggttttctggcagcaccatatcgatgaagtcgacaacgatcatgccaccgagatcccgcaggcgcatttggcgcacgatttcttcggcagcttcaatgttgttgagcgtgacggtttcttccaagttgccaccacccttgccggtgtagcgtccggtgttcacatcgatcaccgtcatggcttcggtgcggtcgatgatcagcgatccacccgatggcaggttcacctttcgggacagcgcttcctcaagctgggtgttcaggtcgaatgcttcgaaagcatccttgccgtcaaagtctgcgcgattgaagtgttccacgcgggacaccaaatcaggagcgactgattggatgtaggcacgcacggtgttccaggcacggtcgccgtcaacgatcagtgaggtgaaatcttcattgaagaggtcacggatcaccttcaccagcatgtctggctcttcatacatggtgatcggcttagaaccgcgggacttcttttcctccgcagtgcgttccttgatctgctcccacagggtgtgcagacggttcacgtcagctgcgatgttttcttccgacacaccttcagcagcagttcggatgatggttccaccctgcgctgggacaacgcggccaaggatttccttcagacgcttgcgctcaggtccaggcagtttgcgggaaatgccagcgctgcgaccacctggaacgtacaccaggtaacgtcccgccagggaaatttgggtggtcaaacgcgcacccttatggcccaatggatccttggagacctggacgagaacctggtcgccggctttcagcgcctgctcaatgcgacgtccacgtccgccaagtccagcagctttccagtcgacttcgccggcatacaacacaccgttgcgaccttttccaatgtcaatgaaggcagcttccatgcttggcagcacattttgaacgcgccccagataaatattgcccaccatagacatctgcgcatcagaggtaacaaactgctcaaccagctgatcgtcttccagcacaccaacctgagtgaccagacctgggtgatcgtggcgttggcgctcgcgcacaatcatgcgacgttccatcgattcacggcgttccatgaactcctgggtgctgaccacatggcggcgttttttgttttcttcgcgcatttccgtgcgacggcggcgttgcgcctccaagcgagtggagcccttaattccgattggctcgtttacctcttctacttcgcttgtcgacgcctcctcactcacttcggtgacggtttcagcttcagctccacgtccgcggccggtgccacgacgcccacggcgcttccgcgccgtgcgttcgcggacctgttcatcgtcggtgtcttggacgttttcagtaggtacaactgcaggtgccacaaagatcggcgtgtacacagatgcttccaccggcgccggggtgatctctgggacgatatcttccagcagttctgcagtggcttcttcgcgggctgccgcctcgaagtcagtaggttgcgcgactgccgcgagttcgcgctctactttttcttcgatttggtggatttcattttccacattcttctcaacgcgtcgacgaatcttctccaccggttcaacgtcggggacggcagctggggcagcgttgagtacgggctgagacagggcgtcgagaagcttttctacttcttctttgctcaggtttgactgcgcaaccttgaccaggccgatgccatcgagcgcaacaacgacgtccttggaaaccattccaagtcgtttggccagttgatgtacgcgggttttttcgctcaatgaatctcgatcaaattccgcggccagcacagccgagggagagatttctgcttctactgccttgttatttggcacagcgacactcctattttcttatctccacgattgagcaatgcacccgggcgctggtagggacaagatctcctaccgccgccgcgcaggtacatgcgccaatctaaaactgtatggtctaaattttccgacccgcaaatatattcgccaggcctgctgccattcttccataagtcttaggtcaagcttgcatttattggctagtgtcggaaatcatgggagatttagcaaagcacatgggcagtgaaccaccagcatggtggaagtttttaccgatgattgtcctcgctggagccactcgagttacctatgaagtagaaccttggctggcgatcccattattcattttggcttttgcatcgatattgatcccattcccgatctctaagacaaaaggactccgtgatatcgatgcctggaaaatccacaccacgcaaggcgataaaaagcgtgccatccgccaactgatcattccggctacggctttggccatcgacatcattgggctgccgacattatttaatgcccctccccttgcttccgctgcactttttggcggtgtttacggcgcttccctagcttgggctgcgtacagagctgatcagcttccacgcattcgaacgaaggaacgcctcgcagaactttcacaaaatgcatctctggatgatgtgcgctcagatgacttagatgttctagagcagccggaatcccgtgaattagtgcgctgtctgcttgcccacggtgcgatggatggcactcgggtgatggccagacaggtcgcgcgagtactggataccgaggtagacgaagtacatcaggtagcacgctcactagaacagcatggtttggttagtcgctccaccatcatgccgggtggggatccaggaaaagtattcatcgaagtttccctgaaagggatctcagccatcaaggcacttgaatccggacgctaagttgttgatacatcaacttatttcttggctatacttgaggtcacgtttcctcagctcaggagaagttcggagaagtccatgtcaaacgcagaaattaatcccgttgaatatgaaatcaacaaccacgcccctggtaccgcgctaaacccacagtgcgaagacggcgccaacgtagaaatcatcacctcccgtgaagtccccctcggcggaccacgcgccatgaccgtgcaccgcacactcccccaacgccagcgctccctcatcggtgcctggtgttttgtggatcattacggccccgatgatgtctcactaaccggtggcatggatatggcctcccacccgcacaccggattgcaaacagtcacgtggctttttgaaggcgaagtcacccaccatgattccggcggaaatcacgcagtcgtgcttcctggcgaagtcaacctcatgaccgccggcgcaggcatctgtcacaccgaagtttccgccacctccaccacgattctgcatggtctgcagttgtggacagttcttcccgacaaagaccgcgaaggaccacgccgctttgatcactacgctccagaagaaatcacactcgaaggcggaagtgcacgcgttttcctaggttcgctatttggtcaaacctcccctgttcatacgtttactggctcttcctgttttagagtgcattgatcttatggaccaactgccctgaatggataaggcaccgcagaatgtagtggttcaaattacggaaacctagagcaatcccacgcaaatgttccaaccgtccgttgatcgcttcgaccggaccgttggagacaccaacatcgaaatacgccaacacatcaccaagtcgtttaaacaaactacgacccaactgcgcgagttccttattcggccccttcaacacccgaagctgatcaataatggtccgcattttcttcttcgcttcacgcttattacccatctgataacaatcaataatcgcctgatacgcaagccacgcaagctttaacgccccgtagtctttgtcatacgcccacaactgctccaagctttcttgctgacgaggactcaaccacttgtgcgtggtcaacaaggtcttccggtttttatacaacggatcctggcttaaaccacgacgctggtatttctcccgctggaggcgttgccggcaggcggtgagcttgtcaccagcaagccgcacaacatggaatggatccatcacgcgacgagcagaaggaatgagttctttacttgctgtggcgtagccttggaatccatccatggacacgatccgtatctgattgcggaactgttcaccgcgggagccaagccaggaccgtaaagcatcagcactacgacctgggacgacatctaataaccgggcaggacaccgtgagtcataccgatgcccggtcatatcgacaatcacggtgacaaacccatcaccatgcttagccctattatgtgaccacttatgctcatccaccccaatgacatacactccatcaagatggtgaggatcgttatagaccagctcacggcacatatcgagggctagttggcaggttaaatcccaccctagcccaagtgctttcgcggttgcgtgaacactcatccggtcaatagcaaggcgttgtaaaatccagcgggtgacccggtgggtgacctttttaccgtggtcagcgcagcttagttctgcttggaaatacttttgcttacatgtggggttggtgcagcggtagcgaggtagacggataaacagtttggtgggaaacccgacgatgggtaaatcaatgagcatccggtgggtgtgatgacgaaacaccccaggttgggagcattctgggcaggtggaggtgtagttgagtgcgtctgcttcgatcagggtgtaatcacctgcatcggaagcgccggtgatggtgagtcctagttccgcagtgcggcagatggtgtcagcgatgatgttgccggtagacttcatgggtagagccttttgttggtgtttggttagcttagatacctaaaccttaaccctgacaaaaggctcgtttattttcgggtctacaccgctagcccaggttctgtgatgtaccccaaaaccggaagggcccgtttactcccctacttggcgcagaaatccacatcaatccaggtgaagcagtcatctttgatgttgatcccacgtttgaacacggcttgcttgtcgattccggcgacgtccaactagaaggcgtcaccgtcgagcccacccagctggcctacaccggcatcaatgaaacccaactccgaatccgtaacatcggcaccacaccggcgcgtactgtactgctaggtggcgaaccatttaccgaagacatcgtgatgtggtggaacttcattggccgcagccatgaagaaattgccgagtaccgtaaacagtggcaggccgaagctgatcgttttggtatcacccacggatatatcagccaccacaaagatgggctcaccaggcttccagcacccgagcttcccaacgctgctatcaaggcacgtaaaaacccagcaccaactgcacgaccagaaacgagaattgattaaatgcgctccgctcacggcccatacattgataagttcttccccgagccatacaagaacatgctcgagctcaccaagactctgcgaaagatctacccggacgttgatctgcctacctcattgattgagctggtcaatgtccgcgtttctcaaatcaacggatgtggcacctgcttaagtttacatgttcccgctgctcgccgtgccggcgttccagagaagaaactcgatgctctggcagcgtggcaaatggtggatgaattcaccgtggaggaaaaggcagcactacagctagcagaatccttaaccttgctggaatcccgcgaaggtcacctggctgcacgcacagcctgcagtgtgtttgccgaagagcaggtagctgccctggaatgggctatcattgcgatcaatgctttcaaccgcatttctattgccagtgggcacccactgctctagtaatcaggcagcaaaaaactcccggccgaaaatggtcgggagttaatttttttctaaccgtaaaaattacaggttagggaaccagatggagatctcgcgctcagcggactctggggaatcagaaccgtgaacaacgttctctccaacagtcagtgcgaaatcgccgcggatggtgcctggggttgccttagcaactgggtcggtgccaccagcaagctgacgccatgcatcgattgcacgctcgccttcgacgatgcctgcgatcagaggtgcagaggtgatgaattcaacgagctcaccgaagaatggcttgtcagcgtgctcttcgtagtgcttttcagcggtctcgcggtctgcaacacgcagatccagagcagcgagcttcaggcccttgcgctcaatacgtgcgatgatttcgccgacgtgtccgttggtaacaccgtctggcttgataaggatgagagtacgttcagtcatgttgggtgattctacctaatggtggtctgcttcgcgcacttaagtcgacttagagcttcctcacagcctctgcgaccgcttcgctggacgatcccctactccacagctgcgcctgacggatcgctgccgcctcctggtcgcgggatttcaactctttcaattgatcaatttgttcctgggtgaacaccactggctgatcaacaagctttgttcccacacgactgttcagacccacaaaaagtgcgatcgcagccacgatgatcgccacaatagcgataaatgatggggaacctgcaatacgagtgattaccgcgacgacacaaaatagtgcagctgcggaaaaggccaggccagacttagagtttcgcatagttctcaacgctacgactactttgataacaccgccacccaagccaagccggagtgatctccgtatcctttaaggcatgactttaaaagataagtacgacactgaagtagctgtttctaataatcaggacaagcaccaatttgaggtcagttaccctgaagatgccgtgactgctggctttgctgcataccttgataaaggtgattcgcggatcttctatcacaccgttgttggcgatgaattcggtggcaagggacttgcgtcaattcttgtttcagaggcgttaaaagccacaaaagaagctggtcttaccgtggttccggtatgtccctttgttaaaggattcgtggaaaagaacgcattcgagggttaccgcaaaccaaaccatgaggatatggagctggtgaagagccagatgtagaaactactcaacttccagaatgcgctgaatggcaaccagtgtttctggaattccggttatagctgccaagcgtcgcttttcaatttcttcaattgatttgtcgccgaatttgtcgtggaagaatcgttgacctttgggggtaaattcccatgattcagtcaatactgtgccttcttctaacggttccatggaataaatccacttgacgtttccatcagtcacgctccaaccaaagcaacgatttggctctgcgacgataacctcgctccgtgtctcccaggtgcgctcaggtgtgacgtttcggccagtaaagtgcgcacccacgacggggccttcgtcttcatcccaccagcatttctcacacacgggcgaccattctccagttcgagtgatgtcagaaactagtgcgtagacctgattgatgggcgctgcgatgttaatgctgtcttcaaaggtcagagatttaggcatgaacgacagaatacgcctccgaaggaggtaggcgtcgaaaagcaaaaaaggccccggagggccttaaagcttagctgtgctgcgtggtaagcagcccgcgtttcatgcgatcaatcagattagagcgcaggtagaacaggtacgcccacgcgatgatgaagatgatggcggcgaagcccatcgcggggtgaacaaagaaaccggcaagtgcaagaacctgcagcacgatgttcatcgggatggaccaactaaacctttgcagaaatgcagcaacaaagtgtgcgatcgcgactgctgatacatagacccagttgaaggtggtccagtagatgccgtcgtccacgcgcagaatcacggtgagaacaagacctaaggtgattgcttccatcactaaggtgccggccatgacacctcggatacccttcatgggatcctttaatggatcgtggcctttgcctaatggtccgtactcaattgattcttcacgcttgctcatgcaggttcctttccaaacagcgtgcgcgcatcgccggcggtcacgattgaaccggtgatcacaacacctgatccggactgtacatcggtgtcttctgctagttcaatagcgagttctaccgcgccagcaagatcttcttggacgtgcacacgctcatcgccgtagatctctcgagcatattcagctaaatcgtatgcgtccaatgcgcgctctgaggcagtctgggtgcacacaatttcatgcaggtatggctcaagtgattccaagatgccgcgggcatccttgtcgcagagcactccgatgacaccgatgaggcgacggaactcaaagtcacggtctagtgctgcaccaagtgctgcggcaccgtgtgggttgtgagctgcgtcgatgaacacggttggtgcagagcgcaggcgctcgaggcgacctggggactgaacttgtgcgaagccttcgcgcaccgtgtcgatatccaatgggcgtccggcggatgcaccgaaaaatgcttccactgctgcgagagcaaccgcggcattatctgcttggtgcgcgccagacagtgggaggaagatgtcggtgtattcgccgcccaaacccttcagggtgagctgctgtccaccaacggcaatggcggattccaccacgccgaattccatgttcaaacgagcaacagctgcgtccacgtccacggcttgctgcagaatcacgttcattgcttctggctcctgcttgcccacgatgacaacgttgccctcaggctcggtgccatcctcagatgcaggacgagccttgatgatgccggccttttcaccagcgatttcaccaatggtgttgcccaggcgatccacgtggtccatgcccaccggggtgatcacggaaacagctgcgttgatcacgttagtggcatcccagcgtccgccaagaccaacctcaacgacggcgacgtcaacaggagcgtcggcaaaacctgcgtaagcgagggccacgagtgcctcaaacttgctcatcttcggtccgccctcggcctctgaccaggcgtcggtcatctccatgtagggcttaatctcttcgtagatccgcacgaaatcacgcgggtggatgggcttgccatcaatcgcgatgcgttcggttaccagctgcaggtgcgggctggtggtccggccggtgcggcggtggaatgcgcgcagcaacgactcgatcatgcgggtggtggaggtcttaccgttggtgccagccacgtgaattgctgggaaggaattctgtggttggcccatgagatccatcatgtagctcatgcgtcggaaagtgggatcaattttggtttccaaccaacgttgatccaactctgcttccacctgggcaaggcgcagcaaatcttcttgggtgatctcctcggaggcaggtgcttctacctcaccggcgagatcgatgggcaaagacagtccagtctcgcccaacgtgacatcgcctacggtgatgtcatcattttcggaatcaaagattccgtcgttgttagccactaggccaattcctccagacgcttgttaatgcgctcaacttcttcttgggcaatctgcgcacggccacggatcttgtctaccactgcatcaggtgccttggacaggaaagcctcattacccagcttctttgcggtggtttccaattccttctgtgcgttagccaggtccttttccaggcgcttgcgctctgctgcaacgtcaacagttccagaggtgtcaagctccaccgtgatggttgcttggctcaggcggatctccaggctggcagaagctgcgaaatcatcttctggttgctcgatgcgaaccagggagcgcacggaatcttccagatcctgcaggtcacatgccacgaaatcaaggcgtgctggaaccttctgggaaggcttcacaccctggtcagcgcggaaacgacgaacctcagtaacaagcttctcgacgtcgccaatgcgcctagctgcatcagcgtccacggcgactccgccgttggtgtcagctgcggttggccaggaggccaccacgatggaggtgcgatcagtaagtgcctgccacagaacttcggtgacgaaaggcatagctgggtgcagcagacgaagcagtgcatccaagacatggccaagcaccttttgggtgttttcaccctgagcggaggtgccttcgcgtgggatctgaaccttcgcgatttccaggtaccagtcacagaactcgttccacgcgaagtggtagagctcctcgttggccttcgcgaactggtagttgtccaggtaagcatcaacgtcgaggcgaacctgctcaaggaggtccacgatccagcggtcagcgtcggtgagttcttcacgtgctggcaggccttcggacactgcaccgttcatcagcgcaaacttggttgcgttgaacagcttggtggcaaagttacgggagctctgtgcagagtcttcaccgacaggcaggtcgacgcctgggttagcgccacgggcaagggtgaagcgcagcgcatccgcgccgtagttctccacccaatccatcggatcgatgccgttgcccaaagacttggacatcttgcggccgtgctcatcgcgaaccaggccgtgcaggaagaggtcggtgaatggaacctgtgggcgtccatccttgccttcgcccagaagttctggggtttccttggctgcaaaggtgccgaacatcatcatgcgggcaacccagaagaacaggatgtcgtaggcggtgaccagcacggaggttgggtagaacttctccagctcaggggtcttttctggccaacccattgtagaaaatggccacagcgcagaagagaaccaggtatctagaacatctgggtcttggacgtagccctcaggtgcctgctcatcaggcccaacgcagatgatttcatcgtttggtccataccaaattgggatgcggtgtccccaccacagctgacgggaaatggtccagtcatgcatgttgtcaacccagtcaaagtagcgaggctccagggacttcgggtggatggtggtgtcgccttcgcgcacggcatcgccggacatcttggccagctcttcgaccttgacgaaccactgcagagacagacgaggctcaatagcttcgccggaacgctcggagtgtccgacggagtggacgtatgggcgaatttccttgacaatgcgaccctgggctgcgagttcttcgcggaccttgatgcgtgcttcttcgcgggtcaggccatcaaactgggttccggtatcggcaatgcgtccggtcttgtccatgatggtaggcatgtccaggttgtggcgcaggccaagagcgtagtcattagggtcgtgtgctggggtgatcttgacggcaccggagccgaactctgggtcgacgtaatcatcagcaacaaccttcaggctcaggtcatcgcggaatgggtgaggcagggtctgtccgaccaaatccttgtagcgctcatcgtctgggtgcacggcaacagcgacgtcgccgagcatggtttccacacgggtggtggcaacaatgacatgtggttcatcgtcgttgagggaaccatagcgaatggataccagttcgccttcgacatccttgtagataacttcgatgtcagaaaccgcggtttctagtacgggcgaccagttgacgaggcggttggcctgatagatgaggccggcgtcgaaaagcttcttgaaaatcgtttggacggcgcgggacaagccgtcatccaaggtgaaacgctcgcgggaccagtccacggaatcgccgatggcgcgcatctgctcgccgatctttccaccatattcttgcttccactcccagaccttggcgatgaactcttcgcggtcatagtcgtagcgagttttgccttcagtttccttcagcatctcctcgaccttggtctgggtcgcgatacccgcgtggtccatacctggcagccacaaaacctcaaagccctgcatgcgcttgcgacgtgcaagagcatccatcagggtgtggtcaagtgcgtgtcccatgtgcagctggccggtcacgtttggtggaggcagaacaatggagaatcctggcttgtcgctagcaggatcggcagtgaaataaccggcgtctacccagccctggtacaaatcagcttctacagctttaggatcccaggacttgggcagcttgtctgcgcggttctggctggtggtctcattattctggtcagtcacgcagaccatcttaacccctgtacttgtttatcaagtatccggatttaggttaatgagtttattgctttgtaattgcccaataaacaggtatggccttccagtttacggagacgttgtccacggattctgagtagccgccaaccacattcgggtaccacagtgggattgcgggaagatcgcgcaacaacatttcctgggcctgcgcatatgcctggaaggtttcctccttggtggaggctgctgcggcgtcggcaatcaattgatcaaattctgggttttcgtacttggcatcgttggaggccacgcccgaggtgtagttaggtccaaggaagttgccgatgcttgggtagtccgcaaaccacgcggtgcggtaggcgccatccaatccggtggtgcggtatgtgtcgcggaaggatttaaaatcggggaaaggattgccagtggcgttgacgtctaattcgttgctgatgctgtttgctaccgcatccacccattcccggttgggaacatccgcgttgtaactgatctgcaattcgccctcaaaaggtgcgatctcctcagcgtcttcccacagctcacgggccttgtcaggctggaaagtcagcacgtcattgccgttcaaatcatcgcgccagccgtcgagcacgggcgcggtgaagtcgagcgcaggcgtgtaggtgccggcgaagatctgctcagcgatttcttcacggttaatcgccatagaaattgcttgtcgacgcaactgtccctgttgcccttcaaagttgggggattccatgcgaatggagagttccagataggaggccgcaggttgattaatggatcgacccgacagttcctcttcataggtggtgtacgccgatggtggaatgagatccagcacatctaggtttccagccaacagatctgaataagctgcatcattttgggcgtagaacacgtacttcaagccatcgttgttggctgcgcgcgggccatcgtagtgttcattggccaccactttcagttctgcgttgtgatcccactgctctagtttgtaagggccagaggacacggggttttcaccaaaggcgtcaatatcatcgcgagccgaagctggcatcggtgcaaaaccgtagtagccaatgcgttgggtgaactcagaatccggttgggcaagctcgatggtaaatgtgcgatcatccaccacattcaaaccctcgagcgtttccacgccctcctcataccctttaatcggtgagaagaaagaagtgttgagcagtccattttccactacaaaattccaggtatccacaaaatcagtggcagtaatatccgatccgtcactgaatttgatgccatcacgcaaagtgattttgtaggtggtgtctgtttcctggtcaattgatgccgccaggtcattttgagcaacgccagcttcatcaaagtagacgagcccggagtacagcatgtccaccactcgcccaccgccgttttcattggtgtcgcccgggatgagtccgcgctgaggttcggtgccgttgacggatacgtaattcacgtctggggtgccactagagctggaacaagatgccagcccgatagccagggttgaggccatcactgttgcgatgacttttgtggctgtgcgcattaaatctcctatgggtgagcgttgctgtttgcaacgtgcctgtgtgggccgatttggtatggccaacaaatcaaatctagccagtgactcaccacacctttgcaattattagtgactcaggactcttaactacccccataacctcattgaacatgcaaaactaatgcttttggggggtatgcataaattcgtttcgttccactgcacagcccgaaaatgctgctagggtcaagttcatgcgttttggacttgacttgggaactacccgcacaatcgcggccgccgtggaccgcggaaactatcccatcgtcactgtggaagattctttaggcgacacccacgatttcattccatctgtggtggccctcaaggcagataggattgtcgcgggttgggatgctattgaggttgggcaggaccacccttccttcgtacgttctttcaaacgcctactctctgaacccaatgtcacggaagccaccccggtctacttgggcgatcatgtacaccctttgggcgccgtcctggaggcttttgcggaaaacgtggtcactgcgctgcgtgcatttcagacgcaattgggagatacctccccgatcgaagtagtcattggtgtgcccgccaactcccacagcgcccagcgactgctcaccatgtccgccttcagcgccacaggcatcaccgttgtcggtttggtcaatgagcccagcgccgcagctttcgagtacacccaccgccacgcccgcaccttaaactccaagcgccaagccatcgtggtttatgatttgggaggcggaacattcgactcctcgctcatccgcatcgacggcacccaccacgaggttgtgtcctccattggcatttcacgccttggtggcgatgatttcgatgaaatcctcctccaatgcgcgctcaaggccgcaggcagacagcacgatgcgtttggcaagcgtgctaaaaacacgcttctcgacgaatcccgcaacgcgaaggaagctcttgttccgcaatcccgtcgcttggttctagaaattggcgacgacgacatcaccgttccagtgaacaagttctacgaggctgccactcccctggtggaaaaatccttgtccatcatggaacccctcatcggcgtcgatgatcttaaagattccgacatcgcaggcatctaccttgttggtggaggatcctcgctcccactcgtttccaggttgctccgcgagcgtttcggccgccgtgtccaccgctccccattcccctcaggttccactgcggtgggtctggccatcgcggctgacccttcctctggtttccacctaagggaccgcgttgcgcgaggcatcggtgtgttccgtgagcacgattctggtcgtgccgtgagctttgacccgctgatcgccccggacaccgattctgcgaccgtggcgaaacgatgctacaaggcggtgcacaacattggttggttcaggttcgtggaatactccaccgtgtccgaggatggcagccccggagatatttccctgctcagtgaaatcaagattccttttgatagctccatcaccgatgtggatgctaccgagatttcacgtttcgatggcccagaagtagaagaaaccatcacagtcaatgacaacggcgtggcttccatttccatcaagatactcggcggcgttaccgtcgagcacacaatttagttaccattttggtgctggtggagtccaggtctgcattgcctttagcagggcatgcgggtcggattccacgatgaggcactcaaagaagtctcgcttgataaatccacgctgggtcatctgctcaagcatttccagcaggggctgccaaaaaccatcgacatcataaagtgcgacgggcttttgatgaatgcccagctgttgccaggtccagacctcgaaaagttcttccaaggtgccggcgccaccgggcatggcgataaaaccatcgccaagttctgccatgcgacgcttgcggatgtgcatatcaggaacgatttcaagttcggtgagcttttcatgcccaagctcacccttcataagtgattccgtgatgacgccaaaggcttcgccacctgattccaggaacgcatccgcgacgatacccatgagccccacttttccgccaccgtaaaccaagtcgatgccgcggtctaccgcggttttcgccaaggtttgagccgcttgcgtgtacagcgaggaactgccgagcgccgagcccgtgaaaacggtgacgcgttggagggttggggcgtcgaaaagcgaagtcatgcgttaaagattagagcaagtcgcgcactgcctcgcgctcggcctgcaattcctgagcattcgcgtcgatgcgggcgcgctggaaatcggaaatctccaggccttcaacgatttcccactcaccgttgcgggatacggttggcagaccgacaaaaatgccctcaggaatgccgtatgcaccggtggaaggaattgccgcagaggaccacgcctcggtgccctgtacccaatcgcgcatgtgatcaatcgcagaggatgctgcagaagctgcagaagactttccacggacctcaatgatttcagcgccacggttagccacgcgaggaatgaactcctccacataccaatcgtgatcaaccaggtcagtgaccttttctccaccaacggttgcgtaggtgatgtctgggaactgggttgcggagtgatttccccagaccacaatgttgttaaattccgcagatccacggccaagcttggtggccagctgggagatcgcacggttgtgatcaaggcgcatcattgcgttgaagcgggatgctggaacatctggggccgcagctgaagcaatcaacgcgttggtgttcgctgggtttccaacaactaggacacgaatgtcatctgcggcgttgtcattgatagctttaccttgaggtccgaaaatcttgccgttgttagccagcaaatctgcgcgctcttcgccttttccgcgaggcttcgcaccgaccaaaaacgccgcattagcgccgtcgaatgcctcattggcatccgcggtgatggtgatgtttcgcaggagggggaaggcagaatccagaagttccatagccacaccctctgccccgccaagagcctgagggatctccagaagtttcagttctacaggggtgtcggtgccgaatacttcaccgttggcgatgcgccacaacagtgaataagagatttgaccagctgcgccggtgacggtgaccttcttggtggagacgttctgcggggaattcattaaacaatcctcaatccttgtagggggtcctctaagaacccatgctatcccgcttaaaagagaacagccaccagttttgggtgatcttgacgatactgcaaaattacccccgaattgccccaatatgtacccctcacctgcaagatgttagggcatcatggggaatcggcgcggtgtgcaagcaatttttcctgatatcgggcaccatttatagttgtcagctgggatttgccgatggtgttatctttgatatttaccttaaccccgtttctaattcacgttttctcgttacccgaaaggaattgatcgattatggcgacatcacgtcgagatgccgaaaacatagaccaggccggtagcgaattcattgaatctgattcaggacacaccgcaacccctgaagaggtagtagccaccgctctgacattttttgcagaggatggttttagcgaaaccaaattggagaaaatcgcgaaggcatctggcatgtccaagcgcatgatccactatcactttggcgataagaaaggcctgtacatcaaggctgtttcctacgcgttgcgattgctgcgcccagaggctgaagcgatgcaacttgattccgcggtaccagttgatggtgtccgcaaaatcgtcgaggctttatatacctgcatcaccaagcacccagaagcagtgcgcctgctattgatggaaaacctgcatagccaagacagcgtggattccaccgcggcatattccgatgaatccaatgtgctgctcaacctggataagctgctcatgcttggccaggatgccggcgccttccgtcctggaatctccgcagaagacgtactggttcttattagctccctggcctacttccgcgtatccaacaaggtcacgttgaagaacctctactcccttgatttggaatcagaggccaatattgaaggcatgaagcgcatcgtcgttgacacggtgctggcattcttgacctcaaatattcaaaattctggcaactccagctacctggttgttggtggcaagactgcagaaccagaaactgatgacagcgtctacagctttgatacggacgtgttcgaaaactaaagggtatcgagtagtttcaagcccttttccgcccattcaatctctgcctgagcgcgtgcaatctgcccctcataggcaagcactttaaacgcgactattcgctcgtgctcctttttcggggagcgctcaagtcgccgtgccaaggttggatgagtttttgctttcagctcatcaatcattgattctgattgaattttctgctgttcaaaatgagcgatgtgcgcccttaaatgtcggcgtgcatcgccatttgtaccgacctcaaaataggcggctttaagcctggcaggatctctggtgggaccgtaggttactggctcgtaccacgcttttcttagcgcttcccagcctttttcactcaaggcgtattcggttttggtggcgcctttggagccccagggaacatcggatcccacgaggagttcttcggcttccatttttcgaagttcgggataaatctgcgaatcggaaccactccacacaaagcccaccgaggccccaaatcgctgggaggcgtcatacccagtcaatggtccggaacttagtagcgcaagtaatgcagatcgtagagtcacgtgctcattgtcccatatctacccccgctcccgagaatgaatacccgcagctcagagaccccagctgacattaactcacatttaccccttgacagtgatttgaagcacaagcaatatatgacctacgccataaactaactaagagtttaggtatttggttatatagttctttaggagttcaccatgacactgtccgaacgcaagctcaccaccaccgccaagattcttccccacccactcaacgcctggtacgtcgccgcttgggattatgaagtcacatctaaaaagcccatggccaggacaatcgccaacaaaccactcgctttgtaccgcaccaaagatggccgagccgttgcccttgcagacgcctgctggcaccgcctcgcaccgctatccaagggaaaactcgtgggcacagacggaatccaatgcccttatcacggcttggagtacaactccgcgggccgctgcatgaaaatgcccgcgcaggaaaccctcaacccgtcagcagccgtcaactcctaccccgtggtggaagcccaccgctttgtgtgggtgtggctgggcgatcccacattggcagatcccacccaagtacccgatatgcaccagatgagccaccccgaatgggcaggcgatggacgcaccatctccgctgactgcaactaccaattagtgctggacaacttgatggacctcacccacgaagagttcgtgcactcctccagcatcggacaagacgaacttagtgaatcagagttcgtggtcacccacactgaagattccgtgacggtcacccgctggatgcatgacatagatgcaccaccgttttggcaaaagaacatgaatgataagttcccaggatttgaaggcaaggtggatcgttggcagatcatccactactactacccttccaccatctgcattgatgttggtgtagcaaaggctggaactggcgcgcaggaaggcgaccgcagccagggcgttaatgggtatgtcatgaacaccattaccccagattcagatcgttcctctcattacttctgggcattcatgcgcaactaccgcctggaaagccaaaccatcaccacccagctgcgcgacggtgtatccggtgtattcaaagaagacgaagacatgctgaccgctcagcaagatgccatcgacgccaacaccgactacgagttttacagcctcaacattgatgccggtggcatgtgggtgcgccgaatcctcgaggaagcactctccaaggaaggccgactggatatccccaccacattcccccgcgcaacaccgaagccggaggcataaaccatgaactcgcaatggcaagatgcacatgttgtttccagcgaaatcatcgctgcagacattcggcgaatagaactatccccgaaatttgcgattccagtaaaacccggcgaacatctcaagatcatggtgcccctaaaaactggacaggaaaagagatcgtactccatcgttgacgctcgtcacgacggttcgactctcgccctgagcgtactcaaaaccagaaactcccgtggaggatctgagttcatgcatacgcttcgagctggagacacagttactgtctccaggccgtctcaggattttcctctccgcgtgggtgcgcctgagtatgtacttgttgccggcggaattggaatcacagcgatccgttcaatggcatctttattaaagaaattgggagcgaactaccgcatccatttcgcagcacgcagccttgatgccatggcttacaaagatgagctcgtggcagaacacggcgacaagctgcacctgcatctagattctgaaggcaccaccatcgatgtcccagcattgatcgaaaccttaaacccccacactgagctttatatgtgcggccccatccgcttgatggatgccatccggcgcgcatggaacacccgcggacttgaccccaccaatctgcgtttcgaaacgtttggaaacagtggatggttctccccagaggttttccacatccaagtaccagagctggggcttcacgccacagtcaacaaggatgaaagcatgctggaggctttgcaaaaggctggggcgaatatgatgtttgattgtcgaaaaggcgaatgtggtttgtgccaggttcgcgttctagaagtcgatggccaggttgatcaccgcgatgtgttcttctctgatcgtcaaaaagaatccgacgcaaaggcatgcgcctgcgtgtctcgagtagtctcctccccttcctcgtccccaacctcgaccattacggtcgccctctcctaaaggagcctggcatggatatccgccaaacaattaacgacacagcaatgtcgagatatcagtggttcattgtatttatcgcagtgctgctcaacgcactggacggctttgatgtcctcgccatgtcttttactgcgaatgcagtgaccgaagaatttggactgagtggcagccagcttggtgtgctgctgagttccgcgctgttcggcatgaccgctggatctttgctgttcggtccgatcggtgaccgtttcggccgtaagaatgccctgatgatcgcgctgctgttcaacgtggtgggattggtattgtccgccaccgcgcagtccgcaggccagttgggcgtgtggcgtttgatcactggtatcggcatcggcggaatcctcgcctgcatcacagtggtgatcagtgagttctccaacaacaaaaaccgcggcatggccatgtccatctacgctgctggttacggcatcggcgcgtccttgggcggtttcggcgcagcgcagctcatcccaacatttggatggcgctccgtgttcgcagccggtgcgatcgcaactggtatcgccaccatcgctactttcttcttcctgccagaatccgttgattggctgagcactcgccgccctgcgggcgctcgcgacaagatcaattacattgcgcgccgcctgggcaaagtcggtacctttgagcttccaggcgaacaaagcttgtcgacgaaaaaagccggtctccaatcgtatgcagtgctcgttaacaaagagaaccgtggaaccagcatcaagctgtgggttgcgttcggcatcgtgatgttcggcttctacttcgccaacacttggaccccgaagctgctcgtggaaaccggaatgtcagaacagcagggcatcatcggtggtttgatgttgtccatgggtggagcattcggctccctgctctacggtttcctcaccaccaagttcagctcccgaaacacactgatgaccttcatggtgctgtccggcctgacgctgatcctgttcatttcctccacctctgttccatccatcgcgtttgccagcggcgttgtcgtgggcatgctgatcaatggttgtgtggctggtctgtacaccctgtccccacagctgtactccgctgaagtacgcaccactggtgtgggcgctgcgattggtatgggtcgtgtcggtgcgatttccgcgccactgctggtgggtggcctgctggattctggctggtccccaacgcagctgtatgttggtgtggcagtgattgttattgccggtgcaaccgcattgattgggatgcgcactcaggcggtagccgtcgaaaagcagcctgaagccctagcgaccaaatagggccgcgattcctagcatgcccagcagcgctaggaacgtggtgaggaagaccgtatcgcgggcgacgatctcgcccttgcggtacgtcgccgcgtagttgtacacattctgcgcggcgggcagcgccgccaaaataacagcggcgtagaggtaatcgccctccagaccaaacgccttggcgatcagccaagtgatggcgggcatacccacaatttttatcgcagtagcagtaagaacgctggggcgatccgccttggaagccagcacgttggttgagggcaatgatgcgccgaagctcatcagaatcaacggaatggatgcgccgcccaaaatgatggtgggttccatgactgcggctggcagctgaatttctaacagacacacgatcaggcccgcgatagaggccaacacaattgggctgagcagtgaacctttcaccgcagcccatattttttgcccgcgcgagcctttcacatcaccagaggtcagcgcggccaggatcatgggcgcgaaaatcaccatctgcatgaccagaatcggtgccacatatgcgcctgttcccagcacataaatagacaccggcaggccaatgttgttggagttcacgtaggcagaagccgcagctcctgtcgccgtagtggcgatatccttcttaaagaaaatcgccgaaatcacgcagtacacagctgctgtgacgatcgtggccacaaatgtcaccacaatgaccggtgagatcaacgcgctgggatctgatcgggcaacgacattgaaaagcagcgctggagttgccgcataaaaagcaatgcggtttaacaccaagcgctgtttgtcatcattgatgacccccagctttgccagaagaaatccaacgccgataaccgacaggatgatggcaaagccggtgataactcctgccaactacgcggtcttttcttctgcgacagcttccaacatctctggttcggcttcgccacgggcaacggcaccgttgatgatgacttcgccaacgtctttacggtctgggaggtcatacatgatcggaaccaggatctcttccatgatcgcgcgcaggccacgggcgccagttttgcgctcgagtgcctgattagcgatctcctccaaagcatcatcagtaaaggtcaacacagcgtcatccatttcaaacagacgtcgatactgcttcaccaatgagttacgaggctccgtgagaaccttgaccagagatttctgatccaggttggatacggtggcaacgactggcagacgcccaatgaattctgggatgagaccaaacttcaccaggtcctcagggaggacatccttgaagatatccacaatgttggcttcttccttcttggaagagacctccacaccgaagcccaagcctttcttgccattgcggtccgcgatgaccttctccagaccagagaacgcaccagcaacgatgaacaaaatgttggtggtatccagctggatgaaatcctggttggggtgcttgcgtcctccctgcggtgggattgcggcgacagtgccttccaaaattttcagcagtgcctgctgcacgccttcaccggaaacatcgcgagtgatcgatgggttttcagacttgcgggaaatcttgtccacttcatcgatgtaaatgatgccgcgctgtgcacgttccacatcaaaatcagcagcctgaagcagcttgagcaagatgttttccacatcctcgcccacataaccagcctcggtcagtgaggtggcatccgcgatagcaaaaggaacatccagcagctttgccaaagtctgggcaaggaaagtcttgccggagccagtggggccgagcatcaaaatattggacttaaccagttcggtttcaggctcgtcattcctgcgacgaccgatggtttccgatgcgcggagacgcttgtaatggttgtacaccgcaaccgacaggatacgttttgctgggtcctgcccgatgacataagtatcaaggaaggctgaaatctccgacggcttggggagctcgttgcgctcctgctcgtcgtgttgagcttgaccgagttcttcttcaataatctcgttgcacagctcaatgcactcatcacagatatatacggcgccacccgcgatgagtttttttacctgcttttggctctttccgcagaaggaacatttgagcagatcggcgctttcctgcatacgtgccattagactgtgagacccgcttccacgattgaaaagatttactgcgtacaactctaaccaacaatattggcaatgggttgttccatcttagcgctttacctgtgaactctgcagagcggtacgcttaagctaatgaatcccgaatttattcacggcgcaaccgaaattgaaaccacaaacaggggccttcgcccgcatcgactcagcaaagaaatagtagaacgctactgtgatccccagtttagcgcgatggaacgccaaccatcgggcgtgcgcgttgtgtgtcgcaccaccgccacctccgtcacgctgaccacgtattccacgcgggtggtgtacctcgattccggccggccgggcggcaagattgatgtgcttatcgacggcgcccccacatcttccacgccaacttccgggggcgagaccacggaagtcaatttcatcaccggcgccacggaacggcgcctgaaagatccgcaggtgctcacagtggatggactttcagagcaggaaaaggtggtggagttctggctgcctcacaatgaagaaattgaagtgatctcccttaaagccaacgcagctttaaacactgtcgaagacacccgtcccgtgtggatcaattacggcagctccattagccacggttcggttgccactgccccaaccaaaatttggccagccattgttgcccagtccaaaaactacaacctgcgtaacttcggttttggtggcagcgccatgttggatccttttatggcgaggctaatcagggatactccagctgatctgatcaccttggaaattggcatcaatattgtcaatggtgatgtgatgcgtcgccgcggactagaggctgctgtggatgggttcatcaataccatccgcgatggccaccccaccacgccgatcaagattgtgtcgccgttctactgccccattcatgagaaaactccaggacccggcgcgtttgatacctcatcgtttggcagtggtcagattaggttcatcgccactggtgaacctgatgagcatggtcgactgacgctggagatggtgcgtgaggtgttggaggggttcgtcgaaaagcaaaaagacccgcacctgacctacgtcgatggtgcgagcctttatcaggccagcgatgcgccgttgctggataatttgcacccagacgaggcgtcgcacgccttaattgcgcagcgtttgcttaagcaactttgaaatcggcttcggtgatttcgcggagttcctcaacggtgacaccgtcggcgcactcgatgagcgtgaggccttcttcagggtccacagagaacacagcgtgggtggtgacaatcatgtccacgcacttcgcgccagtcagtgggaggcgacactccttaaggatcttcggagcgcccttcttggtgatgtgatcggtcatggcgatgatcttggatgcgccgtgcaccagatccattgcgccacccatacccttgaccagcttgccgggaatcatccagttggccaggtcgccgtactgggagacttccataacgcccaagactgcaacgtcgacagacttggagcggatcatggcgaaagaatcagaagaggagaagtaggatgcgccaggtgcaaccgtgatggtttccttgccggcgttgatcagctcaggatcaagttcctcttcagttgggtaaggtccaacgcccagcacaccgttttcggagtgaaggataacctctagtccctcaggcaggtagccggggataagtgtaggcatgccgatgccgaggttgacgtactggccgtcttcaagttcctgggcaacgcgggctgccatttggttatgatcccaagtcattagttagacaccgtcctgttttcgattccggtttcctgcggtccaacgtggacgacgcggttgacgtaaattcctggcagatcgatctcatctgggtggagttcgtctacaaagtgctcgacctgagcaatggtgatcttgccgctcattgctgcatctgggttgaagttctgcgcggtcttgcggaacaccaggttgccaaagcgatctgctttgtgtgcgtgcacgagtgcgtaatcggcgcggatgccctcttccatgacgtagagctggccgttgaattcgcgggtttcctttggctgggacaccacggcgacggtgccgtcggtgttgtagcgctgtgggagtccgccttctgcgacctgggtgcccacgcctgcggtggtgtaaaacgcagggatgccggcgccacctgcgcggaggcgttcagccaaggtgccctgcggggtgaactcgacggtgagttctccttccaggtactggcgtgcatattccttgttggagccaaggtaggagccgatggacttggagatcttcttatccaaaagcaacagtccgaggccgaaaccgtcggtgcctaggttgttggaaatgatggtcagatcgcctgcgccttgttcgcggagggcgaggatcaatgcagtggggatgcccacgaggccgaaaccaccgacggcgatggacgcaccgtctgggatatcggccaccgcttcagcagtggaagaaatgctcttgttaatcatgtgagacatgctaacgtaatgttcatcatatgcacaagggttcgcaatgcgaacaaaaagaggagttgatgggatggtcgaacaatcgccagatttcgtacaatcatttgcccgcggcttatctgtgatccgaagtttcagcgcagataatccatcgcaaacactgtccgaagtcgccagccaaactggactctcaagggccaccgctaggcgctttctccacaccttgaccgaccttggatatgcggtaaacaacgattcccggttccagctcacaccacgtgttttggagcttggagcaagctacctttccgcattgtccctgcctgcgatcgcgcagccccgcctggaggtactctcccgccaggtcggcgaatcaagctccatgtccgtactcgacggcactgacatcatctacgtttgccgcgttccggtgcgccgcatcatgacggtgaacatcaccatcggcacccgtttccctgcgtacgccacctccatgggacgcatcatgctggccaaccttcccgaagaagaattagatgaaatgctggcggcggcaccccctgaacagttgaccacccggtcactgacctccatcgcctcaatccgggaagagatcattgctacccgcgaaagggggtggtcattggtggatcaggagctcgagccgggcctgcgttcgctcgcggcgccgatcaccaatgcccagggcgaagtggttgcttccatcaatgtgtcgacccaatcggcatcacattcggtggaagatatccgcaagctggtgctgccgcagcttttagaaacggctcaagcaatttcgacagatctctctgcactctaaattaaggatcaaaaaatgaaccctcaagatattgtcatctgttccccattgcgcaccccagttggtgcttacggcggatccttcaccggcgtccctgttgaagaattggccaccaccgtgatcaacgcgatcgttgaggcaaccggcatcaccggcgacgatgtggacgatctgatcctcggccaggcatcccccaacggtgcggctccagcactgggccgtgttgttgctctagattccaagcttggccaaaacgttccaggcatgcagcttgatcgccgctgtggttccggcctgcaggcaatcgtcaccgctgctgcacacgttgcatccggcgctgctgatctgatcatcgcaggtggcgcagaatccatgagccgcgttgagtacaccgtgtccggcgatatccgttggggtgtcaagggcggcgacatgcagcttcgtgaccgccttgcagaagcacgcgaaaccgctggcggacgcaaccacccgatccctggtggcatgatcgagaccgctgagaacctgcgtcgcgaatacggcatctcccgcgaggagcaggacaagatctccgcagcgtcccagcagcgttggggcaaggctgctgatgcggggcttttcgacgacgagatcgtgccagtcaccgtccctgccaagaagcgcggccaggagccaaccatcgtttctcgagacgagcatggtcgaccaggaacaaccgtcgaaaagcttgctgctttgcgccccatcatgggccgccaggatgcggaagcaaccgtcaccgctggcaacgcgtccggccaaaatgatggcgctgctgccgtcatcgtgaccactcgcgccaaggccgaggagaagggcctgcgcccagtcatgcgtttggctggctggtctgtggctgctgttcccccagagaccatgggtattggacctgttcctgccaccaagaaggtcctggatcgtttgggccttaccctggaggacatcggcgcgatcgaactcaacgaagctttcgcagctcaggcactgtctgtgctgaaggaatggaacatttcttgggaagatgagcgcgtcaacccactgggttccggtatttccatgggacacccagtcggtgccaccggtgctcgcatggcagtaaccttggctcaccgcatgcagcgtgaaaacactcagtacggactggccaccatgtgcatcggtggcggccagggtcttgcagctgtctttgaaaaggagaactaaaaatggctattttgcacagcgtttcctacggaacttccgacaacaccttggtgttcattggctcgttgggttccaccaccgacatgtggctgccacagctggatgccttgcataaggatttccgcgtcatcgctgttgatcaccgcggacatggtctgtctgaactcatcgaaggcacccccactgtggcggatctggcgcaggatgtgctggataccctcgatgacctgggtgtcggaaacttcggcgtcatcggactatctctcggcggagcggttgcacaatacttggcggccacctctgatcgtgtcaccaaggcagcattcatgtgtaccgctgcaaaattcggcgagccccagggctggctagatcgcgccgcagcgtgccgcgaaaacggcactggttctctgtccgaagctgtgatccagcgctggttctcccccacttggttggagaacaacccagcgtcccgcgagcacttcgaagccatggttgccggcaccccatctgagggttacgcgctgtgctgcgaggcgttggcaacctgggatttcaccgatcgcctgggagaaatcaccgtgccagtgctcaccatcgcaggtgccgatgacccctccactcctccagcaaccgtgcagatcattgccgatggcgttggcggcgagtcccgcgcagaggtcctaagcccagccgcgcacgtaccaaccgtggaacgtccaaacgaggtaaatgaactgctagcacagcatttcgcttaatgttgtaggcatgttcacaaccagtctcctgccccgtcgtcagttgttgcttaggcgtttactcgctgagttcaccactgatcggcggggcaggtttcttgttgtcaccggcccgcacggcgtgaacaaagagcatttcaccagggagttcgccgccgagttgggagaatttgaggtcaacccgttcctcaagaaacgtccccgcgcaagcatcgtggttgtggatgatgtccatttggccgacaaggacgacatccaaaaaacactcaatttggtgcacaccaaagggctcaccgtactcgccaccgcaccgcaccgtatccccggcgccaccgacctgctagccttgccgccgctcacagtcccggaaaccgcgctgctcgcgcgccaaatcgtcggccactgcacacccaccaccgcccaccgcctcaacgacgctgcgggtgggttgccacaactgatcagagagcttctcgacgcgacccccatcgatcactggtccaacgatcggcctactctcacgctgccagagcactgggtgacagacatcgacattaagaaccctgtgcttcgggaagtcgcctcccatcccttcttcgatggctgcccgatcggagatttagatgccgatgcctttgtggaggatggcaccctcattcacgaaaacgggactttaagattccgcagccctgaggaacgcaccttggttcgggcttctactcccccatcgatggcaagaagcccgcgggagtgggaatcgacggagggaggcgtcgataagctaattgccgcaggaaacctgcccctggcccgactgcatgtagaggaactaccccgtgccgatgagcagcgcgcatttttggcgctgtacggcgggcagtcgtttgaggcggcctcggcgtcgccgttttatgcgctggccacctggaatccggaggcgttgcggggcgatccgaccttcgatatgttcgccgatgcgctagacactgggcattacagggaagtcccgcgtccggatgcccctgaagaaagccagatccacgatttcatcagtggctggctggcgttggtttacgatgatcccctcaccgcccgccgtctgctctccaggaggggcccctccgatttggtgggactgtggcagtcggcgtttttggcgcgagcgcactacgtgctgggagaattccaagaagcctccgccgttgtcgaacgcggcctagccaccggcgaccgcaccggagcctccctactcgaacccgtgcacctgtggaccggcgcccaagtcgcagccatgactgggcgcaccgaattggccaaccactatttacagcgcctgaccgtgcccgacgatgcgttcctcatccaaaaactcagcgcatccatgggcaaattgatcaccgcatccatgacctcagacacccgcgcagcaaccttggccggcgaccgcatggcgtcggtcgtatacaccaccaatacccagcagcccggattttgggcctgggaagacatgtatgcgatctcattgatccgaacgggacgcatcgacgccgcagccgccgtcatggatggcatccctgactccaccatcccctcgctgcgtgcccgaaatttggtgccccaagcaaacatcgaaatccaacgaggctccacagcacgaggcgtaaaaatgctctccgaagccgtcgacctcatttcctccgtcaacatgccagcatatgaagcccgcatcctcttcgaatacgggctggttctacgacgcatgggcaggcgcagccaagcagccgaaatgttcacccacgccgaagaagtcttcaccgccatgggtgcggtcactctggctgcccgctgccacggcgaacgacgagtcgcaggcgttgggccacgcagatcagcgcagggactcacccctcaagaggaacaaatcactgcgctggttgtcgacggctgctccaaccaagaagtcgcccgtgagctttccctctccgccaaaacggtggaatatcacctcacgagggtgtacaaaaagctcggggtgagctcccgtggagagcttcgagaattactgaaggtctgacacagcgttgttcagcagcttgaaaccatggttggagttcggcacacccgcatacaccgcagtgtgcaggatgacctcgccgatggtttcctgatccacgccagcgcgcagagcagcacgaatgtgcatgtccaactcgccgtcattgcccaccgcggtcaaaatcgcgatggtgagcaggcgacgctgagtgtgatcaaggcctggacgttcccaaatatcgccccacgctgtgcgagtgatgaaatcctgaaacttctcagtcacctcggtggtgttcgccacggcgcgatccacatgggcatctcccagtacctcgcggcggtttttcattccggtttcatagcgatccattaactgcgtccttttccataaatttctagtgcccgctccgccaaatcttcggcgtgcccggttggtccattgacgcgacttgccatcacatcaacgttgacggtgatgccatcgatgctggttgcagccctgctcactgctgagtgagtgacagcagccaactcgcgcagcgttgcccactccgcgtgccagctgccggtgccgcgctgcaaacggcagtcgagggcgtcgaaaagcgttgcaagaaggccaggtgcccggcgcgcgtaaccgtcgcacgcaatcgcagcggccggattggctttgtggggcatcgcggagctgccgccgggggatttctcccgcaactcgccgacctcggtttgtgagtaaaacaccacgtcaccagcaattttgcgtaccacaccagcggccgttgccagcgccgacgcgatcgcagtgatcggcgtgcgatcggaatgccacacccactgcggatcaaaaaggcccaactcctcggccagcttcgcctgaatctcgaagccacgcgggtgcaccgccgtcatatttccgctggcaccgccatacgacaccggaaactccagcgcctccagggcgcgtgccgcattgtccaccgcaaccagccagccgccggtcagcgcgccgaacgtcgtcggcgtcgcgatctgccccaacgtgcgccccatgatcggggttgctttatgctccgcggtgagctcggccaaatctcgcgcaagctttttaagcttgtcgacgacctcccccaccccttccttcatgcacagcattaacgcagaatcaatgatgtcctggctcgttgcgccaatgtggatgcctgccggattgatggccttgaggtcagtgaccagcggaatgagcggattaccgccctcggctgcgcgacgggaaagctcctccacatccaactgataagaatcaatggtggccttcgccattgctgcgtgctcgggggcagctgcaaccgccaaagcggcctccacgacaagaagattctttaggaaagtctcgtcggaaaggctgctgaggtgttctccactaccagcaaggtcggagtataaagatcgggtcaatttagagtccaaaaaatggggtttcattgtcttcagcctggacagtgatgtcgaagcggaatccatcatcggtcttttgagccaccaggaggtcacgtcgatcagctgggaccacagccaaaactgggtcggtgctcaaatcggcgtctggcaggtatgcgcgagtgtacagacgctccagcatgccacgggcgaacacaccaaccttgaagtgtggtgcctcatctgcgaatgctcccggaaccaaagtggtgaacgttgcctcaccctgcgcgtttgccatcgcgcgaccaagcccgcggaagccatctgcggttgctggtgctgtgcggtttggatccaaatcagagttgtggatgccctctggatcggcctgccacagttcaaacatggcatccgcgatggggtcgccgttgccatcagttgcggaaacagtaaaggacaccgcgccttccgaacctggctccacgagatgctccgcaccttcaagggtcaaaccgatgtggacgtaagggcccacggtctgtgaaggagtgatgccgaactcggcttcgttctgatcgatgatattcgactgctcgtagcggaactcgccgttcttccctgtatcaatcattgcaaaaccctttactcaaatggggtggcgttgcggccacgaaggacgatgtcgaacttgtaaccaagcgcgaagttttcacgggtctcgtcatagtcgaacgttgcgatcatgcgctcacgtgcaccctttggcaccgcgttgtagatcggatcctggaagaacaatggatcgttcgggaagtacatctgggtgaccagacgctccgtaaactgacgaccatagagcgagaagtgaatgtgcgccgggcgccatgcgttgtggtggttaccccaagggtaattacctggcataacggtccagaagtggtactggccgtccttgtcggtgagagtacgtgcaacaccgttgaagtgtggatccagtggcgctggccaggagtcattcttgtggcggtaacggcctgcggcgtttgcctgccacgcctcgaccaaggtgtgcggaactggcttgccatcgaaaccgaggacacggccgtgaacgaagatgcgctggccgatagcctcgccaccgttcaccttggtcatgtcgttgtcgatgtctcccaagtcgcggtcgccgaagacaggtcccgtggactcgccgaggcgactaggaaccatgatgagatcgttgcttgggttgcgcttgatggtggtccggtactccgggaagtgcagtggggagtattcgcctcccgtcggggcgaagtgtgggatgtccatgcgagacctttctgcgtctagtgatatagatctcaaagtagggatgattgaggccgttgacaagtagttcgcggggcgaacatgtcagatcgcgcgcgaacattcgccaccagcgcaaaccccgaaggtcaggggttaactaggggtgtgcataagggtttagtcatccaatacctcgagtgaactgcggagcttttcaaaagtcttctccatccgtgcttccagagtctgcccccactgccccgtgggcatctcttgcgccaacggtccgacaggttcggttaccactgtgcgattgcacggcccaatccaggcgacccgacccatggaatcaatcgccgcctggatgcgcccatcagtcttcatattgtgatgatgcgcgcagaggcactgcaagttccaggccacagtcaacccaccctcaccgaacgggatcacgtgatcgatctggcagttgtcggcagacaccgtgcagcccggatgcctacaggtgccgtcccgccccatcacataaaggcgtagctcgggacttggggtgtagccattttccacacgagtggcgatcgtatccaggtcaatgaccttcgaggcagtcttacccagcttccgggactcctcttgactcaggaatcccacccccggaatccaggacacgccacccaccaggggcgtgtataccgcgctgacgattttcactttggtccgccccgccaggaaggtgaccagggcccgcgcgaggtcctcgcccttctgtttcactttttccagagctttttggaacagcttgccggtgacaccgtcaatatttccactgatgtacgtacgcccgtccacgtggcggaaagtcaaggtgccatcactcccctttggcccacgcttctttcctgtgaaggttggatccagttccttgatccagcgagtaatcagccctgcaagtgcggaggcttccatcagtgcctggccagcaatgcgcggtgtcagcttttcggcaatgcgatggtccaactcatcccacaactccggtttagcctgcttgactgcctgcataatgcgggccaggtacggaatccgaacgtggaagtgagtttctaccaccactcttaaaatgggcagcttcattaaagcccacatggcgttaatagcctggttgataaaatgcttggattcccccgtgacggttttcaactccatgacaagagtgctagcgtccgcctctgggtttgagatcagcaaagtccagcgctggatctccatttgcgccatggtgaagttgatgtgactctctggattatttgggtcctgatggctgaagtatgacatttccatgccccctaatggtttaaatttcccctttttaactcattagcacccaccctaaccacacaaatcaaaacaaacaagtgttctaacgaatatttgttctaattcttgaaaataaagataccgctctaccgaaactgcaggtagagcggttagaacctcaactatcccttgaggtaatactccagagcattggggtgttttgccagtggagtgatcttgacattcatgtatttgaacatcggaaagccactaagaattgcatgcagctcgtcgtggtcatcgacatcgaaaatggagtagtttgcatactcgccgacgactcgccagattgctttcatgattccacgggattgcaggtctccggagtaggccttttccttagcctggaaatctgccatcacatcggcgtccatggaatcagggaagacgacgtccatgcgtgctagaaacagcatcgataattctccttatttacgggtgtagaagttgactttgtccatgtccacatcgacgcccaaacctgggccttgtggaatagcaacctggccgtccttgtactcaaattcttggacaatataggtatctttgagcaactgcggtccgaacagttctgtaccgtaggagatcgccttggtggatgccgcaaactgcagggatgctgcggtgccgattggaccttccagactggttgcaccatggcaggccagcccgccggcttcggcgatagcggcgatcttcttggattccagcagaccaccgtgcttagtggttttcagtgcgataacatccgcagcctgggctttcaccaccgcgagagcttcagctggggtccacacggattcatctgccatgaccgaaacgttggtgcggcgggtgatttcgcgcagggtttccaggtcgtcggccggggtgggctgctcgaacagctcgacgccagcctccgcgagaatcggcaagtaatgcagagcggtgcggcgatcccaacgtgcgttaatatcaatgcgcagagaaacgcggtcgccaacttcgcgcgccaattctgctacacggcgagtatcttccgcaggatcgccagcacccatcttcaacttgaaggaacggttaccaaactcctcgatgcgctcttcaatttccgccaccgcaacatcaagcggcaaaacgcccagcgcccaggtgacatccaccttgtcgcgcacggtgccaccaagcaggtcgcggacgggcacattgaggctgcgtgcccaggcatcatgcattgcgacgtcaacagccgccttggcataacgcgcacgtgcaacaacacgctcaaggtctgccataattcctgcaagctcggagacagcacggccgatgagcactggggcgaggtagccgtcgacaagcgccttcatggtctcaaccgactcgccgccccaccatggaccgccgggcacaacgccctcaccgtagccgatgacaccgttttctaagtgcacgctgaccagcagaatgtgctgctcagtggaggtggtagttgcgaagccgtgtgggcgaatgaggggaacgtcgaggatacgggattcgactttttggatggttaaatcagacaatttttctatggctttctggttaagtgggaaaagtcccgccacaagatgtggtcgggacttcaatgctagctaggtagaaaaactagtcttccttatccaggacgaatgggtagtgaacgtggttaccatcctcgccagtctcagggtgcaggaccagttctggcttcacagcggttgcaacgtcgttttcgacccactcgccaccctcgaagtaaagctgggtggtgatggtgcggtagcccgggtgggaaacgcgcaagtggaggtgggctgggcgccatgggtgcccaccgtaagactcaatgaaccaaccggttgggccatcatgagggatctggtaaggcgcaggctgcagggtcttgatcttgtagcggccttcctcatcggtaacgatggtgccacgcaggttccactctgggattccaggcgcgaactgggagtagtatccgtcctcatctgcgtgccagagctcaacttctgctccatcaagaccgttgccgtcgaggtcagtaacctgcccctcgaagatcagtggggtgcatgcgcggtccttgtcacgcattggcatttcagcatcccaagggagcttcggagagttctctacgtaataagggccttcgatggaacccttggttccggtgtagtcgtggcggttgtagttgatctcttcgatctcatgctcaacgaaaacgtccaaccacagtggccactcgccgtattctccaacgtcgatcatccactgcttgagcactgcgtactcttcgtaggtgacttcgtgcttgtgagcaacctgggcgatcgccgcgagcagatctacgtagatcgcgtttgcgcgttccttggaggtatcggaggaaacgcggtttgccttgaacttgtcagttgccttgttgcccgaatcgtgggctgttggatcaacgatctgttcagctgaagtcatgtcatactcctagagactttgggggtgaagtagggggtgcgagtcggatcactgcctagcggaaaaatctttgtgatcggctgaactcgataacaacactgtggcctgaatcatcgaatccgtcaacatcccaaaaaccttaaaaacaataagggaacctttagaagtataaatttttccacataatcccacttcaagtacacaaacagcctgtcaatttacatcatgcgaacacctacccccgagcaaaccctaggaattcccctaatgtgattcacttcattgatcgggcactgttggtcatacgccatcgacactgcggaattgctcgcaaatgtcacacaccgcttcaaagcaaaaacgaaaacgacatcgcggtggcaataccaacttcttttcactctcttggaggttcacatgtccacaccagtttcaaatttggcaagcgttcagaaaactctggaccatgcgcttgaggaccgccctgaagagggaatcgtccgcgtcaaccgcaacatcttcactgaccctgagatcttcgagctggagatgcgccacatcttcgaaggcaactggatctacctggctcacgagtcccagatccctaacgctggcgactacttcaccacctacattggccgccagccgatcatgatcacccgttccaaggacggcacactcaactgcctgatcaacgcgtgttctcaccgtggcgccatgctctgccgtcgcaagactgacaaccgcaccaccttgacctgcccattccacggctggacattcagcaacgacggcgcactgctcaaggtcaaggacgaaaaagaaggcgcctacccagagaatttccgcaccgacggctcccacgatctgcgtcgcgttcctaagttcgagtcctaccgtggcttcctcttcggctccctcaacgatgatgtcgtttctttggaagagcacctcggcgacacccgtaccgtcattgacatgctggttgaccaatccccagaaggcctcgaagtactgcgcggatcctccacctacacctacgacggcaactggaagctccagaccgaaaacggtgcagacggctaccacgtttcctccacccactggaactacgctgcaaccacctcccgccgtggcactggtgaatccgcgaacgaaaccaaggcaatggacgctggtacctggggcaagcagggtggcggatacttctcctacccttacggccacatgctgctgtggatgtggtggggcaacccagaagaccgcccactgttcgagcgccgcgacgagttcaagaaggaattcggcgaagaaaagggcgagttcatggttggtgcttcccgcaatctgtgcctctaccccaatgtttacctgatggatcagttctcctcacagatccgccacatccgcccaatctcagttgatcagaccgaagtcaccatctactgcatcgcacctaagggcgagtccgcggaagcacgtgcaaaccgcatccgccagtacgaagacttcttcaacgcaacgggcatggcaaccccagatgacctggaggaattccgctcctgccagaagacctaccaggcatctgccttcccatggaatgacatgacccgcggtttgggccaccaggtacagggaccaaacgaggttgccaagggcctaggcatgaacgaagttctttcctccggagcacgcaccgaagatgaaggcctctacccaatccagcacggcttctggcatgaactcatgcaggaggctgtgaataagcagagcatcaaggaaaaggaattggctgacgataccgcttcttcccttgccaccgtagctgcagccaaaatccgtgaggaagcaaaggcagccgcgaagtccgacgctggagagcctcgccgccgtcgtcgcacccgcggttagtcgtcgaaaagcaaaaaatcttttaaggagaacacctaaatgtctgaaatcacccgctctgagatcgaagctttcctctactacgaggctcgcctgctcgatgaccgtaaatttgaagaatggctcgaatgctaccgcgaggacgccgagttttggatgccagcctgggacgacaacggtgaactgactgaagatccacagtctgaaatttccctcatctactacccaaaccgtggtggacttgaggaccgcgtcttccgcatccgcaccgaacgctcctctgcaacttccctacctgaaccacgcaccggccacagcaccaccaacgtggaaatcctggagcgccgcgacggcgaagtagatatccgcttcaactggatcaccttctactaccgttacaacaccaccgacacctacttcggcaccacgtttatcacccttgatgtcagtggtgaaaccccgaagatcgtcaagaagaaggtcgttttgaagaacgactacatccaccacatcgtcgatatttaccacgtctaggaggcactcacatgactcaccaagttgcacttgcctttgaagacggcatcacccgattcatcgactgcgaagatgaccaaactgttgcagatgccgcctaccaggcacgcatcaacattcctttcgactgccgcgacggcgcctgcggaacctgcaaagcgttctgcgaatccggcgactttgacgaaggcgactacatcgacgacgccctgtccgaagatgaagcagccgacggctactgcctgccttgccagatgaccccaaagaccgacctcatcttgcagatcgccaccacctccgtgctggcaaagaccggcgcatccactttcgatggcgagttgaaggagatcaatcacttctctgattccaccatcggcattgagatcgaactggaaaaccgccaagatttggcgttcctccctggtcaatacatgaacatccaggttccaggcagcgaccagactcgttcctactctttctcctgcgctcaagattccggcaacgtgcagttcctgatcaaggtaaccccaggtggactcatgaccacctatctcaccgatcacgcgaaggtcggcgacaagctcaccttgaccggcccgatgggttccttcttcctgcgtgaacctgtccgcccgatcctgctgctcgccggcggaactggacttgcaccgatcttggctattttggaaaagctttcccgcgatgagcttctcgacgtcccaatccgcctggtttacggcgcgaacttcacccacgatctggtggaattggatcgacttgatgccttcaaggacaagttcgacttcgattacatcaccgtgctttccgacaaggacaccgagcatccacgcaagggctacgtcccagcacacctgaccggcgaatatgagccagatgaggacactgatgtgtacctctgcggccctcctccaatggtcgaggccgtgcgccaattcctgggcaccctggagcatcctccgctggacttttattacgagaagttcacttccgccgctgcccctgctgctggtaagccagagatcaccgtggagaccagcgaagttgcagaggatttcaacctggtcgaggtgtccactccaggcatgtcttccggcgaggtgcactcttctgcaacccagctgcaggcccgcatggctctggagctcggcgcgctggagcttgcgatcaacaaactcggcgagcgcgacatcgagcgattccgcaacttggccgacatcgcgaactccttcatcgacggcgataagtttatcgacgcggtgaagttcaccgaggccaacgccgatttccacgagttcctcttccgccgcgcaaacaacgaggcgctgcttgcggcgtaccagaacctccaggttgttcaagaaatgaacgcaacccttccaggcgccgagtggattgatccggcaattgccaccgagcacttggcgcttgtcgacgccgtctcccagaatgatctcgagaccgcgagaacaatcattcgtgaacacgcggagcacggcattgacactatggttaaggccctcgagaaatgagcgcgccagtaggacaaggcatcgaaggtcgccccactcacgtcaccccggaacgcttctttggccagggtgttgtggttaccggagcggctcaaggcatcggcatggcagtggcacaccgcatcgcatatgaggatggcaacctagtgttggtggaccgttccccgctggtgcatgaagttgccgaagagctgcgtaaagcaggcgccggaacggtggattctttcatcgccgatctggaaacctttgaaggcgcaactgatgctttggaatttgccgggcagaagttgaagaaccttgatgtggtgatcaacaacgttggtggcaccatctgggcgaagccttatcaggaatactctgaggaagagatccgcaaggaaatcaaccgaagcctcttccccaccttgtggatgtgccgggccgcgttgccaattctgatcggaaatggtggtggaacgatcgttaatgtgtcctccatcgcgaccggtggtatcaaccgtgttccttatgctgcagcaaagggtggcgtcaacggcattgtttctgccatggcccgcgaagctgcaccgcataatgtgcgcgtggtggcaacggctcccggtggcacgctcgctccggaacgtgccgtcaaacgaggccctgggccagagggcgaattggaagaaaagtggtatcagcaaatcgttgatcaaaccattgattccagtttgatgaagcgctacggcaccctagaggagcaggtcgcgccgatctgtttcctcgcttctgaggaagcttcctacatcactggatcagtcatgccagtcggtggaggcgaccagggataacccttggtcaatcttagggatttgtacctgtttttgcaggtacaagtcccttttttcgtctagtattgatttatggttgcctcagtctctttcaccccgtcatcgtcccaaacgttcctaccgcgggcgtcgatcatcgtgcaagaagtcagcacacagatcaaaagattagaatccggcgaaggcaaactcttccacatcagtggccagcccggcgcgggtaaaacagagttcggcatgcagcttatcgacgagctccaaggctggaccgtggtacgtgccacttccctgtcgtggctgaaaaacagcccccgaaacctccttggacacatcgcccacaaattgggtgcgcactccgccaactccatccgtggtgtgatcgaccgtctcgatgcctccaccgtggtgatcgttgacgatgtccactgggccgacgtggaatccatgcaaaaactcatcgaatattccatgcgcatggtttctggccgtttcgcactcatcatgattggccttgatgaagagaacttagtgttccacgatgaggtggtctcgctcccctccatcgcagactccacctacgtattgccgccgatgagtattgaagaaatccgccagcttgcgcttaccgatgtccgcggccgcatcagcaccaccaccgccacagacatccagcgcatcaccggcggcatctacgggcgagtcaaagaagtcctccactcggaatcccccgatcactggcgaatgcccaacccaaatattcccatcccacaaagctggcatgccaacctgttgagacgcatcaccaacgaagaagtctggcatgtactactcgccgtcgctgtccttccctccggaggccccattgacctggtaaaactcctaggcaacgaccccacgggcatgctttgcgacgacgccgtccgctcaggcctgctccgcgtgctgccgtctgacggccaaccacaagtggatttggtcctgccgatcgaccgcgccgtactgcaatcacgcactccgctcaacattctggcgcagttgcaccacaaggcagccgaatattacggcaagtggaatcaaaaagatgcccaactggagcacgaagcatttgctgcaattgatccaaatgatccagcagtgcgagccctagcgcagcgcggatatgcgttgggtaggactggccactggatggaatcggcacacgccctatctcttgccgcgaaccgcactgcacaccaagaagaatcaaataagtacttgctggagtccatcgattcactgatcgccgccgccgatctcccccaagctcgatccagagcatccacccttgatcttggagaaaccggcattcaacaagactcaatgctgggctacctggcaatccacgaaggccggcgcctcgaagcacgcaatctccttcatcgtgcttctgaagaattgctggcgcagcacccgattgatccgatccacggcccccgcatggctcagcgcaaagtactgttaaacttagtggactggaatccagaagaactcctggtgtgggctgatagagcagtcgcatggactgaagaggatgctggcgaaaaggttgaggcccaagctatttccctcattggacaatccatcctcgatggctgcctccccgaagataaacccatccccggtgaaaccacccttcacgcacaacgccgccacatggcaatgggctggctttccatggttcacgatgatccagtaactgcacgtcaaaagcttgaacgtcgcacatccatcaatggttcagaacgcatcagtttgtggcaagacggatggctggctcggtccctactgctgctcggcgaatgggagtccgcagcacgcaccgtagaaatcggtctggcccgcgccgaacagtttggcatccgcttcctcgaaccactgttactgtggtcgggcgccacaattgcaacagcccgcggaaactctgacttggcacgaaattacatgagcagactgtccaccgatcaagactccttcatcgtccaatctatgccatctgcgatgtgtcgcatgtgggtccaccgccatagaaatgaaatccccggtgcgatcgtggccggagaacaattggaaaaaatcgccgcacacaaacacgtcaacgcacctggattctggccatggcaagacgtccacgcaacgcatctcatccgcatcggcgaaactgagcgcgcccaggagttagtgaactccacgcttgaggagctcagaggctccgatatcatgtctgcccacgcaaaaattgccgttcccgacgccatgttgatgatccaccacggagatgtgaaaaagggatttaagcgtttcgacgacgccctcgatatgctcgatcccctcaccctcccctactatcgggcacgcatctgctttgaatacggccaggccctgagacgccaggggcaacgtcgacgtgctgatgaacaatttgcccgtgcagcttccctattccaagacatgggcgccgacgcgatggtcaccctagccaaccgagaacgccgggtgggtggccttggtcaacgatccgagcaagccggtgggctcacccctcaggaatatgaaattgcccgattagtgtcatctgggcatgccaaccgagaggtcgcacaggagcttttcctctcgcctaagaccgtggaataccatctcacccgggtgtacaaaaagctcggaatacgcaatcggatggaacttgccgaggctttgaagaagtactcacacgacgcctagcagcggatatgtttgcggacaagtatcccctagatctctttagggctatccctagtttcagctttccttaccacaggattgaatgtgaatcacatcaccagcaggtgacaatgtgcgattacttcacaagctcaaggagaatttctgtggcttcccaaatttctggcggctggcaaagtgccaaacaccgcaccactgtttacatggtcctcgtagttgtgggcatttctattctttttgacggctacgatctagtgatctacggcgccgtgctgtcaacactacttgaagatccaacccagatcggtgcgctcagcccagcagtcgccggcacccttggttcctacgccatgatcggcgtgatgatcggtgctctatctgcaggtgccgttggtgaccgccttggtcgtcgcaaagttatgctcaccgcaatcgtctggttctctgtgggcatggcgctgaccgcgttcgcgtcctcgattgcgctgttcggtttcttgcgcttcctcaccggacttggcgtgggcatgatcgttgcaaccggcggcgcaatcatcgcggagttcgctccagcgaataggcgcaacttgttcaacgcaatcgtgtactccggtgtcccagccggtggcgtgctggcttctatccttgcactgctctttgaagatgtcatcggctggcgcggactcttcctcatcggtggatccccactactgttcctcctgccacttgcatacttcttcctcccagagtccccgcgctggctcacctcccgcggccgtgctgcggacgccaaagccctctgcgcacgctatgggctgccgacggaggaatttgtcgtcgaaaagcagcaggaaacaaagggcaccggattcgctggaattttctcctccaagtacctcatgggcaccattctcatcggcgcaatgagcttcatcgggctgctttcgacctacggcctgaacacctggttgccaaagatcatggaatccaacggcgcaacctcacatgattccctgtactccctgctgttcctcaacggcggcgcagtgttcggtggcctcatcgcatcctggttcgctgaccgcatcggcgcgaagaccgtgatcacctccaccttcgctctcgccgcgatctgcctcggagtcctgccaaacatctcctcctggccaatgatgtacaccgcaatcgcattcgcaggcgtcggcgtcctgggcacccaggttctcacctacggcctgacctcgaacttcttcggaaccgaatgccgcgcagcgggagttgcatggtgtgcaggattcggccgactcggcggaatcgtcggaccagcaatcggtggcctgatcatcggcgcaggattcggaccaagctccgcattcctcatcttcgcagcagctgccgcaatcggcgcggtctgcaccttgctgatcccgcgctccccagcagaagtagaggtcaaggtcgcgcaggaaccacttgcacgtgtctaaccccaattaattcgaaacaaggaagcttcggcttcctttttcggcatttcactagcatttagaatttaaggaattagttaatggcaagctcagtattattagctgtcgaaaaaccagaactcccccggcctactttcgctgagatcaaacgagacctcggcccccaagaaattggcaacgggcttgtcgcactgattttctccgcatccggacccatcgcagtgatcctggctgctgctgcagcgggaaacctttcgcctgatcaaacatcttcatggatcttcggagcatttttaggcaacggactgctcacgctgtggcttacctatatgtaccgcagcccgcaggcatacttctggacgattcccggaaccgtcatcgtgggcgactcacttacccacttaagtttcgctgaagttatcggcgcataccttgttaccggcgttgtggtgtttgcgctcggatggaccggtctcatcggacggatcatggcggtactgccaccaaccatcgtgatggccatggtcgcaggcattttcctccgcttcggactcgacctcatcgacgccagcgtgaccgacccgctcattgcacttcccatggtcatagtttttgtggcattgagcatgagtccccgcttggcaagcatcgccccacccgttgcagtagccgcagtagtgggaaccatcgttgccatcgcatccggcaaactagcgtccggaattctagacaacggaattatctcccgccccgtctttaccgccccagaattttccttcgccgccatcatggaactcgttgttcccttggcgatcaccgtagtcattgtccaaaacggccaaggcgtcgcagtgcttaaagcagcaggtcaccgccccggagtaaaccttgccgccgcggcctccggactgtggtccctacccatggcgttgatcggcaacatcaccacctgcctcaccggccccaccaacgcgctgatcgtcgccggagcaaaatcacacaggcactacaccgcagcaatggtcaccgccatcggcgccatcatcgtgggcctgttctccccaactttcgtcggattcatgctggccatgcccatatccttcatcgctgcactcgccggcatcgccatgctcaccccactcaaaaacgccttcatcgcaggattctccggtgattattccactggcgcactagtctgctttttagtcacagtgtcggaaatcagcatcctcggaatcaccgccccgttttggggaattgtcttcggatggctcatcggatggctgctggatagcaagcttctagaaaacaaaaaacgggcttagctcctctatatataaggaaccaaacccgaatctttaaaaaactctagcgcttgagcttgcggtaatcgaagacctggtcaacgatgccatactcgagtgcttcctcagcggtgaggatcttgtcacggtcggtatcgatgcggatctgctccgcggtcttgccggtgtgctcagccaaggtggtttccatcaaacgacgcatgcgctcgatttcagctgcctggatctcgaggtcagaaacctgaccctgggtgccctgggttgctggctggtggatcagcacgcgggagttaggaagaacagcgcgcttacctggtgcaccggctgcaagaagaactgcggctgcggatgctgcctgaccaaggcagacggtctgaacgtctgggcggacgtactgcatggtgtcgtaaattgccatcaacgcggtgaaggatccaccaggtgagttgatgtacagggtgatatcgcggtctgggtccatgccttcgaggacaaggagctgcgccatgatgtcgtttgcagaggtgtcgtcgacctgggtgcccaggaagatgatgcgctcttcaaagagttttgcgtaagggttggtctctttggtgccgtatgcggactgctcaatgaaggaaggcagcacgtaacgggacgttggcatttggaatccgttgctcataatcttattctctcctttaaagttttccgtgcgcctagttgctgattgggccttcagccaaggtaatcacgtggtcaacaagtccgtaatccttagcttcctgtgcagtgaaccagcggtcacgatcggaatccttggagatctgctcaaaggtctggccggtgtgctcagcgatcagctgggccatttcacgcttggtggctgcgaactgctcagcctggatagcgatatcagctgcggtaccaccaacaccagcggaaggctggtgcatcatgatacgtgcgtgtggcaatgcgaaacgcttgcccttagtgccaccggaaagcaggaactggcccatggatgctgccaggcccatgccgtaggttgcgatgtcgcatggggagtatttcatggtgtcataaattgccatgcctgcggtgacggagccacctggggagttaatgtacagggagatgtccctggttggatcctcagcggacagcagcaggatctgagcgcatagcttgtttgcaatctcatcgtctacctggcttcccaggaaaatgatgcgctcactcaggaggcgatcaaagacgtcatttccgaaaccaggcccaccctgggctgccatacgaatatcgctcatgaaaacagtcaactcctacattcttaaatcttgggtacgttcatttggttcaatgtcaccagactacccgcgtatttccatgaaaccgcctctgttcgctatcagcgttttcaccgtttaaaaaagcaaaaaaataacgcttctcgacgtccagtggcgcgtcgaaaagcgttatttctttaaagtttttaagcttcagactcagtctcagctacttcttcttcaccgaagtattccttagggtcgatctcgttaccctcggagtccttcacgtttacgcggcagatagcctgtgcaagagccttgccacggcgaacgtcggagaagaggttcgcgatctggccggactgctgcagctgaccgatgaactggtttgggtccatgccgtaagactgtgcggtgaacaggatgtggtcggtgagctcctgctgggaaacctcaggctcctcaacctcagagagggtgtccaggaacagctgggtgcgaacagccttctcagcatcttcgacgttcttcttgtcgaactcttcacgagtggtgccctgagcctcaaggagggagttcagtgcagcatcgtcgtgtgcaagctcgccgaggagctggtgcagctgggagtgtgcctgctcgtcaacgatggactgtggcagagcgaagtcagcctcgccaagagccgcagcgagaacttcgtcgcggattgcagcagcctgctcgttcttctgcttagcctcaacgtcagacacggtggactcacgaagctcttcgatggtgtcgaactcagaagccagctgtgcgaactcatcatccagctcaggcagctcgcgctgcttggttgcggtgatctcaacgctgatttgagcttccttgcccttgtgctcgccgtttgccagctcagaggtgaactctacggtttcatccttcttagcgccgatcagagccttgtccaggccgtcaatcagatcgtcagatccgatttcgtaggacagaccctcagtggttgcctcttcaatcttctcaccgtcaatgcttgcggtgatgttgatggtgacgaactcacccttcttcagcttgtggttgtgatccttcaaggtggagaaacgtgcacgcagggtctcgagctctgcttcgattgcctcttcgtcagccttgatagctgggacctcaacagtgatgtcctcgaacttaggaagctcgaactctgggcgaacgtcaacctcagcgacgaactcaacgagctcgttgtcttcgatcttggtgacctctacgttaggctggccgattgccttgatgccctcagcttcgattgcctgtgcgtagcggttaggaagcatgtcgttgacaacctgctccagaaccgcaccacggccgaagcgtgcgtcgataagctgacgcggtgccttgcccttacggaaaccagggatctggacttgctgcgctagagcggcgtatgcctggtcgatctctggcttcagttcagaaaatggaacctcaacggtgatctttgaacgggtgtcgctcagcttctcgacagaactcttcacgagtaaatctcctggatgatcgggaaagggaaagtttcagatattacaaaaacaagcccggtttccgacgattaatgcgatttctcgcgtcgtccgaaaccgagctcgtcctcaagtcggggcgacaggatttgaacctgcgaccccctgctcccaaagcaggtgcgctaccaagctgcgccacgccccgatatttaatttgacccatcgaatactaacacactgtgatctcagaacaaattcagtaagtgacttactaagtctctgtgctgaacccctgtgcgctgtgctccttggttcgattaagaactttacacacaaccatctgaaaagacgaaatcgcgtccatagctgcaggtaaagataggtttttaagttacgcaattgcatcaagttttaacaactaagcgttttccagcgactttctatgccaatcccattcgatctaaggaatttccccctccccgttgccgattgtctaaatttatggaattttaaatttatggacaaatttttccccactgatcagaatgaccgcgatgctctatttcagagactcgaagccatagaggcagtgatcgctcggcacgaggcactgtttgcaaaagaaggccactcaatcaacgactcccctgaaactacggacggagcgattcatttctccggacagtttgaaaacgcttcaggttccatctcctattcatggtcgcgacccccacatcatctcctcgaagaagcctgggattcgtcattcacccgactcgcagcattggcccaccctcaacggggtctgattctgaaacagttacttaatgacccctgctcggtctctaccctttgtcagctcggagtgacatcctctaccggcaccgcctaccaccatctcaatgaacttgaatctgccggctgggtaagaaaaggtcgtggcggcgtttatgaagtccccactgagcggatcatcccgctactaaccatcatttctgccagtgagaatcactaatgagattaaagaagcagcttcttggcagcctgttagttgtcatcgtggttttgtccatcgccgtagcaaccaccaaacaacaaaaaggcttcgtcacaggtcagcccaccggtgcgcttaacctctccgacatcctcgactccgaagaacttggcgagtatcacctcatgtcagccgccatcatcactggtaacactgtagatttcagcgggctcggcgcaggtccagacgacccttttgaaatcgcatcgattacgaagatcttcaccggtgagctgcttcgacttcagattgagcgaggagagatcacagaatccacggccgtcggagacgttcttggagaacgtgtagccgactccctcatccgggacataaccgtggaagaactagccaatcacaccagcggactaccccgtctaggcaatgtaggacttagaccttttatggctacgttctttgacaagaatccttacaaagacctctctgcagatcgagtcatctctatcagcacaacgtccaaattgaattcgcgcggagaatttcactactcaaatcttggttttgctctgcttggccaagtccttgcccgcaatgccggtttaacgtttgaccagctcttagaccgtgatttactggcaccactcaacctcaataacaccaagctcatgaccccagaatccctcgctcaagatgcacctcaagggttctcaacacctggcaaacaagtcgaagcgtgggagatggatggctttctccccgcagctggcctgcgttccaccgcgcgcgacatggcagttttctgtcagtacttattcacaaaaggccccgcccctttcacctggcaatcccttgaatcggcccctgaaatcgtctggcataacggagagtcctttggatatagttccgtactcttctttaacaccgctacaactactgccatcttcgttgctgccgacgttgccacatctgtcttcccaattggtcacgagcttttaatggcaaactccactaggcaggaatcaaaatgatcgattcccccgcctctatccatcggcgaatcgttgcaaccttggccgattacagcatcgcgctcctcattggaggaggcattgctctggctttcggaactagtatcctcaacccgctcttttcaactgttctcacgattgccttttggctttccaaatctttattagaagcagccttcggaactacaccaggaaaaatgctcacacacctgcacgtcaaccacgacatacatggtgagcgcctaagcatctactactcctcagcaagaaacgcgtggatcttgttggagatcatcccacttgtcggcctagtactattcagctttgtagccattttcctcgtcgctagttgcattcgcgcttgcaacttcatgggtttacatgacaaatttgcacatgtaaatgtcttgcggaaaaacgaaaaacaccctctcaactgctttaaatgcaactgagagagtgttattattttgagggaatgacgggaatcgaacccgcgtcatcagcttggaaggctgaggtaatagccattatacgacattcccacttgtgaacttttgcaagaactcttgtttggttcgaggaaaagcatagcgcatattgttgttttattaaaaatcggcaggctggcacccggttttcgaacaagacttttggccagaccacattctcaagaatccctttcgatacatcgctacttttcatccggcacctatccagcaaatagccagttaacctgcagcaagtgtgttattgtacatttccttgcaattcccccttacgaaacccgctaaaccttaaaggaacataagagaattttagcaagtgtgtccgtctggccccataaaatatacaagtacttgtttataagtccagcgtacatgggataattttaacaaagtacctgaaatgttcttaggttgtaaaaaccttagaataatttcgacaaaaactacctccttggcgtaacctagctaaacatgaagccaaaaattatcgatgccgaatcgggcagagagctctggactgcaattgaatgtgcagagttctccggtactgctcgaggtactttcactagctacgcaggtcgaggacgtgctccaaagccagttgcaaagctccatgggctcactttgtgggactcccaaaccattgaggaatgggtcgacgaccgcgctgcaggaaacaagggattaattaattccgaagagactgtcgcagtcgccaactaagcactttttctcaaaagccacgaaaacaatcgttttcgtggcatttgtcttttctgggttaagggaaaatctgtgtgctttccccaggtcgacccgaatccgtgctctaggggctagttgaaacgacctgcccatccctgccggataccgctagagttattcggtgtggcatcgattccggtgtcataggtagccgggcgcccgtcgtggtcgtgtggttgttcttgttggatcaagtcggggactttggcgagtccgtcttgaccccagttttgttgcctggcgatctcaaccggatcgccaggcaactgcgtatgcatcaataaccaccaatccaccgcgatacgttgatgttcatcaaacatcccccgatggtttctcgccaacgctttaatctgagcgttgataccaccttccaaacagttcgttgttgatttcaccaccccgtcaacctctgctggtggatcaatataggtaaacaaatgcccattgcgggccaaggcttccaactgcttataagcagtccggtgggttttgtgggtgtgacctgccatttctgattggggcggatatgtttcgggatggcatgtgctggtacatcagcgcggtaggtgcgttcgttaagccagtccccgtaggtgaggtagaactcttggaggagtttgcgccagtcggcggcttgttccggtgtggtgactttcagcagtttcaaggagagaccccggagtgcttttcggcgagctcagcacgggtcttagggtgacgtgtttttggacgttgcgtttgacgtggacgaggcagcgttggattttcgttgtcggccaggtcgtggtgatggctttgagtgcgccttttttgtccgtcggtggtcacgattaagggtggttggagttgatcgaagaggtgggtgtagttgtaggcgtcttctttggtgcaccagcgccaggcgacgacgtggtcgaaggtgtaggccacgaggaggcatgtggtgttgaagaaagtgccgtcgatgaagagttagtcatagacacggaagcggtcggtgttgcgggggacttgtacgaaccagtagtcgtggaaccagttggtgagggtacgacgggtcacgcctagttggttggcgaggttggtgcgtgatgggagttgaggatccagttgataaagagttggaatcggtgggcgtggtggtcgttgggtcgggtgttggtggtggtggcgttgcaggtggtgcagcgccatcgggtggtgccttttgttgtagtggctgttttttctcatggggccggtgcataccgggcagttgggtcgtgttcttttcaccttgtttggtgtagtccccgcgtgtatcacaggttggtgttggggtggggatgttgcctggttttgatgggtttgtggttggcagaacacatttttgtggggttggtgctggtggggttatgtttctgggccactaaaagcacacatttttcccttaaccctcttttctagcgataccagacacaaaatcagcagaagtacctttacagtcttaaaacagggaactttaacgaaagacttgtcgttactttagtaattagaccaacatggtggtgagtggttgaaatcttgccatcaaaattatcgagtgagttgaagcattccgtggaagtactactacttatcgcaatcgtcgttggtggtggcgtttttgtcgcctcaaagatgggatccaataacaataagaagcaagaagaagccaagtttgctgacgcacaggcagatgcgcgtcggtggattgagcgtcttggttcccaggttttgaccatcgcaggtacagatgctgcgtcgacccaggctattgctgacgcctcagagcgctataccgctgcgtcttctcagatttcttctgccactactcctcgtcaggcagagttggctcgagaatctgcactagagggtctgcattatatgaacgcggctcgtgagatcatgggtatgactgctggccctgagctgcctcctctggaaggtcagcgcaatgctggtcgcgttacagaaaagcgcaccattgagcaggagggtcgccagatcactgcttcccccgtcgcaacagatgaaactccgaactactaccctggcggtaacgttgcgggtcgcccagtccctgctggttggtactccgagccttggtgggcaagcgcattgcgttccggtctgtggactgcaggttcggtcatgatgttctcagcaatgtttaacggcatggctggtgtcggctactccgctgcagcctttgaaaatggctatggcgagggctaccaagatggcctggacgcagctggcggagacatgggcgatgctggcgatatgggtgacgccggagctgacatgggcgatgttggtggtgatgctggcggagacggtggcggattcttcgacggactctttggtggtggagacggcggcgatggcggcggattcgattttgacttcgatttctagcccaaaataatccccacataaacacaaaatgggcggttaagttcttggaaaagaacttaaccgcccatttttaattgtttattcgttaggaacgacaggtgcgattccagtgcgctcgtaatcagcgaggatgtcgatacgacgctggtggcgctcggcgttgctccattcctgctcgaggaaggcgtcgacaattgccaatgcctcttcctctgagtgcatgcggccgccgatgccgatgaggttcgcattgttgtgctcgcgggcgaggcgtgcagtttcaacagaccaagcaagtgcacaacgtgcacccttgaccttgttggcggcgatctgctcgccgtttccggatccacccaggacgatgccgagtgagcctgggtcgtttactgtgcggctagctgcttcgatgcagaaggctgggtagtcatcttctgcatcataggtgtgggctccgcagtcgatcacttcgtggccgtgggccttaaggtgttctgcgattgcatttttagtttcgaaaccagcgtggtctgctccaaggtatacgcgcatggaagtcagtttactgcaggcattttcacaacggcggatacccggacttttcccctatttgggggttcacaaatcgcaaaatagctcgactcaatcttggtaaagcggatcggctctgactcgggtaggacacttccgtacctgtcatgatgcggaacgggtaaggaagggggaacggcttccccaagtcacccaacgccatagatacccaagtggcccctgtgtgtagtggcgcaaccataaagcagaaagtagctcttgaataatgagaatacccgcagctaggagcaccgtagctgtccatgatgtgctgtgtggaagatccacgattagcccgccaatgagcatgaggatcgttgcaccaatgtagttggttagcgccatacgccctaaaggtgcgaaaactgcagcgagtgcaccgcgaatcggtgtatgcaaggccagcaacactaaagaaatgtagacgccgccaagcgcgagtcccgccactgtggaaacgatcgagaagcctgaagaagtgatgtcacgtgcctggatgatcagcgtaggtatagcgattgctgcgcttacggcgaaaaagactcccatagcccgcggtgcgttctctgcccgatcgactactccatacctaacgagcgctgaaccgatcaggaacattgaggggataagcaggaacccgccaccgaaaaccaccgctggcacaagcgacacttcgccaaggactgcgacagcccaacgaggcaaccaggaggatggcagcaaaatgaccaggccgactattgcatacggcaacaatgcttcacccggctggagaatttggtggatgatgccgagcggtatcaacgtgagaagtcgacgaaagagaactattcttgggcgttcacctcgacgggcagcggactggttctggccgaaccgagaagccgtttaacggcagtacctatgtggtctagttggtggtctaggtcaaggcccgattgtatctaggactgttgttcccatgggatgtattaaaaaatcgatcaactaagcagaagtgagatgcgggctttttcaataaagttcaataaagtatgctgcgaaacggaatgagcaagtacgtgcgcgtaatcggaatttcattcgctggggcggaaaagctacaaaagaataaaactgcccgacgcgatccttgaacagatcagcgggcagtgtttaataagcagagacagcgttaattagtcgaactgtgggttctcagtgcggctgcgcttgatttcaaagaagtggggatagcttgcgagcttgaaggaagcgtcgaagatctctcctgcttcctcgccgcgtgggatgcgggtgagcactgggccgaagaaagcggtgtcgccgagcttgaccactggggttccgacatcgttgccgacctcgtccattgcggtctggtggaatgcgcgaagtgcgtcgtcccattcggtggtgtctgcaacttcaccaagtgcagcgtctaggccgacctcttcaagtgcctctgcgatgacatcattgaaggaaccttcgattggtccgcgaccgtcgttgtggatgcgggtacccattgcggtgtacaggtcgccgagcttgtcagcatggtcggtggcgacagctgcgaaaacgcgtgctggtccccatgcagccttcatgcgctccttgtaatcctctgggagatcacggccttcgtttaggacagcgaggctcattggaacccactggatttcaatatcgcggacttgttcgacttccttaatccagcgggaggtgacccagcagaatgggcaggtggtatcgaaccagaaggttactttttgagccatattatttcctctttcttaaagttttctagcaatccacactaggcgcgaactatcgtggtgtcattgcgcaccttctaagggtagcgccccctcaaatttcaaggagcattaaattgacgtccactaatctcacccgacaggaagcttcggatcgttcgaggttactgagtgtagaaaactatgacattgcacttgatctcaacaacggtgatgagttttttagttcctccaccgttgtcagcttcactgtcaggaaggctggcgatacctttattgatctccgcgcagcaagcgttgaggaggttcgcctggacaatgtgtccatcaaagatgaggctctaacccttggcaagaacggctacgacgagacgttcggcatcgccctgaagggtcttactcccggcgcgcacaccttgcgggtaacggcgtctatcccctattcccgcaccggtgaaggcctgcaccgcatggtggatccagcagacaatgaggtgtatttgtacacccagtttgagaccgccgatgccaagcgtatgttcgcgtgtttcgatcagccagacctcaaggctacctatgatctgaacatcaaaactcctaagggttggaagatcatttccaactctgagcagcaggtttccactcagcacactgattacgatacccacatttcccgagtggactatcccctctccacctacctgattgcggtgtgcgcgggtcgttaccacgaggtgtgcgatgtctggaagggtacgctcacccaccatgcagaaacacctgccgatcagccaactgagctgactgttccgcttgctctctactgccgcagttctttggctaaagatcttgatgcggtgcgtctgtttaccgaaacgaagcagggctttgattggtaccaccgcaacttcggtgtggcgtacccattcggcaagtacgatcagatcttcgtccctgaatttaatgctggcgcgatggagaacgccggcgctgtcaccatccgcgatgagtacgtttttgcatccaaggcaacccgttaccgctacgagcgccgcgctgaaaccatccttcacgagctcgctcacatgtggttcggtgacctggtgaccatgcagtggtgggatgatctgtggctcaacgagtccttcgccacttggtccgcggcaatttctcaggctgaggaaactgaatacaacactgcatgggtgactttcgccaatgtggagaagtcgtgggcgtaccagcaggatcagctgccttccacccacccggtgttctctgacggatacgacattgagactgtcgaccagaacttcgacggcatcacctacgcaaagggcgcctcggtgctcaagcagctgcaggcatacgttggccgtgaggaattcctggcaggcgtacgcaggcactttgccaaccacgcatggggcaacgccagctttgatgatctgctcggcgccctcgagcagtcctccggccgcgacctctccgactgggcaaaccagtggctcaagaccaccggcatcaacaccctcggcgcaaagttcaccaccgacaacggcaaatacacctccttctccgtcacccagaccggcgccgcgccgggtgccggtgagctgcggactcaccgcatcgcggtgggtctttataagcttgtcgacggatccctcaaccgctacgcacgagtagaacttgactgcagtggcgcgtcgacaagcgttgaagagatcgttggacttgagcaggctgacttcgtgctggtcaacgatgatgatctgacgtatgcgctgctggatctggatgatgattcacgcaattttgtcatcgacaatattgataagttcagcgaccctatgcctcgcacgctggtgtggtccgctgcgtgggagatgactcgcgctggtcagatgaaggctcgtgatttcatcgcgctggttgctcgtggcgctgctgcggaaactgaaattgctgtgctggagcgcattctcgcgcaggctacctctgcgctgaagagctacgccgacccagcgtgggcagaagcaactggaaatgacctgctggccgatgctttccttgagggtgctcgctccgcagaaccagactccgacactcagttggcgttcattcaggctctggcaaaagcaacgctcaatgatgctgctgccgattacttccgcgacattcttgccggcaacgtcgaaggcctgaccgtggatcctgacctgcgttggtgggcactgactgcgcttatcgcccgtggtgacatcgaggctgtcgaagatgcaatcgccgctgaactttcccgcgacaactccagtgcctccttcctcgcatcacttcgagccggtgccgctgtgaacactgaagaagtgaaggctgctgcatacaagcatgtcacggcagttgatagtggcctatccaacctggagctgcgccacaagattgaaggcctcacattcactggctcttctgaactgctgcaagcctacaacgagcagtacttcgaaatccttgatgatgtgtgggcgaacttctccggcgaaatggcacagcagatcgtcctcggactgttcccttcatggaacgtttccgaagagggtctcaagcgtaccgacgagtttcttgatggcgaacatgtcgcaggcatcaagcgaattgtttccgaatccctcgaccgcactgcccgtgctctgcgcaaccgtgcggcagatgctgcgtaagtaaaagattctcaatcccaaaaaatcctggcatgtttgcatcacacgcaatgtgccaggattttttgcatgggaaaacaatgaacaaaacacaaagcaccttgaccaaatatgtccgttagatgaagttctaccggcatctaagaatcgcccaagttaacctaaaactcctgttcgaaattgcccagacaggtgtccaccaacactgctacattgcattggagatccagaatcgatcactctacgaccaggaaaaactttcatgtccatcgagcaagcaatcacttcactctccgcaagagtgcgggaactaaagcccatcatcgagactgaagaagccaccaaaaccgcactgatcatcccctttatcagcaacgttctcggctacgacgtcactgatcctcgtgaagtcattccggaatacactgctgatgttggcgtcaaaaagggtgagaaggtcgacttcgctatcaaaaccggcgatgatttccacttcctcatcgaatgcaaaaaggtcggctccccactcagcctcgatcacgctaaccagctcgtccgctatttcaatgtcacagacaccgaatttgccattctcaccaacggcgaaatctaccaattctatggacaactcgatgcagccaaccgcatggatgcaaaaccattcatgaccttggatttgaacaatattgatgcccgtcagttccctcatttggaaatgtgtacccgcaagcatttcaacccacaagcgctagccgccaacgctgaagaactgaagtacattgctgaattgaagaaagtcatcgcgaatcaattccaagaacctgacgtagaaatcgtcaagatgcttgcggcgacagtcaccacaaagcgtatgactgcacaaaatctggaattcttcacccgcttggttaatactgcgtcttcccagttcctcaaagacgaggtcaatcgtagattgcgctccgcccaagtctttgaggatcctgtccaaacacaaggtgctgatgcagaaacaccagcagaggacgaagcagtaatcgaagaagtggtttcagaaatcgtgacgacagaagaggaaatccacggtcattcaattgtccgtgcaatttgctgctcagaggtatcggcacaagaaatcaccatgcgtgacgcaaaatcctactgcgctattctcttccaagacaacaaccgaaagccaatcgcccgtttctactttgatcgcaagattccacgcatcggcatcttcaatgctgaaggcgagcaggaacactttgatttggaatccatcgaagatatctacaaccacgctgatcttctgcattcccgcgtcgtagcattgaacgcttaagttctgcctttagttctgcagtcggtgtgccacggtcaggcacacctctgcagtccatttgctggagttggcgaggaatacccacaactgatgatcgtttaaccctgccggtagatcgatgcgtgcttcggcgaaaataccccaccttgcgccgttttcgatctcttccgcaaatactgtgaccagtacatgttctttcgagtacaggttgcacagtccaagaagttcctgaagttgcttcttgtttttgattttcacacctgtaccggaagacaccgctagggtttttcgatcgctgccgttgttgccatcggtcaaccatgcactgacacgttgacccatatgcagatactcaacgaagtcctcccccatcttgagttgatccgcacccattaattcgtattgttggtagatacgatccaaagaaaccagcggggtgggttcgtcaatcagcccgaagggattgccttctttgagttgatcttcagagaactcgaaatccacatctggaggagttgcgttgaactctacgcgttcaggggaaaacttcggccagatttgttcgcaccaagacacgaaagtcgttgccacatcattcatgcagtagtgcacgaactctgccgactgttcccacgttgcgccgacgcttgagaagaagaattcacgacctcgcacagtcatgttctttgaatcagcttcatctaaaaccacctgcagatcacgggttggcctgttgaattcattagcggcccgcaggtactctgcctgtttctttgcagggacacagccatgccacatgaaatcagcgacgatgcacaaggtgaccgaatccaagttgaagttcacggtcagccctgggcggcgcactataagttccataccggaatcggtcaccgccatgtcatggttgtagcccagtgtcataagcgccatttgtacaggtttcatccgcatggatagcaacgcattatcaagattttcggtcatcgaaactgtcactttcttcacaaggagtctgagcatgccaattggctgatcgtttttaatcaatgaattttttacaattacccgagggtaacaccagaaattcacttgcgttcgttgaggaaaggaatgaagggataccgctccttttcgggggtacagcactccagcaagactcattcggctcagttagagttcaccacaacgactcaaaaaagaaagtggcagcatgtctacgattcctgatgttttcaccagtgaagtgttccctgaaatcagtggcaccaaagaattccgtggcctgacttatatgttctttgatcaattcactttgcccaccgcagaacagcttgagcaagctaaagcagctggctggtcactgatcacctggggatggtggaatagcgacaccgatcttgaggatgtcgaattggaagacatcactaatgaaggcgacagcctaccaaaactcacggatgaattcgctgtgtcttcactgagcaccttcgatctaaattcccaaggtctgcccaatgatgatcgtgagccgcaaccaattgaagaagccgactcactagatgacatcttctccgaggaagagggctggggtctaatggcaatcaattgcccgaattggcaagtcccagcagcgtgtgaatggctcggctgcatgaatgttggtgaaccatttgaaatgtcacacgtacttagggtgtggcagaacagttggggcgtcgaggccctggcttttggtggtgaagaagacgacgcggatctgctgcttcgagtccctgaagaaagcgaagagctactgaaggctctcgcagtcgcttctgaccaagtcactacctacaagcatgaagatctgggattcttagctagtctttggtttgactaactacaatcaatgtcatgaccagcggtgatccaaaattaattacgcttcgttcccgcaataacaaagttgtcgaaataacagatgcccgtgatcgtgctttcattaagcaggctgatgagctgatcgtgaagatcgacaaactgcttgagagcaaaagaaaaaagtcccgttaagtccgatccacactgttgtccccgcggagacgcttgagcacgttttctgcagagatcaaacacatagatacgcccacccctggaactgtggtgtcacctgcgtcatacaggccatctactttgcgggatttgttagaacccctaaagaacgccgattgtgccagggtgtgtgaggggccaatggacccgccgctccaggagttgtatcggtctgcgaagtcggcagggccgatggtgcgctgcacaacaatgcggctttccaaaccatcaatgccagcccatcgcccaatttgagccactgctgctattgcgatccggcccaccatgtcagattcttctccgtaagcggacccgtgaccaatggagacatcggcgggtactgggaccaggatgaagaggttctcgtggccttcgggtgcggcatcggaatctgttgcggaggtcttggagatctagatggattctgaagccgggaattctggggtggagccgtcgaaaactttgcggaaatcttcgtcccagtcggaggaaaaagcagggtgtgctcccccttcacgcctgccaaaaccagcacagtactgaggccgggttgtttgttcttccagctcgtctccggcttcgcgcacaacgaagcaggtaggagttgggtttcggtgtggtgctgatcagcgcagctgatcacgatatcggcttcgatgaactctgagccgacttggacgcctgtggcgtttcggccttgggtggtgattgcgctgacgggggtgccgaggtggaggacggcgtcgtcgataagcgaaattagtgccttgatgaaggcggtgaagccgcctcggggataggagacgccttggacgaggtcggtgtggctcatgaggtgatagagcgccggggtgtgcgaagggtctgaggagaggaaaactgcggggtagcttaagatttggcgcagttttgtatcgcggaattgggtgttgaccttgacttttagcgaggtcgacaggcttgctagaagtttgggtaaaaggcgcagcatgccggggcttaagtatgggatgaagttggtgaagttggtgtagaggaagccgtcgatggccaggttgtagacctgtgtggcggagtcgatataggtgcgcagtttggcgccggcgccgggttcgcgggattcgaaaagctcggccatcgcatcgatgtcggaggtgacgtcgatgaattcgccgtggtcgtcgatgacgcggtaggcgggttcaagtggcacgaggtcgaggtggtcgtcgatggaggtgccgcagagcttaaagaagtgggacatggcgtcgggcatgaggtaccagctggggccggtgtcccagcggaagccgtcgagttcgaaggtcccggcgcggccgccgaggtgctcgttttgttcgacgaggtggacttcatatccttcgcgtaagagcagtgcggtggtggctagtcctgctagtcccccgccgatgaccactgcttttgtcatttttgaaacacttctttccacattgctttggttgccaggctggcttttttcatagacggcacccgaatccgcccgttttttaagtcttcgagggacgcggattccaggttgtccacgaggcaaccgtagagatcggtcgcggcgcgcacaccggttcgcgcgccaaatggcagcagcggaatgctcagccgggcggcatccaaatcctctcggatatcagtaacgatctcatcgcgcatttcttcggtgaataccggcaaataagaacggcctaggccttcgcggtcttcagctagatctcgcaggaaatttaccttttgaaatgccgcacccaaacgcctggcgccgtgttccatcgtggcccgatcctgcgggctggcagtggaatcttggaggaaaattttcaaacacatcaacccgatgacctcagcggagccgtaaatgtactcatccaactgagtcggatcataggaggtttgggagagatcgcggcgcatggaatcaaaaaacgccacgatgtgagcctgctcaaaaccacatttgcgggcggtattgccaaacgcatggatcactggatcggtatgaaaaggaacggacaaactgagcagaacctggcgttcgtaattgtccaaaatctccgcaacggcgtccggcgcacaccccgcggcagcagcagcgccgtccacaacctcatcggccactcgcaccattgcgtacaatgcctcaatatcgcgacgaattttcggcgacaacagcttcgatgccagagtaaaactggaggaataatgggcgattaccgtggccgtcgcctttgagctcatcgcatcaaaacggcccaaaaaatcttgctgatcagccacactcgcctccttcacaggaaactttaccgcgagaaatccagacaaccgaaagggacgcttctcgacgtctccctcagccccgctccacccgctgcgggttgagccactgggcgatggcaacgaagaacagcgctaccgcgctgacccaaaacgcccccgagccgatgcccatatagataggaaggaatgtcactggtgctgccgctgatccgaagaatcggaaagcctgcacggtagaaagcagcgatgatccaccggggcttccgatgacagccaagttgacggttgcttggattccttgtgctgctgctactgcgaaggcccacagtacggccaccacaatgatccacggtgcgatcggcagcagtgcgagtgcgatggtaccgatgacagcactgacaatgagcaccgcgcgcacaccaaatttgtctgccaaatcgccaatcttgcgggaggcaaagaacgcagccaggccaccacacatgaccaccaaaccacgcgctgcagcatcaagtccgaattgctcgccaacgtgcagcgatgtcatgaatccaatgccgatgatgccgatgcccaccacaaagccggaaaccatgtggatgatggtcggtccccactgcaccttgccactaacgttttgcttcgatgctgatggtggtggaacaacggggagtcgcgccaccaaaataaacagtgacgctgctgcagtgaccaggaaggtcaacctccacgacaccaccgaagacacacctgcgatcagtggcgccgacaacatgccgagtgattgcatcgcagcataggtgcccaatgccttacccaaagaacgcggcggaacaagctcacgcaacataatttgcagcaccggagtggtaaatgcattagcgataccaatcgtggcatacgcagccataaacagcccccacgatggtgtaactaggagcaacagcgcaagtggcagtgtgacaatataagccgcctgcaccaccttatgcggatggatctttctggtgatgcgccccgaaaacaacatcatggtggcaaagggcaacaagtatgcggtcatggtcagcgctgcctggctgacactgatatcaaaggtgtctgcaaattccggcaagaccactgatagagcttggccagtaaacggccccacaaagcctccgaccaaaatggccgccatttgcagtttcttcataagttcctaatctatgcctaaaccccctgccagatctttttttggatctggaaacagggggtattcggggttatgcgttttacaggaaacgctttggcacttcgggttcacccagtgacaacatcaggcggttcgcccagttgaagaacgccacagagttgatcaagtccacgatctgcaggtcgctgaatccaacgccacgcagcttggtgatgcatccctggttgaaagcagcaggggtggagctcagtgcgcgagcagcgtcacggatgacattccactggtcagaacccagatcggagtcgatgcttgccaacagtgcgttgacatcatcagctcgaccggattcttcctgagcacgtcctgcgtgcacggatgcgcagtacacgcagccgttgtagcgggaagtaacggtggcgccgagttcacgctctgcacgtcctaggccttcgccgtcagtgttgaagaagatatccagatcggtcagggtacgcgccttcaatgctgcaggatcgcgtgccaagagacggaagtatggcatatcagcgcgctcaggctggatcaaagaatccagctgttcttcggtgagatctgcctttgctactggtggtacccatggcttccagcccaaagagtggttcacaaacgcttcagggcggttgagttcttcataggtggagatctcaaagccgttgttggacagttcccacttcgcttcaggaatactcaggcgaggagctttcacctgaatgtcttcacctttgagggtgcgcaggccgtaggcaacacgcagctggaatgccaggaacgacaccagctgagccaatgtcacggtgtcatccgcgctccagccagcgccggagagtcgaccaaggacctcggggcgggaatcacgggggtggaaaactagtaggtgtgcgtaatcaaatgctgctgcaagtcgctcgccaagcttggcggcatcgttgcgcacagatccgcctggctctgattcggactcaagtccaggttcacggtaggtgccgtatgggcctgcggataggccctcgtcgatggcatcggagacggcgtttgccagggtggttggggcgtcgtcgagaagcaaatcttggtagagatctacagctggcgcgaattggtgcaaacctgcaacataggtggccacggcgtaacgctcgccgaagctgaaggttcctgggttgaccggttcgagcagagcttcgaagctcttttgtgcattgtcgcgagcttggggacggttgtcacgcagctgtgggaggtcttctccaaccagcatgtcgatgagatctgacatttttaagatctgctcctatagtccaagattgagttcgccaccacgatagcgcgatcctgggatcgcgtcgatgagtcggcgagtgaaatcggtttgcgggttgttaaatacttctgcggtttttccaagttccacctggttgccgcgactcatcacagacacagtgtcagagatttcacggaccacagccaggtcgtgggaaataaacacgtaagtcaagcctagctctcgttgcagatcgtcgagcaggcgcaggatttgtgcctgcacagtcacatccaacgcggatacggcttcgtcgaaaaccaccaattcaggttccaaaatcatggcacgagcaatggcgacgcgctggcgctgaccaccagagagctcacgtgggcgacgggtggcaagagccgggtcaagcgccaccagttccaggtagtgtgccaccttttcgtcggcttcctgcttgctcaccttggtgaaattgcgcagaggttccgcgatggtggagccaatggtttggcgaggatccagggaagaatacgggttttggtacaccagctggatttgctggcgcagttcccgctgctgggccttggacaggttggtgatgtccttgccacttactgaaatggaaccagaggtcggcgtattaaacatcgcgatcgcgcggccaagcgtggttttaccagaaccggattcaccgacgatggcatgcgtggtgccaggcagtacttcgaaggaaatatcatttgcggcaacaaatgctccttctttgcctcgttggtgttccttgcggaatttatccactaccagaagcgggcctttggcctgcgctacctccggatctacggccggaactcgcgtggggatctcgccgatggtgagggagggcgcgtcggcaagcaacttcttggaatactcatgctgggggtcggtcaagaccgaagccgcgtaaccactttcgcgcacctcgcctttttgcatgacgacgatgcgatccgcccgatcgcctgccacggctagatcgtgagtaatgaacaaaatacccatgcccaattcacgctgcatgtcttccagcagatcgagaataattttctgcacggtcacatccagcgcagatgtgggctcatcggcaatgatcagctctggttcaagtgcaatggcagcggcaatcaacgcgcgctgcttcatgccaccagacagctcatgcgggtactggtcatagcggacctctgggttatcaatacccacgcgctctagaagctcaatgaccttctttttgcgctcggcggcggttccacgcttgtggatagccaagccctcccccactgaagcgccgatagttttcaccgggttcagagagttgttggggtcctgcggaatcaaaccaattttggtaccgcgaacgtttttccactcacgtgcgttcaagccaacaagggaacggccgttgaaagaaatccgaccagaatccacttcagcattatcagccagcaaaccaatcacggcctgagcggtggtggacttaccagaaccggactcaccaacaatcgcggtgatttggccagggtgcacctccaggctgacattgttgacagcatgcaccaaacctttagcagtttgataggagacaaccagatcgttgatctctaacaagggagtagtcattttctatgcctccttctgaatgatgcggcttaggtagttggcagacataaccacggcgatgatgacaaaaccaggcagcacagtcagccaccatgaggtcgccatgtagtcgcgggcatcagagatcagcagaccccactctggtgttggtgccggagcgccgtagcccaagaagcccaacacggacagctgcaaaatcgcggaaccgaactgcagtgctgcaagagcaaacactggggtcagagagttaggcagaatgtggcggaacaacacctgcgcctgggtgccaccggaaccgtatgcagcttccacgaaatcggaacctgcaacagtcatcacctgggaacgcgccagacgcgcgaaggtggcaacagaggtaataccgactgcgatcgctgcgttcatggtgccgaatcccaaaaggataatgacagtcaagctgagcagcagtgccgggatggacaacagcacatccacgaaacgcattaatacagtgtcaacccaaccgcgctgtgcacctgcgagcagtccgatcagggttcccacgatcagaccaaccagcactgcgatcagtgcaccgagcagggtttccctcgcgccgtaaacaacacgactgtagagatcgcgtcccacggaatcggtaccaaaccagtgggtgccacttggcccaagcagcgccacatcatcgccagtgaacggatcctgggaggtaaacagtccaggaacaagtgccatcagcaccgcaacggcgagtaccacgatggaaataacagcagcaggcctcgtccaaggattgcccaacgctttacgcttgcgtgccgggtcagcggatccagttcgaggattagcggataccggttttttgggtgaaataggaggattactcatgagtcttatgccctttccctgcggcgcagacgggcatcgaggactgggtacaacaaatccacgatgaggttgatcaaaacataaacagcagctgcgatcaccacgatggcaagcatcactggcatatcgcggttggccactgcgttgacggtcatttggccaagtccagcgcggccgaacactgcctcggtgaccacggccccaccgactagttcaccaaacaagatgccggcaatcgtcagggttggcaaaagggcgttgcgaatgatgttgcggaagaagatccacatttcacccgcaccgcgagcacgaacagccgcgatgaacggttgtgccttgacctcttcaatcgagcggatgagcacctgtgcaagcggagcggtaattgggatggacaaggtgatggtcggcaggatcagtccttgtgccggggtggtcccaataacggggacccaaccaaggcggaaggacacgatctggatcaagatgatgcccaaccagaaacttggaagggacacaaagaatggaggcagagcctggaagatgcccttgatccatgcaaagcgatccatggtggcaagaatggaaataaccagtgccaaaatggctgcgagcaagaatgccaaaatagccaaggtcaaggtgcctggtagggcttctgccagctgggttgccacggcagttccggtttgtacggagtaaccgaagttacctacaaggaagccacccaaggtggagaagtactgagcgatcagggattcatcggcaccataggattcacggatctgtgcgatctgctcaggtgacagacccaaatcagggctggaatagcgggcggacacagcatcgccagggagggcggaaagcatgatgaacgccaaggtaaaggtgaccaacaagaccaagacggcttggccgatgcggcgcagaatctgcgaggtagtcatttagtcctcctcactggaatggtcgctggaatggtcaatgtaggtctcatagaagctggggcggccgatcacttcggggctaaagcccttcacgtaaggctgcacgccgtagacaactggctcttcaaacagtggaagaacatatgcctgctcggtgatgtaatcctgtgctgcggcagatgctgctgcacggtcctcttcgcgtgggctggatgcaatagccatgaggagttcctccaaatgaggatcgccaatatcggcggtctccccttccacggtcatgttcaacagctcgttgcggttggtggagtacagctgggatttcagcacgtcatagtctgcgcgacccaccatggtgtggcgaacctggatcttgttgagatccttggagtcagcgtcctgggctgcttggtcacctgggttgaggttgaccttgatgcccagatcaccgagctgttcttggaccatggtgacaacttcgcgtgaacgaggctgtgggagggcttcgttgaaggtgagctctagaagttcaccgtccttgcgacgcatgccgtcgctatcaagggtccagccggcttcgtcaagcagagctgttgctttgtctaggtcgtagacataggcatctacttgttctttgtagcccagtgcattttgcgcaagcacagaagttgccagcggataggaatcactaaacagcacacgcatgatcttttcgcggtcgatcgcgtggatcagagcttggcgaacacggatgtctgagagcagctcgtttttgaagcggaagttgaagctgttgttcacaccgttggtggctgcggagatgatcgggatgcctgcatccttcaggtgtgcctccactggcgcttcgatctggcgggcgatatcaccttggccagcaacgatggctccgatgcggacggattcttcacccgcgaggacataattgacggcgtcaagcttcgcgcgaccttgatgttcgcgtgatggtggtgcccaatcgtaatcctcacgcgcagtcaaggtgaggttggtgcctagggtttcatcggtgatcacgaaaggaccggagccgatgacgttttgggcgttgcctggggcgaaatcctcattggcgaactccaaggtggaatcggcataaaggccagcgttgaaggagctggtggcctgagcaaaaccaggtgcaggctcagagaagtggaatcggacggtgtcctcatctactacttcgccgtggtcgtagttggtgatctgctcagagatggtgaggcgtcgatcttgatcgccgaggccatagagatcgaagtttttcaccacgttttcagccgtcagcggggtgccatcggagtaggtgacatcggtgcggatgttgaaggtaaattccgtggcgtcttcgtttacttctgggagttcggtggcgatccacggcttgagttccaaggtttcaggatcctggtagagcaagcggtctgcaatgttgttcaccacactgccgttggggtaaaagcccgctgatggtgggtacagggtgcggaagaactgtggctctaagtaagtgagcgtgttgtcttctgcttgtgagggttgtgctgtgcagccggacaggactgccaatcctgccagcgtagcggcggccgcggtgaaaaaccggcgggttattgagcgtggtttggtttcgggggagccgagaccgtgtctgtgctttttaaacactaggcttacctccagtgaatctttaagttactttacgtgtcagctaatttatgttccagaacttaacacacttttagactgatcggtatattggttcagaccaacctgtctaattggggtatttattttaatgatcaggagttttcgtgagcacaaccgataagcaggtagccatcgttggagttggccccagaggtatttccatactcgaaaggatcgcagcagctctcaacacagtttcccgccccaaacaaggcttgaccatccacctgattgaggatgcccagatgggtgcaggcaacgtgtggcgcactgatcaaacccgcacgctgtgcatgaatactctggccggtgcggtgacattattcacagagccaggctctacggtgagcgctccagtggtggaaggaccactgcaatttgattggattcgcctgctgcgcggcgatgaggatttgagcggcattcctacaaaagccatcgagctgttccgcacctaccccccagctgcatccgtggcggaggatttcaaggaagagctagcagccactgttatccagtccaatccttcccgtgctctttatggcgcatatctgcggtgggctttcgatgtcgctttgcagctgttgccacagtgggtcaaggtcgagcagcaccatgcgcgcgcgattggcatccgcgaagatggtgaccgcgatgtgatcaccttagataattctgagatgatttccgccgattccactgtgttggctgtcggctggcaaacccccgcccccaatgcggaggagctgtccatcgcggctgctttggaggagaaccctgatctggtgtgggtcaagcccggcaaccctgtcgagcaggatgccagcctcattcccgctggcgaacaggtgcttgtccgcgggctgggcatgggatttttcgatatcatggcgctgaccaccatcgatcgtggcggcatcttccacgaggatcccagcacccgttccggtttgcgctacgaggcatctggtgaggaaccacactttgttatttcctccgggcgcggctacccctacctgcctaaatccgattacaaatcgctgccaccaggggcaaagctagcgcgactcaaggctgttatcgcggcgatcaacgcgcaaaatcgtggtgtcgcatccatcaactatgatgcggaagtgtggccagctgttgctcgcgacgcctacgaagcctattacgaaacccttgatcgcgtaagcccagaatctatccggaccggtctggataaaattgtggaaattattgatgaggtggacgtcgataagcttcctaaagcactcgccgcgcacaccgatgacgtctttgacctgcatgcttgggaatttccgctcgcgggaattaatgaaagcgtcgaggcgctgaccgcacgcatcgcggacggcatggcccgcgatattcgccatgcagtaacggcctgggacagcccgctgaaatccgcgctgtggtccatttccgccgcgcgcaaacccagctccatcctgggcgcggaaggccgcctgaccttcgaatcgcgccgcaaccgcttcgccgccgtcatggcgatcggccagatggtcggctccggcccaccgcttttccgcacccgcgaacttcttgcgcttgtcgacgccggcctcgctcacttcgccggcgcccgcccccgcctcagcgtgagcgacggtcaatggcagatctcctcgcccaccaccggcgatacgccgctgagatcgaaagtgcttgtcgacgcgtggatgcacaacccagatgtgcgtcgcaacgccgacccgctagcactgtctttggaagatgccgaccgggtacgccccttcaacgactattccgtcgacggaaccgctgcccccacaggctcccccgaagttgatccggcaacccgacttttggttcaccccaacggcaacctcgatccgcgcgtgcacctgattggcatcccaacctatgggcagctggccgacaccaccatctcgccgatgcctggaaccaacccgctcatgctgcaagaaaccgacaaaacagccgttcacgtgctaaagcagctcggcttgatctagggtgaggtgagttatttaaagacttcataatattttggggagtgaactggtttggcattgaagggttacaccaactttgacggtgaattcatcgaattcggatctgtgcaagcaaaagaagaggaaaaacgggcattcgacaacgatcgcgcgcacgttttccactcctggtccgcgcaggacaaaatcagccccaaagtatgggcagctgccgaaggttccacgctgtacgacttcgacggcaacgccttcatcgacatgggttcccaacttgtctcggcaaacttaggccacaacaaccctcgattagttgaggcgatccagcgccaagcagcccggttgaccaacatcaacccggccttcggcaatgatgtgcgctctgatgttgctgcaaagatcgtgtcgatggcccgtggcgaattctcccacgtgtttttcaccaacggcggcgccgacgccatcgagcactccatccgcatggctcgcctgcacaccggacgcaacaaaattctgtccgcataccgcagctaccacggcgcaaccggatccgcgatgatgctcaccggcgaacaccgccgcctgggcaaccccaccaccgacccagatatctaccacttctgggcaccattcctgcaccactcctcattctttgccaccacccaagaagaagaatgcgaacgcgcactcaagcacttggaagatgtcatcgcgtttgaaggtgctggcatgatcgcagcgatcgtcctggagccagtggtgggatcatcaggaatcatcctgccaccagcaggttacttaaatggcgtgcgcgaactttgcaacaagcacggcatcctcttcatcgccgacgaagtcatggtcggattcggacgcaccggaaaactgtttgcttacgagcatgctggcgacgatttccagccagacatgatcaccttcgccaagggtgttaacgcaggttacgccccactcggtggcatcgtgatgacccaatcaatccgcgataccttcggatcagaggcatactccggcggactcacctactccggacacccacttgcagtagcacccgccaaggcagcgctggagatttacgcggaaggagagatcattccacgcgtagctcgacttggcgctgaactgatcgaacctcgccttcgtgaactagcggaagaaaacgtagcgatcgctgacgtgcggggcatcggattcttctgggcagtggagttcaatgcagacgccactgccatggctgccggtgctgcagaattcaaggaacgcggcgtgtggccgatgatctccggcaaccgattccacatcgcgccgccgctgaccaccactgatgacgaattggtagcactgctggacgcggtggaagctgcagcccaagctgtcgagctgaccttcgctggggcgttgttctaagttttctagataacaaggccagcacagaccaccatatctacgaccccaaaaaccgactccaagctccgcggcgacgaagccgcgctcgcgccaccgaccaagcagccggtccaggtttaaagattttgcttttcgacgctcccctccacctcattcaatgcggcggaggggatttccttgcatgttaagcctataggaaaaagtgtttgcatatcacccttgtattcgaacacgtgagcgggtagagtgggtggtaacaacacggggaaagggggaagacaccatgagcatcaccacacacgtccaagcactcaccacagcactcaacgccatcgacaaccatttggccagcatgctcgaccatggtgtcaccccagaccaatacaaggccatcgagcccgacctcatcgccctagaacacaccatcaaccaccacgccaccatcgccgcccaaaccacagccctcgccgaacgcaccaacgccgcccacaccattggctccacccacctcatcgactacctcaccaccaccttcggactatccaaagcacgcgcccaccaccgcatcaatctcgcccactccctctaccccataccgaagccaaaccctggatctggcaacggcggtaatggtggcaatcccgacggcggtcctgatggtggcgactcgggtgatgacgactccggcgacgatgaccccgaccccgaaccggacaagcctgaagacggcaaacctgatggtgataagcctcgtgggccacggatcagcgcggaaaaacacgccatcatcaccgacgaactcgcccgcctcaacccgaataccacacccagcgccgaggagctacgcacccaagccctgagtcaagcgatctggcgcaccccagaagacctccgcacgtggctacgccaccacgtcaccaccgccaataaaaacaaccccaaccccatcaccgccatgaaaaggcgctacctcgctgtaggtaaacccgatgccgacaacatggtccgcatcagcggcctcgtgcccgcagccaccgcagcactgatcaccgcgaacaccgcaccgttaaccaaacgcggcaacctcgtggatctacccgcagcagaagatatgcgcacccgcgggcaacgccatgcggacgcgttgcatcacatcatggagatctacaaccacggtattgtcaccccagctcgtggtggaacagccagcatcatcatctccatgaccaccgatgatcttgatgagatcaaccacggtgatcatggcgatggcagtctacttaacaacctgtaccccaccaatacgggttactcattgaacttggcggagatcatgaacctcatcgctgcgaaatacgacttcgctgtgctcctcgatggtgagacggggcagccgttgaacgtcaataggatgcagcgctcagcgaacctgactcaacgcatcgcgttgtttgcttctgagttggtgtgctcggcacccaattgtgacaggccgcagttagagtgcgaggttcatcatttagatccctggatgagaggtgggctgaccaacctggtcaatctcacgcatcagtgctttaatcaccacccacgcaacgatgattccaggagtggggtcaatggtaaagggtttatggaccgcgatcccgttactggcagagtaggtcactactcagcaagtggtgaggggccggtgtttaaccggtcggctgctgctgatcgttccggtggtgcgtgggccagacgtaagcatcatggcccaccaccggaaccgccgagcccgccggatccacctggtcctgagccggatcctggtgatgagggcagattgttctagcccttgttattgctgagttgttgtcatgttgttgtgcctgttgtcagtcgccccagtgtgtctgataccgggcacagccatgcccacaccaacacgtcaccaatcccatacaacaccagaccaccccaaccctgaataaacccctatttttctaaaaagtcacactttgccgtatagaaattcagtcaaccaagagtactctgtccaccatggtttttactcttgcggactccgtctcccaggttgcgctaggtccgtcctggctggaccctatggaacttctttccggctccggcccgttcggtagcttcattcttccggcgatgcttgccattgtctttatcgaatcaggcctacttttcccacttctaccaggtgattctctccttttcaccggtggtctcctagctaaccaggctgacccttttgcaccgctgtggctggtgctgatcctctgccctatcgccgcaattcttggcgatcaggtgggttactggattggccacaagttccaccctcgcctggtcaatcgtccggatggcaggattttcaagcaggaatacctcaagcagactgaggatttctttgagaagcatggccccgtgacgatcattttgtgccgtttcgtgcccatcgtccgtacttacgcacctctggtcgcaggtatggctggcatgcgttaccgcacgttcattatttacaacatgatcggtggcattttgtggggttccggcgtggtggctttgggtgctgcgttgggtcagttcgatttcgtccgcaacaatattgatctgattttcttgctgatcgtgttcatttcggtggttcctggtttggtcggcatggcccgcaagctggctgacggccacaagcaagccaacaccgagccacaagaaaaccccgcagtccagacagccccagtaaaaacccaggaagcccaggaagccccccagaactaatctttccggtccgccagttcgatacgtggtcgtacgtccacgttggtgatctgggtggtttcgccagcgtcaatcacgaatctgattgcgttggcgatttcttttggttcgatgtagatctctgggcggaagttggtgccttgtgagtccatgaggccttgcagcatgggggtgttggtggggccggggctgacagtgctgacgcggatgccgttgttggcttcttctttgcggaaggcgtcggcgagtccgcggagggcgtgtttgctggcggcgtagatggtgttgccggggtgtggtccgttgccggcgccggagttgatgtagatgacgcagccggatgccgcgcggagggcgggcaagagttggcgactcaactcggccgggacaatgacgttgagatcaaggtgtgcgtgccattcggccacactgccggcttcgatggtcgtgtcacgcgccaccgccgcggcgtgcaccagcgtatccacgtggtcgaggttttttagcttgtcgacgcctccctcttccaacacttccttcacgatatcggactcgataggctctactccctcgatctctgcgagagctgccagatgctctggatttcggcccaaggcgtagacaatgtggtcgcgggagaggtctttgacgatctcaattcccatgcctccggtcgctccggtaacgaccgcaatcttcttcttcatgatcaacctttcgtatgaattttctgtataaaacccatgttagatgttttattcagggattttagttgatatgtccagtatctcgctgaaaacgctggttgtcttgtagaaaaaggcgtaacgtcatataacatgcctagcgaaactatgaaaccagccgtagcgtcaactctggcggccacttccacgggacgtcgtcctggacgccccacccaacgtatcctttccgtcgaatccatagtggagcgcactttaaacattgccggccgcgaaggattcgctgccgtgaccatgaaccgcctcgcccgagacatgggtgtcacccctcgcgcactgtataaccatgtgctaaatcgtcaagaaatcattgatcgcgtctgggtgcgcatcatcgatgatatcaaggtgcccgatcttgatccggacaattggcggcaatctattcatacgctgtggagctcattgcgcgaccaattccgtgagactccacgtgttcttctggtcgcgctggatgaacagatctctactcagggcacttccccactgcgaatcgcgggtgcggaggagtccttgaagttcttgactgatatcgggctgtccctcaaggaagcaaccatcatccgggagatgatgatggctgatgtcttcagcttcaccctgacttctgactacacctttgacaatcgtccagagggcgaaaagccggatgtgtttgctccggttcctaagccatggcttgatgagaacccagatgtggaagcgccactgacccgtaaagcagtcgaagagtccgtctcaacttctgacgaactcttcggctacatggtggaggctcgcattgcttatattgaaaagctgcttgccgccaaatagtttctaaaggttattgagggcctgctcgacatctgcgagcaggtcttcaatgtcttcaataccaatggagatgcgcacgaggtcgcggggaacctcgagctgagagccggcagctgactggtgggtcatggttgctgggtgctccaggagggattccacgccaccgagggactcggccagacagatcagtttggtggaggtacagaacttcttagctgcttcttcgccgcctgcgaaacggacggagatcatgccgccgaagcgcttcatctgcttcgctgcgacttcgtggcctgggtggttcttcagacctgggtagagcacggtggagacctctgggcgggagtccaggaattccgcgatcttttctgcgttgtcgcagtggcgatccatgcgcactgcaagggtcttgaggccacgggcggtcaggtatgcatcgaaaactgatgggatcggtccgatgccgccctgcatgaacagcagttcttcgtccatttcctggtcgttggtaaccacaaggccgccaacaacgtcggagtgtcctccgatgtacttggtggtggagtgcaggactgcgtgtgcgccgagttttagtggctgctgcaggtatggggatgcgaaggtgttgtcaacaaccagcttggcgttggtgccttcggtgagctttgctactgcttcgatgtcggtgatgccaagtgctgggttggttggggtttccacccagatcagcttggtgttgtccttgatcgctgccttgacctcttccacgacggaggtatcaacaacggtgtattcgacgccccatgcggtgaatacggtgtcgatcaggcggtaggttccgccgtaagcatcgttgccgaggacgatgtgatcgcccggcttgaggatgatgcggaacaggatgtcggttgcagccatgccggaggagaatgcgcggccatactttgcgccttcgagtgctgcgacggtctgctctaatgccacgatggtggggttgcccacacgggtgtactcgtagcctttgcgcagttcgtttggagcgttctgcgcgaaggtggtggaggcatagattggggtgttaatcgaaccgtagtagtcgtctggctcatacccagcgtgaatcgatgcagtggagaaaccctgggtgtttgggtcaaaagacaaggtagatcaactcctgtaatcagaattctatggccctaaaaggaccggtcttctggcaatgatagaccaagctgtccacttttgtgtaaaactagccccttttaatgcagagcatcgaacgcgaaccaccggctgcgcacagtttccaacgacaccgacatgtcatacagcgcgcccaaattttcaggagtcatcacttctgaaacagtccccgaagccagtatgcgggcgtccttgatcatgaggatatctgtcgtggaggcggcgatctcttcgacgtggtgggtgatcatcactgtcgtcagaccaggaagagcggctcgcaaaccatcaatcacactgagcaaagtttcacgtccgggcaggtcaaggccggtggtgggttcatcaagcagcagtagggtcggtgagataatcagcgcacgagcaatcagggtgcgggctttttcgccctggctcatatcggcccagtaacgatcggcacgcgctgtcatgcccaccaactccaacatcaaagcgcaccgctccaactccgaagccgaagccgaccaccgtggcaacaacccgttggaggcggttaaccccgacagcacaatttcgtgggccggcaggttggtaaatctttgcttcgggtccaccaggccgattgttttccgcagctcacgagtatccacccgaccaaagcgatgccccaggatgtccacggtgccttccgatgggtacagcaaggtggctgcgatcttcagcatggtggttttaccggcgccatttggaccaagtacggcccagtgcgacccttgcggaattgagagggagatatcgtcgagaagcaatttctcgccgcgccgcacggtgacgccggccatgttgagtgctagttcgcgcatgggtaacaccttactggcgtaaggccagggcttagactggtacccatgacaacctcagaaaatttttatgattctgtgggcggcgaggaaacgttttccctcatcgtccaccgtttttatgaacaggtccccaacgacgatattttaggcccgatgtatccgccggatgattttgagggcgccgagcagcgtctaaagatgttcctcagccagtactggggcggcccgaaggattatcaggagcagcgtggacaccctcgtctgcgcatgcgtcacgtcaattaccccatcggcgtcaccgcagcggagcgttggctgcagctcatgtccaatgcactcgacggcgtggatttgaccgcggagcagcgtgaagcgatttgggagcatatggtgcgcgcggccgatatgctgatcaattccaaccccgatccgcacgcttaacttctgccaaaaagtcgttttgaccataagctaagcgattgtgaatcgaattgcagaaatcgcacgcagtttcggcgtgctgggcttcagcgctttcggcggccccaccgcgcacctcggatatttccgcacggaattcgtggagcggcggcgctggctggatgatcgccaatattccgagatcgtagcgctcagccaactacttcccggacctggatcgtcgcaggtcggtatgatgctgggctaccaccgcgccggtttttccggcatggcgatcgcctggctcatgtttacctggccctcattggcgctcatggcggcgttcgccctgctttttgatgcgacctccgccagctggacgctcggcctgctcgccgcagcggtcgccgtcgtcttccacgcagtcaccggcatggcgcgctccatggcctccacgccgcgcgccgccaccatcgcggtcgcctccggcatcgcggtgctcgccctccccaacgcgtttacacacctcggcgtcatcattctcgctggcctcatcggtgccttcagcttcaattcgcttatcgacgccaccccacccccttccccgctacgcgccataccggcttgggcgggcatcggatcactagtggtgtttttgggcgcacttctcggcgccgtaatcatgggcgggttttatccagcattcattcaagccggatccacagtgttcggcggcggccacgtggttttgccactgctggaaaagctcgttgttgcgcccggttttattaaagaaaccgacttcctatccggctactccgcagcgcaggcagtgcctggccccatgttcagcttcgccagctacctcggcgcaatctacggtggcatcggtggtgcagtgctggccagcctggcgatcttcttccccgccgcactcttgagcatcagcggaatgtacttttggggacgctggcgaaaagcaccgcgcatccaagcagcagtcaccggcatcaacgccggtgtggtggggcttttgggcgcagcgctctacgatcccgtattcacccacggcatcaccagcgtttccgcattagctatcgcaacggtgtgttggctggggctagcccactggaaaattccgccgtgggccatcgccgcgggtgcggcccttgcaggctgggtcttgctttagaaaacgctcagacccaaacctgacgagtgataaacactgccatagggagcatcaacgcgggtccaacgaccattcaccgatacccgcaggtgcctcggcacatcattggctgcctcaaaacctgggatcaaaccaagcgaagtgcaggtaaataccgtgcgcatcgggattccggccttcttgccattgccttctgctgaaataacttcctgatccatcaacgaagccggagggccaagcgggccggagaactggcgagccaatgcctgaccctgatcagccaaagtgcgcaccacgtgggtggggagttcgtcgacaagcgtaaagcccgtggctggcggcaatgagcccggccagctggcgtcgcgggaggtgcctacgtcttcccggccctcgctgagtgcctgcagcaaatccttcgcgccaactgcagcgccatcgcgacccgccacaccaaatacccggcgcgacgccgtcacgttgaacggagtggtgacaaaaacatcaacgacctctggcgtgagctggcggaaacgcgcgctcgccaactcatccaaaccaaccgcacgcgcaacaagcgcctgcaggccagccgcacctgaggtgatagaaagagtctcaaccactacttttctagagcttcctgcgactgcacctcatcagtagcgacagcggtcagcaccttgcgctccaccttgctgatggaacggggcgcagcagtctgcacattgacagccacctgcacgcactcaaccacgcagcacacacgaccgttacgatccttgacctcttgacgagtgctgaaggaagtattaccgatcttggtcacctgtgtctccacgacagcctgggtggtatccggcaagatcgcacgcaaataatcaacttccaagtggcgcacaaacacagcagggatctcatagccacgctcacggaactgatcctccgcaaacgccaatcgagcttcctgcgcgatctcaatgaacgccgcgttgttgacgtgcccaaaacgatcgaaatcagcccagcggagatccacctccgtcacgtgaagattattttgggtgtcgtcgttgacattgttggctgccatggggttcgcctagcctctttctttgtagctgtttgcttggccgtctctttgctcacatcttgcaaatcaagcgtctcgcaagcattctaccgatcccacgaagctgagcacatttagtgacaatcacctcaaggttcggcgctccacaagcatcagttctgccagctcatgcggcgcaatttcttcaggccactctggcagttcccggtgcgggctccacgtgatgatccaggattctcgctcccgatcggtggtgccgccgtgcccgccctcatcaaggtgaccatgatcagttgtgatcactaccagccagtcctccccgagctcgtcggagcgtcgtgacacttcagaaagaaccttcttcacgtgggtgtcgaccctgcgaatcgcatctcggtattcgtcgcctgccaggccgaaaatatggccagcatcatcgatttcaccgaagtacacaaatcccgcatcaaaccccttctgccggagcgcagctgtagcgatcgaagcgatttccgcatcgatgcgctcatatcccagggtttcaccatcacgcacgatgacgttatgaagcccagcgaattgctgctccatccgaggatgaataattgggcctaaaccatggggatccgctaatacaggccaacttgctgtggcaatagtacgcgtggattggtcctgataaaaagcccttgccagaaaatccgggtagttccacagacgcttgcccaccagggaattatctgtcacaccatgctcatcaatatcctgtaaggattgatgaccaccccggaccagaaagcgtgggtggctccatcaccatgattcggaacgcaccctgttgtgccgtttcctgcaaaaactcaccaacaccatcttctgcaatgatgtcccaacgaactccatgcaaaccaagcagaagcatcagtaaaaactaaaacccctcacagaacaatctctgtgaggggtttagcgctgcttcgactctagcgagtcagcttgcggtgagtgacacgggaaggacgtgcggcgtcagcaccgaggcgctccaccttgttcttctcgtagtcttcgaagttgccttcgaaccagtaccactggccttccgcgatgttgccttcccacgcgaggatgtgggtacaggtgcggtccaggaaccaacggtcgtgggaaatgaccactgcacagccagggaagttctggagtgcattttccagggagcccagagtttccacgtcgaggtcgtttgtaggctcatcgaggaggatcaggtttccgccctgcttcaaggtcagcgcgaggttgaggcggttgcgctcaccaccggagaggaccttggatggcttctgctgatctgcgcccttgaatccgaaggcggacaggtatgcgcgggatggcatttcgttctgtccgacaatgatgtagtcgagtccgtcggaaacggtttcccaaacggtcttttctggatcaatgttttcacggccctggtccacgtaggacaactggacggtgtcgccgatttcaacgctgcctgcgtctgggttttcaaggccaacgatggtcttgaacagggtggacttacccacaccgttaggtccgatcacgccgacgatgccgttacgaggcaaggtgaaggacaggtccttgatcagcacgcggccatcgaagcccttctccaggtccttgacctccacgaccttgttgcccaggcgtggtggggttgggatctgaatttcttcgaagtcgagcttgcggtacttctcagcttccgcaaccatctcgtcgtaacgctgcagacgagccttgttcttagcctgacgtgccttagcgccggaacgaacccatgcgagttcgtccttcaggcgcttctgcagcttctgatccttcttgccagaaacttcgaggcgctctgccttcttctccaggtaggtggagtagttgccttcgtaagggtgcagctgaccacggtcaacttcacagatccactgtgcaacgtggtcgaggaagtaacggtcgtgtgtgacggcaaggacagcgcccttgtagtcagcgaggtgcttctccagccacaggacggactcggcgtcaaggtggttagtaggctcatcgagcagcagcagatctggctctgcaagcagaagctttgccagtgcgacgcggcgacgctcaccaccggagaggtgggtaactggctcatcgcttggagggcaacgcaatgcatccattgcctggtcgatcttggagtcgatctcccacgcatcagctgcgtcgagagcctcctgcagaacgcccatttcttccatgagctcgtcggtgtagttggttgccatttcttctgcgatggcgtcgaagcgctgcttcttttcgaagatctcaccaagaccttcttcgacgttctggcgaacagtcttttcttcgtttagtggtggctcctgcaacaggatgcccacggttgcacctggatccaggaatgcttcaccgttggaaggctgatccaacccagccatgatcttcaagatcgatgacttaccggcaccgttgggtccgacgacaccgatcttggcgcctgggtagaaggacatgtagacattgtccaagatgaccttgtcaccgattgccttacgcacgttcttcatcgtgtagatgaactcgcccaatgtaacccctttaaatgcgaatttgcgtttaagtactcaacgcacaagattacatgagcagcgccaatttagggacctcgggcaagtgggccttacagcaatcgcagcgaaggatcactcccccgctgcgaccatttagatgtttggcgattaaaaaggcgcttcctcgcctgaatcagagcctgaacctgctcccacaccagccatagctaattcgcgtttttcctcaggagtctcaggagcctcgtcagcttccgaagcctctgtcccctcctccgaagcatccgaagccgccacctgcttcgctccccgcttctgatctacatctggatagtcttccaagtttgcatctggcatctccacgccctcggggctgttggatgcgttgggcttactttccttgaagccaacgatgtagtggttcatgtcaatgccgatggaggttgctcgcatcctgatttcttggcgcttttctagctttttaacattgggatcagcggattccacttcccattcattggtgtacaggaagccttggacgatcacagagacgcctggtttgagggaaatgtgggagttgacgccgagttttccccaggcttcaacgttgatgaagactttgtccacgttgtgccatttttcgccctgcttgtaggagcgggagctggccacgcggattcttaggacgccgtcgaggttgtctttacggccaatatatacggagtcactgacgatgcggccggcgatggttactggtgtgttgatcatttttcttcccttttctgataggtgatgagtgctttcaccacgcagtctggcaccgaacgacaagcgcgtaaaggaagaaaaagcccgcctgtggataagttgtggcctgatcgaaaatgaggcctagttatccacaggggcgggctggaaggggtgcggggagacgtcgaaaagcttattctttgtctttgtctttgtctttgggctcgaaggtttcctggtagtagtcgccgtgcatgtcgtggccctcgttcatgcgtgcgagcatcctgttgtattcctcggcgtcagcgtaaccagtggcttcggcgcgggcctggtagtttttctccacgattctttcctcacggaaccaaccacggaagaggtaaccgaacacgacaatcagcgggaaggaacccgacgcccaggcgatgccgccgccaacgagctggtcgtaggccagatcgacctcccatggcaggttgagtttggtgtagaaatcctccgccaaaatgacctggagctgcatgaggtacacgccgaagaagaggtggaatggcatcgagaaagtcagccacgccagacgcgacacatgcgtgcgttcctccggcttggggtcaggaccgatcatttcccagtaatagacgtaaccggaaatcacgaacacgaagttcatgatcaggtgtccggcgtgctcggacaccatgatgtcatacagcggcgtcaggtagagcgcgtagaaaatgatgatgaactgaatcgtgttcaccgctgggtgcatgatgaatttcagcagcggattatcagtcatcaccgcagcccattcgtgcagcccaggtcggcccggctctccaggcgcaacggcctccatgatcagcgacaacggcgcgcccagcaccaggaacaccggcacgaccatggacaacagcatgtgcgcgaccatgtgcatggagaacgtcgccggcatattcatgccgatgccggaagaaacggtgaccaccagggtgatacagcccagcacccaccagaaggtgcgcatgtggttccacttttttgcttgtcgacgcaaagccacaaggccatacatatagaaggccaataacatgatgccgatggtgcccagcatcaaatcaaaacgccacatggtgaacacgttgagaagagttggttccttctccagggagtagcccatttccaaagccatcactgaaaggtcttgaatctctggtgcaggtggcggggtgcgtcccatggaaatagcaacgccggtgaccgcagccatggcaagaacttccacgatcgcgatgcgagtaaacagcgctgagttctttggatccttctctagcttcgggatggtgaaagtgcggtgggccaaaccgaacatgcccaccacgacaacaccaacagccttagcaaagaccagcaaaccataattagtggtgaacagatctgagaagtccatgcgcagcaacgcattcacgacgccagaaatcgccataccaataactgcgtaggttgcgatgatggaataacgcttcactgccatatccatgttgggaccaatgcggcgagcgtgcgcaatcaacgccatcaggccacccacccacagcagcatcaaaaccaagtgccacaacagggagttcgtgccgtaatcgtggtcgccaccggcagctgagtgaccttccaaaccaagtggaacagtcatgatgatggaacccgcaaacagcaacggctgtgccaaccatgtacgacaaaacagaccagcgataccggtgatgaaggcaaaaccagcaacccacgcccacgccttagccaacgcaacctgctcgaatgcgatcgcccagttctgcaacttcagcgcctcagtaaacggttgccccgacaagtctgacatcaccatcgggatcatcacaatcgccacaaggccaaaacaaatagccgcaaacgaacccgtacgcgccgcgatggaaccatccaccgacaaatacgaacgattcagataactagccttctgaggcccatcttccgcgctgcgcttaatttctcgcggactaataaagaaggtcgtcgccatgaaactacccgctgacaacgcagcaacaatccagcccaccgcacgcaaaaacggcaaaccagcagtagtcatcgggcccggatcagggatgcccaatgcagcaagagattccgacaggaaaccccacgccaaaatgacacccaccaaaccagccacaaacgcaaacaaaacgtagaaaggccaggtgattctcaccttgctgctctttacctgcgatttattcactggagaagaaactccaccagaaccctcggcaacgacctgctcatccatgcccctaatctaacctccccaacacccagaaccatagttgagtgatccatgtgatagccgaacacgggtgtacggtaaagttccaagcgcacgcaataatgtggggcttcacacaattgggtatttcttgtcaattgtgggagtttctatataaagtgtttcgagaagctttctagattgccggtttggcaccagtagtagtttctacgcctccatagctcagtggattagagcaaccggcttctacccggttggtcgcgggttcgaatcctgctgggggcaccgcaatttaaacatgttttatccatgtttcagcagttcagggcactctttcattttgaaggggtgccctttctgctttccataaacatgctgcgagcacattttgagcacacttcatacacactcttggcaaatttcagacactaattagtcggttttttaggaaaataggcgagccgaagattagttgccaagacttcacttaaaagtagccaggaattgacatatagcctctaccttatggattgcccgggtgaaaactcggaaaactctttggttttcatacctttcttgcttgattttcatgaaaagcacattcccagtgaagccctgaagcacactctcgagcccaacataaggaataaaatgtctttcaagcgtcgttcgcttgcaatcacttgcgccatcacctccagcattgttctcgctggaatctccggcaccgctgccgcccagtcctcctacgtttctggatcctcaggactgctgtcctccagcgagctccatcctgaaactccagcacctctggatgctccaaagaacatcatctacatgatcggtgacggcatgggttacaaccatgtctccgcaaccaacctgtttgaaaccggccagaccatgcaccaggtcgaaggcgagccaggttctgtcaccccagttgagggtggcactccagttcaggcatttgaaggcgctgagtggacccagcttgcacagtccaccttccaggatggaaactcctacgaccctgagcgcgcgtgggctgatcacaactatgtcaatgagaacttcaccgactccgctgctgcaggaaccgcaatggcaaccggcgttaagaccaccaacggcatgatcggcatcaacccagccaacgagcctgcgaagaacacctctgagtacgcaattgaaaagggcaaggcagccggcgttgtttcctctgttcctttcaaccacgcaactcctgcggcttgggcagctcacaactccaaccgcaatgatctgcacgcgatggccgaagagatgatcaacagtgatctcaacgtcatcatgggtgctggccacccattcttcgacaacaacggcaacccaatcacagaagccgacgaagactacatgcaggcttcccagtacgagcgcctcgcaagtggcgaaaccgacttcaccttcgtcgaagaggacgcagacttcgaggctctcgcaaacggccaagttgaaagtgacaagtacttcggtctcgcgcaggtcgaagacccccttcagcacgaccgcgatggcgactctgtcactccttacgacgttccactcaacgacgtcgtcgacctttccaccatgtccaaggcagccctcaacgttcttaaccaggacgaagacggattccacatcatgatcgaaggtggcgcaatcgactgggcaggccacgcaaatgacatggctcgcgacattgaagaagtccaagagttcaacaaggccgttgaaactgtcatcgagtgggttgagaccaactcctcttgggatgaaaccctcgtgatcgtcaccgccgaccacgaaaccggctacatgaccggccctaacgatgatccaaactggtccgcaatgaccggcgctgcaggcatcgttccaaaccacggctggcactccggtaaccacatcaaccagctcgtcccagtgttcgctcgtggcgcaggtgtctccgatatcgttgctgctgccgatcaagttgacccaattcgcgggaattacatcgacaacattgagatcgcgaacctgactttcaacaagtggtggtaacccccgcttgaccagccgttttggttaatacagcacggtgagttaaagttatccgtgctgcttaacgcggcaatggtggctgtagttcagctggtagagcaccaggttgtgatcctgggtgtcgcgggttcgagccccgtcagccaccccgaataatccccttacctgcacaaacaggttgggggatttttacattttcagccgcctacgctttaacctacgcttaaggttcggtttttcactgttccgcctcgcccccaaaggccgcagcaacgccgccatggccacgccagcgcccccacgccgctaagcccattctaccgcctgaggcagccctacaacaccctgccacccttccccctgtgcccccttctcccccttggtcccgaaccacaggcatgggagcgagaaagtgacagcaaaaacaaccacacgctttttagaacacgcgttccaataagcacctacaatccctagagcgcgcccttttgtgacctgcaacacaatgctgtaggtgtctctttcttagtttcgtaatttacgaagcaaactacgaaaaaactacgaaacgcctgacctgcggtttcgtaaaattacgaaaatcgaaaaaacaaattacgaaacacacgaaaacgccgtgaccagcatgtttctactacttttcaatagagtttcgtaattttgcgtattttcaccccaactctttttatatagagacacatagacgaatttagtggcgtggctcacagaggcacaaaaccctattttcgttactatgttcgatattttgatgtcacactagttaactgctgtcacattagttaactaccgcaacaccgatgcggtgggtgatccttgcctttcggattacgaatcggaactgatgcaactggcgcggctccccgcaaacatccgcatcggtttcgattcaactcttccgcaaatagccgaccgaatcggtagccgcttctgtttcccctccgaagttaacgccgattcgatgatgacgtggataccactaccctatttctcgttttaggccagctggcgcgcaccgcgttatgcagaggggctatcgggcgtttgcgaattgagttcgggccactgcagcactagctcggcgagatagaccgcgagagccgggccgagcactgcgaggaagaacaggtagcctccccactgcgctgggaaaaagacggggtacaaaacaagcactatgccaggcaatattgccaaaagagtacgcggtaggtgccctaccgccttcatcatggcctgtgtgattctttggcggaagccgagccccggtgcatcgagatggaagaaccatacgctgacagagcccaatacgataagccccgagatcaaggctgcgcgcagtatcaggcccattgaacccagatctgccttggcaatgatagcgaattcatacgcggctaaggcggcgacggcgagggaaatgagccaccatgcggtgttgaccccgggacgcgtcaaaaggccccgaacgaaggccgagccgcggcgagaaccttcctcgcggaccatctggccggtcaccgcgtgggcggtgcgcaaggacattcccccggtgaatacgggaaagcacgttatcaccaagagaacattcacgatgactaggtcagcgaagaggctcagagcagcatagaacttcgattcggggccgagtatgcgattcatggttttatcctatcgcaaccttctaacccttcacggcaccggcagccacaccttcgatgatgtgcctctgcgtggagaagtagaagatgacgatggggatgatggccaagaccagcatggccatcatggcacccgtatcgcggttaccgttggagccaacgaaggattggatgaccaccgggatggtcttgtatcgcgtggacaggccaatgaccaagtatggcagcaggtagtcgttccacacccacatggcattgagaatggccacggtgatggcagttggcttgagcataggccagactacccggaagtagttctggagcggaccacagccgtcgatcatcgcagcttcctcaacatccagaggaatggacttgacgaagcccgcaaacatgaacaccgacagaccggaaccgaaaccgaggtagagcaccacgatgccgatcgggttgttgaggtggagcatgtctgcaatcttgaccgtcgggaacatgaccatctggaaggggatgatcatggagaccacgaagaggtagtacagaaggtttgtccaccaggtcttgacgcgcgtgatgtagtaggcggtcatcgcggagaagaacacgatgacgatgacggagaggatcgtgatgatgaaggaccacaatgtggcctccaagaagccctgcttggtcaagcccaccatgaagttctcgaagccgacccaggtttcaccgatgggaagggagaaaggatcggaggagatggcgaacttggacttaaaggagttgatgaagatgaagaggatcggccccaagaagacgatggtgaagaacgccagaatggcgtagaccacgaacttggcgctgccagacatgtgggtcttattatccgagggaagctggtgatccttcttcttcgaggccggagcggcctgcgctgaagtgctggtagtcataacttaagcctcgatttccttggagcgggtcgcgcgcagctggaagtacgcgatgacgaccacaacgacgacgaagataacggccttggcctgaccgacgccctcgacattcatacggttaaacagcgtgttgatgatgttgagcgccaccatctcagtttgcccgccaggagcgccgttggtcagcgccaggttctggtcgaagagcttaaaggagttcgacaaagtcaaaaagaggcagatggtgatggatggcatgaccatcggaatagtgacgtgccgcagcatctcccacttgttgacgccgtcgagttcggcagcctcaatgagctctggtgggacgttttgcaggccggcgatgtaaatgatcatcatgtagccgatgagctgccagttaagtagcatgatgaggccggcgtagccgaatttccagtccgcgctaatagtcgtggcatagtgcgaaagcacggcgttgatcatggtctgccaggtataacccagcacaatgccgccgataaggttcggcataaagaagactgtgcggaaaaagttggtaccgcggagtttgcgggtcagcaaccacgccaagaggaaggcgaagatgttgactgtgatcacggagacgatgaccacgaggacggtgaaaccgaaggctgagatgaaaccttcgcgttgggagaaagctttgacgtagttgtctatgccaacccacttggcgttggtgatagtggtgaacttcgtaaaggagaggaagaaacccacgatgaacggcaccaagaaggcaatcatgaatgccagaagggtgggcaagacaaagactgggaagtacttcttcagcgttgcttgcatggtggtgaaaccttaatttcaggtggtgccacacgtttcccagcggggaaggcggtgaggagaggaggctgaggatgtggaataactgctcgcgcacaagctcgcgacgcgggccacaaccctcacctactcccctccccgccctccgctattggaaggagtgtggcgagggggacgggaatagagctttagccccagttggattccttctcagcagcccagttgtcattgaagtgcttgacgacgtcctcccacttcagctttccggaggcgtactgcgacagatcctggccgaagtcatccttgaactgctgggacgggaagtactggaagttccacgggtaggtggtcagatccttgttagcgatagcttccgcgacttgctcagaaagggggtcattcggggtgttctcagcggtgtagctttcgaacggtgcgatgaagccaaggtccttcaccacgtgctccttgccagcttcagaggtaaacagccaatccacgaagtccttggtggcctgctggtcgacctcggaggcctcagagttcacgcccaaatagttctcggtaccgacgttgatgccgtgcttttcttcatctggcagacccatgtacatgggcaggaacttgatcttgtcttccttgaccacgttgccagaagtctcggaaatctgggaccatgcccagttaccgttctgaaccatagcggccttgccctgtgcgaactcagccatggaatcagacaccgtcttagacggcgcaagagacttttctacggtggagttctcaaggtagagatcgaaaaggttcttgtactccttgttgtaggagaactcgatctcgttggtgtcctcgactcccttgtcctggtactcctgccagatcggagcgttggccaggtgggtctgccaacgccagtcctcaccggatgtcagcgaggtggaggcgaaggcgccttcgataccgagctcgtccttctttgcctgcatatcctcggcgacttccttgagcttctggtagctcgtgatctcatccgtggacttgatctttgcgccggacgtggcgatgtacttgtcgaagatctcgtcgttgtagatgatgccgaagccctcgacggcgaacggaacgccacgtacctcgccatcctcggtggtcagcggcggaatgtcgtcggtcagctgcttagctacctcggtgtccgacatatctgccatgtagtcctgccaagtgatgaagccggctgggccattgacctggaagagagtcggggcttcgtccttgccaatctcggccttgagggtctgctcataggagccggaggcggcagtaacgaccttgaccttaacgccggtctcttcagtgtaggcctttgcgatttcctggtatgccacgtcctgttcaggcttgaagttcaggaagtaaacatcgccttcctcgtcggtggagccggagcacgcgacgagacttgcggcggcgagcatggaggccatgctgatggatgcgatgcgagtaagacgcttcaagaggtcctcatctttcttgataaaaagcggggtgatgagccgagatggatatccggcccgtattcgattgtgtctgggagacctcccataacgaaggcttcttcccagcgccaccaagtacttcatagcggattgcagtccgactatgaactggttagccttccttccaccttagtgaggtattccacatattcacaagtaatcgggcctaaaacatacaaatacatataaaaacagttgagggaagcagggaggatttttgatcgtaggagccgttggggcacgcgagaggttatgacaagtcttcgtctgaagggtttgtgctgaggaggcgagcctcgtcgcggcgggccggaagcacggattcaagataggatgccgtggcctctgggagggtgacagcccctcccctttcttgggcgaggaaccagcggtggtcgacgatttcgtggaagatttgtgctggctccagcttgtctaacatctccacggggacggcggcgatagtcggttcgtattcattcgtcatccagagatgcgcggcttgggtaagacctacatgcggtccgcattcgacggcctgataggcctggatcgagcccaataggcgttgggcctggtgttcctcgacgctcagcccggttaagctcaatagctctgcacgatagtggcccggatccaccactacagggcgaatgcgcacaacctgccgcgaatcgtccttcgtgaccttgagctcccctacgtcaaagcccagttgattgagccggtcaattctctcagagaggcgccaatattcactggcatcgacggattcctccgcggtgagctccgtccacaattcaagataagagctttcgacaaggcctcctagggcgatgacatcgatggacttatctaggcattcacccgcctgtaggtccatgagttcgccaatgatgttgacgcgggcgatgtcgacgtcgtaaagcctgcgtgattcagagaggttgggctggaactccccggtttcggcatcgacgagataggcggaataggtttcagcatcgcgacgaaagagagtattagacagtgacacatctccccagtagaagttgagcagatgcatccgcaccaacagcacggacagggcgcggatgagcttctccgattccacgaccgtgaggtgccgagaaaagatctcgcgatagggcagggaaaactccaagtgctcggtcaccaaagctgcggtgagctccccgtagtcttcctctgccggatggcgtccggtgatcacggctacggggcgcacactgggggcaccaaggcgctgcagttcacgcagcatcttgtactcgtggtgggcggtacgcgcaccaatttctttgaccgcgacgatgccacggttgatccccacgaaacgcacgatgtgccgggaaatacccctgggcagcgcggcgatgagattatcgggccactgttccaggggtgtaccccagggcagtgtcagcagtgccgacgcgtacgtcgacgaggtgatgctcatggactctttcatggcgaatcactccaccttttctgctgattatggctagaactgccctactcattacgtgcctcggggtagccggtacgcgggcttaagggaggcgcttgccagtcgacgccgagaagttgtgctggccgccctccacgatgcgtgcgtggaaaacactgcccggagcaggcgcggcgttcggagcagcgcggacgacgatttggccggactcggggacatcctcgctggaggatccaaggtcgccctcgcctaccagcttgccgtagaggaaggaatcggaaccgagttcctccacgaagtcgagcttgattgggatggaaagatcggtggactcgccttccggaatgatctccagtgcctccgggcggaaaccaatggtgatgcggccattatcctccggcgtcatggcggcgagggtttccggggaaagcttgatgcgagcgtgaccagaggtagcgtcaccatccttgaccgagaaggtgcccaagttcatggctggggagccgatgaagccggcgacgaagacgttggcggggcggtcataaagctctcggggcgcgccaacctgctgcaggtagccatccttcagcaccgcgatgcggtcacccatggtcaaggcctccgtctggtcgtgggtgacgtaaacggtggtaaccccaagcttgcgctgcagggctgcaatctgggtacgggtctgaacacgcagcttggcatcgaggttagacagcggctcatccatgagaaagacctgcgggttgcgaacaatggcgcggcccatggccacacgctgacgctgaccaccggacagggccttcggcttgcgctccaagaattcggtcaggcccaaagtggcggcggcttcgtcgacgcgcttattgatctcgtcttgggacttgccggcgatcttcagtgcgaagcccatgttctcgcccacggtcatgtgggggtagagagcatagttctggaaaaccatggcgatgtcacggtcacgcggtgcaacgtgggtaacgtccttgtctccgatgaaaatggcaccgtcagtaacgttttccaaaccggccagcatgcgcagcgtggtggatttaccacagccggaagggccgacgaggacgaggaactcgccatcggcgatttccaggttgaatttcttgacggtgggttcctttgctcccgggtagcttagggaagcatctttgaacgttacggttgccattgcagaatctcctccatcggcaggtacgtgccgaacgatccgtagtgtgagaaacagtgaagtgagtcactgtgcgccatctagagtgctgcctatgacattagcactagtttggaccctatgacaaagcccggaagccatgccgtggcttccgggcttagttcttctaattcatgggcgtggatgagacgccgcgggcatcgagttacttcttgaaggtgcctttagctaggttagagacttcggaaacgaagtccggtacagcgttcttggccgtggtggccttagggccaagctccatgtccttgaccgtgcgggaggcgatcttggatacttccgatgtgaaatcgctgatctgctcggagcggtgagccactccccacttggttacttcgagcagggaatccttgacaaaggagccgtccagcttggattcaccaagctcgcgctcggtgaaggtgatcggaacctcgcggacatcgaagccatccttgatggcgcggaaggcaacgtccacctggaagatgtatccggcgttggaaagctcctcaaagtcgaggtgctcaagcagctcacgccggaaagcacggtagccggcagtcatgtcattgatgccggcacccagggcaacagaaatgtacttgttgcccaagcgggacagcagttcgcggttggcaggccagttcactgtctctccacccggtacgtagcgggagccaatgaccagatctgcgcccttttcaatttcctcaagcaagaggtggagctgttctggtgcgtgggagccgtcggcatccatttcgcacagaacatggtaatccttctctaggccccactcgaagccggcgatataagcgccaagaaggccacccttgccttcgcggtgcagcacgtgcaggtgagaatcctcagcagcgagcttgtctgcagcctctccggtgccatccggggcgtgaacctagatattgcagcaccgaagcccaagaagtcaggccgccgcacactcacaaaacccgaatgggatgccgtcattaagcatctgttaacgcgggataccgagccactgttaacccccaccaagcacaagaacatccgacaaagcaccaagaacatccatgcccgcattgtgcggctcactctcctccaagccgtttcagggctgagaattgccgaagccaatcaattgcagtggaagcacatcatcgacggtgacgatggcatgctcattaatgccagcgccgatattgtcaaggggcgaaaaggcaaggaaagagggcggtatatccctatcctgagggccgacgtagcggaatacctgcgtacacaccgcgaggacgacgagcatttcatcgtaggctcaccgacgacgaccgcgaggccctgggacgcgacgaacgcagatgacaaggtgcccgagctataccggcaaattgcagaagctacaggcgtgaagactcttcaagacctccgaagccactcctggcgtgcgacgctgcacggtgtgtacgcggacgtgatggacccagctacacgcgccgccattttcggccacaccgagcaggtagctgaggagtactacaacgaccgccaaaatattgaatcactcatgagacaagtcaagcgcgcctacgcgtaactacgcttaagactacgcgtaaggctcgggattttgcgggaatcacacggaacaccaaggaacataaaacgcccacacactgcatgttccctaccattcccgcatgtgccctaagttcataccgagaccctgggtgtcgcgggttcgagccccgtcagccacccctaataactagcaggtcaggacatgtttttaattaaacgtcctggcctgctttgttgtctgtggccggtttttggccacatttgggccacaactgcggtgcgctccgcgatagccatgaagtcgctgatcatcttgttcgaagcgctcatcattggcctttctgacctgccactgccaagaggtcgttcattcatccagtggcgtcaaaacagcgatcttccagtcatccccagtgcggatgagttggtacatgttccgctcgttcggtgctccgccctgatgattccaagtgacatcagcccagatactatgactggttgctgcgacgacctccacgactgcccgtgtaaccctgactccctcgtactggtcaaaagcaccggcaaagaactcttcggtctggttggcatcggataccgcgatagccagttcaggaaactcgatcagcgcaggcaccgcgtagaaatcagagatagccttcgcatcacgatcgagcagggcacgggtatatccgtcaaaaactctcgggcaatgttgtacgcgctcataaactcaacgttatgcccgcaacgtcaggtcaaaagattcttcgcttatcgacgcccacctccagcgccacgcttgcggtgccctcaagcagcgctattaatataccctcggcgaaactctgccggcggtaccccatatttagcgcgaaacagtcttgttaaatgagcttggctggaaatgccgtggcgcatgccgatagccaaaatggtcaggttctggaggcgaggatcccgaaggtcttcatatactgcctctaatcggaggtgtcggattaattccgctactccgtatgcttcgccttcaaataatcgatgcaacgtacgaaccgcgattctatgcgccccggctacagctgcgaccgtaagttgtgaggatccaaggttctcccgaatatagccataaactgccactctaagtgcttcatctggagcatagggagtggctttttcatagacaaggccagcaagtagatcgatggcagcatggccgagaaattcagaggactccctgctcgcaacgttgtcgaaaatcgatgattcaatcaattgagtcagcactgaccctacatcgggaattggaaaatacttccggaaggcattgttcagagttcggctcggcagggacacttcttcgcgggatacagtcatgacagtgcaatctcactgtccatagaaatgtaactcatatggaatcgcagtatcataaattgcaatctccccgggttgcagtcgcaaatctggctctccatcccgggtgagcaccatggtctcggatttcagtgcacatactttaacagagtgcgtttcaatgcctgtagtgttccggcaattttgaatgtcgttacgttacccaaggctgaattcctgagctcaccttgtacaagatcagtggaagcccagttcacctctcccctgctcaacaatgggcaaacctgtttccttggtacccgaatccttgctccaaaatcacgttacgcggaagtagtcgatgcattcaccgctttcgctggcagcctgcaggttggagtcacgtcctcccctgacactcagatcggaccgatggcgactgcccggcagcgtgagcgcgtggaatcctacatttcccaaggcaaaaatgctggagcccgcatcactgtcggtggcagccgtccacgagatcttgacgccggattcttcgttgagccaacagtgttcgccgatgtagacaatcgcgcagccattgcccaagatgaaatcttcggaccggtgccctctgttgtttcctaccaagacgatgaacacgccatccaactagccaacgattccgaattcggtctcggcggaactgtctggacgagcgatcccgagcgcggcgctgcattggcccgccgagttcacacaggaaccattggcatcaaccgctatatccctgatcccgccgcaccatttggaggtgtgaaaaacagtggccttggcagagaactcggccccgaaggtcttgcttcctaccaagaaacccaaaccatttatctctaatccaaactgcacctatatataaggagtaaaaatgcaaacccttgctgctattgttcgtgccacgaagcaaccttttgagatcaccaccattgatctggatgcaccacgaccagatgaagttcaaatccgtgttattgctgccggagtgcgccacactgacgcaattgttcgtgatcagatttacccaacttttcttcccgcagttttcggccacgaaggcgccggagtagttgtcgccgtgggttctgcagtcacctcggtgaaaccagatgacaaggtagtgctgggattcaactcttgtggccagtgcttgaagtgtttgggcggtaagcctgcgtactgtgagaaattctatgaccgcaacttcgcatgcacccgcgatgccgggcacactactttgtttacccgtgcaacaaaagagcaggcagaggccatcatcgacacccttgatgatgttttctacgatgcggatgcgggtttcctggcatacccagcaactcccccagaggcttcgggagtaagcgtgttggttgtcgcggctggtacctctgatctcccccaagcaaaggaagcactacacactgcctcctacttggggcgctccacctcactgattgttgattttggagtggctggcatccaccgcctgctttcatacgaagaagaactccgcgctgcgggcgtgctcatcgttgccgctggaatggatggtgcgctacccggagttgtcgcaggcttagtgtccgcacctgtcgtcgcactgccaacctccgtgggatacggcgcaggtgctggaggaatcgcaccacttctgaccatgcttaacgcctgcgcgccgggagttggagtggtcaacattgataacggctatggagcaggacacctggctgcgcagattgcggcgaggtaagggtttcgcaggagacgaactcagcgcatcatggaatttgtcattgacaacatgctccgatcaaggtgacacgcacagggcccgtcgactgttggaacccgaacctcaaaccgagagtggagaccggaaggcgtttactgcatcgcatccaccacaagttgcccgaagcttccttaactccactgcggaggtcgtcgtcctcattcttgcggacaggctcttggagaacggacgctcctgccttaatagcccgtgtggaagcggatcgggcgtcctgaacatacggtgtatatgtgcagcagtcgatactgcagcggtagcgccaccaccactcataacaacactgtcatcgatgctgaactcggcatgcatcaacgttccgtaaggacggtcgattcgtcgcaatagaatcccatcgaaggctataccaccaaaagcacaggtccctcagccttgattgtggagaaatcgtctgcccagtccagcgtaaccacaaattagaagcagtcgaccttttggttgttactcggtggtgccttgcggaattcttgccacaacttcccgctctgaaattcccaaggccaccgctgcagaccgaatatcttcaaactcggactgtgcactgattacttgatcatcacgggaaccgattttgatgttgatggtgtgtccgtccacctcgacttgttcgaaacgacggtccaagccttctcgttcgacttcccatgatctgatcccaaaagtcgtggtggctgcaaataatgcggttttcactgcttccacctcggagctatccaccaatgctgacaccctatgtgcaggacggcccttcttcatcaaaattggagtcagccatgcatctactgcgccagcggcaaagaggatctctattactcctggccacagccgtgggtcttgatcatcaacattggcttctaattgcaccagtgtgcgggtatctgggttactcctagaggtgttgaacaaaattgcgcgcactatatttggacggccttctgtatcttttgttcctgcaccaatgccaacttcattgatgatgccacctgggaaagggccatcttgggtggcaaagtgacggatcaacgcaacaccagttggggtggctaattcaccaacaggttcggtgctctccataagagctccggtttgggtgggccagcctttcaccagctctgccacggctggaactggcactggaatatctccgtgagctgccttgatgcgtccgaatcctaaagcaatcggagatgcagcaatcaaacctgggttaagctgcctgatcgcttcgcacacacccacaatgtctgcgatggaatcccaagctcctacctcatggaagtggattttctccggctcgatgccgtggacttttccttcagcgatagcgatgagttcaaaaacgcctaaggcatcctgcttggtttgttcagggatgtcagcattgacaagcagttctttaatggtgcttaagtggcggtgatgatggtgttcatgttgtgcgtccacatgcagcttgatgcctcgttggccttggcgcactacctcttcggtgcgcaagagcacgtcaccggggatgactgcttccacaacctgttggattttttctagttctgcacctgcatcaatgagtgctcccagcaacatatcccctgcaacgccagcggttgcatcgatccacagtcccattattctcgcttcttcaaatcagttaaaaaattcggttcacaaaaggtttatcagtccagcttaaacccatcgcaggggcggaagaattagactcaaggcacatcacattgaaggagcttcttatcttgtctcgatttgctgccaacctgtcattgacttttactgagctagatttcctggatcgttttgatgccgcttcgaagcatgctttcagtgccgtggagtttcagtacccttacgatttcgatgttcaagagattaaacagcgtgctgattccgcaggtctgcccattgaactgttcaatgccccacctggggatacttttggtcttgcggcactggcttcccctgaagactttcaacaatccatcgagcaggccatcacgtacgccacagtgttgaagccaaagaagatgcatgtcatggctggcatcgcggacgtaacctcagaaaccacggcgcgctatgtggagaatattcgctgggctgcgcagcaactagacaagctcgacgttgtcgttgttattgaaccaattaatcactattcggttcccggttatttcctgcacactttagagcaggcgtattggcttatcgacagcattgcccaccccaatgtgaagatcttattcgatactttccaccttcagcagattcatggcaatctcacccgccgcctgcgcgaggttcatggcgcaggtcttttgggacacgtgcaagtggcctcagttcctgatcgacacgaacctggcactggcgaagtcaatgcggcgtatatcttccaactcctaagcgaactgggatatgacggtgtcatcgctggcgaataccaccctgctggtgaaactacagccggtttgggctggttggagctctagatcgtaagtggtgtcgtacccatgacgtaccattaaccacgaacgttttaaagaagccacgaaggagcctgacatggcgttaccactacccagcaagagcgctcgagcacttgttactggggcaagccaaggcattggcctcgccatcgccaaagatttggcgcggtatgggcacaacctcattttggttgctcgccgcgaggatgtcctcaaagagatcgccgcagatctagagaagaagcacggcgtgatcgttgaggtccgcccggtggatttgagtgatgagccagcccgcaaggtgttgatcgatgagatcaagacaagggaaatcaacatcatcattaactctgctggcatcgcaagctttgggccgttcaaggaccaggattggtcttatgagactgcccagttctcacttaatgccacagccgtttttgagctcacccacgcggtgttgggtggcatgattgaccgtggcacgggcgctatttgcaatgtgggatctgcggctggcaatgtgccaatccccaacaacgccacgtatgtgctcaccaaggctggcgtgaacgcgttcaccgaggcaatgcattatgagctgcgcggaactggtgtggcgtgtactttgctcgcaccgggacctgtccgtgaggcggagatccctgagtctgagaagtcgatcgtggacaaggttgtccctgatttcttgtggaccacctatgagtcctgctccgcagagaccttgcgtgcgctgtctaagaatcagcgtcgcgttgttccaggtccgctgtccaaggccatgaattttgtgtcctctgttgctccaaccgctgtgctctcccctgttatgggctgggtttataagaagatgggttagtttttaaaagtgtctgaatctgaaaacaacacaacaccagcagtcgcagctcgcgatgaccgtctggtctgggtcgatctggaaatgactggtctagatttgaagcgccacgtgatcgtggaggttgcggcgttggtcactgacgctaacctcaacgttttgggcgagggcgtggacttggttgttcacgcaactgaagaagagctcgcgcagatggatgattttgtcaccaacatgcacgaatcctctgggctgactgagcagatccgggaatccgcggtcacgttgaaggaagccgaagatgctgtgctcgcattgattgaaaagcactgcgatccagcccatcctgcaccgctagctggtaactccattgccactgaccgcgcgtttatccgcgaacatatgccacgtcttgatgaggccctgcattaccgcatggtggatgtgtcctcggtgaaggaattggcgcgtcgctggtacccacgcgtgtactacaagcagccggagaagggtttggcgcaccgcgcgttggcggacattgtggagtcgattcgggagttggattactaccgtcgctcattttttgttgcagagcctggtcctacctctgagcagtgcgcagatgatgcgcaggcagcggtggaccgttttgcaccctactttgattagagggttttaagcagcctggtgagttcggtgagcatatgcacccgccaccaggcccaatcgtggccgccatgcacgccgcgcacacgaacctcgcggatgtcgccggagagatcttcggcgagctgatgcgacaggcgcagcatttcaccttcgtattttccagcttgcaggtggattgagctccactgctctgctgcagaaagcgcgtcggcaacgttgaagcgccacaggcttggcgattgcgcgattgcgtggccgacttcgccgtcggaaagcgcaagagcccacagggacgccaggccgccgaagcttgcaccggtgacaatggtgtcttcgccgcgcgcggaaacgttgtaggtttcgcggacgtgcgggaggagggcgtcgataagcacatcaacctgcccacctggcacgccgacactatcccagcggcgttcggtgttgacggaatcgatcatgagcaggctgaccggcggcagcaagccgatggcgatggccgcatcgacctgcgcaggcagattcatgctgttgttccagtgttggccatcaaacagcaccagcagcggcgccttgaccggcgcctcatagaaccagaaatgctcgccggcgacggtttcttccacgacttttacgcttgtcgacgccgcaacccagcagtccggcaacgcatcagggccttcaacgagcgaggaatccatgatatgacccatcgcgcgggaatccggacgcccacccgacatcgcggctttgcggatatgcatccgatcgcccgcctcacgccatggcgcaaccccgtcgccagaccaggcgttgacggtgtagctggctcgccaatcggaaggcatacgcaagctgagaatccacagatcagagccctcgaggcgggtcatttcagattcttcaatgcgctcgtgatcaaaaaccccattgatccatagcagcactgcggtagcgccgggacactcaacgatccaggtatacatgcaaacatcggggttgccttccggatcatcgtcaatgatgggattcggcttagccaacgcggacacagccatgtcaccacagcggcgagcggaatgctccccgccttcgcgcaccgcttcactccaggaaatttccatggggctttggatgcgcatgtgacgtttgggggtttgcggtggcacggttggcgacaactccacatgagcggacccattgcggtccacccacgtttttgtctgcctcaacggtggcatctagtttccccttggcctggtcattacatgtatttcgctttaaacgtgcgcaaccggcaggcatactccgcgctttcttgccacgaagacgaccgccggttttaaaaacaggttgttagtctagttcagacgattaatgcaggcaatattaatatctacccactgattttacctgcgacttccgcagttaccacgccgaagtttgatccgcgttccccttgctccattcagaccatggaatgttccagtcccccagtccgtcgtagccactcaaagtctcaccgatggtgtttttcacggtcacaatgtcaccgcgcttcacggcctcctggaaccactgagcattttcggtggatacattgatgcaaccatgtgaggtgttgtagctaccttgcgcacctacagaccacggtgctgcgtgcacgtaaattccagaataggacatctgggtcgcgtacttcaccggagtgcggtagccaccctcctcatatcccagaccgaaggtggtggagtccatgatcatcgactcattgcgatcaccaatgatgtaggtaccgtttggcgttgcccactcagaggtgtcacgaccaaaggataccggcatagtgcgcagcaactcaccgttcttgtacacactcatggtcttggtggcatcatctgccacagcctcaaccttgtcaccaatggtgaagttggtggcgttatcagtttcgccccagacaccgccgccgagatccttgccgtaaatgtcagcctcgaccgtaacttcagtacctggctcccagtactccgctggacgccagcgcaactcactgttgttcaaccagtaaaagccaccctccacctttggtgaagttgtcacagtaatagcatcctgagccgccttgcgatccttcacaggggaaccaaaacggaaaccgatagtctggccaacaccaacgacagaatcagccagcggagaaagcgccacgtttgtggtagctgcaggggttgcagtactaaaagacgcagtagcggtctcgccgttcttatcggttgccttaatggtgtacgtgcggttgtagccaagggtttccgcagtggtccagctacggccatcgtcagaaagctctgactcaacctcatagccttcttcattagtcatggtgaccttgctcagaccgtcacccatcgactttacgatgacagattccgaagggtccacatcctcatcaccatcatcaacagaaatcacaggagcttgagcttcttcagcttcaacttctgtactttgctgcgaggattgctcctgcgcatcgcttcgttcaattgtgcaacccgtaagcgccagtgaaccaattgccagcactgcaagaaaagatcctgctactgctccgcgcctaccacgaaaaacccgcacctgttacgcccttctggcaaaattgccacaacttaaaaagcgccagttctgtaagccccctccgtgcggtgaaaaccaaggcggagaactgctagaaacctaagaaactgacaaaaactaaaacaacacgctactagcgaaaacgatggaaactaaacgaacattccctgagtaatcaaatcgttagaagaacgacaccaatacacaacatttcctcatgtagctattttgatcatcccttgtagatgccggagcgttacgtccagaatgccttttcaatggttttgtgagcaaatcgttatcattagatttggctactacaactccctaattgcgttttcttcgaagtatttgcagtgccagcccccaaagaactgctttgacgtgcagattttactttgaatccatttacctgttatatttttcttcgttgcaaacgaggaacgcacctccactaagcaacaatgcgtcattagctcaattggtagagcatctgactcttaatcagagggttcggggttcgattccctgatgacgcaccaagcaagcatcccatcaaataagcatttgagatcacggtttgcttcttgaccgcctatgagagtatcttaattaggcagaacaacaatgcgtcattagctcaattggcagagcatctgactcttaatcagagggttcggggttcgattccctgatgacgcacagttaaaaagaacaagttacattttctcaagagaatgtaacttgttattttttgtatttcaataaagtagtggatcatgaacagccactggtccggaataacagacccagaaaaactacactcaggtttcgttgacctggtcgatcagcttgcagaccagtcaagagatggaaattgggatgcaatacttcaacttttgggcacacacgccaacctctcccccaatcaatggcggattggaggcacatcctggtttacgccactgcaccaaactgcatggttgggtgcaccagtagaagttgttgatgagctaatcaatcagggcgcctggtgctcactccgaaatgccgacggtgaccgtgcaattgatatcgcacgaagccgtggccattcccacctgctcgatgcacttcacgtgcgtgacctcaatgaaccagaacgcgaaaaattccaagcttgggatcaacatctcgccgatctcatagtgcagagaaccaagagtctcggcccagttaacttccgtccagtgcccaccgaagtgattaccttggaagagctggaaagcctctggtttgggtatcccggcatgtatggcgggttcctcatatccatccacagagaccgactatttattgaaagctggtctcgtgtggttggaggatccgggcaagcacacgtcatcaccaaaggtggatgtgtgcttgtggaagaaggctttgtttaagacccaggtctaagttctgtcggattcaccagtttctaactgctgttgttccgtcacgatttcttcctcttgctctgccaatgctggttctgcgacgggtggctgcggaggagtcaaaaatgatggattatccaggttgaaagtcaacgtcaggaaggtcatgtgggtttcatagcggtcaacgtgcagtagttttgttgaaacggcaacaatttagttacatctatatttttctcacgatatggcactattgggggcactatgaaacccttgatccgcacgaaaattacatgcgtttgagacttttccaagaagacgtcatcacagagtgcagtatttatgaattcctgtggttctttggcatcaaagacgcgctgactcttcgggaacagttcagggtgtggagcacaactggagctcttaagtggctcttcctgttttagagtgcattgatcttatggaccaactgccctgaatggataaggcaccgcagaatgtagtggttcaaattacggaaacctagagcaatcccacgcaaatgctccaaccgtccgttgatcgcttcgaccggaccgttggagacaccaacatcgaaatacgccaacacatcaccaagtcgtttaaacaaactacgacccaactgcgcgagttccttattcggccccttcaacacccgaagctgatcaataatggtccgcattttcttcttcgcttcacgcttattacccatctgataacaatcaataatcgcctgatacgcaagccacgcaagctttaacgccccgtagtctttgtcatacgcccacaactgctccaagctttcttgctgacgaggactcaaccacttgtgcgtggtcaacaaggtcttccggtttttatacaacggatcctggcttaaaccacgacgctggtatttctcccgctggaggcgttgccggcaggcggtgagcttgtcaccagcaagccgcacaacatggaatggatccatcacgcgacgagcagaaggaatgagttctttacttgctgtggcgtagccttggaatccatccatggacacgatccgtatctgattgcggaactgttcaccgcgggagccaagccaggaccgtaaagcatcagcactacgacctgggacgacatctaataaccgggcaggacaccgtgagtcataccgatgcccggtcatatcgacaatcacggtgacaaacccatcaccatgcttagccctattatgtgaccacttatgctcatccaccccaatgacatacactccatcaagatggtgaggatcgttatagaccagctcacggcacatatcgagggctagttggcaggttaaatcccaccctagcccaagtgctttcgcggttgcgtgaacactcatccggtcaatagcaaggcgttgtaaaatccagcgggtgacccggtgggtgacctttttaccgtggtcagcgcagcttagttctgcttggaaatacttttgcttacatgtggggttggtgcagcggtagcgaggtagacggataaacagtttggtgggaaacccgacgatgggtaaatcaatgagcatccggtgggtgtgatgacgaaacaccccaggttgggagcattctgggcaggtggaggtgtagtcgagtgcgtctgcttcgatcagggtgtaatcacctgcatcggaagcgccggtgatggtgagtcctagttccgcagtgcggcagatggtgtcagcgatgatgttgccggtagacttcatgggtagagccttttgttggtgtttggttagcttagatacctaaaccttaaccctgacaaaaggctcgtttattttcgggtctacaccgctagcccaggttctgtgatgtaccccaaaaccggaagggcctcttaagtggctcaaggaagacaagcatccaacaagaacgaaccctgcatcccattcctaaaatagtggatggtgtctatatttttaggtcgggatcagaacagccgcgcttatgaaatcagatgaggcatggatcgctgggtataaggcggcggcgccgtttctattgattgcagcaatcgggattgttgcgtctggggtggcctcaatttttgtgccgtttgatgcggtcgcaactgtatcaatgattggcacagcctggatggctattttcttagggttgggcgcatttaaagccacccaagctgccaaatctgtttaagctgcgaggccttcttcgagtttggtgcgttgtgcttcgaagacagtggcggtttcttctggggtggtttcaagtcctgcgacgatgatgtggtggtttcctaattcttggatcatcatcacggtggagccttgattgtcaggggtgacttcaatgtcgagggtgaatccaacggcgccgtcgggagcatcatcgagtttgccgaaggtgtaggtggtgtcggaagaatcgacgacggggtcttcgcaagcattcgcgatgtctgcgtagaggtccattggtgagatgtcgttgtcttcggcggttgagtacatggcgatgcctacttgtttgtcgccggatgccagtgccctggatgcgctagctacgctgtccagattgacgtcctctacagcttggagggcttttccgcaggagccatcgatatctaaggcaccgttgaccactgtaagattgatgggttggccacttaatgaggtgtcgtttccttcagtggcattgtccaagccggactctgaaccatcaatgagcaggttatgtaatggctctgcttcgagtggggctgctgcaggttcggagctgcaggcacttaaccccaaagctgcaacaatcaaaggcaacataagcttctttttcacggataattctccttagaattgttcagcccataaagctaccggtcacactcgttctttgcagatggtgccgtcggaaaacatgaaatcgggcagtacgtcatctgggtcgaggatgaacacctcaaagcctgcgtcgcggatgcgtttgaggccttctttgatcatgcggatggctacggggtggaagctaagtactcgggtgagatcaagaacaacttcggtgccttcaaagttgtgttccacgatggcgtggaggaagctttcgctggcggagaagttcatggcgccctgcatttggatgaaggtggtgtcgccgtcccgcgtgatggatcgtactgcgtggccggatacctgctcggtggacatgaggtggaggcccatgtcgtcggaaagctgtttgaatatttttacgccgcgcacgctgttgcctttggggttcaggcgtggggaaaatgtggcgatgcccagctgacctggcagaatgccgatgagtccgccggcgactcctgatttcgcggggatgcctacggtggagagccactgccctgcctcgtcgtacatgcctgctgaagccatgacggagagggtgaggcggcagacgcgggcgtcgagaagcttcttgccggtaattgggtgtgtgccgccggcggcgagcgtggcggtcatgactgcgaggtcgcgcgtggttactttgatggcgcattgcagcgtgtagctgaggacggcgtcgtgggcttcgtcttcgatgacgccgtaattgcgcagcatgtgggcgatggagaggttgcggtcggcgccggcgagttcggattcggcaagcacgcggtcgatggtgagttcgcgtccagcaagttcagagaagtagtgtcggattttttccacgcggtcttccacggtggaatcggagccgttgatcagctggttgatggcgatcgcgccggcgttgatcatggggttcatggggcggttttcgccgtcgagggaaagttcgttgaaggcctcaccggagggctccaaggccacggatgcagagacctcatcaaagccgcattcttggagtgcgagtgcgtaggcaaatggcttggaaatactttgcatggtgaattcgatgtcgtcatcgcctgcgctgtagatgtgtccgttaacggtgcacagggctactgccagcgggtttgggtccgcagattttagttccgggatgtaatcggccaactcgccggaggtggtgtcgcggacatcatctaaaatttcgtgcaggtactcgggtatcggcatcgtcaacatagaatcaagactagtgatttcttttgcgctatatactcttgtgcatgacagattctggggctcacagcgactcaaaagccaccatttatgatgtcgcaaaagtcgctggcgtctccccttccactgtgtcgcgggcgttttcgcagcctgggcgagtgagtttttccactgcggagaaaatccgcaacgcgtgtggaaactcaggcttttcagcgccaaaacaccggcctcatcgctatggttgccgccgatgcgtcgaatcccttcttcttggaaattttccggggcgcgcagcacgccgcaagcactcagggctatacggttgcgcttgtcgacgcccgggagtcggcgattaagtccagggaggtgctggacaagatcgtcccccacgccgatggcttattgctcgctgcttcaaggatggattctggtgagatccacaaagtcgcgcgggaaattcccactgtattaatgagccgtgaagtgcaaggtattcccagcgtgatggtggataactacgacggtgcgccgaaggctgtggtgcatttggtggatcaggggtgccgctccattacctatatcgccggtcctaataaatcctgggctgatgccacgcgctggcacaggctcgctggcggctgccgttgagggtggcgtcgacaagcgctatttcaatttctcgaagcgtgacggtgcagccgggccgaatgaggcatttgatcaagccaaagatgaagacgatttcggtggattcgccggattttgtgggcgggcggcgtgcgtttgaggcgtggtcgaaggatcggaccgatgcggtgatttgtttcaacgacatggtggcgcttggtttcatacaacaggcgaggctttctggggtacgtgtgccgcatgatgttgcagttgtcggttttgataatacggagaattcggtgctcagtaccccgtctctgaccacggttgcggggccgcttcgggcagtgggtcgagtggcgacagcgaacctgattgccctgttaaaaggcatgaaagcacctctgatggcgaagccccgcgaactgcccacgcgtctcattgttcgggaatcttcactgaaaacagcggtggatttgaaacgcagctcgtagtaaaagcgccctggttgcaacaattggcaacaagtagatatcgctgagtgtgacgggcgatcatgaagtcatgactacttcacatgcatcacaccccgatcggttgctgccagctgatcctggtacccgtgacatcgcccgtcgcctactcgcgcacgttgaagatttacccatcatctcccctcacggacacttggaagcttccatgtttgtcaaggatgaggctttccctgatccaactagcttgctgatcagccctgaccactacctcacccgcatgatgcactccgctggcgttgacctggcagatctgcgtgttggcggacatgagggtaagagtgctcgtgaggcatggcgcattttcatgtcccactgggatctctacgcaggaaccgcaactggctactgggtggagcaggaatttgagcacgttttcggcatcaacgcggagcgcctgaatgttggcaccccagaacatgctgacgccatctttgatgagctgaccgatattcttgccaagccagatttccgaccacgcgcactggctgagcagttcaacttggaagttctagccaccaccgacgatccgctcgatgacctggcagatcacaaggcactggcagatgatccaaccttctcccctcgtgtgctccctaccttccgcccagacgcatacaccaagatgtacaacgctggttgggcagaaaaaaccaccaagcttatcgataccgcaggtgacggcaaggcaggctgggagggttacctccaggcaatgcgcaaccgccgccagtacttcatcaatcacggtgcaacctccgcggaccacggtctccacgacaccgacaccaccccactgagccacaaagatgcccagaagatcttggacaagggtctcgctggcacagcaaccttggctgaaatgcatgccttcgaagccaacaccacctaccgtttcgcggaaatgtcccaagaagacggcctggtcatgaccatccacccaggtgtgtaccgcaaccactccgcatccgcgcagaagaagttcggggctgacatcggagcggacatcccattccagatggaattcaccaacggtctgcgcccactgctcagcgatttcggtgagaacaaagatctcatctctgacagcagtttcaaccgctggctgcgtacggtttccctcggatcgacccaggatgccgatatggctgcagcttccaacttggcagccaattctaaaatggcccgccagaacacccgcgatatcctcgacgcagtctctgatggtggcgtcatgctcggccgaaacggtgccctagtgttgggacctgtggttggaactctccacattaaattcattgcgcctttgaacaagcgtgtggaaagagtcatgtacaaaactggactctcagaagctgctgcagctgagcaatgtgctttggaggatcgtctccgcgaagagatggcccacgctttgtatcaatggaatccgggacgcgatgaaaactatgacctcgtgatcaacaccggttcgatgacatacgaacaaatcgttgatctagttgtggaaacttacgccaggaagtatccgctccacgtgagaatcattccgaacggaaaagaccaataaacatacagtccccgtgatgtgaccatacacaccacggggactgtggcgtaggtcttacaaaattccccaaaaagagttatgatagtaccaataagtttttgtggcagcctcctgcattcggcagtcgagacgccaccaaagaaaggataagacatgtcagcagccgaaggcttacatattgtcgtcatgggcgtttctggctgcggcaaatcctccgtcggtaaagccctagcagcggagctcggaatcgaatacaaagacggcgacgaacttcacccccaggaaaacatcgacaagatggcctccggccaggcacttgacgacgacgaccgtgcatggtggctagtccaggttggcaagtggctccgcgaccgaccaagcggcgtcatcgcatgctccgccctcaagcgctcctaccgcgatctcctgcgcaccaaatgcccaggaaccgtcttcgtccacctccacggcgactacgatctcctactttcccgcatgaaggcccgcgaagatcacttcatgccatccaccttgctagattcccaatttgcaaccctcgagccgctcgaagatgacgaagatggcaaggttttcgacgttgcccacaccatcagcgaactggccgcccaatctgcagagtgggttcgcaacaaataaacccctaacccatattagaacaaggatttgtgcgctttttcctgttctggtgtggcttttcctcacatctaacaatcgaataactgttcgaataaaaggttgaaggtgtcccacccccacggcacaatggatggcaagaacacatgaatccagggggatactcatgaccactgacatctacttcagccacaacaacccacacgacccatacgcccaccacaccaccgaactcaaccgcgacacccaccacctctgggtcaccctcaccaccgactccaacgacttcgacgcagactccttcaccaccgaagtcatccggatcaccggctactcccgccacgaagtcaacaacggccttaacgccatggctgcgatgaccaacctcccacacctacgcgccatccaagaacgctactacttcctgagcatccgctacctcgcctccatcatgatcgccgtggccaaagcagaccccaccctgtgggaagaactcgacctgcgcatcaccgacgccttaacaccagtcaccgcaggggaagtcatgatccaatcctccaccctgtccaaacgcatcgccgcctggatcaaagaactcgaccccgaacccacaccagagcccacaccgaaagaggactatgttcacgtccacaccactgatgaggcgacctatgtccgcatcaaaatcagcggccccaaccgcctgatcctcaatgacatcatcacccaactcaaagacacagacaccgaggacagcctgcctgaagcgctcatggcgttcctgacagagaaaatccagttaaagatcaccaaatacctcttcaccccacataagcaccctgagcaggtgtggtcaccggactacggtgacattgatcccgaagcctatgccaacgccaccctcgtgtgcgccaaggacttagatgagctcgctggagccacggagaagagctacaccccgagtgagaagatgaaagccctgatcagagctcgggatgggcattgccgcttcccagggtgttgcgttccggcgagtaagtgccaggtcgatcacattatcccgtgggcggagggcggcccgacagcggcgtggaacctgcagttgttgtgccagcggcatcacaatatgaaaaccgatggtcgctttactgctgatgctaatggattggcggagattagatggattgggccgatggatgtaccagcggtgaccaggccgacgggtccgttggtgaaagcgatgccgcgggggatttggggtcaggtgttgagggatcggatccaggctaggtttgagcggatccgcgaccgcgccctcaacaaagaagactagaagcgcacaggtttttgcatggctagactttgaatgagtaagcaccaacacatttcaaaggaagggtttcaccatggcacgcgcactcattctggttgatgttcaaaaagacttctgccccggtggcagcctagccaccgaacgaggcgatgaagtggcgggaaaaatcggtgcctatcagctgtcccacggctcagagtacgacgtcgttgtggcgacccaagattggcacatcgatccaggcgagcacttttcagaaaccccagactttaaaaactcctggccaatccactgcgtcgcggattccgatggtgccgccatgcatgaccgcatcaacaccgattcaatcgatgagttcttccgcaaaggccattacaccgcggcgtattccgggttcgagggaactgcagtcagtgaagaactcctcatgtctccatggctgaagaacaagggagtcactgatgtagacatcgtagggatcgctacggatcactgcgttcgagccacagcacttgatgctctcaaggagggcttcaacgtctccattttgacgtcgatgtgttctgcggtggatttccatgcgggagaccacgctttggaggaactacatgaagccggggcgattctgatttaaagaaaccttaaaccacgaaacgccccgtcgaaaagcaatttaacgctcggagagcaggcgctggatttccttcagatcgtttgccttcttacggccacgcacaacgctgaatacaacagcaccgacgacgacagcagcgacgcccaggagcaccttctgtacgtttgattcctgcagcttcgcggttgcctggttcttggcgtcatcgaccaagttggaaggcttgctgcggtctgccagctcgtcgagggtggaagccaactgacggcgggtgcgctcaatatcgcgctggatgtcttcaatgttgcgtgccactgcgctactcctgattggtgtatctgtgatcaactaaaaaatttaacgcgtcatgaaaacccgttactgggagtccatattactgaacacttgcgcgcgaggtgcaccagtccccgaattcaccccatatgcaaggtatctacatcgaagagcaccggctattgtggagtgcatgactgaagtgaagcgccttgacgttggagataccccacccgcattttcattgcctaatgattcgggttcgaccacctcacttagtgatttcgccggaaagcaagttctggtgtacttctaccccaaagccaacaccccaggttgcaccaaggaagcatgcgatttccgtgattctttgagcaacctcaacgatctcgacattgctgttgttggcatttccccggatccggtggacaagctggtgaagttccgtgaggaccatgagctgaacttccctcttctttccgatgaggacaagtctgtgatgactgcgtggggtgcgtttggtgagaagaagaattacggcaagattgttcagggtgtaattcgttccacattcctcatcaatgctgacggaactgttggcatggcgaagtacaatgttcgtgcaactggtcacgtggagcgcatcgtccgcgaaatcaccgcggcgtaatagcaccagcttaaaaaccttatgacatcagacaaagacactgaacaattggaagcggcaggcactgaaattttaatgcctcgccgccgtccggcacagcagcgcagtcgtgaacgattcaatcgaatcctcaccgctgcgcgttcagtgcttgtcgatctaggttttgaatcgttcacgtttgatgaagtcgctaagcgtgcagaggtaccgatcggcacgctgtaccaattctttgccaataagtatgtattgatctgcgaattggatcgtgtggataccgcagaagctgtcgcggagttgaagaaattctccgatcaggttcctgcgttgcagtggccggatatccttgatgaattcattgagcacttggctaggctctggcgcgatgatccgtctcggcgggccgtgtggcatgccatccagtccacgccggcaactcgtgcgacagctgcggcgacggaaaaagagatgctggaaatcatcgcggaagttatgcgcccgcttgcccgcggtgccggctacgaggagcgcatgtcactggcgggattgctggtgcacacggtaagttccctgcttaactatgccgtgcgtgatgtcaatagttccgaagaggatttcgacagcatcgtggaagaaatcaaacgaatgctgatttcttacctcttctccgtggctactggatagtcaacacgcacgtcgccaccgcgtagtcgccgtcgtggctgatgctcaagctgctggaaaactccccgatggattcccggaccactgcggccaattcgggcgccaattcgatcgcgacgcgcccccacgcgtctgcgcgaacttcgatgtcccgccacaccacggcttcttcggcgatcacgggtggctggccataaatggcctgtgaccaggccttaataaaggattcttttgccgcccaccgccccgccaaatgctcggcgtagcggcttgcctggcgttcatttgctttacgacgctcccctgcggaaaacacctccatgaaggaacttcccggctgtgcaagctgctctgcgaacgccgaaatgtgaacgaggtcggttccaatgctgatcatgcgacctagcttagcgggctggcctctttacaaagaagcccacgatcagtgcaaacactgccacgcacgctgaggcgaagaatgcagagttggcgccgtcggcgagggcggtttgttgggttgcgccgtcgataagcgcgttgttgctgacggtggaataaaccgcaatcatgaccgcggtgcctgcggcgccggcgagctgttggagggtgttgaggatcgcggagccgtggccgtacatgttgtcggggacggatgcgagcgcgactgtcatcagtggggtgaacagcagcgcaaggccgatggagaacacgatgtgtacgccgatgatgaaccacacgttggcgaactcatcgacggtggacagtgcaaacagggagatcacaacgagtgacataccgccgatcacgagtccgcgtggaccatgacgatcataaattcgacccacaaatggcgacagcacaccttccaaaagaccacctggcaacagcactagacccgcgaccaaggcggtgaccatcaaggatccctgcaggtagagcggcagtgtattcatgacaccgagcagcgcaccgaacagcgtcaaaagcacaaccagcggaatggtgtactcacgaatcgccaacggacgcagatccaacagcgccttatcctgcttacccatggcaatctggcgccacacaaacaccaccaacgcaatgatgccgacagccaacacgaccaaagcgcttctgtcaccttccaaaatgatgccaatcgagctcaaggcgtacacaaggccaccgaaagccactgcggaaatcaggaaggaaataacatccaaaggagtctttttaggctcactgacgttggtcagacgcagggtaccgatcaggcttgccacaaacaccaacggaaccatgacccagaaaatcgcgtgccacgaagacaagctgagtacgaaaccagccacactaggtccaagagcaggaccaacggccatcacgaccgcaatcaaacccatgacggcgccacggcgctctggaggaacaacggtcatcgcgacagtcatcagcagcggcatgatcacagcggtaccaatcgcctgagcgacgcgggctgcaagcataatcgcaaaagtaggagacaacgcagccgtcacagtaccgatcaggaagaccaccgtggcgaaaataaacacactacgagtggtaaaacgttccaacatccaaccagtagctggaagaaccacagccatggtcaacataaaaccagtgagcaaccactgcgcagtattcgcctcaatgtcaaagtccgccatgatcgacggcaacgcgactgccagagtagtctcattcaacatcatgacaaaggctgtaaaaactaatacagccaagatgatgacaacatttctcgggatcccaacctgctccgttgtgggattgctggaggaagacaaggctccagctcctttctcgaatcaaagggcgctatcgcgaggtaaatgcataccgccccagttcctgcatcgtgcagaaaacggggcggatacttgcttaggaaacattatcaacaattagtgcatgcacacattcttgtgtgtgatttcactggcaatagtgtttgtgaggttttgtgggcttagcaaagccctgaatgctcgcatgactgaggcaccccaagatgagctgcttgaatttggtaattttgagaagtgacctcaactaacaagcagatgcgaaaagcagtcattttcctacttttcctgcttggattagttatcggattttttcttcgctatagtctggtcccactcgaatcagttcttgaacagaaattgttgtggcttttaggattcttcatccaccaggcaatcttgttcagcgttgtagttggcacagctatagttctgtaccgttatcgtcgggggcattatgctatccgtgctctgggatggggaatttgggcagggttcctgatttctaacctcttttttatggcgttgattctagctgtggctttaggtggacttactccctgataaaaagaaaatgtaattagtccccggaagcacgattctttctgctcacacgggaattgcgcacgctagtttaaaactcctgacacctgatccaatgagatagctctgctacccgggttgtgagttggggatactcgacctgcagtcatacctagcagcgcagcttgggtgagagcggaaatagcggatcgaactttgggctctaagtcttgttgggcttgcactagatagcgacgctgttgagcaatttgaattgcagtgtccagttcggggtgggaatctgtaggaaccgaccaagagatggtcagtgagctttccgcaccttcggggagatcttcagctagagcaatggcttcccggccgttgcgatcaaggttggcgaaggttgtcgcccacgtggatacgccttcgagattggtgacggtggcgagccagtcctcgctttcacgagagacatcgacgttgtatttcatcgcaaccatccttttcccaatactggttccatccgtttttctatctggatcaaggtgccggtgggaatgtcacctcgttacgaatagcactccatcgttggttagcttcttagtaacttcactgaccctcatagaatattgtatgaccaggtgaagagcccaaaacctgacttggctcattttggccttcagaaattcctattgacacaccgaccagcatggttttgatgtcgagccagaagttttccgcactaagtgggaaatggtgggggtaaggagtgacaaactatgcaaacacacccagaatgaaggaaattattccgcaaaggcccttttctcgcttatagaagtcaagagtcggggtcaatagttcgatctggctcgtgtctgtgctgcgaattatctgcccatctaatcaatcgctatgagttcaggatgttgatcgatgaatctcttctcttcagcactaatttgagccaactcatatttcgaaccaagattgctaatgccgaccccgtatttggccttaaatgaacactttccggcgccgatactgcaatatcaaaccaagatctccattctccaaccgcggtttggcctcaatatgcagccccgccaaatctggccgaaaattcccattgggacgcccagaaagtgccctctcagaatcgcgtttaagagcctgtgacccactaatccatacaaatacccattctgcgatcccaactgtttaaaccgcagtgtaatgactttgctctttttgttttgtggaagatcacattggtaagtgtgtttgggctgctaaatcgtaggttttccgcactaagttaccctcggtgtgaaggacatcgtttcgtcaagacctttgtctcatctgtagacgtggaggattggggtcgttgactcgccttcggcactaatttgagccaagtcaggcaaaaagcccctcacacggcatcccaacaagggacaccgcatgaggggctcaacgcaataaccaactagccttcggcgcggaggacaccgtcaactaggcgggcgcgggaatccaggaggactgcagcttcaacttccttagctgcgtctccgtggacaccgaggttgcgctcgactgggcgttcgtacagtacgccaccgtgcataccggcgacgatggtacgaaggcctgcttcttcgcgagcgatcgcggatgcgcgccatacgtcagctgcctcagcaccacgtgccacacgaactgcctcatagaaggcgtctgggtgaacaatcgcaaccagagcggagacgtgtccgaagccaagggaggtaacaagacctgcctttggtgccttcgcacgaaggtctagtggcttgcgcagccagacgaggtgggaatgcttggacagtactgggtcaacgcagtcgagtgcgcggttggctggcaccagtccggatcggaggacctgggtgagaccgatcatctggaatgctgctgcaccacccttggcgtgtccggtgagtgacttctgggaaatcacgtacatcgggttgccgtctgcacgaccgatagcggatgcgatgcgctcgtgcaggtcggactcgtttggatcattcgcgttggtggaggtgtcgtgcttggagataatggagatctcatcagcagagacaccgacggaacgcagtgctactgcaaggcgagattccacaccatcgcgagcagcaccaagggcaccgaggcctggggctgggatggaggtgtgggcaccatctgcaaaggactctgcgaatccgatgacaccgagtactggaaggcccaggtcagctgcgagtgatccgcgtgccagaaggacggttccgccaccttcggattcgatgaatccaccgcggcggcggtcgttggcgcgggagaagaagcggtgctcaattcccttgccttccatctctgcggagtcggcggttgctgccatgtcgccgaagccggtgatgccttcaacggacagggcatcgaagccacctgcgacaacgaagtcggacttgccgatgcggatcttgtccagtgcttcttccacagaaacagctgcggttgcacaagctgcgactgggtggatcatctgtccgtagccaccgacgtaggactgcatgacgtgagctgcaacaacgttgggcagtgcttcctgcagaacgtcgttggcgcgtggctctgccagaatgcggtcgacgtagatgccacggagggattccatgccgcccatgccggtgccttgggtagaggacacgcgtgctgggtgaacggaagcaagcagctctgctggggtgaatccagcggacaggaaggcgtcgacagtacagacaatgttccacagcgcgacggtgtccaggttgtccaccatgtcagctggaatgccccacacagctgggtcgaagtccttaggaacctgtccaccaacgaagcgggtcatcgccatgcggcgaggtacgcggattgcggagcctgccttgcgagtgaccttccactcccctgctgcttcgtcgaaagaagcaaaggtgagttctggctcggagtcgacgtaggtcagtgcctcttcgcgggatcccacgttgaaggtgaggtcctggtcgaggtagacggtggtcagctctggtgcaaagttgtcgatcatgccgtactcaggcatgtcattgtacttgcggacaccaacgcgtgccatgacttcgtcgtggtagcggtcgaagatgtcttcttcggccactgcgtcgtcggagtcgtcgtaccagcctggctttggatcttcatcccagtggataagtcccatcgtccatgcaagttcgatgacacccgcggcggagagggaaccgttgagttcggcgtcgaaacgcgtacgtgcagaacccagtgggccgagctcgccggcgccaacgatgacgaccatctcgtcaaggttttgggtgacttgacctgcgaaatcaggggtggtttgaaccactggtcggtaaggagttggcagtgctgccactgtgcgtggagcctcaaccactggtgcgttagctgccttagctgcttctgcacgtgccatttccgccaggttcagatcagattcaccaagtccgccagtgaagtcgacggtgattggcgcggatgctgcctgctcgcgaacagtggaagttgcctgggacagcagtttctctgcaatttcttgggtggagtaggtttccacgcctgcttcttcagctgccttgaccaaaggatcgttgccgcccatgaggccggtgccgcgaacccaaccgatgtgagcgtgcacgagggaggtgtgtgctccccatgcagcttgctctgcgttccaacgggtaaccacggcgtcgagagctgccttggattcaccgtatgcaccatcgccaccgaagcgtccacggtttggtgaacctgggatgaccacgtgcaggcggtgacccacgttgatggaggagcccaatggcgcaagacctgcgatgaggcgctcaacagaccagagcagaagtcgcatctgggattctgcctgtgggcctgcatctgccatggatccggacacgcgaggtgccgcgaatgggaacagcaaggtagggaccaaagctggcttgaccagcttggatgcgccgttgacggtggtggtctgctcggatccgacccagttgatgatggcgtcgatgtctgagtaggagctcaagttagccgccacgatccacagtgctgccgtgccgcgtgcggaacgtgcgtagagatccttgtagaactccaggcggtcatggccgaggttggaggtcgtagcaatgacagttgcaccgccagcaagaagcttttcgacgactgccgccgcgatcgagttcggcgatccgccggttacgaccgcaacatcgtcggcgtagtccaaggagctttggtcgcgagcctgagctgcgagatcatcaagtccaaagaattcagcctgtgctgcaacagcttcgcctgcgcctgtgacatcgatatcagttgctgcgagttcgccaagagcaacgcgggagagatcctcacgcgcagaagcccaacggtcatcaagcagaacaaccttttcttcatcgaagcttggtgcaacctgacgtggccaatcagaaccgagttccttggagaccaactcgtagaggtcttcctctgcggtgtcttccacggaaacggttgctggcttatcaagacccaactgggtcaagatggtgcgggctgcctgagcaagcacaccatcgtgtccggtgacctgctctgcaaactcgccaagagctgcggaatcaaccacgccaccggcagcgccgcctgctgaaggcagggagaccgcaacgccgcggcgggaggctacggcctggacggctgcgtcgataagcgaatcaagatctgatgcagacgctgggcttgcaggagacagtgacgccaggtcgccgccgcgcagggatgcgccttcgcgggcgccgatcacaacttcagcgaccacgtggtcagcccagccctggcccaattcccacgtgccggtgacgcgctctgcgatgtatcccgggcgcttaccggtaggaccagtgaggcgacgcagggcatcagctgcagcatcggagagcacagggccaaacgccttgtagcccttagccatcttggacacggtgacctttagatcaccgagctcagcatcggctgctccgtcaattgcgccgaggccgaactccacaccaagatccagcaggagctggttacggcgagaggacacgccctcaaccagggtctcgatggaatcagtggcacccatctgatctgggcgaaccttggtccagatagcgatgagcatttcagtggcatcagaaggagtgaagctgatgtcatctgggcgagggccgccggtggcaggggctgcagctgcaacaggggctggggttgctggggttgctggggtttcagtggtttctgcaggagctgctggggtctcttcaaccgccacttcacgcacaacctcatcggtagcgaacacaactgggcgatcgcgctcaatgtttaacacctcaatggtggcgtccgcgtactgaggaaggcgcagggtctggcccatcatgttggcaagcgttggagcagagccaacaccgacctccacgaaacgctcagcttgaaggcccttgatcaacagatcctgagtctcgatccagcgcacaggtgatgcgaactgccatgcaagcagctcaataagcaacgtgcgggcaagcttctgcttatcggcggaagcagccttgaaatcagccaagatctcattgacataggtggactccaccacttctgccatggatgccacgaactcttcagtgagttcgaatgggcgagccaccaagtttggaatgtagcggccaaccagcacatccagatccagctcagctgggatcagggaatcaaggtgctcacggaacgcgcccacaccgtcgcgcagcttggaggagtggaatggcacgtcaatgccagggatcaaaatgaaggcacgctgacctggtgcacggttctcaacatcggcacgaagggcggcaagaccagcctgggttccagcaactgcgtactgcaggccagccaagttgtagttaacgatctccaggaattcaccggaagcttcggaaacagacgcaacgtaatcgaaaacgttgtctgcggtcagacccatcttgttggggcgaagagctgcgagcgcgtagttggacagaccgttttcatcgcgatccaccaagcggtgcatggtcaagccacgacggtaaacgatctccagaacggattccagggacagcacaccagcatatgcagcaagcgcgttgtactcaccaacggagtgtccagcaaagtatgcacgctggttcaaggcatgtgcttcacgcatttcagcgatctgagcaacgcccagagttgccatgcccacctgggtgaactgggtgaggtacaaaacgccgtctgggtggaagaacttctcccctgccacggttacttcgcgtgggttgttttccacgatttccacgatggagaagcccagcttattgcgggtgtgtgcatcggcgcggtcccagatagcgcgagctgcctgagagttacggcgtgcttccatacccatgccctgggactgaatgccctggcctgggaatgcgtagaaagtagatggagctgccacaacagcggtggcggtaagcactaagttgccgttgacggttgcggtaacggtgcggacctctcccattcctgggcggttgtccactgcggagcgctcaacgctgaactcaatttcttcacctggaagaactggtgccagcatggttgcggtgtattccacgaccttggctgcgggagtttggatctgctcatcgttgaatgctgcaccggcgatcagttcaccgatggcagaggtccacatgccgtgcacgatcacacctggcagaccagccagggaagccgcaacatcagagacgtgaattgggttgcggtcaccggagatcacagcgaatgggcgcatggattcaggtgcaacaacggttgccactgcgcgagctgagcgtggggtgtccacggtggttggcagtgcggaggtgttggtgcgtgcgacagcgttgcccttgcgtccgcggatcgcgaaacgctcagccaacgtagcaatcaggttgccttctgcgtcggcgatttctgcgcgcacgatcacgaggcgacccaggtcggtatcgactacctcatcggcagtcgcggaaaccttcagcgcgccgtcggttgggacatcggacttgagcacaatgtggtgctccaggtgaaccagggacagcatgccttccacaacggatgcggaatcggtgcctgggatgactgcggactttacggcagcgaaaactgctggccatgcgcggccaaccagcacgtcaggtgcggtgtgtgcaggaacaacggatgctggcaggtagcctgcggtgacgttgttgtagtcagcgatgacgccggcatcgacggaggtttcccaggtagcggtgccattgttcacagttgccagggtgccgccagctgcgatgcgggtcagttcacccatcgcggcttcagcgtcttcctgggtgaccagtgggacagcgcttggcagagcgtcgatggggctggtgaaacggattttcagctcagcggtggtgccgaatgcggtggaacccgccaaaggcacagtcagcatcgcgtgctcggcgtcttcgtacaccaagttggcgccggttgggctatggaatgcttcgaattcggagcgggaccacttgtcagcatgcccaaggctgtggatcaccgatgggatgttgcggccagcccagaatgtgccaggtgaggaaagcactttgcccatgatgtcgcgggagcgggaatcgtgctcatcgatgcgctcgatggtggcgtcgacaaagcgatcaagcaggtcagcgacaggttcgttggccttggtgatgccagcaacggcgacgacaccagggataatagccacctgatcagcggtgtagcgatcatcgtgggactgccacagggagtccgagcgccaccagcgacgcacgtccttatcaatgacgggcacaaagttcacaggcttgcccggcgtgcggcacaggcccaagaaccaggcgacatcagccggggtgagcaggtcggttgcggcatgcgggtaagcagcaacaagcttgtcgacgccatcctccaccgtcaggcttggctcaaattggccatgatcctgctcgatcaaacgcgcctcggcacgctccagcatctgggcaaaacgtgcagcccaggaagcatcaatccactgaccatcaacagggccagacagctcgaggtagcggttgagccactgctcgtaagtcatggatccgatgtcaccgaagtacaccttggcggtcttgccaatcgcttcaatgatctcatcccggcgcgcctgcacagccgtctcatcgcctgcaacctcatcaagaaggcgtccagccttagcaaaggagttgtcgatctcgtggatgtctgcgccaagctgggaacggccagatgccattccgttctttgcgccaccagcaggaacccattcatcagagccctgggtggaaacaagaagttccttgacggcctgggaggtggttgcttccttggttgccatcgcagcggtacccaccaagatgccatcaacaggcatagctggcaggccgtaggaagtggaccaggaaccggtgacgtaatcagcagcgcgctcaggtgagccaatgccaccgccgacacacagcaccacgttatccagtgcgcggaccttgccgtaggtggcgatcagcagctcatcgaggtcttcccaagagtggtgtccacctgcaacgccaccctcaatctgaatgatgatggggagttctggaacttccttagcgatagccaacacagagttaacctgcttgatggcacctggcttgaatgcgatccaagggaaaccatcacgcatcagttccttgaccaatgcaacagcttcatccttttcaggaatgccggcggtgatgacgatgccgtcgatggatgcaccattagcgcgggccttaggaacaaggcgcttgccaccaatctgcatcttccacaggtatggatccaagaacatggagttgaactgggcgttgatacctggctcaagcatgtcggtgagctgtgcgatgtgggtttccagcagctctggggtaacctgtccgccaccagcgagctcagcccagtgtccaccgtttgcagcggctgcaacaatggcagggtcaacggtggttggggtcatgccagccagcatcattggggtgcggccggtcagctcagtgaacttggtaaccaggcgtggggttccatcaacgtgctcaacgcgtggtgcgaactcctggtaatccactggaagttcaggtgccatgccagcatcaaatatcttggcctggcctgcggcgtcaccaacatagaaggaatccgcgccgcggccctcaaggatgttggcagtcagcttaacgatgccaccatctggtccaacgtcgaggaaccagcgagcgccagcctcatacgcttcgttgacgcgtgctacccaatcgacagggttaaccaaaacatcagcggcgatctcgcgggtgagttccacatccaaaccagcagtggttgcccacgccacggtctgctccacagccatgttcatagctgggtgatggaaagcagcctgcaccttcagcggagtaatacgggggctgaacgcggaaccgccgcgcagcttatcttcaatggccttcttatccttggcagccattgcctcaatgaccttaacaacgcgagcgttgtcgtctgggcggccaaccaaaacataagaatcgcgtgagttgcgcagaccgataaccgggcggatctccgcagggacttcggcgcaggccgcgtcgatagcttgctgaagctgttcgcgggaaattccggcgatcgacagcatcggcatgttgtcgccctgcgcgatcaggcccgtcatgcgtgcggtgcgggtgatcgctgcaccgatcaactgcgcaatggcaacgagttcatcagcacgagtcgcatcattgagcaggtgcacgcccaatacgccctgggaatgaccaatgctggacacagcctgatccacatcaaggcgctgcgcctcaagggaatccagggttgcgatctgggagacaaagatacccggcacgctcactgcagattgtgcagtatcgaaagctggatcttcggagttgttagcccaagccactggatcgaaaccaaatggaagggtgccaatgagatcatctgcaactagtgcaagcagcgcatttgcgcgctcgacgatgtcactaacattggtgcctgcacctgcggcaaccgcggcacgaagggtcttcaaccagtcatatccttggccggcgaaagcgaaggcaaaaggctcctggccaaagcggttaatcagtcggctggccccgaagttcctgctcaattcggtcacgtgagaactcgctccttgtataacttagccgggatgaacgcagggcgtggatcctgacctgaagtttcggttaatactcttttgtaaagaaaatggcacgcctgtaaaccaccagggtgacattggatagaaaacaatatgccacaaatcatgaggaaaacgtcatcttttgcgggcgtggcattttccgctcctcttatcgtgccatttaacctcttccaaacaaaactttcatggacgaaaaggtccttccaacaagtgagggaaacctgcaggtaatcactaacccaggaggtctgttaacaagtttcgcgcagcctctagctcgtcggaattgttgtggccttgttcaccttccatttgcttgagggaaattctcacaccctccacaggtaggaacacttggcacgcatgatccggtataacctcagcttcagcaacaatgccccgatcttccatccaggcatcgaaatcgcgcgaaatactcatgccttcaaagtgtagccagttgcccctcaaatgagattcctaattgagatataggacaacaaagatgatcactttcgttttgcaccatatatataggtgcaattttctacagctcccggccaaagacttccagcacccacgacacttcaatgaccgtggatgtatcctccaaatagcagcccgttaactcctcaaaccggcgcaaccgatagcgaagcgtattcacatgcacaggaatactgcgcgcagcagcaggaatattcatctggttgtccacatatgcccgcaaagattccacgatctcatgagcaaactcgccagattcccttagtggcttcacatatttctgcgcaagaatctccgtcacccgtgggcttgcatggatagccaacttccatgacaaatcttgtgcccgctgcacctcattaagtttcagattatcggcagccttcaatacaagggatgcatccttatatgagtccgccagctttgagagcacctctgccctacccaaacccacagcaaaaccagggccgtccacgtttcgcttcggctccccaatcacgatccccacgatcacgcttggctgcaccgatgccagcacccgcactccggcgcgctgagtccacttctggatctgtgtttcagctttcgcatgatcaggtgaggtggctgccaatgctcttagaggagtgtcggcgggaacgtcatacatcgcagcaccccataaaagctctgacagttcagagccttccgagaccgctttgccgatccattctgaccttcgcaccgaatcggcgatcgccgtggcgacctcgtgatcgcggtacacccttgtggcacgcgtagaaaaggcatcattgaccgcccacatcagtgtggaccagcgcagcattctgccgggatcaatattgtattccgggcccaactgcaccaaatgctccagaatttcccccagagacatccgaaaaccgtgcagcacacttcccagcggcacattttgcgctatacgttcgtcggcaagccttaaagcctcaggcaagtcctcggcctttggctcggtgcccgcgttaatcacgcgaataatcaaggccgtattgcgtatcgacgactccctgatcggccccgcgtcaacgagctcatagcccgggatcgtagcgagcaactttgcggcggtgccctccgcaatatccggcgcatcggcatccaaacgtgcgagcaattcttgccaccgttcggcatgcacatccgctaccgaaccatccgacgtgacggaactaacattctccatggaatcccaggttagcggggatcattgcaccatgcgacacccctagcacggcgtgtttggtagcacgaaaacttgtacaggggtggggttaccccctaaggtggtcacaacttgataacggactggttaataaatggccaatctgaccattttaacctccataaaaaggattctcatgctaaacatcgcacgcaaccgcaacatgaagcgtcgactagcaattgctgctttcgtcgccaccgcaaccgctaccgccaccatggcaccagcatccgcgcaaaccgactacgcaggcctttcctccggcgttgccgacaccgtcgcagaagctgcaggagtcgcaaccaccgccgtcgcaccagccgccaccgtagcgcgcccagcaaacggcaccttcacctcaggattcggaccacgttggggaaccttccacaacggcatcgacatcgcaaactcaatcggcaccccaatctacgccgtcatggccggcactgtcatcagctctggcccagcatccggctatggacagtggatccgcatccagcacgacgacggatccatctccatctacggacacatggaatacctctacgtctccgtcggcgaacgcgtcgcagcaggccaggaaatcgcaggaatgggcagccaaggattctccaccggctcccacctccacttcgagatccacccagacggcgtcaccccagtcgacccacaggcatggctcgcaaaccacggcatctacgtttaagcgctagccgttcgtgggatacgggtgaaataaaagaaactgcaggtcatcttagttgatgacctgcagtttctgtttgtgcgcctggagagacttgaactctcacgtcctaggacactggaacctaaatccagcgcgtctgccaattccgccacaagcgcttaatgcgggttttactatacatggtgtagtcccaaattaactaatgcgggtgaccaactgcaccgtaaaaaaaattcgcttatcgtaaatcagcaggtagaataacactctatgagcgagccagggccatccggggttaaagaaaagaagaaagtaaaggcaagtcacattgtctttcttctcatttgttttatcgcagcctgcgcgttggcgtggtggcagtggtcaagattccagtccgggtctggaactttccaaaaccttggctatgccttccagtggcctcttatcggagcattctttgtttatgcctaccgcaagtatttgcagtatgagaatgagtccattgagttagaaaacatggaagccaaaatgatggcggagcaaggcaaaacaccagttgcgcaatcagagcaggaagatagcttcgttcagctctctcaccgtccgagcctggtggaagatgacagcgtcaaggaaatcgacgaatccttcctgccgtctcgcccgacgatggatgtggaagagttcaacaggttgaatgatccgcatgcacggagacgtcgaaaagcataaacctggaacttttccgggcccgcgcccgactgctttgctgaagccctatcccgctattttatttttgaaggaagagttgcgtgtctaccaccaccccaatccaccctgagcgcaagaaacgcgttcgtcaggccctcaccatgttctccatcgctgcgtgggtgactggtgtgtttttgctggcgctggtggcggagatgatcatgaagtacataattggcatggatcttcctgagtgggcacgattcgttccgattgcacatggatgggtttacattgttttcttgatgaccaccctgaacctgggtctgaaggcgcgttggaatccgactcgttgggtgaccaccgctatcgcaggtgtggttccgctgctgtcgttttttgttgagcacaaccgccgcaaggaagttactcagacattccagctgaactcatagttaaatacacaaaaacctccccgtccgatcactgcgtgtgatctggcggggaggttttagttttccttaaggccttagctagccgcagctacctgtgcgatcttctcaaccaatccgcgcagcgcttgacctcggtgggacaaagcgtccttttcctctgcggaaagttcagcggagctgcgtccttgtccatcgatttcctctgctggaatgaacagtggatcgtatccgaaaccgttttcgcccttaggtccgcgtaggagttggccttcccaacggccttcctgaacaaattcttggccgtccggaagtgcaagcacgcatacggacacgaaggctgcgttgcggcgctcgtcgggaacatgttccatttgggcaagaagcagctcgttgttggcggtgtcgttgccgtgtgcgccggaccagcgtgcggacaaaacgccgggcattccgttgagttcttcgacagcgatgccggaatcatcggcgatcgtggcgatgcctgtgtgggttaccccggcgcgcgctttgatctgtgcgttgtcggcaaaagtgcggccgtcttcgatcggctcgtcgtatgcctcgacatcacgcagcgcaagcaattcaacggaatccaggcctgcttgatccaaaatccgctggagttctttgagtttctttgcgttgttggatgcaagaagaagtttcatccggtgtccttaactctgttgtggttttagattcccagtgcagctttttgggcagcaaccaattcgcggcagcccttttcagcgtggtcaagcatgtcgttgagctgcgcgcgggtgaaggtagtttcttcgccggtgccctgaatttccacgaattcaccgtgttcggtcataacaacgttgaggtcaacatcggcgcgggaatcttcttcatatggcaagtcaaggcatacattaccgtcgaccagaccaacggaaacagcagcaactggtgcaagaagtgggctgcctggaacaaccccgcgctcctgcagaaccttgatggcatcagccagcgccacatacgcaccggtgatcgatgcagtacgagtaccgccgtcagcttgcagaacatcgcagtcaatcgcaatggtgttctcacccagctgggaaagatccacagctgcacgcaaagaacgaccaatcagacgagaaatttcatgagtgcgtcccttgaccttgccggccatggattcacgacggttacgctccgcagtcgcagcaggaagcatcgcgtactctgcggtcaaccagccttcacctgaatcacgcttgaaacgaggcacacccaattccacagaagcggtgcacatgacacgagtattgccgaattctacaagcacgctgcctgcagggttggaagtaaatccacgggtgattttgacggcacgcatctgatcctgtgcgcggccatcaaaacgagaaaagctggaagaagaagtcatgaaatacagggtaccttccagcccaacacccccgcgcaccaagatgcttttcgacgcccacctccaccagttcagcccaaagcccacgcgctaggggccgaaactaacaatgcattggaggagctagctgctcaacaaacctccaaaccactgggcaaacagtgcggaaagcccaccaaaaatgcggctgaacaccttgaagaattaatccagaactgaaccaagagtcgatccagtagctaccggagtctcagggtcttctgggacaacaggaatctccccagcaattgtcagagtggaccagcccagaacattcgctgaacctgtcttgccagcctcatacactgccaactgattctcgccaccataaccagaacgaacagtgatagttaccgtgtcatcagcccccacagtcattcgatcaaagctgaatgtcgttgggaacaacaccacatctacatcttcgccggctggtagaccaccgatggtgatttcctgaccagcttctgcctccgatggaactacgagactgccttggtttccggcattgagatcacttgcctgtggagcaattggctgttcaccagacctggaccattagtgaaatcaacattaaagctcataggcgccttcttaggatcacctgcgccatctgaggaataccagtaggaaggcaagttggtatcaaagtggaaatcaaggaagccctgcggccacgctccccaacctgcaccggaagtaacctgagaggtggcatccagtgggacatcaacaatcactccgtcataatcaggattgcttgtcacaacaccttcaggatcaaggttcactcccccaaacgttgtgatcgtgacatcctcatacaagtcagtcaacggggttttctcattcgggttcgacatctccactgcatagctagtgaggtcaccagtcaaaacaccagtaccagctacagaaacctcgaggtgcggattcgtgatggtaaacggcaccaaaccatcgtagaagttgatgctgaaagaaccctcccaatcaacggtcgctgatccatcagggttaatgtttgcttgtccaccgccgaactcaacgaactgatccacagttgcatcactaatgtgcgccgccttagatgcgtagtcaggctcagtattggtagtgccatcactgtggatggtgctgttgcaaagttgggccagggtcgaaaagcccaacctcaagacattagttgtccttgctccggggtgcttaagctgtctcgaatatccggctgacgatcaccgcgtctgggttcgggtgcccgtgaggtcaaacatcgtgccctggcctttccgtaatgaatgcatcgcttccatccctttcaacgtccggtaggcggaaattcggtttttgaacgctcccttcggccccaggattcttttaagtcggccatgatctccctcgataacgttgttgaggtatttcacctgccggtgctccaccgtctgagggcagattccctccgccttcagctcggatattgccttggccagagctggtgccttgtcggtgttgatgacccgcggggacccggctgtcgtattcgatcgcagcgtcttggccaggaaacgcttggccgcagccacattccgttttggtgagagataaaactccagggtctgcccacccgcggtaatagcccggtagagatagcaccacgtgccgccgacccggatataggtctcatccacccgccaggaactggcctgccagtcaggaacctgccggtaccagcgagtctgcttatccagctcaggggcgtatttctggacccagcggtagatggtggtgtgatcgactggcacaccacgttcagtcatcatctcttcgagatcttaggtcagctcaccccgtagcggcagtaccaccgcaccgcccacaggatggatctcgcgagggaaatgccgaccggagaagatgcccatggctctgattatttcacgccggtctttctactgccccaactttgcaacaacaccctgctgggtgcccgtgctttccggcactggaacctcaccgccacctgatcccggatcagacgttcgcggtgtcactgtcgcggtcctcgtccgtctcatcgtccaggatgccgcgggcacgctcgacggcaggcagggaatgatcggcagcggccgtcaccaggtcctcgaccatggtgcgcagcagcctcggaatcatcgcagaatccgccccgtagagatggatctcacggatcacctcatagagcatgtccgcgatacgttgcggctggtgcaccacacggacccgaccgtcgtcatcggcgatgtaggggctgggctcgatgacggtgaccaaatagcggaagatccggtggatctcctggacacactgggccgccgtggccggatcattgatgcccggggacaacgcacgatcggcaatgtcgaccagttgacgcagtccgaacgccacatcctggtgaagttcccgctcggtccgcacctcgatggccgagtgcagaacgcgtcggtcccggtcgctgagttccccgtcccaccagacccgcagcagcggctggccctcgacgaggaagtcccccaccggccggtcgaccgtgatcaccgcctggtgttccgtcgaccaggacaccagcttccggtagtcgatccacaccagcgaaccatggctgcccacccggatttcttcccgggggtcaccgggccgcggtgaccagcccggcccctggactgggcctgcgtcgtcgctctgcacgggatagatacgtgcggccagagccatcgtctcctccccgatctcggagatggcgttggccacccgcatcgagaaggtgatgagccggatgaacgccaggaacagtcccagacacccgagcaccagcaggaaggcaaccgacactgaagcacgggggacgaatccggtgatgtcctcgtcctcgctccacacgtaccggatgaccgtcagggagaacacgaacgtccccaggaacatcgccagggtggcctgcacgatgcggttgcgcagaaagccgttgagcattcgcgggctgaactggctgctcaccagctgcagaacaacgagagtgatggagaagatgagaccggtcactgagatcgtggaggcggcgatggtgcccagcacctcgcgggcggcatcaggcccaccctcaaaaacgaatttgagcgcggcgtcggacaacccacgttcccacgtgggaagcaggaaaccgaaaaccagggccgcgaccacgctggcagccggtatcgcccagaagggccgccacagccggtcccaccgcgtctcccggggaacgtccgggatcgaaccgcggatgcggaaactctcggaggtaccagtagtaccgtggtcgtttttcttcaccacaccattatggcattgacgacggttctcagtgcgcactcagccgacttgttccacccgccttcacaacagaaaacggctgttgtggcgacgtcggggcagtaggatcctcggcgtgaaataattaaggccatgagtctcttctcgggtcgtcatttccctcgcgagatccatcctgtgggcggtgcacaggtcactgccgctacgggctcagctgacctaagatctcgaggaaatgatgacttcagcgcggagtgccggtcgatcacaccaccatctaccgctgggtccagaaatacgcccctgagctggataagcagactcgctggtaccggcaggttcctgactggcaggccagttcctggcgggtggatgagacctatatccgggtcggcggcacgtggtgctatctctaccgggctattaccgcgggtgggcagaccctggagttttatctctcaccaaaacggaatgtggctgcggccaagcgtttcctggccaagacgctgcgatcgaatacgacagccgggtccccgcgggtcatcaacaccgacaaggcaccagctctggccaaggcaatatccgagctgaaggcggagggaatctgccctcagacggtggagcaccggcaggtgaaatacctcaacaacgttatcgagggagatcatggccgactcaaaagaatcctggggccgaagggagcgttcaaaaaccgaatttccgcctaccggacgttgaaagggatggaggcgatgcattcattgcggaaagggtcagggaacgatgtttgacctcacgggcacccgaacccagacgcggtgatcgtcagccggatattcgagacagcttaagcaccccggagcaaggacaactaatgtcttgaggttgggcttttcgaccctggcccaactttgcaacagcaccctgtggatgatgcgtacatccctatcagttgactcgtaggtcaatgcagatccatcagacacaccagcggataggtagttggagtcaccaaatagtggtcgtgattgtacttcctcactaataccccaacgcagtacaacatcatcaatgctcagaccatcatcagggatctcggttgcagaacgcaccgtgagaacagcttccctcgacatcgtggggccagaagcattagtagcaacggcacataaccttgctccagactgatcaactgccgtatcagtcacggttaaggaggtgagtccatctgccgtagtgacctggaagttgttgtcggtgttaatcctgatccagactccattgttgcggtattcccagtagacattttcagcttcgagcgggtcccgacacctggcaaaacctttgtttaacctgtcagtagtacttaacgctcctcccaaattaccctcgggtttagacacaaaaatagccccttccggggctaaataatccatctaccaggtatttagaagtgctcgtaatttcaacagctccaactaagcgaattaccgcaattacagaatcaccaaagctaccttattagtacaaacggactaaaactcgataaccattcctgatcgtgccaattcgataggaccatcaaagtgttccgcagctgctgccactgtggcctctgcatcaatccatggtggaacatgagtgataatcagtttctttacgccagctgctgccgcaattcttccggcgtcttggccacacatatgcattcctggtgctttgtcatcgcaagaggtgccccaagttgcctcgcacaagaaaatgtcaacgttgcgggcggcgtcgataagcgcttcggtgtacgcgctgtcaccggaatacgtaattgaggcgccggtgcggtgctcctctacgcgaagcgcgtaggtctcaatggggtgcacaacgcggaacggcgtgaccgtgaaattatcaatgagctctggcttgcgctcttcccaggcgtcgaaagcaaaagtatctgacatatcgtcaacgccatcaggctcatcggagctcaaacgaccaagcctgttgggggtatcttcaggtccaaacaaaagattgcggctcttggcggccagcgttgggtggaacctgcgccacaccatcaaggacgcaaaatcagcgcagtgatcggtgtgcaaatgggagaaaataacatgcgcatcagcaggatcttgaatttcttgaactgctgcaaggacacctgggcccatgtccataatcacggcaggggcgtccggagaagttaacagatatccggatgcggggttacctggagcgggcacgctaccagagcttccaaggatggtcagtctcataaggatactgtgccatgcaattgaagttcgcgtgaacttttaggccaaaatgtgaatttctaactaccccttccctttcagaggtagaacacacacctggggttatccctcgttttgtctcacttgggaaacaattggtccaaggaatcggcggcttaattgcgcaaagatttccggatcgcctgttgattcaaagctataacttggctcaggatgcatgtccggatcggctaaaagatcttgctggctcaaaattctcagcacgtctttcgcagtttcttccgcgctagagaccaaacttacgtggtcccccattgccaactgaatgacaccggaaagcagtggatagtgggtgcatccaagcacgagggtgtccaccccttctgcttgcaaaggctctaaataatcctgcgcaatgttgaggatctgcctgccgctggtaattccgcgttccacgaaatccacaaaccgtgggcatgccactgcgttgaccacaatggaggggcttgcagagaaaagatcctggtacgcaccggagttaatggttcccactgtgccgatcacgcccactttgccattgcgggtggatgccaccgcacgccttactgcgggaagaataacttccacgactggcacactgtatcgttcacgggcatctcggagaaacgcagcggacgcagtgttgcaggcaatgacaatcatcttgcatccgcgttccaccaactcatcggcaatgcggatggcgtgctcacggaccttagcgataggcaacggaccataagggccattggcagtatcaccgatataaataactgattcatgtggcaattgatcgatgattgtgcgagctacggttaatccgccaactccagaatcaaaaattccaatcggcgcatcagcacctggcacggggcgttcaatcatagatccactgaaatcagtcacggttgccatcataagccacctcgcgttgcttccctttttatccgtccaagatgtgtcacaatatggcaatggctgattcacccgatcaagaaaccagacgattcgctgcggtgcgagcaacctcggagaccattggctctcctacagctgtggcatccgcgaaacgttcacccaaaggcagtctcattgggttgatcttgatcttggtggccatcatcgtgattgcgtttgtcttgttgttcaacagcctcgttgcaccaaataattcctcgagccctgtggcaagtccaagcacctctgaatctgtggagcaaactatttcggaatcccctgagtcaccgagcgcgacagaggatcagcccccaagcagtgcaacggaaactccccgaaaccgccctgcgcaaccatcacttcctgcgggagcatcaccagccaatgatgctgctgccacccagaccgatgccggcaatttaaacaatgtgtacaccgggtcagcgtccacctcagcaggttttgctcaagccgtccgagatgcttttgtaaaccactatttagacaccaatgaactatccggcagggtgacagccaccagccctgtcactggcggaaactacaccatgaactgcgaagacaacggcgagtacgtcacctgcacaggtggcaacaacgccgttgtctacatttcttaaaacttctaactacacccggggcagcctgttggacatatcgagtcggttcacaatcttcttcattgcggtgcccattaccttgagttcttctggagtgagatcgtcaaacaccaaacgacgcacttccttcacatgaccaggggctgttgctttaactttctcccacccagagtccgtgagcacagcaacggtggcgcgaccatcatcaggatcgggaacacgcttcacccagccagccttttctaggcgagtaaccactctagatagatgcgatagcgtcatatcggacagctcagcaagctcactcatgcgcacccgatgttccggggccatagaaatctgcgccatggtgaagtactcaaagtggctgacacccgcagcttctttcagttgagcatccaagcgagcaggcaggccgattcgcattgtccacacatcgagccacacatcttgttgctcatcggttagccaaatgtcctgggattcggaattctcacttgtcatgtcaattaagtgtagtcgctaggtgaaaactataagcctctttggcgttgttgcttttctaatttcttctgttgcttcttcgctttcaacgctgccgggtcatccgaggcgataaaagcacccgcaccgattccaccaagtgcaccgaaaaggtggccctgccaggacacaccgatttgagtaggtagcagaccccagaacaaaccggagtaaatgaacgccaaaactatgccaagcaggaactgtttaatatccttgttgaaaattccacgcacgatcaggtagccaagccagccataaatcaggccggacgcaccgatgtggttggtgccgattccaccgaaaatccatgtaccaagaccgccgatgagacctgcgataatcgtgacttcccagaacacgcgcttgccactcataccgatgaggaaactgaatataaagcctggaacggtatttccaatgaggtggctgaagcttccatgcaacagcggtgaggtgaaaataccccacagtgcactggtatccagcggatgaataccaaagttggtcaggttgaagccagtgagcagcgcaatgacgatggatgccaaatgcaccgcccaaatcaccactacataaccgatggcgatggtaagacctgtgcgcacacgggatttgtttttcagctgctgattcaggctggcatcgggcttattccacggcttcaccggcccaccagcaggttggaacgcgccagtggtgctgaaattcgtgttgttatacgggctgttgtaactcatggtaaaagttccctgaagcttttgagcccgagtcccggactcgcggtaagtatggcgtcgatgatagcgtcctgtacgcaatctgcagcatgagccgacaattccgccagctcaaccggggtaacgccactaccatcacccgatgacatggcgaaaaatgtgtcaccgtccatcggtgaatgcgacggccgcactgccctcgccaaaccatcatgggccaccagcgccaagcgcttcgcttgggcttttgtcaccggcgcgtcagttgccacgacgccgatggtcgtgttcagcgtctctgccgcgctttttagcttatcgacgcccacccccatcacttcgggcctaccaaacaaagctccagttgttaggtccacgacttccccaacaggattcgccacgacccctgccgcgatggtgtactttccgacccggcgcgagctttggccaaaaccgccacgcagccgacctgctgtagcacccgttcctgcaccgacgctgcccgaaccgttgtgtgtaccagcgaaagcgttttcaactgcttgttccccatcagctgccgtgggcctgtttttgggatcgcccaccaacaaatcaaaaatcacagcgcctggaacgattggcacgataggcccttcgggacggacagggaaaccaataccgcggttttctagggctgtcatcactccatcggcagcagccaacccgaacgccgaaccgccacacaacaccacggcatgtgcttgctgcacagaattgtgtggttctagaaggtcggtttccctggtgcctgggcctcccccacggacatcgacgcccgcaaatgcaccgttaggtgcaatgaccactgagcaacccgtatcccccttcgtgacgtggcctaaaaggaagcccgcgacgtcgataagcattaattcatcatcgcttccagcaaggactcttgattgtaggcaagccactgcacgaggttttcgcggtcttcctcggcggcttccccgccgcgtacatcaccggaggcaacgtacaggcggatgtcattgagcgcagccaaccaagcgtgcgcttcctcctcagaggcggtgaccgcaacatttccgtcgggtcccagcgcatcgttaatcacgcgcagattttccagttttgctcgggtgatgtcgccttcatggagtgaacggaggaaagaattatcgccgtcgtattcctcatcgccctcgtgctgaaaatcagggagcaaacgcgcaagcgccggatcggttggtgcttctttgtgtccacttgtcatgccggtcatctctgccagaggatccttcggcacagactgtgcacgctgaatcaacgcctcactgaccgcagctgacaaatcacccaacacttcccgctccatcggctcaaaaaccaccgcgtaacgagcctggcgcatcagcccttttttcttcttccactgctgcatgaaaattctcccctaccctgcctgctgcattgtcgcccacagccctgcggtgtggagtttcttcacatcaccctccactttgtccttctcgccagaactcaccacggctttaccttcggtgtgcacctgcatcatcagctcagtggccctcttcttactgaagcccaacacagtctgaaaaacgtaggtgacatagctcatcaaattgaccggatcatcccacacgatgcacaaccaaggcaggttttcgctcgacaacgtgtgcacatcaagctcaacatctggcgtggcaagcggtgcagaaggtgacgacatgttcaagcttgattccacactttccactgccttcacttcctgcgggtagtgaagttggttttgcctattcatgacaaatagcctagtcaacaactatgcgttggtgcagagtagtcgcgctattccagtagaaattgcaagcttaggtgatatgtcatccaaatttttatcccttcacctgcaagaatgctgaatctttaagcacctaacagacatgcttttcactgatcactctgatagccttttctctgaaattgtaccgagcatttgattttgttcccctatcaatgctggttttggtgacaaaaactcggcggaaggaccaccgaatggaaacccttgcagcacaagcgcgcaccctgctagaaaaatggggcgtcgcgccgacgcacgcatctttcgtcgaatccattgcaaaggccatcccgattctgtcgatcctgctgacgctgattgtcaccgtgaatggaatttcaagcggaaatccggtccagccaccagcactggaacaggtacggaccgatgtagtgaacaagatcaactacgaacgcaacctaaagggcctcgtctcgatcagcccggagcttgaattacacacggcagcccaaacaattgcgcagcgaaatgcagactcagattccgaagaaaaagtaccggatccagagggcaacctggtggttctgcaacagaatctgccctatgcaaatgccaacgccgataccatcgttgatcggttcttaaactctcctgatcatgtcaaactactgcttgcaaacgattatgaagccatcggagttggtgtggcctacaagggtgatcatgcgtggatagtggtggagttcactgtagctcccgctgattccgtagaatcaacagagtgaataccaatccgtctgaattctcctcaaaccgttcaacagctctccttactgataaatatgagctgaccatgcttcaagcagcgctcgctgatggttctgcagaacgcccctcaacgtttgaggtctttagccgccgcctccccaacgagcgccgatacggtgtcgtcgcaggaacagcacgagtgctgaaggcgattcgtgactttgtattcacagaggaacaactcgccgatcttgactttttagacgaccgtaccctggaatacctccgcaactaccgattcaccggccaagttgatggctaccgcgaaggcgaaatctacttcccgcagtcccctcttctgactgtgcgtggcacgtttgcagaatgcgtcatcctagaaactgtcattttgtccatcatgaatgcagattctgccgtcgcttccgccgctgcgcgcatggtcaccgcagctgatggtcgccccatcatcgaaatgggatccaggcgcacccacgaatactcggcagtcaccgcatcccgcgcagcatacctcgctggattctccaccacctccaacctcgaggcggcctaccgctacggaattccagcatccggaacctccgcccacgcatggactttgctgcacatcaacgatgacggcacccccaacgaagcagcagctttcaaagcacaggttgaatccctcggcgtggacaccaccttgctggtagatacttatgacatcacccaaggtgtggccaccgccattgaagttgcaggtccagaccttggtggcgtacgtatcgactccggcgacctaggtgtgcttgcccgaaaggtccgcaagcagctcgacgatctcaacgcccacaacaccaagattgtggtctcctccgacctggatgaattcgccatcgcgggtcttcgcggcgaaccagttgacgtctttggcgttggcacctccgttgtcacaggttctggcgcaccaaccgctggcctcgtgtacaagatcgtggaagttgccggtcaccctgtggccaagcgttcccgaaacaaggaaagctacggtggtggcaagaaggctgtgcgcacccaccgcaagtccggtaccgcaatcgaagaaatcgtctacccattcaatgccgaagcaccagatactggaaagctcgacactttgagcctgaccatcccattgatgcgcgacggtgaaatcgttccaggtttgcctactttggaagattcccgagcgtatttggccaagcaattggtctctttaccatgggaaggccttgcactgtctcgcgatgagcctgttttgcacactcgtttcgtgggtttcccgccggccgcttagacaattcggtctcaccaaaccacagtgcccacggatcgggttttccgagttcatgggcattctggtttggtttgtcgccctcgaaaccggacacagctgcccatggatcgtgttttcgaccttcctgggcattctggtttggccaagctgaaaaactggccgtggacccgaaaagctcgactctctgtatcgccgttagacgtgctgtcttaacccacttcaggggaacgttccttcgagaaactcaatcccttaaatgggcttctagagcgttggggctattccagtggggcttcgtatcaacttgttcgggaggccaccgcaaaaaactcagatcacctggaagttgcccgcccagaatcgtccccaagcgcctttatcaaagcaatcgaaccagaccgtaaatcggtgtttcgcctggcttagtctttcgactccgatctggttagacttggcacaatgtctgcgcctgaatcacccacaaataccaccccagatccgctcaatgcttccacggaagagttgcttactgctgccgttgaagcgttgggcggtgcccgtcgtgctggacaggaagcaatggctaaggctgtgaccaaggcttttgatacagagcgtcacttggcggtgcaggcgggtacgggtacgggtaagtctttggcttatcttgttccgtcgattcgtcatgcgcagaagtctgattccacggtcattgtgtctactgcgacgatcgcgttgcagcgccagttggtcaatagggatctcccccgcttggtggatgcgttggaacccttgatggaacgtcgcccgacttttgcgattatgaagggccgttccaattatttgtgcatgaataaggttgcccgccaggaagagctgaatcaggaagatgccctgattgagcaggaggatatctcgtggttaggtaagcacattgtgcgccttaatgagtgggccaatgagactgagactggcgatcgtgatgatttggatccgggtgttcctgatcttgcgtggaagcaggtaagtgttactgcccgtgagtgcattggcgcgtcaaggtgcccgcatggcgaggattgtttcgctgagattgcccgcgggaaggcaaaggaggctgatgtggtggtcaccaaccatgcgttacttgctattgatgcgttgtcggatgtttctgtgcttcctgaacatgatgtggtggtcatcgatgaggcccatgagctagatggtcgcatcactgctgtggcgtcggctgagatcacggtgaattcgctcaatttagctgctcgccgtgcgtccaagttggattccgataagcgggaagaacgcgtccaggaaatcgctggcgatttggaaaccttgttgcaaaccatgcagccgggccggtggaatgacatggatgagggttccaaaggcacactggtggcattgaaggacgcgttgtgggcattgcgtgctcagatcgcgggagcacctgagggtgaggctgcgaatgatccggagcgtttcgccgagcgacagaatttaagcaatcacttgatggaaatccatgatgccaacgtgcgcattttggaggtcttcgcggaggaggatccctccaagcagtacgacgtggtgtggcataaccacgatgatcgtcgcggggattccctcaatgtggcgccgctgtcggttgcagggctgttgcatgagaaactgttcgcggaaaacaccgtggttttggccagtgcgacgctgaccattggtggcaatttcaacgcaatggctgccagctggggtttgccgaaagggtcgtgggattccatggatgccggcacgccgtttgatccagcgaagtcgggtattttgtacaccgctcgacaccttccggaccctggccgcgatgggttgccggaggaaacgcttgatgaaatctacgagttgatcactgcggcgggtggccgaactttggggctcttttcgtcgaaacgcgctgcggaacaagccaccaaggcgatgcgtctgcgcctgccttttgatgtgctctgccagggagatgacaatactgccgcgctggtgaagaagttttccgacagcgaaaacacgtgcctttttggcactctcacgctgtggcagggcgtcgacgtccccggccgttcgctgtcgttggtgttgattgaccgcatcccgttcccccgccccgacgacccgctgctgcaggcccgcaaggaggccgccgatgccgaaggccgcaacggtttcatggaggtcgcagccacccacgcggcgttgttgatggcgcagggcgcgggccggttgttgcggcacgtcggcgaccgcggcgtggtagcagtgctagaccaccgcttatcgacgaaacgttacggcggtttcctgcgcttctccatgcccagattttgggaaaccaccaacccagagaccgtacgcgcggcactcaaacgattggtgactaagtaaaactaactgctactgacgctgcatgatgggaccaccgctggcggtctggaatgcgtaggcatacagcaggaatgtaagcggagtggtcaccaacataccgatgatcactgcgctgcccaagaagctcaacgcgaagatagccagttctaagagaatgacctgaccaacgtttttggacactgccttccagcttgcggaaaacgcatcaccgatcgaggcgtcgcgcagctggaatgccacaggaacagcaaagatcagcaccacggcagcgataattccaggaatgagcagcaagatcattccgatgaagatgacgatattgatcaagatgtaaataccgagcgccttaccaagacccttcatcttgaagaaactctgaatggtgatctgctcaccgcgcacaactcgagccgcgttgcggtagcagttaagggagtacacaaaactgatgaatgccaggacgatcatcagcatgaacccgaagaagctggtgccacccgtcgctgcaatagctgcggaatcagaaccagatgaggtcgctgcgagcacactaaccatcgggaggatccacgcaaacatcagcacaagcaacaccgcgaagtagatcagtgcagacagcacccatgcctgccacgttgcggtaaagcccttccatgcctgaccaaaaacagttccaaggtcaaaggagcgccactgagcctcctgcatggaaggctgtgggacctcaggtgggatgggagaactgtaggcgttgaatccttgatcaaatggctgcccgtaaggctgtccatatggcgcaccgtagggctgaccgtagttctgctcgccggaagggttgccgaactgggagttccaattattgttgtcgtcgcctgggtattgggatccataagggcttgtcataacaatgtcctttttcaattgtgtgcaataagcgatttacacaatacaaggacttgttaatcaaagctcgtttagttatggaattgcaacaaccgtcacggtgttgggggcaacctcagtaaagccgccatcgcgaactggaacagcaccaggagactcgataaggcgcaggaactcctccgagggaatctccctgacgtgcagcgcaaaatccgctgcttcccactgctccacccactcaaacggttggtgcgcggcaagcaacatggatgcgtgtcctacctgcgcagcggcctttcccagcgtcatcttcaacgattcatcaatgtagataacggggtattcatcgttgatcggattcggctcatcgagaggcaattccgtaccggaaatctgcagctttttgatatctgcaggcacatccaccactgcgctgggcaaaaatgcccgaacctttgcagcatcatcttccacagtcacgccgggtaaatcttgcacccgatcccacgccgcattacgagcgcgacgtgacaccttccgaatcaagtgtccgtaccaacgttccaaggccgcccgaaaatcaggatcggtggatactcgttcgtcgaggcaaagcttgaccacactcctcgccgccgcttccaacacatctgtccgccggggcggattctgtttcggaatgtgcaacgcgatctgcattgcctgaacggtcgaaggatccgaaggatcctcgctatgtggcccgtcgctagcccgggccttgaggaggaggtgggcgtcgagaagcgaatctttaggcattggtcaatggaacgcggtggaaagtgccgtcttcctgatccgccagatcgatctcgtcgcgggaaatgcccatgatgtgcaaaacctcgtcgaggaatgggtggttcacggaagtatccgcaatctccttcagcgcaggcttcgcgttgaaagcaacacccagacccgcagcggagagcatatcgatgtcattagcgccatcaccgacagcgacagtctggtacatcttcaggccagaatccgcagcgaactcacggaggaactcagccttcgcagcgcggtcaacgatctttccggtgacgttgccggtcagcttgccatcaacgatttccaaagtgttggcgcggacataatccaactccaactcctcagccaaaccttccaacacctggatgaaaccaccggaaacaacagcggtctggtaacccatgcggttcagcgtacggatcgtggtgcgcgcaccaggggtcagctcaatagcggcagcgacctcatcgatcaccgacgcatccaaaccagccaacgccttcacacgctcacgcagagactcctcgaaatcgagctcaccgcgcatcgcacgctcagtaactgccgcaacttcagcttccttgcccgcgtgagccgccagcatctcaatgacctcaccagtgatcaacgtggaatcacaatcgaagcacaccagacgcttagaacgacgcagcaaaccagaacgctcaatcgcaatatccacattcagctcagaggtaagagcagcaagcgccttacgcatcgcttcaccaccaccagggctgacatccggcacagtcaccttcagctccaggccggtcacagggtaatccgaaataccacgaatggtgtcaatgttggcatcgtaatccgccagggtctgaccaatgcgggaaatatccaacgcatcaaccggatcacccaacaccacaacaacatgggaagaacgaggacgggacgactgcacagtttcctgcagctccaccaccacggactgtccatgcaccttgagggtgtcagtcaggcctgtggtgacggtctcgacacgctcaggtgcgatacccacaaacgccgccaagttcaaaaagccacggaacattgactgctcaacgtccaagacctgaacctgattagcggacaagaccctaaagaacgcggcagtcacacctgggcggtctttaccgctcactgtgatcaccgcaggaagataaccttcacgcaatgcaacctgctggccggcttccagctcagcgatttcttgggattcattctggatgagttcagtcacggcaacaattgtctcatgtctgagcgcggaacacgacattggagacttatcagtcgttgctgggcaattgtctagttatggggaattgggtgagatgtattcaggggtgccccaagtcggaatatgaaaagcaccagccccggcagattatctctgctggggctggtgcttatttagtcaggtaccgacttaaatcagacgcttttagcggctggagtcagatgcaagggctggggcggtacccaattctggagcattaatatcatcgtgatgtccagtgtgtgcctctgcgcgcatgcgttcaatcatgtgcgggtagtgcagctcgaacgcagggcgctcggagcggatacgaggcaaggatgcgaagttgtggcgaggaggagggcaggaggttgcccactccagggagttgccgtaaccccaaggatcatcaacggtaacgagctcaccgtagcgccaggacttgaagacgttccagatgaatggaatgacagacaggccaagcaggaaggagaacacggtggagatctggttgtagatggtgaaaccatcagaatccaggtagtcagcgtaacgacgtggcatacccatgttgcccacccagtgctggatgaggaaggttccgtggaaaccgacgaaggtcaaccagaagtggatcttgccaagacgctcgtccatcatgcggccagtcatcttcgggaaccagaagtaaacgcctgcacacgatgcgaacaccacggtaccgaagagggtgtagtggaagtgcgcgatcaggaagtaggagtcagccaagtggaagtccagtggtggggacgccagcataatgccggtcagaccaccgaagaggaaggtagccatgaagccaacagaccagatcattggggtttcccaagtgatgtgacccttccacatggttccaacccagttgaagaacttaacgccggtaggaaccgaaatcaggaacgtcatgaaggagaagaacggaagcaaaactgcgccagtaacgaacatgtggtgagcccacacagccatggacagtgcaccaatggacaaggttgcgaagatcaggccgacgtaaccgaacattggcttacgggagaacacaggaatgatctcagaaacaatgccgaagaacggcagcgccagaacgtaaacctcagggtgtccgaagaaccagaacaggtgctgccacaggagggagccgccgttagctggatcgtacaggtgtccaccaagcttgcggtcatacagaacacccagtgcagcagcgagcagcagtgggaagatcagcagagcaagaacggaaacaacgaagatattccaggtgaaaataggcatacggaacatggtcataccaggtgcgcggaggcagaggatggtggtgagcatgttaattgcggaagcaacggagccaataccagttgcaccgacaccgacaatccacatgtcagagccaaggcctggggagtgaattgcgtcagacagtggggagtacatggtccaaccgaagtcggcagcaccacccggggtcaggaagccggtcagcatcgcgacaccaccgacggtggtgatccagaagccgaaagcattcaaacgtgggaaagctacgtcaggcgcaccgatctgaagtggcaggacgtagttagcaaaaccccaaacaattggagttccgtacagcagcagcatgacagttccgtgcatggtgaacagctggttgaactgctcattagacaggaactgcagaccaggggtgaaaagctccgctcggataagcagggccatcaagccaccgaggaagaagaagctgaaggacataatgatgtacataatgcccagctgcttgtggtcggtggtggtcatcattaaccatgctttgctgcccttgcgtgcatggcctgtcggctcgggcctctgaggggcgacgtgcccgtcgaccctaggcgccacagcggtcataggttcctcctgactacgggacgatccattcggattaccgatcgtcctttaacaacactgcctgatcttaggccacaggcaggatccgatgccaacccaaaaaggccggtatgcagctaactgtatccccttttcatgcccaaaaaaaatgtttttcaaacaattcatgaggtcgctgccaggttcagtcacttgtgggcagtgacttttaaccaaaggtgtgaaggggttcacaatttgacggacatttcgccaggaagccctacccccacggttaacccctgccacagatttcacaattccccccgccggggttcaatcgaatggttgagacgcccattccaggggcgttttcttctaaagcgtgatgtgccgccgaggggtccacggggcgcctggcgctcccctaccccgatatgcgcttcggaaaaacccgcaccttaagcccccaccagaaagcgaaaaacgctctaacggttgcagttaactacagccgtagagcgcttcagctttttaaaagttagaagtcccagtcatcatcctcggtgttttctgccttaccaataacgtaagaggaaccggagccggagaagaagtcgtggttctcatcagcgtttggtgacagcgcagacaagatgtttggggacaccttggtttcatccgctgggaagagtccttcgtagccaaggttgttgagggccttgttggcgttgtagcgaaggaatcgcttaacatcctcggtccatccaagatcgtcgtagagatcttcggagtactgagtttcgttatcgtaaagatcgtagagcagatcgaaggtgtactccttcagctcttcctgacgctctggagtctccttcgcgacagccttttgatacttgtagccaatgtagtagccgtgcactgcctcatcgcggatgatcaggcggatcacgtcggcggtgttggtcagcttggagtggctggaccaatacattgggaggtagaagccggagtagaacaggaaggactccaggatcacggaggcgatcttgcgctttagtggatcatcgccctcatagtaagacaggatgatctttgccttgcgctgcaggttttcattttcctcagaccaacggaacgcatcgttgatttccgcggtggaggccagagtcatgaagatgttggagtaactctttgcgtgcacggattccatgaacgcaatgttggttagcaccgcttcttcgtgcagtgaatctgcgtctggaagcagggagattgcgccgacagtgccctgaatggtgtccagcagggtaagtccggtgaacacgcgcatggttgcggctttttcaacctcgttgagggttccccagctcttgatgtcgttggatactgggaccttttctgggagccagaagttaccggtcagacgatcccagacttcaagatctttggaatctgggatggagttccagttgatcgcctttacaggtgcaacatgctcctttaagtaagcatcgtgaacactgagatcagaatcagcagccattaggtgcgctcttcccttctacaaatttttttgcttttcgacgccacaatgcagcgcgatttcagatcgccagcttaccccaaccgaagcccttcagaagacccgccccagcctatcaattttggtcaagtcgcctagctttagacctagctttagagcgcaatcccccaccccaaaacgtgatcttagtcacttattttccattacgccccacagggttcagtgtcagactaacgccacaagaccatctccatcagccctcaacttcaaccacttattgccctaaattatcgccactagcacgtcatttagagaaaacctttaatgtgaaacaggtctcaaactgggccattttcaagccttcaaaaaggtgggaaacttagccaatccaaagcccaaaaatgcgggttatgctgcgctaacctatgctgacagccttgcggaagttgtgtacgttaggggccatgacaatcaacgagaagatcgcatcagctttcaacaaccaagtgactgcagagcttgaagcttcaatggtgtaccttcagctctcctacgttctagacgatctgggcctcaccggcatgcgcgactggatgaaggcacagagcaaagaagagctcgaacacgcacagaagttcgctcagcaccttcttgaccgtgactacaccccacagatcggtgacattgcaccaccaaagcttgatgtcacctccgctatcgaggctttcgaggcttccctggcacacgagcagaagatctccggcctgatccgcgagctcgctgccatccaggacgctgagaaggactacgattcccgcgcactgatcgactggttcctcaacgagcagatcgaagaagaagcaaccgtcggcgagatcatcgaccgcctccgtatcgctggtgattccggttccggaatcctgcgcatcgacggcgaactcggctcccgctaaattccccgcagtttttaatgctccactcccccactaaaggggaggggagcattttttattctctaggtattcccttaattagtgctcttttccaaaaacattggtatttgctcgaaagcacaacttaaaacagtaataatggtaatcacattcttttctattaagtaagcaagtacaccggcccattaaagaggcaccatgaccccagcaaacgaaagtcctatgactaatccattaggttctgcccccaccccagccaagccacttcttgacagtgttcttgatgagctcggtcaagatatcatcagtggcaaggttgctgtcggagataccttcaagctgatggacatcggcgagcgttttggcatttcccgcacagtggcacgcgaagcgatgcgcgctttggagcagctcggtcttgtcgcttcttcacgtcgcattggcattactgttttgccacaggaagagtgggctgtttttgataagtccatcattcgctggcgtctcaatgacgaaggtcagcgtgaaggccagcttcagtctcttaccgagcttcgtattgctattgaaccgattgccgcgcgcagcgttgctcttcacgcgtcaaccgccgagctcgagaaaatccgcgcgctcgcaacagagatgcgtcagttgggtgaatctggtcagggtgcgtcccagcgcttcctcgaagcggacgtcactttccacgagctcatcttgcgttattgccacaatgagatgttcgctgcactgattccgtcgattagcgcggttcttgtcggccgcaccgagctcggcctgcagcctgatctgccggcgcacgaggcgctagacaaccacgataagcttgccgacgccctccttaaccgcgacgccgacgccgcagaaactgcgtcccgaaacatcctcaatgaggtgcgcagcgcgctgggcacgctgaactaacgtgatacgcgcactgcgtttgccactgcaaggggaatgtcttgaaacatttccccgatctgcaggcgcagtgtggcaatatcgctaagagcttcaacgaccgtgaccgttgtgcccacggtaattcccactccagtgaggtaccgaaccactgatgggtttccgtccctaacacgtgtaaccgtggcagatgcgccagcttttagtcccaaaagcatgagtccatcattgatggtcatctccccagattcggtggggatgggatccccgtgaggatccaacgttggatagcccactgcctgaaacatcttctccaacaccagtggagacactgcgtgctctaataaatctgcctcgccgtgtagttcatgagcgcctaatccaagcttctcagacagataggtctcaatgatccggcgccgcctgatcacgttgatggcgatgtctcgacctgcgggcgtcagctcgatgtccccgtagggacggtaattgacgaagccctcagggttgagttttttgagcgtcgccgacaccgttgatgcggtaactccaattacttcagcgagttttcctgttgttggttcctcatcccattcttctgcacggaaaagtgctgtgagatagtcctccacaacattcgaattaccccactgcgtcaactgttcaccttcttaattcgccgccgatgtttgataagtgtgctcgacaaccgtttcagaagcatattcaggaagcactgcaactaacgcaagcaaggccactgccaacgcaccagaaatatctttgcgcacagcttcagctgcccacgccaacacaaaagaggcagcaaccactgcggtaccaaaaatcagcatggtcgccacaggtgacgccgacagctcagaaaacctgagcacaacagcagggattgctgcgacagcacacattgccagcggaattcgcggaaacataggtggatcactctccttcgaggaactgctcgaaggtctcgctcacctagttttaggcacgtgggccgggtacacagatcttgcgtgccagtatgtcgacaaccgcgtttgtcgagctactccccttcagcaacagacatcgtgtcagctggcaatcgtgtgtgtctacggacaagaagatgtttgagtgatcaaacaaccacgtcacaccatgtggaggaagtttctgggcataaaaatatccccaaccttgtgcaggtcggggatatttttaagtgcttttacagcatgcagctgacgcagccgtcaacttcagtgccttccagagcaacctggcgcaggcgaatgtagtacaaggtcttgatgcccttgcgccatgcgtagatctgcgcacggttgatgtcacgggtggtggcagtgtccttgaagaacaaggtcagtgacaggccctggtcaacgtacttggttgccacagcgtaggtgtcaatgatcttctcgtagccgatttcgtaggcgtcctcgaagtactcaaggttgtcattgtccatgtgtggagctgggtagtaaacgcggccgatcttgccttccttgcggatctcaatcttggatgcgattgggtggatcgacgaggtggagttgttgatgtaggagatcgaaccggttggtggaaccgcttgcaggttacggttgaacagaccgtgctccatcacgtcggccttcagcgcagcccagtcctcaacggttggggtgtggatgttcgacttggcaaagagttccttgaccttgtcggactttggtgcgaagtcgtttgcatcgaaatcatcgaagtactcaccggttgcatacttggagttttcgaagttcttgaaacgctctccacgctcagtagcgatcttgttggatgcacgcaggcactggtacagcacggcagcaaagtatgcgttggtgaagtccagggcttcctcggagccgtagtgcatgtgctcgcgaccgaagtagccgtgaaggttcatctggccaaggccgatggcgtgagctgcttcgttgcccttacggatggaaggcacggaatcgatgctggtctgctcagacactgcagttaagccgcggattgcggtttcgatggtcttctcaaagtttggtgaatccatagccattgcaacgttgagggaacccaagttacaagaaatgtcttcgccgacctctgcgtaagtcaggtcatcgttgaattcagatggggtggacacctgaaggatctcagagcacaggtttgagtgggtgatgcgaccttcgattgggttggatgcattcacggtgtcttcatacatgatgtatgggtaaccggactcgaactggatttctgccagggtctggaagaactgacgcgcgttgatcttggtcttgcggatgcggtcatcatccaccatctcgtcgtagtgctcggtgattgagacgtctgcgaaaggcttgccgtaaatgcgctccacatcgtatggggagaacaggtacatgtcatcgttgcgcttagccagctcgaaggtgatgtccggaatcacaacacccagggacagggtcttgatgcggatcttctcatcggcgttctcacgcttggtatccaggaaggacaggatatctgggtggtgagcgttgaggtacacagcacctgcaccctgacgagcacccagctggttagcgtaggagaaagcatcttccagaagtttcatcactgggataacaccggaagactggttttcaatcttcttaatcggtgcaccggcttcacgaaggttggacagcagcaacgctacgccaccgccacgcttggacagctgaagagcagagttgatggaacgtccgatggactccatgttgtcttcgatacgcaggaggaagcaggatactggctcgccgcgctgtgccttgccggagttcaggaaggttggggttgctggttggaaacggccagacatgatctcatcgaccaggttctcggccaatgcgcggtcgccgtcagcgagggtgagggcgaccatgcagacacggtcttcgaaacgctcgaggtagcggcgaccgtcgaaggtcttcagggtgtaggaagtgtagtacttgtatgcaccgaggaaggactggaagcggaacttgaatccgtatgcgcgcttgaagaggtccttgatgaactggaagtcgtacttgtccagaacgattgggtcatagtacttgttttcaaccaggtagtcgatcttttcctgcaggttgtggaagaagacggtgttctggttgacgtgctgcaggaagtactggtttgcagcttcacggtctttctcaaactggatcttgccgttgtcatcgtaaaggttgagcaacgcgttaagagcgtggaagtccatctggtctccgcgtggcacgacggtggttcccgatgcagtcaaaggaatgtccctttcaaaagaggtgtgaactttgtattgattgattaagttttaaggtttatcgcgaggtaactggttcttgtggttccagccccaaagcttgggcgttttgagtaagacctccacgaaggatacttacatcttcctcattgcccatgagctcgaaacggtagacatagggcactttacatttcttggaaatgatctcgcctgccaacccaaaatcggagccgaagtttgagtttccacctgcaacaactgccctgatgaagctgcggttgtgttcatcatttaaaaacctgatgacttgtggtgggaccgggcgggagttttctccagtcatggagactccaccaccataggtcggggtgattagcacgtagggctcgttgattttcagcggttcttccaccctagtgagggggatgcgcacgttgggtaaatcgagcttttgtacaaaacgatgcgtgttgtcggtggccgaggaaaaatacacgattagcatcctcgaactcacttcccttctaaataccgtttgtgcgcaagcctagtgtgcttgctggtatcagtttcccccttcaagggcgttgaagggaagaactgaacttctattgttcccgatttcacggccgcgtggtttcaacccgtaggtgatttgctgaattcacgggaattagtggtgaaatacgaaacgccgccaaatattaggcgacgagcgttggggaaggtcacaaatggtgtgacgtgcatggctcacctgttcgattaaacaggtcgtgccacgaagtgcagtttaggcagctgcggttgccatttcacggatgcgctctgggcggaaaccggaccagtgggagccatctgcaacgacaactggtgcctgcaggtagccaagtgcgaggacgtactcacgtgcctcttcatcaaggctgatatcaacgaggtcatactcaagaccagcgcggtcgagggccttcttggtggcattgcactggacgcaagctggcttggtgtaaacggtgattgccattttttggaccttcccttatcggctttagcggttgacgctaatgcctcatctcacttttttagatctgtttttaaagtctttgcatcgctcaaggcgacacaacaaacactatactttgtggtgaataagcgcaactagcactacatatagtagttacatggtgagtattcccaggatggcagttcttcagccaccacatgtagcgatcctttgctccaccaaactctagatacgtaattacattcatgtcatttacgcagttcgccaccccacccaaggggtgtccgttacagaatcgttacattaatgacgtcgcattacaacccaaaacactcccctacccagaccgagccacaacgcacccaacaccacaaaaagtaggtccgtcacatcgcccccatcaatcaaaagcgcagatattagaccgccacggcaagagtcagacagtatctagaacaaatattcgcaatactcactttcgcatgcataaaaacaaccaggcaccgaaccctccacaagggaggagacgatgcctggctatttgtataaaccggaagttaatcgaaaagattaaccctggcgagccttgaaacgtggctctttcttgttgatcacgtagactttgccacggcgacgcacgacctgggcgcccggcttgttcttcagcgaccgaagggaattgcgtaccttcattcgggcgctcctttctctcatgcgctatataaggctatttttcagcggttagatggacaaataaacacgtacgtctaaccagctatgacacgaggaactatcttaaccgactccagcactaaactccaaacccttggcccgcaccgccaaagtttagcgcgccccaagacaccaccgcgccatgtttgcctaggattaggtacatgacaaacactcaaaccgagatcattaatgaactaaaggtgagcccagcaatcgacgtggccaaggaagttgaattccgtgtgcagttcctcgtcgattacctgcgggcttcccatacaaaaggctttgttcttggtatttcaggtggccaggattccactcttgcgggacgactcacgcagctggcagtagagcgcattcgtgcggaagaaaacagcacggattatgtcttctacgcagttcgcctcccctacgcgatccaggcagatgaggacgatgcgcaagttgcattggaattcatcgcacctgacaagagcgtgaccgtcaacgttaaagacgcaacggacgccaccgaagcaactgttgcagctgctttggaacttcctgagctgaccgacttcaatcggggcaatattaaagctcgccaacgcatggttgcccagtacgcaatcgcaggccagttgggcttgctggttattggcactgatcacgcggctgaaaacgtcacggggttcttcaccaaattcggtgatggcgcagctgacctgcttcctttggcaggtttgagcaagcgtcaaggagctgccattctggagcacctgggtgcaccttcaagcacgtggaccaaggttcctaccgctgatttggaagaggatcgcccagcgttgccagatgaggaagcacttggtgtgtcgtatgcggacatcgataattacctggaaaacaagcccgatgtcagtgaaaaagcccagcagcgcattgagcacctgtggaaggtgggccagcacaagcgccacctccctgctaccccgcaggaaaattggtggcgttaatccaacagtttgagtgtcgctttggcggcgtggagtagttccacgccgtagcttggcccatgagacgccgcatgtacggccaaagggtggagttggtgcatgggggtgcgttcacgccacccgtctggcagcgggttgatagacagataaccttcccggatttcatcgagatagggtgcgccaaatacatcaagcatcgcgagatcagtttcgggatgaccgccgtgagctgcggggtcaataaacacaggcccgtctgtgccaaaaagtaggttgccaaaccacaagtcgccgtggattctggcggggggaacgtcatcgggaagttcgctaatcaaatcacaagcggcttccacgacccagagtgcgtgctcggtgaggtgatttcgcctgcgtgcccggcgcgcaaacgggagtacgcgttgctgggagtaaaaaacaccccaggtgggcgtcgataagcatgcttgtccctgggtgccgatgtagtttaaccccgcccagcccgctggtggacagccgaacgctggggcgccggcaaggtggatgcgggcgagctcttcgccggccttgaaggccgcatcgggtgtgggcaattgcgtttcgacgccaacagtcgtgatctgctctgcgtcggcgctaacaacctgtgccacagctgaagatgcttcggcgagccagcgtagacctgcggcttccgccaaggctgcttggggttgtgcggggcgtttagtgaaatgtggcaaagctagtagcgctcaggctcctcgccgagggtgaactcacggccagtgatttcattcggaacaatacggacatagttgtacttcagggttggaatccaaggcttcaactccaaagtgtcggcgtaggcgatctcatccagcttgcgcacaatctctgcggtcgcacgaaccaccacggaccaggcctttccgtccttgacctcatcggcttcaaagagcacatcgtggttgagattcatgctgaacaacttgttgccctcagctgtacgaatgtaaattgcgcccttatccacaatgaagttcaccgggaaaatgtccatctcatcgctgcgacgaaccaccacgcgaccaagagacaccgactgcaggcgctccaaagcttcctgctcattgaggatgttgactggattgtccatagttatctccactcccacaaactaaagaaaaaaagaatatccggtactaaccagtctagccctcaattacgcgcttgacctgctaatgaacacgcaccgcggtacgtccgtgaagcttgccagccatcaaatcttcgccagcttgagcaacatccttgacatcaatcacagtggtcatatcatctagcaccgcggtatcaagatgctcggacagcaacgcccacgcacgtcgacgcagctcacggggtgcatcgacagagttaatgccaaccaaatgcacgccacgaagaataaacggcaacaccgttcccggcagatccggcccctgagccatgccacacgccgtgacaattccgccccattttgtctgagcaatcgcattgacaagtgtgtgggatcccactgaatccactacacccgcccaacgccccttctgcagcggccggcccttttcagaaagctccgcgcgatcaatgatgtcgcttgcgcccaggctggtcaggtattcggcatgcgcttctcgacgccccgtcaccgcgaccgtcgtatatcccaacttattcagcaggtgaagtgcaatcgaacccacaccaccagtcgaaccagttaccagaatctccccatcctccggtttgataccttgatcgaccagagcattcaccgatagcgcagccgtgaaacctgcagtacccaacgcacccacctgctgcgcggagaagttaaatggaatatgcagcaacggttcagacggcactttcagccgctgcgtgaaacctccatgccggttctcccccaaaccagcgccattcagcaccacttcatcaccacgaccaaagcgaggatcagcgctctcgatcacagtgcccaccacatcgatacctggaatcagtggcacagtacgcaccactcccttatcacccttcagagccattgcgtccttgtaattcaagctggaccaaccaacctcaattagaacgtcaccttcccccaaaaatgatggatcagagaacgtgtcctggtaggaggtggtgaaatttccatcctcatcctggctgagaacaacactattgattggaccttcagaaaatatgtgagctggagtcatagcccccgagtgtaatgaaaaatgtccatccggggcatggaatttggggtttggaatttggggtggaagcttccggaagacaaggtgcttaatgggaggattggcacacatttccaaccctcgacacacagataaccaaacactaacaaaaatcttttacacatagaagagttctatgacttgatccacaatgtgatgcaaatcattgaccctcaccccggaccaagcgcttaatgaaggcaagccaaacttaactagtagataggattgcaatgaccgaatcgcaagatctcgccgcattcgtggaagctgccaaactcaatgatgcaagccccgaagccgtagagcaattgaaaatcagagtgctagacaccgtaggcgttgccattggcgcactggatgccgaaccgattgtcgccattcgaggactcctggaagacctcgggggaaccgaacagtcaacacttattggtggtggcaaaaccagtccggaacgtgcagcatttttcaacagcgcattaagccgctacctcgacttcatggacgcctacctagcaaagggcgaaaccaaccacccctcggataacttcggagcagtgctcgctgcagccgaaagcgttggcgcctctggaaaagacctgctcaccgcattcgccgtggcctaccaggtacacaccagactttcagatgtcgcaccagttcgcgccaaaggtttcgatcacaccacccaaggagcattcgcagcgggcgcatctgctgccaaggcactgggtttgccagctgatcaaatcgccaacgcactggccatcgcaggaacagccaatgttgcacttcgtgtcactcgcactggaaacttgagccactggaaaggccttgcctacccacacgtgtccaaagaaggaacctgggcagcactgctcgcaagccgaggtattaccggtccggaagaagtcttcgaaggcaacaagggattcaaagagtccgtctccggaccgttcgagatcgattggtccaaggaagacttggaaagcgttaagcgcaccatcatcaagaaacacaacgcggaaattcactcgcagtcagcgcttgatgcagcccaagaaatacgcgcacaagaaggcttcaatgtggacaacattgaaaagattcacctgactactttcgacgttgcctactccatcattggcggcggcgaagaaggcgacaaacagcttattcgcaccaaagaagaagccgatcactcactgccgtggatgctcgctgtagttctgctggatggtcagctcaatcccgaacagtacgaaccatcacgcatcgttgctgatgatgtacaaaccttgatgaagaaaatcgaaatcacaccgtcagatgaattctctgatcgcttccctgaccacatgccagctgatctagaagtcacactaaacgatggctcggtgttcaaagcttcacaagatagctacttaggcttccacgacaatcccctagattgggacaacgcgcgcaagaaattcgatgcccttgtcacaccattcaccggtgaagaactacgtgaagaaatcgccacgatcattcacgagctcgatagccgacaggtttctgaactcacagaagccctggccaaagtctccaccacccgcagctaaaactttttgaaaggagctcatcatgagcaacgcagtaccccacaacgtttccttcaactttgttccccgcgcttaccgtccagaaaagccccgcacattcggcatgacagaaattcgtgcaccgtactactccactttcggcacccgacacctccaggatgtcttcgatgttgcaggccagtgggtggacggcatcaaatgggcaggcggttccttctccctggtgccgaccgaacaggtgcgtgcttttagcgacatcgcccatgaaaacaatgcctatgtgtcttccggtggctggattgaaactgtgcttcgctacggcgacgacgcagttgatcattacttaaaggaagccaaggaagtcggcttcgatgttattgagatttccaccggattcatcatgctcaacacttcaggtcttcagcgcctggtagaaaaagtggtcaaggcaggcctcaaagcaaaacctgaactaggactacagattggttccggaggcgactctggtgaggctgaacttgcagccgaaggaaagaaagacattggcgatctggttgaccgcggtaaaaaagctctcgacgccggcgcatccatcatcatgatcgaatccgaaggcatcaccgaaaacgtcaccgaatgggatacaggcgctgccgcgtccatcatcaatggactgggattagaaaacgtcatgttcgaagccgccgacggccccgtctttgagtggtatgtcaaaaactacggcaacgaatgcaacctgttcgtcgaccacagtcaaattctgcaacttgaagggctgcgccaaaacatctggggcaacaagagcacctggggacgagtaatcaaccctgcgccttaaataccaggtcagggagggcacgaggctactttccaatggaaaaagccgctgatttttatcagcggctttatttttgtggagctaacgggattcgaacccgtgacccccacactgccagtgtggtgcgctaccagctgcgccatagccccgtttttcaactcctgttactctagccgagcgatgttcaaataaccaaatcgcccacatcgatacacgaattaaagcaaaaatccccctgaccacccacaatatgtggacgatcagggggatttattttccttctagatcagttctttaagaagctagaacagtggtgatccagtcggagatgttgccttcaacatccttgccgtcctggaggacgcgtggtgaggacaggctgccggtttcttcagtgagttcttcaccgtttgcggttgccaggtcgtatgcgcgctggatgttgtcgccgtttcggattgcgtctactacggaggagtctgcgccaagggcttcaacgccgtctgcgaagtcatcatcggaccactggttgtagatctcggactgatcttccatgaggaatgcgcggaagttccagtagagggttgcgtcgttggagtctgccactgcaagggctgctgccaatgcgtgggtggagtggccgtcgatgttttcgcggtcaaggaagttcagtggcttgatttcgacgaccaggttgccgtcttcgatctgagtcttcatgtcagcgtcggtggcgagggagagctcggagcagtgagagcaggagaagtcttcaaaaagctgcacggactttgcgtcggcggaggtgtttgcggaggtcagcgtgatggagtcggagcctacttccattgccaaagaggtgtcttcgtagtcgcggtcaccaagcttggctgcttttgagccctggccttggatgacgatgaagccgacgacgacgattgcaacgacgacgatcgccaccattgcccagaggaagttcttgcttccaccttggttcggattctgaactttgttgctcacttgttgccttactttgatctgttttgttttcttgaattctcgcagggggcgatcattccaaaaatccaacgctacctaccgttgtgtgcagcatcggctacttcttcgaccttaaaccatgtgcactttatttgacacgtccactagttgcgcgagacgagattcacaggagatctttctatctcctgtgaaacttgtcagcaagtccgcagttttactgtccgagtacttcgctgaccaacgcttgggcttccttctgaacctgggcgaggtgctcttcgcccttgaaggattctgcgtagatcttgtacttgtcttcggtgccggatgggcgtgctgcgaaccaggcgttttcggtggtcacttttagtcctccgatggctgcgccattgccgggagcttcggtgagcttagcggtgattgcttcgccggctagttcggtggcggtgacctgttctggggacagtgccttcaggatggccttttgttctcggttggcttctgcatcggtgcgggcgtaggcaggtgcaccgaattcttcggcgagttctgcgtagcgctgtgatggggtcttgccggttactgcaatgatctcagctgccaggaggtcaaggatgaggccgtccttgtcggtggaccaggtggtgccgtccatgcggaggaaggatgcacctgcggattcttcaccaccgaatccgatttcgccggagatcaaacctgggacaaaccacttgaatccgactggaacctcaacgagggtgcggccaagctgcgccacaacgcggtcgatcatggaggagctgaccagggttttgcccactgcggtatctgcggaccaacctgggcggtgagcaaagaggtactcaattgctactgcgaggtagtggttggggttcatcaagccagcgtctggggtgacgatgccgtggcggtcggcgtcggcgtcgttgccggttgccacatcgaacttgtctcggttgtcaatcagcgatgccattgcgtgtgggctggagcagtccatgcggatcttgccgtcggtgtccaatgtcatgaagcggaaggtggaatcaacgtgtgggttgaccacggtgaggttgaggccatgggtttctgcgatggcaccccagtaatccacggatgcgccacccattgggtctgcgccgattcgaacaccagcttcgcggatggcatcgatgttgaccacgtttggcaggtcagcgatgtaaatgcccttgaagtcgtaggcagtggtgcgctcgtcgaggacaccggaaactggaactcgcttcacgtctgcaaggtcgccgcgcagaatatcgttggcgcggttggcgatccagtcggtggcgtcggtatctgcagggccaccgttggctgggttgtatttgaatccgccatcacgaggagggttgtgggatggggtgatcacgatgccgtcggcgtaggggcgggagggtcctgcggtgccaaggatgatgccatcgttgtgtcgtaggatcgcgtgggacactgcgggcgtcggggtgtagcggccgtcggcgtcgacaagcacttcgacgtcgttggcaatgaggacctcaagcgcgctgatcatcgctggttcggacagcgcgtgcgtatcgcggccgataaacagcgggccgacccagttttttggctgctggttgcggtagtcgacgatcgcctgggtggttgccaggatgtggtcctcgttgaaagcgctgtccagcgcggagccacggtgtccggaggtgccgaaagcgacctgctgatcagggttgttcacgtccggcttgcgggtgaaatatgcggtgaccagttccgcaacatcgatgagatcttctggttgggcgagttgcccggcgcgttcatgtgccatgtttgctccttaaaacaccaatactttctcttcatcttcccctcaaaagcaattgtgcgcacgagatacggcaaaattcacggagtagggtggcttaacatgcagaaactcatccaagggctaggtgtcggcgcgggtgccgcgttgggggtgtgcgtgcgccttgcgctgacgttgtggctcggcgattccgcctggccgatcctgaccatcaacgtgctgggagcgtttctgatgggctggttgcgccccaacgcgttctggggcacaggtttcctgggcggcttcaccaccttttcggccatgatgcttaacgacgtctccttctatttcttcaccgctgtgggctgcattctcgcctggttagctggggatcggttggcgcgatgatctttctttatgcagctctcggcggttttttcggaggctttctgcggtggagccttgcccaattattccccggaaaaagggccaccctggcggcgaataccctggcgtgtcttgctggtggattttttgtgtcgttggatcttccccatctctatacggttttgttgatcgctggtttctgcggcgccctttccacctggtccaccttggctaaagaacttggccagctattgaatgaaaagaagtggtggccgatgcttggctatctcagcctgacttttacacttggatattctgctgtttttctcgggatgcggctctagaattgtagaatgaatcgttcaacaatttccccagttgaagcccgccagcaattccgcgcaggccttatccaacccacctccggctggtccgcgggttttgcccaagccaacctcatttccatgccccaggatctggcttatgatttcctgctttttgctcaacgcaaccccaagccctgccccatcttggaagtattaaatgctggcgaaaccttcggcggaattttcggctcaaacgccaccgaagcagacatccgcaccgacgcgccccaataccgcatttacgcacacggcgaacttatcgattcccccgccagcgccgtcgattattggcgcgacgacctcgtcagtttcatcatcggctgctcctttacttttgaacatcccatggtccaagcaggcgttcccgtccgccacctcgaggccggccgcaacgtccccatgtatgaaacctcacttgcctgccgaccagccggttccctatcaggaaacctcgtggtgtcactgcgcatgatccccgcatcccaagtcgcggatgccgtccgcattacctcccgctaccccgcggttcacggagcaccagtccacatcggcgatccttcactgatcggaatcgatgacatcaacaaccctgatttcggcgatgccccgctgtccgaaccaagcgacgtccccgtgttttgggcctgcggagttacccctcaagcaatggtcatgtcctccaagccaccgctggcgatcactcacgcacccggacacatgctgatcaccgacgccccagatctgggattccaggttccttaaacctggatccaccgatgtgatttgggtgtaacggcgtgggaaaataggaaatgccctcctgaacaggaagaatcaagcttagttagagtccttcttcccctgccagaaaggcacctcacaggtgcaattattacacacccccgcagccatatccatttccttcgacgaccccaacctcatctctaccgcagggctggtcccgaccatggccctggccgaggaccggttaacagtaccaaccgacaaaggtgctaacccaggtgccaaaatcacgaccctcattgcggggatggtcgccggtgccgactccatcgacgatatcgatgcactccgccacggcggtatgcaccgactctttgactggatctacgccccctccacgttggggtcgttcctccgggcctttaccttcgggcatgtccgccaactcgacgctgtggcctcccggttcctggtgggtctggcaacacaggccccggccctggtcccggttgatgcttctaccagtgattacgtcttcatcgatgttgatgacaccatcattaaggtccacggacatcagaaacaaggcgctggttttggttactccggtatccgtggactcaacgccctgctggccacagtgaccacaccagagtcagcaccagtggtcgtggcccaacgattacggaaaggatcgtgcggttccccgcggggtgcaggccggttgattgctgatgcggtggctaccacccggcgtttgccggggatggaggatgagaagatccttctacgcgcggattctgccttttatggccatcccagtatcagtgctgcgatcaaggcaggggcggatgtgtctgtcacggtgcggatgaccccgaatgtcaagaaagcgatcgcccaggtccctgatgatgcgtggcagacaattaagtacaccaacgcgatcttcgacgaggacaccgggcgctggatctcggtggccgaggtcgccgagataccgttcaccgcatttacctcccggaagaaaaccgaccacatccccggactgctggtggtacgccggataccggagctgaataacaaggatgtggatcagccggggttgtttgatctacaccgcttccatgcggtgttcaccaccgccgacccaggcatcctcgatactgttgctgcggataaaacccaccgtcaacacgcaatcatcgaacaagtcaacgcggacgtaaaggccagtgcgttggcgcatatgccatcaggtgtattcaccgccaacagcgcctggttggtgtgtgcggtcatggcgttcaacctcacccgcacagccggtgtgatcgctgcaggcgcgatggccagggccaccaccgcaacgatccggcggaaacttgtggccgttccggccaggattgcacgcagcgcccggagattgattcttcacttgccacggaactggcggtgggaaacccagtggtcaagattgtgtgatcacggccgtttaccaccgtaaccggtagctccctgactacctaagccgagctttcggcgtgagatgacaacaattcgtggaacaaccagacgacgacgtgatctggggcttactcctacccgaaaactccagacccgcccagaaccggaatcaggacatcaccgagggcacgtcggtggatccaggcttattcacaagcactcatgattttccaggggtaagatcaggcagttcccattgtttacctaccaaggaatacctaaatgaaactttttcatagggctgcaagcgtcgtagccgcagcgctattaggtacaggtgctattgcgcctgtggttcagagtcaacctgatcagacagtcacccttgatcatcaagaggcctacatccaagaatttcaccgcgggggcgatagaccacctatagtcgatggtgtcggtggttattcagatgaagaagtcgcacagatccatgaagcgatccgacaagcttacgtttctggtgaaccacacgatgagctagttcctggtgagatgtggtcagacaagattgacctgcctgcaacgatcgacaaggcagctgctgatgaagctgagataaagatcgcgcagcaacaatcagggtcgcaggccagggctcttgctgcacagtgccagtttttctggccgtctccttaccaagtgtgtggggccatcttggaacggtataaccaacaaggtgggccgttgagttggatgctattgccaattgagaatcaagcgcttaaccctgatggacagggatatcgtcagcgatttatgtccggatttatttattggcatcccactactggtgcgcatgcagttaataactacagtgcgcaaatatgggagcgtcatgggtgggagtctggctggatggggtaccccatcggtggtgaagtccctgtttcggggtcgaatctcattgacggtgagatcaatggttgggtgcaaacgttccaaggtgggcgggtctatcgtaccccgatgcttgaggggttccagattgccagtattaacggcatgattttaaatagatggttggctattggcgggccggatagcgctcttggttttcccattgccgatgaagctgttgcatccgatggtgtgggtcgatttagtgttttccagaatggtgtactttactggcaccctaatcacggagcatgggaaatgaccggatttattgaagaagtatggaaaatgcgaggtggcttggattctcaatggggttatcccacatccgccccggtgttagattcagatgccccagtggaaattgcccaaaacttttctggaggcgttttcgacctagcaaccgagatcgaggatgctggttttagtccgatcgaggataaggagatgagcaacttgatacttgaatattttggttatttaggattcgatttccctggaagctcttctcgagagttggtgcaagaccattctaaatcagacttgatgactcttagggctagtagatgtgcgctcaaggattcttctcaggcaagtttcggtggggtgacgattcctagccactatgactactggggatgtcttgacaagtccgaccgacccgaccctgatgcttatgggcgccatgactactgcactctttcgcctgattcgtatggtcccctagggaagaaggctgagtttagtggggcttgtgcaagacacgatctgtgtatggatgccgttgatgcgaatggcacggggtatgctccgtgccacccggctttttatacgtggatgagcacagtttgtactaccaactatgctgaggatgctaatttcaagaagggctgtgtgaataccgcgaaggcctactataaggcagtccaattaaagaacccgaattagaaatatgcgtgattatacgattttcgtaatcagactactattactatatttaatagtatttatcgctttttggatttggtctccgataacttctgaatcgtaccttgaagctgtggtgatggccttcgcggtgtctttgattaccgcgttggtgacaagtgcagttacgtacctagcttcgctaaaagtgatagcattcgtcggctttcttggtttcgtcagtttaatagttggtgtctatttctggattactgttccagacgggattttggacgtcttctttgtgctttttggcagcggtatctttctatccgaagtgttaattagcctgaagcgctactcgcgctcgtcaagtttttgagacagcttgattgacttttcttcttacgctgctgctagtgtcctgcgccgttaattcgttttaagtatcgggcgatagaggaaaggatctcctccgcggttttggtccagataaacggcttaggatcctcgttccatgctttcacccagttgcgtaaatctttctccagggcctggacactccgatgatcagaacgctggagtaactcccgggtcacctcagcgaacaaccgttcaacctggttgatccaggacgaatacgtcggggtgaagtgcatgtgaaaccgtggatgcttgaccaaccaggtattgatggtcgggtgtttatgcgtggcgtagttgtcacaaataacatgaacatcaaggtcctggggaacagtcttgtcgatcttgaccaggaacttcttaaacctggatccaccgatgtgattcaggtgtaacggcgtgggaaaataggaaatgccctcctgaactggaagaatcaagcttgcttagagtcctgattcacctgccagaaaggcacctcacaggtgcaattattacacaaccccacagcgatgtccgcatcctttgatgaccccaacctcatctcgcttgctggactggttccaaccatgcacttagccgatgctgccagcctgtccaccttggcccaggaccggttgagcatcaccggtgataaaggtgccaatgctggtgcgaagatcgcctccctagtcgcgggcatggtcgccggtgctgattccatcgatgacatggatgtactccgccacggaggtatgcgccgacttttcgaccggatctacgccccatccacattggggtcttttctgcgggccttcactttcggccacgtacgccaactcgatgctgtggcctcccgattcctggtcaacctggccaggcaggcaccacacctggtgccaccaccaccggcaggcagtggcggtaacgggtatgtgttcgttgatgttgatgacaccatcattgaagtccacggccacaccaaacaaggtgccggctttggttactccggtatccgtggactcaacgccttgctggccacggtcaccaccgcacagtccgcccccatcattgtgggccaacgattgcggaaaggatcgtgtggttccccacgaggggcccaccgcctgatcgccgatgcgatgaccaccaccaggcgcctgcccgggatggaggataagaaaatcctcgtccgggcagattcggcgtattatggtcatcccagtgtcagtgtggccctaaggtccggtgcggatgtgtccgtcacggtgcggatgaccccgaacgtcaagaaagcgatcgtcgcgatcccggaagatgcgtggcagacgattcagtacaccgatgcgatcttcgatgaggcatcacaatcgtggatctccttagcccaggtcgccgaagtgcctttcaccgcgtttacctcccggaagaaggccgaccatgttcccggacgcttggtggtacgccggattcctgagctgaataagaaggatgtgtatcagccgggcttgtttgatcttcaccgcttccatgcggtcttcaccaccgccgacccaggcgtgctggatactgttgctgcggataaaacccaccgtcagcacgcgatcattgaacaggtcaacgcagacttgaaggcaagcgcgttggcgcatctgccgtcggggacgttcaccgccaacagtgcctggctcgtatgcgcggtcatggcgtttaatctcacccgtgccaccggggttatcgctgcaggcgggatggccaaggccaccaccgcgacgatccggcggacactgatggccgttccagcccgggtcgcccgcaggtcccgccgactggtgctccaccttcccgaggggtggacgtggcaaccacagtggcagaaactgtttgatcacggccattcaccaccgtaaccggtagctccctgaccacccagccgagctttcggcgtgagatgacaacaattcgtggaacaaccagaacaagacgtgatctggcgatcacccctacccgaaaattccggacccgcccggaaccgggatcaggacatcaccgagggcacatcggtggatcgaggttaaaggagaacggttaataaaacgatgagtactggcaccgcgaagatcaaaaccgcgaagatcttgccccacgtatgggcaatgttaaacgtgtaattcatccccatcccggtgtccactaagatccgattatcgtccggatcgttgtagaaaatcccccacgtctttccatcttggtcaggcatggggtatttctttgccaaactcgtggttgtttttccaatcagaaccaacaggacaatcgtggcagcaataattccaataagcccgatgataaatccaccaggcagagggtttgggcggaactcattgaggatcatcaccaaaatcaaagcgttgagcacaaacatgtaccaacccatgtgcatgcttgttgccttgtaggtttcccactgccggtgcgcttcattcgccgatttcgccccaccgcgttgcgtgatcactccagactgcatggtcagcaacgcctgcatacccgacagggtcagcaaaataatgcctggccctatcaaaatcagtgaaagaaacgaacccaccgatttaggcgtccaattatccgcctccccggatccattccaatgcaccggcataggatctggcaacgacgggtaatacacatacaaaccaatacccgccaacaccactgtcgtggcaacagttgccagcacccatgtccagttgaagggcagctttggtaggttcggtaaatcgttcacgatgcacaccttagcaatgagaaagtgcctccaccccaggttgggtgaaggcactttgtgttttgctgagaaggtctcaggtactcaagagagcttaggagcgaacctctgcaggctcagtttctttctcagagacggttgccatttcaatagcagcgccacccttttcagcagcatcccacacatcctgatccagaatgccctcgcgcttagcaacgatcgcaggaaccagtgcctgaccggtgacgttggttgcggtacgtcccatgtcgatgattggctcgatagccagcagcagaccaacaccagcaagtggcagacccaaggtggatagggtcagggtcagcatgacggttgcgccagtggtgcctgcagttgcagcagagcccaggacagagacgatcatgatcagtacgtaatccatgatgctcaagtcaatgccgtagaactgtgccacgaagatagcggcaacagctgggtagacagcagcgcagccgtccatcttgctggtcgcacccagtgggatagcaaaggaagcgtacgcagatggaacacccaaggactgctcagtaacgcgctgggtaactggcataacgcccatggaggaacgggtaacaaagccaaggcttgtgacaggccaaacgcgcttgaagaatccaagaacaggaattccattgagcttcagcacgactgggtagataacgaacatgacgattgccagaccaacgtagatcgcaagaacaaacttgcccagggatccaagtgcagaccaaccgtaggtagcaacagcattaccgatcagcgcagcggaaccaattggagccaggcgaataatccaccacaacacgatctggatgatcttgaggaaggactcggtgaacttcaagaaaggctcggcggacttgccagccttcagagctgcaacaccaatcgcaatggagataaccaggatctgcagcacgttgaaggacaggttcacaccagagttctcactgtaagaaccggaaagtcccagaatgtttgatggaataacggactggataaagcccagccagctgcccacgcgagaaggatcagcagcattagatgcgtcgacagtggatccaacaccaggctgcataatcagcgctacggcgatacccgcgagcacagagaagaatgcagtaatggcgaaccacaccaaggtggaaacagccaggcgagcagcgttagctacctcgcgcaactttgccacactggtaaccactgcagcgaacaccagtggtggaaccataactttaagtagagaaacataagcagaaccgacgccgctaagaagaccggtaagccagcttgcttcaccgtctgcagcgccgctgtccatgcctcgggcgacaaggccgagaataagaccaagaatgaggccggcgataacctgggcaccaaagccagtcatccagccgggaaggccgaaacggcccttctgtgcggtggcgttagccatgggtagcactccttgcgtttagcggttgaattgaattcattaactgtaacgctgtagacaggaatttattgcattagtgtgaccaaattaaccgaagctgtctataaagattaaacagatctgtctatttttataccataacagcaggtcaggggaattatgatcaaatagacccataagtctagttttcacccccgcaaccacgcgctgaccgaaaacgagagaaaactgtcacgctcttcaaagataaatatgctattgaagccccttagaaaaatgcacaaaaaaattggggccctccagaaattctggaaagccccaactgattcaactgccgctaaaactagtcggtaatcgcatccaaaggtggtgtcctagatgccttgactgccggccacagcgcggcgataacaccgactacagcggaaccaacaagcatcagtccgacctgaccccacgggatactaaccgcagcgtctagtccttcgcctgacatcactgtcacaaaggcccagcccagaccaagaccaatcgcgataccaatcacagcaccgtagatggcgatctgaacagattctaaggtgatcatggtgcggacctgtccgcgcttcacgccaactgcgcggagcataccgatctcctggcgacgctcgatcacattcagtgccagggtgttgatgatgccgatgatggcaacaatgacagacagagcaagcagcgcgtacagaatgttcatcatggtgtcgatcatcgcaaccgtttcaccagcgaactcggttgctgatttcacagagatgacaatgtaatcagcgactgcgtcttccaagttggtgcgcagttgttccttatcaaagccttcttcgcctaccaccagcatcatctgaggaacagcagtgtctgccgctggtgtatcagccaaggaactttcggagatgatcatatttccgatggcgtcgtttccggtgaaggtaccgatcaactcgatatcgccgatggtctgccccattgattcaagctgcagagtatcgcctactgcccagccgttttcatcagcaaacgtctggttagtcacaacacctgggttgctcaagtcgagggagccatcaatgctttctgtgctgatgaccttgctcaggtcgccgtcagcgacaaaggttacagactggcccagctggctgtatgaagcctgaccgttcaccgaggcagagttcatggaaacgagcacgacatcggcaacgccctcagcatcgcgaacatcattgacagattccttcggcatggtgatggaaccgttggttggtccctgcaggatgtaatctgcggtgtactgctccgccatcatgtcggagactgcgtccttcatggttgcagaaagcatgccaattgcagtcactaaggcaatgcccaacgtcagtgcgaacgctgtagttgcggtacggcgagggtttcgcttggagttggtcgcagcaaggcttccaacgctgccaaacggtgcaccgataaccttgcccaggccacccaccacaggcatggagagcgctggtgagaagaggaacgtacccacgatgacaaacagtgcaccaatgcccaccaggatggaacgagtagcggtggaagaatcagtcatcatcgcaccggcaatcgcaaagatgatgccgagtgctagaacgatgccaccggtgatcgtgcgccccatcatggaacgcatagtggtggtttccatgttgcgcatcgcttcaacaggcttaacctcacctgcacgacgagccggagcccacgcgctcacaatggtgacaacggtgcccaatacgagcgcggtaaccactgcagaaggagtcaagccaacgctggatcccatcggcatgcccaggttattgaggacagctgaaatgatcgctacgaggcccataccacccagcacaccaagagcagagccgaagaggccaacgatggttgcttccagcaccacagagcgagtgatctgtcctggcgccgcacccagggctcgcaggagagcgaactcacgcatgcgctgagccacaatcatggagaaggtattcgcgatgatgaaggtaccaaccagcagtgcaatgagaccgaaggcaacgaggaagtactgcacgaagctcaaggcctgcgtgatcattcctgtagcctgctcgactagcgcttcgccggtttctacatcaaagttcgatccaagttcggcagcgagggcgtcgacaagctcttgaggcgtggtgccatctgcagccgacagcatgacgctggggacggtagccccgtcggtgtaacgctccaggtagccagcttccgacatctgcaggttcagcgcggtggccgaatccgtctcagtggtggtcaggcctgtgatggtgacgttgtagcggccactggagtccacgaccaagatctggtcccctactcccaggccattcgcctcagcgcccgccttcgaggcaagcacctcttcggtgccagtcggtgcctctccctcagccaattcaggtgcctgggcaaccgcgtcgtccgcgctgtaataaatgcttaacgacgatcccccagtcgtttgaattgccttggaatcagcatccgccagaacgacagtctgggaaccgttgatgttgagatggttgatgcgggaatcctcacgcaaagattcaaccgtctcaacaggaacaccctgcacctctgatgcaccgtttggtgaaaccaccacatccacgccgtcaaagctgctggcaatagcctcatcaaaagtggaggacagcgcgttggtaaacatcatcgcgccggaaacaaaagacgtgccgagcaccactgccagaactgtcaaaaacagcctgaccttgtgcgcgccaatattgcgcagactgattctgcgcattgtggaaccggaattcattaggcaatatcctcaattccgttcatcgtggccaagatttcctcgatggtgggatcaaacaactggttcacgatacgaccgtccgccaagaaaatgacacgatctgcataggacgccgccttggcatcgtgggtaacgatcacaacggtctgatcatcctgatcaactgcggtgcgcaggatatccagcacttccctagaagagttcgaatccaagttaccggttggctcgtcgccgaaaatgatctccggacgagacaccaacgcacgagcacacgccacacgctgctgctgaccaccagagagctctgcaggacggtgcttaaggcgctcagtcagacccagacgagaggtaatctcatcgaaccacgactgatcaatcttgcggcccgcgatatcggtaggcagcgtaatgttctccgacgccgtcagagtaggaaccaagttgaacgactggaaaatgaatcccaaacgatcacgacgcaaagaggtcatctctttgtccttcaaccgcgacagatccgtatcaccaatgaatgccgaaccaccagtcgcagcatccagaccagccatgcagtgcatcaacgtggacttacccgagccagaaggacccatgatggcagtgaacttgttcttctcaaactccacgttgacgtgatccaacgcggtgacagtggtatcaccctggccatacgccttgtacaggttcactgcgcgcgcagcggcttcaccagtcgagttattgacaggctgggaagagtcaatgtcagtcttcggcgtaaaagaagagtcccaattctccttcgcaacatcgtccgaattgttggcaggtgtgctcgcggcagggttactcatgaactacgatgctttccttaaattcaatcttgaaaacgtcaggccattttagaaaaacagcccaggtactcctgccagggtaccggagccaaaggacatacgaatcagggaagacccccaattaaaaatttatttgtcgaccaccatcgataagccaaaacagctcttcatgctggcaaaaagtttgtgcttgtcgacgcttgcccccaggcgcaggtgccgcgtgcacaaggggcccaagacccccacaaacacaaaaaagagagggtgcggtgaacacacaaccatgtgtatccaccacaccccctcaaacacgaataaacccagaaacacacagtgtttctgggcttatccatactattttaagtttttggtcggcggtaacctactctcccacaccctcccgagtgcagtaccatcagcgtaaccaggcttagcttccgggttcggaaagggaccgggcgtttccctgctactatcaccaccgacacaaccacacaccaaaccaaccaacaggttggttgtgttgtgtcagacactgcataatggacgcgaacactttatgtgttaatttgttttcgttacgttgcgttacaccaaaccgtaatggtttgttgttatcggtaaattagtaccagtcacctccacacctcacagtgcttccagatctggcctatcaaccccataatctctagggaacctcaaaagaaacctcatctcgaaacaggcttcccgcttagatgctttcagcggttatccctcccgtacgtagccaaccagccctgctcctggcggaacaactggcacaccagaggtacgtccgtcccggtcctctcgtactagggacagccttccttcaagtttcaacgcgcgcggcggatagagaccgaactgtctcacgacgttctaaacccagctcgcgtgccgctttaatgggcgaacagcccaacccttgggacctactccagccccaggatgcgacgagccgacatcgaggtgccaaaccatcccgtcgatatggactcttggggaagatcagcctgttatccccggggtaccttttatccgttgagcgacaccacaaccacaagtaggtgccggatcactagtcccgactttcgtccctgctccacctgtcagtgtcacagtcaagctcccttgtgcacttacactcaccacctgattaccaaccaagctgaggaaacctttgggcgcctccgttacattttaggaggcaaccgccccagttaaactacccaccaggcactgtccccaacccagatcatgggccaaggttaagacatccaatccgatcagagtggtatttcaccaacgactcacacacaactagcgtcatatgatcgaagtctcccacctatcctacacaaaccgaatcaaacaccaataccaagctatagtgaaggtcccggggtcttttcgtcctgccgcgcgtaacgagcatctttactcgtactgcaatttcaccgggcctgtggttgagacagcagggaagtcgttacgccattcgtgcaggtcggaacttacccgacaaggaatttcgctaccttaggatggttatagttaccaccgccgtttactggggcttaaattctcagcttcgaaaaaacaagttttcctaaccggtcctcttaaccttccagcaccgggcaggcgtcagtccgtatacatcaacttaaacgtcttcgcacggacctgtgtttttagtaaacagtcgcttccctctattctctgcgaccacaacacgctcccaacgaaaagttgttcacacgccgtggccccccttctcccgaagttacgggggcattttgccgagttccttaaccacagttcacccgaacgccttagtattctctacctgactacctgtgtcggtttagggtacgggccgaatatcaacatcgctagaggcttttctcgacagcacaggatcacccacttcaccctttacgggctccgcatcacgcctcacacaaaaacagtgcggatttaccaacactgcgtgccacacgcttacaccacaatccaataagtggctgagctacctccctgcgtcaccccatcacttagctactaccagatcaggtcccacgcaaccacacaccacaaaaaagcaaagccttttcgcgggtgcttatgggtggttagtatcactgattcaccatggtcgctcatactcgggtacgggaatatcaacccgttatccatcgactacgcctgtcggcctcgccttaggccccgactcaccctgggaagattaacttgacccaggaacccttagtcatccggcggatacgtttctcacgcatcattcgttactcatgcctgcattctcactcgcacacactccacccaaggtcaccccaaagcttcaacgcatgcacgacgctcccctacccaacaatcctataaagatcattgccgcggcttcggcggtgtacttaagccccactacattgtcggcgcggaatcactcgaccagtgagctattacgcactctttcaaggatggctgcttctaagccaacctcctggctgtcttcgcgaccccacctccttttccacttagcacacccttaggggccttagccggcgatctgggctgtttccctctcgactacgaagcttatcccccgcagtctcactgccgtgctctaacttaccggcattcggagtttggctgatgtcgctaagatgttggtcccgctaaaccatccagtagctctacctccggcaagaaacacacgacgctgcacctaaatgcatttcggggagaaccagctatcacggagtttgattggcctttcacccctacccacaactcatcccctcagttttcaacctaagtgggttcgcgcctccacaacctcttacagctgcttcacactggccatgggtagatcactccgcttcgggtccaagacatgccactaaaatcaccctcgttaggattcggtttccctacggctaccccacacgggttaacctcgcgacatgccgctgactcgcaggctcattcttcaaaaggcacgccatcacaccacaaaggatgctctgacggattgacagcacacggtttcaggtactatttcactcccctcccggggtacttttcaccattccctcacggtactaatccgctatcggtcatatcaagtattcaggcttaccgggtggtcccggctaattcacagcagattccacgagcccgctgctactcggggtatcaacaaccacacacaccaccatgatcttcgtgtacaggactctcaccttctacggcaggtgtttccacaccacttccactaaccacgcagcacatgcccacatccggcagaatatgaacgtcattgccccacaaccacctacatgcaacccctgccgggtatcacacacataagttttagccatcatccacgttcgctcgccactactaacggaatcacaattgttttcttctcctacgggtactgagatgtttcacttccccgtgtaaacctccacaccagctatacattcactggcaggtaaccacacatcactgcggctgggtttccccattcggacatcctcggatcaacgcttagttggcaactccccgaggcataacgcagcctctcacgtccttcatcggcttgatatgccaaggcatccaccgtgtgccctacaaaacaacaaacaaaatactataacccacacacaaagtgcgggcgcgttcggtatcacacaacaaaaaacaaaaaaataaagatgctcgcgtccactatacagttctcacacaacacaccacccccaccacaaccaaagaacacaacattctctacccgtgttgacgatgctcgatgttagaaacaacccacacacaccaccaaaaggtgatgcttgcgatgtcattccagacacccaacagcatgccacctattaatcacagcactgtttgctgtgttgttgtcacccgaggggtcatctccacccgattaaaaatatgttgatggcaaccacatacgggttccaacaccaacaacccaccaaccagacacagtctgatgtgggttaataaagctccttagaaaggaggtgatccagccgcaccttccggtacggctaccttgttacgacttcgtcccaatcgccgatcccaccttcgacagctcccccctaaaaggttgggccactggcttcgggtgttaccaactttcatgacgtgacgggcggtgtgtacaaggcccgggaacgtattcaccgcagcgttgctgatctgcgattactagcgactccgacttcatggggtcgagttgcagaccccaatccgaactgaggccggctttaagagattagctccacctcacggtgtggcaactcgctgtaccgaccattgtagcatgtgtgaagccctggacataaggggcatgatgatttgacgtcatccccaccttcctccgagttaaccccggcagtctctcatgagtacccaccataatgtgctggcaacataagacaagggttgcgctcgttgcgggacttaacccaacatctcacgacacgagctgacgacaaccatgcaccacctgtgaaccgaccacaagggaaaacgtatctctacgccgatccggtccatgtcaagcccaggtaaggttcttcgcgttgcatcgaattaatccacatgctccgccgcttgtgcgggcccccgtcaattcctttgagttttagccttgcggccgtactccccaggcggggcgcttaatgcgttagctgcggcacagaagtcgtggaagacccctacacctagcgcccaccgtttacggcatggactaccagggtatctaatcctgttcgctacccatgctttcgctcctcagcgtcagttactgcccagagacctgccttcgccattggtgttcctcctgatatctgcgcatttcaccgctacaccaggaattccagtctcccctacagcactcaagttatgcccgtatcgcctgcacgcccgaagttaagccccgggatttcacagacgacgcgacaaaccacctacgagctctttacgcccagtaattccggacaacgctcgcaccctacgtattaccgcggctgctggcacgtagttagccggtgcttcttctccaggtaccgtcaccataaggcttcgtccctagcgaaaggagtttacaacccgaaggccttcatcccccacgcggcgtcgctgcatcaggcttgcgcccattgtgcaatattccccactgctgcctcccgtaggagtctgggccgtgtctcagtcccaatgtggccgtacaccctctcaggccggctacccgtcgacgccttggtaggccattaccccaccaacaagctgataggccgcaggctcatcccacaccgcacaaggctttccacaccacccctacggtggtgtgaatattcggtattagacccagtttcccaggcttatcccaaagtgtagggcagatcacccacgtgttactcacccgttcgccactcatccaccaaagcaagctccggtttcagcgttcgacttgcatgtgttaagcacgccgccagcgttcgtcctgagccaggatcaaactctccacaaaaaacaataaatagattgtttaggccgtgaaaagcccaacacctgacaaaaacaacaacacccccaccaaccacacacaaaggtgacagttggagaatggggtgttactggcattatcaaaaaataatgattctaaaaaaacaccacaacccacataaggatcatcgtgtcttcaacgtgggcctagtcccttgacggggaacaagcagacccacaaaatcatgccaacaataagattattgtttacagtgatggataatttggcgatccaccacccggcatgacccaccacacatcacccaaggtgatctgtggtagtgacaaaaataataaatggcacactattgagttctcaaacaacatacgcacaccataagagcatcaacattgtttgtgttggtgtcttgttggcagcttgttcaacgttacttcatcttgtttactttcaccaaatcggtgtttgttgacttcgatgaagtgttgttggtttgtcgagcgtttgttttcctagatccgcctcactgtccacataatctcttatgtgttggggcgttgttggtcgcgctgactggaattaatttacacacccgcccaacagtccgcaactgcccaggtcaagcgctcttcttaccgggccacgcccggcaagaatgcgtggtgaggacgtggggcggcgtcgataagcggaaatcttgaaatatttaggtgtgatcttttggggggaggtatttaatgatcctaccaatcctttagtttcgtctgtagagcgatgtgtgacgcaagttttaagactctaaacccacgtcacaagaaatgaggggtgctttgtttactatcactggttttgcagatgagatcgcacatgatctcgacgaacagatttccttacttaataaactgaagaacagctcgcggaagctaaagccaaattggatgccgcaggaatttcactttcagccgttggatccgacttcggcaagatcaacatcaccgatccttttgaagatcacttggagcgcgcacgccacggtgttgaggtcgctaagctcttcggcgcgaaatacatccgcatgttctccttctttattgcagaaggcgacaaccctgaaagcttccgcaaagaagtactctcccgcacccacgcaatggtcgaactcgcagaagccggcggcatcaccctcctccacgaaaatgaaaagggaatctatggcgactccccgcagcgcgtgaaggatttaatcaccagcatcgactcccctaactaccgcgcaatctacgacgcagctaactacgtgcaaaccggattcaagccttttgatgaggcatggccgatcgttaaggactacgtcgactacgtccacatcaaggacgcgaccattccagatgcagagcaccccatcggaatcatcaagccagcaggacaaggcgacggccaatacccagagctccttgccgcgctaaacgccgacggttacaacggattcgtctccatcgagcctcacctgggtgacttcgatgaattcggcggactctgcggacctgacctgtggaccagcgcatgcgacgctctcgcaggaatcctgaacaacatcaacgccgagtacaactaaggacaactgataatgacaaatgctgcaattgtcggatgaggagacgtcgcaaccgttcatacagaagcgctggaagctttggcttccgatcttggtattaagttcgtcgcagtggtggataaagatctagagactgctgagaaatttgcgacgggacttggagctgctggcgattcttcagaaagcagcgtcaaggcccacggcagcctgccggctttgttctccaaaaagaagatcgatgttctacacatcaccaccccccacgaccaacacattggtttggctctcgaagcgctacaccacggtgtaaatgtcatcctggaaaagccgttggctaatgagttggaccaggcgcagcgtctcatcgactacttggatgaaaaccccgatggtccaaagattgcagtgtgctatcagaaccgttacaacgtttcctcccaggaactgcgtcgtctgctcgattcaggtgacctcggtgccatcaatggtgcatattcctctgtggtgtggacccgcaccccaggctactacacccagaaaccttggcgtggccagcaagcacactccggtggtggcctgctgatgaaccaagcaattcacaccctggatctgctgcagtggttccttggaaaggcaacagaagtcaagggcactgtctccaccgataagtatgccgatgtcatcgatgttgaagacaccgcacacgcatacatcggtcacgagtccggagtccacaccagtgaagtgagttgaaccatgctattggtgatacatattaccaatatgcgcttcttgtaatccagcacacatttaaaaagggggtaccgacagaacctcccttcaaactccgcaaagaaggtcgtatcaaagtttctaaatgtggttaccaaagccgagcacgtcaccagcgaaaatataagtaactcaactctcagatttagacaattcaaagcgttgcaaagtaattcacacttaaatacggggtagagaactcatcaatccacgccgcaaatctgccctaaaaaagtggttagcaagacagctgtttatcaatttttgaggcgaaatctagcccttcaaggagatgcgtaaaacgacaaaccaccagcgcatagaggtaaatcatcgttcaggtaccttcaaaacctcagttatgcaatcgttcttaatcaataatgaatgaactttgaagtgaaagaatctcacgtctgatctccccctgttaaacaccagacgagcttccgctctgcacaagccgctagaagccccgcatagccctaatgtagagctcatgcccatttggaatcacaacaccgcatatcggccatggctggtgtcaaagctcaaaggctcaagatcgcttctcgacgtcggctccggcgatcactccttcgccgacctggccggccgccaggtcgcgcatgtcgatgtcgtggatcctcttattaatacaacctttgaagaattccagccgacccaaagctacgatgccatcacgttcatcgcgtccctccatcacatgaacgcggaagaaggacttaacaaagcagtccgaatcctcaatcctggcggcaagctcctcatcgtaggcctcgccaaaaacaaaaccgcctccgactggatcatctccggactacaagcttttctctcccgaccaatcagcctcatcaatagggaacaacaaatctaccccttccctaccaaagaaccctcagagagtctccacgaaatacgacaactcaccaagcagctcctccctcaccgccgtattcgccgtggaatccacttccgatacctcctcgagtggacaaagccttaaacagccctataaaccaaaaaagggagtgatgaggacacacaaccatgtatcctcaccactcccacaacactttgtgcttgtcgacgcttacccccagggatcggtgccgcgtgcacaggggtctagaaagcacaaaagagaagaagcacgaaacaaacactgtctgtttcatgcttcttctcatatattgttaagtttttggtcggcggtaacctactctcccacaccctcccgagtgcagtaccatcagcgtaaccaggcttagcttccgggttcggaaagggaccgggcgtttccctgctactatcaccaccgacacaaccacacaccaaaccaaccaacaggttggttgtgttgtgtcagacactgcataatggacgcgaacactttatgtgttaatttgttttcgttacgttgcgttacaccaaaccgtaatggtttgttgttatcggtaaattagtaccagtcacctccacacctcacagtgcttccagatctggcctatcaaccccataatctctagggaacctcaaaagaaacctcatctcgaaacaggcttcccgcttagatgctttcagcggttatccctcccgtacgtagccaaccagccctgctcctggcggaacaactggcacaccagaggtacgtccgtcccggtcctctcgtactagggacagccttccttcaagtttcaacgcgcgcggcggatagagaccgaactgtctcacgacgttctaaacccagctcgcgtgccgctttaatgggcgaacagcccaacccttgggacctactccagccccaggatgcgacgagccgacatcgaggtgccaaaccatcccgtcgatatggactcttggggaagatcagcctgttatccccggggtaccttttatccgttgagcgacaccacaaccacaagtaggtgccggatcactagtcccgactttcgtccctgctccacctgtcagtgtcacagtcaagctcccttgtgcacttacactcaccacctgattaccaaccaagctgaggaaacctttgggcgcctccgttacattttaggaggcaaccgccccagttaaactacccaccaggcactgtccccaacccagatcatgggccaaggttaagacatccaatccgatcagagtggtatttcaccaacgactcacacacaactagcgtcatatgatcgaagtctcccacctatcctacacaaaccgaatcaaacaccaataccaagctatagtgaaggtcccggggtcttttcgtcctgccgcgcgtaacgagcatctttactcgtactgcaatttcaccgggcctgtggttgagacagcagggaagtcgttacgccattcgtgcaggtcggaacttacccgacaaggaatttcgctaccttaggatggttatagttaccaccgccgtttactggggcttaaattctcagcttcgaaaaaacaagttttcctaaccggtcctcttaaccttccagcaccgggcaggcgtcagtccgtatacatcaacttaaacgtcttcgcacggacctgtgtttttagtaaacagtcgcttccctctattctctgcgaccacaacacgctcccaacgaaaagttgttcacacgccgtggccccccttctcccgaagttacgggggcattttgccgagttccttaaccacagttcacccgaacgccttagtattctctacctgactacctgtgtcggtttagggtacgggccgaatatcaacatcgctagaggcttttctcgacagcacaggatcacccacttcaccctttacgggctccgcatcacgcctcacacaaaaacagtgcggatttaccaacactgcgtgccacacgcttacaccacaatccaataagtggctgagctacctccctgcgtcaccccatcacttagctactaccagatcaggtcccacgcaaccacacaccacaaaaaagcaaagccttttcgcgggtgcttatgggtggttagtatcactgattcaccatggtcgctcatactcgggtacgggaatatcaacccgttatccatcgactacgcctgtcggcctcgccttaggccccgactcaccctgggaagattaacttgacccaggaacccttagtcatccggcggatacgtttctcacgcatcattcgttactcatgcctgcattctcactcgcacacactccacccaaggtcaccccaaagcttcaacgcatgcacgacgctcccctacccaacaatcctataaagatcattgccgcggcttcggcggtgtacttaagccccactacattgtcggcgcggaatcactcgaccagtgagctattacgcactctttcaaggatggctgcttctaagccaacctcctggctgtcttcgcgaccccacctccttttccacttagcacacccttaggggccttagccggcgatctgggctgtttccctctcgactacgaagcttatcccccgcagtctcactgccgtgctctaacttaccggcattcggagtttggctgatgtcgctaagatgttggtcccgctaaaccatccagtagctctacctccggcaagaaacacacgacgctgcacctaaatgcatttcggggagaaccagctatcacggagtttgattggcctttcacccctacccacaactcatcccctcagttttcaacctaagtgggttcgcgcctccacaacctcttacagctgcttcacactggccatgggtagatcactccgcttcgggtccaagacatgccactaaaatcaccctcgttaggattcggtttccctacggctaccccacacgggttaacctcgcgacatgccgctgactcgcaggctcattcttcaaaaggcacgccatcacaccacaaaggatgctctgacggattgacagcacacggtttcaggtactatttcactcccctcccggggtacttttcaccattccctcacggtactaatccgctatcggtcatatcaagtattcaggcttaccgggtggtcccggctaattcacagcagattccacgagcccgctgctactcggggtatcaacaaccacacacaccaccatgatcttcgtgtacaggactctcaccttctacggcaggtgtttccacaccacttccactaaccacgcagcacatgcccacatccggcagaatatgaacgtcattgccccacaaccacctacatgcaacccctgccgggtatcacacacataagttttagccatcatccacgttcgctcgccactactaacggaatcacaattgttttcttctcctacgggtactgagatgtttcacttccccgtgtaaacctccacaccagctatacattcactggcaggtaaccacacatcactgcggctgggtttccccattcggacatcctcggatcaacgcttagttggcaactccccgaggcataacgcagcctctcacgtccttcatcggcttgatatgccaaggcatccaccgtgtgccctacaaaacaacaaacaaaatactataacccacacacaaagtgcgggcgcgttcggtatcacacaacaaaaaacaaaaaaataaagatgctcgcgtccactatacagttctcacacaacacaccacccccaccacaaccaaagaacacaacattctctacccgtgttgacgatgctcgatgttagaaacaacccacacacaccaccaaaaggtgatgcttgcgatgtcattccagacacccaacagcatgccacctattaatcacagcactgtttgctgtgttgttgtcacccgaggggtcatctccacccgattaaaataatgttgatggcaaccacatacgggttccaacaccaacaacccaccaaccagacacagtctgatgtgggttaataaagctccttagaaaggaggtgatccagccgcaccttccggtacggctaccttgttacgacttcgtcccaatcgccgatcccaccttcgacagctcccccctaaaaggttgggccactggcttcgggtgttaccaactttcatgacgtgacgggcggtgtgtacaaggcccgggaacgtattcaccgcagcgttgctgatctgcgattactagcgactccgacttcatggggtcgagttgcagaccccaatccgaactgaggccggctttaagagattagctccacctcacggtgtggcaactcgctgtaccgaccattgtagcatgtgtgaagccctggacataaggggcatgatgatttgacgtcatccccaccttcctccgagttaaccccggcagtctctcatgagtacccaccataatgtgctggcaacataagacaagggttgcgctcgttgcgggacttaacccaacatctcacgacacgagctgacgacaaccatgcaccacctgtgaaccgaccacaagggaaaacgtatctctacgccgatccggtccatgtcaagcccaggtaaggttcttcgcgttgcatcgaattaatccacatgctccgccgcttgtgcgggcccccgtcaattcctttgagttttagccttgcggccgtactccccaggcggggcgcttaatgcgttagctgcggcacagaagtcgtggaagacccctacacctagcgcccaccgtttacggcatggactaccagggtatctaatcctgttcgctacccatgctttcgctcctcagcgtcagttactgcccagagacctgccttcgccattggtgttcctcctgatatctgcgcatttcaccgctacaccaggaattccagtctcccctacagcactcaagttatgcccgtatcgcctgcacgcccgaagttaagccccgggatttcacagacgacgcgacaaaccacctacgagctctttacgcccagtaattccggacaacgctcgcaccctacgtattaccgcggctgctggcacgtagttagccggtgcttcttctccaggtaccgtcaccataaggcttcgtccctagcgaaaggagtttacaacccgaaggccttcatcccccacgcggcgtcgctgcatcaggcttgcgcccattgtgcaatattccccactgctgcctcccgtaggagtctgggccgtgtctcagtcccaatgtggccgtacaccctctcaggccggctacccgtcgacgccttggtaggccattaccccaccaacaagctgataggccgcaggctcatcccacaccgcacaaggctttccacaccacccctacggtggtgtgaatattcggtattagacccagtttcccaggcttatcccaaagtgtagggcagatcacccacgtgttactcacccgttcgccactcatccaccaaagcaagctccggtttcagcgttcgacttgcatgtgttaagcacgccgccagcgttcgtcctgagccaggatcaaactctccacaaaaaaacaataaaaaagattgttcaggccgtgaaaagcccaacacctgacaaaaacaacaacacccccaccaaccacacacaaaggtgacagttggagaatggggtgttactggcattatcaaaaaataatgattctaaaaaaacaccacaacccaaataaggatcatcgtgtcttcaacgtgggcctagtcccttgacggggaacaagcagacccacaaaatcatgccaacaataagattattgtttacagtgatggataaaattggcgatccaccacccggcatgacccaccacacatcacccaaggtgatctgtggtagtgacaaaaataataaatggcacactattgagttctcaaacaacatacgcacactaacttgatcaccttgctcggtgtctcgtaagcagcttgttcgactttacccttatcgttaatcagaaagcaacttgcgttaattcctgaagaattttgggagtctgtcagcgtttcaatttcccttgctgtgaagctcggttcgttgcgctgactcgaattaatctacacagcccctctgacaagcacaaacccccagctcaatgatggtttcgctgggggatgcttgatgggaaggcttcgttaggaagaaaccctttcgatggtcgctccgagtttctgcagattttccacgaagttggggtatccgcggtcgatgtggaaaacatcgtgaacttcggtcactccgtctgcgcaaagggcggcaagaaccagtcctgctcctgcacggatatctgaagaccacacggaagtagaggaaagctgttcaattcctcggattactacgtggtgcccatcgacattcgcgtcagcgcccaggcgaagcatttcatcgacgaagcggaatcgtgattcaaagacattctctgtaattactgaagttccattagatactgcgttgattccaattgccatgggttgcagatctgtagggaaccctgggaacgggagggtttggtagtcggttgcctcaggctgcttatccatttggacgcggaagccgttttcgtaggtttccaccttggcgccggcgatcttgagcttttccaatggaaggtgcagataccttggtgcgattccgccaactgtaatatcgccacgagtcatcgcagcggcgtatgcccacgttccggcaacgatgcggtcgccgattacttcgtgctgagttggggtgagtttctctacgccttcgatggtgatggttgggcttccttcaccttcaatgttggcgcccatggatcgaagcatacggcagagatcaacaatttctggttcgcgcgctgcgttatctaatactgtgcgtccttctgccatgacggatgcagtgaggatgttttcggtggcgccgacggacgggaaatccagggtgatgttggcaccgacgagcttttcagcttctgcaactactgcaccgtgggaaatgcgggtggtggcaccaagcttttccaggccgctttgatgcatgtcgagtggacgggatccaatggcgtcaccgccgggaagggatacaactgcgcgaccacaacgtgctgtcaatggaccaagcacacatacggatgcacggaattgggtgactgctgggaagtcagcattggagctgagttctgcaggggtagtaatggttacggttgagccgtcgatggtgacatcgcagccaagaccaacgaggacgtcgcgcatcagggggacgtcgaggatttcggggcaattggttagagttgttgtgccttcagcgagaagtgctgctgccatgagcttcaaaacgctgttttttgcgccgtaaacttttacagcgccctgcagctgtgctccaccagtgactaaaaacttgtctttcacgtgccccaccttatccgtgttccccacccctgtgcgtaacgacagctagaatctcaagttatggccgttcatttaaccaagatctatacgcgaaccggggacgatggaaccacggggctctcaaattttgagcgagttcccaaggacgatccccgccttattgcatacgccgactccgatgaagcaaactgtgcgattggccaagtgcttgcactcagcagccctacggaagatatggcaaccttattgcggactattcaaaatgaactttttgatgtgggcgcagacttagcaaccccgattgaggagaatccgaagtatcccccacttcgagttcttccggaatatatcgaacgacttgagaaggagtgcgataaatggaacgaggatgtgccggcgttggattccttcattttgccgggtggcacgccagcagcggcactcttgcacaccgcaagggtaattacgaggcgcgcggagagagcagcttggatagcggtgcgggaatttccgagcaccacctctaccttgccagcccaatacctgaatcgtcttagcgatctgctgtttattctttcccgtgttgccaacaatggcaatgatgtgaagtgggttccgggcggaaaaagatgaaaaccaccctgcgaccgtgattgaaacggtgcagggtggcgtcgtaaagcaaaatctttttaaggcagtgcgccgatccggcgtgctgcgttgactgcctcgtagcgcgtgtgggcgccgagcttgcgcatgaccgagcgcaggtagctcttgacggtttccgcgccgatgcccatctcttcagcagcttcgacgttggtgtgaccgagcgcgacacaagccagcacgtccaactcacgcgcggacagcttggtggtctgcttgatgcggactggggtgaccatctgatcgcaaagctcttccaaatcgcggcgcagatcctcatcggtcacacgatttgccagcatgcgcagcttggaatgagtggaacgaacctgctcccactccgccccattcatcacgcggttagctttgagggaaccgcgaccatcaggaacgccattgcggcgaagcgcggagttgatcgccaggttttgttccaacgtgcgcgcagtcatggtgacttcttcaataacagtgtcgccgagacgcaccgcagagtgaacgccaacatacaaaacgccacgaatttcgcggtgcacgatcacgggaactgcgacaatggaatgaaggccctcatcctgaatcgcggaatccttctcatgtgaaatgacatttgccctggtgtaatcactcacaccaaccggacgacgggttgcgacgacgcgtccaccaacgcccacacctggttcaatgaccagattctgcagagccggggtacgcaacccaacccactgagtaatttgcaggcgattgtcctgcaacacagtggcgaacatggtgactgggatgcctgttgcggttttcagcgatgtcagcgccgaacgaatagcatcttcgtcatctttaatccgctgggtatccaccttcagatttcctcctgctttacacccgtgctggtacacccatagggcgcgtcacgagtaacaatcattcgacaagggtacagtgtacttcccctttgggggtgaacatagtcgaggcggatcgccaatatgttggcacgggtgtccatttgccttgtttttcgggggtatttaaataagttccccacccctcaagggccacccccgccaccccaaccacccccgaagaggtagttaacccccagttcacgccggttttagagaaaaactcaaatccctgtccggtcagccacccctcaacacacccgctacccccatttgcggtattagctaaactcaagtttgctgaaattagtgtcatagaacacctttttccttgtggaaaaagtgaaattattggacgaaactgccaaacctttgagatttttccgacaacggacttctttaaaagatgcttttcgacgccgctccccaaccattaaccccgcgagaaatattcatcgaatagatgtcgatctacctgcaaatacgctcggtctacaaataatgaacagaactgtctacttttcaaactgctttttgtgtagactcaagtcacagaggccacttcaagtagatgtttcgtaattgtttacagcgtttacgcaagcggtcgaccaacaaaaacagcacttcaatgattggagcaccacccgacatgggcaatgtgtacaacaacatcaccgaaaccatcggccacaccccactggtaaagctgaacaagctcaccgaaggcctcgacgcaactgtcctggtcaagcttgagtcattcaacccagcaaactccgtcaaggaccgtatcggtctggccatcgttgaagatgcagagaagtccggtgcactgaagccaggcggcaccatcgttgaagcaacctccggcaacaccggtatcgcactggcaatggtcggcgctgcacgcggatacaacgttgttctcaccatgccggagaccatgtccaacgagcgtcgcgttctcctccgcgcttacggtgcagagatcgttcttaccccaggtgcagcaggcatgcagggtgcaaaggacaaggcagacgaaatcgtcgctgaacgcgaaaacgcagtccttgctcgccagttcgagaacgaggcaaacccacgcgtccaccgcgacaccaccgcgaaggaaatcctcgaagacaccgacggcaacgttgatatcttcgttgcaagcttcggcaccggcggaaccgtcaccggcgttggccaggtcctgaaggaaaacaacgcagacgtacaggtctacaccgtcgagccagaagcgtccccacttctgaccgctggcaaggctggtccacacaagatccagggcatcggcgcaaacttcatccccgaggtcctggaccgcaaggttctcgacgacgtgctgaccgtctccaacgaagacgcaatcgcattctcccgcaagctcgctaccgaagagggcatcctcggcggtatctccaccggcgcaaacatcaaggcagctcttgaccttgcagcaaagccagagaacgctggcaaaaccatcgtcaccgttgtcaccgacttcggcgagcgctacgtctccaccgttctttacgaagacatccgcgactaattcttagcgactgttaaccactcaagctctttgcttgggtggttttttcatgtctcaaggtcgggtcgggtgcgattcgggtcggttttgagtgtctttgagtccttttaagtccttctttgcccgtgaataattctctggatagtttccacgtgcagttaagtcacgctgttagacttgcctgcatgctctcgacaataaaaatgatccgtgaagatctcgcaaacgctcgtgaacacgatccagcagcccgaggcgatttagaaaacgcagtggtttactccggactccacgccatctgggcacatcgagttgccaacagctggtggaaatccggtttccgcggccccgcccgcgtattagcccaattcacccgattcctcaccggcattgaaattcaccccggtgccaccattggtcgtcgcttttttattgaccacggaatgggaatcgtcatcggcgaaaccgctgaaatcggcgaaggcgtcatgctctaccacggcgtcaccctcggcggacaggttctcacccaaaccaagcgccaccccacgctctgcgacaacgtgacagtcggcgcgggcgcaaaaatcttaggtcccatcaccatcggcgaaggctccgcaattggcgccaatgcagttgtcaccaaagacgtgccggcagaacacatcgcagtcggaattcctgcggtagcacgcccacgtggcaagacagagaagatcaagctcgtcgatccggactattacatttaagaacagttagcgccctacctgaagttcaggcagggcgcttttttgggaagctccagagtgcgtttgttagccacgcactagggacctttaaccgtctaaaaccgcccctgtgcgcttctcagcactacccgtgagaaccacccccctgtgccagctagttctttagatccttatactcagggttcttctgaatgaagccagcgactgcagagcaagcatcatgaatacggataccggactcacgtgcatcatccaaagcaaacttgatcaatggcgcagacagtccctgtccacggaattcaggcttaataacagtgtggttgaagttgcggatatccgggccgtctaaatagctggcaaatccagctggcgttccatcaacgctgataacaaagcgcttctgtccttcattgtggacaatctcaatgtttttgttctcgctcatgtgcgttctcctcggtatctcatcccggtggaattaaccggaactactcttcctttataccttttgaacacaaagacaccctgttttatttcctaagaaataaaacagggtgtagatggtggccagagccgggatcgaaccggcgacctttcacttttcaggcgaacgctctaccgactgagctatctggccaggggctgctctacagtatagaccaactccagcgaccctgacgggacttgaacccgcgacctccgccgtgacagggcggcgcgctaaccaactgcgccacagggccttaaagccatgcactattcagtgtttgtcacactgtcctgcgcacagatgaatactctacacagaccgggcgattagccacaaatccgctggtcaaagctaagatctgtggcctgttagttacaaagctgcaactacctcacgcataagcttcgcggtttcactcggagttgttcccacgcgaacacccacggcctccaatgcatgcttctttgctcgcgcagtgccttctgaacctgtcacgatggcgccagcatgccccatggtctttccttcaggggcggtaaagcctgccacgtaacccacaactggttttgtcacgtgcttagaaatgaagtcagcagcgcgttcctctgcatctccaccgatctcaccgatcatgacgattgccttggtctcaggatcagcttcaaaggcctccagagcgtcgatatgggttgtaccgatgattgggtcaccgccaataccaatcgccgtagaaatgccaatatctgaaagttcgtacatcatctgataagtcagtgttcccgactttgagatcaacccgatcgggccggaacctgcaatgtttgccggcgtaattcccgcaagagattcgccgggagtaataatgcctgggcagttagggccaatgatgcgggtgtgtcccaccttcttggcataagcccacgcctcagaagcgtcacgcactgggatgccctcagtaataatcacgcacagtgggatgtgagcgtcgatagcttcaatgatcgcagctttggcaaaggctggaggaacgaaaattacggtgacatccgcacccgtttcctccattgcttccttaacagtgccaaatacaggcaactcagtgtcattgatcaaaatggtttgcccagctttgcgggggttggtgccacccacgagcttcgcaccagaggctaaaattcgacgcgcatgctctgaaccttccgaaccggtaatgccctgaatgatgatgcgggaatctgaattgagaaaaatagacatgattaaacaggtgctccttaactaattagcggttgcgaactggccgtgctgggcaagattggccaaatgggcagcgtgatcagccgctgcatccataccctccacaacggtgaccaaagggtggttatattccgcgaggattcgtctgccttccaccacgttgttgccatcaaggcgcaccacaagaggcttcgttgcttgatcgccgagcacatccaaagctccaacgattccctttgccaccacatcacacgcggtgatgccaccaaacacattcacaaacacactgcgtacctggctatccccaaggatcacatcgagaccagcagccatcgattcagctgatgctccgccaccaatgtctaggaagttcgcggggcgctgcccaccatggcgttcaccagctgcagccacgatatccaacgtggacatcaccaaacctgcaccattgccaatgatgcccacagagccatcaagtttcacgtagttcagatcattcttcttggccttcagttccaaaatgtccaagccaccggcagattcagccaacgcaccacggttatcatggcggaaatcagcgttatcatccagcgtgatcttgccatcaagcgcaatcacatcgccgtcatccgtgagcaccaacgggttcacctcaacgagtgttgcttcctcttcgtaatacacctgccagatcttgatcagcaccggaatgactttctctgccacctcagtttcaaagccagcagcagtgacaatctcccgcgctttgtcctcatcaataccagtgaggggatccacttccacctttgccaaagcttcaggcttttccttcgccaggatctcgatctccatgccaccttcaacagagcacatagccagatacgaacgattcgcgcgatccaacaaaatggagaaatagtattcctcagcaatgtcagcgccctgcgccaccatcacctgattaacagtgtgtcctttgatatccatgccgagaatcgcatccgcagcatcaaaagcctgagccgacgtcggtgccacacggacgccacccgccttgccacgtccgcccaccttgacctgagccttgacgacggtcagtccgccgatttcctcagccgctttcctcgccgcctctggtgttgatgccacaattcccttcaacactggcacaccatgggtttcaaagaggtcccgtgcttggtattcaaaaagatccactgccaattccatttccggcccatgcttagagccttctgcgtctttaacaaagtcttcccgtaaaagtaagtgtttcaactcaccaatatgatcgtattgtgaagtctaacactgtaaactttgcaaattgcaacaaaattggatccgtggtgctcagcccccaccccttgggaacttttccgcaggttttccggcaactagccggtcaaaacatgacatccgtgaggcttaacctgacagcccctagagttcgacttcttaacaccgacttctcaaaggcgacttcactaggaaatccaggaaaatccgactgaaatcgaccacgagaagttgagcataagaagtcgctaccgtgaagtcgtaagcaagaagtcgaacttaagaaacccccgctcttaagaaacccgaaacctgagaccccaaaaacacaccagaaaataaaaaacagaggctgtacaatttcttgaagaaaaagtacaacctctgttatcacattgctgcgaccctgacgggacttgaacccgcgacctccgccgtgacagggcggcgcgctaaccaactgcgccacagggcctcatgtgcagcatttcactgctacttcctttggggaagtagtactcccaacgggattcgaacccgtgtcgctgccgtgaaagggcagtgtcctaggcccctagacgatgggagctcgtcgctcttggcgactggataagaatatacgtgacttttttcaaaccgcaaaatcgcgccctgacctgcatgtttagagacatgttttgtgaaggtttgaaagcagtcacgcacataggtcccaaaagttagttgcaggtgccgtcgacggagcagctttggccgtcaatgacctcaaatgggctgactgggttttcggctgcccactcttcgaaggctttttctacggtgccggtgaatacttcttcttgttgggcgccgttgatggcgtatttgcggtcgaatacaaagaagggcacaccttggacgccgagttggcgggcttcgtggacgtcttgttggacttcgttggtgtacacgtcggattcgagagcttcgcgggctgcactggcatcgagaccaacctctgcagcaatggagaccagcacatcgaggtcatcaacgttcttgccgtctacgaagtgagccttgaagagttcctgcgccacttcttgttgcttgccgtgggctttcgcgaagtgggtaaggcggtgcgcgttgatggtgttggccgcgatggtttcgtcaggattcatttcaagtccggtggcttgtgccattgcttggacttggccgttcatttggcgggcctgctcgaggctcatgcccttggcgtcggcgaggtattcaacgtcggaacgcagtgggtgggtttctaggcctggcatgagttcgaagctcttgtattccacttcgatgcgtccggcctggtcaaaggtacttagggcgtcgtcgaggcgctttttgccgatgtagcagaaggggcacatgatgtcgctccacacttcgattttcatttttgctggtgcggagaattcaatagacatagctttaaacgtcctcgttttacgcgtagttggaatagatttattcatatatcccaaccacatgcgcccgctaactattccgcgcgataactgatgtgacggtttcgagcatggtggtgaagccgggttcttcgatgggaaaatgcccgcagtccttgagcataaccacgtcagtgggcgctttgaggcgcgaaagcgtacgcagactgagctcaacgggagtcagaaggtcgtggtcagggtgcatcagagtgacgggaactgcacccagtttggccttgtgttgcacatatgacgcgaggaaaccccaggttattttggatgctccgctaaattcatcggccgcgcacaatttgctcagggctgggctgcggctgattttgctgaagttcaacactctggtcacgggaatttcgcggttgcgcaagcggccttggatcaaccgagtcagcggtgaaaacctgaacagtgcccggcgcgtcggctggtcggaggggttgagcaggcaggtggcaatgacgtgtgcgaccagtcctgtgcggtgtgcagcttctgcgcaaagcaagcctccggtgcctgcaccgatcaggatgagtggccgaccgtcgtcttcggaagagatgaaagattctaaaaggcgcagccaatcgtcgtaaagcggagttttaggcaggtcgatcgcggcgaggtccgcgccctcaatggccgcgacgaggggccagagggcgccactatgggtgcctagcccatgcaccacgataacgcggacgggcgcttctcgacgtctccttgcaatgtgaacccttttgttttcccattcccaaaaggtgtgctcgggttcaatccccgtacgatgcttgagcggtatgaaggcctcgtatgggttggtcatactcccaacctaacaaaaggtcttcatttttctcagcagctactgtgtgtgaggaaaagaaaagtacccctggctcggagcattctccaaaacaggggtacttaagatgtgggcccattgggactcgaacccaagacctgcggattaaaagtccgtagctctaccaactgagctataggcccaactcagaccatattagtacatggcaccggccttattaaaatcgccctcaattagctaccaaacactagcctgacctggtctaatttaacgctcaaaacccaggtaataaaagaaaccgccgcctcgaaatgttgtcgaggcggcggtttctaaaccaagaaaaaacttatgccttcatggagccgttcttagccaggttgatgtggaaatcaaacgcggttgcaagatcatgaggggtctgcatgtacttgttgtcaccggaggttgcgcgagcgtagtactcctcgagcagtgggcggtaatcagggtgagccaggccgatcatcttggcaacgcgctcacgtggagccagaccacgaaggtctgcgtaaccgtactcagagataacaaccatgacatcgtgctcggtgtggtcgatgtgggatgcgaaaggaacgatcgcagagattgcgccgccctttgcctctgaaggggtgatgaagctggagatgtagccgttacgggtgaagtcgccggagccgccgatgccgttcatgacgcgggagccagaaacgttggtggagttgacgttgccgtaaatgtcagcctcgatgagaccgttggtggcgatcaggccaacgcggcggatgacctctgggtggttagagatctgctgtgggcgcaggataatggactcgcggtaacgcttagcctcgttgttcatcttctctgcgtactcaggagacagggagaaggaagttgcggatgcaacggtcatcttgccggcgtcgatgaggtccaccatgccgtcctggataacttcggtgtaggcctggatgttctcaaacttggattccagcaggcctgccatcaccgcgtttggcacgttgcccacgccggactgcatgatgtagccgtcgtaggacaggcgacctgcagcaacttcgctttccaggaagtcgaggaagttgccagcgatcttcttagagatgtcgtcgacaggcttgaatggtgcgttgcggtctgcggtgttggtctcaacaacagcaacaaccttgtcggtgtcgaactcgatgtaggtcttaccgatgcggtcgcctggcttgttgattggcacggcaatgcggtttggcagggcaggaacagaccagatgtcgtgcataccttcgaggtcttcagactgccaagagttaacctcgaggatgaccttctctgcagcgttgagccactcaacgttgttacccacggaggaagaagggatgatgtagccctcttcagtgatgcgggtgatttcaatgacagctacgttgagctggccgaagaagccctcttcaacctgctggccggagtgggacaggtggatatcggagtatcccatggagccggagttgatcttgttacgcatgattggatcagatgcgtatggcatgcgccagcggatagcgtcagcttctgcaagtacgccatcgcagtcaggggcggtcgatgcgccagtgaacaggtcgattgcgtagtcgttgcctgcaccgtgtgcttctttagcccggttagcgattgccgtaggcagtgcctttgggtagccagcgccggtgaagccggagaaaccaaccttgtcaccgtggttaacaaactgtgccgcctcgtcggcggacatgagcttggagcgcagcttttctgaagcaatgcgatcagacattgaatacctcctcaggtaatcggactttttcaaatttttcccgcactgctatacccaagcagaacacataggtgtgccacttcagcaagcagaatgcgaccattttaacgtccgacaaaattcgttaacgcagttcacaccattgcttcaaggttcgaccaatcttttcagataggtcacttcaaccggaagcatatgatgtaccccactttgatgttgtgtcccaaggataaaccatcgtgacaggaaatgcccgaatactatctgtgatagtgggatttcaaggcccagcattacccccaaatttgcatgccccctgtttgcaagcctcccaaagcccaggaataaagctcagaccaaccctagagcccgcgaagcttaacccaaccccagcccccaaaaagtgaaagcacaccactttcctagttgcgccctgctcacaatttgcttcaaatattttgcccaacctgattcacgggggacaatagttaggtgactttaaaaatcggcccctttgaccttgcctcccctgtggttctagcccccatggctggtgtaaccaacgttgctttccgcacgctgtgccgtgaacaggaaatgcaacgcacgggaacaatctcggggctgtacgtctgtgaaatggtgactgcgcgtgctcttgttgagcgcaatgagaaaaccatgcacatgaccaccttcgcgccggatgaaaatccccgaagcttgcagctgtacacggttgacccgaagtacacctacgaagcggcgaagatgatcgttgatgaaaacttggcggatcatattgatatgaactttggctgcccggttccaaaggtcacgcgccggggtggcggttctgcgattccttacaagcgccgtttgtttgaaaacatcgtttccgcggctgtgaaggctacggaaggcacggacattccggtgacggtgaagttccgcgttggtattgatgatgagcaccatactcacttggatgctggacgcattgctgtcgacgccggcgcgaagtccgtagcgcttcacgcccgcactgcggcgcagcgctattccggtgaggctgattggaacgagatcgcgcgcctgaaggagcatttggcagataccggcatcccagttttgggcaatggcgatattttcgcggcatccgatgcaacgcgcatgatggagcaaactggctgcgatggcgtcgtggttgggcgtggttgcctgggcaggccttggctctttgctgagctgtctgctgctgttcgtggagaagaaatcccagaggagcctaccttcggcgaagttacccaaatcatcctgcgccacgcagaactcctcatgcagcatgatggcgaaaccaaggggctgcgcgatctgcgtaagcacatgggttggtacctgcgcggtttccctgttggcggcgaattccgctccaatctggccaaggtttccacctatgtggagcttgaggatctcctagcaccatgggctgactccaccgccaaggcagaggacgcggaaggtgcacgaggtcgacagggcgctcctgcaaaggtggcacttccagatggctggttggacgatcctgaggatgccactgttcctaaaggcgcagaaatggaaaactccggagggtagttaatttaatacttacccccgccaatagttggctatcccccattattaggtgattcaatcttaaaggggtgttttaggcctgcagaaataccattatcgccttatagtgttgccatgcgtactgcatatagacagcaattggatgaattcgcacacaatctaatcattttgtgtgatctaactaaggagtgcatggataaggcgactgatgccctcctgcgcacttctttggcatcggcagaaagcgctttaggcaatgcagaaaagcttgaagagcttcgtactggatgcgagtctcaagccgtcgaacttttggcgcttgaaactcctgtagcccgtgatcttcgccaggttgtctcctccatctacatcgtcgaggaaattacccgtatgggtgctctggcaatgcacgtggctaattccgtgcgccgccgttaccccgatccggtgatcccggaggacatgcgtggctatttcaaggagatggcccgcctcgcagctgacatgacagatcatattcgtcagatcctcattgatcctgaaccagatcttgccctagagatggctaaaagcgatgacgcggtggatgatctgcatcagcacatcatgcgtattctcacgctgcgtccttggcctcacgacaccaagagcgcggttgatttgacgctgctttcccgcttctacgagcgttacgccgatcacacggtaaacgtggccgcccgtatcatttacctgtccaccgggctgcacccggaggagtacatggaaaagcgcgagcaacaaagggccgatgccgacatggagaagcgctgggccgagctggagcggcagttccgcaccagcgagtaaaaagctgcttctcgacgctaaaagccactacccaccatctgaaattaatcaggtggtgggtagtggctttaattcttcgatttatccgaagcggccggagatgtaatcttcggtttccttctgatctgggttttcgaagatcttcttggtaggtccgatttcaaccagacgacctggcctaccggtcgcctccagggagtagaacgcggtctgatcggacacacgtgcagcctgctgcatgttgtgggtcacgatgacgatggtgaactcttccttcagctcgtggataaggtcctccacagccagggttgagattgggtcaagcgcggagcaaggctcgtccatgaggaggatttctggctcaaccgcgatcgcgcgagcgatgcacagacgctgctgctgaccaccggagaggccgccgcctggcttgtccagacgatccttaacctcttcccacaggtttgcgccacgaagagacttctcagcaacttccttgagcttcttcttgttcttctcgccggaaagcttcagacctgcaaccacgttgtcctcgatggacatggttgggaatgggttagccttctggaagaccatgccgatggtgttacggactgcaactgggtcgatcttggagccgtagatgttctcaccgtcgagaaggatctcgcccttgacgtatgcacctggggtgacctcgtgcatacgattgatggagcggagaactgtggacttgccacagccggatggtccgatgaatgcggtgacagagcgtgcaggaacctcgaggttcacgttctgcactgcgtggaaatcaccgtagtagatgttgacatcattgagcttgagcttcgacatcgctttagatactcctgttgtattttctgagattattattgcttgacagagaacttggcggagatgattcgtgcgccaatgttcaggacagcgatgatgagcaccagggtgagggctgcgccccacagcttgtccagcgttgctggtgcggtgccggccttgtacatatcaagcatcatcagtggaagggaagcctgcggaccgccgaatgggttccagttgatggcctgggaggaaccaaccaagaccagaactggtgcggactcacccatgacacgagcgactgcgagcatgacgccggtgacgataccggacagtgcggttgggagaacgatctttgcgatggtcttccactttggcacgcccagtgcgtaggacgcttcacgcagatcctgaggaacaacgcggagcatttcttcggtgtttcggatgatcactggaaccatcaaaatcaccagtgacagggacactgcgaagccggagcggtcgaagccgaagagcacgatccacaaggagtacacgaacagtgccgcaacgatggaaggaacaccggtgaggatgtcaaccatgaaggtggtcaagcgtccgagacggttaccgttggagtattccaccaagtagattgcggtgaagataccgattggaatggaaatcaccgaggtgactaccgcctgcatgaaggtaccgatcatggcgtgagctgcaccgccgcctggcagcatcagcatgacgccagcctgggaggtggaccaccaatcagcagtgaggatcggagcgatgcctcgagagatcacggtccacagcacccaaaccagtggcacagctgcgatgagcatcgcaccataaatgatgacggttgctgcggtgttggtggtcttacggctggaggagatgtcggtgaaggctgagctcttctttaaaggctcatccatgcgcggagtaacaacattgttagtcatgattttgtccccttctactttccgcggttaaccatggcgcgagcgccagcgttgacgatgaaggtaagggcgaacagcacgaggccggcggagatgtacgcgcctgcgcgggtgttgtcgttgaattctggagcggcattggcgatggccgttgcgaaggtggtaccgccatcgaaaagcgagaagcggaacgccgaggatggagaaacaaccatgtatagcgccatggtctcacccagtgcgcggccgaggccgagcatcgcgccggaaacgtagccggacattccgaatgggagaaccgtcaaacgaacgacttcccagcgggttgcgccaagtgcaagagcagattcaatgtggccctttggagtctgtatgaaaacttcacgtgcggttgctgcgataacaggaaggatcatcactgcgagcacgatgccaccggtgagcatgttacggccggtagcaaaagaaggtgagttttggtaagtagcgaagaggaagaagcttccgccccagctttcaatccaggtgtagaaaccggacagagctggtccgagcacctgccagccccaaaggccgtagacgatggaaggcacagcagccagcatgtccaccatgtagccaagtggcttaaccaggcgctttggtgagtagttggacaagaagatcgcaataccaagagcaatcggcatggcgatgatcagtgcgatgacagagatgagaagtgttgcagctagcaggtttggaataccgaagtacattgcatcaatgtcggtggtgttccaagcgcctgaataagtgaagaatccgccaataccttcagcatttcgcatcaaggcgggaacagcacgccagataaggaacgccgcaatggcaatgattatcgcagtaatgattgctgcagaagcggtggataggacttcgaagatgcgatcgccgggacgcttaacgcttccgccaccttcggcgacaatcttctttgaaggcttggtctgagaggagttcgcattaactgctacaggatgtgcctgcaccctggttgcatccaggcgttgcttctccgagactgactcattagtggccattggtggtttatttccttaactggcgtattgataaaaagcttgttaggaaaatcgggcgccctacccccaattgctgggagagggcgcccgattcacttaaagtgcaacttcacactggtttcgtgaagctacggcagcggtttattactgaattgcttcaactgctgcaacgaggcgatcgtagtgctcgccggtaactgggatgtagccgagagcctcgagctggtcatcctgggagtccagtgcaacggtcaggaagtccttgacctggtcgcgggtggtctcgtcgtagcctgcggagcagacgatttcgtaggtggtgaggatcagtgggtaagcaccggcttcgttcattgcgaacatagcgtcggtgtcaacaaccatgttgtggccctcagtcaggaagtcgagtgcaccaagtgcaacgccaacggactcagcgttgagttcaactgggccggaaccgaagtcgatgtttgcaacgcccaggccggactggttagcgaaaccagcttcaacgtaggtgattgcaccctcgatgttggaagcctcagaagctacaccgttggagccctgcgcaccggagccaacctcggttgggaactgctggccttcggtctcccagatgtcggtggaagctccgaggaacttctggaagttgtcggaggtaccggactcttcggaacggtacagaacggagatgtcctggtctgggaggtcggtgccctcgttctgggaagcgattgcttcgtcgttccacttggtgatctcgcccttgaagatctgagcgatgatgttggtgtccaggttcagggtgtcaacgccaggcaggttgtaagcaactgcaactgggccgataacgaatggcaggtgccatgcttcgttgccgttgcaacgtgcttctgcttctgcagcctggtcgtccttcattgcggagtcggagccaccgaaagcaacctggcctgcagcgaagttggtgcggccggaaccggaacctgaaggggtgtaagccagagatgcaccgctgacagcctcggagtaacggataccaaagtagtccattgcggactgctgggaagatgcaccttcagcaacgagctgaccggtaacaccggaaaggccctcaatggatgcagcatcggaagaaccggtggaagctgcagatgaggaggtggaatcagactcattggagtcggagcaagctacaagagcgaaggagcctgcagtaactgcgcccacaagggcgatggagcgcttaagagtgaggttcacggggaagcctttccggtttaagtgaagacatcgtctgagcagatcctgtaggcgggctagtttccctccggattgctcacgacttaaaaacctaagaccttgaaatgactaactcaggctaatttggttaacaacttatgaactctgggctatcgttcggcaaattctgccactacccacatctcactcgtaacatttggagactctaatcacaaaaatcggcaattttcgacccctgcggaacgaaaatcaccgattcttattattctcacaggtttttagcaagtctcttttttacttttcgtaaactacgtggctttccgcgacagtgaatcccagtttttcgtatgccgcgactgccggagtgttgccagcttccacataaagaatcacttttcgagcaccatgagccctcatgtgatgcagtccgaggcgaacaagcggatctcccaagccgcgaccacggtaggctgaagaaaggccaactacgtaaatctcttgtaattctggactgtgctgctttacccagtggaagccaacgatctcttcgccgtcccagaggaataacacgtcagagtccttgtaccaatcggctttctgagcctgcgccaaccgatgagttgtccatccgccctgctcgggatgccagtcgaatgcttcgttgttggattgaagccatttagcctcagctactgatttctccacaggggcattcgccaaactactgtgtgtaattccatctggatctttgtatgctgcagagtcatcgagcgccctgtcggaaatctccatcaccagaagctcgcgagtcttcttcatacgcagggtggatgccaacgcttgtgcacctgctgtatttccatgcgcccagattgatgaggtgggggtggcgtcgataagcgccttaccgattccctgacgcctgtgcgccgggtggacagccagttccgtggtttcctcatccgtggccgcgaggccaaccagtttgtcattgagcgtgactattaaatgggagtgaccaagtccgggttctgcaagcccacggacaaattgttctgataaagcatccacgccatcaactgcgcgaacctccttcaaaagcaatagtgcctgctcacggaggtcacgatccagcgcgatttgagtgcttttaatacgatcggaagtattcatgtccccaggttagccccaagtttgaatctcttgcaggaacgtggggtaaagatatagatgtggaaaaatccagaaaacgacttgtgaccatcgcagcatcgacaattggggccgttgcggtggctggcggcgctttttggatcgttgatgcttccatcgctgcgcacgcggaacgcaacttgtctaaagcagttgcggaatccgcagatcttgaaaacgacccgcgagtattcctcggcagctccatttactccacggcgttttttaccggcaaactcgactccgtaagcatcgacatgctggacgtggaaatccccggcgtcggcatggtgaatgcacgcacagaggtagaaagcgtggaagtctcacgggatcaaatcctctccggtgacctcgacggcaccactgcggaaaccttcacgcgcacattacgcatggacggcgtcgcaatcggcgcgcagctcggaatcaccgacctcgacatctcccaccccatcgacatctccccctccggcggcatcacctcagaagcgctcctgacaggaaccccaccagacatggaagacccggtcagtgtgctggtcacccttcgcctagtcggctcagaattccagatgctgccgtacgagcttatcgacgcaccctccggactcaccctcgacgatgtcgcccccgacttcacgtggaaaatcgacaccctgcaactacccctcgcagatcgggcaatggcggtttacctatctggtggctccgtccatttccaatctgaagcccgcaacgtccagctcaccacccgcgaactatcaccactagctgcaccggaagaaaactccgatgaatcctagatgccaaacgtgcgcacccggaggaaatcacggacgtgcttaaacaaatggacagcccaattcatgatcggcggtgtcggatgcgtcttcggcgcatacactcgcaccgcatcagtgattgattccaacaccacctttgttggtttgccttcatactcaccatcaacttggaaacgctgatcgctgtcgcacgtgagcgttactttctccgcatcatcaaaagcaatggtgcgcttagcgatcaacttctccaacttccgaccatgccccacgccaatcaggtgcatcatcgctgccactcccccgaatcctcgcacactagtcaagccaaaaagccccagacctgtgtcaaaagaattctgcggatttgtcaccacaggaagcggacccaaaaaagtccacggattggtattcgaggcaagcagcattggcacttcctctttttgcaatttgtgccctttgctgtccaccgcctccacggtaattttcggtggcttaatctgagttttcacccacgcccgaagactcacctgcagatacaacaacggtgaagccgcaaagccgaaagatctcgcccgttcgaccctggcaataacatccgcatcaataccaaacccagcattaaccgcgaaccaacgagtcccctgatcatcacccttccacgtacccaaggtgatagttctggtgtggttcttccgaatcaactccaccagggcatcagcggcagcatacgggtcagtggggtaaccaagcgcacgggcaaacacattggcagaccccgttggcaacaccgcaatcgccggcaaatcctcaaggtttctaaaatcaccttccgccgacccaagtaacccatttatcacttcgttgacggtgccgtccccacccgcggggataatcacatcaaaatcatccaccgtcaaacccgcaaccatttcctccgcatggcctccatagtgcgtaaacctcgcttcaagcgacacaccatcaagcgccatcaacgcaggcaccacacgacggaaaagtttctgcgtctgcgtggtcgactcaggattcgcaatcagaagaacatgcacgttatctaagagtagtgccaaaacgctagtcttgagtgtcatgagcgaaaattccacccctaataatccagtcgtcccaggtgcaggcgcagacggcccatcactgtccgattctgcaagcatcagcggatccgacgcagtaaacctcgctgccgaacaatccaagagcaccgctcaccgcaacatcccaggcctaggtgaccttcctatccctgacgacaccgctaacctccgcgaaggccccaacctccacgacggactcctcgcgctcctccctctcgtcggcgtctggcgcggcgaaggccaagccgacaccgcagaagacggacaatacgcattcggccagcaaatcaccttcgcccacgacggtgaaaactacctctccttcgaatcccgcatgtggaaactcgacgaagaaggaaaccccaccggcgtcgaccagcgcgaatccggcttctggcgcatcaatctcaaagatgaaatcgaattcgtctgcacccacgccggcggagttgtagaaatctactacggccagccactcaatgagcgcgcctggcagcttgaatccgcatctaccatggtcaccgccaccggcccatccacccttggaccaggaaagcgtctctacggactgcttccaaccaacgaactcggctgggttgatgagcgtctcgttggcgacgccctcaagccacgcatgtccgcacagctcacccgcgtgatcggctagttttttctagttcaccgtcacaggcgaccaacaggctcgaattttaggagcggttggtcgcctgttttgtttcttaagttcgataccgcactagcgggttcacatttccaatatcgcaagctcaatttctcaactccaatttccgtccacttttggcgttttcctagtggtatcaaatatgcgaaattgagtacaagaaaccgctgatgcgaaatcgttagtgtgaaatcgaacttagcgcccaaagcacccagcaagtcccagcgccagcctctaccccagagctttggtaatcagcgccttgatttctttttcattgtctggtttccgtaatttgtgtccatcgagcctggtcacccgaactggtccgcggacggaggacactagccacacgctgtcggctccgaaaagatcgtcaatgcttaagtctttttctttacatcgccatcctttttcggttgcgtgtgcaaagagtgctgcttgggtggttccggggagaatgtcgccaccgggtgaaggggtgcggattttgtcgcctttgaaactcactacggtggaggtggcgccttctagaacgcggtcgccatcggtgaagatcacatcgtcgaatccgtttgatttggcgtagcgcagggctgccatgtttgctgcgtaggctagtgttttggcgccgactgtcagccatggtgcgggggttcgttccactttagatagctcgcctcgggtggcttttccgattccggggaggccggtgtcgatggaatatcctcttgaactggtcatgaccgatacaccgtgttcacgttgcgccagtttgtcggaggagactggggtgatggttaaccatcctgaggccagccccgtggaggaacgacctcggctgagcgtccaggtgcatgaggcctcgcctgcgttggggtgggagtaccaggattcgatgcccatttgggtggctttttcccagtcttccaggatcggctctggcagtcccaatagtgctgccgatgctttgaagcgttctccgtgtcggcgcacgttgcaggcatgtccgtcgcggatgaggagtgtttcaaagatgccatcgcctcgggttaaggctgcatcgtcccaaaaaaccattggtaggttggggttttgttgccggatggacccgccgtagggttcgacaattaagatcaccggcgtcggtgcagactttatttgtggttcaagcgccataacgcctgattatgcacggttaaggcgcatctcgctcactggtgctaaccacttgcgcttttggaaggaataacccttcctgtcagattgtgggtactatcgaagacgtggctaacgaacaaatcgaggtcgcgaacaacactgatcagattcctgcaggatacaagtcccctcttctttctagaagtggtgcggcagaagcgcagggcgctgctgctcaagcaggtactgaaggtgtcgcgtggcattacggttcccctctcgtcgagcaacgcatcttcgaaactggcacgggcttagttgaccgttctaatcgcaaggtgatcaaagtcgaagggcctgatgcccccacgttcctcaataatattttgtcccaaaaggttgattccgttgaaaacggctttactgccggtgccctggatttggatgcgcagggtcgtattcaacacacaatgcaggtaactgtcgtcgatggggttttctacctcgacacgtccgcggcggagtttgataccctcatcggtttcttgaccaagatgattttctggtcggaagtcaccgtccaggaagccgatctggcgatcatcactctgctcggccaggaaattgcccttccggacgcggtctttgcccgtagggtcgattggaatgggccatcgcgtatcgacgtcgccatccggcgtgaaaacctggaggagggcgtcgacaagctcttagaagctggcgcaaagctcaccggtctcatggcttacacggccgagcgcgtgaaggcgttggagcccgctgcgggcgtggatttggatgataagaccattccccatgaaatcccccattggattggccgtggcgaacatttaggcgctgtgcatttgaccaagggttgctaccgcgggcaggaaactgtcgcgcgcgttgataatcttgggcgttccccgcgcgtgctggttctgcttcatcttgacggttccgcaccgctggatcctgtgactggcgctgaaatcaaggccggtgcgcgcaccgttggtcgtctgggcaccgttgtccatgacgccgattacgggccgatcgctctcgggctggttaagcgcagcgctttggataaagaacttcacatcgatgatgtctctgtaaacgtcgaccgcgatctgcttcctgcggaggaaagtgaacaacgcggacgcgcagcgatcaataagctcaagggtctttaactaaaacgatttatagcgaaatttaggcgatttttaaacgatacgaaaatcgcctactttggcattttattttcatgaacacgcaggtcaagggttagttgcagaaattttccgaataacaggctattgtgtctatcaggaatacagttaatacatcttgaaaagcccatgggccatccgaattcccaggatcggcccgctcactccaagggggtcaggcaatgggtcgcggtcgcgcgaaggcaaaacagaccaaagttgctcgccagttgaagtacagctctccagacatggatctcgattcgctgcagcgggagctggctaaccagtctcctaggcgttcctactccgatacccctgatgatgaggaccagtacgcagagtatgcggactgggatgaggacgacaccgacaatcgtgcctacggcacaaactgatttcgtgtgtccttaactcttccgagttgagaacctcaaacccatcaattaggtggctttgcgaccgtttcaaggtgtcacattcacctccaacggtccttatcccgttcaaccactaccgtagaagacggcgcaaggtttgacgcggacaagtcccaggagtactttccctctgtgttcccgcactcccaggatttcagcccgtggcagatctagtgccgtcttttgcgtgcctggggctggtgcgagactttagtttcccggctcacgcctgtcgcggccaggatttaagcgatctaggtgctccacttcggggacttgcaaaaattcgtcaaagtatcaaatttgaagcctgaaagtggtcgaaaatttgcgcggaactgactagattatgcaaaaatccgtccgatttagggcttcacgtgtcctacatggtcggattcttgatcagggatctcacagggacaaaatcagggctgtgcatgcacaattgatgatgttttgtaggcctctctaacggcttcaaacctcgctttacatccaatccactcatgagacaattccatcctcttaaaatgccccatttcactgcaaaagccggcccgcacaattaagtgcaaggccggctaattcttagagcagacagttgggcttagtagccagggtgctcgccgttgaggatcacgcgaggctctccctcttcaccgttgcgtacggttccgatttcccagcagtcaatgtgacgtgcggtgagcattgccagggcgcggtcgcggtccttttcagcaacgactgcaaccatgccgacacccatgttgaaggtcttttccatttcttcgcgggaaaccttgcccacagaggagatggtgcggaagatttggcctggggtccaagttgctcgggacatttctgcgacgagcccttctgggacaacccgctcgaggttgcctgcgaggccgccgccggtgacgtggcagaaggtgtgaacttcgcactctgcgatcagtgccaggcagtccttggcgtagatgcgggttggctcgagaagttcttcaccgagggtgcgtccgagttcttcgatgtgtccgtcaagcgccaggcctgccttttccaggaggacgtggcgagccagggagtaaccgttggagtgcagaccggaggaagccatgccgatgaggacgtcgcctgcgcggacgcggtctggtcctagcagttcatctgcttcgacaacgccgactgcagttgcggagacatcgtagtggtctggttccataacacctgggtgttctgcggtttcgccaccgagcagagcacagcctgcctggacacagccttctgcgataccggagacgatctcagcaacgtgctctgggacaaccttgccgatggcgatgtagtcctggaggaacagtggctctgcgccggtgacaacgaggtcatccacacacattgcaacaaggtcgatgccgatggtgtcgtgcttgtccatcatctgggcgatgacaagcttggtgccgactccgtcagatcctgctgcgaggattggcttcttgtattttccgagctcaaagagtcctgcgaagcctccgaggttgccaagaacctctgggcgggtggcgcgcttggccattggtgcaaagagttcgacggcacgatcgccggcttcgatgtcgactcctgctgctgcgtatgaaacgccttcggcggtggtgtcctggtgatcactcatcgtgtacttcgcttctcctgctggggtttggaacttattaggaacataactgtctaaaagtgcgcgggacaacccccacgcatacggggagagcaaaaatgctcaacccctatcgcctaccgatcttaacttgaggcggttgcttgcatcttgcggactaggtctgcgttgctgtttccctgtggcagacccatggggtatttgccgtcgaagcaggcgatgcagagttcgttggctggttgctcggttgctgcaaccatggagtcgatggagacgtagccgagggtgtctgcgccgattgcggagcggactgcttctaccatttctgcttcgttgtcactggtgacagcgttggcaatgagttcgcctggggtggcaaaatcgatgccgtagaagcatggccatttcacgggtggtgaggcgatgcgtacgtgaacctcagctgcaccggcttcgcgcaacatgcggatcacggcgcgttgggtgttaccgcggacgatggaatcatccacaaccacaaggcgctttccggcgataacctcgcgcaatgggttcagcttgaggcggattcccagttggcggagagtgtcggaaggctggatgaaggttcggccaacgtaggcgtttttgaccatgccttggccgaatgggatgccagatgcttgggcgaatccaactgctgctggggtgcctgattctggggttgggatgactagatcgccgactgctggtgcttctgcagcgagcttgcggccgatttcaagtcgggcttcgttgacgtttcttcccttgatcacggagtctggacgagccaggtaaacgtattcgaagacgcaacctttgcgggttgtctcggcgaatcgtgcggacttgaggccggattcgtcgatagcaatcagttcgcctggttcgacctcgcgcacatgcgaggcacctacgatgtcgagcgctgcggtttcagatgcgactacccagccgcgctcgaggcggccgatggacagtgggcggatgccgaatggatcacgcgctgcgtacagggtgtgtccgtcggtgaaggtgaggcagtaggctcccttgacgctggggaggagttccttggcggaatcaaagagattatttccgtcatggacgccgcttgcgagcagtccagtgagcacatcggtatctgatggcttcttggcgggatcgacgaggccaagttcggtggctttgtccaacaactcgatgtaattaatcaggttgccgttgtgtccaagggcgatatcggtgccatctggtgccatgcggaacataggctgggcattttcccaggtgtttccgccggcggtggtgtatcgggtgtgtccgatggcgatgtttccgcggagggattccagaattggttcgtcgaaaacttgggagactaggcccaaatctttgaaaaccaggatctgttcgccatcgcctactgcgatgcccgcggcttcttgaccacggtgctgaagtgcgaagaggccaaagtaggtaagtttcgagacttcctcacctggcgcccaaacgccgaaaacgccgcattcttcctgcggtgcctgttcgttgagatcatcgtacgggtggtttacctgggtcattccggtggaatgctcggtatttaccattgaaccagggagcgtgtgctgatcaagtaatgccacaggtcaaatcgtagtctgtcggttgcccagaaactaatgagcattaggaaatctaaagtttgaccactggtaaccagtccgcaatctctttggctcgggtacctgatgcgctaatttttccgctttcaaattctgcatcaaatgtggtttgcccagttgctaagcgtaaccaggtcttggcgtcggtctccaccacgttgggtggtgtgccgcgtgtatgttttggcccctctatgcattgcaccgcaacaaatgggggtacccgcacctccacgctgtttcccggcgcgtcttgcgcgagcagtcggacgctcaggcgagttgcggcggcaagtgccgcacgaccaggcttttcgacgtctccctccccttcaatccagtctttgacggccaatacggcttgccgggtttccagcggatcaatcctcatgaagcatcagcctagtacgaaccgttaaagtgtccatatgtctgataatccgcatgagaatccccgtgagaatccacaccgctccccagaagtcgtccttcgtttcatggctgcccctactgacgttttgatggctggtagccatggcgttggcggtggccgagtcctggaatggatcgataaggctgcttatgcttgtgctacccagtggtctggaacctactgtgtcactgcttatgttggtcacattcacttcactcgccctattccctctggccacatggtcgaggtgcgttcccgcattgcgatgactggccgttcctccatgcacatcgtgaatgaggtgctttctgcggatcctcgcgatggcaactacacccgtgcgtgtgactgcttggttattttcgtggcgaaggacaccgcaactggtcgcgctaccccagttccttcatttacccctaagaatgaagaagagcagcgcgtgttggaagctgctaactcccgcatcgggctgcgcaaggctattgaagcggagatggaaaagcagacgtacaacggaccttctgaggcccctcgtttgattacccgcttcttggctaagccaacagatatcaactggggtggcaaggtccacggtggcactgccatggaatggatcgatgaggcgggtgctgcgtgcaccatggagtggtctggtaaccacaccgttgcggtttatgctggtggtatccgcttctaccagcccattcagatcggtgacctcattgaggtggacgcccgcatgatgcgtaccgataagcgttccatgcagatgtccatccacgtccgtgccggtgatgctcaccgtggccgtgctgagctagaaaccgctattcacgcaacggtgacctacttaggaattgatgtcgacggagagcctttgcctgcaccacagtttgtgcctcgtacccctgaggatatccagttggctgagcatgcaaacatcctgagggatctgcgtgctgattacaccccaatgccgctgttccagcgcagggttccactgcagatcgactagttagacccgaaaaagcccccttttgtttaaaaagggggcttttcttagttaacgacaaccatccacactgcaaccagatggacaatcgctgcgacgatcgtggcgatgtggaagtgctcgtggtagccaatcactcgtgcgttgcgtcctggccatttaaagccgtacaccaacgcgccaacgctgtagacgatgcctccggccagcaggagccacaccactgtggggccagcaccagaccacaattgagggacaagtggcacaatgagccatcccaaggccaagtagaccagcacgctgagccatcgtgggtgattgatccacaccatgttcatgatcacgctggcaatggcaccaacccacgcaatacctaacatccatgctgcggtaccgggctctaagacgatcaagcacagtggcgtataggttgctgcgataaacaccgcgatggtggagtgatcagctttgcgccaccacgccacggtgtgcaatcgacgccacggtcctcggtgatacgccgcagagacagcaaacagtcccagcatggccaaggcgtacaccatgacacctagcgcctgccaccacaccagttccatccatgcatacgtggagagcaccgaacctgacacaatactcaaaatggccgcaacctggtggaacagtccacgagtaactggccgctcaccgcgatcaaaaacgtaacgtgtcagtgcgagaagcggttcatccgaactatcttttacttctgctccactaacgtcatcctcaatcagcgggtccgcgtccatatattcacgatcttcagacacttcacgcttctttcttccctgacttgttgtatccaatctagtggaagaaagagcaaaagccgggctttgcgaaaacgaaacccggcttcacagcagaaaattatgcaactactgcgttagctccaactgcgtgaccgaaggcctcaggcaaagtgttggtccatgcttcgcggagttcctccacggaaacagtgaactcaacgtctgcgcccttgacagcgatgacggctgaatcgttggtgcagcccagcttgaacactggaacacccagctctgctgcgcgcttttccaactcttcgccgcggttggttgcaaccacgatgcgggaagcggactcagcaaacagtgaggtgaacagggatgggtggatctgggagagatcaacatccatgcccttgtctgcgtggatcgcaagctctgcgagggtctggccaaggccgccctcagacagatcgtgggatgcagcaaacagatcagaaccgacgaacaggtctgcaagacgctgctcgttgagcaggtcaactactggtggcagaccgttgaggccagcgccagaaacctgctgccagatggagccaccgaactcatcgaaggtctcacccaggaggtagagatcgttgtcctcggatgggaggacgttgccgatgctctgctcgacgttgtccaagactcccaaaacacccacgactggggttggcaggatgggctcgtcaccagtctggttgtagaaggagacgttaccgccggacactggaatgcccaaaagcttggatccgtctgccagaccgtggactgcttccttgaactgccacataacaccagcgttttctggggaaccgaagttcaggcagttggtgacagccactgggcgtgcaccggtggagaccacgttgcggtaagcctcagccagtgcaagctgcgcgccagtgtttggctcgagcttggtgtaacggccggatgcgtcggcggagatcgcaacgccacggttggtctcttcgtcgatacgcaagacgccagcattggcgttctttgcctgaacggtgttgccgcggacgtagcggtcgtactgctcggtgataaacgcgcgggatgcaagtgctggtgaagcgacaagcttcagccaagcagccttgatctcttcaacgtcgactgggcgagcgatctcgccttcgagctgcagttcgtcctggttctcagggcgagcaactgggcggttgtagacagggccttcatcgatggttgatggaggtgcgtcgataacaacttcaccgttgtggaccacaacgtagcggtccttctcgtcggtaacttcgccgatttctgcgcaggtgacatcccactttgcacagatctcgaggaaacgctcaacgttttcaggggtgacaacagcacacatgcgctcctgggactcggaagccaggatttcagctgcagacatgttctctgcgcgcagtgggacgttgtctaggttgacgcgcatgccgccgtcgcctgcggctgccagctcagaggttgcacacgcaagtccgccgccaccgaggtcctgaataccgaccacgacgccagccttgtacagctcgaggcagcactcgatgagtaccttctctgcgaaaggatcgccaacctgaacagctgggagcttgcgctcttcgccttcttcgaaggatgcggaacccaggacggacacgccaccgatgccatcaaggccggtgcgggaaccgaacaggatcaccttgttgccggtgccggatgcgaatgcaagcttgaggtcttccaccttgagggtacccacgcacagtgcgttgaccagtgggttacctgcgtaggaatcgtcgaagacggtttcgccaccgatgtttggcaggccgaggcagttgccgtagtgggaaatgccgtcaacaacgccaggaagcacacgctgggtgtctgggttgtccagtgcaccgaaacgcagctgatccatcacagcgattgggcgtgcgcccatagccataatgtcgcggacgatgccgccgacgccggtcgcagcgccctggtgtggctctacgaaggatgggtggttgtgggactccacgcggaaggtcacggcgttgccgtctccgatgtcgaccacaccagcgttctcgccgatgccggcaagaatcttggaagccatttcctcagtggtggtttcaccgaagtaacgcaggtgaaccttggaggacttgtaggagcagtgctccgaccacatgacggagtaaacggtcagctcggcgtcggttgggcggcggccaaggatttccttgatgcgcgcgtactcgtcgtctttcagaccaagagcctcaaatggctgatccagctcaggggtcttgattgcgtcttcgacggtgtcattgacaaaagtgctcatatttactcctcttaagccgcgatggtgccaacggcggacaggaacagctccaggccatcaatagatgggccggttagcttttcgacggcatgttccgggtgcggcatgagaccgacgatgcgaccagtttcattagtgataccggcgatatcgttgacggaaccgttgaagttatcggtgtaacggaacaccacgcggccttcaccctcaagctgggcgatggtctctgcgtctgcctggaagcgaccttcaccgtgctttgcaggaataaggatctgctgacccttttccaaagtgttggtccatgcagtggtgttgttctctacaacgaggtgtgcgtctacacagtgaaagtgcagacccttgttgcgggtcagcgcgcctggaagcaggcgtgcttcggtgaggatctggaagccgttgcaaatgcccaagactggcatacccttaccggcctgctcaatcacggactgcattactggcgccagtgcagagattgcaccggtgcgcaggtaatcgccgtaggagaatccaccgggaacgacaactgcgtcgacgcccttgagatcctcgtcagcgtgccacaggctgattacttctgcacctgcgatgcgagcagcgcgtgctgcatctacatcgtcaagggtgcctgggaaggtaatgacaccgattttggcgctcacttcgcgacctcaactcccaccacatcgaagtcttcgatgacggtgtttgcgaggagggtttcagcaattttctttaggtcagcttcggtgacggaatcatctacctcaagctcgaagcgctttccctgacggacatcggaaacgccagaaactccgatacgtccgagggcgcggtgtaccgcctgcccctggggatccagaatctcagccttaggcatgacattgacaactacacgggccacggtattttcccttactcaagaaatggggaggacaatgttttacgagcacaagtgtaactgttgccactggtcaaacctagccagcccttagatagggagattctcctcgattgcttccactacctcagctgcagatggttccgtccgaggagcaaagcgcttaatcgtattaccttctgcatctaccaggaatttctcaaaattccactcgatttcgctaccatcagttgcctctttgagcaccttgtacagggggtgggcaccctccccattcacctcggttttgctcaagagcgggaaggtgacgtcgtactgattttgcgcgaaagcacacacctcagcgtcggttccaggttcctggccgttgaattgattgcagggcacgccaatgacaaagaagcctcgatcttggtattcctcatacagtttttgaagcccttcatactgtggcgtgagtccgcacttggatgccacgttcacgatgagcaaaaggtggcccgcccaatccgccatggtggtttctgtgccgtcgttgagagttacgctgatgtcatgaatagaagtcataatcgcaaccctagttgagggggaggatttagtgcatcatctaaataaaggtcagctaataggtgaactttggtgagaccaaaggtgaactgccaggtcgaccaaattgctcgccaagcagactccgaaaaacacgggtaattcatatggcttgtatctaatccatactgaacagaggacctctcctatgtctcgcatttctgcgcgcactctggcaatcgcacttgccggtgcaaccgcggccagcctggcagttgttccagcagcaacagctaatcctgccggaaccgctcctgtcatcaacgaaatctacggaggcggtggaaacagcggatcgttgttctccaacgacttcattgagctctacaacccaacctcaggggacatttccctcgacggttggagcgttacctactacgcagccaacggtaactccggcggaaccacaaacctgaccggaaacatccctgccaacggttactacctcatccagcaacgcgcaggcagcaacaacaccggcgctctgcctaccccagacgccaccggtaacttggcaatgggtgcctcccaaggatcagttgcactgaccgacaactctggcctaaccgctgaccttgtcggattcggtggcacgtccatgtttgaaggaacagctgctgcacctgagaccagcaacaaattgtctgttcaacgcaaagaagttggcgctgactctgataacaactccgtagacttcgagactggagctccaactccaacgtcctcgggaggatccgctcctgttgacccaggcgagccagaaactccagtaaaccctggggaaacagtctccatcgcacaaatccaaggaaccggtctcgctaccccactcgagggtcagaccgtcaccaccgaaggtattgtcactgccgtttacgcagaaggtggcttcaacggttactacatccagacacctggatctggtactgcaccaaaggttgctggcgacgcatccgacggcatcttcgtctacgtgggaagcaatggttcctacccagagctcggcgcatctgtcaccgtcactggcaaggccaccgaacactacgagatgactcagctaggcaactcctccttcaccgtttcggacaccgcattcgagccagtaaccccactcgaactggacaccgttcctactggcgatgacattcgcgaagcatacgaaggcatgctgctgaagccaaccggcgctcacaccgtgaccaacaactacgcaaccaacaccttcggtgaaattgccctcgccccaggtaacgagcctttgtaccaggccactcaaatggtggcaccgggagccgaagcgattgcgtacgaggcggaaaacgtcgcaaagcaaattacgctggatgacggacgctccggcaactacactcgcggcgactccagcacgcctatggcatggcttgtgcaggacggtggcgagaccatcaagtccatccgcaccggcgaccaggtggaattccaggcaccagtaatcttcgattaccgctacgacctgtggaaattccagccaaccacccctgtcaccggcaacaccgcaagctccgaccttcctatcacctgggatgacacccgcgcggctgagctagcttcaatcaatgacgttgctggcgaattccacatcgcaagcttcaacgtgctcaactacttcacctctctcggcgaagatgaaccaggctgcagcgcatacagggatatcaacaacaccccagtcaccgccaacaactgtaacgtccgtggcgcttacaccgaagaagcactcgaagatcagcagagcaagatcgtcgaagcaatcaaccgccttgacgtcgatgttcttggacttgaagaaatcgaaaacaccgcgaccgtcaccggcgacgtctcccgtcgcgatgacgcactcaataccctcgtcgcagcactcaacgaagcagttggatccgatcgctgggcggccgtcgaatctccagaacaattgggcaccgatgaagactacatccgcgtcgccttcatctacgaccaaaccaccgtcaagcccgtcggcgaatcccgaatcttcgacgacgcagccttcaccggcaccgcacgccagccactcgcacaggaattccagccactcaacgacagcgagaaatccttcgtcggcgtagtcaaccacttcaagtccaagggctctgtcactcgtggagacgccgacaccggcgacggccaaggcaacaacgccaacgttcgcgtcgcacaggcacaggcactcatcgaccacctggaaaaccaggacgactgggcatccaagccaatcttcatcctcggcgacaccaactcctacgccaaggaaaccgcgatgaccaccctttacggcgctggctacaccaacatcgccaccgaattcgacgctggctacagctaccagttctccggccgcattggcagcctcgaccacgcactcggcaacgaagcagccatgaagcacgtcatcgacgccgaggtctgggacatcaacgctgacgaagcaatcgcattcgaatactcccgtcgactcaacaacacctccgacgtattcgagaacaacgtcttccgctcctccgaccacgacccgatcaaggtcggattcaacctcagcgagaccactgagcccaccattccggtagagcccactgatcctgcagaacctaccgatccaactaccccagttaagccaactgatccggtagagaccacggatccatctgagccaaccgaccctgcagaacctactgatccagctgaaccaactgaccctgaggaaacgaagaagccagaggagccgaagaaccctggttcctccaacggaagctcccaatacgccaccattgcagcaatcatcgcagcaatcctaggtgccattgctttggccttccagttcttcccattcaagttctaattaactcttagggagtaatcccctgccctcgcattacgcgagtgcaggggattttgcatttcggggcctccgcgttcctgcgtcttgaaaacagcgatttaagaggtcgtgttttcagaatgcctatcaccttggggagggtgccttgaggcgcttagaagcgaatctgagagggcactttttgcagaaccggggtttgaaatccggcatttcttgaagcgaccagacaggcgcgacaagattggcgaaaaagtcaaagttttggcacgtgtgtccggtttccagtggttcaaaccagacaggcgtgccaaaagctcgcaagatgtcagatttttgtcacgcctgtctggtctctcccaattgggtgccccgaacctccccaactaggccagttgtgcggccgcctgagaataggtttgcacctgagcacccaaatccaaggcagctaatgcagcttcccggaagtcagctgcgactttagggttggtgagatttcgcgccgatgcggacaagcgcactgtatttcctttttccgctccacgagtgacagccttgatgacattcttgcgccaccattttgcagcaccaaaaccttcacccacggagaggtttctacacgccaagaattcgccggtgtcgaggttatgtaatcccctggtcgaggcggcgacgttgaaatcaaattctgggagtaccgcgaaggtgccttctgacattctccaacgaggtggggcaaagatttggaattcgaagccaattttctgcatttgcctaatggcaccggtaaggcgaagacgtgcttcgtgccgttcaaggttggcgaattctgagcgacgtccctgaactgcttggtcgaaaccgttgaggatgagttcgtggccgcgttcgcgttgttgttccatccacgcgagggtccctttgtctttggcgagacgccagtccccatcgatgcggggtgcgacaagtaatgagacctcgatgccgtcggctcgcaggtctgaaatgagcctgtcagccgccgatcgggtctggtcgaaaatactagaaactgaaacaagaagacggccggacatgcattgtattgtcgcatgtccggccgttgtcgtcctgttgaaaactagtggtcttcttctaactccacaaatggagattttccattcaaaacgtcatggacttggttcatgtccacggtgccagtccacttgccgaccagcagtgttgccacggagtttccggcgaagttggttagtgcgcgggcttcagacatgaatttatcgatgcccacaatcacgtcaacgccgtgcagaagttctgggcggtgtgaagacaatccggcagccaacgttgcaataccggcacccgagacaccagcagcgcccttggatgcgatgatcatgaagacaagcagaccgacctgctcgccgaggctcatcggcatattcatcgcgtcggcaatgaagatagatgccatggtgaggtaaattgcggtgccgtccaagttgaaggaatagccggttgggaccacgattccgacggttggtttagccacaccgatgtgttccatcttgcgcatgaggtttggcaaggcagattcagaggatgaggtagcaaagatcagcaggaattccttggcaaggtacttgaccagcttgaagatattcacgccggtgaacaccttcagtacggcgcccagcacgccaaagatgaagatcacgcaggtgacgtaaaaggcgaggatcaaaataccgagctgaacaacggcatcaaagcctgtttcgccaacgacgccggccattgcaccgaatgcaccgactggggcgagccacagaatccagttcaaaatcttgaagatgagcttctgcagatgggatacgaaatcaaggatgggctgtcccttttcacccatcgactgagctgcaaagcccacgaggatggcgatgaacagtacctgcagcaccgaaccatcagtaaatgcagagaagaacgtttcagggatgatcgagtggatgaatcccaagagtccttcagggctgctctctgtggatgcgaatgaagattcttcatcaactgagatgttcagtccgctacctggctggatgaagttaccgactagcaggccaactgcgagtgcgaatgtggacatcgtgatgaagtacgcaagggcgatgccaccagcgcgtccgactgttgccgctgccttgactgaaccgattccgatgacgatggtgcagaaaataactggagcgataatcatcttgatcaaggacacaaacatggtgcccaaaatcttgaattctttgcccaactccggtgaaatcaggcctagggtaataccgccaatcaatgcgataatgaccgcaatgtagagccagtgagtgcggtccttcttcggcggcttttgaactttaatgtgttcgtttttgacctcaacacttgaagattctgtgtttgaatccatgaacttcctcttcgacctttttggggattcgccaaaaaacggccaccgtcattgatggtcgaaatttaacgtggtgtgatcgttgccgacgaagcttaaaatgctatccgcggacgattcggaaaattatgaaaaactttttcctgtgacgcaaaaagcagatttcatgactcccctcacagaaaattaatattaccttttgtgttcgcatgtcagggcaagaaaacagcccaaatttctccgctcgtacccaaaccccccgaaaaagaataaatcacccccgctaaagtcgccgagggtgatttaaagttcgctagtcgaacaagttttattcggtcacaccggttgcttggttgatcaaccagccgtactcaaatgcagtctcacgccacttttcgtagcgtcctgacacaccgccgtgtccggcaaccatttcagttttcagaaggaattctccaccggttgcagtcgcccgaagctgcgctacccatttggctggttcgacgtacaacactcgggtgtcgttgagcgatgttacggccaagatattggggtagttctttgcctcgatgttttcatatggggcatacgacgccatgtattcatagacgtccttatcgtggagtggatcgccccactcatcccattcgataaccgtcagtggcagttccggcatgagcatagaggtcagcggatcgacgaatggcacgttggcttcgatcgccttgaagcggtcaccggccatgttggcaatggcgcccatgagcatgccaccagctgagccgccttctgcaaccagcatttcaggggcagaaatcttctgctcgatgagggcgtcggcaacatcaatgaagtcggtgaaggtgtttttcttcgtggtggttttgccgttgtcgtaccagccacgacccatttcgccaccgccacgaacgtgggcaatcgcaaaaatcatgccacgatccatcagtgacaaacgcgcgatagagaagcctggatcaatggatgattcgtaggaaccatagccgtagagcaacgtggggttgggcttggatacatccaggtcggtgcggtgcaccaaggacactggaatctgcgcgccatctttcgcagtgacccacaatcgggaggccacatagtctgacggcttgtatccgccgagcacttcctgctgcttcagcagcgtgcgttcgccggattcaatccagtagttaaacagctgcgccggggtggtgaatgatccgtaagaaaggcgaatgacgggggcgtcccattctgggtttccgcccgatgcgacggtgtagatttcctcgtcaaattccagctgttggaaatcgccgaaggttccgtcgataagcttcatgatcgcgacctggccgatcgcgccggacctgtagcccaggatgatgaaatcgcggtaggtatcgacaccctcaatgcgcacgtcatccttgtgcgcgacgagtggcgccagcgcgtccaaagaattgagcttgtcgacgccagcccaccccaccgaaaagttcgggccctcggcgttgtgtgtgaccaaccaaatatcggagccgtctacgactgcatgatcgacgtcgtattccacaccctccgcgcgcggaatcagcacctcaggggtgccctctggctggtcgaaaggaagcacgcggacttcagaggtgatcttggaggcgcaaccaaaaaggatgaacttttctgaacgagtggtgcccacccaggtggaataacgttcatcaggctcgtggtacaccaacacgtcttcttcaaccggggtacccaccttgtggcgccacacagtatctggacgccacgcatcatcaacgcgctggtaaaagaggtactcctcccccacccaagtagcaccgtagaaaatgccagtcagggtatcaggaagcagctcgccagtttctagatccttgatgcgcaacgtaaagcgctcttcgcccgtgacatcggtggaatacgcaaggtagcggccagaggtggtgacagatgatgcacccatggagaagaattcgtggccttctgccaactcgttggcatccatgatgatggtttcaccctgcgctggctcaccctcagggataacaggaggggtccatgcatccgacccttcagtcactggaatgcggcaggaatagccgtagctcttgccttcttcagtgcgagagtaataccagtgctttccggcacgcactgggatggacatgtcggtttctttaacgcgtgacttaatctcttcatagatgttgtcccgcagtgtggctagctgttcagtctcctgcttggtgaacgcattctccgcctccaggtagtccaaggtttcttgggattctttatccctcagccattcatagttgtctacgaaatcaataccgtggtgggttcgggtgatgggatggattggtgcttgcggagcgtttaggcgttcagacatagcccccgatcttagtcacgcacatcttctgcacgctcgtgtgttcgccattggcgacattctgatttgcaccccgaaactgaaaaacccggattcatttaagaatccggggtttagggaaaatcaagcagcttagacgcaagaaccaatccactggcagaacttctgaccagaaatcagctcgtaggcctcgatgtagcgctcgcgggttgcctcaacaacggaacctggcagagctggtggctccaagccggaatccttgtcccagccagatttagggccggtgagccagttgcgcacgaattgcttatcaaagcttggttgcacagatcctgcttcatagccttccaaaggccagtagcgggaggaatctggggtaaggacttcatcaccaagcacgagggtgccatcttcatcgatgccgaactcaaatttggtgtcggcaaggatgacgccacggtcacgggcgatctcagcagcagccttgtaaatagcaatagaggcatcgcgcaactggttcgcacgagcttcgccgagacgttcttcaacaacgtcaaaggagacattgatgtcgtggtcgccgatgtcagccttggtggctggggtaaagattggctcaggcagctgagaagattcaacgaggccttctgggagctcaactccacacacggagctggtctgcttgtattcaacaagtccagagccagtgaggtatccacgaaccacgcattcaaaaggaagcatgttgagcttcttgcacaccattgctcgtcccaaaacttcttctgggatacgtggatcatcagcgggacctgcaaggtgattaggaaaatcgatggtgtcgaagaagaactggctcatcgcagtgagcactcgacccttgtctggaatttcggtatcgaggatgaaatcgtatgcagagatacgatcggaagccaccatgaggatgtgcttgtcgtcgatctcgtagatctcacggaccttgcctgccgacaggtgcttgtactgggagagttcaggacgcatgttaggcaagtctagacccctcgggtgtgttcggaaaattttagcattcaccgctggtttcactgccggtttcaccgctggcttcctgacatggatcacccattcgcccgaattttttgtttacctaaaagacatttttaagctggcagtttattcgaacaaagattaagagaaccttggagccgtacagctaataagcagatattgaaatacaaaaaagacggacactcgctcatggtgagtgtccgtctcaagctcctggttagcgtaaagctaaccggacctagttactagcgatctcgaaggatcgcgaccgactaggaagaagcggtaacgatggagtcgaagacgccctgtgcgccagcgaagatggagccaacgaggccgtgaacgccgtcgaagatggactggatgatatcgaatacagaggtcattgtgatctctctttctgttgttcgccagactcttgctgtctgactgggatgactcaagtgtggctcataacgccccttgcccgcaaccccatcgtcaaaaactgggccatttttgaacaccgtttaataagtgtcatttagatacctttaagggcaatgtaattttattcatcgtaaaaaaattattaaatttttttccaaaatggccaatttttgaagttttcaggcccaccaatgttgtttttaagacacctaaaagacacctttcggaaccttcactggacccgtaattcgagctacacagttgctttgggtacaaaaaatggggctcgaggccccattttctcactgcgatccagcggtaaacccgcgtgaacgccgttaaaaacctttaaagaatctcacctggtcggtagtctgcggcgccggggtgggcgtcgacaagcacctgaatgcggtcgagcacacgggagacctgggactcagcggcaccgatgaaggcgtggcggtcagccagcgctgcctcaaggtcagcttcgctcattgggaggcgctcatcagcagcgaggcgctggataaggtcctggtcaccgccattttcgcgcatgttgagggcaaccgcgacagcgttttccttgattacttcgtgtgcggtttcgcggccaacgcctgcgcggacagcggccatgaggatacgggtagttgccaggaatggcaggtaacgctcaagttcgcgctcgatcatggcagggaatgcaccgaattcatccaggactgtcaggaaagtttcaaacattccgtcaatcgcgaagaatgcgtctggcagtgcaacgcggcggatcacggagcagaagacatcgccttcgttccactgctggccggaaagatcagcaaccatggtgaggtatccgcgaagaataacctgcaggccgcccacgcgctcacaggagcgagcgttcatcttgtgaggcattgcagaggaaccgacctggccttccttaaaaccttcggtaacagtttcggtgccggccatgagacgaatggtgtgggacagcgatgatgggccggagccaagctgaaccagagcagatactgcatcgaagtcaagggaacgtgggtagacctggccgacggagtcgaagacgcgatcaaagccgaggtgtgctgcgatgcgggtttccagatcggagagacgagcctcgtcgccttccatgaggtcaagcatgtcttgggcggttcccattgggcccttgattccgcgaagtgggtagcggttgagcagttcggtgacgcgctcaagtgccacgagcatttcatcagctgcggttgcgaaacgcttgcccaaggtagttgcctgcgctgccacgttgtgggaacggccagccatgaccaggctttggtactgcgctgcgcgggatccgatagctgcaacaactgcaatgcccttgttgcggaccagctcaagggagcggtggatctgcagctgttcaacattttcggtgaggtcgcgggaggtcatgcccttgtggatgtgctcatggccagccagtgcattgaattcttcgatgcgggccttcacatcgtggcgggtgacgcgctcacgatcggcgatgcttgccaaatcaacctggtcgatcactgcttcataggattcaattgcctcggcagggatctcaactcccaaatctttctgggctttcatcacggcgatccagagctggcgctccatgatgatcttctcttcggcactccacaggttagaaagttccgcggaggcgtaacggttcgacaggacgtttgcgatcttctttttatcagccacgcaaattattattccccacgaaccgaaactaacctagtcgctgctattttttgatgaattctccgattttgcgcacaccttcaatggtgtcttcctttgacgcgcacaggctcaaacgaatccacttgtggccttcctcaggatcaaaatcaacacccggcgcgacggccacgcccgcttcatcgagcaaacgcaatgcccattcctctgaatcatcggtgtatgcagaaacatcgacccacaaatacaggccgccatccgggtcggcgaaagtgccaagcccgatttcagggagcttatcgacgaacacctcccgggcctcgcgatacgcttcaacgtgggcatcaagttcggccccagcctccaaagtgaaggctgcgcgtcccgcagcctgcccgatggcaggagcacacaaggaaagagaagcctgcaggttttcaatcggtgtgaccagctcatctggaacgatgatccaacccacgcgccaacccgtcatggagaagtacttggacaaggtacccaccacgatggcgttcttggaaaactgatgcgcagttgccagcggacgaccaaagctcatgccgtggtagtcctcatcagagataagaacagcatcattgtcatcgcaccacttggcgatgcgctctagctcttccggatcaatgatggtgcccgttgggtttcctgggctggtgacaataacagccttcggcttgtgtggcagttcctccaacatttgagcggttggctggaaacgagtctctgcagtacagcgcaggttcagaaccttcgcccccaaagattccagaatattgcgatatgccgggtaccccggggtaggcattgccacataatccccgtgatccaaggtggcgataaacgatgccacgaatccacctgaagaaccggtggtgacaataacattgtcagggttggtgtctacgtcataagtagcagagtgccaatcggcgatgcgttcacggaactcacgatcaccaatcacctcggtgtatcccaaaggacccgagcgaagagcgatctctgcttcttcgatgactgcttctggcgcaccagttgacggctggccagcgcagaacattaaggtgtctttgccttcgcgcctgcgacggtggactcggtccaacatctgcatgacgcgaaacggctgaacattgcttctagtgcttggcttcataagagacaagcctatctgcgtactgcttttagatcgagatacgaccctctaatgcagccaatgcgatatcgctgcggtagtggcttccctcaagttcaatgtccttgatggtggtgtacgcgttatcgcgtgcagcctccagggtctcacccacaccgatcacgttaagaacacgaccgcccgcagagaccagctcgccttcagcattgagtgcggtaccagcgtgaagaacgttatctgcatcagcgttgcggatgacatcaccagtacgaggtgcctctgggtagttgtaagaagccaacaccacagtcagggcgtaagcatcctcccactccagtgctggctgctctgccaaggttccagtagcaactgcgttgagcagtactgctagaggagtcttcagtagtgccagtacagcctgggtttctggatcgccgaagcggcagttgaactccactactgcagggccttctgcaccccatgcgatacctgcgtaaagcagaccggagtacgcgcaaccacgtgccaccatctcacgagcaacaggaacgcagacctcatcgacaatgcgctggacgccatcttcaggcagccaaggaagcggcgcataagcacccatgccaccagtgtttgggccctcatcgttgtcgtacgcacgcttgtgatcctgcgctggcagcagaggaactaccgtctcgccatcaaccaggcagaacagggaaacctcagggccatcaaggaaggactccagcaaaactggatttccgccctcaagcactgcatctacgtgagcacgtgctgctgcacgatcgggggtaaccacaacacccttgcccgcagccaaaccatcatccttcacaacccaggttgggccgaaacgatcgatggcagcatcaatatcttcagaagacgcaccaggagtaatagcctcagcatgagcagtacgaacaccctgcgcagccatgacatccttagcgaaagccttggagccctcgatacgagcagcgtccttgttaggaccaaacacagcgatacccgccgcgcgaagtgcatcagcaacacccgcaaccaaagggatctctgggccgataacaaccagatcagagttcagttctttagccaacgcagtgacagcctctggatcatcagccttgatgccagggtggacagttgcgatcgatccaagaccagcgttacctggggcaacgtggagttcagtggttgcagggtcagttgacagtccacggaggagggcgtgctcacgggcgcccgagccgattaccagaatgcgcatggttgcacagtttatcctgcaaaacttgatccaagctattccagtattcttggcggttcggaaatggttgaaagtggcgtcgaaaagcgccttaaaatgaccggctcacctgcattattttatgcaacctcaatttggttgcacgccaagtagtagtctgtgcatatggcttctgtattcacgaaaattattaatggcgagctccccggccgatttgtgtatcgttccgagaatgtcgtggcttttctatccatcgaacccctcacctacggccacaccctagtcgtacccgttgcagaagttgaccgctggaccgaccttcctcagaacatctggagcgaagtaaacgaggcctcccagctcatcggaaatgcaatccgcacagcattcgacgcccctcgatgtggttacatcatcgcaggattcgatgttccccacactcacatccacctcttccccaccgacaaaatggccgattacgatttccgcaacgccatggccgcagacgccaccgaccctgcaaaaatggatgaagctgcagagaagatccgcgaagcgctggacggtctggtctagttcttgtagttctaattgctttattaagaaaagcccacccctttgcttggctttggggtgggtttttgcgatctgggtgggtcgattgcggaaaaccaaaccaggtgaccgaaaacttcccgcaccgacattttcggtcacctggtttggttctcgggattaaaaaccgtcctatatggccaagtatcaggaatacatgcggatcttggtcacctggtctgtttttgaaaactcgaaggcccaaaccccaaaaatcatgaccatccagaatcgtttctaagcgccttaaacctcgatagctatacaagtagtcattccagattctcgaccgcttaaaacagcactaactggatttaattcccctgaataggaactgcggagtcgactcatgccctggtgagaggccaaatcgctggtcaagttcagccagcccctcaatgggtgtcaatgtgacttctttgaggccagcgttgtggaaaagctctgcgaaattgtggccagtggaggtcgttgacatgggaagattcctcaaaagttccggggtataggtctctacgaaagcactcggaccatccactgaatctacttccgtgccagcatcaatgcccttcggataccaagccgcatctacgcacgcaataaccccaccaggttttagcaaagacacccaacgattaatcgctgcctggggatccagcagagtccacaacacataccggctggttatcgcatcaaaagagccttcccggaactcgggatcatgcgcatccccgacctgaaaaatggcagtcgcccgacccgtcgacctgcgaagaccattctcctgcgtagcttgattgatcatttcctcagaaccatcaacgccgattgtttcgtatccgcaatcgcttagaaggtgggtgacataaccagcgccacagccaagatcgagaacctttaccgcttcttccgacacgataggcaaagccttcgaccacaccttttcccagatggggcgttcaaattgtgcacgctcgctttgggtttggttgaggtggtaagcctctgccctgccgctccaataattgttaaggatgttttgtaattcaggtgatgtcacagatttttcagcccaatcaggaatacgtcatttcaatatcacccaagattaaccctgttatccaaccttcttggccaccatcagtgaaccgacaccgatgacgatgatcgaaatgccaaataccgcgaagtatcggagctcggaggtgtggttggtggggtcgtaaaatttggacacattacctgcaatagacatgccgatggcgagtgtgaggaaatacagggcggagaatcgtgtggcaaatattcgtggtgcgtggtgcgcagtcgcagccattcctccgggtccgatgaaaagttctcccagtgagatgaggaaaacacttaaaggcagcacccacactggcgcgagcggcattccaacaaatggaataagaactagaagcccacttcccgcaatgatcactccaatgctgattccaattttcactcttggggcgcgtgatccgcgcataaaccacagggaaatcgggatggacagcgccaggatgaaaaaaggattgagtgattgtgaccaggctgctgggatctcaaaatcgccaaccatgcggtcaacacgttcttgggagtacacagctagtacgccgtaggtttgtgcttgcactgcccagaatgcggttgagcagacgaagatcgggatgaatgccagcacttttcgtttctcttcggagctgacttgtgggtgtcgtaagggctggataatgagccatagtgctgcaccgattgttactaaaagcagagctccagctagttggtctgcgctgactgtttctgtaaggagaagataaagcagcactccgcaaagcacagccactgcagcaaatgccgtgctaatcacatgtttttctgcagggttttgggcgcggagcagcgctttcttcacctcgagcgggaacgattgcagcattggtttccgcaacgctgcgtagattcccaatccgccgatcataaggactgcggctgcgccgaatcccatttcaaaggaatacctgctggagagccaaccggtcaggagtggtccgagcagtgcaccaacgttgatgcctaggtagaagagttggaatgcgggatctgcctttgcgtctccttcttgttcaccatgcctggatcccagcacggtgatggctgctgttttcacaaatcctgaaccgatcgcgatgcatccaaggccaatggctagaccaattttcccgccgaggccagcaagcacaaggtgtccgatggttactgagatcgcaccgcccagcagggttttttctgcgcccaggactctgtcactgacccaaccgcctgcccaacagcagaggtagagcagtgcgccataaacgccgaccagtcctgttgcttgggtttgatcaaggcctaatccaccggctgcaacatcaaaatacaggtagtacaccaagagtgcttgcatgccgtagaagctgaatcgctcccacatttcaatactgattattgaggttgcgcttttgaacctaacccgttgatccagttggaccatgacttctcctaagacaaagctgcggtaattaaaaacacttagcgccaaaaattgaacactgttcaattaacctattacactgcagatatacatccaaaccaagtgacggaggaaaatggaaaaccccagcttgcgcgagcttgatcaccgaaacatctggcacccgtatgccgcgccgggcgtgcgcaatagactcgtcaccaaaaccgatggagtgtttttgacgctggaagatggcagcaccgtgattgacgcgatgagctcctggtggtcggcaattcatggacacggacacccccgactgaaagctgccgcccaaaaacaaatcgacaccatgagtcacgtcatgtttggcggactaacccacgagcccgccattaagctcacccacaaactcctcaatctcactggaaattcctttgaccacgtcttttattccgattcgggctcggtctcagtggaggtcgccatcaaaatggcactgcaggcctccaaaggacaaggccacccggaacgaacaaaactcctcacctggcggtccggctaccacggagacacattcaccgcgatgagcgtgtgcgacccagaaaatggcatgcatagcctctggaaaggcacactccccgagcagattttcgcccccgccccaccagttcgggggtcatcgccgcaggcgatttccgagtacctgcgcagcatggaattgcttatcgacgagaccgtctccgcaatcatcatcgaaccgatcgtccaaggcgctggaggcatgcgctttcacgatgtcgcactcattgaaggagtcgccacactgtgcaagaagcacgatcgtttcttgatcgtcgatgaaattgccactggtttcggccgcaccggtgaactatttgccacgttaagcaatggcctacaaccagacatcatgtgtgtgggcaaggccctcaccggtggattcatgtccttcgccgctactttatgcacggacaaggtggctcaattaatcagcaccccaaatggcggaggtgcgctgatgcacggccccacttttatggctaatcctctggcctgtgcggtttcgcatgcttcattagaaatcattgagaccggcatgtggcagaaacaggtaaaaagaatcgaagccgaacttatcgcaggcctttccccacttcaacaccttccaggggttgccgatgtccgggttctcggcgcgattggtgtcatcgaaatggaacaaaatgtcaatgtcgaagaagctactcaggctgcattagatcacggtgtgtggatccgcccctttggacgcttgctctatgtcatgcctccatatatcaccacgtcagagcagtgcgcacagatctgcactgcgcttcatgctgcagttaaagggaaataaaccatgccatttttatttgtcagcggtaccggaactggggttgggaaaaccttctccacagccgttttggttcgatacttagccgatcaaggacacgatgttctgcccgtaaagctagtccaaaccggtgaacttccaggcgagggagacatctttaacattgaacgcttgactggaattgctggagaggaatttgctcgtttcaaagaccctcttgcgccaaatctggcagcccgacgagagggggtcgagccaatacagtttgatcagattatctcgtggcttcgtggttttgacgacccagatcgcatcattgtggtggagggcgctggtggcctgctggtcagattaggggaagatttcaccctggcagatgttgcctccgctttgaatgcacccttagtgattgtgacaagcaccggattgggaagcctcaacgctgctgaattaagcgttgaggcagcaaaccgccgaggactcacagtgttgggagtcctcggcggttcgatccctcaaaatcctgatctagctacgatgcttaatctcgaagaatttgagagagtcaccggcgtgcccttttggggagctttgccggaagggttgtcacgggtggaggggttcgtcgaaaagcaatcttttccggcccttgatgcctttaagaaaccgccggcaaggtgatcgtgaacaccgtgccttcgccttgcacgctgtcgacggtgactgtgccgccgtggccttcgaccagggatttcgtgatcgcaaggccgaggcccgatccgccggatgcgcgtgagcgggaggaatcggcgcggtagaaacgctcgaagatatgctgagcatcttcttcagacattccgacaccgttgtctgccacgagaatcctcacgttttgtccatcggtgttgatctcaatgctgacttccgcgtccggtccgccgtggtttagtccgttggcaaccaggttggtaagcacttggtggaggcgagttgggtcgcctttgacaaccggaatggactcagctttgttggatacattgactgtgcgatctggccaggctgctcgcatggatccgcgtactgccaaggcgagttccagcacgtcaacgcggtgcttctccatttgctggccttcggcacgcgtcagtgacaggaggtcttccacaagcacactcatgcgttgggcttcgccaccgatcttggacatgacccagttggcatcatctgttgcacctgatgaatacagctcggtgaagcccttcacagaggtcagtggtgtgcggagctcgtgggaggcatcgccaacgaatcggcgcatctgagcttctttttgctgggcggtcagaattgaggcttggagctgctccaacatgatattgagggcattcgacagctgtccgacttctgtggtcattggccactgcgggacacgtcgatccaaatcaccgcccgcaatcctggtggcggtctcttcaacttctctcaacggccgcaacgagcgtctgactaggaagagtgaagtaatcaaaatagcaaccagaatcagcgcgccgatgatcatctgcaccatcaccaatcggtacagcaggtttgtttcacgccccatgcttttacccaccacggtgataatgtcaccgttcttttccgccatcacacgccacggagtgttggaggcagaaccgctagcagcatccacagtgtgtggaccagtaccgatggtggtttcagctagatcgggtgccgattgtgcatcgttgaagatgatgctggatccatcaggaaaaaccttggccacataataatcgctgggtggcccttggcggacgccatcgaaattaaacagctcaacgttatgcgcccacgtccccatcgaggtctctagctcttgatccatgcgggtataggaaacttcacgcatgaggctggagacagcaatcgcgttgaccagcaaaccaagcccggcgatacccaccacgatcaaaatgatgcgggtgcgcagcggtatggctcgtccggcagctctgatgggacctatttcaggttctttttctgcttctttttttacgccgacttcttggttttcgtcatcgagcgcagcaacataaggattttccataggagaatttagctacgtggggtgcgcagaacatatccaacgccacgaacagtctgaattagctgcggatcctgggtgtccaccttgcggcgcaggtaggagatgtaggattccacgacgttgccgtcgccaccaaaatcgtagtgccacacgttatccaggatctttgccttggacagcaccacttcagcgttgagcatgaggtagcgcaggaggttgaattcagttggggaaagatcgatcagttcgccagccttggtgacctcgtgggtttcatcgttgagggtgaggtctgcgtactgcagggaagttgaggtgtcttcttcaactgctccaccgcgacgaagaatcacgcgcaggcgggtgattacttcttccagggagaaaggcttggtcacgtagtcgtcagcgccgatggtcaggccgtggatgcggtgctccacggcatcctttgcggtgaggtacagaactgggctgtcaaggccttcgccgcgcagcttggtcagcagctcgaagccgtccattcctggcatcatgacatcgaggatgtatgcgtctggacggaactcacgagcaatcttcagggcttcattgccatcgttggcggtcatcactgcgaagccttggaatttaaggcttacggtgagcagctcgacgatgtttggctcgtcatcaacgacgagtacgcggatttgtccgtcagactggttgtccatttttatctcttccattggtgtccattagcggaatgattaacttcccactagtgaacaccctggaacttcaacaccactgaatactaactgtgaatgtactgaaagagttgaaattgggattattcccactccacattctccaagtccacgccttctacctgcgccaatgcttcaataagtgttaaaagatatgaggcgtgtcctttgtaagtttcgttaaaacgctcgtcttccacgtacatccgagccaaaattacttgcttgtttgcactcacggtgtaccactgaccgatgcttgcgcggtgcgcaagcgctagctcattgccctctgcagagccgggcgcgatgccgcgcagggaggcgtcgataagcttttcgacgaacccctcatgttcatctttcgccctctgaaaatcctccttggtcatcttctcctggatcttttgggattctttccactccggggtgtcgccccagcgctggaaagcctcctcttggtacttgggcagatcctcgccgaagatctcaatcttttccttcacgctaatcgcatcctttccaaggatttcatctactgcccggaccatccgatgcagctgaccgatctgttccactaggagttcccgctggcggcgcaggtgctgattggccgaatccggctgatcaagcacctccgcaatatccttcaacccgattccggcggccctgtaaataagaatctgcagggcgcgctcgacatcgtcttctgtgtaaaggcgataatccgttgtggttcgccagctcggttgaagcaacccgatgctgtcccaatgccgcagtgtgcgggtggtgacaccgagtagttcagcagcctcgccaatggttcgatctgtcatgactgttagttaaatccttgacgtcgcgtgaaggtcaagaggtttccctaattgtttctgccgcgggcaactaccttccaggtacggaaagtgccatcggcttcccgaacgtagacctcatccaccaaattaatcacgttgcaggcatggttgggcacgatgttgagctgctccccgattactggaagtagcactttatctggccagaaaatggttgcgtgatgctccgacaaagcagagattcgggcttcaggattccccagaacaaaaccattgccatcaatccatgctggtttatcagtgctgaggattttggatcccgcatccaaaatgatccgacgatctgacacatttcggctgaccacagtagacagcaccgtcattgccacctgcttctcagtgcatgctcccgaggtgatctgctgggaatcgttaaacacatacacgcctggtcgcatctcatcgattgcgtctgtaaactgcgcagacggcgaggaaccgccagaagtcaggccgccagcaagtcgctggacgctgttgtttagagcctgaagctcatcagctgctgcctgctcaccatttcccgggccataagaatgcccaggaaaagtaaacactcctgcatacctgctgcccagcgcctcgcggatctgactcaattctgaagcagtcgccgtgactccacttctacgatgtcccgaatccacttcaatcagagccttgatatcttcccgcaaacccgccgtcgcctgtgccatctctaccgaatccacgccaatggaaatttctccggggatcgcgttcaggcgttgcactgcatgatcggttagatacagcggatatgcaataaagatgtccgtaaaacctgcgccggcaaaaatttccgcctcgccaatggttgcgcaggtgatccctcgggcaccggcgtcgacctgcatctgcgcaatttcaatgattttgtgcgttttcacatgcggacgcagggcaatctcatgggcaccggcgtgagctgccatcctggaaatgttggcagttaagcgctcgcggtcaatgagaacagcaggtgtatcaatcatcatggagtaggaatattccttatgttcgaacgggccagatcgatcatcgctcctactcctccaccaaagacggttcgggtggccgccttgctgaatcccatgacctgttcccacgtgatggttggtgggatcgacagcgcattaggatccgtgacgatatcgatcagtacaggtccaggatatgccaatgcctcagctagctgctcgcgaactttcttcggatcggtgatgcgtaccgatttgatacccgcagccgccgcaatctctgcgaaattcacttcctcatggtcagtaccaaattctggctgtccctccacgagcatctccaacttcaccatgcccaaagaactgttgttaaacaccacagccttcagcggaagttggtgcagcttaacggtcagaagctcacccagcagcatgcccaaaccaccatcgccacacatcgcgatcacctggcggtttcgatcaacactttgcgcaccaatcgcatgaggcaacgcattagccatcgtgccgtggcggaatgaacccacaaagtcgcgcgttccctccggattctcgatgtacctcgcatgccacacattgcacatgccggtatccacagtaaacaccgcatccttatccgccagctcgttcaaaatagaggcaacgtattcagggtgaataggcacatgcttctcgacgttatgtgtgtacgtctctaccaccgagctcaacttacgctcgtgtgccttgagcatccgatcaaggaaggaacgatctgttttttccttcacatgaggcaaaatattttcgattgttgcagcaacatcaccggtcaccggatacttcaccgtggtacgtcgaccaatgtgcgcaccgttgatatccacctgggcaacgttgtctttaggaaggaaatcagaataagggaaatccgtacccaatagaatcagcagatccgcctcattggacgcatccacgcaggcgccgtaaccaagcaggccagacatgccgacctcaaacggattctcatgctggatgtactgcttaccacccagcgcatgcccgatcggtgatttaatcttctccgccaactccaacacctgcgcgcgagcattcttcacgcccgcaccgcagaacaaagtgacagacttagcgttgttaatcgcctccaccagcgctgcagcctcagtaggatccgggaacaccacaggagtgccagaagaaatagtggaattggaataagtaccgtcacctgcgtcttccttagcgatatcaccaggaatcactaccaccgacacacctttacccgccatggtggactgaatcgcgtgatgcaaaatgcgttcaccctgctcaccaccattcaccatctcgcagtaaccagagcattccttaaacaaaatctccggatgcgtttcctggaagaacgtcgaaccaatctgggcactcggaatatggctagcgatggccaacaccttcgcaccatttcgatgcgaatcataaagaccctgaatcaggtgtgtgtttccaggaccacaagaagcagcacatactgccagctccccagtgatcaacgattccgcaccggctgcaaacgccgccgcttcctcatttcgaacgtgcacccactcaatatctgattggcggacagcatccacgatcggattaaggctgtcacccaccaaaccataaattcgcttcacaccttgagcttccaaagtgtcaattaattgttctgcgtagctgtgtgccatctgaactcctcaacgttatggctattgtgttgcctaacttggtgcgacttcaattgtgctcttaaattccagttgttgccacgcttcgcccgcctgccagggagtttcaggcccgggtgggtactcggtaccaaacagggatgcccacttttgggatttccgtcgttgctgggcagtctggtttggtttcagcccgtcgaaaccaaacacagatgcccaccgatcgcctatttaaacatcgtgggcacgcctgtctggtcgcctcgaaaactggccaaatttagaccccgaccccacaaaaagtgacctcacagaatcgcctctaagcgcctcaaagaacccgacccacgctgacagtcccctacgatttccgacgtcttaaatcgccacacagcgccgtggtctaaaacaccaacaaaagagttgtaactgtaccgaccattcgttacagttacgatccatgacttcagaaaccttacaggcgcaagcgcctacgaaaacccaacgttgggctttcctcgccgttatcagcggtggtctctttctgatcggtgtagacaactcgattctctacaccgcactccctctgctgcgtgaacagctcgcagccaccgaaacccaagcgttgtggatcatcaacgcatatcccctgctcatggcgggccttcttttgggtaccggcactttgggtgacaaaatcggccaccgccggatgttcctcatgggcttgagcattttcggaatcgcttcacttggtgctgcgtttgctccaactgcgtgggctcttgttgctgcgagagctttccttggcatcggtgcggcaacgatgatgcctgcaaccttggctctgatccgcattacgtttgaggatgagcgtgagcgcaacactgcaattggtatttggggttccgtggcaattcttggcgctgcggcaggcccgatcattggtggtgcgctgttggaattcttctggtggggttcggttttcctcattaacgttccggtggctgttatcgcgttgatcgctacgctttttgtggcgccggccaatatcgcgaatccgtctaagcattgggatttcttgtcgtcgttctatgcgctgctcacacttgctgggttgatcatcacgatcaaggaatctgtgaatactgcacgccatatgcctcttcttttgggtgcagtcatcatgttgatcattggtgcggtgttgtttagcagtcgtcagaagaagatcgaggagccacttctagatctgtcgttgttccgtaatcgccttttcttaggcggtgtggttgctgcgggcatggcgatgtttactgtgtccggtttggaaatgactacctcgcagcgtttccagttgtctgtgggtttcactccacttgaggctggtttgctcatgatcccagctgcattgggtagcttcccgatgtctattatcggtggtgcaaacctgcatcgttggggcttcaaaccgctgatcagtggtggttttgctgccactgccgttggcatcgccctgtgtatttggggcgcgactcatactgatggtttgccgtttttcatcgcgggtctattcttcatgggcgcgggtgctggttcggtaatgtctgtgtcttccactgcgattatcggttccgcgccggtgcgtaaggctggcatggcgtcgtcgatcgaagaggtctcttatgagttcggcacgctgttgtctgtcgcgattttgggtagcttgttcccattcttctactcgctgcatgccccggcagaggttgcggataacttctcggcgggtgttcaccacgcgattgatggcgatgcggcgcgtgcatctttggacaccgcatacattaacgtgttgatcattgccctagtatgcgcagtagcggctgctctgatcagcagttaccttttccgcggaaatccgaagggagccaataatgcgcactagtaaaaaagagatgattctgcgcacggccatcgattatatcggcgagtacagcctcgagacgctgagttacgattcgctcgccgaggcgaccggtctgtccaagtcgggcttgatttatcatttccccagccgccatgcgctgcttttaggcatgcacgagttgcttgccgacgactgggacaaggaattgcgcgacataacccgcgacccagaggatccacttgagcgattgcgcgccgtcgtggttacgcttgctgaaaacgtttcgcgccccgagctgcttttgcttatcgacgccccctcccacccggatttccttaacgcctggcgcactgtaaatcatcaatggatccccgacaccgatgatctggaaaacgatgcccacaaacgcgccgtctacctggtgcagctcgcagccgatggcctcttcgtgcacgattacattcatgatgatgtcctcagcaagtccaagcgccaagccatgctggaaacaattctcgagctgataccaagccagacttaaatttctaccttaaagtcttgagcatgactgttcaggaattcgaccgcgcgaccaaacccacaccaaaacccccaattgtttcttgggcgttttgggattggggttccgcctctttcaacgcggtcctcgtgacctttattttctcggtctatctcactgattcagtcggcgccaccctccccgagggttccaacgccacatcactgtattcgatggcggtcgccatcgctggcgtcattgttgcggttgttgccccagtcatgggcaggcgatcagatatcaagggcactcgccgcaggtcactgcgcatgtggacacttgtcaccgtgttcttgatgttttgtctctttacagtaaagaacactgatcccacatttttctggtttggtgtagccatcatggcgatcgccaacatcacctttgagttcgctgaagttcagtactatgcgcagctctcccaaatctcgacccgcgaaaacgtgggccgagtttctggtttcggctggtccatgggttacttcggtggcatcgttctactgcttgtttgttacctaggttttgttgccggtgatggcgatacccgcggattcctaaacctgcccatcgaagacggcatgaatatccgcctcgtcgcagtgcttgcagccgtttggttcttggtctctgcgattccggcacttcttcgagtcccagaaattgaggcacaggtagctgccgaagaccaccccaaaggcctcatagctgcctacaaggatctctttgggcagatcgctgagctgtggaaacaagaccgcaactccgtgtatttcctcatcgcagcagctgttttccgtgacggactcgccggagtatttaccttcggtgccatccttgcggtctctgtgtacggactatctgccggtgatgtcctcctcttcggtgtcgcagccaacgtggtctctgcgttgggagcactcctcggaggattcctagacgatcgcgtcgggccaaaacccatcatcttgatttctcttgccatcatgatcgccgatgctgcaattctcttcttcgttgaaggccccactaatttctggatcttcggattaatcctctgtgcgtttgtgggacctgcacagtcagcgtcgagaagctatttaacacgtctttccccagatggccaggaaggccagctcttcggcctttatgccactaccggccgtgccgtgagttggatggtgccgtcgctgtttggtgtatttgtggggctcaccggcgatgaccgcactggtattttggccatcgcgctgattctgctattcggtattgtgctgctgagcatggtgaagccaccgcacaaggtgaagtagacaaagcgcccacaaggattacttgaactgtctcatgaactgattaatcaaattctgcaatgcttcttgattgagagccagtgtgaagaccagcgagctcaacgcggtgaacaacgagatccagctcacggtctcagctgtagagcttccggtcgaaccaacctccaggtcgctgccatcatcagagtcttcaataccaacattgtctgggatttcattcgcagcgtcaggccatacattgtccacagagtcagactcgatatctactgccacatggtcaatttggaagcggtgttctgggaacgcctcgttattgtcgaccgctgtaatccagctgtctttgccagactgctccaccatggtgttcaaaataaggtgccaaggctgcccgatgacttcacggtattcctcttccgacaacttgaagtgcgcggggcgaagaggtgcagcggctggggtaacagagttgccaaagacatctttgccagaggaagttactgccttgccgtcaatggtgaatacgatctggccgtcgaagacttcgacgccccagtcatgccaatccccaaacatggactcttccatttccatttggcgaagcttcatctctgggcggttgccagcacatccaaggtgtactgccgagtactgggtgttcacacgagagctgtagaactcagtaatatccagttcaccataagggcgtccatcgttgtcagcacagaagttggtattgttctgcatccagatagcggggcggacgccgtcgacaagctcttcggactgcgcccgtgcgcgcacggtgagccggaagttgccggcggggatctctggaaggtggacacgcgctgagctgtagcgtgtcacctcacccggcgcgcacggttcctcctgtgcgttttccggagtggcgatgtcatcagtggtggccagacagtggcgacgggtcacgatatccatgcgtccatcaacgaattcgacagcttctgggcgttgctcgagttctggattctgccacgattccttcaaattgaagtagttccaggaaggcctgcggccatcggcaaaatcagcacttgctggctcgtagcgttccagcactggcatgcgaccgaggtattccagagtgtcttgggtcaaaagctgggtggtatctggcatgggggtgtcttcagatactgcgggagatccggtgacctcgatgcggtcaatcaccatggaccggactgggaaatcttcctcagaggaacgtggttttgcccagtcggcgctttctaccttttgattaagagtgagagtccattcgcggtcgacgatctcatcaaacgtctgcgcggagatcccgaaatcatcaatttcggcatgccccaaagtgacatcgttgcgccatgactggcggttaatcgcctcatcatcaatgaagtactcaacgccgtcgcgggtggtgctcacagtccaggtgtgctccacgccatcgagtgactcatctagtttaagttcacgaggtgcacggttggtgccgttgacactttcaggatcacaacccaagtgggtgtttgatggagaccatggcgagcgaagatcgtaagaaaagtgctctaccaggtctagttctccgtagaggccattgttggttgctgaggaacacgcctgttcaccgttttgcatccaaatggcacttcggacaccttcgacgccaccggtgttaagagttgcagtgacagaaaggtcgaactctccacgagcaattttcggagtgacgatgcgcgcactggtgaacttttcaaactgacctggagcacaaggttcaacttgcgcggtgctgtcattgagctttccgcggttgacaggatcactgatcgcgaagtcttcgtcaacgcagtggcgctgagtggtgatggtgagcttgccatcttcgatacttaaagcatcttcggtatagagaactttgtcgctgccataatctggctggcggaaaatgttccaccctttgagagcatcctcggaatcaaactcttccacccatgtatacggcgcagaaagatctggagctggattagccacttgggcaacagcaggagaaacggcaatacttaaaccaagcgcagccgttgaaaaagccgtcaccacggcggtaacggctgaggtcacatgctttttcaagatggataaccttcctttttcaaacttgtttatacgtctatttaaacaagttgctaaggaatttcatatttattgacaactacaaataaggtttaagccagcttctgtactgtgtgctgctctgctggtttccctcacgatcatcggactagtaagcaacccaccaagcaattacttagaagacgcggcatatcctgccttagctcctccggattttcccgctttccccaccgcgtgctgtgctgcgatccaaccaaaggtcattccggaaccaacctgtgaaccagcaccaggatattcagaagccatgacagattgggcatcatttcctgcggagtacagtccaatgatgggctccccatcttcactaacaacctgtccgttggggttgatgctgatgccaaaggcagtggccagaggggttgggactacagcgattgcgtagaacggtcccttcttgattggtccgacgttggggtttggcttgttgtctggatcgccggcggcttgaccgaagaggagttcgcccttgtggaagtcttcgtcgatacccgttttagcgaaggtattgtagcgtttgacggtttgttccaggccgcgagcgtccacaccaatgctgcgtgccaattcatccaaggatgatcctgcgtgcaggtatccggagtcgatgtatttttgcagagcgagtttaggcaggtgtggcatggtgatcatgccgaggccgtattttgccagggtgtgggaatcaacaatgagccaggctgaaacagtcggggtggttttgttggattcgtacatggcgcgcacgaagcggtggtaggagacggattcatcgacgaaacgctcgcctgctgcgttgactgcgatgactccgaggcggccacggtcccaaatgtgtgggtacaccgcggtggatccgtcggcgcgggtgccgatggacgatgggaaccacagtgcgttttcaccgttgtcgtcgcctaggcgtgctcccactttcgcagcaagggccatggtgtcgccggtggcgctttcgttggtgcgggagaactgtggggtgggttctggcatgtacttcttgcgcagttctggattctgggagaatccacctgctgccagcaccacgcccttgttcacgcggatacggtgggatactcccccatgattgactaccgcgccaacaacagcgccatgtaaggatcattaacttgctggctgatcctcggcacaaaaccagcctcagcacacaactgaaaggtggaattcctaaacacagaccccgcaaactccggcgtcgtcacaaacccatctttagccagatccaccaaatccaccactccttcccccgcaagacgatgatccttcggcaacaccacgcaaaactcttccaaactaatcagccgagtctcaatctctggatcctcaatgggcaaacccatcaacgtaatatccaacgcccccaagcgcagcaaacttaccgcttccctcgtcaacttctgaccaacgagctccaactccacattaggaagccgtttatgcacctcactggtcaaaagcggcagcgtggaatagttcagcacaccagaaaaaccaatgcgaacaacaccaacgatctccccctcggcagcattcacagcttccctcgccaccgcagcgctcgccacaatccccctggcatgtggcaaaaacgcccgacccgcggcagttaactccaccgaccgggtactgcgatcaaaaagcttctgccccaactccgactccaaccgccggatcaactgactcaacggcgattgcggcatccccaaacgaatcgcagcattactaaagtgcaattcttccgcgaccgcgataaagccttccaaccaacgaatctccacgagacccaatcctatcgtggaaaatcccagctgttcgtggttttagctccaatcgtccatttaagacgtcgagatttccacatgggtatcggcctaggttggtccgctaaaggcccttagaagcgatcctgcgaggtcgaacttttagaagtcttggccatgaaatcacctcatccgaggcaaaccagacaggcgtgacaagattggcgaaaaagccgaagttttggcacgtgtgtccggtttctcatcccctaaaccagacaggcgtgccaaaacctggcggaaatccagatttttgtcacgcctgtctggtttcctcttggtccagcgaagacaccctctgaaaaggctaaaagaggcaaggaaaccacactgtttccttgcccctcgagctaaattagacgtcgcgtgcgatcagatcgtccaagttctctggggagagcaggtatggagcaacttcgaggacggtgaaagctccgctttggccctgctgcttcatgcggtgagctgcgcgaccgaaagcgatctgtgaggaagcggtgaaatctgggtttcggtccagcttgaggatgtattccacggtgtggttgaagccaccggtgtcgccggtggtaatcacgtggccaccgtgtggcatgccggtgtgctcggagtcgaaggttgcttcgtcgatgaagttgacttcgacttcgtagccaacgaagtaatcaggcatggtgcggatgtcgttttcgatgcgctcgtgatcggccgcgtcggcaaccacgaagcattggcgcttgtgggtttgctttccggtaaggtcgccggcttcgccgcggcgggccttttccagggcgtcttcggatgggagggtgtactggactgccttttgaacgccagggatgcgtcgcaaagcatcggagtggccctgtgacaaacctgggccccagaaggtgtgctgctggtgctcggctaagactgccgctgcgtagacgcggttgatggagaacattcctggatcccagccggtagagaccagtgcaacgttgccggctgcggtggcggcttcgttcatgacctggcggtggcgtgggatgtcgcggtggttgtcgtaggtgtctacggtgcaggcgaactgcgcgaactttggtgcctgctcagggatgtcggtggcggagcccatgcacaggaacagcacgtccacgtcgtcggcgtgcttgtccacgtcggcgacatcaaagactggcgtctttgtgtcgagggtggcccggcgcgagaagattcctacaaggtccatgtcgggctgcttggcaataagcttttcgacgctgcgtcccaggtttccgtagcccacgatagctacgcggatgttggtcatgttcttgtaatcctccaaaattgtggtggcactgtcctggtcgagcttaccgagatgcatacttagatgatgattcagggacatctctttcatcaggaccgaaagcgaacgtttcgtattgttgagccttttggttccaccacggatgcgctgatctattttcatggctcccagcagtcaggatctgtggggcgcagcttcaccaacaggacttttgatccgttgccgttcatggtggtttatccggatggggtggatcagcattggaatgatgcgcggttgggtttggatgaaaatacccgccatttaggcattgatgatgtggggttctttgtaaaactcgccacgcacttgggcaacacgtatggcatcaagaggatctttattgttggctattccaacggtgggcagatggtgttgcggctcatgcatgaggttcccaagatgctcagtggcgctgcaaccattgcatccaacatgccagttgcagagaatacgctgccgcaggtgaaaaccttcaagacacatccggtgccttatttggcgatggctggaactgccgatactttttcaccgtatgagggtggcgatgccggtattggtcgcgaacaccgccgtggcgtgggcatgtccgcctttgattcagctgcctatattgccgcccgaaacggactgaccgaacaccgccacgacgtgattgatgatgtggtgtcgatcgatacctgggatggagaaaatcccgttgagttttggacactcaacgggatcggccacttggtaccaagtgggaaaacttatccagaatttctaggcccctcaaccacatcagtgatagcggctgaggagattgggaagttctttgatggggtcaggcgtcgataagctcaagctttaaaaacgcattgcgcaagccgtcctgcccaacagcatccgtgaccaggtcagcagcagccttgagcgattcggtggcctcgcccatcgcgacgccgtaagcgctcgcctcaaatagggagagatcctcatcgctgtcgccgaacgcaatggtgtttgcgcgatctgcgttcaggtacttcagcaggcgatccacgccgatcttcttgttgacagacacaccgatcgtgccgaacaacgcacccgtctgaccaccccacgtggtgtgctccaggttagggaacgcctcacgcgctgcgtccaaatcttcctgagaattgaagatgtaactgatcttgttcacatcgtcacgatcaaggctcgcgccccagaacatatccgggtacatgctatcgactgtcacgtcggtcttctccgaaaggcgagacagcactggcttagaagcctcacggaaaccacggcttgcatacaaaccgttgttggactcgagataaaactccaaaccacggttgtagagccactccacaatgtggcgggtctcctcacccgacaaacggcggtggaacacagactcctgtgcgctttccacatatccaccatttgcgccaatgaggccatccactccgatatcccacaactgagaagtcacctcagcgctgcttcgaccagagctcaagtacacgcggtgtcctttggcgcgtgccttacggatcgcgtcaacggccgaacgcggaacttcatttgagtaatccagcagtgtgccaccgatgtctacgaaaagtaactttcccatgccccaaactttacgcgtaaatgaggtacataatcgagaaaattaaagaacttccaatctgaaggaaactcccgctaccctgcagccttaccgacaagccccctcagcttcgcctcaaacttgtcactaacagccaaaacagcgaaactcgtggcccagaaatctccgtcatccagaaaagcttcgtcattaaaaccaatgcttccatagcgggaatcgtgttgggaagctggttgaaaaaatacgataaccgtgccctcacgcgcatacgctggaacgccgtctcgcacctgaggatcaaggtgtggcgcttcatccttaacaaccctgtgcaacaactccgcgatctgtcgatcaagcccctccaacgactcaatcaacgagacacaatctgccgcctcacgttctttctctttggtgccggtccctccagcaccctccgctctcaattcagcagcacgcagctttaacgcttgtagctcagcagcactaataccctgggccatctggctctccctgtcatcgattagtttcaacttttcagttcgatcctagggtaacgattttaggaggattcgcctagggaaattagccctaatcattcatattgaatttcgccccacctgccaggctttcgatcctggaccgagctcaatgccgagcagtgcaaagtttaactcaagatcttagaatgttgcatattgttttttagttgtgttgcatattaaaacaatttttcataacttacatccatgacaacaaatcaagaaaagtatccaatcagcgatctagttcgcaaccagcgccgaaccctcgacatgaatcaagagcatctagctaaagccatagacaaaacccgattctgggtaatcgacctcgaaaaaggaatatcccggagaaccggtgaaccattcaccgtcgatccaatgatgtgtatgaagcttgcagaggctctcgaccttgatccagtagaggttttaagtgcagcgaaagttcccgaatctgaatggccaaatttttcgaagatcatctcccaaagtgactatgtgaagcatgtagacataacaagactgaccgtccgccagcaagatctagtcatcaatctggtcaacgaatttaaggagcttaatttgaacacgccatatgaaaagtgactaatttcaacccaaacgggagcctaagtgaaatgaaataatcccctcaccaactggcgacattcaaacaccgtttcatttccaaacatcgagccaagggaaaagaaagcccctaagccccgtgttattaaatggagactttttggagacctcaagccaaaaaggggcattttcattaagaaaatacccctttgacctggtgttattgagctggagaagagacttgaactctcaacctacgcattacaagtgcgttgcgctgccaattgcgccactccagcaccgcagatgctgatgatcaacaactacgaatacgtatcttagcgtatgtgtacatcacaatggaattcggggctagagtatctggtgaaccgtgcataaacgacctgtgattggactctttttccttgcaaaatgttttccagcggatgttgagttttgcgacccttcgtggccgcatttcaacagttgacgctgcaaaagccgcacctccgccatcgccactagccccgattgatctcactgaccatagtcaagtggccggtgtgatgaatttggctgcgagaattggcgatattttgctttcttcaggtacgtcaaatagtgacaccaaggtacaagttcgagcagtgacctctgcgtacggtttgtactacacgcacgtggatatcacgttgaatacgatcaccatcttcaccaacatcggtgtggagaggaagatgccggtcaacgtgtttcatgttgtaggcaagttggacaccaacttctccaaactgtctgaggttgaccgtttgatccgttccattcaggctggtgcgaccccgcctgaggttgccgagaaaatcctggacgagttggagcaatcccctgcgtcttatggtttccctgttgcgttgcttggctgggcaatgatgggtggtgctgttgctgtgctgttgggtggtggatggcaggtttccctaattgcttttattaccgcgttcacgatcattgccacgacgtcatttttgggaaagaagggtttgcctactttcttccaaaatgttgttggtggttttattgccacgctgcctgcatcgattgcttattctttggcgttgcaatttggtcttgagatcaaaccgagccagatcatcgcatctggaattgttgtgctgttggcaggtttgacactcgtgcaatctctgcaggacggcatcacgggcgctccggtgacagcaagtgcacgatttttcgaaacactcctgtttaccggcggcattgttgctggcgtgggtttgggcattcagctttctgaaatcttgcatgtcatgttgcctgccatggagtccgctgcagcacctaattattcgtctacattcgcccgcattatcgctggtggcgtcaccgcagcggccttcgcagtgggttgttacgcggagtggtcctcggtgattattgcggggcttactgcgctgatgggttctgcgttttattacctcttcgttgtttatttaggccccgtctctgccgctgcgattgctgcaacagcagttggtttcactggtggtttgcttgcccgtcgattcttgattccaccgttgattgtggcgattgccggcatcacaccaatgcttccaggtctagcaatttaccgcggaatgtacgccaccctgaatgatcaaacactcatgggtttcaccaacattgcggttgctttagccactgcttcatcacttgccgctggcgtggttttgggtgagtggattgcccgcaggctacgtcgtccaccacgcttcaacccataccgtgcatttaccaaggcgaatgagttctccttccaggaggaagctgagcagaatcagcgccggcagagaaaacgtccaaagactaatcagagattcggtaataaaaggtaaaaatcaacctgcttaggcgtctttcgcttaaatagcgtagaatatcgggtcgatcgcttttaaacactcaggaggatccttgccggccaaaatcacggacactcgtcccaccccagaatcccttcacgctgttgaagaggaaaccgcagccggtgcccgcaggattgttgccacctattctaaggacttcttcgacggcgtcactttgatgtgcatgctcggcgttgaacctcagggcctgcgttacaccaaggtcgcttctgaacacgaggaagctcagccaaagaaggctacaaagcggactcgtaaggcaccagctaagaaggctgctgctaagaaaacgaccaagaagaccactaagaaaactactaaaaagaccaccgcaaagaagaccacaaagaagtcttaagccggatcttatatggatgattccaatagctttgtagttgttgctaaccgtctgccagtggatatgactgtccacccagatggtagctatagcatctcccccagccccggtggccttgtcacggggctttcccccgttctggaacaacatcgtggatgttgggtcggatggcctggaactgtagatgttgcacccgaaccatttcgaacagatacgggtgttttgctgcaccctgttgtcctcactgcaagtgactatgaaggcttctacgagggcttttcaaacgcaacgctgtggcctcttttccacgatctgattgttactccggtgtacaacaccgattggtggcatgcgtttcgggaggtaaacctcaagttcgctgaagccgtgagccaagtggcggcacacggtgccactgtgtgggtgcaggactatcagctgttgctggttcctggcattttgcgccagatgcgccctgatttgaagatcggtttcttcctccacattcccttcccttcccctgatctgttccgtcagctgccgtggcgtgaagagattgttcgaggcatgctgggcgcagatttggtgggattccatttggttcaaaacgcagaaaacttccttgcgttaacccagcaggttgccggcactgccgggtctcatgtgggtcagccggacaccttgcaggtcagtggtgaagcattggtgcgtgagattggcgctcatgttgaaaccgctgacggaaggcgagttagcgtcggggcgttcccgatctcgattgatgttgaaatgtttggggaggcgtcgaaaagcgccgttcttgatcttttaaaaacgctcgacgagccggaaaccgtattcctgggcgttgaccgactggactacaccaagggcattttgcagcgcctgcttgcgtttgaggaactgctggaatccggcgcgttggaggccgacaaagctgtgttgctgcaggtcgcgacgccttcgcgtgagcgcattgatcactatcgtgtgtcgcgttcgcaggtcgaggaagccgtcggccgtatcaatggtcgtttcggtcgcatggggcgtcccgtggtgcattatctacacaggtcattgagcaaaaatgatctccaggtgctgtataccgcagccgatgtcatgctggttacgccttttaaagacggtatgaacttggtggctaaagaattcgtggccaaccaccgcgacggcactggtgctttggtgctgtccgaatttgccggcgcggccactgagctgaccggtgcgtatttatgcaacccatttgatgtggaatccatcaaacggcaaatggtggcagctgtccatgatttgaagcacaatccggaatctgcggcaacgcgaatgaaaacgaacagcgagcaggtctatacccacgacgtcaacgtgtgggctaatagtttcctggattgtttggcacagtcgggagaaaactcatgaaccgcgcacgaatcgcgaccataggcgttcttccgcttgctttactgctggcgtcctgtggttcagacaccgtggaaatgacagattccacctggttggtgaccaatatttacaccgatccagatgagtcgaattcgatcagtaatcttgtcatttcccagcccagcttagattttggcaattcttccctgtctggtttcactggctgtgtgccttttacggggcgtgcggaattcttccaaaatggtgagcaaagctctgttctggatgccgattatgtgaccttgtcttccctggatttcgataaacttcccgatgattgccaaggacaagaactcaaagttcataacgagctggttgatcttctgcctggttcttttgaaatctccaggacttctggttcagaaatcttgctgactagcgatgtcgatgaactcgatcggccagcaatccgcttggtgtcctggatcgcgccgacatcttaaggtgccagggctttaaagtgccaggggttctgtgggatccgtacactggttcccatgactttgactattgaggaaatcgccaagaccaaaaagcttttggttgtgtccgattttgatggaaccatcgcaggatttagcaaggacgcttacaacgttcctatcaaccagaaatccctcaaggcggtaaaagacctctcccaacaagcagacactgatgttgtcattttgtcgggacgtcacctggagggattgaagacggttcttgatcttggtcagtacgacatcaccatggtgggttcacacggttctgaggattcctcccgcccgcgtaccctcactcctgaagaggtagctcgcctcgccaagattgaagcagatctggaaaagatcgtcgacggcatcgaaggcgcattcgtggagatcaagcctttccaccgcgtgctgcacttcatccgtgtttccgacaaggacaaagtccaaggaatcctcgcccaagcagcacacgtagactcttccggcctgaaggttactaacggcaagagcatcatcgaatactccatcagctccaccaccaagggcacctggctgaaggaatacgttgaccgcaccgagcccactggtgtgattttcctcggcgatgacaccaccgatgagcacggtttcaaagctttagaaaacgatgatcgtgccctaaccgtcaaggttggcgaaggagacactgcagccaaaacccgcgtcgacgatgttgataatgtgggaattttcctagagaaactcgcctaccaccgcatgcagtatgcggaaagcgtgcgattggggatttaagagagcctaaacgcacgaaaagtgccacaagcctagattggcgcaaccgtggaacctgggtggaaggaagtttccaattccacttctggttccacgtattctttgtcaatcattttcaacagtgtttcgccggctttgaaccctttgagtttgttgggttggatgacggtggtgagatcccgtgcgagtgccatgtgggtgccatcgaaaccagtgagggatagatctgcaggcgctgatttacctacgcttttaaggtattccagaacgccgaatgccagtgcatcgacggtacagagtactgcggtgaggtctgggtgtgtttctagaagttctttggccacttcgaagttgtgttggcggttgttgatccagcattccatgatcggcacggtgccgggatcgattcccgcttcgataaagacttccatggcacccctgactcggtcgcgttgtacctggtattgggcgttttcgaggcgctcgcgggtgacttcgccgtcgttgtttgcgcggtctaggcggatggacaggatgccgattttgcggtggccggcgtcgattagcgcttgagctgcaggggcgatggctttgcggttatttggggcaataaacggcatgccttcttcgcgtgcaggctggtcggcgatgactgcgggcaaaccacgggcacggatggcatcgatgtgtggatcacccttggcaacggagtaaataaccactccgtcaactgcagcgttgttgactaattgttgagccgagacatggtcaacgctgctcgcgggcgaggcaggaatcagcgttagttgggtgtctccagcagcttgagccaccccggcaagaaagtccacggaggccatatcttcgaaggcataagtgaggtcctcagtaagcagcactccgattgcgcctgctctgcgtgtacgaaggctgcgggccaccggatcagggccgagatagcccatatcttcagcggtgtcgaggatgcgttggcgaagttctgcggagagttgctccggccggttgtaggcgttggacactgtggtccttgagatacctagtttcgcggcgatggacgcgagggttccgtattgttgtttcctacccataatcatttcaatctaccagttacccctatggcgtatccgaggtctaacgcgattttgcgattttcaataagttttcatgttgacatcctttttcaataagcatttaatggcaggtatgaaaaagcttctttggacactccccatcctcccactggtactagctggctgctcaactggatcagcagattccgcggattccaccaacgctgccggatccaattcccttaaagtggtcacctccacccaggtgtgggctgacgtcgccgaagctgtcgccccagatgtagacattgaagcaattattaccggtggcgacatcgaccctcattccttcgagccttccgctaccgatatggctaaagtttccgaagctgacatcattatcgtcggtggcggcggctatgattcctggctctacggcaccttggaagacgatgatcgcatcatccacgcattggatctctcagagcatgaccacagcgagcatgatgatcacgagcacgaagccgaagaagcccacgaacacgaccacgatgaagagggccacgatcatgacgtcgacaacgagcacgtctggtactccactgaatacgtctctgaggtagctgaagagttcgcagaaaaagtcaccgagcttgatcccgaggcacaggccgatgcaacggctgtgaccaccaagatggacgagctgcacaatcagattcacgatcttccagcagttcgcattgctcagaccgagccgatcgccgatcacattttgtcccactccgacatggtggaatccacccctgagggttaccgcgcaaccacgttgagcgagagcgagccaaccgcagcagatgttgcgtcgttccaggatgcaattaacaacggtgacctcgatgttttgatctacaacccacagtccgcgtcgactgtcgcgaccagcttgaaggatttggcagaagaaaaaggcatcccagttgttgagatctatgagacccctcaaaacaccgagaatttcctcgatgcattcaccaaggcagttgatgatctcaccgctgccactaaccaggtttagaattatttaaatgctgttgactttcaatgatgctgcggtggatcccctctggaggggcctgaatttagagctccgacagggggaatttcttgcggttttaggccccaacggcgtgggaaaatccacgctcatcggtacgattttgggcacccgaaaactcacccacggttcggttaaaactgatgcccgggtgggttatattccgcaacaacgaattttcgatgtcccgttgcgtgcccgcgatatggtttcgctgtccgcggcgcatggcgtggtttccaaaaggggacccgcgaagggtgacgtcgataagcttcttgcccgcgtgggcgcttccggaatcgccgatcgacgcgtcggcgagctctccggcgggcagcagcagctcgtccgccaagcccaggcccttgccacgcgcccgcaattattgcttgccgacgaacccctcctcagccttgaccccggcgtcgcgcagcgcacggtgtccctatttggtgaattgaaggccgaaggcgtcggcgttgttgtggtcacccacgatgtcaatccactaatgggcctggtagatcgcattttgtacctcgcccccaacggccacaccatcggcacggttggcgatgtcatgcagtccgaaaaactcagcgaactctacaacgcacccgtcacggtggctcgcatcaacgacagaatcgtggtggtttaagtggatctatccacctggctttccgacacccaatatctcatcagcgtcgatttcgtccagcacgcactcatcgcctccgcgctgttgggcctgctctccggtgtgatcgcgccgctcatcgtggtgcgccaacagtccttcgcagtccacggcaccgccgaactcgccctcatgggagccgccgccgcgctgctcttcggattgaatgtaggcggcggtgcagtgatcggttccgtggtcgccgcgatcctactggcattactcggcatgaaacaacaagattccgccgtcggtgccgtgatgagtttcggactcggtctgtccgtgctgttcattcacctctaccccggccgaagctccaccgcgttctccctgctcacagggcaaatcgttggtgtttcctcatcatcgctgtggatccttgtggcagtcaccgtgatcgtggttagcgccgtggtgattttctggcgcccgctgcttttcgccagcgccgatccgatcatggcgcaggcctccggagtaaacgtccgattcatcgccgttgccttcgcagttctggttggcctcaccacgtcccagtccgtgcagattgtcggtgcgctgctggtcatggcattgctgatcactcccggcgcggccgctgtggcggtgaccgccaatccagtgaaagccgtggtgctggcagtcatcttcgcggaagtatcggctgtcggtggcctgctattgtcgctagcgcctggtttgccggtgagtgtttttgtcaccaccatctcttttgtgatttacctggtctgccgcctgatcggttggctccgcggccgtggagctcagcgtgacgaagatgcttatcgacgccgccagcacgatcaccaccctcactaggcgtttcgaagtcctatttcaagggtccacttaaaaggggaaaccagactgttttgtgtcagagggttgtgcacactcagtgtcatgaccttatgcacacttaatgccatgaccttgtgcatgcatagtgtcatgaccttgtgcacaccccagacctacaccacaggcatagtcctaggctgctcacaattgacatcatgcctaaacccctacccccagaaacccgacgcaagatcatcgatttcgatccgttcgcaccgaacagcccctcgatcgaagagttctgcagtcggctaaaaatatcgcggcgcagcttctacaacatccgcaaccgataccaacaagacgccaacgcagcactgcatccacactccagcgccccaatcaccgcccggcgaacgtacgatgaatccatcaccagcaccttgctgtccatccgcgcacgcctgaaagcccaaggatgggagtacggcccgatctctattcgattcgaaggcatctccaccggggaactgactgcaccgattccatctgtttcaaccattgctcgtttgttacgcgccgcaggagctgttgaaagtaaccctaagaagcgaccgaagtcgtcggtggtgaggtttcaacgaggtcaagccatggaaatgtggcaaatagatggtttcatctacacactgcacgatactgatctgactcgggtaacgatctatcaaatccttgatgatgccactcggtttgatgtcggaacctgtgtcttccccgcgaatgaaaactcagtcgatgcccgaacagcgctagaacaagcgattgctcatttcggtgccccgcatgaattactcagtgataacggctcagcgtttaaccggatgcggcaaggatacgtcggaagcttggaaagctatctcgcgacggtggggtgtttaagcattaccggcaagcctgggcatcctcaaacccaaggtaaaaacgaacgcagccaccgcacactatttcgtttccttcaagctcatcaaccacacacacttgaggaatgtgcgcactatattgaacagttccgcgatcattacaacaatcgtcgcccgcatcaggggttgccgaataatctcaccccggccgcggcctgggagattgtgggctgtgtggaacaacaacccccgattgatcccgtcgtgcttcaacagcaagccgatcactatgcccgtcgtcgaattgagaagcaatcagatgtcccgcttgttcggcaggaggaatctgttccggtgtctaagatgcagcagaccgagcaacgtcgacgggtacgtcgttttggtaaaaagccggtggatcctgatgtgtttacgtttgctgggaataatcagaaggtggtgttccaggggatgcgtatttctgttcctcgtacgatgagggacagggagttttatcggacggtgacggcaactgagcttggtttctgggatgcgataaccggggagcttgagttgtcgattccgttgccggttgtggcgattgcccggggtaagtcgtatatcaattcttacaacattcgtggggtgtggatgcaacacccgacaccgttgtggcaacgcaaacgtgatgaggctgagaagcgattcaagtcgatagatccgggggatcttctgcgctagaaacttgtcccgaggggctgggttggtgtgcacactgctgtggctttgtgtgtgcacaacctagtgggatagggcgtgcacaaggatatgacattgggtgtgcacaacgtgctgacactttacaaggggaaaccagacaggcgtgacaaaaatctagatttccgccaggttttggcacgcctgtccggtttaggggattggaaaccggacacacgtgacagaacttcgagtttttcgccaatcttgtcacgcctgtctggtttgcctcgagaagggtgatttcacggccaagacttctaaaagttcgacctcacagaatcgcttctaagggcctaaagctgctctccccagaactcactacccatatggaaatctcgacgccttaaacgcctatgtttcgaggttgcttcttaacagcgatttcacggttccaatacctcaagctcaatttctcagcggcgatttcgctcggttttccccggttttccgaccgaaatcgctgttaagaaatcgacatttaggagttagccagttctttgcccgcgatgtatccgaatgccagcgctgggccaaggttgatgccacctgctgggtagaaaccacccatgatggaggcacgatcgttgcctgcggtgtagaggccatcgatgatcgtgtcgtcatcgcggagaactcgtgattttccatcggctttgatgccatcgaaggtgccaaacgaacccggaacaactttcacagcgtagaacgggcccttttcgattggtgcgagtgatgggttggggccgatcttggggtcgccaccgtacttgttgaatgaagtggatccgcgaccgaattctgggtcttcgccccggcgcgcgttttcattgaattccgtgacggtggcgcgcaaacctgcaggatcaatgccacatttttgggctagttcctcgatggttttgccctttaccaagtatccagaacgcaggtatggggtgagtggtacgggtagtggcttggccattcccagtgggtatttgcgcacgaaggtggagtcggcgatctgccaggatgcaactggttcgccttcgggggctgctttcagcatggcgtcaacgtagtcgtagtagccgttggcttcattgacgaatcgcttacctgtggagacaacaccgatggagcctggttttgcgcggtccatgatgtgggggaaggtgccgacttttccgttgaagtatgggaccaatgaaacagggcaccatgctgctggggatttcaggtcgttgacaaaacctgcaccgatttcccgagccatggatagtccgtcgccggtggtttctgctggcgcgagggtccagtgttcttgacctgatggggtgcgtgggaagagttccttgcgcaggtcaacgttgttggggaatccaccagtggcgagcacgacgccggcagtggcttcgaaatctaccaagccctgtggggtttgtactttcacgccggtaacgcggtcgtttttgtaattcaacgacactgcggagtgattgaccaggagatcaacgcccagcttgtctgcagaggtagccagtcgagcggtgagtgctgcaccgttgaccatctgcatattgcgtttgtgcacgaccatgtcccacatgtgcacgatgacgcgcctggcggcatgtacccaaccacgtggatcgaactgtgaagcagagaggaatttcgtcaggtcaggcccagccatgatgcccattcccaggaaggaggtttcatacagctggtggcgcagttttggaagaacactcttgggtactttgcgtccgttgaatggttttggcccaacggagcggtgtccagtgccagcaccggggaggttgccgtagatgtcgttgattttcgcgccgggggtccactgcaggtcggtgtttttttcaaagaaatcgaccatttcaggggctgcgtccaagaaggcggagatgttgtcttcttggtagtactcccccactaccgcttgcaggtaggtttggaattcttctttggattccactactccgtctttgcgcgcaaggctggttccaggagtccaagcccaaccgccggaccaggtggtggctccaccgagtactgaggccttttcaattacagcgactttcttaccgccgtaagctgcactgactgcagctgataatccgccagcgccggaaccgacaacgatgacatcatattggtgtttcatttagactgcttcctcaattttttctaacagagcttgggtggtgttgtagaggtggttgatccatccggcgtcgccacgagaggctacttccccatcgttgggggtctccacgctgagtgggacgttagaatccagggcgttgacaaaggtcaggaggttttgttcaccttcgccgggagccagacgcagggagcgggattctgtaaccagtccgtcgaggtcagccgggcgttgcagagggctatcgcaaagctggagaactcctagaacatcggtgacgtcggtgagttcttctggggtggctccgaacctggccatgtgcaaggtgtccgccacgacttttccgccggagtctctggcgattgctgctgcctgcggaatggaatgcacgctgcggtaagagattggctctagggctggggtgactccgaaatcacgggcatcgtcaaccatggcaccgatcgtgtcggtcaggggcgcaatgttgtcatcaccggcggcgatggtgaaggttttagctcccagtgctccggcggcttctagtgcgggaagccaggcctcgcgggtggtgtctgcgtttacctgtaggaattcagtgtcgagcacatacagggcggtttctttcaacgcttgttgggttgcagccagcagtggggatcctggggaaaggtcatatacacgttcgttgggggttactgcgatgacgcgcagaccgacaaaggagaaaccagtggcagctgcgaggcgcactagttgatcaggtggtgtggacagggaggataaaggtgcaagaccgatttggcgtgacgttttaaaagcttccgttagatcaaagagaccggctggtgggtggctgctgattcgtagacaccaaggagaactttcagagctctggtggcatcgcggccggtgatcagtggtgggcggccttcgttgagcgcatcgataaagtctgcgatctgggcggtgtgatacgggatcaaagcaccgttgatgatggaaagatcggcattgggataaagatccgcggggtgggatggggtggtttcgacggtgtcgttttcactgcgaacaatgagcctgccgtcggtaccttcagggaattccaggatcgtcatggtggcaccctttgttcccatcacctgcacttgtgcgccgagtgctggctctgcggcggtggtggctgaaattgtggccaacgcgcccgattcaaaacgcacagtggcaacggcgctgtcttcgacttcgatgttgtcgccgtgtttgaaggagttggtgtagccgaaaacttccacgggttcgcccaacagccagtacaaaagatcgatgtagtggatggcttgagtcatgagcactccaccgccatcggctgcccaggttcctcgccatggggttgctgtgtaataggaatgctctcggtaaagcgctaccgtgcattggcccatgacggctcctttttcattttttgagccgcgggccagaagcggcgctggaagagcacgccaagttggacccctgcggactcgcaggcatcgatcatgcgctgtgcggaatcgagttcgatggcgattggcttctcacaaagcacgtgcactccggcggcagcagcggcgaggaccactgtttcgtgggttggatgtggggtgcagactgcgacaatgtccaccccggaggcgaggatctcatcgacagacgtgaaactgggagaaattccatatttcgctgcggtttccgatgctttcgcaccatccacatcacagactgcgctgacttctgcgccggggattgcctgaactgcttcgatatggtttcggctgattgcaccgcaaccgatgatgccgactttccagatcttgtcagacattatttcttccctagatcttcaagcttggtgaaggcggtttccttggtggtcaaaataactgcggcagacagtgcgattgcgccgatgatgaatcccgcaacagcttcccaaccgttccatgcgtacagggcggtggcgatggttggtgcgaaaccaacgatgatcagaccgagctggttgcccatagccatgccggtgtagcgcacggaagatgcgaacatttctgggaagaaaatggtccacacgccgttccagcaggagtagaacaaaccttggttgaccaagcacagtgcgaagatcagcacaaggtcagcttcagagattgcctggaagtagaagtaggtggtgattgcacaggtgatggccccgaacagcaagactggcttgcggccaatgcggtcagagacccacgcggccaaaggaatcgttccgatggaaagccccagcgcgatggtgttcaccatcaccatgaaggaacgatcgatgccgatttcgttggcggcgtatgccagtgcgtaaacgttgaaagtggtctgaacaacggcgaagaaggtgatcaggaaaactcgtgcgacatcaatgccctgggtgcgcagcacagccaaagccggagcgcctgcgtcctcttcggccttctcagttgatgcttcctccagtcgggtgcgcacgaagtatgcgacaactaaaaccagtgcggaaagcaggaaaggtacgcgccagccccatgacatgaggtgttcttccggcagcatcaagaacgggataaataccaagccagccaggacgtttccaactgagcaacccgccatcaccgatgaggtgaagaatccacgcttgccttcaggagaatgttccatggtcagtgtggatgcacctgcagcttctgcgactgcagagaatccctatgcgatgcgggcgatcatcaacagcacggtcgcccaaatgccgatctgtccgtaggtgggcagaagtccgatggaaatggaggcgatacccatgatcatcaacgtcaccatgagggcggttttgcgactgatcttatcgccaacatgtcccatcaccagaccaccgatggggcgcgcaatgtacgcaacaccgaatgaggcgagagagccgatcgtcgcgacgactgggtcgccctgtgggaagaagaggtgattgaacagcagcgcggaggcggtgccgtaaatgacaaagtcgtagtactccagagtcgaacccaaaagtgacgccaaggcggctttctttggggactttgctgggctttctgcctcacgcagcttcaaagatgcagtttcaggagcggcggttgcggtcctcacggtttccatgtgatcaccctttctcattaagaatcatgaacttaatcacgtttaatgttctttagaataggtgtcacaaacacacaaccaagttcttcccattcaatgggaagaggtgggtgtaggggcattcacgccaaatgggcgcgttcgaaatgcgaacttaatatagagagtctttttgtagccttacgctgagcttttggcatgcatcaagcaccacagaaaccgcctgattcacatcaatttcatcgttcctcgccactacccccactgatgcccgaacaaccccttttcgatcaaaaaccggagccgcaaccgccgtattctccggaatcagaccacccacaaatacaaaatgccccgtcgcgcgaatttccgggagcatcgcagctacagcagcaccatccgtaatatcccccgaaatggaatccttaaacggcgaactcgtcactgccttaatggtttgcggcgaagcaaacgccaacatcaccaaccccaatgatgtggtgtgcaaatccaaacgccccgcatgcctgcccaaaagacgcagctgactatccgtcgaatcgaaacgctccacatacaaaatcgtacgatccacaaaatccggcaccgccaaacacacgtattgccccagctcttcacgcacatcactcaagatggtctgagcttgcagcctcatgcgctccaaaggattcgccctcacaaacgtctcccacgcatgcgtgccgatgccatatttgccgtcagaaaagcgctccagcaacttcaccgacgtcaattccacgaccaaacggtgcgccgtcgagctaggcaaaccactgcgacgcgcgatttccgaggccccaacctcgcgttttctgcatcaaagcagtgcaacacccgcatggtgcgttgcaacaccgtttcccccgatgaagaattagccatgcccaaagtatagggaagcgtcgaaaagcattttgcttttcgacgccaacctccggcttaacccttaatgcgacgctggcgcgagaactccgacagcacgacgccggcagcaaccgaagcgttcagcgattcaacccagccctcggtgggtatggacatgatggtgtcgcagttttcgcgaacgagacgggaaattcccttgccctcagaaccgacgacgatgacaacgttgtcggtgccgtcgtaggtgtccaaagtgtggtcgccgccagcgtcaaggccgacgacctggtaaccgttttgctggaattccttcacgacacgagtcatgttggtttccttcgccactggcacacgcgctgcggtaccagcagaagtacgccatgcaacagcggtcacagatgctgaacgacgctccggaatgatgacaccgttgccgccgaaagcaccgacggaacgaatcacagcacccaagttacgtgggtcggtgatgttatccagaatcacgaacatgcctggcttcttagaagccgcagcattggcgatcagatcatgaacatctgcgtactcgtaaggagggatcgccaggccgatgccctggtgcatgccgttgccggtcatacgatccagctccagcttgttaacctccagcactggaagatttcggccagccgcagtgtgcactgcctcgctcagacgctcatcgttcgccgcaccctctgcaacatacaaagcagtcgctggaacgcgtgcatgcagacattccagcactgggttacggcccacaaccaactctggcatttcacgctggtggcgtccacgatcacgacgatcacgctccaccttgcgcttgtgagctgcgtgataggtgcgatcctcagctttaggggtaggccccttacctttcagaccgcgacgaacctgtccgccactgcccttggttgcaccttttttattggtcttgcgtaagccgcctcgacgactgtcatttcctgccatgtttaaattatctccttaaaagtgtctgtaattactgcaatttccatgtagcgccatctgcggtatccacaacctcaataccagcatcggcaagacgatctcgaacctcatcagcaaccgcccaattcttctcagcacgagcagttgcacgacgctcaagctccgaagaaatcagcacatcaagcgccttatctgccttgccatcagcgcctgcatctgaaccccattcaacggggtcgaagcccaaaacgccagtcatcgcacgaaccgaggaagcaagcttctccgctgcctcacgatcacccttatccaaggcagcattgccctcgcggacagcgttatggatttcagccaaagccttaggaactgcaatatcctcatccatcgcaacttcaaaacctggcgtccactcgcctacctcaacatcccccacacgctcaaggaaagactcaatgcgacggtaacccaccgcagcttcactcaaagcgctctcggaatactcaaggacggaacggtaatgggcagacccaaggtaataacgaagctcgacaggacgaacctgctttagcatttccggcacagccaaaacattgcccaaagacttggacattttctcgccggccattgttacccagtgattgtgcatccagtagttggcaaatttatcgccagccgcatgtgcctgggcaatttcattttcatggtgtggaaattgcagatccaaaccaccacagtgaatatcaaattgctcacccaaatagtaggtggccatggcagagcattccaaatgccaacccggccggccgtctccccaaggggttggccatgacggctcacccggtttggcagccttccacagagcaaagtcctgtggcccccgcttaccaaagttatcgggctcgccctgctccatatcttcaacacggtttccggacaaagaaccatagtcagatccttcagccttggaccacgctgcgacatcaaagtacacagagccatcaacggcgtaagcaaagccgttatcaatcaagcgctgcatgtacttaatcatctgagtgacgtggcctgttgcacgaggctccgttgatggaggaagcacacccaacgtgttgtacgtccaggtgaattcacgttcataggtggacacccattcccaccaagggcgaccattttcagatgccttggtgagaatcttgtcatcgatatcagtgacattgcgaacaaatgccacatcaagtcccttagccatgagccagcggcgcaaaatatcaaacgctactgctgaacgaacatgtccaatgtggggtgaagattgcggggtggcaccacacaggtacaccgaggcatgacctggttgaacaggtttaaaatctcgaagcgtacgggtaccggtgtcaaagatgcgtagagtcacgtcccctagtctaacctgtgtgcgaacactcaaggtttcaacttatggtgttgctggcaccgcttctttctttgcgacgttgagcaggttggctcccgcttcaatttcgcccaaaccgtaagtgtttacaggtccggttttcttgtaattcgaaacaacaatcggcgtggttacctcataacctgcagccttaatggcatcaatatcgaattcacacagcagctcccctgctttgacttcatcgccctgcttcttcagcgggttaaagtgcgtgccgttgaggtttactgtgtcgaaaccaatgtgcatcaagatatccacattggaaccatcctcagccttggtgcgaactgcgaaagcatggccagatgggaatgccaccacaatctttccactcaccggagaaactaactgccccttggttgggacgatggcaacgcccgagccaagctttccgctggcaaacatggcatcgctgacgctgctcagtgcaatagcttcaccggtcaaaggtgcctggatgatggtggaatcgtttgaaaattctgcgggtgcttctgcttcggctttggtcgttcctgcaggcactggagcagcggttgcatctggatcaatgctgccgttgcggcgaaccaagtaaaggccataagcaatcgctgcgccgaatgcgatgaagaaggtaacaactgcacacaccaagaacatgaccatatctggagcatcaatagaaacaacacccaagaaacctgcagcgcccaacgcaactgccttgatattaaagagtgcaatcaaagcgccaccgatagctgcggtaccgataccgatgaagaacggccagcgcaggcgaaggttcacaccgaagatcgcaggctccgtaataccaagaacagcggagacacctgaagcacctgcaaggcccttgagcttttcactcttcgccaggaagaacactgccaaacatgccgcaccctgggcgatattagccatagatgccgttgcgaagatgaaggatccaccctggttaaacagctccagctcaattggcgggaaggactggtgcagaccagtgatgacgattggtgagtagaccagaccgaagagcagaccgccgactggaccaccgaaatcataaagtccctgtagaccgtgtgccagcacatcgcccacccagcgcattgctgggccaatggcgatgaatgtaaggaatccggtgagcagcaacgtcagcactggagtgatcaggaagtctgcagtgcccttgagtcgcttgtgcaggaacttctcgatcgttgccagaatccaagaaaccaccagcacaggaagcacggtgccctggtaaccggcttgggcaacatctaaaccaaacagggaccacattggcatttcgcccgcagccatggtggcggccacgtcgtagccgttcaccaagctcgggaacaccatcgccataccaataccggcgcccaggaactcattgccgccgaaacgcttggttgcggtgaaaccaaccaacactggcaagaacgcgaacggcgcagatgccatgaggttgatcatctcagcaacaccgctgatctgagggaacatctccaccagtgattgcggaccgaacagatcctgcgcaaccaacacattgttgatagccatgagcagaccgccaccaaccaagattggaatcagcgggacgaaaatgtccgccaataccttcacagcacggctgaaccagttggcgttgttagccacaacatctttgagctgctctgtggacacagcgatgtctttggaggttgcgtcatcgagttctttgaaaacatgatccacatcgcctggcccgacgatgatctggaacataccacccgtttcaaacgtgcctttcagatctggatcatcatccagactttggcgatccacatccttggtgtctttgagcacgaggcgtaaacgcgttgcacagtgtgcggcggcgacaatgttgtcttcgccgccaatgtcgcgcaggatgcgttgcgcgaggtccttatggtccatgaatttctccttaaccgggaagaagcaaaaatattcagacatgaatgtttgttcaaaagctaaacaacattaaacctgtttatttgtgtccgatcaagggattttgcgaagtatttgtacaattcgccacaaaagacccttttttatgacttatctctcaatagtgtcacctttgaaagcccggaaagcgaatgaaacctgtccatcacctgcagttatctcaatggctgtattatcgtccgcgatcactaattcgccaggttttacctcagctacgcgacgatcaccaccacgatccacagacaaacggacaccatcccactcgagggaaatattgcctcggatgtctactcggacaggttcagaacctaatacagatctgattacccctgactccccctctgggagaagaagctcttgatagatcgcgtggttgcgcaaatgaagcttgcggggcacagtcaggcagtgcacccatccttcccgtgcaactgttgggtgatcatcctgcgcgggcagccccatccagcccacgagccaggcatcagaaccgtttactgcaacctgcggtgcgtagaattcatggccgaaatccagctcgctgaatcctcgcaagacgcggaaggtcgttccttcaagcttgccgacgacatatccgcactggtcagagcttgcgtagtgagtaacctcatcgtggattcggtccaatccttgtggacagaaaatcagcacgtcgagatcttcgccagtttcttcatcgcgaagcgtaaaaaggttggggcattcccacatgtagccaccgggaacgagatcaggagcagaaccaggttgtgcatcactgaggtcaaaggtgatttcaccggagaattcccagttttcaagatctgtcgagcggtatagaaccgctgcaccggtgaggttttcgcgttgggccccaagaaccattttccaaccatcaccatcagggctgatcatgggatcgcggtaatggggtgtgaaaccgctggcgggtccgtcgataagcggatttttaggcgaacggcgatgaatgccgcccatcagcccagttgggtcctcgacttcgacgaggttttgggtggcgcggcgcttgccgtcaatttttaggttgccggtgtagaaaagtttaagtgtgccgtcagtaaatacggctccaccggaatagcatccatccaggtcataggatgcatccgggtaaagagcgtcgggcaggtgcgtccactgcaatcgctgcggtccggtcaacggcgtggtggtgtgagcccagccggtgcgctttggtgcgaaggggaaacctggatcgtgctggtagtagacgtggagggtatcgccatcgacgtacattccgttgggatcattgagcctgccctgcggaggagtcacatggtacgcagggcgcaaactggaaagttctgtgtgcatagccccacacactactttcctttttgtttctagcgcagctttaattgctccatgagacggtagtgatcagcgttttccagcttggatgctgctgcttcatcaacgatgatggtggcattgttgtgcatctgcaggatggaacctgggcacatggcggtcagtgggccttccacagttccgcggatggcgtcggcttttccttcaccagttgccaccaacacgatgttttgcgcgcgggacaaagtgcccaaaccctgggtgagggcgtgggttgggacctcttcgatggtgttgaagaatcgagcgttgtcctccacagttttagggtgcagcgcctggacctttgtcagtcctgacagagaagatgatggctcattgaaagcgatgtggccgtttccgccgatgccaaggatttgaacatcaacggattctgcagcgatctttgcctcatactctgcagctgcttcgtatggatcagggtttgcaccatctgggctgtagacctcttcatcaacgatgtcgatgtggtcagtgaactctttacgaatggttttgaagtagctgttttcatcgtcgcgcgttaatcccacgtattcatccaacaagaatgccttgcagttcttgaatgacacttccccagcttcatacatgcgaatgagctcttggtaggtgctcaaaggtgacgatccagttgcaagccccaaggttccgcccttagttgcgaagggtgcgatcagggctgccgctgctttgccgacttcttgctcgtctttgcagatgatgatgtccatggtcggactccttttattatcaggaaagttttgctcgtatttaaattacttgatggtctaaatggacctgttgtaactggccgtttgagtcaaagaccacaaaatttacagggttggatttaacgatttcgtgatcgctaagtccgagaattttggcggcgacggttgaggtgtggagggtcgcgtcgataagcgtcatacccctgcgcacgtggtgcacgaactgactcgctagtgtgctggtacccccggcgatggcgccgccatcgcgcagacgggcgacgccatcggtgacggtgacgttcaaaacgcccaaaatgtactcaccgtctggcattccggcggcttccatggcgtccgtgatgaaaaaggcgttgttggaacgagctagatcgaccgttccatcggccaaatgcacgccgtcggcgatcaactcaacatatgcgtccccggcacgtgccgcagcaagcaaagcgcccacgctgccgggatccctatgatgcagcggaggcatcgcattgaacaaatgcgtagccgtgaccgtcacatttttctctttagccaaggcaattgcgctggtagtggtatcaaaatctgcatcagtgtgcccgaaggaagcaatgatgtggtgcgctgcgcagagatcgagaagctcagtaagattgtcagtttccggcgctactgtgatcgatttgatccaaccttttcccgcatggatcacctgggcaagatctgttgggttgccgggaaaaataaaatccgggttttgagcaccacaacggcatgcgttgatgaaaggaccctcgaggtgaatgccgcacagcaggccctcttcacacaagggaataaggttttccacctgcgctgccagtgcgtcagccggcgccgaaaccatgcttgccaacatcacggtcgtgccatgttcgcggtgatactgcgcggcattcctcgcctggtcctgcgttcccgtaggaaacgcgccaccgtttccaccgtgattatgaagatcaataaaactgggaacaatcgtggggagttcggggtggaatcctgcgtttttaggtgctggttctccagagagttccgtgatgatgccgttttcgagttggagaaagccatcaatcaccccgtggggggtaacaattcttccttcaatttttttaactgcttgacctgcattttcttgataatgcaccacttctgccatctttctgaggttatttgcttccttccagcaagcataggacgtatgatgtcttatgtctacggatttaggttaattatcttcggacttgaggcctgctgttgcaggtctactgaattacctcagccttccaagctgatgatgcattacttaaaaactgcagacacttgaaaaacttctcacccgcactcgttccctcaacccacaaggagcaccatggcttccgcaactttcaccggcgtgatcccacccgtaatgaccccactccacgccgacggcagtgtggatgtagaaagcctccgcaagctcgttgaccacctcatcaatggtggcgtcgacggacttttcgcactgggctcctcaggcgaagcggcattcctcacccgcgcccagcgcaaactcgcactgaccaccatcatcgagcacaccgcaggccgcgttcccgtaactgctggtgtcattgaaaccaccactgctcgcgtgattgagctcgtggaagatgccctggaggctggtgccgaaggcctcgttgccactgcacctttctacacccgcacccacgatgtggaaattgaagaacacttccgcaagatccacgccgccgctccagagcttccactgtttgcctacaacatcccagtgtcggtgcactccaacctcaacccagtcatgcttttgacgctggccaaggatggcgttcttgcaggcaccaaggattccagtggcaatgatggcgcaatccgctcactgatcgaagctcgtgatgatgctggactcactgagcagttcaagatcctcaccggcagcgaaaccaccgttgatttcgcctaccttgcgggtgccgatggagttgtcccaggcctgggcaatgttgatcctgcagcatacgcagctttagcaaaactctgcctcgatggaaagtgggcagaagctgctgctttgcagaagcgcatcaaccacctcttccacatcgtcttcgtgggagacacctcccatatgtccggatccagcgctggtttgggcggtttcaagacagcactcgcacaccttggcattattgaatccaatgcgatggcagttcctcaccagagcctcagcgacgaagaaactgctcgcattcacgccattgttgatgaattcctgtacaccgcttaaggcccacacctcatgactgatcccacttgcacccttgcccttgatattggtgccacaaagattgcctacgcactagtccccgataacaccccgacgacaacattgtccacgggacgcttgggaacaaaagaaggcgacagccctatcgagcagatccggctggttcttctggcaggcttaaaagctgccgaggaacacggtctcagtgtcgcccgcatcggcatgggcgctcctggtgtaattctgggaccagagggaaccatcgtgtacaacggtgaaaccctcacagagtgggcaggcactgacctgcgaggattatcccgagaagtcctcaacgttccattcgcggcacacaatgatgtccgcgtatgggcctacggtgagcaccacttaggcaccggcaaagacctcaccggcagggtactctacgtgtccctcggcactggagtcggcggagcaatcatcgaagacggaatcatgatgagtagccccactggaactgcgggagaattcgcagaagttgtgtgctctgaccatgcaggattagccgttcggtgcgaaaatgtagcaagtggcaccggcctaaccaggtactacaacgaggccgccgcaactcaacttgaccttcccgccatcatggagcgcttccaccaaggtgacggcctggcacagcaaatcattactggaaatctccgaggctttggccaagcgctaggcgcattagtcacagtgctggacctttccgcagtagtagttggaggcggagtcgcaggcatcggcgcacccgtcatggatcccatcaccgcagggattttcgatcgagtgttaacccccaacaaatccgtacaagttttaagcacgtcccttggtgcccaagcagccgtcatcgcagcagcaaaatatgcccgcgataacgccttttaagcacctaaaacgctgttctcaacacaggagtttccttaaataatggacttaaatactcaacgctcaaagctctacgcacagcttcaaggccagctcattgtttccgtgcaagctcccgacggccatgccatgcgagatacccatacgctcacccatgtggccgcagcctgtgtcgatggcggtgctcctgccattcgctgtggcggttacggcggtttggaagatatccgttcaatctccaaccgtgtcgacgttcccgttttcggactcaccaaagaaggctccgaaggagtttacatcaccccaaccagggattccgttcgagcagtggcagaatccggcgccactgtagtctgcgcggatgcaactttccgacctaggcctgacggctccacctttgcagagctggtcactgttgcccacgattccggaattctcatcatggcggactgcgcaactcccgaagaagttctcagtgcgcataaggctggcgcggattttgtgtccaccacgcttgctggatacaccgaacaccgcgagaaaacagtcggtccagatttcgattgcctccgcgaagcacgtgagttagttcccgatgcgttcctcattggcgaaggtcgcttctccaaccctgcggatgtggcgcacggtcgtctcattggtgccaacgcgatcatcgtgggcaccgcaatcactgaccctggtttcatcactggacagttcgcgtcactgttgcactagcacttagtccagcgctgcacggatccaccacaaatcgctctgatcagcggttttgtggtggatttttgcgtctcatctgcctaaaagcgctaggatccaccacagattccaagattcctcagggatgtggtggatccttgccctgctaacccccagtaaccacacaggaatcacaccagcctcagtagccccaaaaacaacagtgccagaatcgcttctaagagcccaacgaccccaaaacctacccagcacccatcccgcaattaaaggaccgcaaatcggcctctacagccccactccaaaatcctgtttaacttcccccaacgagcgaccatcataaggaaccgtgacgccgtaagccacttctccacccttgcggatatcaaaaaccaattcatccccaatttccagggtctgtcgcgcgggcttgcctcgagtgcggattttttgggtgctcgcgtctggattggacacaattttgaatacaccttcaccccattgcgatgcgtcaggcagtgcgacttcgatgccgtcatggtcatcgttgatcaccacatggcggagggatatggcatcggaaatgggctcatcgatccgcagcgaaatatcatttacgctgatcaccgtgcattttatcgcgcgcgttccctctgcttcccacaccacggcaacatctccgttgggcatttccgcagcggttgaataggcggcttcttcgcgctcgatggtgatgcgatgcgcccaggtcgctccttcgtcgctggataaatcaaccaccaagtggcgtcgcagatcagggtccgccaggtgcgttgcggcgagcattccagccgctttccagtagaacacgtggccgttgcagccggggtcgattagttcaggcacaggctccagcggagtgaatgtctccccgaaatcatcggacacactgctcagacggtgtcccacccccctggaatgcagcacaatccgaccgctcggcagctgcgtcatcgcggattcgttaccgccggcaatatcggtgatgtggccatcgctgcgcagaatccgaagcgaaatctcgcgcccgcgccgcaccacaaaactctgaatccaccgcccatccgccaggacaagtcccgtccccgacgaggcgaacgcggcatcaacatccgcaaaatagtgggccatgcttatcgacgtccacccactcacatcccggcgcgccagccggggttcaaggtcggtgggatcctcaaaaaatcctgcgaggttggacaatccgtggaagcacagatcgcccgtgacaaggcagacatcgcccacaccgcggtgttcagtttcgacgattgctggttctggggtggtccaggtgatgccgtctgaggatcgcgctgacaccacgtcgatgggtgcggggaggtcgtcaacactgaggcgggcgtcgaaaagcgttaaaagaccctgatcccagaccagcgcgggaatgcggtacaacccgcgcgcaatgaggctagtgcgcatcgagcatgttggaaatcatgcggcgaaacggcgcgtagtgagcgagcacggcgctgcgataatcgtcgatgttgccgctggagagcgcttcgacgatgtcgctgtgagctttgatggtttcgtcgatgtctgcgggcatagccagattgagcatgggctgcgcctcggtttggatctgccaaaacgcatcgttgagctctctaatcagcgggtttttcgttcgcgctaggagtgctcggtggaatttttgatcctccaccacaaaggattcgccctgatcgttgtgctcgcgcatcttgtccaccagatcaaggagtagctcgcggtcatcgtcggtgaacacctcgatcagctcttcgccaagtgaaaggtcaaggatttcgcgggtatccaccacgtagaaaaggttttccaccgaggtgtcattgtccaacaccgtgcggaacaccatcccgttgatcaggggctcgagggacatcctggacacgaaagtgccgtagccgtggcgaacctcgacgatgtccaaggtcacgagcgcgcggatcgcctccctgatcgcagaacgggaacaacccaattcctcacataagaacgcttcggaaggaagaaggtctcccgtacgcagccggttgtcccgaatgtattttttaatgtcgcgcactgcttcttgagtagtggaccttgatcgcgaagtctttttggagctttccattgtgttcacttcctaatctggagatggttctgatcatatcgactgtcgtttccatcagaccccatccgtcttatctgaagtgctttcagatgttctacctgcaagtttctagacggcaccccactgtaggggtaagtaaatgtgcattttctgaaatgatttcaaaaaatttattcctaaacgtctgatgtctgatgtatattgacactacagcaattcaatgacaccgctcacaatttcttttaatgagcatagcgtcacaattcaactcacggcctgggcccctcttttaaaaaggatgtacctcatgagcaccacgattactcgccgcaatttcctccgagcaaccggaatcctcggtgtcgcagctggcatcggcgcaacacttgctgcatgtgcaccagacaacaccggcaccagcggatccacctccaccgcagctggcaccggaactgcaaatgaagaaggcaccatcaccgcagccatctcctacgaactgggaaccaacggctacgacccaatgaccaccacctcggctctcactgtggcagccaactggcacacccttgaaggcctcaccgaaatcgacccagccaccggcgaggtctacgcagcactcgccagcgcactgccttcagccgatgcgacctccctagacatcaagcttcgcgacggcgccaccttccacaacggcgacgcagtcaccgcagacgacgtagtcttctcttttgagcgagtcctcgatccagccaacaactccctttacgcatccttcatcccattcatcaagtcagtcaccaagaaggatgacaccaccgtcaccatcgacctcgactacgcaaccggcatcatcagcgaacgcctcgcagtagtaaagatcgtgccaaagtccgtcgtggaagcagacgcatccggattcgacgccaacccaatcggctccggcccatacaagatgaccgacaacggtgcatccaaggtggtcaagttcgagcgcaacgacgactacaacggcccacgcccagcacgtgccgccaagatggaatggcagatcatccccgacgcctccacccgcaccaactcccttcagtccggcagcaccatggccatcgactccgttccatacctgtcgatcccacagcttgaagccaccagcaccgtagaatccgtccaaggattcggcctcctgttcgccatgttcaactgctccgaaggcaaccccttcaacgacgtccgcaaccgccaggcattcctctacgcactggacatggacaagatcgttaagaccggcatgtccgaccaggcaaccccagccacctccttcgtgcagaaggaacaccccaactacaaccaggcatccacggtctactccctcgacgccgacaaagccaaggcgctgttcgctgaaaccggccttaccagcctcaacctcctgtgcaccgaccacgactgggtcaagaactgcaccccactgatccaggaatccctcgcagcccttggcatcaacgtttccttcaccgaacgtaaatccgccgacgtctacaacaccatcgacggcaagccagaagcatacgacgtcgtcatcgccccaggtgacccatccgtcttcggcaacgacccagacctcctcatgcgctggtggtacgccggcgacgtctggaccgactcccgcatgcactggaagggcagcgaatcctacgaccaggtacaaaacctcctggaagaaggcatccgcgctaccgacaaggcagaacagcaagacatctggaaccgcaccttcgatgtcatctccgacaatgttcccctctacccgctgttccaccgcaaggtcccaaccgcatggaactccaacgccctcgtcgacttcaagccaatctcactcaccggcttgaacttctcaggtgttgcaactactgaataacaaccccagtggctttcaaagcccggcgtagccagaattctgcgccgcgccgggctttttctcttcagttttctccagctctctccaattctttccagtttttggcgtttttctagcctgttagttttcagcatttttcagcacactttttaagatctcatcgaaagcgcgatacccactatgtccaatcttttgagacttgtcggccgacggctcatcgctttaccgatcatgattattggcgtcaccctgctggttttcatcgtcatgtcattctctcctgccgacccggcacgacttgccctaggcgaatcagcctcccccgaagcacttgaagcctaccgtgaagccaacggcctcaacgatccaatgatggttcgctatttcgacttcatcctcggcatgctcaaaggcgacttgggaacctctagcggtggcgtagctgttaccgacattgttgcccgcgctttccccatcaccctgcagctaacattctggggactcatcatcgctgttgtagtggcgttgatcctcggtgtcatcgccgctctataccgagaccgctggcctgaccagttgattcgcgtggtctccattgcggctcttgctactccttcattctggttggctatcttgctgatccagtggttgggtactatccctggagcctggggtttcttcccagcacttgtcacccggtgggtcccattcagcgaagatcccgccacctacttcaacaacatcgcacttccagcgattgcgttggcagtccccgttgcaggttctttggcccgcgttgttcgtacctccatggtggaagaactggacaaggactacgtccgcacagcaatcggtgcaggtatccccaaaactgaagttgttgcccgcaatgttctgcgcaatgcgctgatcaccccaatcaccgtgattggtcttcgcgttggttacctcatgggtggtgcggtgatcattgagatcatcttcaacatccaagcaatgggacagctcatcctagacggtgtgacccgaaatgacgtctacctcgtccaaggtgtcaccctcaccgttgccatcgccttcatcatcgtcaatatcgccgtggacctgctctacgtcctggtcaatccacgtattaggagcatctagatgcgccgtaaactaaccaccacattagaaaacaagcccggtgcacgacttggtggcttccgcgcacttgcaccaacttcaaaaatcgcgctggttttccttctcctgatcttcctcctcgcgatctttgccccactgattgctaaatacgatccactggcctccggaactccagtccagcctccaagcggtgagcactggtttggtaccgacgccatcggccgcgatattttctcccgcgtagcccacggcgccagagcctccctgatcattggtcttttcgctacgggtgcagcacttctagttgcggcagtgttgggatctatcgcagcgactgcaaacaaagcaatctccgaagttctcatgcgcgtcctcgacgtaatcatgtctttcccaggaattgcactggctgcagtcttcgttgcagtgttcggcaacggcgttccagttatcgtgttcgccatcgctttcctctacaccccgcagctggcccgcattgtgcgtgcaaatatcttgtcccagttcggtgaagactacgtcaatgcttccaaggtcattggcgcatcaaccgctcacatcttgatcaagcacgttgcccgaaactgcatggctccgattctggtgttcgccaccgtcctggtcgccgatgcgattgtcttcgaagcatccctgtccttcatcaacgctggtgtgaaaccaccatcaccttcatggggcaacatccttgccgatggtaaagccctgctgcttagcggcgcatggtggccaaccttcttcccaggtttgatgatcctgctgaccgttctctgcttgaacatcctttctgaaggcctcaccgacaccctggccagccctaagccaaagcctgtttcagcttctgcaaagaaggcactgaagaaggaagaatccggtgaaaaggaaggctccggaatcgtgcttgggcacaccacacgtgaagaagccaacgcctcactgctcgcatcacttgctgcgctatccaccagcgaaaacaattccaataaccggcttatatttgatggcaaccccactcctctgttggaagttcgcgatctaaagatctccttccccaatgctcacggagatatcaatattgtcgacggcgtgaacttcaccgtcgccccaggccaaaccatgggtcttgtcggtgaatccggctgtggtaaatcgattaccgcaatgtcgatcatgggtctgctgcctccaacagcaaagatcgaaggcgagatccttttcgacggaaagaacctccttgatctgaaaccagacgagctcaatgcactgcgtggacatgaaatcgccatgatctaccaagatgcactctcctcactcaacccatccatgctgatcagcgcccaaatgaagcagctgacccgccgcggtggaaagcgcagtgccgaagaactcctggaacttgtaggccttgatccaaagcgcaccctgcagtcctacccgcatgagctttcaggtggccagcgccagcgagttctcatcgcaatggcactgaccagaaacccacgcctcctcatcgccgacgagccaaccaccgcgctagacgtcactgttcagcagcaggttgtcgatctgcttaatgaactgcgtgaaaagctcggattcgccatgatctttgtatcccacgacttggctcttgtcgcccgcctggtgcacaagctcaccgtcatgtacgcaggtcaggttgttgagcaaggaaccacccgcgaaatccttatcgatcctcgacacgaatacacccgcggtttgctcggatccgtgctctccatcgaagctggtgtggaccgcctctaccaggtcccaggcactgttccatcaccaaaggaattcgtggcaggcgaccgctttgcaccacgatcagaattcccagaacttggccttgaccaaaagccagtacttcgccccatcacgggcacagagcatgcatacgcagcaaccgatgaacttcttgccgcaaagggagaacaacgatgacctcgacaatcgacaccaggcaacccatcctggtactgcgaaacaccaacgtgatccacaagacccgtaccggaaagctgtttcgcccagaccaggtccacgccaacaaaaacatcaacttcaaggcctaccgcgatgaagtaatcggcatcgtgggtgaatctggttgcggaaaatctacccttgcccgcgttatggttggcctgcaaccggtcacctccggcgaagtgctgttcaaaggcaagcccatgaagcctcgtggtgcgcagcgcaaagaactcggcagctcagtatccgtcgtgttccaggatcctgccacctcgttaaacccacgaatgaccgtgcgcgaacagctcctcgatccacttcgagtacacaaagttggcgatgaagcatcccgcaaccagtgggtttcagagctgatctccatggttggcctcccgcaatccgcgttggaagtactcccccgacaggtttccggtggccaacgccaacgcgtggccattgctcgagcacttgcgctgaaacctgacatcatcgttgccgacgaaccaacctccgcgctggatgtatccgttcgtgcgcaggtcctcaaccttctgctggatctgaaaactgaactcggcctgggattggtattcatctcccacgacatcaacactgttcgctacgtttctgatcgcatcgcagtcatgctggctggagaaatcattgaggaaaacaccacctcagagatcttcaacaatgcgcagcaggactacacccgcactctgctcgaagcgacaccatcgctgctgaacaaaactcgtttgtagtctccaaccctttattccctcacagcgggcttatcactttcgcacaaccggcctaagtgataagcccataagcagtattaaccagtaatccggcaccaatgagaaacagtgcgatgccaccaaccagggtgataatgcgatccgcagacggtaacttttgcagaccaatacccctgaccaatgcgattgttcccaaccaccacgctcctgagccaagcacgatggtggcacacaatgccaaggtcctcattttcatatcttccccattcccaatgaactgaggaagaatcgctgcaaagaacaacagcgctttcgggttcgtggcattggtgataaatcctcgaaaataacctgcactcgattgactagcagcagtttcagattccccggtattttgggaagcacgaaacatgttcgtgcccatccacaaaagcactcccgcaccaagaagttgaatagcgctcaatactcccggagctgatagcaataatgcagttgctccggctatcgcaagactcgcatgtaacatcagtcccgtcatgattcctgccgcagtcatgacccccgtgcggatcccgcgggttgcagaatgtagaacaagaacaaggtcaggtccgggcaccgctaatgccaccaataatgcgagtgcgaatgcgacccatgatgctgcgtccacgtgtacctcaatttctgttcaaagaatttccagaaactaaatgtacgaatatgattcgttagacttcaaacatgaatgaatttcaaatgaaacaagatcaatctccaaaattagattcggtagattggaaaatcctcgaacttttacaggtcgatgcaacaatgccgaacaaggacatcgcagccaaagtcggtatcgcaccgagcacctgtctagaacggatccggcgaatgcgacgaaatggaacaatcgtagccacccgtgcgcacgttcgcccaagtttgttgggtagaggtgaacaggcttttcttggcatccaaatccgaccccacgcccgtgatacagccaatgactttgtgcaaaaagtactcgcacttcccgaaaccctcgcgctctacaacgtcagtggcagcgaagactatcttgttcatgtcgccgtagcgaacagcaccgaattacaatctttgatcatcgataaactgctcgcactgccacaggtcgcgcactgtcgaacacaactaattttcggtgagccttgggtcgctccgcttcgacaaagcgacggacaataaagccaccgacattaaagcaacagtcgatcccgacaaactacaggggtttacttcctcttaggtgatttgtggaagtctttatacagggcaagaaatccactgagaattagtgtgaaaataactgcccctgccaaaccgccccaaaacttagtccaggattgcgcatcaaaaaggagcattaaattgggtacagccgcaaatgcgtagaggcgcggaataaaccaatcacagggctttttgtaattcgaaagtccccacaccacagctccgatggctattgcactcgaaatccacatcactaatgcggtggagttgttgtcccgaaatcccaaaatctgctcggtagccatcccgccaagcacgatgatagcaacgagattccagactttaggtgaactcagcttgggcatgccccgaccataccttgaagccagccccctccagtccccgccagctccaaacagaccaagtcagcccaatccctacagaaaacttaagccttccacaccactgccgttgctaccgatgcacgaccctcgctgcgaccagtgaatcccatgtgatcagtggtggtggcagacagtgagcatggtgcgccgatgatttcggagatgacttgttgtgcttcttcgcggcggggtccaaatttgggggtttggccaaccagttgggcggcgacatttccaatgacgtacccgtgtgccgaaagcagctcccgaacttccttcaacaactgtgtaccagaaacaccatcgtattcaggtctccccacaccaacgaaagagcccaaatcccccagaccagaggcagaaaggagagcatccacaattgcatgagctacaacatcaccgtcggagtggccttcgcagccgtcgacgccttcaaagaggaggcaggcgatccagcagggttttcccgcttcgatttggtgggcgtctgtggcgattcctacgcgggggatgattgggttagtcacctggtacctcaaatattgtgggttcggcttcgtcggtgatgcgttgtgccagcatcatatcaatgggggttgttactttaaacgccattgggtcgccttgtacgcagactacatctgcgccgtaccattccatcaagctggcgtcatcggttgggatgaagcctgggttggggtcggcgaagaatttctcattcgctgcaacaagttcggacagcaggaagccttgtggggtttggacggcgcgaagttctgcacggttgggtgtgtcgacaactactccgccatcaggggacactcgtttgatggtgtccgatactggcagtactgggatgactgcggtggcgccttcgtggactttgcgcaccacgcgcgcaatcatgccgggtggtgtgagcgctcgggcgctgtcgtggattaagacaattgcatcgggggtggcgtcgtcaagcgaaattgcctgaaggcctgcccagaccgagtccgcgcgctccccgccgccgtgcacgagccgtacgcgtaccccttcggggtcgttcaaaagaccgcgtttgcgcagcaaatcgcgggcgtaggtttccatgtcggggctgacgaggatgatgatttcgtcgacgctttcggaggtgagcatggcttggagcgagcgctctaaaagtgtgcgttcacgcaacgtgacgaatgctttggggatgggtccgccgaggcgggttccgcgccccgccgccgcgaggagtgcgatgacggggattcgtgtagacgacatgggcgtctaatcttcgtcgtcgaagctcagatcgtcaagatccacgtcggaatcgtcgaagtcgtcgaatgcgtccttcttctcttcctcgtcgccgagcaggtcagcgcggtggcgagcaatggtctcatcgacctggctgaggaaagcatccgccttctcatcgtccacggtttcggcgagcgcgagctcaccaacaagaacctgacgcgccttggagagcatgcgcttctcaccagcggaaaggccacgatcctgatcacgacgccacaggtcacggacaacctcagcgaccttgttcacgtcaccggaagccaaacgctcctggttagccttgtaacggcgggaccagttgccggcttcttcgacgtcaatttcacgaagaacagagaaaaccttctgcaggccctcctcgccgacaacgtcacgcacgccaacgagttcagcgttctttgctggaacgcgaacgacgagatcggaatgattgatctggagaaccaggtagtccaccgtctcaccattcatttcacgctgctccagggctgaaataattgcagctccgtggtgcgggtaaacgacggtatctccgaccttgaattccattcccactccttctaatggcggttccatttttgctagaaccagccggtggcgcccgcattgtccatgcaagcgacctatttaatacttcaccctgctgcgctacccctcaaatttcaatcgaattcggggcaggctttaacctatggaattctaccatatttaacgtaacttcagcgccttgaggcgcagggataatgcttttcgacgcggccctccacccgcaatctacggttgagcggccgaggccaaggcagccgtttctgctcctgttgttaatcaggaaacagaaaaggccatacttgaaaccatgacgaacccctcccccgcgctaaatgaaaccctttccggcagggtgctgatcgttgaagatgagcgccctcttgctcgcatgatttcgctttatttaagcaaagcgggtttcgataccaccacgatccacgacggcgccgctgctccagataaggtcgctcacctgcgccccgacgtggtcattttggatcttgggctgcctggtcttgatggtttggaagtgtgcaaacgcatccgcgcgttcaccgattgctacatcctaatgctcaccgccaggggttcagagcgggatcggattacaggtttggaaattggggctgatgattacatcaccaagccgtttaatatccgcgaacttgtcattcgtatccagtcagtaatgcgtcgccctcgaaaaatcgatgaaaccatccaaaatggtttgaccttgacttatggccacattgagctggacaccttggcgcatgaagtcactgtcaaaggcgttggggtgacactgacccgcacagaatttgagctgcttcaagccctcatgcacaaaccgggagaggcagtgtctaggcgtgatttggtcagccaagtgtgggataccacctgggttggcgatgaacgcatcgttgacgtgcacattggaaatctgcgccgcaagctggaagcacctgcgccgggttcacacttcatcgacaccatccgaggtgttggctaccggatggccttcaaatgacagccctcatcccagctcgccacagcctgacttttcgtctgctcaccgcgcagcttgctgtggtgttgatcagtctgctggccgccctgattgtggctgccttggtagggcctgcaattttcaattctcacctggatctttccggcccgattgatccccgccagacggatttccacattcaggaggcctaccgggacgccaattacattgccctcgcagcggcacttcccaccgcagtgttgagctccattggtgtgagtttttggctttcccaccgcctgggccagccgttgtggcgactgtcccgggctgcaactgccatgagctccggcgactaccaggtgcgcgtacccatttccgatgtggataaagaggtcgctgctctatctctcgccttcaattccatggcggatcagctcgaacacacagaagaactccgccgaaacatgctctccgatctatcccatgaaatgaacactcccctttccgtcctccttgtttatgtcgacggtttgcaggacggcatggtggagtgggacgccgacacccacgcagttttcgccgagcaacttggccggctttcccgcctcacatcagatcttgatgatgtctctagagcccaagaacaccgcttcgacctggtctacagcaccgtcgccatcggtggtctcattcacaatgccgccggagccgccgcaggttcctaccaagaaaaaggcgtggccctggaagtaacaggcagcgattccaccgaactcatccgcgttgatagccaacgcttcgcccaagtcatggccaacctcttctccaacgccttgcggcacacccccgccggtgggaaagttcacgtccgcgtcctgcgtcaaggcgtgggaaccatcgtcatcgaagtcatagacaacggcgaaggaatcgcccctgaacacgtaaaatacgttttcgaacgctacttccgcgccaaacgatccgactccgacgaccaatccggctccggaatcggcctcaccatctcccgcgcactcatcgaagcgcaaggtggcacactaaccgcagaatccgctggcctgggcaaaggcgcgaaatttaccatccgactaccccttttaagcaaataaaaaaattgcttttcgacgcttccctccacccttgaacaatccacatttaagatttatgccccttttgtttgcccccgtttacaccctccgtttaatcaaccgactgtgtgaatgcgcttaaacggactagggttgtgagcagcatatccagatttttctggataaatcctggaatttcttaaaaccaatggaggacgaatccgtgaagtccctgaacttggctgcccgtcgtggcgcgctcgtgaccgtggctgctgcgtcagctcttgcgcttgcatcctgcagtgccggacagatcacccagacctcaagccaggttgcagcagttgatggcaaccaggcaggctccgcgaacgacccagttctggtgcgtgatgtaaccgtgcacctcaccaccgacggcgaagctggagtaaagttcaccgccatcaaccaggacacctctcacacttctcacacccttgagtccgtcaccgttgacggcgaagaggttgagcttgatgatgcagagccaatcgagcgcaactgctccctcgttgcagacatccagtccgaactggatctgatcgaggagccagaagttggctgcatccagcacgtagcaacttctcttgagaacccaggtttcgcatacggcggagtcgtgccagttgagttcgtcttcgacaccggtgcgatcaccatcgatgccaccgtttccgcacctgtcctcgagtcaggcgtagaaaaccgcgaggtcggcggagacactgcagaggcaagccaccactaagcctctcaaagctgcttgaaccgcccacttccaatgaattgttggaggtgggcggttctttttcaccccttttcgaacaccgtttctcttaatgtccatcccaccgtttaaggtaggggcatggcaaaaaaggttcgcagcgtacacgagtgttctgaatgtggttattccagcccaaagtggttggggcgctgccctgaatgtggttcttggggttccatggaagagcgcacagtcggtgagtccggtggtgcggctcgtgctgctgtgtcgggtgctgcgccggcaggcttgaccccaacttccccggcagtgcccatcggtaagatcgttgcttcccaggccacaagcatttccactggtattggagagttagatcgcgtactcggtaacggcatcgtgccaggatccgtcgtactcatggccggtgagcccggtgttggtaaatccactttgctgcttgaggtcgcaagccgttgggcttcaatgaaagagggcgacgggacccgcaccgcgctgtatgtcaccgcggaggaatcagcaggtcaggtgcgtcttcgcgctgagcgcaccgcagctgtcaaagacaccctttatcttgctgctgaatccaatctggatgtggttttcggccacgttaaccaagtgaaaccgagcctcctcatcgtggactccgtgcaaactatgcatgccgctggcgttgaaggcgttgcgggcggtgtcgcgcaatctcgcgctgtcacagccgcgctcaccacgcttgcgaaaacctccggaatcccaattctcttggtaggccacgtcacaaaagacggcaacgtcgcaggtccacgcgtccttgaacacctcgttgacgtcgttttaaacttcgaaggtgaccgccactcctccttaagaatgctccgtggcatcaaaaaccgcttcggtgccaccgatgaagtcggctgcttcgaacaacaatccgacggcatcaaagaagtccccgatccctccggactcttcctctcccaccgcggctctaccccagacggcaccgcggtcaccgtcgccatggatggcgtgcgcccgctattagcggaggttcaaagcttgcttgtcgacgccccctccaagaatccacgcagggtcgtcacgggcctcgacgccaatcgggtccccatggtccttgcggtgttatccgcacgcgccggacgccaaacccaaggaaaagacgcttacgtggcaaccgttggtggcatgaaagttggcgaaccagcaacagacctcgctgtcgcgctcgctactgcctcggctttagccaagaaaccactaccagataaaacagtggtactcggtgaagtcggcttggccggagaaatccgtcgcgtccccaacgttgatcgcagactagccgaggcggaacgtttaggttatgaaaaagcagtcatccccggaggctcaggcatcaaacaaacaagcctgagagtcatcgaagcttcaacacttgccgaagcacttgcagcagtaagcttataaagcatgacaccaacaaccactcctgtatcaaacccagatgccctttccactggaactcaggatgtgcacaccctcaaaggaacgttgcagcgcctcgccccaggcacaccacttcgcgatggcttagaccgcatcgtccgaggacacaccggcgcgttaatcgtcattggtgatgatgaaaacgtctcctcgatctgcgacggcggctttgaattcgacgtttcgtttgctgcaacccgactccgcgagctgtgcaagatggatggcgctgtcatcttgtcttccgaccttgagcgtatcaaacgcgccaatgttcagctgctgccttcaccaacctggccaacccaggagtccggcacccgccaccgttctgcagaacgcaccgcgcttcacaccggtgtgccagtgattgcggtatccgaatcacaaaacaccatcactctctacgtcgagggcaaatcccacatgttggagcagccagctgccctgcttaaccgcgccaaccaagctttgggaacaatggagcgctaccgcgatcgtctcgatcaggtcaataaccgccttcacctggctgaactccacagctatgtcaccgtgattgatgttgtttctgtcattcagcgcgaggaaatgctgcgccgagtgggtgaaatcattgatggcgatgttcttgaactaggcaaagacgccaaggagattcagatccagctcagcgaattacgtggcgataatgaccgagaacgtgaatcaatcattgctgattaccttgtcaccgacggtattcctgcagatgaggaaatccacgcagccctcgaagcgatctcacatttagatgataaggctctgctgaatcctgcgaacatcgcgcgtgttcttggactgccaccgaccgaggaagcacttgatgagccagtcactcctcgcggctaccgcacgctcaacagaattcctcgagtgcaaaaattcctcatggataaactcatcgtggaattcggcaacttggatgcactgctcaatgcgtcagtagaggatctaagtgcagtcgatggtgtgggctcactgtgggcacgccacatcaccgacggacttggccgtttaagttaggttaaaggtcaccgctggtgaagggttattaccgaccacagtgtgcaagtagtagccaccggcggggacatcagtgcggttgttgcactggtttggcgctgaagtggtacgagaccatgttgcctggaagtagcgatcctcgccggcagggaacacgctcgtgccgtcttcaactgcagggttgcagtcgacatcagaccagattcgtgcgttggtcgcgagattgtatacctcgaaacggagtttgttctcctcgaggtcaatttcgcaatcaacagcagtcggattatgcacagccataaataattctggctgcgcagaacctgagaaagtcggctgattagtgcttgcggaaatcaccaagtcactaagctcacaggtcttttttgcatctgctgcaacggtggatgttgcggttggttcagcactggaagtctcttcttctgtggtggcttcagtcgtggattctttagaagaagaactagacgtcgtggaagattccattgaggaggtcactacagcattatttggctgctcttcctcaggctccgatgatccacctcgaagcgcgacgactgcccagataatcaaggcaatcacgacgagcagaactaggagcgctgccatgcggcggcgcttgtaaatgacttcattatgtctcggcgttcccacacagaacactctattactttcatcggcctgttcagcggattagcgttttgggcgtgttgagtgtggggttacgtcgaaaaacaattagctgcgcttgatgccgatccatcgatctgtggtgaactcctcgatcgcccaatcgccgttgaagcggccgaggccagagttctttgaaccaccgaacatcacgtgtggttcatcgttgacggtgaggtcattgatgtgaaccatgccggaatcaatctgcagagcaaactgggctgcacgatcaatatccttcgaccacactgccgcgctcaaaccaaagtcggaagcattggccagctctgctgcgtgtgcctcatcatcggccttcagcacgctgatgagaggtccgaagatttcctcacgagcgatttccatgtcagaggtgacatcagagaacacatgcggatgaaccagtcggccttcaattggcccttcaacctggacggttgcgccttcctttttggccaactcgatcttttccttcaaaccactgagctgactgtcattaatgacaggtccaacaagggttccttctgcgcttggatcgccggttggaatgttcttcactgcttcaacgaacttctctaggaattcatcatgaactgcagcatcaacaatgactcggttgattgacatacaaatctgtccctggtgtaggaaagcgccaactgcggcagcctgggcagcggcgtcgatgtcggcgtcggcaagcacaacgaacggcgcgttgccaccgagctctagtgcaacagttttcattggtccaccattaattgccagctcaccgacacgacgaccgactggggttgaaccggtgaaagaaatcagctttggcacggcgtgggtgacaaagtgatcaccgatttcagatcctgcgcccgcaaccgtgctgatcacgcctgcaggaactccggcctcctcaaagattcgtgcaggaattacaccaccagtaactggggtatcactcgcaggcttaatcactacggcgttgcccacggctagtgccggagcaaccgagcggatcgagaggttcagtgggaaattccatggactaatcactccgacaacgcccttggctacgcggtacacacggttttctttgcccggagtattcgaaggagaaattcgaccatgcacacgaccagggaatgaagccgattctttagtgatgtttcctgccaaagtgatttccaaattagccttggaacgcgtcgagccggattccttgatcagccattccacgatttcctcccggtgctcttcaagaagttcagccgcacggtagatgatggcagatcgttccgcagcgggcgtagctgcccactcagcctgggccttcttcgcggcttcatacgcggcatcaacatcagcaatggaagcttgtttgctttcggcgattacggaatcgtcgtaaggattgatattggtggaaattcgatccgagtttccctccacccactgacctccgatgaggtgtttggtggcgtcgattccagcaaatgttgcagtcacaaggtctcctaaagttgattgtggatacttcaccaactgtacctttagttacaaacttgtgatttttatgaaatcaatcactgctgccctagaggtcgatttgcgggcctggatttccaaaagggccatagggctgagtggcgttcaccgccgttggaatcgattctgcgaggtcactttttcgctgttcaggacgggaattgtgatagtttccacagcgatcaaactggtgcgccaagattacctaaaaagccgaacttctggcacctgtgtccggttcccaaccggttctcaatctctaaacctctaaaccggacaggcgttccaaaacctggaaaaaacccagagtcttggcacgcctgtctggtttctctaacttgagtcccccgaactaccaaaccacactgcccacggcccccaaatcaccgatcataggcaatctcagaccgaaaactaacccacgttcttgctaattacaggttcagtacgaccgtcagagagtcggtagcgcaaaccaatgattcccaactcaccggtttcgaccttctgatgaatctctggagaacgggacaacagttggtttaccgttgccacaacgtggtgttcctcgaattccttgatggagctcaggccctctgccttggcttctagaatggatggtgcaaccttttcaaccaaaactcgttggtagcctccgggaagtgcaccgccttcaagtgctgctgcagttgctgcaactgcaccacaggattcgtggcccatgacgataaccaatggaacgccgatggattcagtggcgtattcgatggacgcaagcactgcttggtcgaggatttctccggcagtacggacaacaaagaggtcaccgagaccgacgtcaaaaataatctcaactggcactcgagaatctgaacaggaaataacaacagctgcaggcgtttgtccattgcgaagttctcttctgcgcggggcgtcctggtttggtcgatcttcgttgaaactgatgaatctttcgtttccggcaagcaatgcttcccatactgcgggcggagttctatcaacattacgcaaaggcataagctttattattccactcggtgtgacatatgacctaaagtgccagtcagtacaatcatttaggtcatgtcatttacagcttttcaaacagccctgctcgtgtggtttagagcaaatgcccgcgatcttgcgtggcgtgatcccaatacttcagcatggggaattctcctttcagaggtgatgagccaacaaactcccgtcgcgcgagtcgagccgatttggcgtgagtggatggaaaaatggcccactccggaagatttcgcgaatgcgagcaccgatgagattttgcggtcgtggggcaagttgggctatccacgtagggcgctgaggttgaaggaatgtgcggaggtgatcgtcgaaaagcatgccggcgaggtgccggatacggtggaggcgctgctcgcgttgccggggatcggtgattacacggcgcgcgcggtcgcggcgtttcattttgggcagcgcgtgccggtggtcgatacgaacgtgcgtcgcgtgtaccagcgcgcggtagccggacgttaccttgcggggcctgcgaaaaagcaagagcttatcgacgtctcccttctccttcccaacactcacgccccagaattctctgccgcaataatggagttgggtgctcttatctgcacggccacttccccaaagtgtgacacctgcccactgcttgaccagtgtcaatggcaaaaacttggctgtccctccccgagtgaagaggagctggcttcagcgaaaaagcgtgtgcagaaatttgtgggaaccgaccgacaagtccgtggcctaatcatggacgtactgcgcaatgccaccgcacctgtgccactatccgcgattgatgtcgtgtggcctgacgatgcccaacgctcccgggcgctgttttcgctcattgaggacggactcgcggaacaaaatgaggcgggttatttccacctgccacggtaaaccactgcgcgcctgcaaaaaacagtaggtttaagtaatgcttggtctctctcgtcgtaagtttgccatgctcgctgccttaactgcgggaatcgttggcgttgttgccactggttgtagtacgcccgcagaacctgaaacgatcgataatccggtgttcattggtatctccatcgatccaattaaaaacctaagtccgaatcacgctgcaaacctcttcgctttatctgcagatggctcgggaggaattttccaagaactcgctcccacatactttccgtcgatccatcgattaggaaacggattcatcgcacccgatagagattctttggtagttgtcgacgcttctctaaaggaagtttatcgacacgaagtggccaggcttggtgttggaatgcaaactcaatcagctaggtctccactgcataaatcagttgccttctccttcaatgaaggaacagctgaagccccatatagacaccgcatcgtctccgcaactgagaaaacatcagcttccgcaatgacagatcagcggcacttcgcgcttactgcatgcgatgacggatccacacggtgggtcgaatattcccctgaccgcggaatggaagatccaatgggccccggctcagcacgcatcgtgactctccaggccgacggagaactcagtgaaattgacgttgagtggaatttcccggatcggccctccgccccaattattctgtcttgcgaagatccaagcgcttatatagtttcagaagaagacatcatctatgtaaaagacgaggtaagccctgccgaatccataggaaaattacctgcatatgaaattccggaccgcgcccgattcgatacagtttccggcgaagactacttcgcttttacgtcaactgggatgctgacacgcatcaatattccccaagcaaaaatcgtctacgcacaatccattgacctctacggcaagcatccggtttccataactttcgattccgaccgtgcatacgtggttacttccggggattccggggaaagccttcttgaaatcgacttgaatgatccaacatgcacttcagatcagctctcgctcactggtttcaacaaattactcacagctcggaaacctaagccagaaccgtcgatcatcatcgaaaccatcttgccaattgacccaaactactcactgggttgtaagagttagattttggacggaagtgtgtatgccgtttggcgccgttatttcttccacctgccgcgatagttcaaaccgccaggcaacttcactgagattccaccacgcgaattaatagtcaccggcccgattcgcttcgatccggaaacgccagacttagaaacattcagccaactgtcttttccggtcttaataattttccgataattcagtcccatgtgaaccagcataatcttcatcacatggtgtgtgcagaaatatttttgctggtctattgtggcgaccgagggcctttgaaggttcgacaaactgtataaggccttgaatcttgagaatttattttgaggaagcaagaggaagtgtcatgagcaaagttgcaatggttaccggtggtgcacaaggcatcggtcgtggaatttcagagaagctggcagcagatggtttcgatattgccgtagccgacctgccacaacaggaagaacaagctgcagagaccatcaagttgattgaagctgcaggtcaaaaggctgtattcgttggattagatgtcaccgataaggctaatttcgacagtgcaattgatgaggcagcagagaaacttggcggcttcgatgtgctagtaaacaacgccggcatcgcacaaattaagccacttctggaagtcaccgaagaagacctaaagcagatctactccgtgaacgtttttagcgtattttttggtattcaagcagcatcccgaaagttcgatgagcttggcgtaaaaggcaagatcatcaacgctgcatcaatcgctgctatccaaggtttcccaatcttgagcgcctactccaccaccaaattcgcggttcgtggcctcacccaggctgctgcgcaagaactcgcacccaagggtcacaccgtgaatgcctacgcacctggcatcgtgggcaccggaatgtgggagcaaatcgatgccgagctttccaagatcaacggcaagccaatcggtgagaacttcaaggagtactcctcctcaatcgcattgggccgaccatcagtacctgaggatgtagccggtctggtttcgttcctggcttctgaaaactccaactacatcaccggacaggtcatgcttgtcgacggcggcatgctctacaactaggggttgctttcccgcactcaacgcagtttttgagtgcgggttttttcattcttttttacttttcaaacacgtataaacattgctattcggacaaatgggcacccctcaaaacttgcacatacccagcaattatcagaggttctaataatctccttagcctctgttcgaattcttggaaacttcaataaacaggtgtccaccatagggaatataatctacagctgcagccaaggtttttcctaggctactgccatattccctctatttaggagactcccttgaagtcaaagaagttactgtcagtgcttacagcagtggccctttctggcggtgtggtaaccacaacagccatcgtttccccctccattgtttccgcagctgagacaatgacggaccaatatgatccgttttacgatgacactactgtccgggcggttccttgggtgctactgtacccacaaggcgaaaagcgtctgccatctgggacgactttttcactctttgattcaacttcatatagtcctgaagtcttctcggatggtgcagttatgattaaactaactcctagcagtggccaactacatgtctggcttaatagcctatgaacgcctaagcctggagccacaacaaccacattccgaatggtcgcagagtaccctgacggatcctcggaaatattcccggtaacgttaaatttaattccggaagataccctcgtttatgacgccgtctacaaattcaaaagcatccgaactggttccgaagatcaaataaccccatttgtatcaaaccaacctgatgtgcctttccctgcaggaacatcgttcacattaactggatattatgaaattgatcagctgagaagtgcaggatggaaatttgagcttaatcctgtaacaggtgaactttcagtcacagttcctatctctgtaatttaccctgatgggtctcgtgataacacaatcgcgaccatggaatccgtaggccctgatgattctgagcttttcaaaccagactttgatttaatcccaataaaatcaggtgactatatagagataggtgtactcgcaccagggcttcctgctggtacggaattccatctcgattactacgcacttccggatcgattctttgacttaggcggttctacaagcctttcaggcaacggtaagttctctcttggagttccacttacctggaatgatgatctccagctcccgatctcgattacttttcctgacggaagccacacagttgagaatttgcatgttgacgtaacccccgcaaactttgctggcaaccccattgacgagcctaaggacgatgacaaggatcatccacaaccggctcctaaaccaagtggcagctcatttggttctagctagttcctactaaacagttcaaaacagccagctccgcaactacaaggttgcggagctggctgtttatccagaagcgctcattggcaaacagggctattcagaggtttcgtgtcatcaaatccaaacctctgaacttgcgttagcttcaaaaacctccgtcaagatctaggtgtgactatgccacgccaaggacttttagccttccaaaggaaccacatcgaaaccaagaacttccacgctcatgccacgttgttcatcatcagcatggttaccggcagggcgggcatccgaccatgcttgatagtcttcgcgggaatcccaacgagtaactacgaagtagcgatcctcaccaaattgtggacgcaacaactcaaattcttggaatcctttggccgtatctacagccttcttacgagccgcgaagcgttgttcgatttctttttcagcccctgcagggaacgtaagagccgtgatgttaacaaatgacatgatgacctcctccgcagcggaaccccgtccgctgcactattcacaaccggacaccattagtgtaacctaactacattgtttatagccttatgagaatcatcacctttaactctctgacctggcattaattcaattaaatcccgcctggcgcgcttatagcccatttaagacctccgagtttttcgaatgggtatttgcatacacaaagatccgaaaacctcttaaaagctcttctggggaagtatgacttttaggactcaagggcataatttgagctcgaccaaacacgcatgcccaaaatcttcaaaatcccgaacgatgggcccggcaccggaatgcactgatcctgaagtcagtagccagaatcccctccctgagcattaaaaaagggcccgcacgttaggattttcctaaagtgcgggccctttttcaaaaggttgctactccttgcttggagcagtgcctccctgatcatcggtgccgtagtagtcaccggacacctgatcaatgtcggtgccgttttctacatcttcctcaaacttttcaagggtttcaaggtcaatgtcggaaagtgaatcggtttctgggacatcgccgtcagctgcagaatctacatcttgaattgcttccgcagcctcgacagagatctcagagaacttaccttctggcattggctttggacgtggtgtgaaggtgaacttcgcacggtcggtgtccttggactcgccgtcccagccttcgacgtcaacggtgacgatctcgcctgcgccgatttcaccgaagaggatcttctcggacatctggtcttcaatttcgcgctggatggtgcgacgcaatggtcgtgcacccagaactggatcgaagcctcggttagccaggaggtccttggccttctcagtcagttcgatgctcatgtccttctcagccagtgcgttggaaacgcgaccgataagaaggtcgaccatctgaacgatctgatccttggtgagctggtggaagaccacgatctcatcaatacggttcaggaactcagggcggaagtgcttcttcagctcgtcgtggaccttgttcttcatgcggtcgtactgagcatcgctgtcagtctcggaggatccggagaagcccaggccaacagccttggagatgtcagcggtgcccaggttggaggtgaagatcaggacggtgttcttgaagtccacgatgcgtccctgaccatcggtaaggcgaccatcttccaacacctgcagcaaggtgttgtagatctccttgtgggccttctcgatttcgtcgaaaagcacaacggagaatggcttacggcgaaccttctcggtcagctggccaccttcttcgtagccaacgtatcccggaggggcaccgaaaagtcgggacgcggtgaagcggtcgtggaactcacccatgtcgatttggatgagggaatcatcgtcaccgaagaggaatcctgcgagagccttggacagctcggtcttaccaacgccggatggaccagcgaagatgaaggagccggaaggacgcttaggatccttcagacctgcacgggtacgacggatcgcacgggagacagccttgacagcttcatcctgtccgatgatgcgcttgtgcaactcttcttccatgttgagcaggcgtgaagattcagcttcggtgagcttgaagacaggaataccagtccagttggccagtacttctgcgatctgctcttcgccaacctcagcgatgtcctcgaggtcgccggagcgccactgcttttccttctctgaacgctcttcgccgagcttgcgctccttatcgcgaagacctgctgccttctcaaagtcctgagcatcgatcgctgcttccttctcacggcgaacatcagcgatacgctcatcaacctcgcggagggaggaaggtgcggtcatgcgcttgatgcgcatgcgggcgccagcctcatcgatgaggtcaacggccttatctggcaagaagcggtcgttgatgtagcgatcagcaagctgagctgctgcagtaagagcaccatcggtgatggatacgcggtggtgagcttcgtagcggtcgcgcagacccttcaagatctcaacggtgagatcaaccgaaggctctggaacctgcactggctggaaacgacgctcaagagctgcgtccttttcaatgtgcttacggtactcatccagggtggttgcaccaatggtctgcagttcaccgcgggcaagctttggcttaagcagggaggcagcgtcgattgcgccttctgctgcacctgcacccacgagggtgtggatctcatcgataaacaggatgatgtcgccgcgctggttaatctccttgaggaccttcttcagtcgctcttcgaagtcaccgcggtaacgggaacctgcaaccagggaacctaagtcaagggagtaaacctgcttgtccttgagggtctctggaaccttgccgttaacaatgtctagtgcaagaccttcaacaactgcggtcttaccaacacctggctcaccaataagaactgggttgttcttggtacgacgggagagcacctgcatgatgcgctcgatttccttatcgcgaccaacaactggatccagcttgccgtcctttgcagcctgggtgaggttgcggccgaactggtcaaggaccaaagaggtagaacgctcgcctgggctgcccgaagatggacgaccgccaggagcagctcctgcaccaacagcgtcaccgccagtaggggcgccctggccgccctctggggatccgccctggccaccttcgtagccggagagaagctgaataacttgctgacgcacgcgtggcagatcagcaccaagcttgaccaggacctgggcagcaacgccctcgccctcacggatcaaaccgagaagcaggaactcagtaccgatgtacttgtgtcccatttgtaggccttcgcggaggctgagctccaggaccttcttggcacgtggagtaaaaggaatgtggccggtggtgggctgggagccctggccgataatctcttcgacttcctggcggacggcgtccagggaaattcccatggattccaaagccttggctgcaacgccctcgccctcgtgaatgaggccgaggagaatgtgctccgtgccgatgtaattgtggttgagcatgcgcgcctcttcctgcgcgagcacaatcacgcggcgtgcacgatcggtaaacctctcgaacatgtctctccccttaattctttatttctaaattcgctttcacccactttaacgcccttattgggcaaaacttccagactttttcagctcggcttggaattagctaaacaccaaaccatataagccctgttcagggctagtttttgaggcctgaaaggccctgtacgcctgtagcgaacaccgggttggggcgtcgaaaagcagtagtaaagcagcaggaaggtggtggaaagagcaattgaggtacccttgccgtgttcagggataactgattaatcaactaggagacccatgcgttttcttaacaattccaatccgccctatgagctgacatattccgatgtgtttatggtgccttcgcgttctgacgtaggctcccgcatgtccgtggatctgcgcaccaatgacggaactggaacaaccatcccgctcgttgtggcaaacatgactgctgttgctggccgacgcatggctgagaccattgcgcgccgcggtggcatggcgattcttccgcaggatgtgcccgccgatattgctgcagagactatcgcgaatgtgaagaaagcggacctggtttttgataccccaattaccgtaaaaccgcaccacaccgtgggttatgcacgcaacttgatccacaagcgtgcgcacggtgcagccattgttttggagggcgatcagccggtcggcatcgtcaccgacaaggacctcgaaggcgcagacaacttcactcaggtgggcaccctcatgtccacctccctattgacgctgcctgaggatatttcccccgaagacgccttcggaatcctccacgaacacagccgcaaactcgcccccgtcgtcgcggctgacggctcactccgcggcatcctcacccgcaccggcgccctgcgcgccaccatgtacaagccggctatcgacgccaacggccgcctgcgagtcggcgccgccatcggcatcaacggcgacatcgaaggacgcaccaaaacgcttctcgacgccggcgccgacgttctagtcgtcgacacagcacacggccaccaatccaccatgatcagcgccctcaaacgcatccgcgcactcgacgtcaacgtccccatcgttgctggcaacgtggtcaccgccgatggtgtccgcgacctagttgaagcaggcgcaaacatcatcaaggtaggcgttggaccaggcgcaatgtgcaccacccgcatgcaaaccggcgttggccgaccacagttctccgcagtgctggaatgcgcagccgaagcccgcaaactcggcgcacacgtatgggcagacggcggagtccgcgacccccgcgacgtcgccctggcactcgcagctggcgcctccaacgtgatggtcggatcctggttctccggaacctacgaatcccccggcgacctccgcttcgaatccgacggacgcatgtacaaagaatccttcggtatggcatcccggcgcgccgtggaaagccgaaaccaaaaggtcgaagctttcgaaaaagcacgccgcgcaatgttcgaagaaggcatctccactgcccgcatctacattgacaaacgccacggcggagtcgaggacctggtagatcaaatcatctccggtgtccgctcctcattcacctacgcaggcgccgattcgattgaaaccttcttcgaacgcgccaccgtcggagttcaatccaccgaaggctacgcagaaggaaagccacgcgcttcgcgttaagtgttgttgtgcctttgagattgtgccgggagctttagggctcccggcgttttcctattccgcattaatgacttatgtgatctaagactctattgtggtacgcaccatgactgctcaaccagcccacgagccgccaaggcatctccggttcagtacgagcgggatcctcccggacaatcgcgtccaaatgtgggagggccacaatgctcgcgcattgcttccgctcgacattagaaccattgacgatcgccccatgcaggcctccgaaaccaacctgcacctcccatcaatgcggatggcgagcgtattcgggacttcgcaatttgtcgagcgttcagagagtttcatctcagaaaaccccacgggtgtggttgcgatcttctttgcgactgaaggtgaagcagtcttcttccaccgtggtggacatgtagcgcttcggccaggtcaggccattgtttacgacgccgataggccattcctccgcggattcaacaatcgcttccgcgagctagttctcaccatcccgaagcagcgctaccttgaaattgttggctcaaaaggccctgagcttcccgctatttttgagttcggagcaacaggaaccgccaatgaacaagctttagcgcgactagttcaggaatctctacacaggattgaaagtggcgagccgaagcatatcgattccagtggacctttaggaaaaccgtggagcgatatcgagcacgaggcccacggacttatccgcaatgtacttggcgacgccacaagtagcgaagaaggcttaatttctgcagcccagagatttattgacatcaatatttccgaaagtgacttacaagcgtcgcggattgctgcagccgtgggaatcagcgaacgccaactaagtcgaatcttctcagactcaggacaaactatcggacgctacgtcctaaacacccgactggattttgcaaaggaagcgctgtcgacaccggagcgagacaaggtttcggtcagtgagatcggtaagcgctttgggttcgcttccccaagtcatttcagtcgcaccttccgcgagcggtttgaaatgacgccgcttcaatggaggaaggaatcgcagcgtcaatcctttcaagagtgaggtttttgttctcaggcggacatcatcttgcctaacacagacaataagctgaatcacactttcattcgcagtgtgatctgaactacatttctggttactgtacggaacacgctccgtgaatgagataggaaatcccctcgaaaggaccagacatgcagtttcattatgaaggatacgcaaccggtgacccaatggagatgcgcgcggaaggtagcggaatcaaccgcccggacgatctccccgaggtcatggatgttctcatcgttggtgcaggtccggctggcaccatcgcagcggctcagctttcccgattccccaatgtgaccacccgcctcgtagagagaagcgaccgtcgcctcgaactagccaatgcagatggcgtgcactcccgaaccattgaaactttccaggcatttggtttcgcccacgagatcctcgccgaagctcatgaaatcaccgacatggcgttctggaagccggacccgcaaaaccctcgtgagatcattcgcgacaacagcacccgcgagctgccacagcacatcagtgaatttccgatggcgttgctcacccagacccgcatcatcgaccacttcaaccggttcatgaagaactccccaaccaggatgaagcctgactatggatacgagttcgtggactttgaagtagaagaagacgcagaatatccggtaattgtcaccctccgccgcaccagtggcgagcaaactggcgaattggtcaccgtccgcaccaagtacctggtcggtgccgatggtgcacgaagccaagtgcgcaaatcactgggataccgactccaaggtaagcaggctaaccacgcttggggtgtgatggatattcacgcgaacaccgagttccccgacgtgcgcaagaagtgcaccatcaaatctgattcgggtcgcaccatcttgctcatcccacgtgagggtggcttcctcttccgtctctacgttgacctgggcgaagtacctgatgatggcagcaaggctgttcgtgataccccactccaggatgtcatcgacaccgcgaaccagatcatggctccattcaccctcgacgtgaaaaacgttgtgtggaactccatctacgaggtaggccaccgcgtcgcagaccatttcgatgaccgtgtttcagaaaaaacctcgagcgaacacccacgcattttcattgctggcgacgcctgccacacccacagcgctaaggctggccagggcatgaacgtgtccatgcaggacggattcaaccttggctggaagcttggacatgtggccagcggaaatagcccacgcgaactacttcagacctacgctgaagagcgcgaagacattgcctacaagctcatcgagtacgacaagaactggtcaacactcatggcaaagccaagcagcgaaatgggcagtgcccaagaccttgaggatttctaccgcgcgaactctgagttcaatgccggctacatgacccactatcctccttcttccatcacaatggatggcagcaaccaagatctggcaaagggctacccaattggccgacgcttcaagtcagcgatggttggtcgagtctgcgacttcaccgaaacacacctcggtcaccaagcaacagccgacggacgcatgcgcgcatacgtcttcgcaggatccgatgcacttaacggcgagggttctgagctagaccgctgggcagaatgggcagaggcgaaccttgaccccacgcttgtcgacgccaaggtgatttaccaaagcccttataccgagctcgacacccgccaggttccatccgtgttcaaacctgcagtcgggatcttcgaactgaccaatgtggaaaactccttcggtatcaccacggactccgacatctttgatagtcgcgagatctcccgcgatggtgtcgtggtggtagtccgaccagaccaatacgtttccggaatcttcccactcactgatacccaagggcttggcgaattcctcaccggatacttccccaaaatgaaaggcgcacatcagctaatcaacgcgaactaaggcacagctgttaaaacagtggacgttctgctcaaattaagcagaatgtccacttctgtctagccgcgtacagctcgaaggactcgaagagtcttaagactgtccctcactctgcgagcagccattgcgctatcggcagctacctgcaaggtgcgctggtgggaagcgtcgacaagcatctttaagtagcgttgatgtatgcgctcacttcaatcggtccttgacctgctgacttctaagtccaaagtggctaccaaaattgtggtggaacgaattgaaaagcatcctgttcatggattgggatggatgatgtatccgccatttcatccatggactgatgcttcgaccttgacgattgagcgaaacggaaccagtcggcgcgcgagtcagaatggcgttgcggttcttcatcagcatgagcaagttcaaactatcggtctagccagctattttatcgactccaagatttgggtaaacgagctggctggccttgatcgtatcaacatttctgagagtgaagttgctggtcgtgacgtattagttctgccgttatctgatctgactttaagcatcgatgcgaaatacggcgtggttttggctgcggaagacagcgatgaatcagtgcgcgcggtatccgtggagttcctggaccagtgggtagatgaagaagaacccccagcggaagaagtgcctaaatatacggaaaccagggaggaacttcctccacttgagattcctccggctccttccggaaatcgtaatctccgagttctgtgcacgtggggagcgatggaaggaattattcctgagtggaaacccggcgatcaagtttcactgtttttgtctttcgacctcgacgatccgccgttcgaacagctcaaaaccactcgtcgcgggtacaccgaacctggcgagatttatggaaaccagcgcagctataaatttcacgctgatggttggaacgctgttatttccgccaaagtgccactgcgcaccgaagaaaacctcaccggctacttcacccacagctcctacgcggacacgagccgccgcacgtcagcggtcatcaccgcagtctaccgccacggtaaggacgcaattatcgacgtgaccctcgacggtgcgaaacctcctagatatcaagaatccttggattggagcagcaccagtacctgtgacggtgaaacaatctggctgtccgataagagcttgcccttcgtccgcggtttcaatgtctccacaggcaagctagtacacgagatctccatacccaccttcaatgagatcgccctcgaatccggcaatagagcccgcgcagcgaaaaaactttgggaacttccagatcttaaagaggcaaccgaccctgtcccagcgatccccgcgggctggaaactacacaaaagattcgggaaaaacttccatatcgtaagcgctgacaacggaacctggaaacaaaccatccttaggatcaaacccttcaaagcaattgagcttgatcttggatacgccaagatttcgacgatttaccaatacggtgaacgaatttatctgcgttccgatcttcaccagatcacgtttaatcaggatcttgaaatcctcagtgtagaggtccacggaaatcccgatgcaggttattggccactttccgatcttccaccaggggattctccaacgctgggatttcctatcggatcactcatgatgttccacgaacaacaagatatctacgctttccacgatcctaaaacaacaaagcaactaacaactgtgaacttgcccaaaaggcagtttgaagtggaatatgcttctcagaacagaattgttatttcgctgaaaaatccagaaagccgcctcattgacaaactgttggtgtgggaaccacaaaccaggtggcgggaacaaaacctggagagctgagcacggtttgattaacgtcgataggcttgagaaatggaatccgttgatgaactcctgagtctgatccgccgaggtgcagccaccaccgtgagtatgaaacttcaggtgacccgagctccgagctcccttcacttcgagggtgggatgagaccaacacagctcttgaagtacgtgaatctagatggtctaaacatcgatcgcagccacagtaccttccacgtgcagcaagatggggccgatgtattacgcggatcgggaaacatacggtggtgcttcgaagaagacgatatcccctacgaagtcgacgtggatgacttatttatcctcggtggcttagacaacttcataaatccccttggagtgattgagataatgaatctccactccttagagattcgccaaatttcatccggcacaatttcagaacgaaaaacttggatctttcccactgctgctcgctcattcaatcaaaatctagtacacccgcaaagcattgaaatcgatgcacaaaccggcgttattttggctatggaaaaccgactacaacgtaccgaagttgaatcagtagagtacccaacggatcttcctaatcctgcatggacaggtccagccatttcttggccactaaaagacccatcaatcgatttccctgacccgctcccccacagcatttccgaattaccacctcaatccgataatcctcggcatttgcgagtatccatcagcttagatgcagtggaaggtgcttttccgcgctaccggatcggagattcaatacgtattccgcttgtctttgcccgggacacgcccttcatgtccggcttagaaacaacacgtcgcgcctggattgaggcggccacggaaatggacatccataacacatggcccataatcctcaccggtgacggctggactgcactctctcattcagacaaaccaatacgccacgaagccgagttaaagggatggtttttccacagtttgttcggcagtgaaatgcccttgactgatctgaagattgaacgaatctacggaggcctgggtactttcgacagcggagccacccggtggcaagaactcacagacacagatgatgcctacacagaaaatggcagctggctgttggaagttatcgtcgatgccacccttgacggtgcaattccaccaccacttcagccacaacagtttgaagcatccatcactcacatcgtcgatgagcaactatgggtccttgggcagatgcttccagttctacgatgctgggatcttgaaaccggaaaatacctggggcaaacctatgtacctatttcggtttctcatagttctcggcttcagttttcggaagggttgattcacgattatgaaaatgcctggtcgctgaatcctggggtgcgcatgcttgcggagccacagccgtggatagagcctgtcatagaactcgacgttccagcgccatgggaattacaagaaagcttccccgatgggctttactccctaactgatggagagcaaacagcactgggtcgaagcactccagcaggacaattggaaatctgtgtaatcagcaatgacggatccaggatcttaaacgcaggccgagtagaagacctgtactttgtgcaattctggggcatgaccgtctttttgaattccaactttcaagtgcaaagtgccgaagaacatcagcttggtgcgaaacgtgaacgctggattacacaagaaggcgtagctgccaagttcaccgaagaagatgaaatcgtattcctcgatcagatatctggaagcgaaataaccaggtggaaaacaccagaaggatacttcactgaggtcagaattctgtcaccaaaccacttcaacatactggttactccgcctactggttctgactatctcaaaccagtaccttcctctgtctcagtgtttagagacggtcaatggagcaacattaaattcgaggacgtctctgtagaaatctagggctttcgacgcttgagccccgcgcacctgcaaggtgcgctgtagggaggcgtcgacaagcatctttaagtagctttgaagcatgcgttcctttcaatcgatccttgacctggtaaattcagcatccgaggtggctaccaaaattgtgttgaagcgcttcgaaaaacggataaccagcgaaactgactgggtaccgtatcagcggtttagtctttggtcggttggttctccgctaacgatcgaacgcaaaggccccgatgtgcgtgtgagcaaggacaacactgccgttcttcagcgctatcaaagaccggaagcagaaggactgatcagctacttcatggatccaaagccatggataactgaattggcaggcctgaatctggacgatgtttccgaagatacagttgcaggtcggacagtattagtggttcccctatccaatgtcattctcagcatcgatgcggaatttgggatgattctaactgcggaaaacgacatagaaaagatccacgcaatatctgtcgaactcttagaaaaatggagatcatcccattaccctgagccgcattttcctgcagcggttctcccacctgcgtcgactggaaaccgcaacctccgagttctatgccctgagttttccattccaagtgtcaacgttggtgatcaggttttactatttttaacatttgatcaaaccctgccaccagtagatcagcttgaaactactcgccgcggatacactgatccaatccagcttgactacgaccaccgccaatacaggtttcacgccgacggttgggatgccatcatctccacggtggagccactacacgacgaagaagaactcacaggttacttcctgcaccgccttgacccagatagcgcgtacccaaccattgcagtcgttacagcagcgcactaccacggtacggacgcaattatcgacgtgaccctagatggtgtgcatccacccaaaaaccaagaaactcttgaaggcatcagcactagtaccagtgacggtgacatattttggctctccgatgaaagcttgcctttcgtccgtggattcagcgtgtcaacaggcgaactattacacgagatctccatccccacgttccaagagatcgtcctcgattccgctaatagagcccgcgtaaaacaaaagcaatggcctcacgatttcagtgattgcaagggaaaaacatgggagcttccggatcttaaagaagtattcgaagctgtcccttcgattccagcaggttggagattgttagacagcttcgggaaaaacttgcacaatgtcacacgcgaaaaccctcgtcttaatgacaacttttggcttcaaacaatccttaggcttaaaccatttaaagcagtagatcttgatatcggccgatcgataatcacagcaatttacccatacggtgatcgaatttacttacgcgctagtaaccaccacatcacgtttaaccaggacctcgagattctcaacgtagaagtctttggcgaccctgaggttcccgaatctggtctaatttatcttccacctggggattctccaacactcggttttcccaccggaacactcatgatgtttcatgagcaagaaggcacatatgctttccacgaccctgaaacaacagaacaaataacaactgtgaacttagacaggaatagtttttcagtggcatattcttcccgaaccaaaattgttatttcactgaaaaacccagaaagccgacctaccaacaagctgttggtgtgggaaccacaaaccgggtggcgagaacagaacctggagcgctgagcacgcttaaggtgaggtggcggcgggaggcgtcgagaagcaaaaaaatggggcagaaagtcaatgaccttctgccccattttttggtatttagtgagcttcttcctcgacgcgagtgacgaagagggaaacaaccaaagcgatcaccgcgatgattgcgcctgcgatgaacgcaaccttggtaccagcggcaacagcttcagcatgcgcagatcccgaagacgctgcaatggaagtgccgaaggaaagtgctgcaatcatgatcgctgttccggctgcgcctgcgagctgttggaacgtgttcaaaattgcggagccgtgaccatagaggtgcttcggaagggcgccgagagcggtggtcatgagaggggtcatcatcaaacacatgccgatgctgaacacaacgtgcatgaccacgaccatccacacgggtgaattctcattgaggaaagtcatcgaggatgccgcgatagccagcgcaattgctccgggaatcagcagcggacgtggaccgaccttgtcgtagaaacgtccgatgaatgggctgatcagaccctggaggaggccgccgggcataacaaccaaaccggtcaccaaagcagtaactccgagggaagtctgcaggtagattggcaaaaccatgacggttccgagcatcgcgccgaacgccaaaaggatggtggtcaaggagaagctgaagttcctcaccttgaaggctcggagatccatcagtgctttgtcttgcttgccgagttggtgctgtcgcaaagcaaagatgaggagtgcgatggcgccaacgacgatcgcgaagatacctacggtgccttcgccctccaggattgctccgaaggaactgaagccgtacaccaaaccaccgaaggcaaacaccgaaaggatgacagacagaacatccagtggggtgatcttggtttcgccgatatttttgatcaagaagaaaccaattaccaaagcgataacaacgatcggaagcatcatccaaaacaaccagtgccaggtcaaagagttaagaatgacaccagacaacgtaggaccaagcgccggcgcaacagaaatcacgatggaaataatgcccatcatcgaaccacgacgctccgcaggaaccaccgtcaacgtaaccgtcatcagcaaaggcatcaccagcgcagtaccaaccgcctgaacgatacgagcaccaagcagcaccgcaaacgttggagccaacgccgcagtcaacgtaccaaccgtaaagaacaacaacgcagtaacaaagatcgtcttagtggaaaaacgatcaagcagataaccagtagttggaatcaccactgccatcgtcaacataaagccagtggtcaaccactgtgcagtagtttcaggcacggagaaatcttccatgatggaaggcaacgcaaccgacagaatggtttcattaagaatcatgatcatcgcggaaaccacgaggatcgaaagaacaacaacgacctccctaggcagcttcgcagctgccggagaggtctgagtattaatttgggaatccatgaatggagaaaaggcctttcacagcatgaagctcagtttctagagttctctaaagttgcgaaactgagctatgagaaaaaactactaaagagtgccacaagcaagtgcattgtgcaaatggtggttcttggagtgtttaggcggcttgcttgaggtgctcaggtggggtcttctgcaaagtgtttttgaggattccgatgaactcacactccccatcttggttgaggtctaactgtttcggatcgattcttaagaccgcatagccctgattgaggaagaatttctcccgatcgcgttcagccatgagcacctcattgagctccggggaatcatatttcgaacgtccatcaatctccacgatgatccactcattgatcaagaaatcgacgaggaaatacttgttgtgcgattgatcgaaacgggcctgcaccttcactgactggatttccgggagcttggcctcccgaaggattaaccgagccctcgtctcctgagcactatccgaattgggaatcgacaactcaatcgcctgccgatacgccttcacaccccgatgcctcgggaaactttccgcactgtgcattaacttctcacgcgtaagcgatggattctgtcttcgagctgaatcaatagtgaccacagccgccaccaccccatcatccaaagcgatgtccaaaaatgtgcggaacgctcccgtaactcggatcccatgaacctctcgaatatcacgcgacgagaggtaacgatctttatatcgcatcccggacggccaatgcttggaggattttgaacgtagcctttccggcaacagacacaacacggttttctcaacagtcaaagtttggtatccccataacctcgccgcagactgccccgctaccactgctttgtccacagtcatacccactgcaaaagctcgggcggctgctttatcccatgcaggaaggcttcggtacttttcagcattgattgcgacttcatgagtgagtttaatcatttgaccattactgattgccgcagaagtctcggtatcgctatgcagaagtttcgtgagattgactagttggaattcttcttgccagtttttcatgaccccactatggatccgaaggcataagaagccaaggatgaactttgcagaaaactgaaaacctgtggatagattgttctatccacaggtttggaggattcaaaatgctgttggtagctggagtgtgctaataggcgacttcacgtactcgacttcgcgtgctcaacttcacgtgtgctgacttcagtgggcgatgtcaggattttctaccgaagtcgtgtggtgagaagttgagtatgagaagtcagcacacgtgatgtcgccccttcagccactaaaagatccccggcaagccggaggtccttggagtcaaacagctcaaactccagtccatcccaagcacaaagagcaaaaacctacttttgttctggtttcaccattgggaagagtacggtttcgcggattccgaggccggtgagggccatgaggaggcggtcgattcccatgccgttgccggaggttggtggcatgccttgttccattgcggtgaggaagtcttcgtcgaggaccatggcttcgtcgtctccgtcggcggcgaggcgggcttggtcttcgaagcgttcgcgttggatgactgggtcgatgagttcggagtatccggttgctagttcaaatccgcggacgtagaggtcccacttttcggtgacgcctggcttggtgcggtgttggcgtgtgagtggggaggtttctactgggaagtctttgacaaagattggtccgtagagttggtcttcgcagaggagttcccagatttcttcgacgagtttgccgtgtccccagccgccgttttcggggacggagaggccgattaccttggcgatttcgcggagttcttcgacggtggagtcgatggttacttctggttgtcctgggaatttgcgtgcgagggcttcgttgagggaagggtacatctcgatgactttccactcgccgccgaggtcgtattcggtgccgtctgcgagggtgaccagggtggttccgaagacttcttgggcgacggattggacgagacccttgatcagtttcgcgccggtttcgtaggttccccaggcttcgtaggtttcgagcatggcgaattctggggagtgggaggagtcgacgccttcgttgcggaagttgcggttgacttcgaagacgcgctcgatgccgccgacaacgcagcgcttgaggtaaagctctggtgcgatgcgcaggtagaggtcaatgtcgagggcgttggagtgggtttcgaatggtcgtgctgctgcgccaccgtggagggtttgcagcatgggggtttctacctcaaggaagtcttggtcttcgaggtagtggcggagtgcacgcatgaccttgatgcgggtgagcgcgttggtgcgggcttgttcgcgcatgatgaggtcggtgtagcggtggcggacgcgggtgtcttcgctgaggtccgcgaatgcgactggcagtgggcgcagggacttggaggccatgtgccaggagtcagccatcacggagagttcgccacgcttggaggagattactttgccgcggacggaaacgatgtcacccatgtccacatcggctttccaggccttgagggattcttcaccgactgctgccagggacagcattgcttggacggtggtgccgtttccttcttggatggatgcgaagcagagcttgccggtgttgcgaacgaacatgacgcggccagcgattgcgacctcaacgtcggtttcttcgcctacttcgaggtaggttacgccttcttcgcgctcttggaggtcttctgtaatgacaacaaattgggagcgcaggtcagagattgagatggtgcgatcaacctcgactgggtaggcgtccaatccactgtccagaatgcgctcgcgcttttcgcgacgaattcgcagctgctcaggcaaatcggcggaattgttcttggaagtgggattggaattagtcacgatttcctagggtagtcgaaaggtatgcgaactgggtaaaccgggatcagccttcgatgtttttgaagccgattccaaggggtaggccgacgttgtcgtggagttggacatcgccaagcgtgatggctgcgaagagtcgggcgtctccgatttcgggggctggtccaagatccaggccacggatttctacataatcgggggtcacgcctgcggctttgagcacttgcgtgactgtttctttaaccactgcctcgccgtgttctgccgaatgcgcaccggcggtgagggctgctgccaggctcaatgccgtttcgcgggagtcttcgggcactgaaatattacgcagggaaatggctagtccatctggcatgcgcacggttggaacagaatgcagttttactggaatatgcagatcattaagggcgcgctggactagaaccaccagctcatagtccttttcaccgagcaccacatcagttgctccggtgattcccaacagccccagcaccttggttacttccgcaccttgtggggtaagtgttgggccacctgtaacttccacccggatgccgtgaggccatagcgtttcgggattgaacgggaagatcgcgtcgataagctcttcccttaaacgtgcgtgatccgattccgggccggcataggcgacgacgaccaccgcaccggggatgcgttttgctgcgcggatgagcgcaatatggcctgcgtggaggccatttcccaagggtacgagcaccactggtttgccggttttgcgcagggcgctgccgaacatgcggatctgctcgacggtatcaaaaactctgccctgaccatgcgtgaaactcaacggtcctccttctgaattgcccacagctcaatatcttgcgcgcgggaaatctctgcctgcctgcgcgccaaatcccggaaaaggcgttgcctgccggggttgttaatcgaatcgtactgggcaatgacctcatccaacgaaggcagtgcctggaattgctgtgcggaatccataacgatgtcagaggtcacatcgggatcgccaagaaattcatccaggaaatacgacgcatcgcgctgcaaggtgcttaaaaatccggcataggtcagcgctgcagccaactgtgcgcgcttgtcatcggcgatctcgacaatcgagccaccgagctcccccaccaaaagccccacgatggtctcccccaactcatccaacgcggacgccacccaccggtcctgaccaatcgggtgcgcagacatcacgatgccgccggacgtctccagcggatccatcacagtgatgccgtgcgtgagcgaggtatgcaggaacatctggccacggcgcgcaaaagcagaaagcttttcgacgtacccctccaccccgtgggcatcaatcacgacaagctcaaagtcacgaatatcttcgggcgcgtgaagcacagtcacgtagtgcccgacagaatctaatttctccgccatgttgacggtggatgatccatcatcaaaaattccaacgcgaaggcgaggagcctgcattagttgttttcctttttccttgctgctgccagaagatcagccacgctcaaaccgccttggcgttcatctttgcgtcggcgtccgccagtttcttcgggagctgcgtgcctacgccttctgcgacctggtgctggttcttcctcagcttcgacagcaacttcaactggctcaggttctggtactggttccggcaccggtgcaggttccggcattggctctggaactgcaacaggctccgggacttctggctgcggtgcctggaactgctgggaaagctgctgggattccaactcaaggattcgtcgggcttcggcacgcagcatggttggctcatagccccattcacggccagaaagctcagacagctgggtgcgcatttcctccagttgaagtttgatttcctcaagggtttcctgatcgcgtgcacgacgggattcagaaatctccattttttcttggacgagttcagcttctagtcggttgagttcagattggtgtgcgtattcgagggtttccttctcccgcgcagcagcttcgacttgtttgcgggaccgataaacaaggaagaatccgatgattgccgcccacagcgctgcaagaagtgctattttcatggcgccgtcactgttggccagcagcatgatgacgctggcaatcagggcaagtccaatgagtactgctagcagaatctgtccacggtcgacagaattgccgtcgccggaatcctcgtgtgacaggtcttgattcatgaattccaatctagctgatcgcttcgccagattggggaggcggagcctcacagcttcgctctaaataaagtccggcagctgagagtgcgattccgcccagcgcacaggcaataactcccggaagatcattcgatgctgcggacaactcaccggcgcgtgggattacataactgccaattcccacataaacgccgccgaaaattgcgccaccccacgcacacgctcgacccagcatggccagataggcaatggtcacggggttcatttgggatttgtcctggccgatcagcccctcatcgaggcgaccttggaccttcacacctgcgaaaccacacaccacggccaacaaccaaaaagtgatggataccgtgatggaaatagaggtcatggatccataaaaacgccacgtcaaaatggcggacacagcggcgaggaaacctcccgttgcgatcaaccaacccgctgacgttttctgcatgaaagccacgactccttaaatcttggtgacaccttcaatgtctgtgggatcaagattatccacatgttctgcaatggtcgtgccgtgcaggacggcatcaggttctgcttccaaccaagggatcaacacgaaggcacgctgccaagcccaagggtgtggcaaggtcagttcgggatcctcagaaaggatctcttccccatctttaatgatctgcacgatatccacatcgagggtgcgtggcccccatttgcggacgcggacccgctcggcggcttcttcgagtttttggccacggcgcagcaactcgatgggggtttcttcaacctcaacaacgagcactgcgttgaggaattcatcctgatcctcaatgccccacggtggggttgagtagatcgcagactgcgccacgatctcatctttgaattcctcgatcactgtgttgagcagcgcgtagcgatcatccatgttggaaccgatggacaaaactgcatgcattaggcgttgctccttccagcagccatggatttcctggaacgtcgggcaaccaccgcgacgtcagcaaaagtacgtgggatcggtgctttgggcttatggatggttacttccaccgcatgaagcgcatcaaatttagccatcacagcatccgcagattccgtggccaccgtctcgatcaaatccctggatgggccttccacgatttcagcaaccaacaatgccaacgcgccgtaatctacggtgtcggaaaggtcatcgctggcacctgcggcatcgaaatccatccagcaggtgacatccacaatgaagggctggccttgctctttttcaaagtcgaacacaccgtggtgtccgaagcattcaaggcctttaagttcaatacgatcagccatggtgagttcctccacttcgccacaatgcggcaacatcaacagcgtcccttgatactgggacatcgtgcacgcgcacaccccatgctcccatatgtgcagacactgcggtcaccgctgcggttgctgggtcggcatcaatgggggtgacatctaggccacggtctttgcgcacgccagccaggaatcgcttccgggatgctcccaccaggatggggaaaggtccagaaataaactcgggcagtgcttgcagcaaacgccagttgtcttcacgtgatttggcaaaacccaaacctggatcaagcacgatctggttttcggccacaccagcagcggtggcgcgggcgacaagatcatcaagcactgcgtgcacatcggctacaacgtctccaccgtgatctgcctgacctgcggcatcaccgaattggagggtgcgccagtgcatcaaacacacgggaatttgcgcttccgccatgacagaaaacatctcaggatcagccaaaccgccagagacgtcgttgatcatggagacgccagcgcccgcggcagcctgcgccacggaggcccgcatggtgtctacggaagtgtggatgccggcgtcgtgaagcgccttaatgaccggcacaacccggtcccgttccacggacgcgtcgacgcgcactgccccaggccgggtggactcgccgccgacatcaatcatgtcggcgccagcagccaccaattccttggcatgcgcgatcgcctgatcaacgtcaatgtacttgccaccgtccgaaaaggaatcctcagtgacattgacaattcccatgaccaaacagcgtcccgggatggtcaaagaggatacgttcatttagtgcccccgaatcagggagaacacctcagcgcgggaggcagcgttgttcttaaaaccgccgcgcaccgcagacgtcgtggtcacagcaccaggcttacggattccgcgcatggccatgcacaggtgctcagcttcaatcaccacggccacggcctgggcatcaagcttttcgacgagagcatccgcaatttgggaggtcaagcgctcctgaacctgaggtcgcttagcaaacatatccgctaaacgcgccagcttggacaggccagtcaccttgccggacttacccggaatgtaaccaatgtgcgccacgccaaagaacggcaccaagtggtgctcacacatggagtaaatcgggatctcacgaaccagaaccaactcttcatggccctcagagaacgtcttctccagcacagtggtgggatcctcatgcagacccgcgaaagtttccttgtacgccctagccactcgagctggggtttccaacaggccttcgcgatctggatcctcacccacagcgatgagcaactcacgaatcgcagctgttgcgcgctcctcatcgaactcgcgaactgcagcgtggttatccacggttgtctccttcattttccggattctcctgtgtgccctcagcggacttcccggaatcaccatcgatgggctgatctggaacgacaggcatttctgtggtttcagaagcatccagcaccgactctttttgcgccttttctgggtagtccgaacgttcatgatccggcaaacggaacccgatcatttcggttggggattcctgtgaaacgttacctggggtatgttccgcacctgttgattggtccatgagttcggaatcgccgaagccataggccttcataccagggtgctcaccggatgcggttggagtcgcgtaagggttggggcggccgccacttgaatcaggggactgctcaggagcttgtgccggggtctgagccgggaagccctgctcagctggctgttcttctgcacgtgagcggtgctttccagcggaaccgggcacgctccaatcagctggaggtggggtgccataggatccggcagctgctccggccgcaggtgccacgccggcagaagacgcaggctgcaccggcaacttaccctgagcttccaattccttgcgacggcgttcgcgggttgcgcgggaggcctcaagaatggagaacttctttggtggttcttcgccacgttccagtgcgagctccactggggtttttactggttcgcggttttcttggcgagggaatcgtgtggactcgtcggggaagacttcggcgaccttgcgtgggacgatgtcgtcgaaaagcgcttcgaggtctgggcgtcgcagggtttccttttccaggagtttttccgcgaggcggtccaggtggtcgcggtattcagccaggatggagtaggacacttcatgggctttgtccaggaggaactggacttcggtgtcgatggttgctgcgacttcttgggagtggtccaagtttccaccgccaccgcgtccggagaatgggtcgccctgttcttggccgtatttcaccatgccgacagctggggacatgccatattcggtcaccatggatcgggcgatcttggtggccatttcaatatcggcggaggcgccggtggtgggttcgccgaagactagttcttccgcggagcgtccacccatggcaaagaccaggcgggcgaacaattcgttgcggttgtacatgcccttgtcatcttcttgggcagtcatggcgtgaccgccggtgcgaccgcgggccaagatggtgaccttgtagacgcgctcgatgtcttccaacgcccatgcggacagggtgtgtccaccttcgtggtaggcggtgaccttcttttccttctcggaaatcaccttgccggagcgacgtggtccaccgacaacgcggtcggttgcttcttccagagcgtcggcggtgatcacgttgccacccacgcgggcggttagcagcgcggcttcgttaagcacgtttgccaggtcagcgccggacatgccggcggtgcgctttgccaatgccttgatatctgcatcgggtgcgaaaggcttacccttggcgtgaacttccaggatctgttcacggccgcgtaggtcagggttggtgactgggatctggcggtcgaaacggccaggacgcagcagcgctgggtcaagaacatctgggcggttggtagcagccatcagaatgacgccttgacgatcaccaaagccatccatctcaacgagcaactggttcagggtctgttcacgctcatcgtgtccgccacccattcctgagccacgggcgcgaccaaccgcatcgatctcatcgacgaagatgatgcagggactgttttccttggcctgcttaaacagatcacgcacacgcgaggcaccaacaccgacgaacatttccacaaagtcagaaccggaaattgagtagaacggcacgccagcctcaccagctacggcacgagccagcagggttttaccagtaccgggagggccgtaaagcagcacaccacgagggattttcgctccgagggcttcgtagcgggtggggtcttccaggaagtccttgatctcatggagttcatccactgcttcttcagcgccagcaacatccgcgaaggtgttggtgggcatatccttggtcagctgcttggccttggatccaccgatgccaaacatgccaccaccctgcatgcgggtgaggaagaacatcagcaaaccgaagatgatcaccatcggcaggatgaagctcagcatggacatcaggaagctctcctgcgtcacattggtggtataggaatcagtgttggatgcttccaccttctcaaagatcgctggcgcggtacgagctgggtactgcgcgaggatctcttcaacgccttcgcgttcatccaccgtgatgggttcacgcaaggtcagtcggacgcgctgttccctgtcatcgatttgagcttcggcgacgtttccggcgtcaagctgtgccatcgcaacagaggtatcgacctcctggaagttcctggtgtcactgctaaacagggacaccaagaacagaacgatgaggattacggctgcgataccgccgaactgcaggtatttcttgtttttcatacgcagtggcaaccggctcaactaaggccgttttgcccgtgcctttctcggaatcgaataaaagggatctactagacaactaatcaaacgaagttgagggccaaaacgttccctctttcgcacttttgattactagtcggagtacacgtgaggctcgagggtgcccacatatggcaggtcgcggtagcgttctgcgaaatcaagtccgtagcccacaacaaactcatttggaatatcaaatccaatgtcgaacatgtcgatgttggtggtcaggcgctctggcttacgcagcaaggtgatcacgttgagggacttagggttgcggtttttcaggttgcgcatcagccaggacagggtcagtccggaatcgatgatgtcttccacgatcaaaacgtcgcggccttcaatttccttgtccaggtccttgaggatgcgcaccacgcctgaagaggaggtggagtttccgtaagaggacaccgccatgaactcggactgggtggggatgtcgagcatgcgggagaaatctgccaggaagtagaacgcgcccttgagcacgcacaccaggatgaggtcttcttcggcgtctttgaactcttcggagacgcgcttggccatttcggcgatgcgctgcttgagcttctcttcgctgatcaatactgattcaatgtcggtgccgtatgggttggctggaacattgagatctttgtggtcggccatttctacgttgttgctcatcgtcgcgttccccttgtgttgtagattcaggtgtcaatcagtgatcttaagcttgccactttgccgcaccacttccaaccttccattatcgcttttacccacggctacgccaccctgtccgcgccaatcggtgagcaatcggtcaatggcgtcgagtttcctcgaggtcacagcgatgccttccccacgcaaaaaatccgccaacatgcgtcgcctaaggcccgtaggttccccggccaacgtcacaggaaaaccgtcctgccactctaaacgccgcttctcgacgtcgccctccaccacttcggcatcctccacagcgcgtcgcgccgcaagtgccaaaccaggtacagggtctcccccgtgcacctgcgcaagaagaggaatcacctggtttcggatggctacccgccgaaaggcatcgtcaaaattttgcggatcgtgccacggtttcaaccccaactccacgcacgccccgtgcgtgtgcgcacgccgagcccccagaaggggtcgaataatggatagctcggggcgtcgagaagcatctttcatgcccgcgggattcccccgcaaaccgccaaggagataggtctcggcttgatcatccatggtgtgcgccacccaaatctcatcggtgagctgcgcaaaagccgcgtaccgagcctccctggcggcggcctccatcccctcccccggcgcgacctcgatgctcttcacgatcgcctgtgcgcccatgtggcgcgccatcgcagcagcgttgtgcgtgacttcagcagaaccggtctgcagattatgatcgatacaaatcgccgttacctgggatttctccgcgagcacagcagccaccagcgccaatgaatccggcccgcccgacaacccaatgtgcacatgctctttcaggtaagggcgcaccgccttgcgtaattccaagaaattagggcttaccctaggcagctcaagattcccgatgagggatgccaccttaaaagtccctcagaatcgacgccatctcatccaaagcctcacgcgccggcacaatcgcggaaccattagacacaaaagcaaaggtaaacacacgccccgactccgaggtcaccacccctgccaatgccgatgtatccgtcagagtgccagttttcgcccgcacccaacccgcacctgagagtccgtcgtagcgatcctccaaggttccggttccatgcgcgataggcagcgatgtcaatagtgaactcaactcaggttccgtggcggcgcgggtcaaaatatcatcaagcaggcggggcgtgatgaggttgtcaaagctcaaacccgaattatccacaatggacacgccactcaaatcgaagcccttgtccttgagaatctccaacgtcatcttcgaggtactcgccgaatcggtagccaaatccttcgacgcggccacttccttagcgataccctctgccatcacattgtcagaatccttcatcatccgagcaagacgctgatccaacgtgtcagactccacggatgccagcacggttttgtccggagcgctgccctcatctacggtgtccgcgccgacacgatccgccaacgcctgcgcaacatctaacgccggagtatgagacctcggcagatccccctccgacccaccaatgcgggcagcctcaatcatcgcgggctccacatcagcgatataaccagcatcaacatccactggatcccacgtactagcaaagccctcatcaggccaaatagacgtatcgatcaacacagtgccaatatcttgcccctcaagctgggtggccaaatcatcgagcatctcctcactcaacgtgacatcaccacccgccttaatcaccaccgttcccggctgctccccctcaacaaccttcgttgtgatggtgtcctcacggccaagctcatacaacgccaccgccgccgtcaaaatcttcgtcgccgacgccggcctcaccgcagtcccctgattctgctcccacaccacctcaccagattccacatccctggcaacaccgacaaaagtgcccaaccgagaatccgcagcctgcgaggtcaaatccttctccaaagtggcaaaatctggggcttccaaagcatccggatcaatcgcagaagaaaacagctgctcaggcatctccaccgacatgggctccgggtgatccaaaccaaaaccagaatgattcacccacacgccaccaccgatgacagcccccactgcaatcagtacaccaaccgatgagccaacccaccacgcatttttcatgggcgctccttctcctgcaaattttcttgcgattcttcttgcgatatcaggactccaaccttatatcgaccgtcgtctcacgcacgaaccatacgcgcggttccaaaattttcgaggatttccttgccccgggtctcgtttatttttgaacacgctagaattcaagggcagtaactaatttcaacccgggagaaatacctatgagcatcgaagtaaccgtcgaaatccctaagggatcacgcaacaagtacgaaatcgaccacgagaccggaaaggtctacctcgaccgctacctgttcactccaatggcatacccactggactacggctacatcgaccacaccctcggcgaagacggcgacccattggatgcactggtcatcctccccgagtccgtttttccagcagttgtggttaagtcccgaatcatcggtgttttcaagatgaccgacgaagccggcggcgacgacaagctgctctccgttctcgacgacccacgctacgaccacatccaggacatctccgacgtgtccgatttcctcaaggatgagatcgagcacttcttcgtccactacaaggacctggaaaagggcaagcacgttgacggttccggctggggcgacaaggctgaggctgaaaagatccacgctgaggcaatcgaccgctacaaggcataagtcttttgtaaattaagagctgcgcatccctgcgattccggttttccggtttgtttaggtggggtgcgcagctttttgcatgctcgcttgggctgggaggggtgtccgcggctcttcaactccgcaaaacctggcacatgtgacaaagatgtcggattttcagattctttgtcccactggtctggcccgagccccgcctgattcagcattcgagtgccgcgatcaaaccacggtgcccaccaaatccattttcatgattcgtgggcatcgtggtttggtttcaagacctcgaaaccagtcacagatgcccacgaaactcattttggaccttcgtgggcacgcctgtctggctttccaaaagtcagccagaattccagctcaaaccccaaaaatcacaccatcacagaatgcgatttaagggactttcacacccatcccgatacaaatactcattcgaagataccgatcgcttacatcgccacacagcgcatcgttgcagctagtcgcctgattcgcggtatcccttgcgcagatcctccaccacgcggggatgatccagcgtggaaggttccaattcacgaggctgattatccaacccaaacaccccagcagccaccagaacttcatcattaaggaaagtcagtggcggggtgtcttcccgaagctctaattccatgtcggcagggccacacagttggaagccccagtcgccaaatgtgggaacatgcacgtgatatgggatgacttgttcacagcccgccgatttcaaggttgctccaactcgccagaacacatctggagtggtgtaggcgctggaggattgcaccaccatgcggccttgttcgttcagtcgtgctcgggccaaggtgtagaactcttctgaatacagcctggccatggtgtcgttgtttgggtcgggaagatcgatgatgatggaatcgtaagtttcgccattatttccgccggagcgcagccaggtgaaagcgtcgtcaacgatgatggagacgcggggatcttccatcgctcccccattgtcagagcgcagcactgtgttggctacttcgatgacttctgggtctaattcaacttgggtgatctgcattgatgggaatcggaggagttcccgtgctgcgaggccatcgccaccgccgatgattaacaccgattctgcctctggattaaggcttggatacaccagtgattctgtatatctatgctggtcacgagtggaatactgcaaaccgccattgaggtagaggcgtcggtctttgcctcgttctgtcactacgatgtcttggtagtcagattggtgtgaatagatcacggggtcgcggtagagctgtgcgcgggcggtggcaacgatcccgtcggatttcaccaacacggtggctagcgctgcgatcgcgagaagaagcgccaccacggatacgaagaagtgggtgcgcggaagcaaatgtcgcagcagcacacagcccacgaatagtgctgcaacgaggttgatcattccggctgctgcggcaccgcgcatcatgccaagccacggcagcaacacaaaaggccaggccaggccacctaaaagtgcgccaaggtaatcagcagcattcaaggtggcaaccagagatcctgtggttttggcgtcggcgaggcggccttgctggatcatggtcatcagcagtggaagttcagcgccgaccaggatgccaattgcagcggtggcaatcaccagaatccacagggattggccgatggtcgcgaaggtgaaatacagcaccagcgcggaacaaccaccaataagtccaaggagggtttccacaccgaggaaggtttgcgcaggccagttgagaaacggcttgaccagcagtgcaccaagtccaagggcagctacataacctgcgacgatgagggaggtttctacaattccgccaccgttcaagctggtggaaagcgataccagggctagctcatagaccagccccgatgccgcacaaatggagacggaaactaataacagccagcgccagatgggtcctaaatcagacatgcagcgtttacggttcccaccacgatcaagatgacggcggccacgacggcaccggaacggagtttgggatcttccacgagatcacggaaacgtcccggaatgacagcttccaacaccgccatgaccaccacttggataaccagaccaagggcaccgaacactgcagtctccagcaaaccttcactcaaaatatctgaggaggtcagcacagcagtgaccacgatgattccgatggaaacctgctgcgccacggtgatcacagcggcgttgggcagatggtgcacaaacacgagttcatgcagtttacctggggtgatcaagtccaaaatcacaaaaccgaccacgaggatcactgcggccaacacgaaatatgaaagggtgccgagcactccgtcgacaagatattgactcatagtgttctttctatttcacgccaccgccggaaccggaggatccgccgctggaactgcttggtgaggatgggccgaaaccgccgccgagccagatgaacgcaccactgttgacgcggtcaaggccttcgacggtgatggtgcattccggcgtgccttcacctgagatgatgatcaggtttttgctgtatcgcaggtaagtatcgccagttgcggggtcggtggcgcggtcggttggggtggacatgttcacgatttcatccaccaccccactttcgccagcgcatgagtaggtgccgttgtttccgggccagcggtcggagacttggcttcccaccgcaggcttggcaaaaaccgcagcgaacaggcacaacactgctaaaaacagcaggatgaatcctatgcttcggtagtttcgggagctcatggtttgtaaatgctcctcgtgctcacgatggtgagctcttctgggtagaggtggtggctaaaccattcccatacgtcttccagaaattctgcggtcagcgcggtgaggtggtgttcgccggcgccggggaaactggcgatcaaccagtcgtcgtcgccgttggagatttcttcggctgcgcgggcaaaatcttcctcagacagcacggcgacgttggtttgcagcaggtagttttcccgcgtgatgctgtcgggcagcggccagcgggaatcttccgcttcttgtgcatggcaggaaatttcttcccggaaacgcccatcgggcgtttcaacggtaaccacatgcgagccgccaatcaccgctaaatggcaggtgctggggtgtggggatgcgtcgataagcttatcgacgagcacctccggcgattccccattccagctcacgccgagcgcttcggcggagacatctgtaggcatgcaatcgatgtgatgaatcatgaggcctctggtgctgggtaaacggtgagttcgccgggcagcaccgtccacccgagcgatacttcaaatggactgtctttgccgtagcgttcaaaactgagcaacctgtttccgccaacttcggcgagatcccagtattcaaattcaccttgatcagccacgccggtggtgccttcggaggtgaaggtgcccacgccagattcggttttacggtagcgaacgccctccacggtgacatcatgtgcgggctgttgtgccaggtcagggcgggtaatccaccatccgaggttgagttggccctcatcgtattccacgctcaggtactcactgcctttgccaccgtcgagtagatactcgtgccaaatgtattggccttgacggaactggatggctccgcggcagacataatccacgccaccgcgggaaataattgctccaggacccaaaatgcgggcattaaaagtgtcggatccgtcggcaaatttcagaggatcttgacgctgacgaggaggctgcggttcgctctttttcttctgtgctgaaagataaaagaacacgacagcgatgatggctaaaacaccggccaggataagccacgtgatattcatgcgaaactcccatgagttttctaagttcggtacgagccaatcctacagaccgacacgcccctcctcttatcgcgacaacttcatcaaactcgctacatgcaacgccaactgcagcaccactggaatgcccaggaaggtgacgtcattaccagccttttggaaagccaccagagtcatcgactggagttcaccgtcaaccaacacggttactgcctgaagctgtgtgtgcagcaatgcaccagcgagtgcgactgatgtaaagacattggcaccgaatttacgagccgcagtaatcgccaaaatgactgccaagaacatgaaaaggcatcgcctgcagcataaagaatttgataggtcgtggatgtcgtatccaccgagtgcgctgcagctgcaacagctagaaggcctttgaggataccaacaccagccatgggtcccagaatcggagcaaagatggaagacacgatatccactgctttgccgagacagtttccagaacctccaccttgcgcagcgccctctgaatccgcagtgatcgatgccggtagtgctgcgtaaacctaaggaacgttgtttccaatcacaacttggaactgaccaccggattccacaacggtgataacacctggcagcttcttgatatcgtcaccgttcactttggcgcgatctttgagtacaaaccttaaacgcgttgcgtagtgaacaactgaaaaacattttcttccccaccgatgcgcgacattatctcacccgaaagggcttgataatccacttttgtggccatgatggacctccctaaaaacctttaaggactgctttccatctgtttctgaaatgcaaaaaacctggccaccgttggctaaaacgcatcctcaaaaaaggaggcagattcagcatttgaagaccaggttttgcttccagtgcctggaataacaaccctgatggactattgcttatgcaactgaaatttgctctagatcaattctttcaaaaaatgcaagagtgatttccaacccactccgccccagacaagaaaaggccacgcctcccctctttgcaaaagggcagcgcggccatcaaacacactgcttagagctctgaatacggaacttctggatccactagcttctcggtgtcaacgctctttcctgatgcgatgagaggcttgatttgatcaggaacatcccacacattcacgttcattgcggcgagaattcggttttcagtatcaacccagaaggcgacaaattctcgtgtttcaaggtttccacggatgaataccttctcctgcgaaccggtggcgtggccgacgtattcacaacccagatcgaattgatctgtaaagaagtacggaaggttggtaaactcggcgtctttgccaagtagggatttcaccgcagccgcaggttgattcaacgcggtggcccagtgctccacgcggatgcggtgtcctagaactgggtgatcgtggttcgcaatgtctccaactgcgtagatatccgggtcgctggtacgcagtgctgcgtccaccaaaacaccattgtcgatttccagtccagcagtttccgctaggtcaatcactggggtgacaccgatgccaatgactactgcgtctgcgggaaccacttcgccgtcatcaagtcgcacgccaactgcacgtccatcttcggtgacgatgtccgtaattttcacttcggtgcgcaggtcaacgccgtttgccacatgcagatcggcaaagacttgcgcgaccgtttcaccaaggactttcaaaagtgggagctttccaccttccaaaacagtgacgtcagtgccagctcctcgtgccgctgatgcgacttcgagtccgatccagccaccaccgatgaggaccagctttttaccttcaccgaaggttgccttgatcgcgtcagagtcttccacggtgcgcaggtagtgcacattagaggcgtcggctcccggaattggaagtttgcgcactgctgatccagtagcaagaactagtttgtcgtagttaatggtctcagtgtttccgccatcatcaacggtgacttggcgtgaacccgcatcaattgccgttgcacgcacaccttgacgcagcgtgacattgttttctttgtaccactccgccgggtgaacaatcgccttgtcaaagcccacttttccagccatgtactcctttgacagcggtgggcgctcatatggcagataatcctctgctgcgatgagcgtgatggagccttcatacccgtttacacgtagtgcctctgcggttttcgctccggctaaaccgccgccgataatgacgatgctttgtggtgtgctcatgctgtactcctagtccctaaaaaagtggacggtcaggcgcaaggtcgaccgcatggatctatacaccatgctagttaaaaggccgaaaccctcggcgagcgcgctaaatacccggccctaattgggggtgtgaggcagcacacaagaccaaactctaacgaaatcgccggactcctcgcaatcacaagaagcgacgactagcctgtggggacaaactatttcaagaatttattcaacaaaggagttcttcacaaatgaaggaagtagcagtcaacgaagtcccagcaggcgcacagttgatcgatgtccgcgagaccgatgaatacgcagaggttcgagcacagggtgccgtcaacattcctatgagcgagttcgttggccgcatcgatgagatcgatctggaccgcgacatttatgtcatttgcaagctgggtggacgctcagctcaggttgccgaataccttgagcagcgcggaattgaagccatcaacgtaaacggtggcaccgacggctgggttgctgcaggattgccaaccgaggcataagaacccgccgcaaaagatcccggcatctgaattcacgtcagataccgggatttttcacgccctacaaagcccctacatgccctacaaagcccccaacacaccaacccagatacctccaccctcaagtagaagtcgagatttttcatttcactgcaaacatagttctagatcagaccatttaaaaaattacaccctcacctggaattttgcagaaatagggcaagaatcaaaatagtgggaaatccccatgtttcgcgaagtcccattgttggagttaggcttatacccatggctacgcatccagatattcccacagagttgcttgaatctccgagctatcaacttgaacgacttcgacgacgcactcgtgaccatgttgaggccgaattggccaagcatgagaccacgatgagggaattctggacgcttacatgtctggttcattccgacgctgcaagccagtcagttctgtgtgagctgctggccattgatgcatcggatatggtcagactcgttgactcacttgaggtacgcggctgggcgaaaagggaacgtgatcccaaagaccgtcgtcgccaaattgttgcgtcaacgaagaagggaaaaaacgcccaggcggatctgcacaaagttgtgcttgaggcagaggatgctgcgttggatgagtctacgtccaagcagttgaagcaccttcgtaaattggccgcagcaattatctccaccgaagaggactaaatataacgtggcattgagcagtgttccagcacagttcctgagatccgcccaggcgcccccgaagcgtactttgtgggacgtcttagaatccgtcgcctctacttatcctgaggcagcagctattgacgatggccaggtgttgacctacgcagagttgatggaagaagtcaccgcgttggctgattccattcatgcacagggcattcgccgtggtgatcgcatcggtattcgcatgccgtctggtacgcgtgacctttacatcgctattttggccactctcgctgctggtgctgcttacgtgccagttgatgcagatgatcctgaagagcgcgccgagatggtgtttggtgaagcaaatattaatgcgcttttcgacgccaccggcttccatatgcttcgcccgaccgcgggcggcgatacccgtagaccacgcttggatgatacggcgtggattatctttacttccggttccaccggcaagcctaagggtgtggctgtgtcccaccgttcagctgcggctttcgtggatgccgaagcacaaatgttccttgtcgatcacccttccggcccccttggcccagaagaccgagtccttgcgggattgtctgtagcctttgacgcatcttgtgaggaaatgtggttggcctggggccacggcgcctgcttggtgccagcaccacgctccctagtccgttccggtatggacttgggcccatggctgattcgccgcgacatcagtgtcgtctccaccgtcccaactctggctggtctgtggccagcagaagcattgtcacaggtccgcttgctcatcgtcggcggcgaggcttgctcgcaggagctcgttgaacgcttatcgacgcctgaccgcgaggtgtggaacacttacggccccaccgaagcaacggtggttgcctgtggcactcaactctatgctggtcagccagtgggcattggtttgccacttgctggttgggatcttgttgttgtcgacgatgccggcgaacctgtcggaatcggcgaggtcggcgaattggtcatcggtggtgtgggtcttgcacgctaccttgatccagaaaaagaccgcgagaagtatgcgccactgaagtctgttggttggacccgcgcttatcgttccggtgaccacgttcgtctggaagaagatggcctctactttgtgggccgcgttgatgatcaggtgaaaatcggcggtcgacgcatcgagctcggtgaagttgatgccaatgtggcagcgctttccaacgttcgttcctccgcagtggttgttcagaccactggtgcggatcaaaaagttctggttgcatacgtttctttggaagatgctgcagctggatttgatcacaacgtcgcgactgcccgactcaccgaaaccatgcctgctgctttggttccgcgcattcacgtgatggatgatctgcctgtcaccacctccggcaaggttgataagaagtctttgccgtggcctcttcctggcaccgtggtggaagctaatgacctcagcgcaacggaagcctggattgctcaggaatgggtcgatatcctcggcacttctgtgagcagcaaagacgccgacttcttctcccttggcggtacctctctcgcggctgcgactttggttggccgggtacgtgcaaaggttcccaccgctgcggtgcgtgatctttacgatcaccctcgcttggagaaattcgccgagcgtgtcgaggctatcgccgccgacactggcatttctttggaggcgccaaaccaggtggaggagcgcgtcgtcaagcctgtttcttttggcactcgtgtgatgcagaccctcatccagattccgatcatgacgctgcaagcagcacagtggattgcatggttgctgttgggcaacaacatcatggcagcgcttgatttcgattgggctgttcatgtctcctggtggcttgtcatcggcatgattttggtgttcgctaccccgattggtcgcttgccgatcggcggttggggcgcccgcatcatcacccgtggcataactcctggctcctaccctcgtggcggttccactcacctgcgcatttggtccgccgagcgccttgctgatgcctctggctctcgcaatatttctggcgcaacctgggtgaactacttcgcgcgttccctgggtgtgaagatgggcaagggcgtggatcttcactccctgccaccaatcactggccttttgaccttgggcaacaatgtttccatcgagcaagaagttgaccttcgtggctactggctcgacggcgatatcctgcgtgtaggcaccattgaggtccatgacaacgctcgtatcggcgctcgttccaccctgcttcccggcaccgtggtgggcaccggcgctcacctgctgcctggttcaacagtgactggtgataagaccatcaagcctggttctcgttgggctggctcccctgcacaaaaggtgggtcgtgcaaagcaccgcttcccaacctcccatcctccacgcaggtcccggtgggttccggtgttcggcgcgacctccatcgtgttgtcgctgctgccacttcaggctctcgctattggcgctgctatcaccttgtggctggccacgattagcccgcttccactgatctggggtgtgctggtttttgctaccgtcggcgcgttggctgcgttctttgcttacaccgtgaccatctgggtgcttgtccgtttgatccagatcggcatcaagggcggcaccgcaccagtgaggtcccgtcttggttggcaggtctgggcagttcaacgcctcatggacgatgcccgcacctatctcttcccgctctacgcatcccaactgaccccactgtggttccgcagcttgggcgcgaagatcggcaaggatgttgagatctccaccgcggtgatggttcctaaactggctgatatccgcgaaggcgcattcctggccgatgacaccctcatcggtggctatgagctgggtaatggttggctgctcagtggtgaaacccgcgtgggtaagcgttccttcattggtaactctggcatcgcaggacctgagcgcaagctcgctaagaactccctggttgcagtgctctcctccaccccgaagaaggctaaggccaactccaactggtggggttcccctccagagcgcatgcgtcgtgtcactgtcgaagttgatgagggcgaagcaaagacctacagccctggctttggtgtgaagtttgcacgtggcgcggtggaaaccgcacgtctgcttgctccaataacctctggtgtgttggctgcgctgtcactgctgctcatgcagtacctgctcactgagttcaacatgtggatcacctggttgcttggcggactgatcctcatgacggttggtgtgctcgccatgggcattacggttgtgatgaagtgggtttgcgtcggcaagcataagccgtctgagcaccctctcttcagccgctttgtgtggctgaatgagctgcaagatgcgttcgtggaatccgtggctggcccatggttcctcgtgcccaacctgggcaccggcgcgctgaacgccggcatgagcgcgcttggcgcacacatcggccgtggcgcatggatcgaatcctactggctgccggaaaccgacctctgctacatcggcaagggcgcaaccgtgggccctggcgtggtcgtgcagacccacctcttccaggaccgcgtgatgagcctagatacggtgaccgtcgctgacggcgccaccctagcggaccactccgttgcccttcctgcttcgcttatcgacgcctccgccaccatcggcccaggctcgctggtgatgcgcggcgacaaggtaccagcgcatacccgctggcaaggcaacccaattgagccgtggagcaactcttaaataacaacaatcagccggatccttaaagcaagggtccggctttttgctacggcaaaactttaaagattttgcccagctttagcgctgtggccacggtgtctgagtacacctttcgcggcattttggccggcccacgcatagacatccagcgctgctccgcgatgtttcggatctccgcatattttgtaattccctccgcaccatggcggtgccccagccccgactgcttcatgccacccagaggcgtggacacgctcgcccacgtcgcggcgtagccatcattaataccgataccgccagcttccagctggcctgcaacaagattgccggtttccgacgacccaaagacggacgcattcaggccgtagggcgtgccatttgccttatcgacggcttcttccagtgtggctaccttttcgatgaacaccaccggcccgaagacttcctccgtgagcagtggggtgccctctgggacatccgccaataccgtgggctcatagaagaagggaccaatatcagggcgtgacttgccaccgcacagcaccgtggcgcccgcagctttagcctgatcaacaaaggtgctcacccgatccagctgcgcctgattgatcaacgaacccatctcatatttccactcaaatccggcaccaatggacatggctttcgccgccttgctaaaccgtgcaatcacctcctcgtacacgtcttcctcgacataaatacgttcagtggagacacacaattgccccgagttggaaaaacacgcctgcggaagctcagcttccaccttgtccagatctgcatccttggccacaataagagggttctttccgcctaattccgcagagaaacccaccaaacgctcacccattgtccgacccaagatccggcccgtggccgtggatccagtgaacatgaggaaatcacactgagctgcaatcgcaccgccaacaatatcgccagggccggtgacaacctgcatcaaatcacgcggcagaccggcttcaatgagcaggtgcaccatgatcaagcaggagaaaggtgtcgcgaggtcaggtttagccaccactgcgtttcctgccagcagcgccggaacagcatcagatactcccaaagttaaagggtaattccacggcgtgatctgcccgaccactcccttgggcacatactgttgtgtgtttttcgtgatgatcggaagcgcgccggggcgtttcttgtcatttaaaaactttcctgcattgtttgcgtagaagcgggtggtgatcgcaacgtccaacacctcatcggcagccgatgctcgatttttgcctgtttccaactgcacgatgtccatgagcagctcacggtttttcaataccagatcatgaaacttcaggaagatcttcttccgttccactgccgtggtgtgcacccactttttctgggctgcccttgaaagtgcaaaagcatgctcgacgtcttgctcatcaccatcaaaaacaaatccgagggtctcgccagtaaatggcgctataacctccactttcgccgcatcttgggcatttgcggtcagatcaagcagagtctgatgaagttctttaggcagcggacctaaaggaagacgtttgatcatgggcttttaccttcgtttcgcgttctgatgctcgtgtggtgcccagcttatgcagaatccttcacagctgatttaagacccgccaagtagttgtccactgcccatttagagaatcctggttcaatcgtctccacctgaaccggcaacggccgtgaagtggcaactaacccaaagtgaaaacgaattggacttagatcaggtgccgcaaaacaacgcattggctcgtcgtcggattaatgcgcctttgccatgatgaaaaaatataagttttatcgcgatcctcagatctgccaggagatcgcagcagcatagaacaccgaactagatcacaaccgattgggcttacttaaataaaaaactccccagcaccttctactgaaaggtgctggggagttttttcatgcccgcctagtgactagtcaccgatctggtcgcgcccacgaagcacaaccttagggtcaggctcaccaacgagctcgtaatccttgtcggtgtaatcaaacttggacaatacataacgcatcgcgttgatacgcgcacgcttcttgtcattcgacttgatggtgatccacggggactcatcagtgtcggtgtaacggaactgctcttccttagcgcgggtgtaatcatcccagcgatcaagtgaagccaagtccattggggaaagcttccactgacgcacaggatcaacctggcggatagcaaaacgggtgcgctgctctttacgggtcaccgagaaccagaacttggtcaagctgataccagagcccaggatcatgttttccagcattggaacctcacgcaggaactctgcatgctgtgattcggtgcagaaacccatgacgcgctccacgccggaacggttgtaccaagagcggtcaaagaaaacgatctcgccagcagctgggaagtgctgaatatagcgctggaagtaccatgaggtggattcgcgtggtgatggcttctccaacgcaacagtacgggcaccacgagggttcaggtgttcgttgaagcgcttaatggtgccacccttaccagcggcgtcacgcccttcgaacaaaatgatgtggcgctggccagtttccttggtccagttctgccacttcagcagctcgatctggagggagcgcttgaccttctcatagtcttcgcgggtgacgcgctcttcataagggaagtcttcgcgccaggtttcaatgggggttccatctggacgcagaagtactggatcatcttcatccgagtcatctacaacatagccttcgatttgggcaaggtcgataactggaagatcattttcgttggtttcagccatgatgggaagtttacccaccattgactaattcggcgtgccaaaggggcgtctttctggtggcagatacgaaaaaactctgatccatatggatcagagtttttgaaaactttgcccgtgggcgaagttaattagccaagcagaccgatgaggtcagcaactgcgccagcccacttgctggaagcgccgaggaagtcgaagacgtagccgatgaggccggagccggaaaggacatcaaggtttccaaggaactcgtaaacgttttccattttaaattctcctattaagagttgagatgagggggaagggggaaggctgtggattttagccaatcagccaaatcggatttctcttaggaagagaagttatccagattctcgccggtggtgtcagcgagatctccgaagttgtcgaagaagttaaggatggaatcgagcagggttgggatgctctgaagagcggtaccgatgttgccaccgaaggtctcgtagttgccgagggtttccttgagaagggaaagatccatgagaaatctccttgagaggaccagcaaagaaagctggtgatggttgccagtttgctgacgccctcaggacgtcactcaattattcaatcacattttgacaacacgtcaaggcgaatcaggaaagtttcccagcgtgcttttcaaccaaactcagcaaagaattatttgacgatttttcccgtaaatatatcttgacctgcagaaatgttagatatttaagtgaacagggagaaaactttccagctaaaccccatgaaggtgtaacactacttaacaacggctcgattaaagcgaaactttaaaaaagcgattgtcatacacaccctaatatgggggtaatttacaccattggctaagtggggtggtcgaaaaaaggtgtggagttagtcttttttatcaagatttgagatgtctagcaggttaacggaaggttgccgtgcatgtcaccttacgcccctccgaaggtgtggggagacgtcgaaaagcaatatcttttgacacgcaaaagccctcccgcaaagcgtgcgggagggcaattgaggtgcgcgaatgaggggcttagaagccgcccatgccgcccatctcgtctgcacctggcatgccagctgcgcctgcaggctgtggcttgtcagcaacgacagcctcagtggtcaggaacagagctgcaatggatgcagcgttctggagtgcggagcgggtgaccttaactgggtcgttgatgcccgcagccatgaggtcgacgtactcgccgtttgcagcgttgaggccctcgccctgtgggagctgggaaaccttgtcagcaacaacgcctggctcgaggccagcgttagcagcgatctgcttcagaggagcagtcagagcctcgcggacgatgcgaacgccggttgcctcgtcgccggaaagctcaagatcgttgtccaggacgtgagcagcctgcagcagcgcaacgccaccgccggcaacgatgccctcttcaacagctgccttagcgttacggacagcatcctcaatgcggtgcttgcgctccttgagctcaacctcggtagctgcgcccaccttaagcactgcaacgccgccggcaagcttagccagacgctcgttgagcttctcacggtcgtagtcggaatcggagttctcgatctcaacgcggatctggttgacgcggccttcgatctgagcctcagaacctgcgccgtcaacgatggtggtgtcatccttggtgacaacaaccttgcgtgcctggcctagaagtggcagatcagcggtctcaagggagaggccaacctcttcagaaatgacctggccaccggtcagaacagcaatgtcctgcagctgagccttacgacggtcgccgaagcccggagccttaacagcaacagacttgaaggtgccacggatcttgttgacaaccagggtggacagagcctcgccctcgacgtcctcagagatgatcagcaaaggcttgccggactgcatgaccttctccagcagtgggagcaggtccttgatgttggagatcttgccggaaaccagcaggatgtaaggatcttccagaacagcctcgaggcgctccatgtcagttgcgaagtaaccggagatgtagcccttatcaaagcgcataccctcagtaacctcgagctcaacaccgaaagtgttggactcttcaacagtgatgacggaatccttgttcagcttgccaccgccaactgcgtacattgccttagcaatctgtgcgccgatagctgggtcagctgcggagataccagcggtagcagcgatctgctcctcggtctcaacttccttcgcagcctcgagcagcttctcagttacctgagcaacagccttctcgatgccacgcttgatgcccattgggttagagccagcagcaacgttgcgcaggccttcccgaaccagagcctgtgccaatacggtagcggtggtggtgccatcgcccgcgacgtcatcagtcttcttagcgacttccttgaccagctctgcgccgatcttctcgtaaggatcctcaagctcgatctcacgtgcgatggtgacaccatcgttggtaatggttggggcaccccaagccttttccaaaacgacgttacggccctttggtcccaaagtaaccttaacagcgtcagccagggtgttcagtcccttttctaggccacgacgtgcttcctcatcaaaggcgatgatctttgccatgtgtttgtgctcctgaaatatttgtaggacgacactcacgtcttctgcccggtaggcgcccgcgacggcacggttagtgagtgtggaccaacctcacccaccaagcagttgatgatcaatattggcactctgattagttgagtgctaactacttttctagcactcaaggggtgtgagtgcaagattttatagcttcaaatgccctaatcagatacgtgaccagataaaaaccatcacgagcacaataattacggctgccgcaatgccagtgccgatccacaacatcgcagaacgattccgcgcctttcgcttggcctgtcgctgcgcctcatattcttcctctgcgcgaaccgcatcaagcctcacgccttcggcatgctgaaaactcatttaaaccacctcaggaatccacgttttttaggttcttcaaccggggcctcttgggcttcaggctggctggtcggggcaggttgggcaggcgggatattgcttttcgacgtctccagcccctctagaatcccaatttccgagaacaactctctcaacggatccaggcaacgaaacggtgcgataccgcttcgattaatccgatcaccttcaggacttgcacccagaggagacaccgcgaagcactggaacggataagcctcttcaccagctaggggctgattgaactggttcagcaaatgcgtcgcatccaagcactgcagcatgcttcgaatttccagatccaaaatctcgccagcaacgcgatcatatgcaccatcaagcggagcactgtccctgcggaaagttgcaccaaagttgctcatcacgcgctgccaattcaccatgtttgctcctgcatagtgcaggtgatcttggttcacttcagctagctgctgcatggtgtcgaacttagacatgcacagggaaatcttggggcgataatccggtcccaacactcggagcacgtttcttaagacaaccatcggcccatcagtgtccacctcatgagtggggactgaaccttccaacatctgtcggattcgtggaacagacatgggatcaaacagaaaaagaatgcggtccgcgttttggaaaaacgctagttcgtcttcacgagccgaaaaattctcttcctgcagatcttcgcctgccacatccctaaagactaaaaagagtcgctgctctggatgattcgaggttgaaatatcaaagatcaatggacgctgctgatgtgcatcaggagccgatgctggcggagtaggcggaagcaatcccatctgttcaaacagtggcttctcgtatttttcctggtaaatccggcgggtgtgctcatcggcgtataaaaatgatccaccgttggcaacgaccagtttgcgcagcagcttcacgatcaccgcaatgtacatactcttgcccgatgacctgtcacctgccattgcgaaagtcagagttccggaattttgccacccgtctggcagggtcgcatcctggaccgtcgcatcaacaaaaggtgatgaggtcgcttctggatccggcagcacttggaaagtgaaaggacaccgtgtggggagcagaccagtggagggtgggtaaacatcaggagcggtcatgtcgttggatcctctcgtcgtgcaaccgaagtcaacgcgttaaacatttggtggacaggtccagcgagaagacgctgatcatgatttttaatagcgttaatcagcactggatcgaaataggtggtgctggttccatgttccaccaaaggtttccgagaactcaaaacatgcaggttgttggagagttttaagatctcggcaggaatgtcatcagagatcaccaccagcgcatcgtctggggaaatctggtgcaaatccgaattccaccccacttccctcaccggcgcgtacttttccgaaagcttgctgatctcctccggattagcgacacgcacttttggatccgtagcgctactggtcatcacatggatggagcgtccctggctcactactgataaaacaccagtggcgaaagaacacatgagatcaaaggtctcgcggctggtgcttgctttcatcgacgccgtcttatcgaccaacacggtgacattagctcgagcaatatcagctgagccgtccttatcaatggtgcgtcccaacgctgatcgaactgccgaagcctcagagtccaaagaactgtcattgctcacatcgccagcctgcatgcgaatgatgccctggcttgggaaaacgttaagaatcgggatggagcgtaaaccaccgataggatacgttggaagctgcagcgtagtttcttggcgcccagcctcctgaatcaccacagttacatacagcttggttcccgaagggaattctccccgatcgccatcaggaaacaccgtgacctcggtatttccttgaggattacgaatccaccacgtattgccacgtcggttggtttctgtggaaggaacctctacccggaatcctaagtcctcgctgagatcaaattccagacgtgcagaaaatccctcgcgtggtacgtcataggtctggttggaatccagtcgaatcacgttcatgaccgcatgtcctttccaatattattccggctaattgctctgatgatagcgcgcgccatctcagtaaaaatctggttaacatccctagaccgggacactttcttattgatgatatcttggtcgatatagccgagatattgctgtactgctcgagcattggtgagaatcgacggcaaatcctctcgggcaatctgctcaccatatttctcgaatcgtctaatgtcttccgttctgccctcttgaagagttaactgcacgaaactaagaacagaatcgaccgtgagagtagtaaaagccctgtaggtatcttcgtcgccgatcaaagcgactccaaaatacgcccgcaaaagatcccacatgaagtggcttctaccagtttgaacagacgcacccgcaatgattcctgcaaagatctgctgagcttcatcgcttctcgtccagtcttcgatgtctggcaaagaccgatctctgctgaagttcggaacgatatggtccaagacgattgccgcaggtgctctgttcctagcatcgcgttctgcgtccacgagtagttccctcaagcgagggtgcgcatcctcggtgaacttaatgtgtcgccagttgtccatcgctggaaagtctgaaaaactactccgaaaaaagggatccgaagcattaatgcttgtcgcaagctcagttttcaaaaggaaatccaaataggcaacaagatcctgtgccggcgaatcatgaagcttctcaatgctgttgatcgcctgctctgacatattgatgatcctgcgccgactatccggcaatcgcctcagacttggccaatcttgtgattctgatgctctccgaggattgtgaactacctcagatgcacgcgcccaaattgcattggggtttggtgccggagcgacaggctccaccttaggtgctggcttgtctggcacctttccaaacatatgctgatcagcaagtacgcgaagcgggtgcgtgccggaaaaacggccattccggataaatcgcgctaaaccgtctccaaattgagcgagttccttttggctattatccaggttctcgttggcacgaatcagccctgcgacaagttcatcagcatcaaaaccgtcggagaagagcccttctgtcattcgggaccaggatccctgcgggccgaaaggttggctctgtggaatctccggatcgataatcacaatccctgaatgctccgccaacaattcacgatcaattcctgggaccacaaacagagaacgagcctccattgatttatctggagctggcaaggtagcagcacgctcaaaggttgagaagtgcaacagacgccgggcttcattcggagtcaatgtagaagacaacgcttgaagccaatatgctgcctcgttagtgctgttcagaaccaaaacagtagctttatctccagcttggagagcatcttgaagctggtagaactgctgtctgcgatcgccaaacatgctgtcgatcatcatccacgacaaggacagatcagtgatggggccaattctcggctcgcctgcatccaaagggagctcggcagcgttgaccgcggctgcacgaaaaggggtcagcaaatcaggtgaacggtacagggaaatgggataaacagactccagtgggctttctagatccccatcaaatactgcatgggtgaacacattccctggacgtccagtggcatctttacctgcaggaacagactgcatgatcaacgatcggcctgccaaaggacggtactcaaacctcctcggcaacgcatcgatatcttctgatgagatgaaatcatcaaaaggggtcaccgtttcaatatgagtgggcgcaacctccgcgataaattggaggtcttctttagtggcctgagcagaccaagttcccaccttccacccacccctacctgcagttcctctaaaggacgcgtaggtgacatgagtccatctcaaggccacgggcaactcacctgcttccaccaatccacgttcccagattcagcaaggagggagcgggatcgattagagctttcacatgaacgtcatcggactcttcttggtggatgaataggcgaagatagctagttggtggaaggctagcaatcttaggatcgatctcccagtattcaacttccggttcttgctcagatcgtaaagatgaggaactaatgccagctagaagatcagcatactgctgccctcccccatcattgatgatctttcgagtcatcacttcttgaccatcttctggttcaagcgggagacgggacgggtgaatcctcaaagagaactggttgaactgattgtttggtcgctcgctgtaaatagaaaggaacaaacggttattcatcaaatgcagtttgtaactgaatttgtctagacctcggtacttgaggatctcaggctgtccccaaatctggcgtccttcataaactcgggaggcaaacagcgcaacatcgccggcaccaggcagtttcacccgcatgccaccttcctcctcgtaggcttccctatggatggagacaagactagaacctggggcatcggcagttggtcctactgaatgacctgaaccgggctcgccaaaaacagcagtgacttcgtgtgcttcttcaggccaaccaaaagtgagcaattggttattcacccgctcgtacagcttcggacggctaatctctcccacccgaactcgtgaataggtttgtccaacttgagcttggttgcccacaacattgactggggtgaggaagatcgaataccaatcttcaggccacaccacattgcaggaggtcttggtgtcctccaggtcattggcccaatctcttcgcgccaggccaaagctttccagttggtctgtttcaatcgcgttgaactgcaggtcgctttctggtgcttcctgagttcggtaaatccagacttcaccagagtgaggagcatcccacgtcacgtcaaaactcgtgctgaatccgtcgaaacgctcttcgatcgaaattggcacctcgacgacctcagctgggacgtcgatgacgaactcctctgacggcgccgagccgaccagctttccgtggatttccgcaaaacggcgcgcgacaaacttgtactcccggccgcggtgctgcggatggaaacggaatccctggaagttgtttttatcagcggcgatctcatttcgagacgccgtgaccaggcgttcattgctcggagctgcgtagacagcaactcggtgggtgtgttcagcaggagcccactgccccttcacctcagaacctgccaccgacaactcaatgttggaaactgggttgataaacactgattcccccaccaattgcggttgggaattcactgccgaggactccgtaacaccctcgtacatccacacctgatacatgcgataagcagtggtcaaaggctcctgatccacccaatgggtgcccacagtgctcactcggtgctccgctaaatcaggatcctgctcaaacgccatctcatcactaacaatgcggaaaacccgagatgcattgatataagactccggcgcatcccactccagatccaacccacccgtgaggtttgctgtaatccggaggaaaccaccgtgagcctgcttgacctctgcaaagccatcaagtcgtgcgaactcatagtcctgccaattgcggatatcacgatcaattgattgagcttcagcacttgccgaacgatgtgatccggtgttttggcgtcgtcgacgtggtgcaggggttggatcaggttcaggggtttcagggatttcagcaacgcttggttcagcttggtgcgctggcttgcgaaccagctctggtgcaggttcagccataggctcaggttcagccacaggctcaggagccggctctggttccggcgtaaattccggagtaaattcctgctcaggcactagctcaggctctggatccagcactggttctggcgctactacctgctcaaatacctgctcaggcacctgtgctggccctggaacagcatgcacaggctccgattccagttccggttcatactcaggctcatcaatcacttccgcgtagtgataatcagctggctcatcgtcgtagaactctgcgtcaacgggtgtgtcttcgagcgcgtccacggaagcatcttcaggttcaaagtgcttatcaaaatcaaggtcaggggtgaacatcgctgcgtcggtgccctgctcaatgacgtgaagggtgcctacttggacgtatcccaggactcgtcgaagggctgtcgcccacacgagaagagctgggtagtcgccgccaggtttgagctggtcagggtccttagcggtggcgagtagttcctcgtcggtggggagctgatcttcgttgaattttatgcgggcaatgtcgcgccaggttttaaacgcactgagaatttggtattcgctagccattaaaactctcccgtacctggtagttctggccgcttgtgagattggtttccgcggtcaaggaacggcgattcagcgggattctctgagcggaagtcttcattggtgggcattctgtcgaacaaggttggatcaaaggttgtttgttgaggtcggacaaatgagatgtcagcgtcttcggcgggttcactgatttggagcagcacttcgctgattccgatggcatctgattcgttttcttgtggctggtacatgcacagggaaggatccaggctgaggatgcctttcacgcgacctttttcgctggcgatttcgccgttgaagaaaccaacagttaccaggtcttttagtggttgttggtatggtgcgtcgaccttttcgccaccgcgatagatctggagtgaattcaaaataccggatcgaacttcatggctttcctgcgagagttgcagggtgatgtcatcccagatctgcacgctgcgatctgtttggcggaatttttcgccggtcacgaaatccgacaatctggctagatcaccgtaggagccttcgccggtgctgccaaaaagggtgcgttcattgacgctgtttccagactccgctgccaaggcatctgatgcggagttcagcgcagccattacccgttcgctcacccatccctgctggtataggtctcggcggaattgtctggtcagtttctccacggcatctgaatcaggaatagcctcggcgaaaatgactgaatctggcatcgagttaatggggatcggtgattccctgcgggctcgttcaatgttgccgaaaggtcgttccagcagtgcacccataatcttggatacagacaggaactgttggtagcccacttgaatgcggagctgtgcctgctgcgaaatcttcaggttcttcttcgcagcatcaagctcggtgactaggtctttacgcaggtgagtaaatcgaatttcatcgcgagtctcaaaaatgcattgcgcaatccaacaaatcagccagataccaaaccaaattccgaagaatttccacttgaaagcggtgtctgtcgcagcgaaacttacagcccagcgactgatgtccattggagtttcagccaagtagtattctgcagcccaccacacgccaaagatggccgcggaccagaacgatacccaacccaaccagcggaaaactcgggatcctaaacctgttccatcgaaggattttccttgttgggacaggcgattaatttcttgattccaccgcttttcctgagattccatctcccgttggagattttgcagcccagatcccacgaagtaggcaaaactcttcgagttttggtcttgccagcgcttgaattcgccaataacctggcccattccgcgctgcccgcggtcgctttcttttgctaatcgacgctcaaactcagcgacgccttccaggtcgtacgggggcacttcttcgacatcgacagccactttgacctcaacgggcagcccatcgccatagttagtttctgggcctgggataacgtcagcgcttcgtcgtgcaacaaccactcgttgggattgtccagtgtgaacgaccgacggggttctcatcccgttttcaccgtaagcaattgcgcgaggctgagcatcaagaaggctcattgcggtgttggcatatgcttgccacagttcttgaagatcagcggcatatctgattttgaggtcctcagactgcactgccctctggtttttgtttccactcaaagcagacgcagtgacacgatcacccacgcgagtacccgaaccggaattgccgtagacacttgcttgaagtgcatcttctgcgaaggtctttgattcagcagaaaactcagcaaagaagcggttcggtgtagtcaccatcttcttgatccagacgctgaagaactgcttaactaccgcacttccagaaatcgtcttcgttttctcaacatgagctgcagcttcttcaccgatcagtggagttctgaactcatcaagaatttcctgagctgctttttgggcgaaggtatccggattttctgcgtactgcgcagtgcgctccttacctggaatgtccaagcgaggaagcgggttttccgcggtgctgagaatcttctccttgagacgagcctgaactgcttggccgtcaattcgcctgtaaaaagacctcaccaaacgaaagctggaacctttcgcaggtacgagctgttcgattggtgtggatgtgctgccttcccacagtccgtacaagctggcgatattagccacgcagtgcagggtgaaacggtgatcgctgaaaccatgacggtaggtcactgttgcggtgcctgggctgtggctatcttcaggtgccagcatcaggttcacataaccacgaagaattggaagttcctcatcaagtgtggcagccaccgcaccgatcatcacgttggatcggtgaatttggtggtgtgaacagacactgtcgatgatcccaaccaatgggttgagttcttctgcatgaagcatgccttcgctgccatcaatgacgttgatgacaccgatgtgaagcttggtggttcgtgaccgggacaccaactcattgaaaggtcgtcgctgaagctccggaagaccgtcttggttggttgccaagtgggtgacttcagatgaagactcgtggaaactatcggcatcaatccacaccaggttgcggactaggccggtttctgcgaagtcttctagggtctgtcggatcccttcagcggtcagacccctccccagaaacaccgtcaaaatggtgtcctgcgaataggcggcggacatttagaactcaccctcaccaggtagagaaggtcctgaagaaacgtcgcggcgagctacgttcatgtcaaagacctgtgctgatggtggacctgcagccaagcacttttccaggatgtcgatgatttcttgggtgccatcaaaaacatcggctgcaaggtcagcaaacactggaatctgtgctgctagttcacgatccttgacgtcgccaaatggacgatcagcggtggtgaacagacggccttggcgaagcttgtcgcttgggacgtaattttgcgagatctcgttctggcgctgcaggaagttcttcgcagcctcaaaacgtgcagctggggtgacaccagcttcggttcctgggatctggaggacgtttccagccatgcggttgccgtcgaaaagccaatcgtgcagcagcttctcaccgcgggtggtgcgtcctggcaaggatgggctcgcagcatcatcccacagttggcggagctggatgtaaggctcgacggattcaaagacaggacgctcgcctgcccgtgcccatgccaatgatgctgattccagaaggtttggcagccaatcgaggcttccacggaaacgggacactggggtgagcattggggtggagaagttgatccacgaatcagacttctcatcgtagatctgcactggagtggtatccgcagtgtctagagttgcggggaagaatactcgtccgaccagacgaccgatgtaccaacccttgaccatggcgttgcgctctaggtctgtcattggaagtgcagcagtcaaaggacgagtacggcggccatgccagaattccgtgcgatcgccggtgatctgacgccactgcttctcgattggaggcagcagggagtcaaacacgatcggcgcgtagttggggtaagagccgaagatatcaatggaacgctcttcaccttgggagaccaaagccttgcccagtggcttggaaatatctgctggtcggtggttcgggtaatcacgaactgcctgttccaggctggatccaagctcatcgccggcaaatgggatgcgagagaagttgaagttgtagcggacttcatcgccgtaaagcgcacgaaccagttgagggttgatctgagccaatggaagcgcgtaggtcattgcctcactgaacttgctcagcacctgctgacggcgcgcgcgacgctcgtggtctgccaagcccggcgcggtgatgaattcacgcagtgagctggcgatgaactgctggaaggagaaaccagggcggcggatgtactggcgggagcgctcgagtacttcgccggtatcaatcttcagctcaaagcgtgcttgcttagggtcgcggaggcttcccgaaccggacggatccctggtcaggtcacgggcaacccatacgtcgatgaggcggatgagatcgcgtggtgctttttcagagccggacttggattcccacacaccgctgactactcgagttgaggcctcttgcagggcgctcgagtaatcgttttgttcgttgatgtcatcggtggacgagcggacgtgtgcttggaactgctccgggaaggaggcgacatcggtcaggaagacttcgttggctgcctgactgaaacgtgacgggacggtagtttgagattcatctggccacagtgctggaacgttggttttcagctgggagattcccaggttcacatcgttggtgagctggtagtccttttctagggagtggtgctcacgttggatggtgcgctgaagtgggtagatgaaatttttgaggaaatcgtccagaaccgaagccatgtggtccgcaatgtattgcactgcgcgggtgtgtagttgaccagtggatcgtgacacgatttcctggatgtagctgtcagaatcgtcgatcctgcccttgctgttgtccagttcactgcggctgacatcgtctagttgaacagcctcaggtgcacggttgtttgccagatcagaaagctgtccgatgagttggttttggattgtggcgctgagagattcgatcacgctgacgccgtaaggaacgcccagttttgcgatctcatcacgaagcaactcgactactcggcgctgcaacacatcagcactggcccagtcggcgacacccatgtagagctcatggcgggagtcattatcaatcatctggctggatgattggaaagcacgctggacatccccgagccattcacttccgcgctggccattagctgcaggaatttggctcttgatgattgctttcatacgctgggtccagttttcaatcatctggttgaaactatggaaaatccagtcccctgccggcgcgttgacgggcaaaacgtcgctgaggttgcccatcagcgatggacggttgttctcgagtcgcttttgaagctgctggtcagaggccgcatcattgcttggatcaaagtgtcccttgagcagacgatccacggcagagcgtgccagtcgctgggcggcgtattctgcgtagcgatcacgacccatggatagttgtgagtagccgtagctgccccacggaatgttcttagcttcctgtgcaccccatgcgtacttgctctgatcggcacttccgccaccacggttgccgagggtgaattgctcgaagttgtccatggacacttcatcagccatcagagctgcaaggccacggccgagtgcgcggtagacggtatctggcttgccatcaccaagcagagcgccgttttcaccggagcgaatacccactgggaagatacgtccaactgggatggagtcatcgccaacagaaacacccaaagcgttaaacagtcgggcatcttcttcggaagctgcacccatctgtgctgctgcgagctcggcaaacatggccagcgcgtttgggttagttccggcaacctggtctggggaaagctgggagaagatatccggggtcaccataaacagtgagctcagacccactgcgttgccttcaagaccggtgagcaggcggcagatatctagagccatcgaagcaccggcgccaccagccatggaggagacaacgaagataattggctgctctttagaggtttcaccactggaaacagacgtgccatacagtgcagaacgaaggtcagcgagctcacgttcagtctcaccgctgaacaacacatcccatgatttacgtaattcagcctgaatttcctgaagtcggctcaggatcaacatacggccaatggagcggtactggcccgcacctttactaattggggtggtttcagaatcagggtttcgaagcgcccatgaagaaacgccacccaacgcgcccctggaggagagctggttggacaccgcagtatcaacggtggcatagcgatccgaggaaccacaggaaatataacgtccaccggcttctggaacattcggaaggttcgggccggggctttctggggaggtcggaacatccaccgacacgaactgccacgcaccaggaagttttgcttcctttggatttgggtaacgctcgggaagactatccgccagggtggtcttgagctggtccatcatataagcgagcgttttggcacctgaaccaccacagccgacaacgagaactttcttcatgtgtaaatccttaagttagtttttaatcgcaagttacaggttatcgcgcgccgaagccgccgctggaaccaaatccaccatttgtgtcgttggatccgctaccggagccaaagcctccaccattgctggagccgaaaccaccaccggaaccagtgccaaaactaggagcttgcttttcgacgtggccctgcgcggctggggcgcgcggtggaacctttgcgggctgggaggtcgcggcgtcgtcaagcaatttttgtagttcgcgtgccctatcaggggctttgctggtgatacctgcgatcatgcggtcgatttggccctgctcgagcggcaggtttgtcagggcgatgagttccatcttggaagggtcagcgccgcttgcagtgaggaaccaactgccttggaccgccagcgggagtttagcttgtgtgcccttttgtttgccgtcgaagctgatcgacgggtcggtctgcacgatcactgcaggagacgcaatcgggttcagctggaagcgctggactttaagtttgtggccttccacattgaaggtgtctccatgaacaacgacctgcttggtggcggtggtttgcgatgcgagatcaggcatagtgctgcccgcatagcgcagagcttcaccggagaattccactggaatgcgcacgccactcatcgcagaggacggaacctttgcggagaggaaacgcacaatatacaaaatgagcagcggaatcaggagggaaagcacaagggccaaaatgaatgccaatgcgaaagtggaggcgttaatgggaacgctcaacgtgccttctgtcggcagatccacgctggtttcattggcgccctcagcgttggagatctggagtggaatcgagccgttgaccagtccgtcacgaagatcgctcacggttagttcaacaggaatcgtgccctgctcatccagtccgagcaccaaagcattatctgggctgtcgaaagtacttgatgctgcaatgccgtccacgccgtctggaagcactccgctgagctgggttcccggtgcaatccataccttgccggggccggtgatggggatgtctacggtaacaacgtcctcatccgctgtgaagcgaaccgacgctggcagctgaggcatatcgcgctgagtgatggtgatgcgcgtggtgttgagaattgggctcaacgtggtgccggggagatcatcgacgcctgcggtggtgatcgtggtacgcgcttccaccgtgccgatggctgggagctgcgaaatcgtatccagcgggaagcttaattcgccgccagaaatatcaattccttgagccaaaggggcgaactcgccggtatctgcgcgggtgaaaccaagatcgaccagcgcggacccctcaaggatgcgtggctgaccatcacggcccaccagctgcatattcagctgctgatcatcgcgaaggttaagtgcacctgacgtcgaatcaccgccactgaacacaagctggaggtcaggctggatctccactgagttgaatacgcgtccatcaaccgctgcaggatcaattccttggaactgaatctgccagacacccttccaatccccaccttgctgcaggttgagggaaccatcagccatttttactgggctgctttcggcttcccaactcacgtcagtgctgttggcgacgctgcttccagaatctttgagctcaaccgtttcgccgttgggtgcggtgagcaccaagtgggcgttcgggccgagatcatccttggcgatcgcggtgaaacgcacagagttcaccgagttgtccagggtgaagctgaaaggatcaccagctcgggtttcaccaattgtttcaccaccaatcgcaagggcttcacggaatgctgcgaaaagtccgcccacgttatctgctgggaagaatgcaccgttagctggttcgacaccacatgttccgccacctgcggtggttccgcgcagcaggctgaaatcagatgggttggtaggtgccgataaaccgatgccgatgtgggtgatgccagcactgcgcagtcgatcggtgacgccacccggcgcgcacagtgctgcttctgcaacatcggcgccttcttgagcggtcagtgcgccgtcggtgaaggtcaccagcatgcggcaggcgtcctcagagccggacctagtgaagtcctggtaagcgccctcaatcgcggaggcgtagttggtgtactgctcctgggtgcggtcagcgaagcgggagatttcatcttgtactccgccaacggtggaggcatctagttgcgtccatgctccgtaattgtctggatcagtggcaccagatttgtacgtctggccgaaaccagcaacacggatgcgggtgttcagatcaccatcgctttgcttggctagaagctcatccacaaagctctgtgctgcaggaacacggtggtgctgtgcgtccgcgcctggttcattggcgttgaccacgccgtcacgagcttcatggatcaaggattctgtctcatcgatcatgatgatgacatcaagagtgcctttatcagcgatgcaggcacccaggttgctcaaagaacctgacgctccggcctcaactgcaggtggttcctgcgccaacgcactaggcgcgaggcttaccaaagcgccaaaaaatagcgctgtggctgcagcaacaacgcctctggcaaaacggggtacattcacggttttagagttcaacgtgttcaccatgactgctttcctacccacagggcaatatccaaggccgaccacacaacagcaaacaccaataggacggctgtcgcagtaaagagcgctttcttccacggcacttctgtataaaagcctgtcgactttcgctcatttactgctgacatgtacttgccgatggacagcacgctcaaaattcctgccaacacccacgcaattccagcaacgatgagaaaaagattatcggtggccactggcgcaccgaaggtaatccacgcattgagtcccaggctgatcagccctaaaactaggcccggaagaatccattcagtgggtgccgattgaaggcgcccaccagctctttttcgccccgatgagcgccccggcgctgggctttctgcaacctttggcgtcgaaaagcccgatgggtttgacgttgctccggccggggtaaacccgccagttgaaccgccgaacgagccattcgatgaacccccagagaaaccgcctgaagagccaccaaaaccactgttttgggagcctccaccgaaacctgattgcccgcctgaaaatccgccagaggaagaaccaaacgttcccccgggtggttgggtaaatccttgtgacatcagctactccgcacgtgaataattgatcgaaactctaaagctgccaagtttccttgagatatgccttcttctctgacattttcctgtttgattaatataacccacggggtggacaccgctctcgtcctaatccataaacgaagtagagttttcgaacacttcaacgctgcccctctatgctgctcctagttacccctgcacaaatagcggtttttctcacgcattctgcatcgagtcgggtcgacgtatataaggtggaaaggcatgacccaattcgaaaacgcgcaagtacttaaagagaacatcgaaaaccaacgcgagcagatctttacccagttgaaagaaattgtgtctttcaactccgtgcacagcgatccaaacctactggaggactacgccggcgcgaaagaatgggtaaaagaaacactgaccaacgcaggtctcaccgtcagcgaattcgctgccgaagatggaaccaccaacttcatcggcacccgcaagggctccgaaggtgcaccaaaggtactgctgtacagccacttcgacgttgtcccatccggccctttggatctctgggacaccaatccttttgaactcaccgagcgcgacgctggccacggcacccgctggtacggccgcggcgccgctgactgcaagggcaacctggtcatgcacctcgcagcactgcgcgccgtcgaagccagcggcgacaccacactcaacctcacctacgtggtcgagggctccgaggaaatgggaggcggagcgctcagcgcgctcatcaaggacaagcctgagcttttcgacgcagatgtcatcttgattgcagacagcggaaacgcttccgtgggcaccccaaccttgaccactaccctgcgcggtggcggacaggtcaccgtcaccgtggacacccttgaaggcgctgttcactccggccagtacggtggcgctgccccagatgctgttgctgctctcgtgcgcgttctggatactttgcgcgatgaacacggacgcaccgtcatcgacggcgtcaacaccaccgcaaactggaagggcgagccttatgatccagagactttccgcagcgatgccggcatcctcgacggtgtagacatcatgggcgacggcgacaacccagcaagcatgctgtggtccaggcctgcaatctccatcaccggattcacttccaccccagtggcagaagcactcaacgcagtgcccgcaacggcatccgccaagctaaaccttcgcgtgccagcaggcctggaagcaaacgatgtggccgagaagctgaagcagcacctgatcaatcacacaccttggggcgcaaagatcacggtggagatcgatgacattaaccaaccgttctccaccgatattaccggccctgcaatgtccaccctggcgtcctgcctgagcgctgcgtacgagggcaaggatcttgtcaccgaaggcagcggcggatccattccactgtgtaccgaactgattgaggtcaacccagaagcagaattggcactctacggtgtggaagaacccctcaccgttatccactccgctaatgaatctgttgaccccaatgagattcgcgatatcgccaccgcagaagcattgttcctgctcaactacaccaagtagacccaaaagcaggcgttaacactgccacctttacaaaattaaccaccccctgatggggtggttttttcatgagctgaaaaaagtgtcttgattcactttgtgatgacggttaccatagccatcgtgactaaaaacattgaccttaagcgagtagccaaggctacgtaccctactgcgggatagatggactggctccccgcactagggaagtagtcgttaatcaacaccaagaagcttaagagtcggtcctccacctaacaggatccttcacacccttcttttcaatatctagaaaagaccgatccgcccaacatctttttcatgacgcaaaggaccgtgtcaatgtctctctacacccgtactcaaaatacccgtcactccaccatcatcgagttccgccgcgagcagactcgtaatcacacgatggagccaatccagtccgagccacggatctacgctgacgatcctttccgtgcacgcttcggacaccaactcccccgcggacttcgcgaagaagcacgcggcatggaatggcgcaccttcaccaacacctacgcaccaaccggcaacctgcgcatcagcaacctcgagtccgaggcacgccgcggaggaatgttccacttcaacgcaaccctgatcaacaactgccagggcgagcgcaccaccaccgacgctcacatcatggcaaccggcccagtttccgcatgcaccaacttgcttgccgacgccggccgtcgcgttgaaatcctcgaattccaccaattcgacatctttgaagcaaccgtcaccttcatctacacctgcaacaacgtttcccgcacctgggcaatgggcttcggcggtacccctgagcagtccgctgcttccgcaatgagctccgcagctcacttgctctacggataggttgcaataacattcattccccgggagccttgagggcatccggggaatttactattttctataaatctctcacctacctgctacaacctgttgagctgcagcaacacttggcaagcgtgcgcaatagcccccaatatatacagtgcaattcggatttccgttgggatctcagtcaagacacaggtagactgcccctgtattggtcgcgccctgtgcgacgccgactgagctttaaaagtgtttctcagttgacagacttggtttcttaattactaaaaaatcgatgtgtgttgctaactgggggtggcacgcacgttggcgttgttgtttggtgtggctccagagtaatccacaacgcgcaaaggggaactggagaacacgtgctcattctttttctcgcgctcactgcagccgcagtagtcgcccccatcctgatccgaactctcggtcgaccagcttttggtctgctggcgcttgtacctggcattggttttttctgggtgctttcggagttcatcaaaggcactttcaaggatggaggtgaactcctcctccactatgcctggatgccttcggctcacctcaatatcgatttccgtatggattccctcgcggcgctgttctcactcatcgtcttaggcgtgggcgccctagtgctgctgtactgctggggatattttgattccaacgcgggtcgcctcagtgcctttggtgctgaactggtggccttcgccatggcgatgtttggtcttgtcatttcagacaacatcctgctgatgtacgtcttctgggaaatcacctccgttttatccttcctcctggttggttattacggcgaacgcgcatcttcacgtcgctctgcaggtcaagccttgatggtgaccaccctgggtggattggccatgctggtgggcatcattttgatgggtacccaaactggcgtgtggcgattctctgagatccctgcctactcaagctcctgggcagatgtgccgtatatttccgctgctgctgcccttatcttggctggcgcactatccaaatcggctatcgcaccaacccacttctggcttcccggcgcgatggccgcaccaacgccggtgtctgcttacctgcactccgcagcgatggtgaaggcgggtatttaccttgtggctcgcctctctccagacctcaacgtagttggttcgtggtacctgatcatcatcccgttgggcatgttgaccatgctcatgggtggttggatggcgctgcgccaaaaggatctcaagctgatcctggcgtacggcacggtatcccagttgggcttcattatttccgtggtgggcattggtacccgcgaagctttgctggcaggtcttgcactgaccgttgcgcactccttgtttaaggcaacattgttcatgacagttggtgccattgaccacaccaccggaactcgtgatattcgtaaactctccggtctgtggcgtaaacaaccgatcctgttcgccgttgctgctgtttcggcggcgtccatggctggtattccgccactgtttggttttatcgccaaggaaacagcgctggataccgtgttgaatgagcagatgttgcatggcatgccaggtcgattgatgctggctggcatcgttttgggttccatcttcaccatggcatattcctgctacttcctgtacgaagcctttgccacgaagcactccaaattcccagaggccaacggtgtctcacctgcagtggaggcaatgcatccggtgaagtttaagctgtggatcgcacctgtcatcctggctattttgaccgtagtgtttggtgttttccccaagccagtgtcggaagcaattgtcacgcatcttgataacgtcacgccatcgcttgatgatgtccacaccaaactggccttgtggcatggtctgaatctaccgctgctgctgtctgtggtgatcatcatttccggattcatcatcttctgggagcgagacaccgtcgaacgtttgcgccctaacaccgcagcgtttggcagtgccgataccgcctacgacgccattcttgatgcactgcgtgtgctctcccaccgcctgactgcatccacccagcgtggttctttgaccctgaacgtcggtgtgatcttcttcgtcctcacgattgttccgctgatcgctttgatcactggcgaacaaagcgatgtccgcatggagctgtgggatagccctattcagggcttcatcgcggccatcattatcgtcgttgcgattgtggcaaccaccatggataaccgtttgtctgcgctgattttggtgggtgtgacaggttatggcattgccgttatcttcgcgctacatggcgcaccggacttggcgctaacccaggtgctggtggagaccatcgtcatggtggtattcatgctggtgctgcgtaaaatgccgacagaagttgcgtggaaggcagaacctaaacagtctcgcgtgcgagcgtggcttgctggcgccaccggattgtccgttgttattgtcaccatttttgccatgaatgctcgcaccactgaaccgatctctgtatacatgcaggatctggcctatgagatcggacatggcgcaaacaccgtcaacgtactgctcgtagacctgcgtggttttgataccttcggtgaaatttccgtccttgtgatcgcggcaaccggtatcgcctccctggtctaccgaaaccgcagcttccgcaaggattctcgcagaccaaccctggctaccactggtcgccgttggttggctgctgctgttgataccgaaagggcgcagaaccgctcgctgatggttgatgtggcaacgcgcatcctcttccctgccatgatcatgttgtctgtgtacttcttcttcgccggacacaacgcgccgggcggcggattcgccggcggccttgttgcctccttggcgttcgccttgcgctaccttgccggtggacgtgaagaacttgaagaagcgttgcctatcgacgccggccgtatcttgggaactggactatttgtttctgcaactgcagtgctgtggcccatggttcttcttggtgaaccaccgctgacctcccatatttgggatctcacactgccacttatcggtgagattcacattgcatccgcgctgctctttgaccttggtgtctacctgatcgtcatcggtttgaccatgcacattctcaacagtttgggcggccagctcgaccgcgatgaggaaatgcgtaagcagcgtgcgcgcgaccgagctcgacgcttggcgcgcaaccagcgtcgagaagcagcaaccgtcggcgcacgcaggtcgaacgagaaatcgacacgccaaatgccgacgattcggcctccaggggcagacacagaatcggtggagcagaacggtgagaaccagacgtcgataagcacaaagcgtttaaagcaggaaggaaaataacacatggtagccaaccttttcctgctcctagctgctggaactctcatttctgcgggtgtgtatctgctgcttgatcgcgcgatgaccaaaatgatcatgggtctcatgctgatcggcaacggagccaacctgctgattttggtcgctggaggttccgctggatcgccaccgattctggggcgtgaaagcgaaatctacggcgacaaaaccgctgatccgctagcccaagccatgatcctgaccgccatcgtgatctcgatggcgctgaccgcgttcatgctgtcgcttgcctaccgtcaataccgttaccgcaccgaggacttcattgaagatgacaccgaggacgttgcaatcaccgtccgccccagttttgcgtctgctgcacctgaccacgatgcatctgacgacccagaaactggtcgcatgacctcagacggcgacgatttcggcccagaatccttcgaagcaccactgaagggagataaggatgactagtttgtacgaaactctcgtcccgttgatcccttatatggtcccgctgcccatcattttgcctgcggttgcggcggcgctggcattgattttgtcgaaatatctgacagcgcagcgcaccattactttgtctgttttggcgttcctcattggtcttaacgccaccatgctgtacgtggtggatcgcgaaggcattcagactttgcagttgggtggctgggatgccccgatcggaatcaccctggtggccgaccgactgtctgtttccatgctgacggtgagttccatcgtgctgttttctgtcatgtggtacgcgatcagccagggtattcgcgacggcggcaaggacgaacctgttgcagtgttcctgcctacttacctgctgctctcgatgggcgtgaacctggcgttcctcgctggcgacctgtttaacctctacgttggtttcgaagtgctgctggtggcgtcatacgtgctgctcaccttgggtgcatcgccggcacgtgtacgttccggcgtgggttacgtgatggtgtccatggcgtcatcgatggtgttcctgtttggactcgcaatggtttacgcctcagtgggcacgttgaacatggctcacgttggcctacgcatggaagatgttccgtctggaactcgctccgcgatcttcgcagtgttgctcgtggcattcggtattaaagctgccgtgttccccctagattcctggctgccggactcctaccccaccgcgccatcgctggtcaccgcggtgttcgcaggtctgttgaccaaggtgggtgtgtattccatcattcgagcacgctcgattattttcaccgatggatcccttgacaccatgctgatgtgggtggcactcgccaccatgctcattggtattttgggcgcgatggcgcaaaacgatatcaaacgtttgttgtcatttactctggtcagccacatcggctacatgatcttcggcgtagcccttggatctgcacagggtttgtctggtgcgatcttctacgcaatccaccacattctggttcagacttccctgttcctggtggtcggtctggtggaacgccaagccggatcctcctcgctgcgacgccttggatccctggcatatatctccccacttcttgcgattttgtacttcatccccgccatcaacctgggtggtatcccaccgttctccggcttcctgggcaagatcatgctcatcgaagccggcgccgaagatggcagttggctggcatgggtccttatcgcaggcgccgttgtcacctcactgctcaccttgtacaccatggttctggtctggtccaaggccttctggcgcgaccgtaaagacgcccccgatggagcaaccgcactagcaagacccgcacctttggtagatatccaagacgaagtcgccgttaaagaccgcaacgatgtcggacggatgccttggggcatggtcttctccactgccctgttggtttccgcatcccttgctgtatccgtgctcgcaggaccactgtcatctattactggacgcgccgccgaatccgcacaagatgtcaacatctaccgcgccgcagtactcggccccaactacctcgacccatcacgcacactcgagatggagcgttacgacgccaaccgcgatgacatcaaccaccgcgtcgacaccaatggaacggaggaccaaccatgatcagtggattcaaacgacgcttccgccccgtcttcatcatcggcctcaccctgatgtgggtcatgctcatggcagaattcacctgggcaaacttcgtcggcggtttcctcgtagctagcgcaatcgtgctgttcctcccacttccagccatgccgattgagaacatctccatccgctggggatcactcatcctgctgatcctcaactggttcaaagacctcgccgtggcatcagtcaaagttgcttggctcgcactacgcccagccgacccaccgcgcaccgccattgtgcaagtacccatgcgcgttcaaaacgacctagttttgtcattcgccacaatgctctacaacttgcagcccggcggaaccgtcacagacatcgacatcgccaacagaatgtggaccatccacgtactcgacgccgacgacgaagaagacctccgccgcgagatccaaaacgtcgcagacctagaagccaccctgatccacacctttgaaaggagctaagcgatggacaacaccctctacacagcaggcctcacaatcgcagctgcctttttcatgctgtcgttcatcttcaccatctaccgcatcatcgtcgggcccaactccatcgatcgcctactcggcctggacggaaccgtctccatgattcaatgctccatggccacctacatctgctggacactcgacaccaccgtcaccaacttcatgatggtcatcgcactcttaggattcatcagctctgtatccgtagcccgcttccgcaagagggatggtgcctaaatgaccctgcaactattcaccgacatcgtgtctctggtgttcattctcagcggcgcattcttgtcattctccgcatccatcggcctcatacgattcaaagacaccatgtccagagtccacgccatgaccaaaccccaaacaaccggccttatcctcaccgttgtaggcgcaatcatccgcatcttaggccacgaacacttcgatcaatcacaacgcagtgacctcggagtccttgttctcctcgtactgtttgcactgctcaccagcccagtgaccgcgcagcgtgtcggccgtgtgtccaggcgtgaaggactctacggtgcaaaggacgatatgtcggataaccaggctcctgcggagttgaagccgaagaagtcttgagttttctgaaggctttctggaggttttagagagaatcagcgcccgggagctgtttgggactctcctgggcgctgatttttgttatttcagggtggttttcgggtttattgtggcctgggtatgccccgagtaggccgatgtgcaagggcgactccgcagaaccggacaggcgtgctaaaatgtcgaattttcagcacatcttggcacatgtgtctggtttcaagctctcataaccggacacacgtgccaaaacctacggatttccaggatttgtggcacgcctgtctggttttccaaaagttagccagaattccagcttaaagcccaaaaattacaccatcccagaatgcgatttgaaggacttttacacccgcatccacacaaacacccattcgagaatattagggccttaaattggcgtttaggcgtgcccttctattgggcgaggaattccgcaatcgcagcaccagtttggcgtccatgcgttgtgtaagtcagccaattggcaccaataatggtggtagcccgagcgctcgggatttgtttttccaagtcagaatcaattccagccttcgcagcggagcctcggatgattaacgtcggcatggtaatctcggaaaatcccatcggaactgcagtacgggcttcttctacctgctgcaggaggtctttcttgttcttctttcggaagaagaatcctggcatcattttcagtgcggtgctcatgcctttgagttgtttctcatcaaaggtcaccaacggtgaatccagcacgaggcgttccacgcggcggggttggttcttggcaatttccaacgccactccagctccggttccagcgccgaccaggatgacgcgccggatttcttcacggtcgaggatggattccacagcctgcacacctgcggaaacactaccgctccacggtacgatccgtggtttgattccggcgggaatctcgttgactacctcggtaaactcgtcgggtgtttgttgggattccgggatgaaaatgatgtgttgggattccaccatagctatttagtccagtgctttgaggtcgttgagttcgtcgcaggctaaatcaactgcagctttccaactgccagtttctttaaacactctgcgttggcgttcgtatccaccaccacgttccaggatttccaacacaagttcaagctcacgagcgcagccgagttcgttggctagaggcatcaattgcgctactagtcggcggagttcgtcttgaaccatcgcttcatcggtgtctctggaaatgatgatttcggcatccagaccatacctagccgcgcgccatttattttccgaaacgtgccattgttgcagggagggaagctcttcgccagcgtcgatcatgcggtcgtagtgcaccacgagacagtgggtcaacgccacgatggcagacagttcccgcaggttggaggtagaatcggccacgcggacttcgatggttccccatttggatgcggggcggatatcaaagtgcatggatccggtgtggttgatgacaccggatttatcttgatccgccatgtagctgcaccattcatcccagctttggaattggtatggcagtccggctgtaggcagctgttggtagagcatcgtccggttggaggcataaccggtatcaagtccgtcccatgctggagagcttgcagaaagtgccaacagatgtgggtaatttgtcagcagcgcattgatgatcggccacacgcgatcttcatggctgatgcccacgtggacgtgaatgccccaaatcaacatctggtttccccagtattgggtgcgcgcgatgatctcgtcgtaggagcctttttcagatactgggttttcgcggaaatccgaaaatgggtgggatccagaggtccacaaccgaagcccgagagaatccgctgcttctttcagcgcatctagatcgtgggaaagctctgccaccgcttcggggacggtgtcgcacactccggtgacaagctccacggtgttttggaggaattcgcgctcgaggtgcacctcagggtggttcttggccacaatctctagtatttctgcagcgcgcggggctagatcacgtgtttctggatcaacaagtgcaatttcccactcaacgcccagggtgggtcgcggtgaacgcttaaactcaatgcccatggcgtgagcctccttaaaatccgactaattacgactagttccaacaaatccgagaaaactacagcgctacgtcttggaccagcaccaaaacgagggcatctttgccttctgtttcggttggcagtgcatcgctgcgttccattgctacgccactgacgcggtcagcgagttcacgtgcagccttttcagcttcggtgtttccagcggtgaagtacacagtgttctgcggaatgatggtgtctggaaggtttccggactctaccttttggtagtcaccgcttaggctgtctgccactcgtgctgcaagttgtgggacggtggagttgttgagcacgtacagagtgttcactggggtggagttgccgttagccgaactagcgccaccagcagcagcggccccagcagcattagcggcttcgccatctgcagctggctgctcagcagaggtttcttcggaggttccaggttctgctgatgcctgctcggaatccgaagagccagaagattcagcaatagttcccgcgttggtttccgtggactgggtttgtccggcgctggtggtggaggtgtcgtctttgccctgcattgaccacagtgcccacgctgcgagcaatacggccacggcgatcaaaatcatggccaaaccgcgcatgggcagtccgccttgtttttcttctgaaggcgtggccgagtgctgtggagaattctgcatgtccgaagtcatgtggcttagtctatctttccggcgcgacgtcgtaacctggacaccaaagttggattcactttcatggcttcgggggtatcgatgatcacgttgaggcgttggtaataacgcaccggtgagataccaaaagtggcgcgaatggcttcctctttagccccgattgcgtggggtgcgtgagcctcaaactcgaggagggttaaatcatctgcggaaagcatgcttagaatgttgccatgactgtccgaccaatcgttattcatggagatcctgttctccacaaccctacccagcttgttactgaggatgtctctgaactgcaggaactaattgcagatatgtacgagacgatggatgtcgccaatggtgtgggtcttgcggccaaccagattggtgtgtccaagcgcatttttgtttatgactgtcctgatgatgagggcgtgatgcacaagggttgtttcatcaatcctgtgttggaaacctctgaaatcccagagaccatgcctgccgatgatggctccgacgaggaaggctgcctgtctgttcctggcgagggcttccccactggccgtgctcattgggcgaaggttactggactgaatgaaaagggcgaggaagtttctgttgaggctgagggtttcttggctcgttgcttccagcatgaggttggccaccttgatggtttcttgtacaccgatgtgttgattggtcggtggaagcgcatggctaagaaggctattaaggccaatgggtggactgagcctggtttgacctggatgccgggtgaagatgaggatcctttcgggcatgacgcctagtcttccccgtttccgcagccagaaacctgccgtcggcgatcgtgttgttgcacgtcgccggattcctggtgccaatgtgcattggacagatgtcattggccatgtgattggggtggatccgttggtggttcgcccgcagtcggttggtgggatgccgtctgatgcggaagaaattgtcattcctgatgatcagcttgaggtgattaagattttgtcgccgcgcaccattaggaattcggatattcgtgcggtggaggttgccacggcgaaggcctttccggggctggtcaatgagtggcatgatggttggctgctgcgtgccggtgatggcattgcggagcgttctaattctgcgtcgccactcggcccaagtgtcggttttgagccggtaccgatggaggatatttcgcggttttatgcacgtcacgatctccccgtgaagctgcacattccggagcggattggtcggcctgcgcagaaagtcattgacgccgatccccagaaatgggtgatgggcccggagattttggtgatgacgaaatctttggaccatgtggagtcgcacgaattgcccggtggcctagaatttagcgtcgataagcagcctgaccaggagtggctgggcatgtaccatttccgcggacaggcgttgcccgctcacgcccttgagcttttgcgcacgcaaatcgagggccgcatggggttcgggcgcctgaccacgccggcggggcaaaccgtcgcgatcacgcgcgccaccatcacggctgcggaggagcgcatatttttgggctattcagcggtcgaggtggatcctgcttttcgacgtcaggggctgggcaccgcgctcggctcgcgcatccaggagtggggcgccgagcaacacgcacaggaggcatatctccaggttgtcgcccataatgaagcaggtatcggcctgtatcaaaagctcgggttcagtgaacaccaccgacaccggtacgccgaacggaaattctaaaatccaaaacagctagggtataagtcatgcgcatcgttaattggaacgtcaactctgctcgcactcgtgtggaccggatggtcgattttttgcttcgccatgatgttgatgtattagcggtgcaggaaaccaagtgtaaagatgagcaatttcccaccgagcgtttcaccgaaatcggctatgaggtagcccatttcggccttaaccagtggaatggtgtcgccattatttcccgcgttggcattgaaaatgtggaaacccacttccctgcccaaccgggattcaacaaagacatcaccaaggaacaatccatcgaagcccgcgccatcggcgcccgctgcggtggtgtccaggtgtggagcctctatgttcccaacggccgcgaaatcgcagatcctcactacgactacaaactgcgctggctattctccctgcgcaactacgtgatcgacaccttggaataccgccccgaggaaaaactggtgttgctcggcgacttcaacatcgcgcccacagacatcgacgtctgggacatcgcagccttcgaaggaaaaacccacgtcaccgaaccagaacgtgcagctttcgacggcctcatcgaagccggactcaaagaaaccacccccggacctggtacctacacctactgggattacaaaggcgcacgcttcctcaaaggcgaaggcatgcgcatcgatttccagctcgcatccccggcccttgctgcaaccgcgggtgaaacctttgtggacgttgaagaacgcagcggaaccggcgcctctgaccacgcaccagtcatcgttgattacaaggtgtaactgcgtatgatctttcagatcaacctcgaatcttggcaaaccgttggtttgatcatcgactacaccatcaaaatcatcgccattggctacgtacccgaaggacgccgacccagctcctccaccgcgtggctcctggcaattttgctgctcccctacgtcggactcccactgttcctgcttatgggatcgccatacatcaaccggcgacgccaccgcatccaacaagaaatcaacgacctcatcgaagacgtccacgacgacgtccccgacatccccaccggaatggatgtctccgcggaagttgaatctgtcatcaaactcaaccgccgcctcacccgcatgccagcagtgaccggcggaaacaacggcttctactccgactaccgtgaatccctcaaacggatgaccgccgcaatcgacgaagccgaagaatacatctacgtcgagatctacatcatggcctgggattcctacacccaaccattcttcgcagcactcgaacgagcccacaaccgcggcgtcaaagtccgactccttttcgaccacgtcggcagctggaaataccccggctaccaccgcctcaaaaaagaactcaaccgcatgggcttcgcctggtacctcatgctccccctccaaccctggcgacgccgcttccgccgacccgacctgcgcaaccaccgcaaaatgctcatcatcgacggccacaccgcattcatgggctcccaaaatctcatcgccccgagttacctacaaaagaaaaacatcaaactcggccgcgaatggaaagacctcatggtcgaactcaccggccccatcgtctcctccatggaaatgatcttcgccggcgactggtacgtcgaatccaacgaagccctcgacatccgcgaccacgcagaagcccacggctacatcggcaacactcaaaaagactccgccaccaacctcgtgcagctcatcccctccggccctggttacaccacagaacccaacctgcgcatgttcaactccatcgttcaccacgccaaagaacgactcatcttgtgcagcccctacttcatccccgacgaatccctcctcgaagccgtcacctcagcctgctaccgcggagtaaccgtcgaactattcgtctctgaacaagccgaccaattcgccatcgaccacgcccaatcctcctactaccaggcactccttgaagccggcgtgaaaatctaccaattccccaaacccgacgtcctccacaccaagtacatgatcgccgaccccgacgacaccaccggcaacgaagccctcggagtcctcggatcctccaacctcgacatccgcagctttggcctcaactacgaaatctccctgatgatcgccaaaggcaacctcatccacgaactcaacgccctcaccgaccgttaccgcacagtaagtttcaagctcaccttggataagtggaaccagcgcagttggcggcgccgctacgtggacaatgtcatgcgtttgacctcggcgctgcagtagtttggcgcgtttggagtgcgtttgaggtggcttttagagggaccgacttacccatcgccattatgcaaatatccgttcgaaactttggtcgggccacgcgtttgtggtggatttttgcaccttgcagccagtttgatgcgaaaattcgttcggtttaatggtcgggccacgcgtttgtggtggaaatttgatcagggaactgacaggatccccaatggtcccatcatccccaaaagtcacacccctagattgccgtttaagggcctcgaatcaccatttccacccatgcgtccatccggcacctcaaagcccttaaaacgccacctagagctacttcatttctggaataccttttcgacctgccaggtacgcacacccacacgccagcagtgcacaagcagtcattgcgattcccatagtcaaagccttatcagagcctaatccgaccagtgaactcaccaaagcacccatcgtgaattgcacgaaacccaaaattgcagaacccgatcccgccctgcttcgcaccacttcagttcccagagctgtcgcgttagccataaccatcggaatatgggaaacgataagaaacagcagcaacaggaacagcggtatccaattaataaacagcacttcaatcagcaaaagcgcacacagcacagtaaaactggccagcacagtttgcatgatgcggtgtggatgaatccgctgcagaagtcgcctattgaccattccgcccacaatcaaaccaaaagcattcactccgaaaataatggaatacagcagtaccggaatgcccatttgattctgcagcacgaacggcgacgccgaaatgtaggagaacatcgccccaaaagacagccccaatgtgaatacatatgccaaaaattgaggattcttcagcacaaagacatagttggacagcattccgccaagtcctgctgcggtacgctcttcaactggcttcgactccttaatctgcagcaaagcaacaagcagctgcgcaaaattcaccagtgcaagtgcccagaaaattccccgccagccaaaaggcccgaccagcacaccaccaatgagcggagctaccacgggagcaattccctgaataatcatcagcagtgcaaaggcgtgcgcagccttttgtccgcgttcaaggtctggcacgatcgcgcgcgcaatcaccacgcacgcaccgccgccaagcccctgcaccaggcgtgcgatcactaatacgcttatcgacggcgccagcgcgcacaccacactagcgaccagcgcagccaccgcacctgcaacgagcaggcctttccttcccaattgatccgacaaaggaccaatgatcaattggccaatcgccattccagccataaaggaagaaagagttaactgcaccatcggtgcagttgtccccaaatcttccgcaataccaggcattgccggcaaatacatatcagtcgctagcgcggagctggctgacaataatgccaatcccataatcagggcggtgctcagctgttgttttttctgcatcactgtctcgtgtatctatatcgaagatttgggggtatttttaattagaaattttcattcaggtaccatcagcaccggaagatagcaccaatacttaaaacttttaagagtaacggatttaaatcgggcacgtgaacaaatcgggaattttgttattggtttgttcactcccatgcaatgtacgatcggttctaacgtctacggcaattgacacgtcaatttaattcaggaaaggggtggggagaatttatgtctagtggttttgaatatgttcaacatcctcgacgagccctccctccgcctatacctgaacggaaaggtcctgccgcagcattcctgccgggaactttccatcccattaatccaaagaatattgcagcgagccacgatcaggtgcttctatctggttggggcaaatttgtgcgttggctcttggtattgttgtccattttggtcatcatcattggcatcaacctcatcttggacggtgtctacggatttggtactttttcaaccacccagatgtaccaagttgcgaaagatccactcattggtgtgctgatcggtatcttggctacggccttggtgcaatcatcaaccaccaccacaacgttgacggtgactgcagttggtacgggcattgtgtcggtgcctgtggcgattccgatcattcttggcgcaaatatcggtacgacgatcaccgcgatgctcgttgcgttttcttatgtgggtgaacgcagggagtttaagcgagcttttacggttgccgccatgcatgtgtggtttaacgtgctcgtcattcttgttctatttgttgtggaattgctctttcatccattccgcacaattagtggtgcgatcgcaacggagatcacactgacaactggtggctctttgcctaccagtggtgtgatgaccaagatttttgatcccccaacccaacttctgggtatgaatggtcttatcggttcgatcggcaatcctagtatttcggcgattgtatgtcttgtggtgggcaccattcttattctgatttcggtgcgtgccatgagttctcagatccgaaccattacggcagcgaccgtaacctcaattatggacaaggtgatcaatccagagaacagccccaaggcgacgattctttccaatttctggagcttcattcttggagttttgttcacgctcatggtcactgcctcgtcagtgaccgtggcttccatgcagccagtggctgcctctggtgtcgttaagcaaaagccattgctgggcgtcattttgggtgccaacgtgggcaccacggtgaccgcaatgtttgctactttcgcgattgtcagcgatcagggtgagttcgctattcaggctgcgttgatccacctcattgtgaacttcaccggcgcattactagtgctgtgtattccgcagcttgccaatgtgattattcacttggccgagaaaactgcgaacctcactgcccgcagttactccatcaccctggccacaattgtaacggcctatgtcttggttccttcagctgtgttgatgatttacttcttcatttaaaactctgctgttccttgaaagatcgtggtcacagagccgcccacccaaatcgcatgagattcaatactgatgtggatttccccggcgcgaccgatggcggttccttgggatgccaagtaaccttcgccggcgcgaccatctcggtgtagccactgcgcaatggatgcattgaggcttcctgttactgggtcttcaccgattccttgagcgaatgcccgtacttcaaaagcgtggggagccccttcgggataggccccaatcactccgagtttcaatgttggatgtgcactgaaatcgggttccagatccaatacgtgttgggcgctcggtagctccactactgcccagccggggccgttgtctacccattggtgggctcgaatgaagtcggggctgattcctaaagcctcacaagctgcgtctaggtcggaagcatccaatggcccgtctttgagtgtgggtggagcctgaaaagccaatccacttgctggcccgtcaatagcgcgcacagcaactaaaccggcgacacattcctgaaccaactgggttccctgttcaccgtgcagttccctaaacacgtgggcggttccgagtgttgggtgtccagcgaaggggagctcaccggttggggtgaaaatgcgtacccggtagtcagcaccttcttgggttggctttaaaagaaatgtggtttctgagaggtttgtccacctagcgattcgggccatttgttcggcacttaagtcatcagcatcggcgatgacagcaagcgggtttcccatgaacggctcggagctgaatacatctacttggtaatagggccgcgatattttagagggcattttaggcgtctttcttttctaggacgacgattccgagtgcgaacagcacgaatgcccacgctccgaagtacaccgctcccatggtggtggaccatcctggatcaattgattgatagtcggtgatgaatgcgtagaggttggtgaagggaccatacttgccgacgtattcgccgatgcgtggcaagaaagacaggaggttttcgatagcgaagtgccacataagcaccagtgccactgctcctgcagtttgacgcagcaggagcgcaattccggaacagaaagttaccaatagtgctgctgccagtgggtattgccacatgattcgtcgtgcttgcgtatcttcccacaccaccagggtggagcttgcagtgtctgatgccagggctttggctagatagaagcacagaatcacggtgatgaaggtcaacactacggcgaacacgaggtacagcaaccatttggaaacggcgacaacccagcgttttggtgtggcgaggaaggtttgggtttggtagccgaatcgaaattcggtggtgaacatcatgatggattggatcatgatcaccacgaagccaaggaggtaaaggccggtgactgtgctgcctgcgagaaggaacagtgatgcaaagctttcgccggtggcgagtgatccggtgagcgctgcgtatcccaggctgaagaccagaattagtgcggttgtccaccagaaggatttggtggtgacaagtttggtccattcggagcggatggtattaatcattgttgtccacacttccagcctggtactgcactgcttcgccggtggtttcgaggaatgcttcttccagggatgctcgggtttcggacagttctaacaaggcaattcctcgttcgaatgccaaacggccgatgtcatcggtggtggagccatcgatgcgatatgtcatgcgtccgctttcatctggtgctgtgttgaatgcgactccggcttctttcaacgcgttttccaaagcgccgggtactgctgcgcgcaccacaactgtggaagcggaatgggagcgcacaaactcatgcatgggcatatcggcgaccagcttgccacgcccaatcacgatcaaatgttccgcagtttgcgccatctcggacagcaggtgggaactcacgagcacggttctgccctgcttggcgatgttttgcaacaaggtgcgcacccagtgaatgccttctgggtcaaggccgttgacgggttcgtcgagaattaagtattccggatcgccgagcaatgctgcagcaagtcctagacgttggcccatgcctagtgaaaacccaccggtcttctttgacgcaacaccagtcagtcccacgagggtgagaacttcatcgactcttttggtggacagcccatttgcacgggcgatccacttgaggtggttttctgctgttctatttgggtgtgttgctttggcatcaagcagtgctcccactttggtcaggggatttttgagcgatcggtagggttgtccttcgatcgtggcatgccctgcagttggattatctaagccaaggatcagccgcatcgtggtggattttccggcgccgttggggccgagaaatccggtgactattccgggttttacttcgaagctcagatcatcgactgcgcggacctgaccatattgtttggtgaggccttcaacgttgatcatgcgcaccagtgtcgcataaacctactctgttgtgttcagtagctttcttaaagagggccacgctttggcgaatgctggcatcaaagccaaagagtcaaccgctgcgatatctacccaccgtagttcgagggattcttcattagcggtggtatctagggtttcgccggttttagttcgtgcgatgaccgtggtgtaggtccagttgccggcaagttctgggcgttctggatcggcgggaaaagggcctgcggtgactattgaatctaaaacttccacgtcgtcgggcaggattccagtttcttcaaatgcttcacgcagggctgattccgctgcggtttcatgtgagtctcgtgcgcctccagggagtgcccaggtgtcgccgttgttggtccatgcggctcggtgctgcatgagcatttgtttatctgctaccaacaacaatcctgctgctccgtttttgccccatactgccccgccattgggtgctgctgcccatccatcgccgtcgcctttcatggtgtccacattaggctaaacgctgggggtattcatcaaggtagccaatactttcaacatgtcatgagtcacgctattctgaaacaatgatccgggatggaaatggggagcattcagaggtgcctaatcctctggatgattctgcggtgcaaaattcagccccacattcagccccacattcagctcggacccggttggagtttttggataccgatgactcgcctgatcattggcttgatccgttaacggagaaggatacttctaagcgcactctcgttaattcgattgttcaggaaactttcggccagcctatttttgttgcccgcaagatttgggctttcgtcaatacgtcgccgggccggatgacgttgatgacgattatcatttcgatcgccatttttgctgctggttacgccatgtcggtgtcttcggatactaggcagtccaatttggatgatttgatcactaatgcggagcctgtttcctataacgcgcatgtgctgtatacatcattgtcggttgctgataccactgctaccactggttttgttcaggctggtgtggagggcccggtgaatcgggtgaagtatcacactgctattgatcgtgctgcggttgctgctactcatactgcggcgtctgcggatagtagtaatgagcatttgatggagttggtgctggagattcagcgtcagttgccggtgtatacggggttggtggaaactgctcggactaataaccgtgcgggtaatcccgtgggtgtggcctatatgtctgaggccagcgcgatgatgcgtaatgaaattttgccgatggcgtctgagctttacaacctgacgagtcgtgcggtgtctgatcagcagcgttcggtgacgggtccgcagtggtttccgctgtctggattgcttgcggctcttgccatgttgattgttgcgcagtggtggttgatgcggattacgcgcaggcgcatcaacaaggggtttgccctggccacggtgatgatgatgacggcaacgttatgggtgtcagctgcaaactgggcgacgtggcaggctggcacgaagggttttgaggaagcgtcggggccgttgaattccatgactacggctcgtatttatgcgcagcagacccgcacgacggagacgttgtcgttggtgcgtaggcagtcgattcagggcagtggcactggttttaccgcaacgattaatcagattaagcgtgcgctggatgagtatgaaaccactgcgcagtcacagactccggagcatcagcagttgattacggcgattcgtaatgcgattgctgcatggactgccgatcacgatgagttcacggtgttgttggcgtctggtgattacaacggtgcggtcaatgcggtgctcaacaaagatgaggagggccagaccagctttgatgagctcgatactgcgctggctgagctgatcgcggattctcgcagctccatgcgttcctatatccagtcgggcctgcaggccacggagttggtgtccgtcatggtgatgattctgtctgtcgtttctgtgttggctttgtgggtcggcatccgcccccgtttgcaggagtacttataaatgcacgcttttcgacgcccccctccactcaccacgcgagtcggcgctgcattgctggccgcaacgctgcttgcttcctgcactccaacacctgtggaaccggcagaaaccttgactgctttggatcccgatgccggtccaccactgccaccggattcttcgattgaagctcccggtgaaaaagagcccattgtggaagtaatagagaattggccaggttctttacgcccggatgatctgacccctgaggagcgggtacctggcatcgtcaaccggggtcgcatcattgtgggtgtggatcaatcgcaaaacttgctcagtttccgtgatccggtgactggtgagctgcgcggttttgaagtggaattagcgagggaaatttcccgcgacattttcggtgaccccaataaggtggatttccgattcgtcggctcgtccgaccgtctgcgttcccttgaccaaggtgatgtagatattgtgattcgttccgtcacgatcaccgacgaacgcgccaaattggtggaattttccacaccgtacctgcgcacccaaacccgcatgttgaccatggaatcttcaggaatcacgtccatcgcagatctacccggccacaccatttgtgtcaccgatggctccacttcattgcagcgagcccgcaccattgcgccggaggcctcaatcttaaaaactcgcaattggtccgattgtctcatggcgttgcagcagcatcaggctcaggtcattttgggcgatgatgtcattttgtccggcatcgcagcacaggatccctacaccgagattcttgatacctccctcgattcccattcctatggagtggcagcggcatcgaccactgctgaaacagactcttcggggttgattcggcaggtaaactacacaattgaacggatccgcacagaccgcatgtggtggacaatgttcgacgattggttcggaccttatctctggtcctacggtccaccacagctgcagtacatgccagaggaagaagggacagaaaacgatgaaggataatgaagatttcgatccagattcaccagcaaccgaagctgttgccttcaaccctttcgacgatgacgatgaggatgattcccccgctacctcagccgttgcctttaacccttttgaagatgacgatgacgacgatgagttccaaggcgaaggcctagaattcctgctgcgcgacctcgacaatctgcgagccacccaaggtcaaatggtggtggaacaaccagcagttgaagacagcctcgggtcagcatctgcgcatacggagacaactgcggcctcactgcgtccccgcccagaggtggatccaagtgagaggagtcgtcgacaagcaatttcgctgttccgcgaacggcgccgcgtaaggcgccaatcccgcccagttgctgatggcatggtggaattgccgttcatcacccccaaaccggaagatgagctgctcatcgacccggaaaagaagcgcaaacctggtgtggcagcgccgcaacttgtcgcgggcgatatcgtcgcagagcaatatgaagtcctcggcgtcatcgcgcacggcggcatgggttggatttacctcgccaacgaccgcaatgtgtccggccgcatcgtggtgctcaaaggcatgatggcgcaatcttccgttcaagaccaaggcaccgctgaagccgaacgcgaattcctcgccgacatcacccaccccggcatcgtgaaggcctacaacttcatcgacgacccccgcgtccccggcggattcatcgtcatggaatacgtcaacggcccctccctgaaagaccgctgcaaagcccaacccgacggcgtgctccgcgtcgacctcgccatcggctacatcctcgaactcctccccgccatggactacctgcaccaacgcggcgtagtgtacaacgacctcaaacccgaaaacgtcatcgccaccgaagaccaagttaaactcatcgacctcggcgcggttaccggcatcggcgcattcggctacatttacggcaccaaaggattccaagcacccgaagtagccacccatggcccctcaatctcctccgatattttcaccatcggacgcaccctcgcagcactcaccatgcccctccccgttgaagacggtgtcctcgcaccgggcatcccctcgcccaaaaattcacctcttctgcgcaggcatttgtcgttctaccgcctcctgcaacgcgccaccgccgacgacccccaacaccgattccgcaacgtcagcgaactacgcacccaactctacggcgtactgcgtgaaattttggcagtccgcgacggcaaacaatacccgccacagcactcactattctccccacagcgaagcacctttggcaccaaacacctcgtgttccgcaccgaccgcatcatcgacggcatcgaacgacaagcacgcatcacagcaccagaaattgtctccgcgctgcctgtcccactcatcgaccgcaccgaccccggcgcccgtatgctctccggatcctcctatgcagaaccctccgaaaccctggaaactctgcgcaactccatggaagacgagcaataccgccaatcaatcgagatccccctcggtgtcgtccgagccctccttgacctaggctttaccaccgaagcacgccaatggctcgaaaccctagagggacgcatcggcgacgactggcgacacaaatggttctccggaatcacctacctcctcctcgacgactacgccaccgcccaagtattcttcaaccacgtcctgaccatcctgcccggcgaagccgctcctaaactagccctcgcagctgttgacgaactcatcctccaacaaatcggcgccgaatccaccgcctatctcaccccagacatcgtctctgcaaccgcgaccctcagcaaagatttcgaagacctcgacgcctccgccttcgaatcactcagcgacacctggtcccacatctccagcgacccacacgtagtccgcttccattcactgcgcctctacgcacttgtctgggcaaccaaccccaccaccgtgtcctccgcgttcgggctcgcccgccaactcatggccgaaaaccaaatcgaactcgcagtccaagccctagacaaactcccccaatcatccacccactaccgaatggccaccctcaccaccatcttgttgctggtcagctccaatttgagtgaatcccgcatccgacgggctgcccgccgactcaccgaaatccccacaaacgaaccccgcttcaaccaaatcaaaattgccatcatgtcggcaggcctcagctggcttcgagagcgaaaactcaaagcttccgcctccgcgaaccctttgtttgaatacccgttctcccaaaaaggcctgcgcaccggcatctccgaggcactccgcattcaggcacgttctgcaccgttcccgcaccaccgttacgcacttgtggatatggcgaatgccgtgcggccactgagttggttctagctgttttgacttggggctatttggtaggtggcgatttaagggcctttaggagtgcgatgtcccctagtttgactttgggcgagttaggcccttagaagcgattctgggggagttacttttgggacaattggggctgatgtgatttctgcggggttactgcaggtttcctgttcaacttctcgttacgggttgctggaattcgatgaaatggaacgaatattcgcataatagcaaggtgttagagcaaattttcgaccaaaaccggccttttaatgttcggtggggacgaaaattcgcaaccccaagaggtctaggggccaacaagcgattcctgtgaagctccagggcaaggatccaccacgttccaaaggaaaactgggatctgtggtggatccgtgcagtttcaccccttaaaaacgcaaaaatccaccacaaaaccgctgatcagagcgatttgtggtggatcctaaccaggagagctaagcgaacttcaccgcgtacctagcgatagctaactcttcattagttggaataacaaacaccttcaccttggaggcatcggtggaaatcaatcgaggaccatcgtttggcaatgcgttacgctctggatcgatctcaattccgtacatttccaaacctgccaaggcatcctcacggacaaactgggcattttcaccgacaccggcggtgaacacgatggtgtctacccgtcccagtgccaccatgtaggaaccgaggtagcggcggagttggtgtatgtaaatgttgtacgcggaccaggcatcttgatcattgttgtcgatcatttcccgcagttcacggaaatcattaacaccggaaagtccctttacacccgactttttgttcagcagattatcgatctcatcgatgctcatgccagcggtgcgggaaaggtggaagacgatacctggatcaatgtcaccgcttcgggtacccatgacaaggcccgcgagaggtgtcatacccatggaagtatctaccgcacggccaccttgaacagcagccatggatgcgccgttgcccaggtggaaggtgatggtgttgatgtcttcggtgggcttttccagaatttccaccacgcgcttggacacaaattcatgggaggtgccgtggaaaccatagcgcctgattccgtgttcagctgcgacatccttgttgatggcatacagcgcagctgctggtggaagtgagtggaagaaaccggtgtcaaagacagctacgtgtgggacatcggggagaatttttcgagcaacatcaatgccgtcaacgtttgcagggttgtgcagtggtgcgagtggaatgagatcgcggatcatttccacgatttcatcagtgataagttccggtgcggagaacaagattccgccgtggaccacgcggtgtccaactgcggtgatttccagttgggaaggaccacagttgtgctggtccatgagatcgaacgccaggtttaggccttcggagtgatctgcgatgggtgtctctagggtatatttttcaccctctattttgagtacgatgcggccgtttggctcaccaatctgctccacaagaccagaaacatatggctcgtcgatggcagagttttcggggttgaccagctggaatttgatggaagatgaaccggagttcaaaacaagtgccaatgccattagctgcgtcctcctgcctgaattgctgtgatggctactgtgttgacgatgtcagggactgttgcgccacgggaaaggtcgttgactggtttgtttaggccctgcagaatcggaccaactgccagggcgtgaccggtgcgttgtgcagttttgtagccgatgtttccggcttccaggtcagggaagataaacacatttgcctggccagcgacgtcagagtctggcatcttcttgcgcgccacacccgggtcgacggcggcgtcgaactgaagtggtccatcgacgcatagttctgggttaagtcggcgtgcttctgcaagagcgtcgatggcgcgatccacatctgagcctccgccggagttgccagtggagtaggacaagatggctacgcgaggatcaatgccaaattgtgctgcagtttttgctgacacaacggcgatttcaccaagctgttcagcagttgggttcgggttaacagcacagtcgccgaatgcccacagtcgcccgcgcagcaccatgaggaagatggaagaaacgacggatgcttctggaacagttttgatgatctggaagcttggcttaatggtgtgtgcggtggtgtttgctgcaccggataccattccgtcggcgtcgccgttgtggaccatcatggtgccgaagtaggaaatatccttcatgatttcgcgggcttcatcgatagtgacgctctttgacttgcgcagctccgcgaattgttcggcgaattcctccaggcgaggatctgtcagcggattgaccaggtatgcagtgttaaggtgcaggccaagttcggtagcgcgctccttgatctttactggatcgcccaggatcgtgatgtcacagatgtcttgatcaagcagctggtgggcagccatcaagatgcggtcgtcgtcaccttctggcagcacaatgtgggagtgctctgcgcgtgcgcgcttgagcagccagttttcaaagagttcggcgctcatgactggttcgaggttgctgtggttgcgcacagccttgcgcagcttatccggcattggctcttgttcagcggtaaatgctgctgcaacaactgcgccggcattgtttacctgggtgcgagcaagagcaacgtgcttgccttgcttgtctaccagcagtagcactgggacgccgagggcagcggcgacctgggcgtcgaaaaacgtgtttcctacaccgatgatgagagctggcccctcagcgaggaggtccgccgcgagaactttggatacttctagttcttcgtcgggcaggtaggtgagccgaactccaaggtctgctgctacttcttccaaatcgaatccatcgaagctgcggttgaccgtggtgatcagagctgaggtcggtgtgtcagacatacatcgcctttctaatttcagcctgaaccttctcattgatgacacttcaggcttgtgcctcctggcactaatgaggggaggttgtgatttcttacatagtttagcgttcgtccgccttgcgtacagcccggtttgcaaagttttattttgtaattttcaaaccgatctcaattccacgctttgagcagcacaaatgcttattgccgtagaaaacaatacggagcggttacaagttgcgaagcaccctttgcaaagtttttagcggtactttacagctcttcaccccccattaatggggtctatgaaagcgcgcagcgtgacaaatctgaccccagcaaagcccccaatactccccgactggcctttattagtctgcacttaccacgtatcatggagggttgatagcagggcaccattagcagtcgcaccccgataggagtcgaatctacaagtggaacccccgctcacatactccacattttttagaacccctttaaggaatcgaactttatatgtctcgccctttgcgtgttgccgttgtcggtgcaggtccagcaggaatctacgcgtctgatttgttgatgaaatccgacacggacgtgcagattgatctttttgaacgtatgccagcgcctttcggtttgatccgttatggtgttgcgcctgatcaccctcgcatcaagggcatcgtgaagtccctgcacaatgtgatggacaaggagcagctgcgtttcttgggcaacattgaggtcggcaaggacatcactgttgaggagttgcgtgagttttatgacgcgatcgtgttctccactggcgctactggcgaccaggatcttcgggttccaggttctgatctggaaggttcgtggggcgctggcgagttcgttggtttctatgatggcaacccgaactttgaacgcaactgggatctttctgctgagaaggtagcggttgttggtgtcggtaacgtggcgttggacgttgctcgtattttggcgaagactggcgatgagctgctagttactgaaatccctgacaatgtctatgagagcttggctaagaatcaggctaaggaagtgcacgtttttggtcgtcgtggacctgctcaggcgaagttcactccgttggagctgaaggaacttgaccattccgacaccatcgaggtgatcgtgaaccctgaggacattgattacgatgcagcttcggagcaggctcgtcgtgattccaagtctcaggacctcgtgtgccagactttggaaagctacgcgatgcgcgatcctaagggcgctcctcacaagctgttcattcacttctttgagtccccagtggagatcctcggtgaggacggcaaggttgttggcctcaagactgagcgtactcagctggacggcaacggtggcgtgactggcaccggcgagttcaagacctgggatatgcagtcagtttaccgcgcggtaggttaccgttctgatgcgatcgagggtgttccttttgacgatgagcgcgcggttgtccccaacgacggcggccacatcatcgatcctgaggtcggctcccccatcactggcctgtacgccactggctggatcaagcgtggcccaattggactgatcggcaacaccaagtccgacgccaaggaaaccactgagatgctgcttgctgatcacgctgctggttctttgcctgcgcctgcaaagcctgagttggagtccatcattgagttcctcgatgagcgcaaggttgcgttcaccacatgggatggctggcacctgctggatgctgcggagcgcgcgctgggtgagcctgagggccgcgagcgcaagaagatcgttgagtggaatgacatggtgcgccatgctcgtccagaatacgacatctaaagtcgcttaaagcctcaaaaaagggcgctgttggaggttaatccacagcgccctgtgtgcactctattagtgaatatccggtgaatgctcgtccctcgactgtctacttagtaggtttgcaggctagtcttttgtcatgacccgatactttgcagtttccaatcttcaggagcttggctccctcgaagtacacaaattgtacaaacttcgtgtagatattttcgtccacgagcagcagactccgtacgcggagatcgatgacaccgatgctgccccaaccaccaatcacatcctggtttgggagcgcgccgacgccaccccaaccaacctcatcggctgcgcacgcctcgcgcccatcaccgccgccgagcttaaggcgtacaccggcaagggcatttcgcttgacgacgccaccccgctctcacaactcggccgcgtagcggtggcacaggaagggcggggctcggggctctcaggtgagctcatgcgcaacgcgctgcgtcttgcatatgagcagtaccccgaccgcgatgttgtcctgaccgcgcagaagcctttggtagatttctacgcagaatacggctttgaggtcttgggtgaggaataccttgactcgggtgttcctcaccttccgatgttgctcaaggctgatgagcttgaaaggttctcagacctagacgcctaatccgtagtcactggaactcacccacatctcctcgccggtcgcggtgcggaaacgcacccgatcgccgtcgagtgttacggagagggaggcgtcgagaagcgaatttggcgcctcaatgagctggcggccgcggaaatagtcgaggccggggttgcccacttgggtgcccatcaggctgagttttccgccggtgaccgtcaaatgaatgaggttgctgccgtcgtcccagccgggggtgctgagtgtttggcaccagaaatcttgcgatcccggcgcgtcaaagaaacatgacatggcgttgccgtcactgaaccgtaattccgcgatgttggaaaatgcctggtacaagccaccttgtgtggttagttccgcgtcgcgctgggcatttgagagcatctcaaaaccctgcgcgctgatgcggaatgtttcattggtcgcgtacttaatgcaggaaatttcatcggcagactcggtgaaacaagccatggtgtgtaaatcgatgtaggttcccggcggcaacgtggtgtaattttccggcatgacatgagaaatcgccgtggtgtactcagcaaaacctggtctgttttccacatttgtatccgccactacgtaaccatcgtcgaattggcacgcaccctgcacgaaactcaaccgccaatcggtggagggctcccggttgataggtgcgtcctgttccatggggcgaaactcacatttaatggttccatcagctgaggaaaaactcacctgtccaggctgataaccactggaaaagtgccccacattttggcgagtgtagcgaggcgtcaagttgataccttctgcctgctgcgtggtcgtttccgcaggtgtcgtgggttgtggtggctgcgctgccgtttcagaagtaggttgcggggcggtttctgtcactgtttctgtaaccggcggctgcgtatcagagcatgcaaccaccgcaagcgccacgaatggaatgatcgctaaccacttggttttcatcagtgctcctaaaattagtgtgtgccggctccaaaatcgtgtgtgtttgcccaatactgattcccctgaggcgtggtcagcgtgagggtggttccatcaaattctgcactcacaccgttcgcgaggagatacgatcccggaccgaatatttgttgagatttataaacgctttgcgttggattcgtggggcgagcaccctcaaactcggagtcggcctggttcagattccaccacagggtgttggcagggccagctgaagttgaccagcctccaggaccactgttgtggcacaagaactcttccgcctgcaactcactgacacaggtgatgctggtgccatcggtgaactggaaattcgtcattttcgataacgtttgaacctggccactcgaattaattagctgctcagtggcttttgcaggatcaagctcatggaagccctgttcattcatggtgaacgcctggttggaggcgaaatcgagacaactaaactccgatacactcggcgcccaacaacccatgtgaccaagatgcaccatctcaccaacatcgagagtcgcttgcgcttctggtaattcttcttcggtttcactcaattcggcaaagcgttcccggacattttcatccgtggtgacgctgatgtgttgatcaccaaaagcgcacgttcccgcagtttcgtcgaaatcaaactccttgatctgatagctggtctcccccggtgttgcctcgaagaaacactgcgctgtgatcccatcgccagtggtaaatacggcagtttcttggtcttggacaccgatgtcatacgttgctggatcgatgtggagataatccaactcggtggctgctatgggagttgctatgggagttgctgtggagcttgctgaggaggttgttgaggcttgaggagtctcgggagcctgcgaagtcagggtgggcgctggcgtttgttctggggtttgttcctgttcggagcaggcctggagcatcaaaagcccgactgaactaagcgccatgagaactgcgtgcgctgttgtcgttctagccatgatgaacctgccatctcacgaggtgtgctggagtccacttgtttctaaaacgttagtctcccgaaaccttgattaataccctcacggctaattgttataacctcgttaaatttttatgcctactctgctgcctctcctgaaagcgcaaaaaatcgtgatcaccaaccacaacactgcacacccaaagttaatgagcgcagggtggaagatcaccgggtcactcactggtgtagtccacacgaggtaactgatgaaaaacagggcagcaattgcccctgaagccaccacctcagaggtggtggtgtgcctgagagaaatcccaatgatgtacaaacaaagcgataccacggcaaacactaccccaatacctaaagcccaccagccggcagccccgccggagtcaagctgcgggccaacagctaccgccgcgtatccgatcaggatgacaccgatggcaagcaggatcgtagaaacccacgaaatgctgccccgatgctttcccagcatgttaagcctctgcggaatttcctggatgaaccttgatcgccgcggcagccaaagtggcgcggtccctggctgcagccacatcctcagcggtggacactgcaacacccatgcgacgcttggtgaaggcctctggcttggcaaagatacgaagatcagtttcagccactgccagcgcttcagccaacccggtgtagctcacgccttcagattcgatgccaccgtagatgacagcggaggcacctggagaaatcagggtgacatcaacaggcaatcccagaattgccttggcgtggagttcaaattcagagaaacgctgggtggcaagggtgacaaggccggtgtcgtgtgggcgtggggagacttcagagaagtacacgtcatcgccggagacaaagagctccacaccaaatacgccgcgtccgcccaatgcgttggtgatgcgtgcggctactgagcgtgcgttttccagcgcgcgaggagtcatctccattggctgccaggattccacgtagtcgccgtcttcttggcggtgcccaatgggctcacagaaccaggtcgcaggcttagaggtggtgggatcgatggaccttactgtcaacagggtgatctcgtaatcgaattccacgaaagcttccacgatgacgcgggagttggccacgcgtgcaccgctcatcgcataatcccatgctgcctgcagatcgtctgaactacgcaaaacagattggcccttgccggaagaactcatcactggtttcaccacgttggggtaaccaagcttttcagcagctgcggagaattcctcgaaagtggagcagaactcatagttggaggttggaagacccagttcctctgccgccagcttgcggatgccttcgcggttcatggtcagcttggctgcacgtgcagtgggcacgatggtagctagcccctcttcttcgatcttcaccagttcatcggttgccagtgcttcgatttcaggaatgacaaaatctgggcgcacacgctccaccaattcccgcacctgggctgcatctgtcatgtcgatgacataggagaagtgagcgacctggtgggctggggcatgttcgtagcgatcaactgcatggacttccaggccgagacgctggaaagcgatggctacttctttgcctaattctcctgatcccagcagcatcactttcgtggcattgggggtcaaaggggtgccgatcgactctgggatgtacatgccttttagcctccgttggaagatgtcagaaatattggtgttcactttatctgacgccacctcgtgaaagctctaaacctgttaaaaaggttgcttaattttgcgacaactgattgctgttaactgcgctggagaccaagatcagtggccggttcaagtcttaacggcgcatcccgcgaaatgaacactggtgggctgaaatatagaagtcgatttaagaagttaaagtatctcatctctatggatgagactcattgaaactgtgtggaatgagtctgcaaagcgtgattaaagattagcaagatacctgaacaaaagttcggagttctcgatccaaatacccattatggatcaaaagcgagttcagaccccatagaacaacccaaaagttgcaatgtagatagacgtgcaacaagtcctgaagaacccaagacagcgttcttcgagacgatcaatcaggggatatcctgccttcggaccaaccaggctatagcgattattggcccaccgggcagccgtaactaaaagaagctgggatcaactgtcccgaaatagctgcagagataaccataagcctggattcaccaaggccaattcaaagctacacacgaaattagaaaatgccgccctgagctagaataacctagatcgcacatagcctgatccgccctaaacatgacacggactatccatgcagtaattccgtttcagaaggtgttcaaggtcatgtaacgcgatccccaatccgtgatttccacacaaacttgaaccaagccacaaagtaactaaatctcaggtccacatccttcagtcgaataatgcaacgattccccacgctatgcaatctggaacacgttgcatcaactcgaccccgaaatagttttaaacaggttcgctaatcttactcctttaaaaacttttgacaccaagggtatttttattttgaatcctgactaacagagagattgctagccagccattcaccgtttacccccttagaaaaactgagggtcgggacggttagtttatttactaaagaagtggttgaatcacaaagtaccacatcagacgggttcaataaatctgattcaactgaatcatcggaccaaaatacaatgcctgattgctcagagccttccaaatccggaaccaactctatgggtagatcaagcacttcagatgaatacgtactgggcgtatctgcgcaaatgaacgcgaaagctgtccactcgctcccgtagatatcagaaaggttaactaccggacgattgaaattagattcctcgagaaaactcaaaagcggtgattgtgaatcagaacagctagtaagtaatagacaagaaaataatactgcagttccttgcttaacaaaccgggcttgaagcatgattgccctcaaatcaataaactagcgaagtttccaaagctaaccctgatccggtttggatctctaagatttcgttaccttgggttatgcgttgaaagacaccggcacttaccatttcaatattatgagaattagagttctctatgatttcattcggcttctctgatgattctgggaaaaccagaaaacttagttctttcgtgccatcattcaatgaaatgcttccacccctgctctcaaaggcctctgcggaaacattggttacagcttgaacttcaggacttacaatttttaactgaacatcccccgcagaactgtgaacttcctgaagggaccaggatccatcggtccatctagtactttcagacgcaatactgaaaatttcatcctgactatccgcaatagacattcccccacttgggattcctccaatccatgctcgagctggcgcttcttggccacccaatcgatattcatatgtaaaagaagcacgttcattattgagctgagaagtgctaacactacaagtgtctccaccaactgaagaataaatccccagtctacaagtcataactaccaaagggttatcggtaagaccgctgcttgcattactggaagttcttaaaaagccccacgatcctgcaccttcatacattgtagtacctggcgttacaacaccattaaaccaagtattatccacagcgtttgcaagtggagctgacatcaaaggagctgcaaacataagagctacaagacatcttgtggctttgcttagtttcatgttaaacctttcgagtttaggaaggagaacaatttgaatatagctaacaaaaacaacaaataacttttctaagcgaaaattcccgaaaagtgcccaaatcttgagggtgcaaaaggtatacattcaaaacgtgaagtgcagataagaaatgctatagttctgtcaaaataaaaccttcctgataagcgtgtttaatcactgatctaactcactagggttgttgactgactctaaactatggtcacggtcccgaagattgggacctgccccctggaaacacaggcgatttaatcaggaaacagatttcagaatagctaaatttctactctcgaacaccgcaggcaccacatagccacaccaagaatgcctgcgatttgtgctgtacctggtacaccagcgaaatacctcccggcggcacaccaactgattggcaaacgtcttggaatcctgcagcacctctcgcttgagggcggcattaaacgactccgccagcgaattatccgcactggtaccaacagcacccatcgactgacgaacacccaactttttacaagtgtcctgaaacgcctgcgaggtgtacacactgccgtgatccgaatgaaacaccgcacccttcaggctgcctcgctgactcttcgccatcagcaatgcctcctgcaccaatgacgtgcgcatatgatccgcaatcgcaaaacccaccagcctacgggaatagcaatcaatgaccgtagccagatacatgttcgtgccatctgcgatcggtaggtaagtaatatccccgacgtaaacttcatttgctgctagtgcgttaaaatgacgtttgaccaggtcagggaagacaggcttctttttatcagacacggtcgtgatgaccctgcgtttcttcgtgaaaccaaacagctttaatgatgccatgatccgggcgactcgtttatggttaaccggagtgctgccaggatcatcgttgagctcagccgtgatgcgttttgagccgtagcagccgcgttctttcgtgaagatggacttgatcttcgctcctaagactgcgtcgctgagcaggcggttgctcctggtcggggcagtctttttccatttgtagtacgaggagcggttgattttcaacacttcgcataaccgcttaaccggataggtttttcgcacgtcgtcaacaaaccggaagcagctcaccagtttgtctcttgccgggaaatatttagcagctttccgcaggatgtcgcgttcttgcgcgttgtagcgcgttttccttcttcagctgccggatttgttcagcttcagagactgccgcagatggggttgtcccttgtacgttgtggttggatccgtatttgatgatccagtttttcagggttactcggttgatgccgagatcgttggcgatctgttggagtgaggccccgtcggagttctcgtacaaagcaacggcgtcgcgtttgaactcctcggaataggtcttggttggcatgatcggtaggttacctttctatcccagaatgttgggatgttaggtgtctaccaaacaggggccaggtccctttaacgacaaacagggaaggtgggtaaaatgtcgcaaattccagcagttatagtaagtgattgaacaagttcaacaaatagagacaatttaagaatcctcacatttcaaaggtagtgaaataactactttccagtatccttgcagtgaagtcacacagacctgtcctttaatattacgtatccttctggttaagctttctacgccaatgcccacacctggaattgcggactccccatttgcatgccaatctccaataggattcattactagaatctgaagagactgtgctttttctgttatgcgaatagtaacgtttgccttgggcggagaatgtttaattgcattacagactgcctcattgaaggctaaagcaaacgccgtttcagcaatatggtccagcttatagttcttttttctactgtcaaaggaaacgacatgtcctgcatctactaataactgaatggcagaattaaccgtgtcatgaatagaaactgcagcccatgctccaaacgctgtggctttttcagcagactcctcgaccacgaggtgtctaactaattgatgcaaatcagccactgcctcttgtccaattttggcaatactgtttagtttttcttgaatcttttttggatcaggctctagttcagtcagctttgattgaactatcattattgccaacgatcttgccatactgtcatgcaaatagtgcgctatatcagtacggatttttttgatgatttcctgctgagtaattgcacgttgcttgcgttcactcaaaattttccaccgacctgcccctgtgccagctgctacaagtatgagcaaaatttcggtaatgagagatggagagtctttagcctcaagaggcctttccaaagctaccccataagcaattaagatccattcaactcccaaaatcaatgcgagagcgaagcgcccacggcttgttgcgtattccacagcaagataaacaataaaaccagttaggagaagatggtctgcccaagcattaagccatacagtcgccactaatgcgagaggtaaggcggcaacgggaaaacgtacattaataagtgggatcattgacagcgcgattacctggatgccaaaatttcccaagcctattgcaggcatagttaatgataaagttattaggaacaaactcgttatacattcgagactcccattatctatatatcgaagtaacgagaagagtttctccttcttcattttttactttcatctccctgggcgtgattagtctgtaatgaagaatctcaagttaagcgtgtatcgccccctctcaaagtcgggtcgatgctacgagttccagacgacttgatacctgaaatcgttgcatcaatcgactaacggattttttgactgaaactgtcgataatttcagctctgcagcgatatctgcattactcttccccaaatgaagaagggtgagaacatctcgctctctggtcggaagatcacttatggaggaaggaggctgcgacaaaaatttacgtaaatttgttgctatttcaggggagatggtagttccccccatagctgctgattggacagcttctattatctcatctcggtcggcacttttgagtaaaaatccaaaggccccaaattgaagcatagagagcatcgcataatcatctagaaaagaagttaatgctagcactctgcaggtaagtttcttttcagcaagtattttcatcaactccacaccgctcaaaagtggcatacgaacatcacataacaccacatccacgatagtctttgatagaatgtctagcgcttgcacgccgttctctgccgttgcgacgacattgatgttctcattagtggaaaaataagtttcaagtgcattaatgaaaaagggttcatcatcaacaattagaacttgaatcgggccaagcatgagagaatcctaactatgaaaaaggaagagtgagcgcagtatatttatgctcatatcattgattttaagatctgccataactgggtaaaacgtgaatacttccactactttccgagtcgacgtaaatctcttgcgaagctcgcctttcaacggctaggtacacctagagtccacttctcccgaaattctatattccgggaaattactgctagataagtacacgttgttgcatatgatacaagatcccatgaggatagtgttcttcacatgatgcatttaattctgattcagacatgcatctttgctttggtcacataatcactgatgcgcttgattacttctcagcctcgccccgcccggccaatcggtcaacctggtattttcggcaaccacgtccaccgaaacctaattaatctgtccatcgtggactttcccatcaaaccggagccattaatggacttgccaaaagaaaaactccccgactgttggaatctgatttctcaggccgacttccggggagtggagaaactcactgatgtttatcagtactagttgtcagctagtacgtcatgcaggacgatggtctgatcgcgaccaggtccaacaccgatgtaggagaagcgagcaccagagagttcttccagacgtcggacgtagtcctgggccttttgtggaagatcctcgaaggtcttgcagtcggtgatgtcttcgtcccatgcaggcatggtttcaaagattggggttgcgtggtggaactctgactgggtcagtggcatttcatcgtggcgaacaccatcaacgtcgtaagctacgcagattgggatttcaccgatgccggtgagcacgtctagcttggtcaggaagtagtcggtgaatccgttgacgcgggatgcgtaacgagcaatcacggagtcgtaccagccacagcgacgcttacggccggtgttcacgccgacctcgccaccgacggtctgcaggtactcgccccacttatcaaacagctcagttgggaatgggccggcaccaacacgagtggtgtaggccttgatgatacccaaggagctggtgatcttggttgggccgatacctgaaccaacacttgcgccaccggcggttgggttggaggaggtgacgaatgggtaggtgccgtggtccacgtcgagcatggttgcctggccaccttccataagaacgtgcttgccctgatcaagtgcctcgttgagcaccaaggtggcatcgatgaccatggggcgcagacgatcagcgtaggagaggaagtactgcacgatttcctcagcgacgatggccttgcggttgtacatcttcaccagcacctggtttttgtaatccagggcggattcgactttttgacgaaggatggattcgtcgaaaatgtcttgaacacggattcccacgcgggatactttgtccgcgtaggttgggccgatgccacggccggtggtgccgattgcgcgcttgcccaggaagcgttcctgaacacggtccatcacctggtggtatggagcaaccaggtgagcgtttgcagagatgcgcaggcgggatgcatccgcaccgcgagcctcaaggccgtcgatttcttcgaacagtgcctcaaggttgatcacaacgccgttgcccaaaattggggtggccgtttcggagaggacgccggcaggaaggagctttagctcgtacttctcgccgccgaccacaacagtgtgtccagcgttgttaccgccattgggcttaaccacgtaatcgacgagtccgccgagaatatccgtggccttacctttgccttcatcgccccattgagcgccgacaataacgattgcagccattggtttacgtcacatccgatccatgaagttggagtatgcacgcgtgtgcgcacacagacgttatttcatcttactatcccatgtgaggtttttaatcatcgcgatactaagcttgcggtatgcgtcttctggttttgcggtgcgatgccccacacatcaacgaattccctgccctttccacctctgtggagatccacgatttgcctgcggtgcccacccgaaaagacctcaaaattcttgatgatgtggcctttgatgtgctccctcaggatcccacgccttctctcgatgagatcgccaagcagcctgatgtcgagcatttgagcagccctaagtttgcgccacaacagcctgaaacccgtttgcgcatcgtggtgatcggttcggatgcagcgctgtctgcggtcctgactcgtctcatgcgcgccgataatttgtgggcggagattggattcgtgcccgttggtccttcaacggctgcgaagaactggggtctgcccgccgatgaggctgccgcgcttgagctcgcactgaccggattggtcaatcctgccccgctcatccgcgatgacgttgcggtcgccgtcgccggttcagccaccatcaccaactgggagccgggtgagatcaccggcgaagtcatcgtcgatgatcatgttctcatccgccacgaggctgcctcgaaggccccacgccgtggcgtctacggtgcccgcttggtgccgatgcttgacgccccaggcatcgctgcggtcatcatggacactcccctgcccggcgaggtgccctcccgcagcctgttccctcgcccctcgggctcggttattccagagagcttttcgacgggccgtgccatgcaagccggcggcccctcgctacaaatccgggttgacggaatttcccgcaaacgtaaagtggagcgcgttaccttctatcgacatttgcgcgatctccaaatcgtgcggccgtaaaacaaggagccagcatggcaccagcgacatctctcccgcttgaatcaggaaataatattctcttcccgccaatgtatgaccttgtttggtctgtgattcccttcgtcattctcttggttgtggccatcaccgtcgcaactgtggaatacacgagaaaacgggatgtagtggcttcattgggctggggagctctcgtgttgttcctccccatcatcggatttgtcatttgggcagtagcagcgcttattcgccgtgaaaaccgaaccgcgataaaaggctagtcttcgtcatcccacagctccggagggtaagccggactctctgaggtcggaaccaacactgccaccgcagattccctggacatgccgcagatctgcaacaggtccacaatgatggatcgcgattgcgccaaaattacttgtgcggatagcactcgatcttcggcgatgtcctcgcccacttcactgcccagttgacgcagtcggttaaccaactcaggaatttccagtgcttcactgatttctttgtggtgctcataaaggtctgacagtcgcagtgcaatgtctgcgatttcctcaatcacgtggatttgttcatcactgacggtgtcattgtcttcggtcagcaccactgcccgtcgcgcaaggactcgagcatttcggatgacgttgtccactggcgccagaatgcgatacagcgatctcacgcgggccctatctccccataaaaatggcgatacggtggttgcttccttgcctgaagatgccgcagtttccagcttgttcaccgacgcctgcgaccttctcaatgcttccaaagcattgttgagtttggctgcatccttggcttttagggaagctgccacgtcttccagcacactagctgcgatccccaaaacgttggccacttgatgccggcctgcgtcaagaggagatgagggaagaagtgcgatgaccaaaattcccacgccaccaccaatgaaggcgtcgatcatacggtcaatgcttccaccatcacctggcgggaacatcgtggcaatcaaaatgccaccaatggccatctgattactcaccaacggtgccggtgaaacaaacgaggccaccagcagcgctaatccaactaccacaaatatctgccaatagcccgtgccgatttgcatgatcagtaaatcacccaaaccaacgcctaaagcacagcccagggtgagttccgtggctcttttgatgcggtctcctccggagagacccaaaataatcaccgcggacatcggtgcgaaaaacggttgtccgtgtttgatcacttccacggcgatccaatacgccacacccgcaccaattgcggaatgaacaataaacagcagtcgggaacgaacccgcagcaatctattgcgcagggacttatccagttcagacagtctggcgacagtccccagtttcttctttgccatggcctcaagattagctatgcatattcacaagagcatgagaagacacgaaaaagggcagtccccctgatgcggaactgccctttttaactgctgagattacttagaggtggtctttccaacagacttgaggtcctggcaagactcgataatgcgctcagacatgctctgctcagccttcttcatgtaagagcgtgggtcgtaagccttcttgtttccgacctcgccgtcgatcttgagaacgccgttgtagttctcaaacatgtgggagacgattgggcgggtgaatgcgtactgggtgtcagtatcaacgttcatcttgatgacgccgtaggtcagcgcctcttcgatcttttccttctcggagcctgagccaccgtggaagacgaagtcgaatggaagtgcgtcgtctgcaagtccaagcttcttgcgtgcaacctgctggccctcaaggaggacctctgggcgcagcttgacgttgcctggcttgtaaacgccgtggacgttaccgaaggtagctgctagcaggtagcggcccttctcaccggtgccgattgcatcgatggtcttctcaaagtcttctggggaggtgtagaggtttgcgccagccttagcctcaacgccgtcttcttcgccaccgacaacaccgatctcaacttccaagatgatgttcgctgccttggccttagccagcagctcctgtgcgatttcgaggttctcgtcgattgggacagcggaaccatcccacatgtgggactggaacagtggaagctcgccgcggtcgacgcgctcctgggagatagccagcagtgggcggacgtactcgtccaggacttccttctggcagtggtcagtgtgcagagcaacgttgatgccgtagctctttgctgcctcgtgggcgaaggctgcaagcgcaactgcgcccttgaccttgttctttactgccaggccggaaccgaactctgcaccaccggtggagaactggatgattccgtcagattcagcctctgcgaagcccttgagagctgcgttgatggtttccgaggaggtgcagttgatggctgggaaggcgaatccgccttccttagcacgatcgagcatctcgttatagacctcgggagttgcgataggcataaggtgtctcctccaaaaggtgactgtcactgaactatgtatgtaatttcatcatgcagaaacatggtgaagcgcgaaccgataatcccacattcacaatgtctgattctgttggatcaaacattgattgtggcatcttcagttgcctatagccaattatgcctgcatcactcaacttttgtcgtgtgatatttccttcaacctaaggaaaatgcataaacgcaggtcagcacatacactatcggggctatcgggagcgaccggtgtaactattgccgttgttttccagttcttcggccactttcgctgctgcttccatgagcatccaaccggacaattgcacggacagatcacgttcatccacgcgcacaacactcaccagatcgctcaaactagaggaactcaaaccaaagttttgtggcaggcgtgcatccgttgtccagtctgtggcgaataccggaaggccatcaacttccaatcggtggttccatacgctttccgccgattccagtaccaggcgtgctgcaatctttttggtttcccggttggttggtgaatcgtcaggcaggcggatggccacatcagctaaatagcggaccaaaatgcccttgaacaaaccgccgtcgccgtcaccggtgtcccaatcaataacgccgtggaagttggtcatcttccgcgacacagcctgaaccacagcgtggatgtgtgcaaagtatttgagggagtcttctgccttatcggcatccgaccagtgatccaccacagtagtggtcaagcctgcgcgctcacgcagtttgagagcaatttccaaacacgcaccaatggcgacaccttggcaatacgggtggatggaacggacaagctcaggtccgtgcatgcgcatgcgcaatccgtccatcacaaggccgtcgccatcgatcaggttgtcaaaaatccaatcggtgattttcatagcctcgtccaaacggtcggtgcgggccatcatgatcgcagcaggaccgttggagggaacgttgtagaaggtttcgccggaacgccacggcagcacaccagtaagggaatcaatgccatcgacgatgttttgttccaacgagggcaatgattttggtgtgcgcacctttcgcacttttccggcacgcccaagagcaagggccagccaagctttgtcgtcgtaataacgattcgaggtcagcttgcccacattgcgcaccgaaatgccgcggatggtgtccctgatgcggtcgcgacgggcctttgtggtgcgtcgacgagcagcatccaccaggcagtctagataatgcgcttgccaccagtagtgccagtggataaacagtttttctttggcgttggatggccatgccacaaacccaagatttgttcgaggcagaccccaaaccctcgcggaatgcctttcgttgatggcggattccgctaggtcagctctgtttacccatttgtctaacactgagtgtttcttcgctccaatgcaggtgttgtacaactaaatacgacacccaaaagtataacgaaagtctaacgatctagggtataaaattaccaggcttgcgataagtcggcatgttgacgaatccatgcatgcattgcaataccagcagctacacccgcgttgatggatcgagtggaaccaaattgggcaatcgaacaggtcattaacgcacctgcacgcgcagcttcggtgacacctgggccttcctgaccaaacagcaacaggcagttcttcggcaactcagcggtttccaaaggcacggaacctggggtgttatcgatcgcgacgatggtaagccgctccgcgattgcccacgcaagcagcgaatcaacgtcttcgtggtgcatgaggtgctggtaacggtcagtcaccatggctcccctgcggttccaccgacgcctgcccacaatgtggactgtgttcacggcaaaggcgttggcggtgcgcacgacggtgccgatgttggcgtcgttttcaaagttttcgatcgctacgtggaggctgtggcggcgggtgtcgatatcttcaacaatcgcctcacgggtccaataacgataggcgtcaacaacgttgcggcgatcgccctcgttgaggagggtgacgtcgaaaagcgggcttgtaggccgaggtacgccggggttttcctcttcccatggacctttgcccacgcgggactcgccccactccgtggggccgggggtgttagttgagtccaagatcagaaagtcccagcaagctgcggtaaggaaggccttccgctgcgataacctcatctgcaccggttgcgcgatcgaccacggtggcaacgcccacaacctcaatgccagcttcacgcaacgcggcaacagctgtcagaggggaatttccggtggtggtggtatcttccaccacgagcaccttcttgcccgtcaggtcagggccctcaatgcgacgctgcatgccgtgcttcttggcctccttgcgcaccacaaacgcgttgatatcgcggccgtcggcgtgcatgatggcggtggcaaccgggtcagcgcccaaggtcaggccgccaactgcgtcatagtcccagtcagcggtggcttcgcgcagcagctgaccgatcaggcgagatgcgcgcgcgtgcaaggtggcacgacggacatcgatgtagtaatcagccttcttgcccgaagacaaggtgacttcaccgtggacgacagctagctctttgatcagttcagcaagctcagcgcgcgcttctgcgttaatggaattagatgacatggatttcccagcccttccctaatttgatgattgaggtttaaacccgcgtttgttacagcatagaacctggggtggacacggccgaaaaacaccagttttctaccacttttttggtggctcatccgcgtcggtggaatcttggaaaatactggactgaccattgagatcacgcagcacacgcgtgccataaagatcgctcggacgctctggatcgccctccgcaatcgactccacatcatccgcacccaatgaccgtggctcgaccactccgcggctttcctgcacaccgcgaaccggcatctgcaacggctcctcggggcggatcaccaacggctgagacaaatcttcttccgaagcattgggagtaaacgctggcttttctggctgctccggcttcagacggcttggttccaaatgcttcaaatccaaggtttgcgcacgcgtggaacgaggtggcaacgtgaaagacgcgtccgtgagcagcgccaacggccgcaaaatctcttcccaatcggaaggcgtggaacccttgatggtttccgccaacacccaatcagattccatccacacagcagtcacagcttctggcatggaatccaaaccgacgtgaatgcgctcgtcgacaaaacgctgcgcaacccccgccacgttactgagcaggcggaatccagagacggtatcaatctcgactaaatcatcagattcttcacgctctggatcggcaggctgctcaccgcggcgcgcatcaatgaccacgtcagaggtaattccacggcgcatcgccatcacgggcacgcccgccaaatccaccagatgcgtttcatatccttcagccatgccactgaccacatcacgtgcaacggcaccagtcgatgccgcaccccttgaccattcatcggtcaaaaaggcatcttccttgatgaaatcgaagtggtgcttcgccgcccagtttcggcgctcccggcgctgcgaaccaggcaaagagctcaaaaacgaatgcttatcgacgccccgttgctcctcgtccgcagctacctccgccgtggcaggggcttgaggttgctcagactgcactggctcttccgggtagtcttctacctcagtaagctcagccaaggcattttcaacatcagcatcgagttcaggggaatcatcaaaataaatgtcctcagcctgatccggctcaagatcttgaactggttctggcgcaaatctaggcgcaacttccagctctggttctggttgcgcttctggttcagggtccagttctggctcaaactcagggtccggctcttcttcaaccagcacgggcgcaggtgcgactgagcccacaggtgattcagcctttttagctgcctgtttagacgagtccgcgcgccacagtacgatgcctgccaccaagatcagtgcggcgatgatcaagacacttatttccatcacatcacacaccttactggcagtgcgtactcaagccacgattttaggcctcgataggattctcggggttagcgctccactgtgaccaaccagcaaaataatggctcgcaccggttagccccgcgtgctccatgccagccagcaactgggacgagtggttaccggaaccggaataaacgatgacgttctctccgctggttacccccttgtccgcaaaaatctggcggatttcttctggtgatttgaaggtgaaatcatcttccagcaaagatttagcgttgatgttgatagcgcctggaatgtgtccggctttcagatcgagcttttcactgcgacccgcaaatcgttgttcatcgcgagaatcaatcaaaatgccctgatgtgccttgacatcttcgatggtcgctaccgacagctgacctgggttgggacgcacattgcaaaagtgcgggaagtttccaggcccgccagcgtgtcccagctcatggtcttcccacttctggaaaccaccgtcaaggatgcgaacgttgggcatgcccgcccatcggaggatccaccaggcgcgtgcagcaaaaaggccacgtccctgatcgtaaaacacgatttcacgatcggtattcaaaccccaggtcctgaaagaacgtgccaacacattcagcggtggcagtgggttgcggccatcttcagaggaaggaactccggaaagctcaagggcagggtcgcagaaaatggaagttgggatgtgctcagagcagaaaactgtgcggcctgctccttcaattggagcccagaaagcagcgagaacagtttgtttcttaccagcgtggattgattcagcaagggtggacggagaaatcaacacggtcatagccccgagcctaggcgttaatgtgaccaagcgcagcgcgggcaaaacctaaccggtataagacaccgaaacttcccctaccattcactttggtaacccgttggggtgcgtacgctaagtattttagcgccaaccgctcgtgaggtaatcggcttcctcgaacatgtggaggctgtgtagatcaataactaattgcacaggtgccacaaaatttagcctgtcctgggtgtaacttcccaccagttccgtgaccgttgcgggcaggagaattagatcggcgtcttctgccacatcaacaatggtgcccagcgctgagacatcgagatcgtgggcaggttcgtgccacacaatcgaattccccagcacaatttgtcccatgatcaccgtggcagccgcagcgcccgacagcgcccatttggttttgtgctgttggaaaagctccggtagctcagcgatgccgcgtggattgagtttcacaaactgcgcatcctggcgatgtgtgatgccctgaagcgttccggcttcagagacaagggtgagcggatcgttgatattccaccgctcaaaacggtgcaaccaagcgagaatttcctggttgtggggattttcggggacggaggcgtcgataagcgtgcgcgctgcagcggccgcaaagggatcgcaggcgtggtgcgcggcgaccttaatatcaagcccgagcgccaacgcgacctcacgcagcgtcgacagggtgggctcgctggtgccatcgccgacccgcttcagggtcgagcgcgagacaccggaacgcctggagatgcgagtgggttgctccgcggcgagagcaatcaattcatcgatcttcacaacaaaccatgctaatcatcacggtttttcgctcaggcaccggccaacgcttttcgacgcgcccctccaccttttcagtagcgtcacgggcgccaatcctgtatttttagcagcagtttgagggtttttgctccccatctttaggagacaccccgtgtccacgtttcataaagttctgatcaacaccatgatctccaacgtcaccactggatttctgttctttgccgtggtgttttggatgtatctttccactggcaacgtcgcactgaccggcatcgtcagtggaatttacatgggtttgatcgccgtttgttccatctttttcggaaccgttgttgatcacaatcgcaagaagtccgtcatgctgttttccagcgtcaccacactcgtgttttattgtctcagtgccctggtgtgggtgttttggctggaggaagacggcctgagcatcggaaataccgccctgtgggtgttcgtttctttcatcctcatcggatcaatcgtggaacacatgcgcaacatcgcactgtccaccgtggtcacgctgttggttcctgaagctgaacgcgacaaagcaaacggcctggtaggagccgtgcaaggtgttggatttttagtcaccagcgtcattgctggttccgccatcgggttcttgggcatggaaatcaccctgtggatctgccttgggctctcacttgtcgcgctgctgcacctgctgccgattcgcgtcgacgaaccggaaatcatcacccaagaagacgcacagcctactgtttctgacgattcagttcccacacctacctccgatttggcgatcgtgtccaaaggcatcgacctaaaaggatcaatgaaaatcatcctgagtgttccgggactgctcgcgcttgtgttgtttgcgtccttcaacaacctcatcggcggcgtgtactccgcactcatggacccttacggcctggaacttttcagcccacagctgtgggggctactgcttggactcaccagcctcggcttcatcgttggtggtgctgtgatctccaaaactggcttgggcaaaaaccctgtgcgcaccttgctgctggttaatgttggtgtggcttttgttggcatgttatttgccattcgcgaatggtggtggctctacatcctgggcattttcatcttcatggctatcaccccagctgccgaagccgcagaacaaaccatccttcaacgagtcgtcccattccgccaacaaggccgcgtatttggactagccatggcagtggaaatggcagccaacccgctctccacagtgatcgtggcgattttggccgaagcctacctcattccatggatggctggccccggcgcggacaccatctggggcgtgatcctcggcgagggtaaagctcgcggcatggcactgatgttcctcgcatcaggtgccatcatgttggttgtcgtgctgttggcattcatgtcgaggtcctaccggaaactcagccagtactacgccaccaccagccaagacattgcgggagctgctgagaagtaagtgctctagaccgttgtttgattggcttttcttgcctgttgaacgagggaaagaaaaacaaacagtcctgaagctacacccaaagaagcagcataaattggttccgcagggaacccattggcaacaaaacacaagataatcattgcgccaacttgccaaaccggggcccgctttttccaaaatcgaactgtggagaatttattaatcccccatgacaaggcaacaaggaggccgatgaaagctatggctaaaagaacttgattcagagttagcgagtaaatgaacaatccaaaaaaacatagaagcgataaaactctgccagtacatattcaccttgagaggctttgggtatcggtagtcaactgatacagagggatctattaagtacatttaagagtacttcactttgaatcgttgttctgggattctctcaaccccgggcctaaaacgtcagctctctacaattaggcgctctataacgccctgaaaattaccccctgagcatgcagatcatcgagcaggatctccaaaccgtgcgacggtgaatcgggggcaatattgacagttagcatttctgacatgggagcttccacgtgtagcccaagtgtttctagttgggctcgcacgtggtcagcagcgatggcatcaacgagcacccggagggttttgtttccgccagcaactgccacttcttgaaattccaagacctcatcaacatgatgtgcccgcacgacgtcacccagggcacagtcctgggcgacagccggcaaagtggctaccaggtagtagccttcggcaagcagttctacacctacctcttctgattccactcccggaacatcgagaggaatgcgcagcttttcctgcttgcccacgagccgttagaccgccctggaaacgtcgagcttctggccgccgtcggcgacgtcgacaagcacaccatcgccatcacggacgttgcctgccagcagttccttagccaaagtatcaccgatggcctgctggatcagcctgcgcaacggacgagcaccataagcagggtcgtagccacgctccgccagccaagccttcgcgctgtcgctgactcgaaggttaagcctgcggccagccaaacggtcagtcagctgcttgatctggatatcaacgatgctggtcagctgctcaggggacaaacgatcgaagatcacaacatcatcgagacggttcacgaactcaggcttgaatgccatcttcacagcatccatcatttgttcgcgagtaccgcctgcgcccaggttagaggtgaggatcaagatggtgttgcggaaatccacggtccggccttggccgtcggtgaggcgaccctcgtcgagaacctgcaggaggatatcgaagacatcagggtgagccttctccacctcgtcgaaaagcacgacggtgtacggacgacggcgcactgcctcagtgagttgaccgccctggtcatagccgacgtatcccggaggggcaccgaccagacgagcaaccgagtgcttctcaccgtattcggacatatcgatgcggatcatggcgcgatcatcatcgaagaggaactccgcgacagccttggccagctcagtcttaccgacgccggtaggtccaaggaacaggaaggaaccagttggacggtttggatcggcaacacccgcgcgtgaacgacgcaccgcgtcagacactgcagttaccgcttctagctgaccgaccacacggttgcccaagacgcgctccatgttgagcagcttctcggtctcaccctgcatcatcttgcctgcaggaatgcccgtccatgcggaaaccacatcggcgatcgtgtctggcgtgacctcctcagtgagcatggcattttcattgacctcgaccttggattctgcatcctcgatctgcttttccagctcagggattcggccgtagcgcagctctgcgacacgaccataattgccgtcacgttctgcaatatccgactcagaacgcagcgcttccagctcttccttcatctcacggacatcgtcaatagcagttttctcattctgccaacgagccttcaactcagagagcttttcgcgttcatcagcaagttccgagcgcagcttttctagacgttccttggaagctgcatcggattccttggacagcgccatctcttcgatctcgaggcggcggacgatacgctccagctcatcgatttcctgaggtgaagaatcaatctccatgcgcaggcgtgatgctgcctcatcaactaagtcaatagccttatcaggaaggaaacggctggtgatatagcggtttgagagttcagctgcggcgaccagtgcggagtcctggatgcggacaccgtgatggacctcgtagcgttccttcaatccacgaagaataccgatggcatcttctaccgttggctcaccgacataaacctgctggaacctacgctccagggcagcgtccttttcgatgtacttgcggtactcattcagcgtggtggcaccaaccaagcgcagctcaccgcgggcaagcagtggcttaatcatgtttccggcatccatggcggattcacccgaagcaccagcgccgacgatggtgtgcagctcatcgatgaaggtaacgacttcgccgttagctcccttgatctcatccagaacagccttcagtcgctcctcgaattcaccgcgatacttagcgccggcaaccatggaaccaagatcaagactgatcagagttttgcccttgagggattctggaacgtcaccagcaacgatgcggcgtgcaaggccttccacgatggcggttttaccgacacctggctcaccgatcagaacagggttgttcttggtacgacggctaagcacctgaacgacgcgacgaatttcctggtcacggccaataacaggatcaatcttgccttcacgagcaagcttggtcaggtcagtggagtacttttccaaagcctggaactgtccctctggatcctgagtggtgacacgctgagatccacgaaccgaagggaaagcctctttgatggcgtcataggttgcacccttgttggtcaacagatccgcagcatcagactttccgcgagcgataccggcaagaagtacttcggttgagacgtactcatcgcccaactcaccggcaagctcctgagctgcagtgaacgcattgagggcatcccggttgaagtttggattagccatattggcgccagaagccttggggtaagaagcaaccaacttcttggcctctgcgaggatctccttaggatccacaccagtagccatgaggactggcgctgctacgccatcagtttgctccaagatggcagccaacaggtgagctggacgaatatcagggttgccagccgaggatgcctgctgaagagcagcctgcatggcttcattggttttggtagttggattgaatgaactcatctttcaacgccctttctttgttgggcgccaacctacacaatcagtgttgatctcaatttcctgcaggtcaagcgccattatttaactctctaatatctataacgcacaaagagttgagtatgttccactcaagttcaaaaaatttgaaaataaattgagtggaccgcagtcaattttaagcactgactaccacttaagcatcagggaaaacccgtaactttaatgttacgtggagggaggcgtcgaaaagcatacgaaaaaagcgccggacctagacccggcgcttccaacctttattgcggcttaccctcgccgcggacatgtccgcgctccggcaaccacttcagaccccacgcgaggccaaaaatcacgatcgcaacaatcaacgacgcccaacccaaccccatggtaaagcctgcgagcaccgcgatcggcgcgatgatggtcatgccgatttcaaatggagcaaaaccgatataagccacgccgtactcattaagcgctcccgacttcaacttcggatccacgatcttcagcaacgcgataccggtagcaaccgcggcagtagcccaaccccaaccgaagatcgcgcgctccagccacttctcgccaaagaaacgaggcgcaacccagaaaaagaagaaacaacagtagatggtgcccaaaacaaacagcaccacaagaggaacccagtaatcagcaatcgcagcaggagcaatcgaggcaataccaaacgcaatgaggtaatccgtcgccgcgcccgacacggaattcacggtgtcgcgatccaaatactcaggcttcttcaacaaacgcataattcccatgcccacaatgccgaccacaaatgacatcgcaaacaacggaatctgcacggttgggaacatgctacccaaccactgattaatggaatacgcaaccgcaacagtcaacaaaataatgccagtatgcagcgccaaaggctcaatcgcagacggattcgtactcgccttaccaatcgacggacgatcactcagcttatcgatataacccgaacgcaaatcccacggcaactgcgcaggcatcgccgcagtcttgcccttcttaataccccacgttgtgaaaataattccaccaacaatcgcagcaaaagtacccaccgtcgcagaggtaaagcccaaagacatcgcagcctccgcacccgaagactccaacgcagtacccaccgcagcagcagtaccaaaaccaccaacaaaaccaaccggcaacatcatgccgaaccactcatcggtaccccacaccggctggaacaaaaacagacccagcaaaatgaacagaccccactgccccacaaacatcgcagtcgaatacgcccacatcgtcttcatgccagtacgcacgccacggtcaaacttcatcgaatacggcatcgaagcaaacacaatcgcaatgagcaccgtagtgtaagtggaaagatgatccgaccaaccaatcagacccaacaccttaggccccaaaatcatgccgatgatgccagcagtaatagaggaaggaatgagcaaagtctggaaaaacggaatcttccggcgcatgatattgccgatgatcatcaaccccgagatccaccccacatcgagaatcagactaaacggtgtgtactccatacctaaagcacttccttccacttcttcatagaaatcttttttgagattcagttacattcggccgggttcagccttactggtttttgttttgcgttctagtgcgcgggttttggggcgcaattgttgaacaaaacacaacaaccctaatcgagtggcgcggatcttccacatttcctatacggatcgacaaaatctgcagggaatgggctcgggttggtggcattgccgggtgctgttggggctttattggtgcattctcggaactttctcagggcatgaaaggtgcgcatgcctcagtggtgatttaagaggccgagtttttggaatgaacatagatgtggtcgcgacactttcaggcccttagaagcgattctgtgaggttaacttttctgggatcttggccgtgaaatcactctcttcgagccagaccagacaggcgtgacaaagccaagtgaatttccagattcctgtcacccagtccggttttccaaaactccacccctcgatgccctaattaacgcctcaattagtgccagaccttgccgaccgcagaccaaacttcaccatttcaaaccatccctagccacaacaacggcagttgtgcaatgatctgcgtatgaatgcagataagaaaatgtgcggaatgaacccggatagccaatacgtcgaacttgccgtcgaagttttcggactcctcgcggacgccactcgagttcgcatcatcttggcacttcgaaacagtggtgaactttccgtaaaccacctcgcggacatcgtcgataaatcccccgcagcagtttcccaacacctcgcccggctgcgcatggcccgaatcgtgtccacccgtcaagaaggtcaacgagttttctacaaactcaccaatgaacacgcatcacagctagtctccgacgctatttttcaggcggaacacaccattgcggacggccagactcccccacaccaccaccgagaacgagaacaatcatgaccacccacagtcaccaagaacatagccactccacacacaaccactccacacacaaccacgagggtcacgaccaccatcaccccaccggattcaaaggatttttgtacgagattttcgttccacactcccatgacaccgccgactcgattgatgatgctatggaggcgaactcagagggtattcgagcgctgaagtttagccttgtattgatgctgctcacgacggttttgcaggctatcattgtgtctttttctggatctgttgcactgttggcggatacggttcacaacctttccgacgcattgactgcgattcctctttggattgctttcatactttcccggcgcgcagcgactcaaaaatatacgtatggattcaatcgtgcagaggatttagcggggttgtttattgtcgcgatgattgctctttcggcgattgttgctgcatggcaggcgatcgaccggatgattaatcctcgcccgatggagaatattgaatgggtgattgcggcaggtgttattggtttcttaggaaatgaggctgtggcaatgtatcgcattcgggttggtaagaggattggctcggctgctttggttgcagatggcgttcatgctcgcacggatggttttacttcacttgcagttgtcgcaggtggtgttggagtttttctgggattccccctggctgacccaattatcggattgatcatttctgcgatgattgccacccttcttgttggtacgatccgttcggttggcagacgcctcatggatggaattgagccggagttggtagagaaggctacgcacgcgatctggcatgtgaaggaaattgagtcgattgatcgactgaggttgaggtgggttggacaccgtcttcacggcgatgccacggtcagcacttctacatcatcgctatcggaagccaccgcaatcgcccttgaggctgagctttccgtcaaacaacatcttcccaatgtggatgaaatgactgtgaccatcaccccttccaaaccttgagtcccgtgatacaattgttgatatgtcaacaaattatgaagcaatcatcattggagcaggtcaggctggactcgcggcggcgcatgaactttcccgccgcggtttcactcccggaaaagattttctcgtcctcgattccaacgacgggcccggtggcgcctggcggcataggtgggattcactcacattaggtaaagcccacggaatcgccgatctcccagggcttcccatgaatcgccccgatccgaaaactccggcttccacattggttgctggttattacggcgcttacgagaacgagttctccttcgcagttgtgcgcccagtcaaagtctcacgagttgagcccacttccgaggatccttcgagcccattgcgcgtgagcagcgacgatggtcgagagtggattacccgcatggttcttaatgcaacaggtacgtggacaaacccttatgttccgtacattcctggcatcgataaattccagggcaagcagctccacaccgttaattaccgcaaggccgaggatttcaaaggtaagaaagtcctggtcgtcggcggtggtttgagtgctgtgcaatttctgctggagttggaaggcttggcggaaaccacctgggcgacgcgtcgtccgccgaacttcacgcagcgcgagttcgacgccggctggggcattgcggttgagcgcgccgtccgcgaacgcacgttcaacggtaaagctcctgctagcgtcgtgcgcaccacgggaattccgcagattcctgattatctcgctggcgtggatcgtggactcattgtcagccgcggcatgttcgaggaaatcacgcccaccggtgtggttttcggtgagcctcccgccgagagatctgaaggtttaggcccttcggcaggcacgacgctggcggttccggaaagctggaagccatatcctgcaggcacgcacctggatgtggacgtcattttctggaataccggcttccgcgccgcactgcgtcacctcgcaccaatgaaactccgcgggcaaggtcgcggtatcgagctgatcgacgaggtcagccccgcctccgacgcgcgcgtcctgctcgttggctacggctccaccgcatccacggtcggcgccacccgcgcgggcagggtcgccggccgggttgctgctaaaagattgcttgtcgacgtctcccctcacgtaaattaaggtaaagaaaatgaaagcattcggttttttaagcttcgggcactatcaaatcggccacgaacgttccatgctgaaacaagcactggaattagcaaaagaagcagatgccattggagtaaatggcgcatacttccgcgttcaccacttcgctccccaaggtacatccccgatgccacttcttggagccatcatcggtgccaccaaacacattgaagtgggcactggagtagtggatatgcgttatgaaaatcccttgtatatggccgaggaagcagctgctctcaatctgcttgccgacggccgactagccctcggagtttccaggggatcacccgaaccagccgagaagggttgggaagctttcggctacgacggcggtgatgatcctaaagctgcaggcatggcacgggagaaattccttcgcttcctcgatgccatcgatggtcgccccatgtccatcgcttccgagaatcaatacccacgcctctaccatccgggcactcccctgccgatcttcccgcatgatcctgacctgcgtaaatccatttggtggggcgccggttcccacaacaccgccgaacaagcagcacgcgatggcgttaacttgatgagctccaccctcgtcgccgaagccaccggccaatccttcggggatctgcaagccgatcaaatcgcgttctaccgccaagcttggaaagaagccggacacgattggaccccacgtgtgtctgtctccaggtccatcttcccgatcgtcaccgaccgcgaccgtgagcttttcggacttcagggacaaggcggtgaccaagtaggaatcctggatgatacccgatccacgttcggtcgcagctacgccggaagtcccgatgaactcatcgaccagctcaaggaagacaaagctgtgatggaagccgacaccttgatgctcaccgcccccaaccaaatgggtgttgagatcaacgcgtcgatcctgaagaacttcgctgatcatgtcgccccagcactggagtggcaaccaaacactgaaggtctggttactggctacgagttctaacccagaactttgtcgattgaggcgttgaggtcttcccatagatcttcaacgtcttcaattcctacggaaacgcggcaaagagtcatcggtactcctgccaccacttcagcatcccgcctggtgcgacgttcaatggctgtttccacacctccccaactggtcgcgtgggttaaaagtgacaggctttcgagaatctcatcagttcgttcaggtgttgcatcaagctcaaatgacaacatgtttccacatccagagggtaggactcgcacggctttttcatgttggggatcatcaggaagtcctggataattgacgcgggtaaccgaaggatgcgcgttaagtcgccgcgaaagttctgctgcgttggattctgctcgatcaagacgcaccgccaaggaatacaatccacggagagcaagaaacgcttcaagacctcccggcactgaaccatgatcatgacggtgagtggcaagaaactgcgcatggtgctcagacttgcacactgcgactccaagaagaagatcagagtgtccaccgataagtttggttgccgagtaaagcacaatatcagcaccaagttccaatggacgttgacgaagtggcgttgcgaaagtcgcgtcaacgacagtcaaaactccaagcccacgcacaccgtcgactattgcagggatatcagctaccaccatcgtcggattagcgatcgattccacccacaccacatctgcaccttgagcagcagcaatcacttcttcggtattgtctgcatcaacagttcgaaccttcagccttccgcgggcttccatcctggcgaaaatattggtcacgccataataggcagctttaggtaaaacaactgtgccaccagtaggaaccaaatcagcaatcgacgttgccgctgccaaacctgaagaataagataccgcgaacccaccatctagagttcccatggcagcctcaaatgcaccccatccatcattgccatcgcgcccataagctttttctgaatcatgaacataagtgctggacaacgtgataggtgggttcatcggcgcaccaggagttctggctggccgtcccgcttgcacagttactgtgggtggacgccacgcagggttaataggtacagatggtgggtaaaaattcatcaggcttccttacttgttatatcaagcacgaggtacacgcttgtccaaggcaactaaatacctagtggctacggtggtgggattagcaaagtcggtatctcgcggaggcccaaaccgtagacaatcccccgttgaaagttcgtggacctcttcaccttcagtaatacgaacggccccttcgagtacccagaccacctgatccatgaaacgataagcatcagctgggtagccaacttccgccccaggaggcagcattacttccactagttctagtggggattctgacggctgtgacactgcacgccgtgtgtaaccggtagctggatctgtccatacagactgctttgaccgccgagcgccccggtcatagccaccttcagcctgtgcaatgagctccgaaagcgtcatacccaatgcaccggaaaggcgtccaagtaatgcagcgcttggttgcgcctctgcgttttccacgcgggaaatcattgctcgcgacacaccggaggattcagctaacgccgagatagagagcctgcgttgggttcgcgcgtcgaaaagcgctttgacgagagcagcactgagatcgtcttccatgcagacaataatgtcgctttaagaacaattttatctactatgagaacatttttagagaaagtagcccgctctgtgggagtagcattggattgcacaaaacggatcgggtcacggggctcggaagactacgatgattcacccacctaccgaaagcgcttactgcgatgaataatcagctagatcagggcccccttttccacggaacaatagcgcggcttcaacctggtgacctccttaaacctggtcataagtctaattaccgtcctgacataatcatgaaccatgtttatttcaccgctctgattaatggcgctgggcttgctgccgaaatcgctgctgaattagacgctggcctatcggacgatgtttttcagttccccggaaaactccgcgagtttatgaagtgaaaccactggggagttttgacaacgatcccaacgtgaccgacaagaagtttccaggcaatccaacgaggtcttatcgcagtgacgaactgctgcagattattcgagagatcaccgattggactcggttaactcctgaggcactagcgaagtggagggaaaggttacgcaattacccccaataagagcgtagaaatcattaactagctgcatcgttcaatattagtgaacgttcaatattgatgaacacacgctacacttagattatgccaatagtaacttttgaggactggaatgaatcgttccttcagacgggacttccctttgaactccttggacaggttcaaggcaagactttagaagacgaacccttcgccgatatgggcgaagccaagttaaggattaaaaattttgaatcggtgaatgcgtcaaaaatagtgcatgcgctatatttccccaacttgaaatatctccgatttacactgccacagtctgtggacaagttctttatcttatccccaagtattccccctcgagttgctgaacttttgcgcgaacaagggtttatgttcgccgaccaacgaggcaatggtttcgcatcatggcctggggtccatatcgatgtccgcggtaaaacaagcaccgattcatcaaagaaaatcaaaagacgaacaccagatcgtcgaactgcatcacttttcactcctcgcagagctcaagtatccggagcattgcttgcacaaccagccatattaaggtcaccaatccgcgagattgcagactcagcgtccgtctctgttggcaccgcgatccaaactcttgaattactcaccgaagctggctacttgcgcaaaatagaaagcggataccgactcatgaaaggcgatgcactgcttgattcatgggcgcatgcctatccgactgggctcggtgtaagccaacaaactttcagaggcaatggagaccttaatcgctttaaaaacattgaacctcttgggtggatcagtggcgaacaagctgtcccaaaacttatcagtggcggaaatactgcacatatttatgtcaacgatgacagcgacgacaaggccactaacaaaatcattcaacaaggacgacttcggagagatgataccgagggccaggtattagttcgacgagcattttggcggcaatcaaaaaagcataatgaaagctaccataaaagaaatctatcgctagcttttccaaccccatttaacatgtggccgatcgctccattaccagtaatctatgcagatttactgtccgttggggatccgcgcctatcggaagttgcctacattataaaaactcagattcaggaatacacagaccatgatgaattcaccgaacgcggacattattttagtagttaacaagctgtccaagtttattgatatcgaaaatattatgctcgttggagcacgatgtagagacattcaccagcaaaaatatcgcgatcaaacagcgggtagaagaactaaggatgttgacttcgctttagctttagaaagctgggacgacttcaatctattaaagcaacaattctcaccgactggtaacgcatggcaaggaatcaccattggaaatattccagtagatctcgtgccattcggaaatattgaaaacccacccggtgaagtcttgtccagaaaaggtcatctacttaatgtcgctgggttcaaggaagtattcgagcaagctgagctatatcccctaaatgatgcgatagacattaagttgtctacagttcccggacttactgcgctaaagctacatgcatggctcgaccgtaaagaaaataacatcaaagatgcaagcgatctagcattaatcttgtcgtggtacgaagaggatgtagaaactttatggaatcgctattttgccctggaaaatcaaggatacataggtgaaccagaggcaatggcagctgaattactaggacttgacactggaagaatactcggccacaaggaaactcaagccctccttgatcgatttaatgaacagtctcctcctgagctaaaccaatttgctgaatcacttgaagcccctcctgaacacagtcacccattagaacggcgtcgtatccaggtcgaggcactgttaggtggacttagagattccctcggttacgatgaatagcttccaatcccgcattgttcaatattactgaacgttcaacattaatgaacacggctgtttaattttcttttatccatcagtcattttaagcttccgcccctcggcaaggtgacgaaaattttgttattctctacggtttgagggcttctcgcgggaaggattgggtgaggagggaggcgtcgaaaagcaagaaacgcctgacacgcgtagccgtggctgcgcaccttttaccttgattaggtgcacaatagggagtgtgacacctcgccctgtttcttctgttgcgcgactcgttgaggataacgcgcaagattttcttcgcgccgttcaggcgaaacttttaacgctcgcgccacaggctcgtgggcattttcccactgcggatgatgcgactcatatcagcatcgccgaaatggtgagtgcgctgttggaaggcactggtgaggaagggaaagtagacgacaaaacactggagttctttaaagaagcggcgttagatgcgcgtcgatttggcctgaccccagaaatgcacagcgctttgggtgaggccgtgcgcagcgaactattgtcattatgcgaggatcttccctttgaaaatgtgctgtttgccgagcgtgcgattgctgcaaccacggctgtttccgtcgaggcggttcgtgaagctgatgaggcacacattcctgcctcatatcaggcagaaattgtagaagttgaaaagcgcagccgtaggttcaccgtcgtgcgcatgcaagctgaaacgcaactgccctacctaccgggacaatatcttgcagcaactgcggattttctgcccaacacatggcgctacctgtgcccttcgatccccactaacgaatgggggcaggtggagtttcacatccaatcagacgcagatgatatcgctggacttttagccaccacacgccttggcgataaatggcgacttggccccggtcgtggagatttcggacaaagcaaaattagttccggcaatgatttgttatttattgcacatggaacgggcctagctcctcttcgcgcttacatgtttgagctgatgaaccaagcagcacctccacgtttgcactttttcgtcggtgccgactaccccggtgagctgtatgaactcaccggcatgtggaattttgctgcagccagcccatggctttctgtcgtaccggtgtcaacgcatgacaaggatgcgtggtgggttcaagccaccgaagcatcgcagccaccgaggggtttgcatttgcatcaaacgggttcgatggcgaagatcgtcaccgaagcaggtgcttgggccgaccgcgacgtgttaattgctggccctgaatcgtgggctcgggatgttcggcgcgcgatgattaggcgtggaactccggcccagcagattgagattttagggttctaggttgcctcaccgggctgaccaatcagaagcgccgacgtgcccaacgagtgattccttagacagtggttaaagaacaggcaatgcctcccgaattttggccaaaccgctgacatcaatatccgcgatcaacatttctggctcataacccgcgctagcaattacttcaccgtgtgggtttgtcaccatggaatgaccaatccccgtagggccttttcgttcatcgcgtaattcttctggaagtcgcgcttgcccacacgctacgatccagcaggtggaatccagtgcacgcgcgcgagggaggacttcccattgttctaattttccaggaccgtcttgccacgacgtgggaaccacaattatctgtgcaccgttgcgggcgaggtctttgaactgttctgggaatcgaatatcgtagcatgtcgccacaccaaatttaatatcgtcgacctcgaatacaaccagctcatcgcccggtttcacagtgtcggattccctataaccgaacgcgtcatatgtgtgaattttgttgtatccctgatgcaatccagcgccactaatcagcacggtgttgttgacgcgcgagatcgttttttcaccgcgctgcacggtgtcagcaggggtgaacatgcccgcaacgatgacaacgtccagctcatcggctaattttcgtaccgcggtggagaattcgccatcgagctcctccgcctgagtatcaagccttcccgtaccaaagctttgcgaagtcgcctccggaaacaccaacacccgagccccctgttccgcagctttttcagcagcatcacgcagcagggcgaagttgtccatcttatcggaattcgtcgagatctgaagcaaggcaatacgcataatccacagcctaggcgctttgaggcaagttatacacaggttcgcgtgatcacttcttgcccagcatcgtaaaaaccacttgaatcagcagcatgtacctacaaaccgacctccccaatcacctcatccaccgcgacatcacctatcccagccccacacttaactgcacgcccagccacacggccaccgcgctgagcagcgcgaatcaacactggcgtctattgcttttcgacgccaacctccatctcaacaatcatctttccgatatgcgcactgtcagcgagcagatgctcaacatagacgtcgatcttggccacacactgaataagttgcactgatgctcgccctcaaaagttcagaattagaaggcatagccacatcactcaccgccgtggcgggtgcgctccacgaatcaaacactgaccggttgcagtcctggcagcagctcgaaacgatgacctctgccagctcccttatccagggctttatcaagcttgtcgattacaaccgacccacagtgaatatcgtggaacaaatgcacaaaaccgcatccacgcttttcaacaccgctgatttcctacgcactttggaaggctatgttgatgtactggaaaaacaagccgataaatctataacgctcaccgtcatgcttcgatatattgccagcttgagtagccttttagacctcatgtgtgcacgcgagatcaacgcgttgtgcacagcgattactccagaaccattgaagcatctgggcgattttggcactctacccgcctcagcaatccacgagtttcatttggtgaatgccccaccagaaatccgtgccttagccgaagcccatcccgatatgcagatcctagaagccggcgatggttcattggtagcatcgtttggggatattgatagggctacgaccgtgaccaccatcgtggcaggtgtgggttcctccaacccagaagggtggaatacatatgttgaccgtgcccgcacagtatctgcttccaccggttccgcaacggtgttgtggctgggatatcaagcacccgcttcgattcctgctgcggtatccggcgcggcagcgaatcgcgctgccgcggatctccagaggtttcaagcggcactacagtcccgcaatccccaccaaagaaaagtagtgatgggctacagctacggttccacagtggtgggaaaagctgcgtcttccggcgagctcagtgccgatgcgttggtattggttggcagtcccggcgcgggtgtctcgcactcttcccagcttggcgcacctgtgtatgcggtaacagggtctgctgatcccatcggttttgccggcacccaatatgacggcatccacggcactgatcccaccgctgccctattcggtgcaacagtgtgggattcgccctcaacgcattccggttattggaatgaccaggagttcctgggcaatgtggcggaggtggttcgcggcaaatagaaaagccgccgcacactggaggatgtgtgaggcagcttttctaggacttaacgcttagatcagaacagtccggttgggtttggatcgtaggagaccaacaggttcttggtctgctggtagtggttcagcatcatgaggtggttctcacggccgatgccggactccttgtatccaccgaaagcggagtgcgctgggtagttgtggtactggttgacccaaactcgaccagcctggattgcgcgacctgcacgataaatggtgttttggtcacggctccagacaccagcgccgaggccgtagttggtgtcgtttgcaatacggatggcctcatcgaagtcgctgaaggtagcaacagaaaggactggtccgaagatttcctcgcggaagatcctcatgtcgttggtgccgcggaaaacggttggctcaatgtagtaaccgttctccatgccatcaaccttgttgaccttgccaccagtgagggtttgagcgccttcttctgggccgatcttcaggtaggaggagatcttgtccatctgctcctgggacgcctgagcacccatcatggtttcagtatcaagtgggttacccagcttgatgttctgaactcgcttcacgccaagctcgaggaattcatcagcgatggactcatgaacaagtgcacgggaaggacaggtacaaacttcaccctgattgagggcgaacatcgcgaagccttcaactgccttctctgcgaaggcgtcatcctgtgacagaacatcggagaagaagatggatggggacttaccgccgagctccagggtgacaggaatgatcttgtcggatgcagcgcggttgatcagcttgccgacctcggtggaaccggtgaaagcaatcttgccaatccgattagagccggacagtgcagcgcctgcttcaccgccgagtccgttgacgatgttgaggacgccctctgggatgagatcgccgatgatgttaatcagatacaaaatggatgctggggtctgctcagctggcttcatgacgatcgcgttacctgcagcaagtgccggtgcgagcttccaggtagccatgaggattgggaagttccaaggaatgatctgaccaacaacaccgattggctcgttgaagtggtaagcaacagtgttgtggtcgatctgtgaggaacgatcttcctgagcacggatcgcgccagcaaagtagcggaagtggtcgattgccagtgggatatctgcagcaagagtctcacggactgccttgccgttctcccaggtttctgcaactgcgatttcttccaggtgctcttccatgcggtccgcaatgcggtgcaggatcagagcacgttcagcgacagaagtcttgccccacgcatcagcggctgcatgtgcagcatccagtgcaagctccacgtccgctgcggtgccacgtgcgacctcacagaaaacttcaccagtgacaggtgaaatgttctcaaggtactggccctctaccggtggaacccacttgccaccaatgtagttctcgtagcgcttttcatagttaacgatcgagccttcggttcctggatttgcgtagacagtcattgggtctcctttgggccacctccacctgagcactacctgtgcgtcaggtgacacttggtcaacgattgtgacaacgcgcacattcgcacgcttagcagccaccatattcacgaaaatcaatccgcgctagaacccccgttaaattcacccccttttctcaaaattctcgcagctcaacgccgaaagcctttcaaaagttattacccctgttcgggtggttatacatgtatctaattggcgaaagcacgaaacgggcacctccaaaagataaatggaggtgcccgcttaatttgctagaaagtggcgtcgacaagcatgtttttacttggaacgccccttgcggcgttcccacatgaccaccgcggtggagcggggcacgtgcaccagctcgccacgcggacgcccgctgcgtaattgatctttgagctgctcattctcagctgtgaccttacgcagggattctttgaggtttcggttttcttcgccgagctcgatgatcgccttgattccggcgaggtttacgccttcctcctggctgaggtgctgaatttctcggagtaattccacgtcagcgcgggagtaacggcgaccgcctccgcgagtgcgtatcggggtgaccaaacccatgcgatcgtaggttcgcaaagtttgggcatgcatgccggcaagctcggctgcgacagagataacgaagacttccccttgaaaatcgacacggtcaaactgaccttcatcgttggattttttcggtgtggatgccatgtttcgtcacctcctttctcaaagagaacgtctagcggttctggcccgcccagttagcgcggggatcaaaacctgaattagtttctgcttcagcatatgcgcggagagcttccgcagcgttgtcatccagattcttcgggacagaaacctggactgtaaccagcagatcaccagtggaatcacgtgcttcgataccgcgaccgcgtacacgcaaagtacgaccatctggcgttcccgcaggtagcttgagttttacaggcttgttgagcgttggcacagaaatagcgccacccaaagccagctcgctgaagctcacgggaatggtgatcaaaatgttgctgccgtcgcgtgtgaacacatcgtcctttttcacgtggactttcacaaagagatcgcccgctggtttgccatttggtcctgcttcgccttggcctgcaagacgaactttctgtccatcttccacaccagttgggatacgcacggtgatggaacgagacttccggacggtgcctcggccgtggcagttatcgcaaggatcagtgattatttcaccagtgccaccacaggttgcacatggagcggagaatccgaaagcacccttgttctcagaggtgaatccggttccatcacaggttccacattttgcggggtggcctgatttggagcccgatccgtggcaggtgttgcagggcgcatcgccggtgagttccactgggatggtcgtgcctttcgctgcctcaacaaacgagagagttatttcggtttgtacatccgccccccgcgtcggcctagctgactggtgagaaccagcgccgcggttgaaaaggccaccgaagatatcgcccaaaccgccgtccgtagaaaaccctccaccttgtcctcctccgaagaggtctgaggtgtcgaatcctcccgtcgacgtgcgaaacccgccggggaatcccgcacctccgcttccgaatcctccgcggattccaccagaagctagaagtgctttgagctcgtcgtattcttttcgtttcttgtcatcaccaagtacgtcatatgcctcggccgcttttttgaatcgatcttcagcggccttgtcacctggatttttatctgggtgattttccctggcgagcttgcggtaagcctttttgatctcatcttctgaagcggacgaggagacccccaggtctgcgtaatagttcttatttgcccattcgctgttgttcactgggcatcccctccttccatgagtcttatatgcggtgaattgtatgcaatttcttaagttatcttgtgttgcaagttttgttgtccggacaccggcggatacctttgagtatttattacttcaaggatatccgccggtgttgttcaaggagttccatctgtggaccgtggacaacggcggaaaccactaagagacttagtctctctagctctcctctggatccccaatgaggaccattgcggtgcggatgacgcggtcgccgaggcggtatcccttgcggagtaccgttcccagaaccttgacatcaccctgtgagagatcctgtactgcttcgtggatctctggatcgaatgcttcgccgatctcgccgaaggattccaccttcaatccacccaggatgttgatcagcttgtcagacagtgacttcagcggaccttcgttaaggtcaccgtgctgttcagccaggtcaagatcgtcgagcaacggcagaagttgggtaacaacacctgcgcgtgcggtgtcgatgatgccctggcgttcacgctcggtacgtcgacggtagttggcgtactcagcggtgactcgctgcagatcctcagtgcgttcggcaagctgtgtttctacagcggacacttcaccatcgccatccaaatctggatcaacatctgatagaagatcattgatctctgcttcgagctctggagaaatttcttcctctgaggcctgtccaaatggagattcctccgcttggcgggcagctgcttcttcagctgcctgctcagcacgatcagcagaggttgcctctggatcggtattttcaggatccccaggattgtcgggcattccgttaggggtagtcatttacttcttgtcctcaccattgtcagctgcgtcgtcttcgacaacttcagcgtcaacaacattgtcatctgcagcgccttctgcacctgcgtcagcctgggttgcaccagcagcagcgtcagcctcgtagatagccttacccatttcctgggactcggtgttcagcttctcaactgcagccttgattgcctcgaggtcctcgcccttgagtgcttcttcaacgcccttggctgcctcttcgacctttgccttgaggtcttcggagaccttctcggagttctcttcaacgaacttgcgggtctggtaaaccagggactcagcgttgttgcggacttcctgctcctcgcggcgcttcttgtcctcatcagcgtgagcttcagcatccttgatcatgcgatcaatttcatcctgggagagaccggagccgtcctgaatggtgatggtgttttccttgccagtacccttgtcctttgcggtgacgtggacgatgccgttggcgtcgatgtcgaaagtgacctcgatctgtgggacgccacgtggtgcaggtgcgatgccgccgagctcgaaggatccgagcagcttgttggcggttgcgatttcacgctcgccctggaagacctggatctgaacagaaggctggttgtcctctgcggtggtgaaggtctcggaacgcttggtagggatggtggtgttgcgctcgatgagcttggtcatcacgccacccttggtctcaatgccgagggacagtggggtgacgtcaagaagaagaacatccttgacctcgccgcggagaacaccggcctgaagtgctgcaccaactgcaacaacctcatctgggttaacacccttgtttggctcacgtccaccggtcagttccttgaccagttcggtaacagcaggcatacgggtggaaccaccgacgagaacaacgtggtcgatctccgagacggacacgccagcgtccttaacaacctggttgaaaggagtcttggtgcgggccaggaggtcctgggtgatgcgctggaactcggcacgggaaagggtctcatccaagaacagtgggttcttgtctgcatcaacggtgatgtaaggaaggttgatgtttgcactctgggaagaggacagctcgatctttgccttctcagctgcctcacgcagacgctgcagggccatcttgtccttggtcaggtcaatgccgttggaggactggaacttctctaccagccagtcaacgatacgctgatcccagtcgtcgccaccgagctcgttatcgccggaggttgcgcgaacctcaacaacaccgtcgccgatctctaggagggagacgtcgaaggtgccgccaccgaggtcgaataccagaatggtctgctcctgctcgcccttctcaaggccgtatgcaagtgcagccgcggttggctcgttaacaatacgcagaacgttaaggcctgcgatctgaccagcttccttggttgcctggcgctgtgagtcctcgaagtatgcaggaacggtaataacagcatcagtgacgtcctcgcccaggtatgcttcagcgtcgcgcttcagcttcatcagggtacgagccgagatttcctgtgaggtgtagttcttgtcatcgatagcaacggaccagtcggtgccgatgtggcgcttgacggagcgaatggtgcggtcaacgttggtgaccgcctggttcttagcggactggccgactagaacttcaccgttctttgcgaatgcaacgacggaaggggtggtgcgtgagccttctgcgtttgcgataactactggctcgccgccttcaagtacggaaaccacagagttggtggttccaaggtcaattcctactgcacgtcccataatggtgcctcctgttttaggtgattttagtactgtccacggcttgagctttgacttgcttcccaccgactttcgccggtaagaaaaactcctcattgagcctgcctgactcaagcttacatatatagcaacggtaaatgccacaaagttgttccaactagactcaactttcttaatttacgcaggtcaaagcgcttcacttgagaaaaaatccgggtttacccctaattttcaaccacccaatcagggaagataagagctgttttcaacaggtcccactcaactttgacaccaagtctcacgcaaaattaacagccataaactttagaaggacaccctgtgtcccacacctgtggcatagtgatttttgtgagcacagaatcaggaaacaccccaaaaagggatgatgcaaaaagcaccatccctccgaaagatttgcctgacaccgtcttagacgcgattgaaggcaattttgagccaccgctaaatacccagaagtcggcggttccccctaatgccgaagcaactgtcgaggctgattctgaaggaactaccgaccgctctgtcattttgggcagggacggccgctggctgtccggatgggcattgcgcttcatcgtgctggttatcgccggcgtcattgcacttcgtatgctgggcttcatctgggttggcatcctcccagtcgtcctcgcacttctagtctgcaccgtgctatggccaccagtgaaatggctgcgcgagcataagattcccgcggcgctcgccgttgtcatcacaattttgggtttcttcgccctcatcggcggagtttttgcagccatcgcgccaagcgtgtcttcccagacaaagcaagtggtagaccaagcaactgttggtatcgaagatctaatggattgggttcagggcccaccttttaacttagatatctcacagtttgaaggcgcgctcaatgacctaacatccatgctgcaatcacagtcttccaccattgcttctggtgtgttctctggactgtcaacggcatcatccatcgttgtcacactagcagtgatgctggtgttgaccttcttcttcctcaaagacggtcctcgtttcctgccatggatgcgcggcttcactggtgaaaacgcaggttggcacctcacagaagtcctgacccgtacctggaataccttggccggattcatccgtgctcaggcattggtgtccatggttgacgcaatattcattggtatcggattgctgcttcttggcgtcccaatggccctcgcgctcgcggtcatcacattcttcgcgggcttcatccccatcgtcggtgcggtgtctgcaggcgccctggctgtcatcatcgcgctagttaccaacggcgtgaccaatgcgcttttggtacttgtattgatcctggcggttcagcagatcgagggcaatatcttgtccccattcctgcagtccaaggctatgaacctgcacgcagcggttgttttgctatccgtcaccgtcggctccaccatgttcggcatcatcggcgcattcttggctgttccagtagccgcgacgttggctgtctgggtgcgctaccactctgaaatggttgctttgcgcgccggtgagatcaccagtgatgacattgagatcgccacgacgaaaggttccccaaccagcctcaatggccaagaaacccttgctgccattcgaagcagattcgccatccttggccgcaagaagccgacatctgccactgcagaaaaagcagactcagaaagctagccaataatgctcactcccgatgccgccaggcatcgggtttttgttatttaaactccttcacagcctccgccaactgtcgtgcgcccgcatcgaccgcatcaaaccacgaccccgaagcctcctcatccgcgctgtcactaacctgcttcagcagcgtaatcggaacaccaaaatgctttgcgacgcccaccagcgccgcgccctccatatcgcagagggaggcccgggtggccaggtggttgcgggtttctgaatctgcaataaatgagtttcctgttgccaaactcgctactgggaagtgcccactcgtggccaaagttgaaccatttgagcatggctttcctgtcatttcagcgattaactcgctactgaaatcatgctgcagaacgtattcgatctcgtatacgccagccaatccatccaccaaagctcccgccgtaccaatattgacaattcgggcaggaagcacctcccgagtagccaactccttagtcaaaatcatcgttgctgcggtcgttccgatgccagtcaccagcaagtcgattccatctggaagatacaccgcttcctcagttgtggcggatacaaaaagagtctcagtcatggtgaccaagcatagaacgaccaagaggttacaggctgagttgtttaataaaaaacaactctgaaacaacttcacccacgaattactttctcgatttcttcaacagcaacatcgaggcggatgcgttcttgttcaatgcggagctcaccgtctgtaatgagtaggtcaagtgcgtcagattcaaaatcatgaaggttgtcaaagctctctgccttgaattctcggtcggcaacgccaaggtagcgccagcgggagacggtttcagagttcatcagcacggattcggtgtgaggaacatggctgcggacgccgtcgagaattttgaaaccgtccaggtcaaggtcaccccagtacagcaaccgaccattagaaaagtagggtcctcgaacaatgtctactgcacggtagcccgcaccccaagcaattgttacgcccggccaagtgggtaaagcgagaaatgaatcgaggttttccaccatcagaattacttgcggttcttgtaattcacacaggttggaaagcggtacttcaatgtctgtgagcccagcgggagcatctacggaatggaagcggagccggacgcgagcttcggcgtcaccaagtccaagatcggcacgaccaggttcaccacgtttgtcggccactaacgtttcaatgagtacgcggtggttttcgagccatttggtatgcacgccttcaactgcgacggcgcgtttcagcaggccagagttagggtgtttcaaaaaccaatccacaactaacactgccttagagagatcatcgttagacagcgaacgccacagcgacacatgtttcgccaccacctccgctgtaaaaccagacagctgtgaaaacctctcgtgaagtgaagaccattcatcctctacctgcgcaaacacaactaattcctcagtcgtgttcaacgtcagcctaacgggtacttcagttttacctaagcccacaggagaccagtttcgaatggcatattccacatcatcacgcccctcccattggcggataaattccctcgtggcatcaatatcggcggcggctttagctgccgtcggtgggtgcaggggcaggctgaggcctgcaaattcgccgaggagcagctcgcttaagtgcgcgtggaagtattttttgctgcggtggagggcgtcgtcgataaacaatggcatgttatttctcgatcctagagaaactggaattgccctgaattgcgccctgggcgtttggtttttcggtgtagctgaccacgatggtggagccgacataatcgccgagggtttggataagtttcagcggggtcgcgagcaccatgtggaagccgaagctgtggaagacgttcatggtttggcgggtgaaggcggggtcggcgcggtcgaaggcttcgtccagaatgacggtggcgtaggtgggataatgggcgccgggttcggctagctggtagcgcaaggcagcggcgaggcagaaaaacaccagcttctgggcttgtccgcctgaaagtgatgcggagtcgacgtaggtgttgacggttgcgccgtcggaatcgcgctcgaggccgatgaagcgaacgtggcggcgggtgtctagaacggtgttgcgccagcgggcgtcggcggagtcgtgggaggcgagtttggaaatgatttcagcgatcagcgcataacgggcgaaggcttgtttctcggtactggttcccaggtcaccgctggtagcggcatcaagtttctgctggaattccctcacaatcggaccactttgatcacggatgtcgatgtgcaggaagcgaccttcgttgaattccgactgcgccaaggaggcgttgatcggctcgatgcgctcctcgatttcccggcgcgcatcacgtagacgccgcgagatttggccgaggtttcgggtggacatctcgttcatgagccctaggaatttggccgtgaattctgccaaacgatcgctgcgaagctcgccgaggcggttgatggcctcaccaacaaactcaggttcggcttgtaagtcagcgcggttcgcaggccacgtttcaatatagctgcgcaaaatgccaacaatttggttttcacaacgtcgaagttctgcctcattggcatcgatttgtttgtccagatcctcgcgcagcgcaatggtctgctcatccacgttggcggcgtgaacccggcgggtgttggcaagaaatagtttctccacttcccgcgcgatttcttcagaaacctccgcaaccggcaggctttcgagccgtttcaattcagtttcggcgcgtttcaggttcatcgacgccacggtttcctcactctgagctgcgacaagcaagtcagaaaccctcgcgagcgtctgcttcgccgcctcatgccgcgcggaaagctcggtggcctctggagtgttgttcagctcttccagcaatcggtccagctcagcaatcgccgcgtcggctgattccacatcaatctgagcccacgacactttcaaaatttcttgcgaagcttgatactgccgttcaagttcccgcagctcagcgcggtttgcagcaatgcgattatcagctgcctgcacaactgctttgccagctttcacggtttcccgaagcgtttccaccttggcatcattggtggaacccaaacggtatgtggaacgatcccccagctttcggcgatcatctttttcccaacgcgtcgtcggatcgcctgtctgctgcgcaaattttcgcacacccaaaatggtcacgccctgatcgcgtggccccagcgccgacaattcctcaggagtgcgcacgcaccgaatattaaaacgcttgcctaattcttgatttacccaatcgcgaaacggcgactccacaacatcaacttttcggatcagggaatccgccggaaaacgcgaggttttgtactcccccgttgtcaccacgccgttgaatttcagcagcgctgccaaatgtttggcatttacccaatcccgaacccgtggcaacaacccatgaggaaccaacatttccgcagcaaaaccacccaaaatgcgctgcacaacgggttcccattccgcattattcggatcaatcagctcaccggcaaagggcatatcccgcgggctcacgcccaaatcctgacacaaattttcccgcacctgcagcaaacggtactcaatattactgctgcctttactcaaagaagacagctcttgatccgccgctttgaactcatcaaccgcacgggttcggtcctctacattcctctgacctgcagattcaagcgcttccctcgccgccggatactcatccacggtcagccgcgcagcgttgttgagctccaaaagctcctccgccgattccggcgccgcaccgcccagccccttaaccaatgcgtccagaccagcgcgcgcagtgctaattgttcttcgcttatcgacggccccctccctcttcgcactcaaaattccatgctgcgctcccacaatttgtttgacgttgtcgtgcgcgagggtttccatttcgcgggcacgatctgtctcaattttggcggactccaccttcgacttcgcctgcgtttgctcgacagtaaattgtcgaaccagcgtttcttgctcttccttcttaatgcgattcccgacagtcggcagcgccttcttcagtgcattggcatgatctttggactgttgcgctttctctcgccgattcttcagctgcaccaaaggatccagggtgtggatctgccgtttaatatcttcgacctgctcataagcaccttcaaggtcttggaattgttccacggcagttttggcaatgctgaacgtatccggttccaccagcatgtaatcccgaaatagatcatccaagctttgaagatctttcgccgactgcgcgcggtgcaacaacagcaaagcttcctcactggagatccccaaacggcttctaaacctgccggagaatacagaatgctgctcgctaaagatggcttccttgaaagcagctctgatctggcgtttatcgatgccctctttcaggaaatccagcagcgcattgatgtcttgatcaacgggaaacacaccataatatgaagaaatatcggaggttaaattgtgtcccgatttcagatagaaaatagccaccaaggtgtgctcgacgccttcaccgttggaataagtcaatccaaccagcgaataggttgcgcggggacgtaggtacgtggagacaatctgatcctgcagcggatcctcctgcgcacgccaagcgccacggatataggtaaccaaactgcgtcccttattccgcggagtattagcctgtgcggcagagttaaacctcagctttccttgcggaagcaataccgccgtgatcgcatcaatcagcgtggattttcctgatcccgaaccaccggtaactaagattccttccctggtcacaggaatgtccaccgttccgtggaaggttccccagttgatcaactgaatccgagaaagacggaactgacctgggtggataggatctaaagcttgttcgctggtcacttctgttcctcttcatttccatcatgggctgctttgttaaatttttcgtactcagcgcgcacacctgccacagtgtcggcatcaaaaatctggcgcagtgctggtgagacctcaaaacgttcaggtgtctctgtctttttagctaatgaataatccacgatgcgcctaaatgcagcgtcgaatcgcttagctagtttggcttcatctcgctcttcatcaacgcggtagagcaacacttgttcgcggatttcttcacgatccacaatgactcgttcccccggtggcgccatggtgagttcttggcgcagaatcaaaatgatcaacgtatcaaaatgcgacagcgtctccgtgcgcagcactttgggcatcgcttcagttttgttatttccaaccaatacttcttgtctaccattggcaggccgagtaaatgcaacacccgcatcctcatcaagaaccaactcgaggaacaaattgttaagcacagcattgagcgcatcttgatctgtggtgatagcccgccacacttcaacatgctgcaaagcattcaccatgggacctttgagtaattgcaccagagctttcctggacccaaaagtcagcgttccagtgtcgccttcccacagctgatcattcatttatccatctcgctttctgccaaatcttcactgtttaaacccctgatgaactgccatcctgtaatccgccggcggtgtgtggcatcatcactttcccactccactatttgcgcgcgacctgtgggaacaccatcacgcatcgccaggtataacaatccaacaatgctggcgagaccttgcgttgccgggaaatgttctagtacctcggtgatcgtggcgtgcgattgctcggcaagaactaaagaaacagcctcttccaattcctcaaaatcaatctcgcttgcccgaatttgttccatcaagacttcagtgtctagttcttgttcttcaactggctcaggcaaatcttcgacgcgttcttcacctgggttcttcagtttcaaccccgcaatcgagcgaacatccataccaatgcgcacgagtggtgtgtccatgtgattgagtgaggtcacttcaccagcctcggcggccttagcagcggcactgcgggtatcgcgaagcaactgaatcatgcgtcggctctctgcgaactcctcggtagtgacatagtgacgcaaacttcgagccagccctgtcatttccccgttgacctcgaagctggcatcctccatatcccggaaaattcggtacagccctgtccttaattttgaatccagatcaatagcctcatcgcgtcccagaacttctctgatccatcgatcaatcagacttgagcgttcccgatcgagcaaaacatcaaagaaactattgaagctgcgccccgcatcggaatccccaatcagatcaactcccctgaagatctcttccaaaacatcaccacgggaatcttcaggatcaagcaactgcctgcgcagcttccggttcagatcgctcagctcatgccttaccctggcgaaatctgcaggaatagatgctgctagatccaaaatatctgctacccgatcaccaatctgcacggtggtgaggacttcaaattcaccagcgtggaccgcttcaatctggcgttcaatcctgtcgcgttcacgctctaactcagctaaacgtttcgctgtgctggggtccgattccaacgccaaagtctgcaacgcctgcgtcaacgattcaattcgagacgccgaaatgcttcgatgcgggttatcccaccgctgcaccgaatccagcaccgccaacagctcttcactcggttccacggtctcaccagtctgcgaactacccggacgacgcacaaaccaccgggacttcacccaatcactcacataatccgacgggcttttcggcagctcaaatccttcttcacgcagcacccgaaaatcatcgctgagcagctgatacagctctgaggccggcttagcgatagccccctgcggaaaatactgcgctaccacggcgagcaccaccggaaagttgtcactgcgcaacaaagacagctccagggattcctgcctaaatcgcttaaacccaagcgcgtgcgatacaacggtcatgccaattgactattccagaaggggtggacacgtgtcgtacattcctgttcgaatccggtcacactcccccatcaccgcaccaacttcaaacaaaggtcatgccttaagcagcaaaaagccacgcccctcctttaactggctatgaaccagctatatataaggagaagcgtgacttttcaatgatgagaatgatgagaatgatgagaacgaccagaacgatgagaatgtcgagaactacaaaagcgacgaaagctcagccaaagttcgtcacattttcagccaaaccgctctgcagcaaccgcctcaaagtagcttcagagcagtttcaacacaatccgttagaaacgaatcgccacacgaccatcgatcttgccgtttcgcatgcggtcaagcacaccattgacctcatcgagggagcactcactcacggttggcttgattagtccgcgtgcaaagaaatcgagcgcttcggccaagtcttggcgggttcccacgagggatccacggatggtcaggcccttgaatacgatgttgaacacggatgctgggaactctcccggtggcagaccgttgaacacaattgttcctgcacgtcgagccatatccagtgcctggccgaatgctgcctcgtgaactgcagtcacaagcacgccgtgtgcgccaccgttggtgtacttctgtacagcttcgcctgaatcttcattacgcgcattcacggtaaattccgcaccgtgcttacgggcaagttccagcttgtcatcggcaatatctaccgcaatgacacgcatgcccatcgccgctgcgtattggactgcgatgtggccaagtccgccgacaccggagatcaccatgaattggcccgggcgggtttcagagactttgagtgccttgtagacagtcacgcctgcacacagaattggtgctgcttcgaggtagtccacgccgtctgggatgcgagcggcgtaacgggtatccaccagcatgtactggccgaaggatccattttgggtgtagccaccatactcagcttcgttgcactgagtttccctgccggtgatgcagtattcgcaggtgccacacgctgaccagagccacgcattgccgacaatatcgccgaccttcacatcgtgttcacctggtccgagctcaacaacttcacctacaccttcgtgtcctggtacgaatggtggttccggctttactggccaatcgccctccaaggcgtggaggtcggtgtggcagatgccggaggtgagtaccttcaccaatgcctggtgtggccctggctttggaaggtcaatatccttcacggtcacgtcatgaccgaatttttcaacaacagcagcggtaaattcttggggtgcagcagtggtcataaaactcactccttctcgcttggattacttggcaaattgctcttctggcacatgtaatttcacaccgacatagatgtgccttaaattacaatccttgcaattgtgtgatttacaacattcaattgctgccatcgtccaccctagcgaaatcccaataaggtgaaaatagaaagttgagttattacccccgaacatttcaacaaccgtgaatgaactggcaattgtaaaaaaacaaaccacccccgcacgttgaaatttcgaaaaatagattcacaaaactccagcaaatcaccccctaatggaaatgtttttcaattaacttttcaagattcacacaattccctttaaaagcatcaaagatgcttttcgatgcccccagccacccattccccaccaccccagcgggcaattaaggcacgcgcgccgtacctactagatagactcgacaaacatgcagtacacaacaacattccaaggatcgttttagtgtcgattttcaaatggaatgaatatatgctgccggtgcttaaggcactgccccaagatcagattatggtccgtcgggatttgattgagctcgtcgcctagtcaataggaatcaccgaagaggatcgaaaggaattcatcagctcaggtcagctcacttatgtcagccaaattaactgggcaatcacttatcttcacagagcactatgcttaaaccgtccgcaacgtgctcactacgcgatcaataatctgggcaaaaaactccaagctcagcacccggatgaaatttcgcaaagtgaccttgccaagttcgcccaagatcatggaataaagtatccaagcggtgttgctcaaagaaagctgaataatgaagaacggtccgtcgacaagcaagaagccgagctgacgccgaccgagcaaatggaaaccggccttgtgcggctgtgctctaggatttcagccgatttgttggagcgattgcacaacaacgctccggtgttatttgagctggggttgcccgcaagtggtggacacataattaagctacttgttagtttcctacaggtgaaacagggcgatcatgatcctgctcaaactgaacaggagagataaacccgagcgaggaatgcctacgctggcggttataaaactccttctttaccgttgaccaaaagacttaagctatcgaattatcaaaacacaccccagtccggcccatcgactgagcgatccccaattcctgacacgcccgatacaactgatccgatgtgaactgcgaaaaaccacaccatcaggcacaccacaccgcaacgtatgcgccatccgcaacgcacgcccaacaagccgtgtcgtttgagtatcatccatgcccatcccaacacacgccgtgaacaaccatcacgcaccacacatggactcagccagccccactttcccctttcccatgaaagatccacgcggaaaactaaaacccgccccgcttgcgaagcacttcgataggtttatgattgtttgaatgagaggtttctgagtttcagcaaggctttcgcagactattccaaggaattaccattcaggaaattctgctcactctcagcgagtgtgaaaaagccacatccgctttccttctgaatgaaacaatagagtgaccttaatatctttctcgaatagaatatttgttctataattaggtttcacctacctgaagcgggaaaacgcccacccgcggtggtgcgggtgggcgtcgaaaagcgtgttttaagtgcttttaatcttttggccctttggttcggagacaacttcgctggagatggtctcgttgaggagatttttgcggtagcggcggaagccgaggtacgtcagcggcaggccgatgaggaggacggtgacctggatgaggccggtggggatgaaatcaaggccaaccacgttgagcacctttggcaggttcagtgtgacaatcagggtgcccacgaagccaccgaggacggttgcattaacgcgagagatcatccaggcgccgattggtgctgcgattgcgccgccgatgagcaacgcgagaactgcagagaggttagctactaggtcatcccacagtcccacgacgaagcccaatgttgcggctagggagactaagaattctgcggtgttgacggtgccgactactttgcggggttcggtgcgtcccaaagacagcagcgtagaggtggtcactggaccccatccgccgccaccggatgcgtcaacgaaaccaccgacaataccgagtccgccgaggaatcccctgctgtgcgggcgatcggaatagtcgcggcggatgcgtcccttgctgaatcgccagactaggttcatgccgatcagggcaagaatcagggaggtgatcggtgctgctgcttcggtggaaatattggacaagaaggtagcgccagcaaatgcgccgatagcgccggggataccgagccggacaactactttccaatccacgttgccaaatttccagtggcttaaaccagaaactaaggtggttccaacctctgcggtgtgcacgacggcggatgcctgcgcagggcctaaacctgcgagcatgatgaggatggtggttgaggtgacgccgaaccccatgccgaggccgccatcaacaagctgtgctgcgacgcctgcaatggcgataaagattaatgtctgcatagctgatttccttagcggtcttagatatgtgccagcagtgcgctcaatgcagcgtggtaacgggctgcaacaagtggtgcgaggtcagtagttaggggttcggaataggtgaagtttgtgccggtggcagctgcgatgttggcggattgatcaatagcccgatccagcagcaaaccttccgtaacaaacagcggcaggatgtggacggccttgtgtttcgaggccacctctattactccggcgccgccggcacctggcccaccggtagcgggcaccacctcaaccgaaaagccagtgaggagagcaatggtgtgggcaagatcgatgactgattcattggcggacacgtgtgagctgccaacggaatacaaaatcacatgggcatctgtgggggcgtccgcactcaaccgctgcgcaagcacgctggctacatcggagccagtgcccaaatgcggacccacgagaagttccacaccatacttttctgaagcatcttttactgcctcaggaacgtcaatctttgcgtgatacgcattgctaaacagcaaaggaaccaacgctgccctggttacaccttccgcactgagcgttgccacaacctgatcaagggaaggttcagcaagctctaaatgcgcttccacggctggtgtttccagcattcgtccggcctcatgagtcagcgcagtaatgcctgcagctgcggactttttgcgggaaccgtgggaaagcgtaatcaggggaatcatgaggtgtcctaaatggggtcttgcctaagacactggtctagatcgaccagttattgcgtaggcggtggccaaccaagccagctgcgagggtatcgccggaggattggtcgatgaggaggaaggatccgatggcgccgcgggcagcgtaatcttcaacttcgagttcgcctgcaacgtcgatgcgcacgtgtgcgatgtcgttgaggccgtaggtttctggtgcttcgttgtcgttgacgccgtcgatgtcgaggactcgttcgatggctgcgacgcgtccgcggaccagctcggtgccgtagcgaaccttgactgctgcacctggtttgatggtgcgatcggccaagccaacaacagtggcgttgaaggagcgaacggattctgggcggtcttcgccagcgatgagttcgccgcggatgaggtcgatttcctgggctaggcgcaggacaacggcttctccaactgatgcggtctggagggatccgtcagcggaatcgatgtgggtgacctgggtggtgcggccttcaggtaggtacacggtatcgcccacggagacggaaccagcgttgatggtgccggcgtagccacggtagtcggtggcgtgctcgcggatgacgtactggattgggaagcggaagcccaggtcgtgtgcacggccgtgggaaacttctacgttttccaggatttccagcacggttggtccggtgtaccaatccatgtgggtggaaggttctgcaacgttgtcgcccttgagcgcagagattggaacaacgtgggtgtctgtgacatcaagtgcagatgccaggccaacgaattccttttcaatgttgcggaagacttcttcgctgtaatcaacaaggtcaattttgttgactgcgaggatcaccgtgcgtacgcccagcagagccgatacggacaggtggcggcgggtctgctcgacgacgccgtggcgggcgtcgacaagcaaaactacaacctgggaggtggagacgccggtgacggtgttgcgggtgtactgcacgtgacctggggtatcagccaggatgaaggtgcgcttgtcggtggcgaagtagcggtaggcaacgtcgatggtgatgccctgctcacgctcggcgcgcaggccgtcgacgaggagtgacaggtcgaggccttcgaagccacggtcggcggaggtgcgctctacggaagccagctgatcagcaagaacagacttggtgtcgtgcaggaggcggccgacgaaggtggacttgccatcatctacggaacctgcggtgcacagacgaagggtctcgcgtgatgcaatcttttcggatgctttattcaaggttggagcagtcatcagaagtagccttccttcttgcggtcttccattgcggattcgctgaggcggtcatcggcgcgggttgcgccacgttcggtaagggtggaggtggcgatctcttcgatcacatcgtcaatggtgcgggcttcggagagcacagcaccggtgcaggacatatcgccgacggtgcggtagcggacagtcttggtgacgatctcctcgcccttctttggtccaccccactcgcctgcggtcagccacatgccgtcgcgctcgaaaacttcgcggtcgtgggagaagtagatcggtggaagttcgatgccacgggcgccgatgtactcccaaatgtcagcttcagtccagttggagattgggaaaacacggatgttttcgcctggcaggtggccaccgttgtagagggtccacagctctgggcgctgacggcgtggatcccaaccaccgaaggagtcacgcacagagaacacacgctccttggcgcgggcacgctcctcatcgcggcgagcgccaccaagcactgcgtcgtagccctgctcagcgatggtctccaccaaagggacagtctgcagtgggttgcgggtgccgtctgggcgttcctgcaggtcaccgcgatcgatccagtcctggactttagctacgcgcaggcgggcgccggtgcgctccaccaggttgtcgcggaattccaaaacctctgggaagttgtggccggtgtccacgtgcagcaattcaaaaggcacgttagctggagcgaaagcgcggcgcgcaagctcgtacaccacgacggaatccttaccgccggaaaacagcaggccgaccttatcaaactggccagctacctcgcggaggatgtggatggattcattttcaagatctttaaggtgtggggatagtactgatgcaacggttgtggtcatgagtgaagtccgcattctgtcttggcgtttccagcccaacggccggccctagggtcttgtccttcagcaacaggaagggtgcaggtttcgcatccaattgatggataaccctgatgggtaagtgggtgatcgatgaggttgttgtccgcaatgaactcgttggtttcctccaatgaccaggtgataattggagaaatcttgagcctgccggtggcatccaagctcagcgcaggggcttgagcacgggttgggccatcagcgcggcgcaggccggtgatccagccagcgtatgggcttaacgacgccgccagcggttcaactttgcgcattcggcagcacgccgctgggttgctgcggtacaggttgagaccataaatggaatcctgctccgtgcgcttgaggatcggcagcgcggtgacaagcttctgggaatagcgctcatctacctgacgggcaacttcaagggtctccttgaagtggtaaccggtgtccaaaaagaggaaatcagcttccggcaggtgccgcgcagccagctccgccagcacggtgttttccatgctcaaggtcactgcaatagcgcccggcgcgtgctcggctgtccattccaggatctcttgcgcgctggcgtcatacaacgcagcagcatgcttttcgacgagttcctcgttatgttttgctacctctggtgacaacggtgtggtcgtgcgaggtccttcgggtgagatctcgggatcttttaccgaaccagtatttttcagggcgttaactagttgaaagctcattgttgcgactcacctcttttgtgtctttcgagagattcttttaatgcttgcgatgtggactttgctggtgctggcctgtgcactggatcgtcctggccgtgatatttcacttcaaaaactctggtgcaatccgcacacaaccacgcgaattctgtttgctcatcggggaaaagaacttctcccgcgcagtatgggcagtacagagggtggttgcggttgggattgggtttcctccgaagactcacaccaaatcttcctcagcggcccgctggacccaatcgcggaagtgctcgtcctcgtggcgctgttccttgaagtgggtaacaacgcgagtgacgtactctcccacttcatcggcaataaccttgtggcccttgagcttgcgtccgaagtttggatccaagttcatggaaccgcccaggtgaacctggaaaccttcaacgcggttgccgtcagcatcagtgacggtctgtcccttgaatccgatgtcggaaacctgggtgcgtgcacaagagttagggcaaccgttcagtgcaatcttgatgggaacatccaaatcgccgaggcgctcttccagttcgtcgacaagctcaattgctcgtgacttggtggttgcgtgcgcaagcttgcagaactccaagccggtgcaggaaatgatgccgcggcggaactcggaaggtgaagagtacagtccgatttcatccaggtcgcgtgcaacggtagtaaggttctttctctcaatatcgaggaagagcagttccttttccgccgtggtacgaatcctggtgatgccgtgcttttctgcaacatcagcaatggcaatgagctgctcaccggtggtgtgtccaacggttggcttcacaccgaggtagaacttgccgtccttttgtgggtgaatgccaatgtggtcacggtagccagggttggtggtaacaactgggccatcgatcagcttgcgctcgaggtattcggtctcaagaacttcacggaacttctcaataccccactgtgccaccaagaacttgaggcgagcacggttacgcaggcgtcggaagccgtagtcgcggaaaattccggcgacgccagcccacacttctggaacctcatcaagtggaatccaagaaccaagtggctgagcaagcattgggttggtggacaggccaccgcccacaaagcactcaaatcctgggccgaattctgggtgaatcgaaggaacgaaggaaacgtcctggatttcgtgggtaacatcctggcgctggttgccagtgatagcagtcttaaacttacgaggaaggttgtggaactcttccttgtctaggtagcgctcacgaatcgcatcgatagccggggtggcatcgatcagctcttcagcagctacgccagaaactggggagcccaagataacacgtggaacgtcaccgcaaccaagcatggtggacagtccgacggtttctagcttctcccagatcgcaggcacatcttcaatacgaatccagtgcagctgaatgttctggcggtcggtgaagtccgcggtggaacgagcataatccctagaaatttcacccacggcacgcaggcgctcaggggaagccagtccgccatcaaaacgcacacgcatcatgaagtactcatcctgcagctcatcatcaggaagctgaccggtcagttcaccgcccagatcctgcttacgctgggtgtaaatgcccaaccacttaaagcgtggggcaatgtcatccggtgcaatggaagaaaaaccctgcttggagtaaatatcaatgacccgctgcttgacagcaaaagcgggttcttcttgcttaatttcctcggcatggttaagcggctcggtgccgtcgattttccattggccttcgggcttaggcttcctggcggcacgtgctggccgggcacttccggtggttgttgtcatggggagttaatccttaaagagctagtgaagtacatgtcactcggtttgatctatccgcaaacttagacgtaccgctctgtctagaccaaccattagattcatgagactgaaagcaatggagtcacctaatgcccgtttaaatgaattaacctggggatattaggttaggttcaccgtgaatataatagaccgatctgtctagttttttcatggagtttgaatttaattaagcaaaagtcttcgcattgtcgcatttcgctgctacgtttacagaccaagcggtctaggagtgttaaacagcctggacttgaaacacctttaactacttgattttcacacccttgtttccataaaagggctcacgaaaggcaacttcaaacacatgacaactcccctgcgcgtagccgtcatcggagctggccctgctggcatttacgcatccgacctcctcatccgcaatgaagagcgcgaagtgttcgttgaccttttcgagcaaatgcctgcaccgttcggactcatccgttacggcgttgctccagaccacccacgcatcaagggcatcgttaagtccctgcacaacgtgttggacaagccacgcctgcgcctgctcggtaacattgaaatcggcaaagacatcaccgtcgaagaactccgcgactactacgatgcagtcgtgttctccaccggcgcagttgcagaccgcgacctcaacatccccggaattgaagcagaaggctccttcggtgccggcgagttcgttggcttctacgacggcaacccacgcttcgagcgctcctgggatctgtctgcacagtccgtcgctgttatcggcgttggtaacgtcggcctcgacgtagcccgcatcctggctaagacaggcgacgagctcaaagtcaccgaaatttccgacaacgtctacgactccctcaaagaaaacaaggccactgaagtgcacgttttcggacgtcgtggcccagcacaggtcaagttcaccccacaggaactcaaagaactcgaccactcccccaccatcaacgtggttgttgatccagaagacatcgactacgacggcgcctctgaagaagcccgccgcgcatccaagtcccaggacctggtctgccagatcctggaacagtacgcaatccgcgagccaaaggacgctccgcacaccctgcagatccacctctttgaaaacccagttgaggttcttcaaaaggacggcaaggttgttggcctgcgcaccgaacgcacctcacttgatggcaacggcggcgtaaacggaaccggcgaattcaaggactggccagtccaggctgtctaccgcgcagtcggctacaagtccgaccccatcgacggcgtcccattcgatgagaacaagcacgtcatccctaatgacggcggacatgtcctcaccgctccaggcgcagaaccagtaccaggcctctatgcaaccggctggatcaagcgtggaccaatcggtctaatcggcaacaccaagtccgacgccaaggaaaccaccgacatcctcatcaaggatgccgtcgccggtgtacttgaagctccaaagcaccagggcgaagaagccatcatcgagcttctcgattcccgcaacatcccattcaccacctgggaaggctggtacaaactcgacgcagcagagcgcgcactcggtgaagccgaaggccgcgagcgcaagaagattgttgattgggaagaaatggtccgccaggcccgcgaagctccagcaattgtctaaattgttttaacgcgtgaagcagtccccgcccgatttattcgaggcggggactttcgctttccgggataaaaattgcaacgcactacactgagcagtatgaatgatgagaatattcaaagctccaactatcagccattcccgagttttgacgattggaaacagatcgaggtgtcgctcttagatgtcatcgaatcctcacgccatttttctgatttgaaagatagcactgatcgttctgcgttagatgctgcgctagagagagcaaaaagagctgccgcagttgataccaatgccatagaaggaatcttccaaactgatcgcggttttacccatacagttgcaacgcaggtaggggcttgggagcaacaaatggcgatgaaaggcaaacatgttaagcctgcgtttgacgatactctagaaggctttgagtatgttctcgatgcagtaactggtagaactccaatctctcagcaatggattagaaatttgcacgccgtcattctgcggagccaagaaagccacgaggtttttacagccgttggagtccaaaatcaggcgcttcagaaaggcgagtataaaactcagccaaatagtccacagcgctcagatggatctgtacatgcatacgccccagttgaagatactcctgctgaaatggctagatttatttcagaacttgaatctaaggaattcttagcagccgagaaggttattcaagctgcctatgcccactatgctttcgtatgtattcatccttttgcagatgggaatggacgagttgcacgagccttggctagtgtttttctatacaaagatcctggtgtccctctcgtaatctaccaagatcaacgcagagattacatccatgctctagaagcagcggacaagaataacccgctcctgctgattagattctttgctgaacgagtgaccgatactattaactctattatcgttgatctcactaccccgatcgcgggtaaatctggttcggctaagctttcggatgcgctacgccccactcgcgtattaccagaattacatgatgctgcacataggctccaagaaagtttatttacagaaatccgatctcgattggatgaagaaggaaaaaggaatgggttggagtttctacttcaacggatttttatcggttccccattcaatctgccagagggctataacgctttccctgatagctattgtctgaccttagctttcaatagcaactctccaaaacaaatcttccacccgctatccatagtaatagcagctcgagatgggaaaagagcgagcagcgacctcgtggcagctacttctattggatacaactttcacgcttacggacgtgaagtcgagcctgttgttactgaaagctttcgagaacgtgtgaaaatttacgccgacgggattgtagatcacttcttaaccgaactggctaaaaagtttcaacagaattaattagcctatctcggctttcgccttccgatcctcagtctaggtttagcgacttttaaagtccccgctcgttttattcgaggcggggactttcgctttccaccttgcgcggccgattcaccatataaaccagcactgccactaccaatccggcgatcataaaaccaagcgcaaccagcgcattggcatacatgatgctgatgtacattccggtgagaactccaagcaagaagataatgaacgccttaacaacggcccttcgttgaagatcttctttcatggcaaccaccttttcctcaatgctcaaaatcaagctttaagtccagagttgcagttgcctcacccgaattcaataagtttccaaaagttttagccaccgatgttgaacatccagtgagttccaaagcgatcctccagcgcaccataaaccgcaccccaaggaacagcttccaaaggcatggtcacggtgccgccctcagacaacttctcccagtagccacgaatttcctcttccagctcagcgccaccagtcagcgacaacggagtgtcctcgcccttcattcgttgcatcacgcgcggaatatcactggcaaaaagcaacttctgaccatcaacgaccagctcagcgtgcatgattttctcgccgtcaccaccaacttcctcctcagaatgcatggcggaaaacggcatcatctgaagctcgccaccaaaaactgtttggtagaactccattgcttctttggcatttccattgaactgacggtacggggtgagatcggctttcatcggattcctgccttccaagcgagagcattttctgtgacccacattacgctagaaagcatgcgtcaatctgcttccagacatgtcaccctcctcagcaccgccacccgaccaaaaaatttacgagatagcgcgcgatcttcctaggctgcccgcttgggcttcaggtttagcaagcgggacgctttcgcttatcgacgccaactccctccatttggaatcccccatgggcctagttcacaccgaattcaccccaataaacacctacggaatcctcgaccacgtagtcaccctccccgacggaactaaagtgctcaaccctttccgagtcatcccccacgacaccggctccgaactcattttcaccgtccgccccaacgaaaacttcgaagaagattgccaagcagtcgcagcagacctcgaaaggctggtcgcactggccgaaaaatgaccccacagaatggtctctaagcgacttcgaggccttaaacaagaaacaggcaaaccgtagccacagctacggtttgcctgtttctatacggggactttaagcgtcgatggtttcgagctgagaagtcaggtgcttgcgacgaccgcggattgcagtgatgacactgaccgcgatgaagatggcgagcactgcgtagagggaccaggtgatggggctggagacgaggatggagaaatcgccaaccgaggacagtagtgcgtcgcggagggaggtttcagccaaaggtccaagaaccataccgatcatcagcggtgccagcgggtaaccgtagcgacgcatgatcaaagccacgacaccgatgccgagcagcatgagcaggtcgaacactgcgccggaggtggcgtaaatgcccaggccacagaacaatgcgatgccggagtagaggtagtggtttggaatgagcaggagctttgcccacagctgtgcgaacggcaggttgatgaacagcaggacgatcatcgcgatgaagaagctggcaagaagtgcccagacaagttcagggttgcgatcgaagagtagtggtccgggctggattccgtactggcggaacgctgccaacatgatggccgcagttgcagagactgggagacccagggcaagaagagcgcccatcgccatgcctgtggtggcgttacctgcagcttcaggagcagcgagtcctcggattgcacctttatcgccgaactgcggatctttgcgtcgtttatccaatgcgcgctcggtggagtaagccaagaaggttggaacttcagatccaccaacagggatcacaccgaaaggcagaccaatgatggttccgcgtgcccaggctggagcggcttctttgaattccgttccggtaagccacggacggcctgcagagcgcgtctccagatttgctttgtcacggcgtgcgcgggctgcaatgtaaaacacttctcccagtgccaaaatcgcgacggtaacagtaacgagggaaattccgtcgaaaagctgcggtgccccgagcgtgaagcgctcgatgccggtgaccgaatcgatgccgatggtcgcaatgccgaggccgaaaatgagggacgcaagtcccttaaacacggagtcggacaccacggaggaggtggcgacgaacgcgaagagtgccagtgcgaagtactcggcggggccgaatgcggtggacagttccgccagggttggtgcgaggaagaccacgatgaaggaggagacgataccgccgatgaaggcaccgatcgctgcggtagccagagcctgtggcgcacggccgttaagagccatgcggtggccctcgaatgttgaggcgattgccgatgcctgacctggggtgttcatcaaaattgccatcgtggagtcaccgaagagaccaccgaaatatacgccagagaacataatgaacgcggcagttggatcaagcgcgaaggtcattggcagcagcagcgccacagccatggaggatccaagaccaggcatgacgccaaccgcggtgccgagcaaacagccgacaatcacccagaggaggttcatcggcgttagcgcgccggcgaaaccttccatcaagagggacaaaatatccattaaaagccaccacccaaaagtccggaaggaagattaagtcccaagcccacatcgaatgcgaggtagaccacggagctcatcatgagggaaacaagaacatcgaaacctgggcgtttggaaccgaaagccctggtcattgtccagaacaacaaggagccagcaaggacccagccaagatatggaagcaagactgcaaaggcgaagaagccaccgatcgcccacgcgagtgagacgtaatcagagtggaatttccagcttcggccagattcattttctggatgcatggggtacttgatggtttgaatggtcaatgccactgccaccaacaaacccgcgatgccgaggattgttgggaagaatcgaggtcctgggaatgctgcattgcccacatccatgtttaaaacaccgatgagcaaatacaaactaaatgccgtaagaattgcgggcatgatgagcccggagcggccttcccagaaagtgccctcgccaactggacgaggtccgggcagctggtgtgattccgggatgtcgatatgggactcgccggattgttcagtgacgttcactagcccatctccttgaatagctgatcaattcggtcaatttcatcttcaacaaactggtcgagttcttcgccttcaagtgaggcgttcatccagtagtttcgttccaccgcggactgccattcagcagtctccacagactccgcaacgattgctcgaagttccgcaatttgatcatcgctcaaaccaggaggagcgaacatggcacgccagttggtcaaggtcacgtcatagccttgttccactagcgttggaatgtcagaacctggaaggcgttcttctgcagcaattcccaaaaccttcaatcgaccggcttctacctgcggatacatatcagcaaaaccaccagttgatgcctttgcggttccgttcagtagcgcctgaatcgcttcgccaccaccatcagaaggaataaaggtggtttgcttaggatctatacctgcagacagtgcaatttctgtcataacaagctggtcaaaggaaccaccaccggtccaggacactcctgctggatctgccttccaaccttcaatgagctcttcaagggtgttgtatggagaatccgctggcacggtgatgatgtcgaactcttccaccacacgagcaattggggtgacatcctggattttcgcaggggtatcgaattgaatttgtgctgcgatatgccccgttccacccaccatcaaggtgttcggtgcagtcatggtagacagtttgccaagtgcaatggttccaccagctccagggatgttgaccacctgaatattgttcacgatcttattcacgcgcatagactgctgctgctcacgttggaaagtatcccaacctccacctgcagctgcaggagcaatcagcgtcatgttggaacgaatatcctcgccaccggatgcagactggatggagaaaaacgcagcgattgcagtgatgaccaccgctgcggtacctacaacaaattgtttagttttggattgtgcagaccctgcgggttctgctcctacttcggccattttgggggaatccctctcggtcggacttttggacaacaagctcttgaatgtttgatgcctaagtgcttgggtgattcacgtcaccgcttcactgtggtgtggactacattaaatggcttgccgtgatccctaaaagtccttgatggaattctttgagattcacccccaatcagagtgttaaaactcattgacctcgatatatgcttatttggatcattttaaatcatttagcgcacagtgatttgtagatcattcttcaaggttttgtgatccattcgagaactacttgtgagctaggactcccccttgttgtccatcatgacgtccatcatgtactcagcaatttcttccggatcctcaaagaagtcacgtagcgctcgaaacgccgttgtcacctcaaaatcaaaccctcgatgcagttcccccgatgcactaaactcccaaatttctgcacccggaatagccatcaacaccggcgaatgcgtcacgatgataatttgcgcaccactttccgccagaaaattaagctccgccagaatcgccatctgtcgaatgaacgatagccccgcttcaggctcatccatcagatacagccccttgcccacaaaagcattctgcacaatatgcatcaccgactccccgtgcgacatgtgatgaaggttcacccagccgggagcctcatcgcgatatccagacgcgacgttgaaatgagtttccgcccgcaggaaatacccccgcatcggctcttttcccttgtgtgcttttgccacagtttgcaaagggttgtcggaaggtttgaactttccggtgtgttcaccacctgctgtgtcgaagcccgcattgatcgcgatagcctccagcaatgtcgacttacccacaccgttttccccggttatgacggtgatcggcgcacgaaagtccagcatgcgcttttctctcaacacccgaaaagcaggaaccttctctgtccaagcagcagccacacccacatgttcaagcgctgcaatatcggtgatatacggcatcattggtgatcctcctccgcagtcagaaacgccgccgtacctcgcggatctgccacaaattcccgagccgcacgaacagcctccgcatcctcaaaattcacctttgcaacacccgaagatgtaatttcaaggatctctgcccccggaatagccaacaatattggagagtgcgtagccatgatgatctgcgcaccacctcgagcaaggttgcccaactttcccaacaactccaactgcctcagcatggaaaggcctgcctcaggctcgtccaaaacaaaaaatccttgattgttaaaacgccgatcaatcaccgcaaataccgattcgccatggctcatcttgtgaagatcatgcatgttcttttcccccattaactcctcataataggaagccacgttatacatcgtctcaccccgaaaaaagaacgcatcccgagggttttctctccgcaccaacttcaacgactgatgaagcgacgacacaatatcgccttccctgccaaagtttgcatgcctagagccaccagacggattaaggcgcatccccaccgccaaagcctcaaccaacgtggatttacccaccccattttcaccagtaatcacagtaatcggtgcacgaaactccaacggctgttcatgcagatattccacgatcgccaggctcgataaataccccggcaatgactccggatgatcaagcagcgaaacctttgtcaagaacatagctccccaccctagacaaaagcccaaataaatctgctcaataacctaacctaaagtccatgcacgcctcgtcgccccaacctcaccctcagcgcacccgtgttctcagcggcctgattttcgcccaaatcatggttggtgcatccaatggcgtgacgctatcgatgggaagtttgctggcagcacacttggcgggagcttcgtggggaggatcagccgccacattgaccacgatcggcgcagctatcttttcgattccccttgcccgcatggtctccacatacgatcgccgaacttcactcagcacgggcatgttgcttggttgcgtgggcgcactactggcgatcctcggcgcacaattcggcttgtttccagtagtacttttggcatttttgttcctcggatccatgtcggcggttaacctccaagcacgtttcgccgcaaccgacgtggccagtgaagaaacccgcggccgcgacctctcgatcgttgtgtggtccaccaccatcggcgcaatcgccggaccaaatttatttgaaccaagcgcccgattcagcgaaaccctgggcctcgaacaacatgccggcgcatacctgctgtgtttatttggccagctcatcgccatcgcagtctggcgattcaccctccccaaaggcctcaaacccgaagccaccccaaatgcaccaacagaaaagaagcgcctcaccccgaaagccctccaagccatcacatcggttgcaaccgcacacttctccatggtcggtctcatgtccatggccgccatccacatgcaaggccacggcgccagcctcaccatcatcggcttcaccatcagtttgcacgtcgccggaatgtacgcactctcaccagtgttcggcctgctcacagacaaactcggccgcaatgtcaccatctattccggcttcgccatgctcgccacatccgcagcatttcttatcatttggcccgaaccacagtgggccatgatcacatccatgatcctgcttgggctcggctggaactctgccctcgtcggttcttcaacattgcttgtcgacgccacccccatccaccaccgcacctacgcccaggggcgcagcgacctaacgatgaatcttgcgggagcttcaggcgggttgatcgccggaccgttaattgccatgggcggaatgcccttgttggcaggcgtcgttcttgcagttgtggcgcttcaaacggtgcttagtttcagaacccgttcaattgaaaagactcctgcttcatgtttttagcctaggaattcacgcacgacggagtcataaccccgaacagtcagttcaagatcttccaggtacagcgcctcgtcatgggagtgaagttgccccattgcttccgccaaagttcgttcacgtgcatgaactgcaaaaccataaccaacaccgcctagtcgacgaccaaagcgcaggtcagagccaccagaggaaataattgggaccacaggcgcatcggggaagaaatcaccaagaactttttccaaggtgttatacaacctggaatcagttgggctcaccgttgcttcttcagagatgaggtgttcgatttctacttcatcggcaagatcgcccagagcagcacgcagggtgtcatcaacatagtcattggtttggcctggaagggtacggatatccagttccaagtacgcatgcgatggcaatacattgatggcttgacctgcacgaaccacagtttgggcgatcgtgagatgagacaccgcgtgggcgaagcgggagagtccgccgaactctgcgtaggcctcaggggaggtcccgctaagaagcgcctgctccgtttctgggtcgaaacggtgcgcttggacgaagccttgccagatatcgtccttggctaccttcagatcggcggcagcgattcggcgggcgacttcaccgatcttgacaatagcgctgtcacggtcgaaaggaatggaaccatgaccagcatcgccattgacgtgaatacgacgttgagctgcacctttttctccaacgttaattactactgcgtcgctgccgtcgtggactggaaggtgcgatccaccggattcggagaggcagtttttccagctgaagaggttttggtgttcttcggaaagccacttcgctccgagtccgccgcgggcttcctcatcagcaacgccaacgaatgtcagcgtgccacgcaggccgccttcacgggctacttgacgggtgacggccgcttgggttgcggtaataaagagcatatcgacggaccctctaccccaaatctgtccatccgaaatctccgcaccgaatggatctttagtccatttaggcagatcaacaggcacaacatcagtatgtccaagcagtgttaaaggctcagcatctggatcgctgcctggaacagtcacgataattgaggtccggcccggatgcggttccagcttggtgattttaacgttgggggttccttcaaagaaacgttctaggctttccgcgtttctaatttcctgacctgaatctggggttagatcattcacgcaggcgttgcggataagttcctgaaggagggtgagggtttcgtcgtaaagcgtcatctttttctttctaatatcgcgttcatcgccactgtatcgaatttccggctaactgacgctggattctgtctgttttccctggagttttagaccgtatcgttcaatgcgtatagactatgcagtctagtaatgtttcttcgaacacgctaaccatgcaccagcccacatgactttccagcgtgcccgattcgaaagcatcacccacccaacacaacgtcacagtatgaaacaaaccagctcacgatatggaatttcaccaaatgcgaactaccctaaataccaaagacagacagtgacagccccttcgagaatgcagcaagagacgacacctcctatggacggcacctcgccacagaacaaaatttccaccactcccccagcgccaggaaatgctattcctgcacctggaggcgccattcctacaccagcgaaaactgagcaggacgcagtacctccaactgtggcggcgaaactacccgtacctggaagttctattccagcacccggtagagcattgccaactccagtggctccgggaggttccgtcccagctccgagagcgtccgcacctgcggttcctaacgttcctgcagctcccggcgctgctgttccagctccgggaatctcgatcccggcagcacctagtgccccaggcagtgcaattccaacaccaggcacagcaatccctgtgcctggaagtgcaactcctgtcccagcacctggggttagtgcacctggcgcaagcgttccaagcattccagtaccaggatctgtcaccccacctgcaccaggaatttccgcacctggcggtgcacttccgactcctggcagtgcgcccccaacacctggcggtgcccttccgactccaggtgaggcacttcccgttcccggagcacctggtgcacccggagcatccggaatcccaagtcctggccttccaaccccaggtgtcccaactcccggagcttccttaccagtcccaggagcaccagacgcacctggaaccccaagcattcccgcagctcccggcattcaagcaccaggaattccagcagcaccaggagcccctgcccaagctgctgctcacgcaaagccagtattccaagatgcagagaaacgacctcgcacagatgaagctggaaatgcgaagaaggaactgccgctgagagttcggttggcgcagccaattacacgtaagcagtgggcaatgactcttggtgtcctggttctcggagcaattgtcgtggctgcaatcgcggtggtccttgccaaatgggcgtttaccacggagtggttgcaggacttcgtcgagaagtatccgggtaaatatgacaaccccgaaggtgcgccagtaggaattccaacgtggctgagttggcagcacttcttcaacatgttcttcatggtgttgattatcaagacgggcattgagatcaatagaacccgcaggccaaagggttattggacgccgaaaaagggtggcaagaagatctccttgacgttgtggatccacctggttttggatttgttgtggatcatcaacggtgcggtgttcatcattttgttgttcgcgacgggtcagtggatgcgcattgttccaaccagttgggatgtgttcccgaacgcgctgagtgctggtttgcagtatgtgtcgttggattggccgactgagaatggttgggcgaattacaacagtttgcaggagctgacgtacttcttcactgtctttattgcggcaccgttgtcgattgtgtctggtttccggatgtcgagttactggcctaagaacaatgcgacgatgaataagttgatccccatcgggtttgctcgtgcgctgcacatgccagtgatggtgtattacatcgtgttcatttgtatccacgtgttcttggtgttggcgaccggcgcgttgcgcaatttcaaccatatgtatgcaggtcaagacgttgtgaactgggttggttttggttggttcgtggcgtcgttggtggtgatcattggagcatttgtggcattgcgtccaacgattatcgctccggtggccaagctgtttggtcaggtcactgcccgttaagcgagatcccttatggcccttcagatgtaattctgaagggccttttctgttgagtgctcatctaacgggtcgaagtcatgagatgagctctttgtatagcttgggtgcgttcaggctcttagacgcgattctgagaggtcgcttctttcagaccccgaggtagattcctgactgcaccagaccacagtgcccacgaagcctcgaaacccaaaacttgggcatctgtgaccggtatcgagggcgataaaacaaaccacagtgcccacgaactcggaaaacccgatccgtgggcactgtggtttggtccaaagaaacctagagccccatttccttcactatcgcgtattcagctacctctgccacgaaggtttcatcatggcaggtcaggatcagcgctcccccattccctaagaaatccgcaaagcgctggtggatggcgtttcgaccgccgacatcaaggccgacgtcgggttcatcagcaagcaaaacttccgggttattacccagggctgcgtcgcattgggcaaggcggagttcgcgttgcgataaatccagcggatgttcttcactgttactgcctggcacccaattagcaacagtggagtcaatgacttgatcgctagggttttgcagcatcaattcagtgccgggttcattggcaagaccacgcaggagtgtggacttccctgaaccattgggaccctgcaaccacagcacttgacctgcagaaacagtaatatccagggggccgatctgaaactgtggttgggattcgttgaattgccaccagcgtcggcgttgttgtccgcgggttcctgtaatcgctgaaaacgttcgcgatggaccggaaaattccacccgcgcaggcagggacagctcctccaaatcccctaagtacacagtcggcgcgtcgagccaccgcttgtgcgcagcgacgatgacatcgccctcatatgattccaacattgtgatgagttgggctcgcgaggaggtatcaagaccggagagggggtcgtcgagaagcatcgttggcgcctctaagatggcgacggtgccgatcgccagccgccgtgtttgcccgccggaaagttgcgcgggtgcgcggtctagcagattctcgaggccgagcccgatgtttcggacgcgctcccacatctgcgcgggtacgatgccgcgttgttccagcccaaaggccagctcctcggcgactgtcgcgcgcaggtaggtgatatgcgcgcgcgggtcggcggtcagcatcaccgctccgggcgtttcccggtagcgtttttccaattcccgcgtgagcccggagccggacggtccgacgatttgagttagagccaccacgccatcccgactgccaaaagcggcaacaaccagcgacaatgcttttcgacgcgcccctccaccacctcaaccaacaccgtacgcggccccggcctgtccaggcctgcgacctccaagggaatcgctcgcgcggcacctgcactaagtaaatgtgtaatcaggggcaaacccacatatttcaccgcgcgcacgggacctttaacgctgcgcccgcgcaaagcattggcatcacgaaccaacgccaaggtctgtttaccctgcggaatcatctgcaatgcagaacccacgatatacgccagcttgggccaacgatatagggatttcaccagctcaggaatagtaatcgctgttgctgcaaggaggaaaatagacatcaacgcactaaaacgagccgtcaaggtaagagcaatcaaccagccgtcggaagaatacggcatgtgaatcagcgccatcgaggccaatgcaggaaccgataacaatgctgttgaagccaacacagatacattgcgcacccgaatcatcgccacgacctgcgcgatgatgatcactgcgatgcttaaaccaagcttattaacgcccagcaccacgatccacatgctgaatgcgccaatgatccatgtcaaaggattcatgtttaagcgacgtcctccggaacccgctgcggaaccaatgccctagtggtgcgcttgggtagcgacttgaccaccacaaacacaatgagcataacaatggccttatccaaaggatcggaaataaacgactgccaggttaccgatgcgagcaaagagttacccatttcgcggaagaggctaaccaccgcaccagttcccacaccggcggttccgccataaacaaacgccgcaaccggggcagcgacagcacccgtgatcaaaccaatgaccgcaccagagatgatggtggcgaagatattcttaaacgcaccctttttaatcaccacaccggtcaaccaaccagtcagcgcggaacctgcagcaaacggcaaagccagcggattgaacaacgcccacaccacagaacttaaagcacctgttgccaaaccagcactaggaccagcaagagctgcgaccagcactgtgcccaccgcatctaaatacagcggaatgacaaaagaaccagtgacttggcctaacaaaatattgagcaccaaagccacaggaatgatcgcaatggtcctggctggaagcgtaggcagcacaccaaccaacaacgcgatcgtgccggcaacatagcccaccaacgtgatcaacgcttccgtggaaccacccactgattcccaatcggtaggcctgaccaagaccaaatacagccaggtagcagcgatgagtaggccaccaaacgcgaccgaaattttagatgagcgtgacatagtaatccccatgcagatcgtcgaatgcaaaaacaagccagcagtatgtcacctcgtgctggcggaaacgatttgaaagtatatcggactaacggaaaattctttgcatgcagagaaaccttgaggggagggaggcgtcgataagcatgcttttatctcagcccaaacccggcgcgctcaaacacgcgcctaaggaactgcctgttggtttttgtaatgcttttcgacgccgccctatgcgccgtctgcttcgaccagagctggtgctggccgtagcgagaatagtaagtgtcgagggcgcggtcgtaggaatcgataagttcgaggtttttctcggtgtaggtatcccagtgaacaatggcttcttgtggcaggcgaggtttaattccggcaggttcagacggatccgcatgcccaatttccaagcccacgacaggcacgatctcaggtggaaggccaagcaatttctgcacggcttccgcatcgttgcgcaccgaacccaaatagagcgttcccaatccaagtgactccgcagcaattgcagcgttttgagctgcgattccggcgtcgaggaaccccaacgcggcctcatcgagataatcaagagcccctgttgggagatcttctctggctgccaccgcactgattcgggaataatcaatcaaccaaatcagcaccgcgggaacctgctcaaggtgcggaaacatctggcgagtgatccccgcgaggcctttcctcagctcaggatctttaaccacgatgacagaaatgacctgcttattggaagaggttccagccgattgtgcggcggaaataatggtgcggatggtgtcatcatcaaccggtttatccaaccacctgcgaactgatcgatgctggtgaatgacatcaagcgtctcattccactgcggtggcgtccaggttgcaggttgtccgtagcgggcggctaaaagttctcctggtgacggcatgggcttctttctctcgctgttgtctgccagattaagcgagttgccctgcatcagcaccggattatttcattccactgctcttagaagttccgcgtgggcggcctcaatgtctgcggtttccacaagaaatgcgttagctggcttgccccaatgtccgcgaatatctgcaacagtggtgccacgcatcaagggcgaatcagcctccacgtccacggttacttcacggcctgaaaatgggattttatccaaggcaatcatgcaggtcagcaggtcatgaatttgagcaaggtaaccttcgccctgcacttcgtgaaattcaaagtaaaagcgcagcatctcaggtaaatgctctgcgatgggttggctgccaagcgtgttgataagtgtagaaaggatgtccgggttcagcgtaaactgctcggtcacgcccaaggaacacaccgtaatgggcttttgggctgccgcgaatgcttctttagctccgtgtggatcaacccaggtattccattctgccgttggagtggtgttgcctggataaaggtaggtgccacccatcagcgtgacgttttccactggcccgaattccgcaaggttggtggcgggcccggtgacaatcagcttagtttctgggttactgaggtgttctttccacagctgcttccagtcaccttctggaatttcgacgtgacctgggtttatataaccaaggccatggtcgccgtgtgtttctggagtagtcactagcggcacgtgctttggttcaggttgtcctgcgaggaccgggatgtccgctaatccacactgatccaacacccacctggtattgatggcggtttgtttcacatcaacatttcctgcggtggtcgttgctccaaaaagttggatttcaccacgtttatgcaaagcaaccaggtagatcagggcgagggcgtcgtcgatgccggtgtcgcagtcgatgagaacaggaatcatgtctcacgagcttagtgttttctggttttggggttgggttctagttggggtctagtgctggataggctcctctggcaggcttgctgccatagaggactaataggggaaaggatgtgcgaaaatacaccacaaattcctggcgggttacagtttgtggtggatccttgcgtcccagagtcggtttaatgcaaaaatcagttcgatcaactggttggacctcacggatgtggtgagaatttgatcagcaacctttcaggtttcactcctgccccactagtcacaaaatggacactctccagatttgcccctaagcactcaaatcaaccccgcccacacttgagaacattccggaaatctaaccctttaaaccgcctcccaccctcccgaaattagaaatccccttttaatgtgatatcactttctgttaaactgatatcacattctttttcagcaccccagacttaaaaggagcaccaccatgagcaccatagaagagcgcactcctggagctgtcgccacagaaccagtgggacacgaaggcgcacgcgtcagcattaatgagaagaacgtgtggtctttgggcgcaggtccagcagctttcgcactgctcgcaatgattgtgctcatgattgccagtggagttttcttcgctcaatccatcaacactttagaaaacgatggcggtggaacacttgcggttacgggactgattgccagcatcgtcgttttcactgttgcattggtggtcaccataacttcggtgaaggtggtcagccctggacatactctgactgtgcagttctttggacgatacatcggaaccctgcgtcgaactgggttgtctttcgttcccccactgtctgtgacgaagaaagtgtccgtgagggtccgaaactttgaaaccaacgaagccaaagttaatgactacaacggcaaccccatcaacattgcagcgatcatcgtgtggcaggtagccgatactgcacaggctagcttctctgtggaggatttcgaagagttcctgcaccagcaggccgagtccgcactgcgtcacgtggcaacccagcacccctatgattccccagttgatggtcgtgtttccttgcgtggcgctaccgatgaggtcagtgaagaactcgcagatgaggtggcacaacgagcagctgttgcaggtcttgaaatcgtcgaagcccgcatctcttccttgagctacgcaccggaaattgcccaggcgatgctgcagcgccagcaggcttccgcgattgttgatgcccgcgaaaagatcgtcgagggcgctgtcaccatggtggaaaccgcacttgaccagcttgagcaacgtgaaattgtggatttggatccagagcgacgcgccgcgatggtttccaacctgttggttgtgttgtgttccgacaccaatgctcagccaatcgtcaacgccggtagcctctaccaataagacaatggcccgcaaacaggtgccactgcgccttgatccggcagtctacgacgcaatcgcgaagtgggctgccgatgaagctcgcagcactaatgcacaaattgaaatgatgctcagggaacaattgcgcaaggctggtcggttgcctaaaaatattggggatatcccgagacccggccgccccaaggagaatccatgagttcattaatcgttggcacggacggcctcagtcgcccgagttgggctgcgcaagatcccctgatgcgcgattattacgacaccgagtggggaatgccgattcgcgatgaacagggattattcgaaagagttagtctggaagcttttcaatccgggctgtcctgggcgacgattttgcgcaagcgcgatagtttccgcgcagctttctctcagtttgatccggaattagtcgcaaaattcaccgatgctgacatcgaacgcctcatggaggacgccggcatcgtgcgcaacaaacgtaaaattttggccaccattaacaacgccaaagccacccttcaattgcgtgagaagggtggcttggtggaatttgtatggggtttcaaaccgattgataccccacagccggagaccctggaggagattccgacgcagtcgccggagtcagttgcactgtctaaggcgctgaagaaggaaggtttttccttcgttggtcccacgacgatgtttgcccttatggaagccataggaatcgtcgacacccatttggtgggcagccatcgccgcggaagttctggggtgtgggcttaggaaatcagccagtcgtttggtgcgaagagctcgaagtttacgtcgcgaggctgctcatcgagcgcctcgatctgctcacgcacgttcttcaagaattccacgccaccgcacaggtacacggacgcacctgatggaatgcggccagcgacctcgagccactggtcgttgtcgcggtagaagatttcaaacgcagccttagggagcttttcgacgagcccctgcacttcctccacctgcgcgtaggtggactcggcctggtcagcatgcaaaaccacaacgtcacgttcagggttcatacctgcgagcatgcccaccattggggtggagccgatgccctgggaaatcagcacaactggattggtgtccttgttaagaaccaggtcgccggccgcgatggtggcttcaatcttgtcaccaacggatacgcgatcacgcaggaatccagaaacctcgccgttatcctcaaccgcaatgcggtactcggtgtcggagccgccgagcaagctgtactggcgcagctggcgggcgccgtcgtcaagcactactccgatggaggtgtactgacctggctctggggcaaccagctcacctgccagggtgtattcccagacggttgcgctgagctgcttcttcgcggtcacggtgacttcgcggaagacgtcgccaggctccagatcgttggaagcataaaggttgttctcaaaaccgatcagcacatttgccatgatccagtagacagcatcccaggcttcagcgacaggtgcggtgacagtttccgctcccaaaacctcaacgattgcggcgaacaggtgctcgtgaacaatgtcgtactgatcagcagtaatgccgagggacacgtgcttgtggccaatgcgggacagcagctgaactgggtcaggagcatcaggagtaacgagcatggtggcaaacgttgcaatcgaagccgccagcgccttctgctgatcgccttgcttctgattgccacggttgaaggtgttagcgatcaattctgggtgagccgcaaacatcttgttgtagaaaaccggcgtgatctcattaatcttgccgcccacgagaggaagcgttgctttgatcacctctgcgtgttctgccgagagtgcgctgcgatcagtaatgggctgggtggaaacgatcaaggggttttcgcctttccatgcttcatgggctaatttctacggatttaatctaattaaataaatcccaggatccaagcaatttggccttaatatgatggcaatcactaattggaaaaatgtttaaacgggcattaaaaacggattcaaccgggtttaatgccgttttatcgctatttaatacaggcctacccccactacccccattcagttcagggaatccccggatttaaaacaattaaaaaccctctagaatgagacattatgggcgaacaatttccaggcgataaaaacatccgagtcagcgacaccgaaagatcagcagcactagcagcactcggccagttctacgcagaaggtcgcctctccctagaagaaaccgacgaccgctgcgaagccgtcgccgacgccaaaacccgcggcgacctcaacgccatcttctacgatctgcccaaccaacaaatcgcagtcgtcgaccgctccgaacaaacctacacagccaccgaagttgccgaactccaccgcaaaggcgcacgcccacgcgccggaatcctcggactcaccacagttttagccatcaccggtaccgctgctttcgccagcaccacagcttttgcaacagtacttttagccctgattccgatcgtgttcatcatgctgtacgtgatgaaaattggtcctgaatcctggcacgcaccaacacctcgccaacttcagcgaaagcgcatgatcgaactgcgtgaaaaggaaaaactccgcgacatggagctcaaagcccagcgcaaggaacgcacccacgcattaaccaaccgcgcgttggatgctgctgaaactgctttcaacaccaagccctggaagaagaacaaatagggcttttgaagtgtgtcgcgtgtgcggactgaaatagtttccgcttcaacttggttgctaaggataggctccataaaaataaccaaaggcggaaaatttcaatgtcacacactaagccatccattgccatcctcggtgctggccgagtgggttcttcacttgccaggtcagcggtcgccgcaggctatgaggtaaaggttgctggttcaggtgctgtggacaaaatcgctcttaccgctgagatccttatgcccggcgcggttccaagcactgctgaccaggctgtaaaggatgcagatattgtgttcttggctgttcccctgcataaattccgcagtgtcaatccagccactttagagggcaagatcgttattgacacgatgaaccactgggttccggtcaatggtgagttggaggaaattgatcaggatccgcgcagcacttcggagattattgcggagtttttcgcgggatcaaccatggtgaagtcttttaaccacattggttatcacgagattgagcaggatgcgggtaccgggcgtgcgattgcgtatgccacggatgatgtggatgcaggtgcccaggttgcacagctaattaagagttttgggtttgttcctttaaatattggcgcattggaaaacggccgtattctggaacctggccaagaagctttcggcgcgcaccttaataaagattcgcgcctagaacttgttaatcagcggtagtacctcgatcttcagccaacctcgcgacatggagcgcgaggtaggtttgctcgtcggaggaaagttcggcacccaatcgaaggctgaggatttggctgagtctttccgcacatgccaccgaatccgggtgggaaatttctaggctgttgcgcagcacggacatgccgtcgttgagttgtccgtcgtggtgaacgcgaacaaagaagtagcgcatgtgggtgataaaccgtgcggcgttgacggattgtcggtcaagggtgatgccaaacgaggaatcgattacctcaaagagctgctcgaaaacgccagtcatcacgtaggtttctgcgaggtcttccgtgcggaaaccagcattaaccaggtgtaatgagatggctacaacttccgctggtggcagcggagggatccctttttcagcaagccaattgttggtgcgttccaggatctccgttgcaagacgagtttcctcaggatacaaatgatgcacttctgcgcttaatgggttggggttggacgtcagctcgggttccaactcattacgtttcaccgccatttgaaggtgatccgccaacgccaccaccgtggtacttccgccagcaagctgaccgtatgatcagcgtcgcggttattttctggcacaaacacctgcgccactttggactaatcaatatcttcacctggttttttctggaaacccacacctcatccggtcagtaccacctcggcaccgtctttcatggcaagcacaacattattgttgagcactctcaaccctttcaccgaagtgacacctacctttatttcttaggattccaggctttcgccattggtggcgatgatgtcgcggcaccaatcaaaggacttcttcttgtagcgcttcaagattcctgagccgccgtcgtcgaggtatttgatgcggtagtcatcgtttactgttgggccggagggtccgtcgataagcacgtcctttgctcctagtccgttttcgacgatgaacagtggcttctgccagcgctcccagtagttgttcaggacgatgcgcaaaccgaggggatcaacttgccaaccccattcggaagccgcgagagtggggctgaccactccgccgatgatgttaccgccaccggttgagtagttttcggggttgtgggcttcacatacggacatgtaataggagaaggaaatgaaatcgacggtgtttttttaagatctcacggtcttcatctgtgatgtcgatggtgataccctttcgcggaatttgtgcagcaagtagcctgggtattcgccacggacgtgaatattgccgaaggcatagtcctcgtgggacttttgctgggcggtaagttgatcgcgtgggtccggggtaatgccataacgaggaacggcaataatcatgcaaccgatctggttttgtgggtcgatctcatgagcaatcttagttgccaaagcacttgctactcaatcatggtaaacagcctggtcgcagtccttcacgattcaaactttgccttccgctacgccttccacctgatcatcatagaagacggtgaagtaacagcagccggagatcccacagagatcgtcactgcgggactgatcgaagaagtctacaacgtcaaagcctgtgcatcccagaccccgtgaacagcaaaccgatgatcgtgccactggaaagatcttaggcagccgtgggattacacccttttagagctagaacagtaaaaattcacccaatagctttcaactacgcacacaaagtggcaacattgagcgggtgactacagacaagcgcaaaacctctaagaccaccgacaccgccaacaaggctgtgggcgcggatcaggcagcgcgtcccactcggcgaacaactcgccgcatcttcgatcagtcggagaagatgaaggacgtgctgtacgagatccgtggcccggtggccgcggaggcggaacgcatggagcttgatgggcataacatcttaaagctcaacacgggaaatccagccgtgttcggattcgatgcccccgacgtgattatgcgtgacatgatcgccaaccttccaacttcccaagggtattccacctccaaaggcattattccggcccggcgagcagtggtcacccgctacgaagttgtgcccggattcccccacttcgatgttgatgatgtgttcttaggcaacggtgtctcagaactaatcaccatgaccacccaagcactcctcaacgacggcgatgaagttcttatccccgcaccggactacccactgtggactgccgcaacctccctggctggtggtaagcctgtgcactacctctgtgatgaggaagatgactggaacccatccatcgaagacatcaagtccaaaatctcagagaaaaccaaagctattgtggtgatcaaccccaacaaccccacgggagctgtctacccgcgccgggtgttggaacaaatcgtcgagattgcacgcgagcatgacctgctgattttggccgatgaaatctacgaccgcattctctacgatgatgccgagcacatcagcctggcaacccttgcaccagatctcctttgcatcacatacaacggtctatccaaggcataccgcgtcgcaggataccgagctggctggatggtattgactggaccaaagcaatacgcacgtggatttattgagggcctcgaactcctcgcaggcactcgactctgcccaaatgtcccagctcagcacgctattcaggtagctctcggtggacgccagtccatctacgacctcactggcgaacacggccgactcctggaacagcgcaacatggcatggacgaaactcaacgaaatcccaggtgtcagctgtgtgaaaccaatgggagctctatacgcgttccccaagctcgaccccaacgtgtacgaaatccacgacgacacccaactcatgctggatcttctccgtgccgagaaaatcctcatggttcagggcactggcttcaactggccacatcacgatcacttccgagtggtcaccctgccatgggcatcccagttggaaaacgcaattgagcgcctgggtaacttcctgtccacttacaagcagtagtagttgttaggattcaccacgaatctcaggatttttgagattcgtggtgaatttttgcgttttccagtcaggctcctgcaactttcggaccgatttcagaggggcggagctggtttgtggtggatccttgaaatggaacctcgcaggaagctttcaggaagaccaagttgggcctaggggtggcgggattgcaaaaatccgtccccggttcgccatgaaatgctgattttgatcgaatctttgcgctaactgtagggcgggttcagggggtgaatgcaccacgagcaacccgaagggtgcgaagtgggcattcgtagaacaatcccagaggaaagccgtacggctttcctcgacatgatcaatcaaggtatgtcaggtcttgctgcgtctacagcggtcggggtcagtgaattcaccgggcgaaagtgggcgaaggccgccggggtgaaactgacccgcggcccgcgaggtggcaatgcttttgacaccgccgagaaacttgagattgcagccagcatgctagagaaaggatgcctaccccgagaaatcggcgagtatgtcggcatgactcgggccaatatatccctatggcgcaaacaaggcccagacaagcttcgccaacgcgcagccaccttgcgcaccggcaagcgagcagctgaattcatccacgccccggtgatgggcccttattatgggccacgcacactccatcaagtgttgcgtgaggactacacaacactgtttgacgagttatctgcgttggggttgccagcacaggtgtgtggggccttacttcatcttgctccaccaccatcattacgcttttcttatatgtcgtgtgtagtgccgttatttgctgatgaaatcaaagtcgtaggacaaggcacacgattatcgttagaagagaaaatgatgatccaacgtttccatgacaccggggtcagtgcagcagaaatcggtcgacgcctgggtcggtgtcggcaaacaatttccagggaacttcgacgtggtcaagatgatgatggacgttatcgtgcacgcgactcctatgaaggtgcgatcaggaaactagcgcgtccgaaaacaccgaaacttgatgccaatcgtaggcttcgggctgtggtggtcgaggcgttgaataataaattatctccggagcagatttctggtcttttagccaccgagcatgctaacgatagctctatgcagattagtcatgaaactatttaccaggcgttatatgttcaaggtaaaggggcgttgcgtgatgaattgaaggtggagaaatttcttcgtaccggtcggaagggacgtaaaccgcagtcgaagttgccatcgagaggtaagccgtgggtggagggtgcgttgattagtcaacgcccagcagaagttgctgatcgtgctgtgcctgggcactgggagggcgatttagtaattggtggtgaaaaccaagcgacagcgttggtgacgttggtggagcgcacgagccggttgacgttgattaagcggttgggggttaatcatgaggcgtcgactgtgacggatgcgttggtggagatgatgggtgatttgccgcaggcgttgcgtcggagtttgacgtgggatcagggtgtggagatggcagagcatgcgcggtttagcgtggtgaccaagtgtccggtgtttttctgtgatcctcattcgccgtggcagcgtgggtcgaatgagaatacgaatggattggtcagggattttttcccgaagggcactaattttgctaaagtaagtgacgaagaagttcagcgggcacaggatctgctgaattaccggccgcggaaaatgcatggttttaaaagcgcgacgcaggtatatgaaaaaatcgtagttggtgcatccaccgattgaattcgcctaggagattgtacgaaaattcgttcggctttcggatttcctggcgatctgagacgagaagttgaacagctaacctgcagaaaccttgcaagaatcacaacagccccaatggcctcaaaagtcacgccctcagaatcgctgccaggcgtctaaatcccctaaaacgggacaataggtcactgggcgatcccaagcccttaaaacgtgatccttaaatacccactgtcctctattctgggttaggcttcactgggtaaaagtgcctgcctatgcctgaaacttgagcatggcaacagcaaggagacaccgtgggaaaacatgcagctgaaacatcggaaccgaagaaaaattcaccgtggcgcattggtttgttgacgtttttgatttcttcagttgtcgtgacgctggtgggcatggtgatgctgtggccggattctgatgatgtggtgttggcggataacttttcgcagacgtttgcgggaaatcatgagcaggtggatggaacgatcacgctcgttgataattctgcgtgtaattcgccagacaccggccgagtttttgcggaaagccccacgatttctgcggagccggcaacgttggagtgcgtgcgtgcactcgtagacatcacatcgggtgccaatgaggggcagaaaactcagctgatcacttacgcgcaacctggtgatccggagttttccgagggcgacaagatccgcatggtggaaacaccggatacaaatggcgagatcatctacacctttgctgattaccagcgcggaccggcgttgatcatttggggtgtggttctcattgtggcgatgggagctttcgcggcgtggcgaggtgtgcgtgcgctggttggtttggtcgtcaccttgggaattgttggtattttcttgctgccaggattggccagcgggcacgatgcgatgtggttggcgctggtgtgtggcgcggcgatcttgttgattgtggtgccgatggttcacggaatcaactggaaatcggcagctgcgttggcgggcacgctggtggcattgttgttgtcggcggtgttgtcgtgggcgtcgatcgtcaccacgaatttgcgcggactgggcgatgagaatcatctgaagatcatcaactatttgccggaggtgtcgatctctgggttgctgttggcatcgttcatcattggtaccttgggtgtgctcaacgatgtgacgatctcacaggcgtcgaccatcaatgagctcgcggaaatcgatgaagatgccacaccgtggaggctgtttaccggcgcgatgtcggttggtcgcgaccacatttcctcaatgatttacaccctggtgttgggctacaccggcgcagctttgccactgttgctgctgctttccttggcagagcgtccgctgattcagactctgagcagcgatgttatggccggcgagctgctgcgttcaggtgtcggtgcgctgacgttgacactggcggtgccgatcacgacgctgatcgccgcatggacggtacccggcgatgagcctgccccagatgatggcaagccccgcctgatccaccgccactaaaggttgcggccgagcgcttccatttcccaaccggcggccttccatttggcaacatcgaggacgtttcggccatcaataatagcgcgcttctcgacgacccctcccgccacttcggggtcaaggtcgcggaattcttgccattcagtggcaagaacgacgaggtgggcgtcgataagcgcctctttagtgctggacgcatagctgagcgtcgggaagacgcgtcgagcgttgtccatagcttccgggtcgtagaccgagaccgccgcaccctggagcgacagcgaacccgcgaccgacagcgccggagaatcgcggacatcgtccgagttgggtttgaatgcggcgccgagcactgtaacccgcttgcccagcagcgaaccgccacacatctctttggccagctgcaccacacggtcgcgacgacgcatattgatggaatcgacctcacgcaagaacgttaatgcctggtcagcacccaattcgcccgcgcgtgccatgaaagcgcggatgtctttaggcaaacaaccgccaccgaatcccaggcccgcgcctaagaactttcggccgatacgatcgtcgtgaccgatggcatccgcaagcgcaaccacatcggcgccggtctgctcacaaatctcagcgaccgcattgatgaaggaaatcttggtggccaagaacgcattcgcggaaactttcaccagctcagcggtagcaagatcagtcaccaaaaatggggtatcggcagcaatcgcggtggcgtaaacctcgcgagcgatcgcctctgctgtcgccccctcacgcacacccaccacgatgcggtccggagtgatggtgtctttgaccgcgtagccctcacgcaagaactccggattccacgcgatctccacgtgcgaaccaggcttgaccagagaatcagcaagctcctgcaactgctcagcagtaccaaccggaaccgtagacttgccgaaaataatgtgctcgccctcaagcagcggcaccaaatcctcaacaacctgacgaacatacgtcagatccgccgcataagtacccttctgctgaggagtacccacgcccaagaaatgcacctgcgcgaaagccgcagcctccgcataatcagtagtgaagttcaggcgaccattttccagattgcgctccaaaacctcaggcaaacccggctcaaaaaatgggaccttgctgtccttcaacgacgcaatctttgcctcatcgacatcaacaccaagaacctcatggctaagctcagccatgcaggccgcgtgcgtagcgccaaggtaacccgtaccaatcactgtcatccgcatgtagggtgattcctttcaatgaagagtggactggagattatctcaacacgttttgatacagcccgcgaccggaacacatgattgcttacttgttggggaaattcaggtacgccttcgaaggagtaggaccacgctgcccctgatacttcgaaccaagcttgccggaaccatacggagtctccgcaggggaactcatctggaacaaagccaactgccccaccttcatacccggccacaacgtgatcggcagattagccacattggacaactccaacgtgatgtaaccactaaaaccaggatcaatgaaaccagcagtagagtgcgtcaacaagccaagacgaccaagagacgacttaccctccaaacgaccagccagatgcgcaggcaaagtgaacttttccagcgtggacgccagcacaaactcacccggatgcagcacaaagccctcgccgtcctcaacctcaacaaggctggtcagctcatcctgattcaacttagggtcaatgtgggtgtacttagagttattgaaaacccggaagtagcggtccatgcggacatcgacactcgacggctgaatcagctcagcgtcgaaaggttcaattcccaagtcgcctgcgtcaattgatttacgaatgtcacgatctgaaagaagcacgtcaaccagtgtagcgttcagcgttcagggttgggccacgggttgctgcgatgaggttcctggggcgcgtggtgctggcgctgatttttatcgtgctagccttattctcggcccttaattaagcgccaccttttacactgccggtgtagttcaatggtagaactcctgcttcccaagcaggcggcgcgggttcgattcccgtcaccggctccaaataagcccctgacctctcaatacgcaatgaaggtcaagggcttaattctatggaaactacaaaaagcacccacttaaatacacgctttaaatcccctcacggtgcgatcatcagcccttttacatttttagaaaaagctttgcagttttccatcgcagccgaaaaccgctccagtgcgaaattgcgcactacatcacaccgaacactcgacgacatctttaattttcaacatatccccacccccagaaattattcaccacttacacttcacatactcaccaatgcataacccaaaaagcgttagatgaaacttcccacccgaatccacaagaactcgggtgccctcaatttcacatacccctaagcgcaacactgtgcgagctttccgccagtaggccaagcaccctttcgattgaccccgacaaacttttaaggcaagcctaaattaggtaaaccttaaacagtcgccattgaagaattttaaaaacaaacaaccttcaacgcgctaacaagcatcttcccactctcgttaccggagtttctcacatgtctcacaagttttcccgccgtgctttcgcagtactgaccgctgccgcaatttccacttccgctttcgcaaccactgctccgtctgcgattgcagagccagtttctaatgtcgccactgcagacgattccagcgtcgcaacttcagaaaactccctcgactggggcttcaaggcttcctggcgcacctatgtcaccggaccttggactggtggaaccgttgacgcaactggcggtgcaactgtcaacgaagatggaacctacaacttcaccctcggaactggctccaattacgacgtcgacaccgagaagggccagctgaactacgaaggaactgttgccttcgccagtgacgctcacggcttcaacatcaccttgtccaacccgcagatcaccgtcgagggcgacactgcaactttgagcgccgagctgtctgacaatgccgctcccgaagagacctccactactcgcgttgatgttgctgagttcgaactgaccgctcctgaggtttcagaaaccgatgcggacattacctacacctggaccgatgcttccggcactttcttggagaccctgcagcctgaagaattgagccgttacgcaggccaggaagcggatgcgctgagcttctccatcaccgtggacaaggcttcagagaacccttccgatgatgttgctaccggatcttcctccagcttcctctccaccatcttgaacttccttcagcagctggcgagcccactgctcaagctcttcggttcgctttcttcctaaataatcagtaatgccccaccagatatctggtggggcattttgttttaggagcagaccacgtttggtgaaggatcgtaaaccgtggtgacggtttctctggtgatttcgttgccagaaagatcgctgatgattcgggtgtctgaggtggtaaatcctggtgcaccggttgatggcacacaatctgaacccgatactcgaactgtgttgggctgggtggtggaccaacgtccgttgttgatggattccacggaggtggtgtccacacccatgatgcgcacggtcacgtttgaggcgtcggcagaggtgctgatcatgacggggtatggggagttgttgcggaattggaggtcgatggcgccatcgaaaatcgtagcttcacgtccggctgggtagcgggaaatgtagtagctgtgcggggtgtgcgtgatgtcttccagacctgcgaagtagtacgcgttgtacaaggtggtggcgaactgactgatgccaccgccgactgcggtgtcggaacgaccattcaaaatgatgccggaatcaacaaagccttgggctgcgccacgtgggccggtgtagttgttgagggagaatgtatcgccaggtgaaacgactgcgccgtcgaccatttgcgcggtgaggcggatgtttgttccggaggcagcagagaagccgccggtggtgaactcgcccatgacctcattgaaggtagcgttttgggcgtcggtggcggtgaatgttgctggggtgtcctcgtagattgcgtcgatggtgcgggggccatcgccggtgaggttgttgggcagatcggccagggtttcttcccagttgattccgtgtccggtgacttctggggtgactacgcgggagcctgaggagaaactgatttgagcgttggtgggctcgatctctgtttctttgagaccttcggccagcattgctgttgctgcttctgcattgatgtcgacgcggatggtgccgttttcttctgggaaactcaccacttcacccatgcgctcgacggggatggtgccttcaattccgtcatcgcctcggacgacgaaagggctagatactgctttagctccggcgccttctgcaagtttatcgatggtgtcttggctgatcgcagcgggaacaacgtatggctcggcttttacgccctctgggttgagccagttttctgtgactgcttgttccaaaatggtgcggtctacggcttgtccgtcgatggtgtcgttgaccacgagggtgccggcgtcgatatgcaggtttccggaaatgggatctcgatagagttcgccgaccatgcgatcaagggtcgggccgaaggctgcgggatcgacggtgctcacgatgggagattcggattctttgaacagcgccacgaagcgggtaatggggttccaagactgctcgccggtgccttcgatggttgcgtcccaatcgatgccgacgccggaggcaactggatcaaaagtggtgctctgctcccctgccgtcacggtgacgggctgcaccacatcattggccagttcggtttccaactttgtgcgggcttcttgtgcactgaggttggaaatactgacgccaccgacggttgttccacgagggatgttgtccttgttgaggaaaacatcgaccgcatagatgcctgcaaaaatggcaatcagaccaacgagaaccccgattaggatccctttggtccgattctttgccgaatttttcccagagttcttcacacctgaaaggctagttgcactgatgcgaaattcctactcagaaggggttacggactggtaacttcacttttgttcgagacgtgtgatgtagagcaattggactcttaacgcagatgccagcatttgttcttgagggtattcaccgctgctaacggcagcatcaacgcgatcaatcgcggagcccaacgacccatagtcgatccatagtgcttggtctgcgcctgctttgagggaggcaagcactgcttctgcgggtgaatgggtggcggaaatggcactcattccagagagatcgtcggtgtagatcacgccatcgaaaggcacgccacctgggtaatcgccactgcggagcagttgataggtggcggggtcgatagaggatggaactccgtcggtgccaagacctggaacaatcatgtggcccaccatgacggctccgtcagtttcagaaagtgcttgaccataagggatgaggtcgtaagttttaagctcatcaagtgcgggggtcaccacatcttgggtgtgcgaatcgccacttgcacgaccgtgacctgggaaatgtttgaatactggggtaattcctactttgcttaagccctttgcaaaagctgtggcataagtagctgctacggctgggtcgttggaaaaggaacgatcgccaacgacggggagaccccaagcatctacatctacaacaggtgcaaagttaactgtcacaccatgtgcagctaaaccagtgcctaggatttctgcgagatcttctacttgttccggcgtcatggtttgcgccatcacgcgcggtgaggggaaatcaccaagaatattggtggcacgctggacgcggccgccttcgaagtcgatgctgacggagaaatccctgccgacggcttcgcggagcgcctcaatattacggccaggttccgtgagcagattttcatctgtccaggaaccaataaagatgccacccaccccctgattgagcgcatccaatgcctgatcataattcgcaactccaaccatcatcagcgacgcgacttggtcgcgttgctgttcagggatttgcgcgcgcgccaaatcctccgcggtcggtgcgggaggggtggagggggacgtcgataagcggcttattgctttttgctgttccggctcttctgcgcagcccgcaaggagcacaccggctaccgcgacggctgctgcgaggggtttcaatcgcttccacacggctctaactataggaaaagacggcagcaaagcattaatcgtcggtaggctgaagtgaagtactttccgaaagattcacagggagcatgcaatgacgaacaaaaccatgctggttgcttttgatggctcaccggaatcccggcgcgctttggaatatgcggcgaaattgttgcagccgcgcaccgtggaaattttaactgcgtgggagccattgcatcggcaagctgcgcgctcggtttcgttgatcaccttgggggtggaacccgaagaccccgcccattccgctgcactaaaaacctgccaggaaggcgtagagctagcccaatctctaggtctggaagcgcgagcccacatggtggaatccgcaacggccgtgtggagcgccatcgttgatgctgctgacgagctccgccccgacgtgattgtcaccggcacccgcgggatctccggatggaaatccctgtggcaatcctccacctcagacagcgtgctccaccacgccgacgtaccagtttttgtcgttccacccctggactaaaaccgagacgagaaccaagaagatgaaaccaaggggtaaaaactggtagtctcttccacgtcatggcatacgaaactgattccctcaaccgacgcaccctcgggcccgcgattgcaagcgcagtcgtgggaatcgccgtcggcgcagtcgcagtagttggggtttcaatgatctcagggcaggacactgttcccactggtaacgccgtaactgcagacgatgccctgctcggtggccctgagtatggttcacgcgaagcagactaagaagccacttccccgttttcttcactcggcgcatttctatgtctggattgtgctgggttttgtggtgtttgcgcaaccttatggtcaggttgctgccgatactaaactagatttgctgctcaaccccgcaggatttttaaccggtgcgcttcatgcgtggactgacacgttcaccttgggtcagttgcaaaaccaagcttatggctatctgtttccccaagggtttttcttcctcataactgatttcctccctgactggattgcgcagcgactgtggtggtggcttgttcttggcctgggattttctggattctacgcactggtagcccggctggggattggcaatcctgcattcagggtgatcgccgcgctgctgtttgctctgtccccgcgcacgctcaccaccctcactgcaatctcctccgaaacttggcctatcatgctcgcgccatgggtatgtctgcctctgctttcgcgaaatgtggatgcacgggccatcgcgttgtccttacttcccgcggcatgcatgggtgcagttaatgccaccgccacgatggcagcactcatcccggcagcgctgatcttgctgtatagagggctcttcttaaggctgcttctgtggggaatgggcgttctcgctgttaattcatggtggatcggacctttgttggtgcttggcaaatacgccccgcccttcaccgaattcatcgaaagttcctccgtcaccacttcctggctcaacccagtagaaatactccgcggaaccaccagttggacacccttcgtagacactgaacgacaagccggatatctcctggtcaacgatgctctctttgtcaccctcagcgttctcgtcgcagccctcggcttgatcggcctcaccttgatgaaacaccgtggactgtgggcattcatgctggccatcggactcctcatcctcggcagcgcccacctaacggctgttcaagaattcctcgacggcccaggcgcagcacttcgaaacatccacaaatttgatctattagtccgcatgccgttgatggtgggcgttgccgcattggggtcgcatatcagtctgcccttgcttgggacgactgcattgaccagcggacaaggcaaacaccacaccatcccgctgcctctccaaaaacgccaagccgcaggactcctcgtggtgatcatcgctgtcggtgctcttgctcccgcatggtcggcacggctgctacctcagggaacgtgggatgaagtgcctgactactggtacgaagccacagaattcctcaaccaaaacgccacaggcacccgcacgttgatttggcctagctcgccgtttgcccgccaggactggggatggactcgggatgaaccagctcaaccacttcttgatgttccgtgggctgtccgcgatgccattcctttggttcccccggaggcgattcgcggattagatggtctcgacgacctaggcactctaggcaccggtctaaacgacgaggctttaaaacgtctaggcatcggcgcagtactggtgaggcatgatctggaagccgacccagatattgaggtggatctgcctggggaaaagcacacttttggctcccaaggccaagtagacgtctacctcaccgaccccgaccgcaatatgtggatcacttccggcacatccaagcagctgcccaccgtcgctggcggcggcgaaatcctctcgctcctagacaccatcaacggctattccccgaggactttggtgagtgagaatgcccagatcgtcaccgatacccctcagctagtcggcacaaattacggcgatggcaccagttccgcagcattggccagccttgatgagactgaggtgaaaaaccgcatcgtggattatccttccgcggggccaatgacgcaggtggtgcaggaaggttccatcacggcgtcttcgtctggttccgatgccacttctttcggcggcgcggatcctgatcgttcccttaattcacttcttgatcatcgttacaacaccgcctggtacccgacacctggcgatacgtctccgtggctcgaagtctccggtaccggcaccacattatcgatctccccccgcagcaccgtcaccgccaccatcacctccggcgattccgtgatggtccgcgagttcgaaaaaggccgcaccaccacagttacgttggcggagcctgaagctcgcattgaattcgatggtttcgtaggaatttccgagctgtccctagagggtctcagccgcaccatcactgtgccggagacctctcctgacgtgcagcaattcgttttccaacgcctcacagtgcccacctcgttcctcgaccgcactttcacagtcccccgccacatgtccgtcaccgtggaggcccaatcctgcgtcacattggaactcgacggcgatcgcatcgactgtggccccctcgaactcacccccggaacccacacgctgcgcacccaatcggaatgggtcaccctcaccgaatccgctccgctcgccgctgttcagccagcaacaaacatcgaggcagcacccaccgaccgcgtgctcgtcaccacgcgcgctttcaattcaggtaccagcgcgcttatcgacgccacccccctttccccaatccaactcgacgcctcctcccaaggtttcatcatccccgcgaacgcctccggcgagttgagcttcgctttcgacggcgaaaaaccctacaaactgtcccttttcggtggcgcaaccatcgcattaatcgtggtgttgggttgtgttgttgtggggaggcgtcgagaagcaataaaccccgtgtggcaggacacccgcaacgcgcaatgggcggtggtggcattgatcccgatgttggggtggtggttcgtgccggcggtggcgtcgtggctagttctgcgattcaccctcatcccgaaatgggtgctggcagggctcccgttggctatctgcggattgtggctcgcccaagctccctggccggctgccgcatacccaggagattcccccgcattggccctgctagcgggcatttccgtggctgcgctatttgctggcgatttaaggcctccaaagcgctaaatgggtgtcagttcattctgacgattctaggcccttggaggcgattgtagagagggtagaatttgtgaccattggggctcctgtgattcctgtcagcttgttgatcaaggatccaccacaatcctgtggccagaccttcaaatcgaacggatttttgcataaaaccgccggcgagttgcaaaaatccaccacaaacggctgaaaatccggatcctgtggtgagtattagcaaattagttcccttaccggcttgccatgccccgtccccgtcttgacgtggtgccaattcatcattttccagacctacccccagaaaaatggtgaatcctaacgacccccagcctgaatggcgcgccgggtccaccgcatgatgggctcttcgatgaaggtgtagctgatggcggcaactgggatcgtcaacaagaccgtcacgatgaacaccaacaggaaatttccactaaataaaggcaacccgagcagtgggaacacaatcgtcagcacgggaaggtgccagaggaagatggaatacgaccaggtgccgagcgttttcatccaactggaatcaagaagccgagagggcgtacccagcgcgtagggaaccaccagaaatacagcgaaaagtgtgcccgcgaggactcttaagttgaattcccaggggctggggtgcactaaacctagtggtccgaaccattcttggcccgcgatccaagcgaccactaaagctaaacccacccacacaaagctcggaacccgtgggaatcgaactccttcaatttctgcggcgatcatgccgactgcaaaccagcaagcgtaagcgggtggccagatctgcatgttcgcccacccctcgtccaacgcatgctccacaaggggaatccacggccacgccagactcaacactgccccaccaacaatcaacaggatgcgcaccggccgaccaaacctatccaacacccacgcgagaagcggcatcaccaggtaaaacgccacttccacgcacagggaccaaaggtgggtgaggcctgtcatgaggccgtctggccagtagatttgggtcatcgtcaggttggctaaccaggggccggtgggaataaacagcaggactgcaatgaccgttgcccagtatgcgggcatgatgcgggctaggcgtttgaggtagtacagtcccactggttgcccggcgcggcgtcgccaaagaacgaaggcggagagggcgaagaagacggcgacgaaaaagtcgaaacgcgcgagtactgcaccgatgttgctggcggggtcgacggaggtttggaatgcaacgtgggtcgccaagactcccagggaggcgattgcgcgtagtccctcgagtgagctgatgaatccgcgatggcggatgggtgcatatgattgggtagacattatttcaacatgcgagtttagcggaaaggtgtgggctgtttttatgaagcgatctgcaacggtcctcattattgcgggcgtgctgttcctcatttttgccttcacggtaccgccgtatgtgactggtcaggcgcggacgattccgaaggatttggatctgacgttggtgagcgaaagtccgcaggggtttgtgcgcactgaacatattgtgactgctccgacggaaaaggtcgatgagatcgcgacgcatgtggatcagacagttacggatgtgcaggggaaaactgttgcggaaatttcggatgatgtggtgttgattggacactctcgttatccggtgattaagccgactgccaccatttcgggttcgccggcggatagtagcaatgtggtgcgggaggggttgcattacttcttcccggctaatacgttgcggaattcttatccctattatgacatcgtattgggtgaggattccccggtggattatgtctcgcgcgagggcaatacttataccttctaccagcatcttcgttatgttccattggatgattctcacacctattcggtggagcggaccctgaaagtggatcgtttttccggcatcattgtggctaaagatgaggcgatgacgtttcatggcccagacggcgatgacacagtagaattcacttatactgcggatacgttgaagcttctgcaggatcatgcgcatgatattgatcagcggttgtcgtgggctaaggggtttgatttcttttctaaattcttaggcctgtcgttgcttgcgattggtgtgttcctcacgggaattttcaagcgcggccagctgatgagcactgtgaataaactcaggagttaaatccttatgaccccgacccgccgtatcctgctgtgggcatggacgactgtgcttttgggttctttgctgtggccgttggctgcgcctggcgagttgttgttgcgggatatgtcggtggtggaccatcctgcgttgtcgttgaatgcgttgggttttggtgatttgccgtcgcggaacgccccgcaggatggtgtgctggcgttgcttggctttttgccggtgagttggatcgttcgaaccatgctgcttgtggcgggtttcgcgggcgcgtggggtgcgatgcgccttgggccttccaagtttttggccgttaccgtggcgatttacaatcccttcgtggtggagcgtctgctgcagggccattggtcgttggtgatggcggtgtggctgttgccgctggttgtggcgctgcgcaggcatccgcgttggcaggttgtggcgatctgggcggcgtcgttgacgcccacgggtgcggtggttgcggcggtcacgggcgtggcgagttctaaaagaaaacgctttacgacgctatgttccttcctttcgtggcttccttggctaatacctgcgcttcttgccacccccacttcgggaggtgcgctgaccttcgccattcgttctgaaacatatgcaggaacgttgggaactgcgctgggcctgggtggaatttggaacgcgggggccgtgccggcctcacgcgaactgggtttcgcggttgctggaattttgttatttgcgattctgctggcgggtttcaaaaactgtccgtgggttctcgcactgctggcggtcgtaggttttatgggggcgatcggtccgtggctgatgccgaatctgttcacgtggaccatcgcatatgttccaggcgccgcgctgtttagggattctcaaaaactcctcatgctggctatccctgcctatgtgtgtttggccgccggggtgaaaagcccactgtcgtgggtggctaccggtttggcgttgctccagattcctgatgcaccacgtgaggtttccgtgatacgcccaagttcagcgcatgtggaatcagtggaagcactggcagaaatcgctgatggccgcgacatcttaatcatcggccaaggccccttggtgacccgcgaggatgggatcccggttgtcgatcccaaaaccaaagccctctccgtggtggaatccggcgaactgcgtgtggacggaatcatcaccgacgcgccctcacagcggtggaccgaagcaacgcaggcatgggcggccggggatatcgagcgccttgaagaacttggcgttggtgtcgtggtggatggagatacgatcacagaaactggcgcaccaccgcagcatggctggaaatactacctcggtgtgggcctgaccgtgctgtggatggcgttgccgctgggactactttttcgacgcaagaccaagaagtagttcctcgaactgcgctcccgcggtgtcccacttgtagttttcggcgcgctgcttcgcgctggcgccgagcttggagcggagggaggcgtcgataagcagggttttggtggctgaaataagctcggccttggagtcgacaagcaggccggtttcgccgtcgacgacggaatcgcgcaggccgcctgagcttcggtaaccgatcgtcggaacgccgtgctgcgccgcctccgtgaccgccaggccccagccttccttgcgcgaaggcatgagatgaatcgtggcgcgctccagcagggcgtgcttgtgatcctcggcgacctggccgtggaaaaccacgcgatcgctcacacccagcgtgcgggcataatcgaccagttcctcctgccaccaaccgcttccgactacatccagcaccacgccgtcgagcgccgcgacgacatccatcgcatgctcaatctgcttgtgcggaaccaggcgcgacaacgtcaccgcatgctggccatcgcgatccagcttcggcgtgtgcagcggcacgggatccacgccattgcgcacgatatgaatccgctgctgatccacacccaacgcaatgagctcctcagcgctcggctctgaaacagtcacatacggcgcagttttgtaagcgcgcggcgcgatctggctctcaatcagccaaccaaccttcgccagcacccgacccaccaccggccactgctccttatggcaatgatgcgtgagcaacacagtcggcttaccggagaaaaactttccaaaaaacggaatgccattctgcgtatccaccaccacatcaaccttggaaaacgtgccaatccccacacgacccaacatcatggccacccacgccttgggatacacactaaacttcccaccgctcctggaatacctcacaccatcgcggaaagaacgccgtggcgcatccgtgtgcccagcagtacgaaacaccacctcatggccctgatccgccaaaaactcacccacccgctccagatagcgttcacttccgccaccttgaggatgagtggtatcacgccagcacaacaaaaggatcttcatagggttattcagtctagctgcttttaaacaagccataatggaagccatggccacaacgatcaccgttttctctcccacccactcccccgcacaaatccgcgaaaccatcctcagcgccgcgaaagaagacgacgtggacttcctcggagtcccctttacccaccccagaaacgtcaccatcgaagtcgacgacgaactgatcaacgactgcttaggctggctcgacgacgtggcactcgcctccggcctgggcatccaatacaacgacgaagtgctccgctacggcgacgaagacatttcctttaccgtccaaaccaaaaatgacgatgacgcccgcatcggcgcctcccgccttggactcgagcaccagttgaacgtcattgccgggggctctggagattccggggattccggggattatttgaagattgcacacttcgacctagacaaccccgccgacgagtcctcctacatctccgcgcgcagcctcgcagaagtagacggctggaccctagaattcggcgtcgcaggagtaaaaaacaccaccattgtttcctccatcgacgatgccatcaccaccattttgcgatggatgaacggcgaagacatccgcgacctcaactggacccgcgcataaatggcctcatttccggagcttccggctcttcgtcgcttggctaccttgggcaggtcgtggggtttactgtctgatttcaaatacgaacaaacccgacctgacatcttttacggaaacctggccctcgatacctcgagtctggtggcggctttgtctgaagatatttctggcgccggattaaatgacctgaaagttctcgacgtcggcggcggacccggatacttcgccgaagcctttgagacactgggcgccacctacttctccgtcgaacccgacgttggcgaaatgtccgcagctggcatcgacgtccacggatcagtccgcggatccggcctcgacctgccgtttcttcccgattcctttgacgtggtgtactcctccaacgttgcagaacatgtctccgcaccgtgggaattgggagaagaaatgctccgcgtcacccgcagcggcggcctggcaatcctgagctacaccatttggttagggcccttcggcggccatgaaaccggactgtgggaacactacgttggcggagaatttgcccgcgatcgctacacgaagaaacacgggcacccgcctaagaacgttttcggggagtcactgtttaatgtgtcctgccgggaggggctggaatggggagcctccgtgggcaatgcggaattggttgccgcttttccccgctaccacccgtattgggtctggtggatggttaaagtcccagtgctccgagaattcgcggtaagtaacttggtgttggtgtttaaaaagcactgaggttttgaggaattcatcgcttaacgacaagaaaggctcccactttcggtgggagcctttcttgttatttagcagttcttaagcgtgaactttaagcgtgagctgctgaaatgcgggccttcagagcatcgaactggctgtgaacctctgcaggaacacgtggtccgaggaaagtgaggtactcggcgttgtcttcaacgtcgtttgcccactgctctgcaggagcggtcagtgcttccttgacatcctcaattggggtgtcgaggccgtcgaggtcgaggtcttcggccttagcggtgtgtccaacaacggtctcgtctgcgccaacgtggccttcgatgcggtcgatgacccacttcagaacgcgagagttgtcgccgaagccaggccacaggaagcgtccatcttcgccacggcggaaccagttgaccaggaagatggatggcatcttgtcgccacccttgttacccatgtcaatccagttctgcaggtattcaccagcgttgtagccaatgaatgggagcattgccattgggtcgtggcggagtgtgccgacctttgcttctgcggaagctgcggtctgaccggatgcgagcagtgcaccaaccatggtgccgtgctcccagtcgtaggtctgggtaaccagtgggacggtgtctgcgcgacgtccaccgaagaggattgcgtcgatcttgacgccttcccagtcgttgaactcaggtgctgctgctggggactggtcgattgctacgcagtaacgggagttagggtgagcagcgttttcgtcggactctggggtccagtcgttgcccatccagtcaatgaggtgagctggggcgtcgccgtccatgccttcccaccagatgtcgccgtcgtcggtgagtgccacgttggtgaacagggtgttgcctggttccatggtcttcatcgcgattgggttggatgcgtagttggtgcctggagcaacaccgaagaaaccattttctgggttaactgcgtagaggccgtcctcgcgcagcttcagccaagcgatgtcgtcgccaacaacctgagcggtccagcctgggatggttggagtgatcatggcgaggttggtcttgccacaagcagatgggaatgctgctgcgatgtggtacgccttgccctctgggttgatcagcttcaggatgagcatgtgctcagccatccatccttcttcgcgagccatgacagatgcgatacgcagtgcgtagcacttctttgccaggattgcgtttccgccgtagccggaaccgtaggaccaaatttccttggtctctgggaactgggtgatgtacttggtgtcgttgcaaggccatgcaacgtcttcctggcctggctccaaaggagcaccaacggagtggaggcacctgacgaagctgccgttcgcgccgatcttgtccagcgcttcaatacccatgcgggtcatgatgcgcatggacatgacaacgtactcggagtcagtgagctgcacaccaagcttagggtccggatcgctgattggacccatgcagaaaggcacgacgtacatggtgcgccccttcatggaaccagcgtaatgcttggacatttcgtccttcattgcctgtggtggagcccagttgttggttgggccagcatcttcttccttctcggagcagatgaaggtgcgggactcaacgcgcgcaacgtcagatgggttggaacgagctaggtagctgttcggacgcttttcctcgttgagcttgatgagggtaccggcttcaacaagatcctccgccatgcgatcccactcagcctgggatccatcaacgaacacaacagcctcaggctggaagagctcgacggcgtctgcgatccagttcagcagttccttattcttggtcggcgcctcgccctgaaggcccctgattgcagcagtagtcattacttctccagattttgtgtcattcgacagagttctcgccccctagcgtagctttcagatacagaactagttaaaactttaggtgagacaacggacacatttgtcattaccagtggacctaccccctgcccacacgcatctacacactttctttaatatgagagcacccgtttaaatagcctattttgggggtggtttcaagaattaacctcaaccgttctccgacagttcattccccgtccatggccattgggttcagatttgggcaattctcacacattccaggggacaactttcccagttttcccaccattaacacttaacattcggacaataggcaacaaaacgccaagaacagcggtaatggtaatccctttcccttaccctgccatcacaatccaagcactccgctagtggccgaccagcacaaaccggcccactgtcagtacacacctttttaaaacaacatttacactcacatgcatgcccgcactgtcaccacccgccctcaactaccgaactaaagatatgtacttgaagccaaatttttaccctagatcccccttttaaatactttgaaaattactcacacacatccccacgttaccccaaaggttatatccagttagtcgtatcaaaaagtgctctgatcttaactttgccctacctaaatacatgaccccaccacgacggccagtactaacgacagaatccactagcgaacccatttattaacaaacattgcaaacaagtgttgaagtattcgcgaaattgcaacttttggagcccaaaggtctagaccagtgatcgagcgcacaacgctcccatttagcggtttcactgccccaaaggcttaaagtaatgggcatgcccactccttcttcgaccaaaagctacgctgcggtcttacctccacctggcccctcgtgggctggttccctcatgggcatctcattgttgtcatcactgttgaaaatccatggttttccagtcgtcgcagatttcttcttcgcgttagctgttgtggtggcaattgtcattattggcggttggctaatctaccgctctccttcattcaaaactgaagtcatgccggcatgggcaatgctgtccatgggtttgatcgcattgggaactgcaagccccgtagttttgggtgatgatctgtggggatttatgtttgtgtgctggtctattggcacagccgtgggacttgttgcctattccttatatataacggccattttgcgatctaaggcgggcacaccaacttttgcgtggggtcttcctcttgtcacgccgatggttgcttccacctcggcagcacaactccatgagcactttgaacttccggcgatgctgtgggtttctttcgggctcttccttttaactttggcgtctgcaccagcagtttttacccgagtgtatttctactatttcggccccaaggcgcagggcatcccactgatggcaacaccaacatcatggattcctttgggtatggtgggccaatccactgcagcagctcagctcatcggtgcgtcctttggatccaagacagcaatcacaatgggcattatttacggcatcatcatgggaatttttacgattcctctgggagccatcgctcactttgtgttctacagagctgttttcaaaggggcgacatacagccccacatggtgggccagtaccttcccagttggcactttgagtttgggtgcgcattttttatcacagagcaccggagtggagtggtttaactacttcagcctgtacttgattgctttaatgctctttcatgtcatcgtgtccaccatcgccggtacgattgcagtaatgagaagaatcgtcggaaagcttaaatctcaactggcctaaattgcagcgagaggtctaaaaggtagtgctctagggattcatccaaactcacgaatattgaagttttaaagttgaacaggaaaaataacaaataatgtctatttctgataattcccgcgatcaattaggagaactgccagctggtcggcctctccaatccgattttgataatgacctcgactacccacgtctaggcagtgtcacgtttaggcgtggcaccctcactgaaaaccagcaaaccatgtgggatgaaaagtggcctgaactgggtcgcgtcctcgaagatgagctgattgatgttgatgcgtggttcgggcgcgaaggcgcaaaaaccatcgtagagatcggctctggcactggaacttcgactgctgccatggctccacttgaggctgataccaacattgtcgccgtcgaactatacaagccgggcttggccaagttgatgggctctgttgtccgtggagagatcgacaacgtgcgcatggtccgcggagacggcatcgaggtgctcaaccgcatgtttgccgatgggtccctggacggcatccgcgtatacttcccggacccttggccaaaggcgcgccacaacaagcgccgcatcatccagtctggtccgctgaacctgtttgcaaagaagctcaagccaggtggagttctgcacgttgctaccgaccacgctgattacgcagagtggatcaatgagctagttgaggtcgaaccactgcttgagtacaaaggctggccatgggaggaatgccctcagctgactgaccgtcaggtcatcaccaagtttgaaggcaaaggcttggaaaaagatcacgtgatcaatgagtacttgtggcagaaggtgcaaaactaatgtctgatgtgcatgaggtcattcatagctacaatcccactgacaaagaaggccctgaaagtgtccttctagtgtgggacgctcccaacctagatatgggtttgggcgctattttgggtggtcgcccaaccgctgcgtaccgacctcgctttgatgccatcggtcggtggttgcttgctcgcgcaggtcgcagggcacatgagttgggccgccacattgagcctgaggcaacggtgtttgccaacatcaccccaggtggctctgatgttgttcgaccttgggtggaagcgctgcgtaacgttggtttcgcggtcttcgctaagcctaagatcggcgaggattccgatgtcgatccggacatgattgatcacattcgcaggcgctatgaagaaggcgtgctgcggggtgtcatcgtggccagtgcagatggtcagaacttccgtgagactctcgaggagctcgttgcagagggcattcctgccacggtcattggtttccacgagcacgcgtcatgggctgtagctcatgacaccatcgagtttgttgatctggaggaaatccccggcgtcttccgtgagccgcttcctcgcgtcagcctggataacctgccagacggtggcgcatggctgcagccgttccgccctctgactgccttgttatccaaccgccacaattcccaggagtaatccacccgtgttttctaaatggggccactttgcttacagatttaggcgcattgttccgttagtcgtcatcgccgcgattttggctttgtttgtcattttcggcaccaagctgggcgaccgcatgagccaggaaggatgggatgatcctggttcttcctcgaccgctgcggcgcgcatcgagttggagacctttgggcgtgacaatgacggcgatgtcgtgttgctgtttactgcgcctgaaggcacttctttcgatgatgcagaggtgttctccagcatctctggctacttagatgggctaatcgagaacaaccctgatgaagtcagccacatcaacagctactttgacactcgtaatcaaaatctcctcagcaaagacggcacccaaacctttgcagctctcgggctcaaaggtgacggcgagcaaacgctgaaggacttccgggagattgaagatcagctccatccggacaaccttgccggtggcgtcaccactgaggtcgcgggtgccaccgctgtagccgacgcactcgatgagggcatggctggcgatatttcacgcgccgaagtttttgcgctgcctttcgtggctatcttgctgctcatcgtgtttggctcagttgttgccgcggcgatgccattgatcgtgggcattttgtccatcttgggttcgctgggcatcttggcaattttggctggattcttccaggtcaacgtatttgcacaatctgttgtgacccttctgggcttgggtcttgccattgactatggcttattcatggtctctcgtttccgtgaggaaatggataagggcaccccggttgaacaggctgttgccaccactacggcgaccgcgggtaagactgtggtgttctctgcagcgatggtggctgtggcgctgtccgggttgtttgttttcccacaggctttcttgaagtcggtggcattcggtgcgatttccgcggttggccttgctgctttgatgtcggtgacggtgttgccgtcgctgttcagcatgttgggtaagaatatcgataagtggagtttgcgtcgcactgctcgaacagcgcgccgtttggaagacaccatttggtaccgcgtgccggcatgggcaatgcgccatgccaaggcagtgaccgtgggcgtcgtattgctcttgcttgctcttacagtgccgttgacgggcgtgaaattcggcggcatcaatgaaacgtatctgccaccagctaacgacacccgcgtcgcccaagagcgtttcgacgaggcgtttcccgccttccgcaccgagccggtcaagcttgtggtcaccggggcggacaacaaccagctgatcgatatctatgttcaggccaacgaagttgagggactgacagatcgtttcaccgcaggtgcgactaccgatgatggcaccacggtgttgtctactggtattcaggatcgttccctcaatgagcaggtagtggagcagcttcgcgctatttccgtccctgagggcgttgaggtgcagatcggtggcactccagccatggagatcgaatccattgaggcgctctttgaaaagctcctctggatggctctctacattgtgctggccactttcatcctcatggcattggtatttggttcggtgattttgccggcgaaggccatcatcatgaccattctgggtatgggtgccaccttgggtattctcaccttgatgttcgtcgatggcgtgggtgccagcgcattgaacttctcccctggcccactgatgagtccagtgctggtgctgatcatggctattatttacggactttccaccgactatgaggtgttcctggtatctcgcatggtggaggcccgcgataaaggcgaatccaccgacgacgccatcagatacggcactgcacacaccggatctatcatcaccgcggccgcactgatcatgattgtggtctgtggagcgtttggtttctctgagatcgtcatgatgaagtacatcgcgttcggcatgatcgcagcgctgattctggatgccaccatcatccgcatgctgcttgtccccgccgtgatgcacctgcttcgcgacgacaactggtgggcacccggcttcgttaaaaaggcctacaccgtcatgggtcacggctctgaggtggaggaagcacctcgcccaaccacccgtcgcctcaacgacgatgaggaagtcaccgtgcatgaagcagttgtcgctggcgataccgtggcatctcgcggtggtttgagcacgcaggaaaaccgtgatctggtgtccttcgtggaacttaaggctcgtttggaaaagcgcaggcttgaggatctagattaaatctatgcgaggatttttcagcaacccctggattcgttgggctttgtccctggcgtttctaggggtgatcctatttttcctgagggatcagctggatttcctcaaaatgggcatccaacaaatccgccacgtcagccccgtaggcgttgccctcaccatggtggcgttggtgttgtcattcgttgcgatggccagagtcatgcagatcatgttgaaagccggaggtagtcctgcgactctcaaagccaccacggctttaacttttgcggctaactcctggtccgcgacccttcctggcggcccggcgttttccgcgattctcacctataaagtgcagcgcagctggggtgccagcgccgtgctgtgttcgtggtttttcctgctctccagtgccctatcgaccgtctggttggttgctctcggtgtcatcgccgtgttttatatgggcgcatcgctgaacttatggtcactgatcgccacattcatcgccatggtcgggctgtctggcgccgtttattgggcagccaacaaccccgactccttggctcggtgggtgcgaaaattgacgaaaaacagggagtggggcttcgtcgaaaagcttcttggaagcattgagcagctgcgctcggtctcgctcaccgggccgcaattcgcggccagcaccgcgtggtctttaggcaataggcttttcgacgccatctccctctggatttgcatctgggcggtcaccggcactgccccgatgtttgaaccagaacccaacaacaccaccatcgcaggcgtactgttggcgtacaccaccgcaaaaatcgcaggctcaatccaagccaccccaggcggaatcggccccatcgaagccgcctacatcgcagccctcgtagccaccggtatgaccgcagtggaagccgccggagctgtcataatctaccgtttatgctcatttatcatcatggcgattgtcggatgggtcatctattttatctatttcaccccccagggactcaaggccaatgaatccctggatgtggaacaggatacgattaactcagactctaaccgacagtccgcaattgaaaggccagatacgtgaaccgctggatgtccttgctgtgtgattccatcgccatcggtctcttcgcactcttcgcccgcgtcgcccaccaaagcgccgacatgccactaaatgtgcagggctggtttttcacatggctgccattcctcgcaggtgtgttcatcgcctacctggtggcaatcctccctgcgaagcttcccagcgaacgcatccgccccgctggcctgaccgtgtggatactcgcggtaattgtgggacttgtgatttggggcttcaacaatggtggggttccacactggtccttcatgattgtcgcaacgaccgcctccgccattttggttctcggctggcgagcgttgtttaaggtgacaatgcgctaagtgcttttaaaaaatgggagcttctagatttctagaggctccttttttcacaactcatcgacccgtactgcttgtctaagacgcgaaagaggggaccttctaaagcgttctagaaggtcccctctttcttgaaaggcttagtagctcaagaatccttgcaggtaagacaggcttacgctgaggaagtcaatacccgacagaactgcgaagatggttgccattgcggtctcctctggtgaattagttacaggatttctatctggataattctttggacgttacatcggcatgatcgtgtgcttcttgtcgaggtctcgcacagccttggtttccagctggcggactgctcggcgaagcaccaaacgggtctctgcaggttcgatcatggcgtcgatgtaaccacgctcggcggccacatatgggctggtcatgttctcatcgtagaagtccatgaacagtttcttcatgtattcacgctgctcaggtggggcggcttcgagctgcttgccctggatcatcacgacagctgcggctgcgcccatcacggcgatctgtgcggttggccatgcgaagttgaggtcaccggtgaggttcttggaacccatcacggcatatgctccgccgtaggccttgcgcacgatcaaggaaatcttagggacggtcgattccaccactgcgaaggctagctttgcgccacggtgaatcaaaccgaccttctcttggtccacgccaggcaggtagccaggggtgtccacgacgaagatgatcgggatgttgtaggcgtcgcagatacggatgaagcgggcgcccttgtcggcggcgtcagcgtcgatgcagcctgccttatccattggttggttggccaccacaccgactgccttgccatcaacgcgggcgaaggtagtgatcaggttgggggcgtactcctcttggatttccagcaggttggcgtcgtcgaaaagcttgtccagcaggtcatgcatgtcgtagccctggttagtgtcgtcaggcatgaacgagttcagagcttcgtcgtaggcgatctcttcatccgttggtgctgcaaacacaggggctggatcattgcaggtcaaaggcaggaagtcgagcaaatccttgaccatattcagggcctcttcttcagaggacgccaaataggaaatgttgccgttttgcatctgctgcgcaccgccaccgaggtctgcggaagtgatctgctcgccggtgacttccttgatcacggctgggccggtgacatacatttctgtttcaccatcaacgccgataacaaagtcagtggtcacaggtgcatacactgcgccacctgccgatttacccagcatgatggaaatctgagggctgcggccagacagcggaagctgacgacgcgcgatctctgagtacatcgccaaggaggtcaccgcatcctgaatgcgggctccgccggaatcctgaataccgataactgggcaaccaatgcggatagccatgtccatgacttcgctgactttacgtccgaaagtcatgcccacggaaccaccgtaaacggtcttgtcatgggcgtagatggccactgggcgaccatcgatgcgaccataaccagtcaccacaccgtcagagtaaggcgcatcgggttcatccggggtacggcctagtgcgccgatctccacaaaggatccggcatcaagcagagcatcaatacgctgacgaggggtggttcggccttcctcgtcgcgctttttacgtgcgcgttcactacctgggtctttggcaatctccaggcgtgcgcgcagatccgctagcttctctgcagtagtggtgttactcaacttccgtcagctctccgttactaattcttccgagaaatctcatcaatgcggcgactcaaatgagctccgactgtgccgatttctggttcatcgacaactgccaggtggtcaccattcagctgaacaatttccaaatcgttgacaattccggaccatcctccatcttgatcaatcttggcatagtttggttcaagttcgatagctccatcatgcatgcgttccgcgcggaacaggatgacaggggcttcaacgttggcccagtctgcaaaattaagtttagccaggatgcggttgtccacaaaagaagcgcgctggtgttcaagcacacctgcggacaatccgtgctcggaggcgtcggtgttggccaggaagtcggtcatcatggacagcattccgtcttcaccgatggtgtccaagatttcaaaaggtacctcgaaatcaaggccgtaggtcttcttggcgaagtccgcgtagcgagtccagcgtgcacgagtttcctcagcggtatctggtgctgggtttgaaggctgcacagtatccagcaacgccacggtagctacctcaacatcggagccaaccagttggtgggcaacctcgaaggcaacggcaccgccgaagctccagccacccaaaactactgggaagccatcggagtacttcttgatgtcatcaacatatgctgccgcgcggtcagcgagatcgccttccagacgctcaacgccatagacagggacatcttcaggcagacgacgcattagtggttggtagaccacggaagaaccgccagctgggtggaacatgaacactgcaggcttggtggagccttctgcacgtccacgcagcacacgaatgttgccctgaacttcagtttcgaggccttcacgcaccaggtcagacagtggttcgagggtttctgcagccaacacctgttcagtgctgatttcaattccggaacgctcggtgaggcgctcggcaattgcggttgcagtatcgacatcgatctgtggcaacttgctggtcacgccagctgccgcagcgccagtcaggcctgcccaagtaccaaagaccatgcgttccgacgcatctcgcggtgcaacgccaacgccctgcacgtcctcgcccgaagcagaagactcagcagcttgagcctcccctgctgcctcagctggcacctgcggggtggcgtcgacaagcgtctcagaggagcggccagcgaccatgttttccaccatgattaccacgtcagcgacggatgcatcgcggagcgcttggacctggagtggtgggatctggaagtcattttcgatgcggtttttgatgcgcatgcccatgagggagtcgaggccgaggtcaatcagtgggagttcgcgtgggaggtcatccacgtcgtagcccattgcttcggagacgatggcgcgcatgcgctcttcgacggtttcggtcgctgggtcccagcggactgcttcgatgtccaaaggcaggtcggagcgagggtctggctggtcgctgtaatcggtgttgaatccgtcgtagcctggaccgtcgaaggaagatgctgcggcgaatcctgggttggctgcgaaaccttcggcgacaagagtgctggtggttccctcaatcttgtatacggacaggctcaaaccgcccaaggagcgagtcacgatggtggtgatttcgccgcttggtggcagcatgtcgcgctcgtccactgcgtcgacggaggaacctggggtgacagccatggcggctgcttccatgattgccactgcggatggtgccagttcggctgcggtggaaaacgccacagtgttgtttggcagattcacgcggaagcccggcagatccagggatgcgccagaggatgggcgtgcggaagtccagaagcgctggtgcttccaggtgatgtgtggcggatcgatggtttcaccttcgccgtacagcgcggagaaatcaacgtttgcgccgttgacgtacagcttcgccagaaggtcgcggagggattctgcctctgggacttttcgcttcaggctgaacagcagctgtgcatcaggcttgcccacggtgaacgcggtgttcatcatgcccatgagtgcaactgggttcggggaaatttccaccaaggtgttgtggcctgcagcgaatgcagcttcggtggagtcctggaagtacacggactggcgggtacagcggagcatgtaatcggcgtcgtggaccactgctccaactgggtaggtaacaccctgatcgacagagctgaacaacgggatctgcagcggaagtggctcgatgccagcgatttcgccagcgagctcaccaagaagtggttccacagcagaggtgtggccagcgcccttgacgttgagcaggcgggcaaacttgtcttcagattccagcttctctacgaactgaaccacggcgtcgcgaggtccacccacggtagtcatgcctgggcctgcataaacagcaggctcaatgcccttgtactcagggttttcttcgatgaacttatccaggtccgcagcggcgaattccaccacagccatggcacccagctgatcctcagccagggacttctcgccctcgcccattaggcgggaacggtggctggcaatgagcatggtatcgcggtcgctgagtccaccggcagcgtaagcggcagcgatctcacccatcgacatgcccatgacggcagctggctttacaccgaagcttgccaacaggtcagtcagtgcgatctggattgcggtgatcacaacctgcgcggtctcggtgtcgtaagtttgctcatcatccaaaacaagtttcatgatggaccagccggactcgaacttaaccatttcatcgagctcttcgatgcgctcgcggaactgtggcgaaattgagcacaattccttgatcatgaggcggtgctgggatccgaaaccggagtacacaaacacaggaccgttggccgctggggaatcagctgcggagataccgacgctgaccttgccttctgcgacctggcgcaggcgctttacggcttcctcgatagtgcttgcaagcacgactgcgcgggagcggccatgattgcggcctgccagcgcgcgggctactggggttaggtcgcaatctttgcggccctccaagaagtccgccaagtcagcagctgcttgtcgacgcctggatggcaggtgaccagacaccggcagggcaacctgctggtcaggaagcaacgcctccttcggggcacgggtttcgtagtcttctgcgttgtactcagagatcaccacgtgcgcgttggttccaccgaacccgaacgcagacacaccagctactgcgtgaccgttgtattccggccattcacgtggatcttccacaacttccaaacgctcagcatcgaaatcgatgtagcggtttggacctgcaaagttcacggttggtggcagagtcttgttctgcaaagcaagcagcaccttgatgacacctgcaatacccgcagctgactcagtgtggccgaagttggactttgcagagcccagaagagttggggtggatgcgtcacggccatagcccaaaacagcacccagggcagttgcttcaatggggtcacccaggatggtgccggtgccgtgagcctcaacgtaatccacggtggtgggatcaacctgagcgtcaacatatgcacgctgcagcacatcaacctgtgcgtcagggtttggagcggtcagtccgttggagtgaccatcggagttcactgcagaacccttgatcacaccgatgatcttgtcgccgtcgcggattgcgtcatccacgcgcttcagcacaacgactccggcgccgtcggaacgcacgaaaccatcggcatcatcagagaatgcgtggatcttgccggttgggctgatcacaccgagctcagcgaatgcagttgtgacaaatggagatgccaaaatgttcactccaccagcgatagcgtgatccgcttcgccattacgcagcgcacggacagcctggtgaaccgctaccagagaagaagaacatgcggtatccacgttgacggaaggaccgcggaaatcgaaagcgtagttaatgcggttagcgacaatcgcactagaagtaccagtcagcgcataaggatgtgcttctgctggatcggcagcgatcatcatgccgtaatcgttgttggaggaacctatgaacacgcccacggcttcgccacgcaaagtgtttggtgcgatgcgagcgtactccaaagcctcccacgttagctccagcaaaatacgctgctgaggatccatgttggcggcctcgagcggagacagaccaaagaactccgcatcaaagctagagatatctgacaggtagccaccgatggtagaaaactcttccatcttccgagacataacctcatcgcctgcatactcagaccaacggccaatcggtagatccgagataccgtcacggccctcgacgagtagcttccacatatcctccaggctctcagcgcctgggtaacgcgcagccataccgacaaccgcaatatcgtgggaacctggggaatcgctcaccgcggagaaattcaattcacgctgggtatgtgcacgacgaggctcgccctcaacaaggcgctgcgccaaactacggatcgttgggtactcataagcgatggtggcatccaaggaggtgtccagcaggttttccagctcaccagacaacacaacaacatcgcgagaggaaaggccaaaggtctccattgccttgtcatccgtaacttcctccaccggaatacccgtggtgcggacaacccaatcacggagccaggtgcgaacctgttcaacggtcatcttctgatccgacgattggctctgttccatattgaggcctcagcctttcagctcgattacaacttaaacttaaaaaaatattaaaactatccgcctcaaccaaaacgaggctgaggagaatagacatccagacgtttatcgctattcaaccttcgaacgtttcatccccaggtcagaagcaattttttccagacggatttgtaaacctatcgcgtccaccgctaactgcaatagtttacaaggacaaagcgctcgatggaatttatagagaagcttcacctgacaattccgctgatgtttctactgatgtttccactatgcacaaaaccaaaagaaccccgacggattctgttgaaaatccatcggggccctgcggtgtctgcaaagaactagttagcttgttcctgaatgtagttgcgctggttgacgcggcgtgcgatctttccggaggaggaacgcgcgatctcgtcaggtgcgaggatacggatctcttctggaacaacaccgtgtgcagtgccaacggcggagcggattgcttcttcagcagctgcatcgtcggcttcgtttgcagtggtgtcgcgttctgccaggatgatgagcttttcaatgtcatcgcctgggactgcgaatgctgcgacggaatctgcacggatgtgtgcggaagcagcctggacggtgtactcgatgtcctgtgggtagtggtttcggcctgcgacaacgatgaggtccttcagacgaccggtgatgtagagctcgttgtctacgatgacgccgaggtcaccggtggccatccagtagttgtcgtcggcagcaccttctgcgcgggagttttcttccaggcgggtggtcagacggttgcggaaggtttctgcggtgtcttcctcgcggtcgaggtaacctgcagcagtgttttcgccgtgggtccagatttcgccgatctggccgtctgccagctcggttccggtttcggaatcaacgatgaccagctgctgtggggctgcaacctggccgttggagacgaaagcaacagccttgttattgcccttttctacaagctcaacgcggttttcggccaaggcctcgcggtcgaagtaggagatcagtgggcggttttcggtctgtggggtggtgaccagcagggatgcttctgcaagaccgtaggaaggacgcagggtctgaacaggcaggccgtaaggctcgaaagcttcacggaaggtggtcagagcgttttctgtgactggctcggaaccgataatgatggcatccaatgcggaaagatccagggtctctccctctgctggctttgcgtagcgtgctgcaagctcgagggcgaagttaggaaccacggtgtagacgttaacgtccacgtcgctttcgcgacggttgagctgcttaatccagcgggaaggctgctgcacgaaatcgcgtgggttcatgaactcgttgtccaggccaagcatagtgacaaacgccgcgaggataatgcccatgtcgtggtgcagtggcagccatgaaaccaggcgcagtggggttttcagctgtgcggcgctgaagatctgcaagacgttggtcaggatggagcggttggtcagaacaacgccagctggggttcgggtggagccggaggtgtactgcaggaatgcggtcagatcaatgggcgcggactggcgcagagcagccaggcggcggccggcttcggtcagcattgggttctcgtaagaatccgcgagagaatcaggcaaggaatctacagagaggatgcgtgggcgttctgcagctggaaggctggagaagtgcttgcgcacggcacctgcggacttggagttggtcagaacgacaactggctcgctgtctgcgaaaacagcgttgaggtggtctgcgtgtcctggctcgtttggatcataaagcggcacagggaccatgccagcgtagatcgcgccgaggaagctgaaaatgtactcagggctgttgttagccaggatcgctgcacgatcacccagggtggcgacctgctgcaaacggcctgctacagccttgatacgagtatcgatctcgtttcgggtgtactgaatcagcttgccatcgcggtcttcggagaagtcccagaaatgcatgcgtggtttatccccgccgccttcagcgatgtcagcctggtacatgaactcacccatggctgccaaagttaggaatggaggaaggttgatttctccattctcatcgaagaatgaaccaatcgctttatctaaatccatgtgaacccctcttacaattctttaatgactattgtgaccatcgacaaagatgaacattttattacttttgcaaactaacactacttgagcgagtgaccgttcctccaacaaaagacgaagggctcgccgtttaaggcgagcccctgcgcaaaacctcaagctttagcgcacaacgtccgggaggtggacgtcgaaaagcgaaaaagctttatccgttgtcgatgaggttggtcgcccaatccacaacccacgcattggtggttgtgcctgggaaaacatccggattggtggcgtagagcgcgtgcacaccgttggcggagaccatggccaacgcacgatcaagggcgttgccgacattcaccggagcatcacagatcgcatcatttggagcacaaatatcctgcacccggtcgttgagcacaccgaaaccgcccgcgcgcccgccacgcatggttgcgcccggaacaatcggctgcaccagcaagttcaaaggctgcagagtaacctccgcgccgatgccatccacaaacgtgcctgggaactggcccacaccaggctcccggcgaccgtcagcgatcagggcgacacccctgacgctgtcagctggaataacaccttgctctgaaccgatctgagcagccacatcgcccgcaatgaccgcaccctgggagaaaccaacgatgatgaactccgtggcagggcactcattgtgagtgttgatcagttcctcattcatcttcgcggtgccttcattgcgcgaatcatcataggacatctcattttgcgagttgatgttgcggaactgcgcagtgtacggcagcgtccacaccttgacgtcatccgcagaataacgctcctgcagtggctgagtgatgctcaacatgaatgacagcggattagcggtcgggttgatcggatcatcattagcagccgactcccacgtacccggcgcggcaatgacttctaccgcagggcaccaatcaggttgaaccggtggttccgtggtttcggtaccggttggctcgccaggctggccaatgaaatctgagtcatcggatgtgttcacatactgcacgatgcccacgccgattaaggcgaggacgatcaatacagcaataacggtgatggttttcctcatcggttaacaatacgtccgatccgcagattccttcagcagcgtagaaatttccgctgcttgatcttccttcacgctggtgcgtccctgcacgatgagctggcctgcaaccgcatcgacagtgacgttttggtccttgttttccgaactgcagtaatttcgcgcagtcgcaatcaactggtcctccacgccggagatgtcgattttttcatctttcagcgcatccaggaacgcttgcgcctcagcgctgcgttccacggtcacctcgggcaggccgtcgatttcctcggctgccccgtcccgggctgtgcttccgccgcttccattgctttgcgacgcctgactgctgcgttcggtcgaccttgcggtgctgcttgacccagcgctgctttctgttggggctgccgttgtcgagggagaatcatctccttcaacagtgactcccccacaagcagcaaggctcaggcacaaaagtccggaagcgagagttgcgtagatgcgcttcactattagcgagactcctcaattcggccattgacctgacggatggtgccgttctggaaatcaatggtctgtccacccgcggtgattgcggtctggtcagaggttgggaagccgtattcgccctgctcccagcccttagcaccccatgcgtcgaagatgtcgccgtgcagaatcacgtgcgcgccagtggatgcggaccagtagatgttgcccttttcgaattcctggaaagcgccaccgttgatcaacttctcattgccggttgggaaaccaagctgagcgaagattccgtcttcggcgtacttcttggagatttctccgcgaacccagtaagactggttattggaggtacggaatacgtagccaccttcgaactgctggcgcaggccaccgttgtattcaactgcagcgccggttgggtagccgaggctgcccttctcatagtcctgggtgccccatgcggcgagcatatcgcctgggatttcccaaggaccagtggtggcggtccagtagatggagccgtgctcgaaggtgacgaagcggccacgtccgtctggtgtcttcaactcagaagaggttgggtagcccaaccaggaggcaggtccacccagctcagagtaacgagcgttgatgcgtccaaccaggccgaaagcgccagtgtttgcagaccagtatgcgcgaccgttagcgaagtcctgggccttaccgccggtaacatcgtattcgttggtcaggcaggtgcccatcgcgccatccgcaacagcgtcagcgattgcgccgacaggtgcacactcaacgccacggtcctcagtggacatgccaagagcgttagcgatgtgagggaacgcctgagtcatctcgaactgccagtattcccatgagtgcacgccggatggacggaagctagcaacaacttccacgccagcctggcttgcacgatcgacgaaggtctgggaagtcatacgggagataacttccagaccgacacctgctgcgtttgcaggtccaatagctacagagccttccttaccgaagtcatctgcaccgttaccagaggaaacgtagatggtcttgcccttgagcttgtctacgttgctctttggatcgttttcctgccagcgctcagaaccgactggtccccacattgcgttggcatcgtatccgccggcgtctgccagggctgcggaaatagcgattggcatgccagcggaggtggtgtccagatagccggagaaggaaccgacgaacttaaacatgtctgggtggtgggttgcgatgttaaccgcagcggtaccgcccatggagataccggtgatggcgcgatcggtgttagaacggaaacccttgtccaggatcggtgcgagctcctgagtcaggaaggtctcccactggtagttcttgccgttgtttggcccttcccagtcagagtagaaggagctctcgccaccgacagggagcacaacaatggcgttcttatcggcgtagtactgctcaatgttggtctcaatggtccaaccactctgctcttcaatcgcgcgcagaccgtcaagtgcccagatttcagggaactcacggttcggggaagagtaccagtcacgcggaagcagcagctgcaccttgattgggcgctctggcattgctgcagactgaatagtcaaaatgacatgcttggaggttgcccactcagcgctgatcacgcgcacaccatcaggcagcccggcgatctctgggtaggtgacttcaccagcaggaagctcttcgacgcgaggcttcaggtagtcagtcaggccatcggtgacgccctgcgcgatgctgccaataacggcatcagaggaaaggttgctggactgagccgaagccataggtgccagggacatagtcaacgcaattgcggttgggacagcgcctgctgcaatccagagggaacggcgcttagcctgagctttagccttgatggaacgaaatgcggtgtcgcgcatgaagttttccttctcattttgatttttggatactgcgcacaggcccgcaatgagttagatccgtcccgaaagttccccgcttccggcccgacaaacacacgtgggctatgccttgagagtcttcagttcttttcagtctgtcgtgatcttagtccagaaggttacacatgtgggtatgtaactcttctgatgcaggtcacaacttcagaatgacctcaatcttaagttcaactttagacttttttcaatgccacgccgggaatccgcaagactcgcagcatttcccctccaccttttcgcatttcgctgaatttttcaatccgcccctccgcttcctgtggataacttttcaccccagggcgcggatcacttcggatctgtggataacttttaaggcccttgttttccccttgaagcttcggttgtgtggaaaacagaaaaggaggggaaaacaaaatgcaagaaatccacaccatcatgaaacacatggacgcgctcatcgccgacccgtccgccgccgcattcaaagcaacactccccttcgccgaactcctcgaaaagctccacaacaaaaaagcgcttttcgacgccgccctcgccaaatccgccgagcgcgccgatgccggacgcatcatcggaaaaacctcccacatcgatgccctcgcgtaccttctcgacatctccaaatccgaagcattccgacgcacaaaacgcgccgaagaacactacggcaacccaagcccggaacccagttcagaagaactcgcgaaagaaacccccgaagagaagctagccagagaagaaaaagagaaacaagacctagccgaacaagcagaagccaaccgcatcgcccgcgaacacggcatctccgccgaaaaacaagacaccatccgctacgaactagaaaaactcaacgacaacacatccctatcccgagcctcactccgcaaactagcaatgcaggaagccaccagccgaacccccgaagacctacgcaactggacccgcaacaaagttatccgcataaaccccaccgccaaagacccactcgccgcagtaaagaaacgctccttaagcatcggacgccaagaccacgacggcggagccaaagcatccctctatttagatgccaaaggtctagccctgctcaaatcactgatgtctaaagccaagccggggcatttgcttgaagactctttggcggaggataaacgtacgaaaccgcaacgccaatacgatgccttcgccgacatcctccaccgcgcacacagcgatctcctccccgcacgatccggagtgggcaccatcctcgtctccctctccgccaaagacgtaacaaacctcaaagcatcgggccccgaccaccgctaccccaccagcaccggcataaaactcacaccgcttgagatcctgcgactcggtgcagccaaatatgacttcgtgaccgtcctcgactccgaatccggccgtccgctgcacctggcacgcactcaacgcaccgccagcctgtatcaacgcctagccctcttcgcctccgaactcgtctgcacccgcgaaggctgcgactcccccttcgaagacaacgaaatacaccacatcagatcctggctagacggcggccccacagacatagaaaacatcaccaacatctgcccccacgaccacggaaacaacaacgaccaacgcgacggcaaagacaacatggggcacatgaacatagatcccacaaccgggcgcgtcggatatcaacccgccgaccgccgaaaacccatgcggtttaacaacaccgcagccgcagcagaatcaggaggagcacaggccaggacctaagtttttagcgcgccaaaaagcccactgcaatagtacagtgggcttttgattttggtgtggcctttggtgtggcctttggtgtggctctaccaggcgttcatgacgtctagaacacgaccctgagttctctccagctgggagttgaactgagcccagccgtgaatgccatacattgggtaatccgcagttgggttcagaccctgaagccttgcctttgcttcccaaatcctggtggatgtcattgccacgaattcaagcacagaaccagtgaggcggtggtctacgcgaactccatcatcctgagggctccacaggccggaagctgcagagatgtagacgtcggtgttagccaagccgcccatgttccagaatgggtcgttttcaaaacgacgtgggttaatgattgagccatacattgcgttgacgttgaatccaccggtgtccagcatggccagacgcagcagggtttgcatgcctggtgcagtggtgttcaagtagccggaccaagacatagcctggcggaactgatctgggtgctttgctgcgaggttcagcgcggcagttccgcccatggacaggccaccaatggagttgttgtttcgcgcaacgccgaagttctgctcaaggtatgcaggcaattcctgggtaaggaaagtctcccacatgtagatgacaggatcggaggaggaaagagatgcctgggagttccagtcagcatagaaggaacctgcgccaccaactggcatcacgagggtgatgttgtttggtgcgtagaggcgcgcagcgttggtatccacgagccatgcgtttgagtactcagtagcgcgcataccatcgagcaggtacaggccagcgtttccgccacgccctgcaggctggatctggacaggaatgttgcggcccattgcaggcgaccaaacatcacagcgctgaacccagaagcccacagcatcccagtcacagtaaccagagttatctgcgcgcaaccagtcacggtttgcagcttgtgcggtgccttgtccaacaaccatgagggctgccgcggtggcaagagccactacaagggcgacgagcttacggcttgcctcgccagctcgtgtaaatacggacataattctcctccggcaaaaattgatatgtacccatcggcggtatggaccgctgatacctctcgatgcctatcttgtttttccgcccacacgttaccaagttgtgacactcttgggtagttatcacagcccaatgatttgcgaataagtgtttactgagagctatataaaggttctccgcgaggttcatcaagtttaatttccccaggccaagcaatagtttctaacccgtcctgaatctctgcaggggtcgggttaaattctttcaaaagatcttcaggattatctgaaatttccagtgttcttccggtagtgagtgcgtatttaatattgtccacaaaccggtggtaggacattggctcacggtaagtctggaaaaggtgaaccaattctgggtggcgtagcgcctggcgggcctcataagtcttttgagtatccaaccaacccggtgtgtacgccagcggagtggcggattccgcgacctgccattccaagtccatcaatttatcgtggccgattcgaccaccttcaatgcgtggctggcgggctgccagtggcgttgccaaaccaatcaggtctgtcacacgcacgttgagcggtgcgttcatggaggtcatgccgaggttcacatggaaaacagttggcgagaggttagccaaatcaccggcttcaaccccctccacgcgaggtgtggtgatccacgaataagtggtcgggtcactgctggccagaatattgagttgctggcctgttggattaaccaacgtctgatcgcgcataacctctgcgtaatcattcatggaatcaacagtgaggaaatcctctgcataaagcggaggatgatcttcatctcggttggtgaaatcaatccaaaaatcacgctcatcaaccacatgctggccggtattttcccattggtgcccctgcacaaaaaccacagtggaccacacccacgtagagaaaacgagaaccagcgcaaccaaatcctgccaacctcgatcaacaacattgaccggaatgacagaaacaggcagcagaatggcaaaaagtggaaggagcagcatgcgtccatgcatgaagtcgccaccaacacggataacgtaaaggaagtggacgagcgcacagataaccagcaacgctatagccatacccggagtgcgcagccccagccgccccttcggtatcgctaagtgcttgtcagttttccacactgtcaacgcgcctgcggccaacagcaaggccaaaccgagccacaggttgtaaggccccgtgaaatcctcaacatattcccaaccagtcccccacaccgcatctgaggctgatttcgctacagccgtgtgcggcaccatcagcccgtaataacccatgcggaagatttggtacgcagctggaagaggcaaagccgccaccaggatccccaaaactacccgccatcgtggcgcagtaagcagcagcaacactccagtcaaaccgccatacatcgccagttctgggcgaaccagccagctcaagcctgaccaaaaggccaaagcataggttattgcaccggcattaacgataggatttgaagtttttgcgcccgaagccttcttgcccgaggtcttgcccgaagtcgcccacaacaccagcagcagccattggatggaaatccacatcaaagataggccccactccaatccggaagtggcaaagtctcgcgccggggaaaggctgaagtagccgatcacgcctgcaggaagcaatacggcaatgcgtttgcggtggagatgcgcggtacccaggacaccgatgatggacgctgcggtggtgaacagcagcgcaagccacagagcaatatcttcgaggcgatagtcagttactaaggcaaccagatagatgcagtattgccacagagtagatgtgttggcttcgacgcgttcgccagcgttgaatactggcccgtttccagccaggaggtttcggacggtgcgtaggacgatcagtccgtcgtcgctgatccatttgcgggtccagcctgcccagaaagcaaagatgccagcagtaagggccgctagaaacgttgtaatgagggtgtagttcggaccagaagaaccgttagatgcggcgcgaggagcactgcttgaggtttcttcaaagaagtcacctgcgtgttcagtttctggatctggctgcttaccggtctcaaactccggacgctgggggctaaacgtcatgaggccacatgctagcaccgcatgtggcctcaaacgttaatggacatgctggtcagagcatgttcattggtaaatattcaaaacatcggcatgatgtacacagccatcacgatgcagaaaacccatgctagggctagtacctgcagaactttgtcgctgagtgccacttcgtcaggggcaccgccgtcgccggtgtctacgccggctgcgtagcgcaggatggcgatggtgaatggaaccatggagatttggtaccacggacctgcgtcggtggagtgttgggaaaggtcgaagccccacagtgcgtaggacatgaccactgctgttgctgccatggtccaaacgaagcgcaggtaggtgggggtgtagctttccagggacttgcggatcttagcgccggtgcgctcgtgcagaaggatttctgcgtagcgctttccagatgccatgaacagggaaccaaacgcagcgactagcaggaaccactgggatagctcgatgcctgctgcgacaccacctgccattgcgcggagcatgaatccggaggagacaagcgcaatatcgatcactggcatgtgcttccaaccgaagcagtatcccagctgcagcgcaatgtacacgccaatcacgcaggcaagtgccacgccgtcggtggcgaggaaagacagtccgatggatagtgcaatgagcgccacggccatgccgtatgccattcctactggcaggactcctgcagcgatggggcggaaacgcttggttgggtgctcgcggtcagcttccacgtcacgggcatcattaaccaagtaaatggctgatgcaccgaagcagaacactacgaatgcgatagcaacgtcgatgatcgtgcgctggttgaagatcgcatctgcaccagcagcaagtggtgctgctagcacaagaacgttcttgacccactgcttggggcgcagcgccttgatcatgccgtcagcaaggtttttcggcggttggcgcttcttgttgtcttcgattgccgtggtgtgcggttcggaggttaagaaattttgggtatcgcggtgatgttcagcggcgtgttcgctcacttcgtagccctttcgatcttatggacggcctctgcggtcgctgctcccaacaacgcgccggctagcacatcggttgggtaatgcacgccaagcaccatgcgtgatagcaccatgatggggattcctagcagtggcactggtgacttggtgatgcgcgcaagataaaccatagttgcggttgtcgaggtcgcatgtgaagaaggaaagcttagctttgagggggtgcccacaccaatcctgatggctgggtcatgtggccgagcgcggcggacaactcgtttgatgatcactgatgctgcgtggcttcccagtgcagcgatgaagagtccagcccaggagcggcgacgttttttgtccacaacagcaccgccagcgccgagtgccagccagcctgcagcatgttcgccgagcaggctgagtcctcgtgcggtgggcagtactcctggggcatccatgagttgatcctggattgctaccagaatctgtacttccttattgctcatcgaagacctttccccaggcttcacggctcacaagctcaggatgagcgttgcggtaggcgcgactgagttcgtcgaaacgctctgctacttgcttttgcagtgcgcgtgcttctttgccaagttctttagctttgtcgcggtcgcgcttgcggtagaccacgccgcggccatccgcggtggtaactgttgcgccatcgactcgggacaggctgaaccaacgtgcttcgattggtgcgaagttggcctgtggcacctcgtggtgggaggcatcttccttagacagggagtgcttcaggcccttagccagccacattgccttcttgattggggccaggcgtccaccgatgtccttggttgggacacccggcgcgccggttgctcgtggcagttcggtggcgcttggcagcacaacggcgtctggataggttttgcgaatcgctgcaattcgaggtagtgaggtgtccaggatcgagaagagctgatctggtcctgcaaggaagtccttcattgcttcgttttggattgccacggtggagtattccaggcacagcaggtgcttgaaggtggctttttgcatcgatcggacaatgccgtcgacgctgccttggtggtacatcgcggcaaccacgaggcggttgcggaggtggaagtaggcctgccagtcgatggcgtcgtctttgtcggaccaggccatgtgccagattgcgattcctggccaggttgctgtggggaatccagctttgcgtgcgcgtagaccgtattcggcgtcgtcccacttgataaagagtgggagtggttggccgatctgttcggcgacaacgcgtgggatcatgcacatccaccagccgttgaagtcaacgtcgatgcggcggtgcaggtcgcgggagtttggtgcgtctggcttgtcgtcgaatttaccgcgatcatgtagtgggtgtgcagagaagtcgtggtcgtagtgcacgtgtggtgcggcggtccacatgaagtcgtgtccgccaactacttcgcccatggtgtgaaggtggctgcgctcttgcaggttgagcatttgtccgccaacgaggatgggggattttgcgtagcgggctacctgaagcgcacgcagcactgagtctggctcaatagcaatgtcgtcatccatgtacaggatgtatgggctcttggcagcgcctgcttcgcccttgccgtcgactccgccaagggcttcgaacatgatgcgggagtaaccgccggatccgccgaggttgccctggcggaattcgaagaagcggtcgccgaagtgctcaacagctgccttgtaacctggctcgtcggcagggtgcttgttgccttgatcaggcatgatgacggtatcaatgacggcgtcaactgctgggtcggaggcaagtgcttccagtgctgcaactgcatcagctgggcggttgaaggtcgggattccgacggttgcacgggcttcaaatgggccgacttcagatccatctggcatgatctgggcttttggcgcgtgtggagcgtaccagcctgcttcttcgacggttgcgtcggtttcagcggtgaggtcgaaccagatccagccgccgtcttcgaatggggctaatgaaacttcaaattcgatgaagtcatctttgactacggaaccggtaattccgatgcgtgctccatcgatcttggatcggtagaggtcgacgcgcgcttcgccggaaactttcagtttcagtacgacagaatctagctgtgaccagcgacgccagtagcttgcaggaaatgcattgaagtaggtctgaaaagacacctcggcgccagcggggacggaaacgctaaaacgatcttcccattccaggcgttccttattactttctgcttccaacaggtacaacgacctgacatctgctggctcgccgcgcctcggcaggagcactcgctgtagctgctcaaccgccaggtttgttgcgctcattgacgtatcttcacccttcattgaactcacaatttatcttgcctaagcgtagtatccggaccccgcattcacagaacttacgcgccgtatccgccatggaagatcctggcaattgtatgagattgtctgtttaaccgggctgtctttaaaagattttgcttttcgacgcaccgttcggccgttatctagatctggtcacaatgtcggtttttcatggattcatgtcctttatcggacgtactgtggggagtatgcaaccttttccactgtccttaaccaacagctccgtcgctggtattgcagcgggagcgttgctgtttctctccgtccctttcgcatcgcctgttcacgcgcaaaccatactgcaagacacccttgaagtgactgtgttggataatgccgacgagctcgctccagaggatgaggatttcctcagcacggaaacacccaagattgatttccctgactcagttaccgcagtccggtacatcacgctcacggacaacactgacaaaatcaatgatgacgttgaaaattacctgcgcgccgaacaccccgagtggatccaaacaaactctttcgcccctggtgaagtgatcatcgcagtcggtttcgaccccaacaccatgggtgcctacgcgggtaacgatgtggccgcagagactgggatcgcagaacaagaccgcatcgacggcaccaccgatgcgatgcgcccattactccaagacggtcgcattgccctaggcatgttggagggtgcaaaatcggttgctgatacctctgtcgttcgggaaagctcagctccaagtggtggagtaatcgccgctattttgggtggcatcgctgctctcgtggcaattattgtcgcgtgggctacgagttacgcgaataagaagaaggcagaaaaggctcgtgagcagtttgattatgcatcacgccattatggtgaggtcgcccagcaactcgacggtatcaacgtgcgagcgcactcgctaacttccccactggctgatgatgagctccgcaggcaatgggacgatgtaaattctcgttttcttgaagtcaatgatatttttggcaggctcgaaggtttgacctcgacctcagaaaacaaggcatttcgaaaagccttgccagatattgaaaaagctcatactgccgtgactcaaatggagatcgcacagaaaaacattgacacgctctacgatatggagcacggccatgaagacacccgtcgcagggaattaactaggctgcgtgccgatatgcaggaagcccgtcaagatatcaacgataaagatgcagttgttgacgatattctccgcacgctgatccagcgcacggaaactatcgcaccgtccgcacctgatttcatggaccaatacgcccgcttgatccgtgattatgccgtggcgcttcaaggtgtggaaaagaacctcgagcaggttaaacagaccaccgagcgcaatgctccagccatctacgacgacaattggcgcgtgggcactggctacaactcgtgggtcccgtactacatgatcagttcttggcacgcagctgatgtcagtgctgcatcgtcagcttcttccagttcagcaaataccactttcagcagtggtttcagcggcgctggaggaggttccagctggtaaacaccaccactgaagtcaacgcaccgatggcccagccggcaagcacatcgctgggccaatgcacaccgacatacaaccgagacagccccacaagcagcgcgattacccacagcgtgagtttccaccaccggttcacggagtaccccactgccacggcacatgctgcagcgcccacagcatgaccagaagggaatgaaaagttagtttctacaaccaagtgctctgctgtatttggtcgaggccgttcaaacgccctcttgagaaaatgactgatcagattagccagccccaccgcgatcggggcagtggcgctcttgcgcaacaagccccacacaagcgcatacacaaacatcagtgttggcccggtgagctgggtgaacaaaataatcaccggactcagccaagtcactctcaagccgataaatgcgtcgaggattagctgatccataattctcctttacgcaagtaggagtgcataacaaatgccggttgcaactgctcctgtaacaacgcccgccacaatctccgacatcgtatgatgcttgatccgcatacgtgcccacgcggtgactggggtaaacagcaacccgagtaaccaccacgaagaaaccgtcagaccgaggaacatcactaaacacacccacagcccaacatgaactgaggctttaattttcaacgtcacttgtgcaaacagaactaagaaaatcagtgctgagaacatgccatcccaaatcagctgaggtgcttcaagggctctgaggataaaaatcaaaatgatgacacaaacaatgatgcccacaaacacaaggccgcgctgatttcgggtcgtcacatggtggtttcctaccctgccgagcttcatcaagcccaaaattaagatcatcggaacgattccggttccgattgccgccacaattcctagcgtccaggcgcctgttacgccgcccaggatgaggaaaaatccgatgttgagtacccacggtgcacagatttcactaacgattctggccgcaagctcactgagacttcttttgttttggtcagttgtcacgatctccaaccatatagtgtccgatttcccctctcccgttgactgtggttcaaccacaggatccatccagttttccgtcatagggggtactttcccaaagttatgttttgccaattcattcgatagatcctcgcaaaaagtgcacaatacccactttgcaagaattacaaacgggggcaccctcaatgacttgaaacactttatagagtagaaagtgagtcacgacactttttaaaggaggatgctttgcccgaacaagacttaaccaccttggccaatgattggctccaagcttttgaaaaggccactgctagttccagccctgatgaagctgccactgcagtcgtgcaactttttgaggatgaaggatactggcgagaccttcttgcattcacgtggaacctcaccaccgctgaaggtgcagatgaaatcgccgagatgattcgcaatacgtggccatcaagcatcttccgaaacgttgagctaaagggcgaaccagctgatgaaggagatggtgtcactcgcgtacatttctcctgcgaatccgcagacttcaagtgcacgggcattgtccgccttcgtaatggcaaggcgtggacgctactcacctcagctcgtgagctcctggagcacccagagcccaaggggcgcaaccgtgagatgggcgtcgtccatggacaaaatgaggacacccgaaattggactgaccgcaagaatgatcgacaagcagcgttgggtgtcaccgagcagccatacaccctcatcatcggtggtggacagggtggcattgccttgggcgcacgactcaagcgacttggtgtacccgctctaatcattgataaagcatctcgcccgggcgaccagtggcgtagccgttaccattctctctgcctgcacgatccagtttggtacgaccacctgccttacattccattcccagatcattggccagtatttactccaaaggacaagatgggtgactggctcgagcactatgtcggcatcatggatttggactattggaccaacaccgagtgcctgcgcgcctcatacaatgaggacaccaagcagtgggatgtgacggtcaatcgtgatggcgcggagtccacgctccaccccacccaactagtcatggctactggaatgtcgggcagcccgaacaaaccaactttgcctggccaggataagttccagggtgaaattcggcactcttcagagcaccccggcggcgatgtcgatcgcgataagaacgttgtagttctgggcgctaacaactcagcccacgacatctgcgcggatctttattccaatggtgcaaagcccgtgatgattcagcgctcgtctacacacatcgtgcgttctgattcgctgatgcgcgaagtcttcgggcctctctattctgaggatgccgttgaagccggaattgataccgatactgccgatctcctgtttgcgtcgtggccatataaggtgctgccaggtgtgcagaagcaggctttcgacaagatccgtgaggacgacaaggagttctacgacaagcttgaaaatgctggattcttgcttgatttcggcgatgacgattcggggcttttcttaaagtaccttcgccgtggctctggctactacatcgatgtcggcgcctctgaactggtggctgatggaaagattccggtgcgctccaatgtcagcattgaagacgtcaaggaaaactctgtggtgctcacagatggtactgagctcccagctgacgtgattgttctagcgaccggctatggaaacatgaacaactgggttgctcagctggttgatcaggaaaccgctgacaaggtcggcccatgctggggtctgggctctgaaaccaccaaggatccaggcccatgggaaggcgagttgcgcaatatgtggaagcccacaaacgtggattcgctgtggttccatggtggcaaccttcaccagtcacgccattactcacggtatttgtccatgcagttgaaggcgcgctacgaaggtatgaacactccggtgtacagcaagtagatacaaagaaaagggcatctccgctatgtgggagatgcccttccttttagtgtccgcgttcctgctctagcggtgtgccttcttcaaagaacggcaccagcttgttgtcaaacatgctcagcgcagaaccgatagccatgtgcatgtcgaggtactggtacgtgcccagtcgaccgccgaacagcaccttattattagcagcctcttcagcagccagaaggcggtactgcttcagcatgtctcggtcgtctggagtgttgattgggtaataaggctcatcctcgttatctgcgaaacgggagaactcgcgcatgatgacggtcttatccttggggtaactgtcatcacgctctgggtggaagtgacggaactcgtggatgcgggtgaaaggtacgtccgcatcgttgtagttcatcactggggttccttggaagtcaccggtttctactacttcggtttcaaagtcgagggtgcgccatcccagcttgccctctgcgtagttgaagtagaggtcgagtgggccggtgtagaccacaggtgcgtcggggttgcttgcgcggaggtcatcgcgaacgtcgaaccagtcggtgtcgaggcggacgtcgataagctcatgctctgccatcttttccaaccatgccgcgtagccgtctgtgggaaggccttcgtaggtgtcgttgaaatagcggttgttgaagttgtagcgaactggcaggcgggtgatgttgccggctgggaggttctttggatcagtctgccactgctttgcggtgtagtcgcggatgaatgcctcgtaaagtgggcgaccaatgagggaaatggccttttcttcgaggttggtggcgtcggaggaatcgatttctgcagactgttccttgatgagctcacgggcttcatctgggctgtagtacttgccgaagaactggttaatcaggcccagtcccatggggaattggtaggcggtgccgttgtgcattgcgaagacgcggtgctggtagccggtgaaactggtgaactggttgacgtattcccacacgcgtgtgttggaggtgtggaagaggtgcgcgccgtatttgtggatttcaatgccggtctctggttctgcttcagagtaagcattgccaccgaggtgcgagcggcgttcaacgatgaggactttcttacccagctggctagctgcacgctcagccacggtgagcccgaagaggccggagcctacaacgattaagtcgtaatttttcgattccgtcatgcattcgacactaacttacattcggcgttgccgaaatttcagacacccgatcgggccaagtttctccagttagcagggcatatccacacccagatacctttgtcgttctcacaggctcttaacaacttgcgacacaccctacgaaactttagtcacataggtaccattatccccagaagtgcactaggcttctcagttgtttcatatagtctcagccgcaccaatatcatcagggagaacatcgtgcagcaacgacgccgcatcagcgagactcggaaaaaaccgatgctcgctattattttgaccgccgtattgggcgcatctggccttgcagccgctggcactcagtacctcaatactcagggcgaaggcatcggtccggtcgccgtccaaaacgacagtgaatcgtttaattccggcaccaacgtggttgttgaagacgcagcagtcaccgcccagggtgaaggcggaggcgctcgcaccgtcaaggaattccagcgtgaccagcaattctctagttttgctcttacctggaccggtaaaaaagacatcactgcttttgttcgcgcagaacaggaagacggcacctggtcacagtggtacgacttggagccaatggtcaatgaagatcaaggcaccaacggaactgagctgatctggcacggccctaccaacaagatccaggtttccaccctcaacgtggatctctttggagcagatgctgcagccgctgatgaaaacggtcaagacattccagcagtagatgcagccgaggcagcgccagcagcagaacctgcaccagctgaagcaccagtcgaggaagctcctgcacctgtcgcagaaccagcaccagctgctgaacctatcgctgagccagtcgctgattactcagcaaatgacggcctcgctcccctgccatccaactatggcgacatccagcctgttgccgatgttgatgacggcctaaacgcagtatttatcgatggcaacgctgatgcaggcgtgggtatcgctaacgttgctgacaccgatggcatgccaaaggtgatttctcgtgctggttggggtgcggacgaaagtctgcgctgctcaaacccaactattgatgatggcgtttctgcgatcaccattcaccacactgcgggttccaacaactacaccgaggcgcaggctgcagcccaggttcgtagtgcttacagctaccacgccaagaacctcggctggtgcgatatcggataccagtcattggttgataagtacggcaacatctacgaaggccgtgccggcggcatgaccaatgctgttcagggtgctcacgctggcggcttcaaccagaatacttgggcaatctccatgattggcgactattcctacaacgctccccctcaggaaaccatcaatgctgtcggtgagcttgctggttggcgcgcaaaggttgccggtttcgatccaactggtactgatactcactactccgagggtacttcttacgcgaagtactcctatggcacccgagtgtcacttcctaatatcttcgctcaccgcgatgtcggcctgaccgcatgtcctggcgatgctggctatgcgcaaatggagaatatccgccagatcgctaaggcgaagtacaccagcttgcagaatggcaacacaggtggcacgactaccaccccggcgacaacgccgaaggagacgtcgacaagcaatgctccttcgacgaccactgcccagcctgtaactcccgctgaacctcagcagtacagcgaatccgatgccctggcagctctgctgacaggtggctcttccggcggcaccgacctgctcaatggcgcaaactctgagcagctcctgactggcctgggttccattgcggctgtgctgattgctgcgtctttggctgatggtggcctgaatggtctgatcagcaatgttggtagcaacaacggcgtcccagtgcttggcgatatcaagatcactgacgtcatcccaatcgttgataccgcgatcaacctaaccggagacaataagtactctcgcggttggaacgacctgaacaacacgcttggaccagtgcttggcgctgccactggtggcgaaaccaccgtgaagtacaccagcgaccagaactctgaggttactttcgtgccgtttgaaaatggcatcatggtgtcttcccctgaggctggaactcacggcctgtggggcgcaatcggtgacgcgtgggctcagcagggcgctgaccttggccctctgggacttccaaccagtaatgaatacaccgttggcgaacagcttcgtgttgatttccagaatggttacatcacttacgattctgcgactggccaggcaagcattcagctgaactagtctcaattagagccgaaaaccccgctaccttccctgaggaggcggggttttctccaatcaaaagccaattaaaggccgacccaaatcagctaggcctggtcataagaatgctccactgccctattccattcggcatagcgacgttcgcgctcttcttcgctcatgtcagggttccagactttcttcactgcaataagtttttcgatctcgtcagttgttttgaagaatccagagccgagacctgcagcgaatgcgacgccgacggcggtggtttctacgtcctcgagacgttggacgtcgatgccgaggaagtcggcttgcatttgcatgaggaggtcattttccaccatcgcaccgtcgacgcggagggattcgagggctttgcctgcgtctttggccatggcgtccacaacttcgcgggtttggaaggcgttggcttcaaggactgcgcgggcgatgtgtttgcggttggcaaaacgggtgaggcctgtaatgacgccacgagcatcggggcgccaacgtggtgcgaacagtccggtgaatgctgggacaacatgaacgccaccgttgtcttcgacttctcgggcgaggttttcaatcgctggtgcgttggggattagctgtaggttgtcgcgcagccactgcaccaaggaaccgcccatggatacggaaccttccagcgcgtagaccggagcggatccttcccgttgataggcgatggtggacagcaggccgtgctcggaaatcttcaacgaggtgccggtgttcatcagcaggaagaggccggtgccgtaggtatttttagcagcaccttcgtggaatccgccctgaccaaaaagggccgcttgctggtcgccgagcacgccagtaatcgggacgtcggctagggttccgcggtggcgcacggagcggaattctccgacggagggacgaatctcagggagcatggacatcggaatgtctagggcttcgcatagttctggatcccactgttgcgtgcggagatccatcaatagtgtgcgggatgcgttggtgacatcggtgacgtggatggcatcatcaccgtcgtcgccgcggacaccgccggtcaggttccacagcacccaggtatccatggtgccaaacaaaaggtcgcccttttcggcgcgttcgcgagctccctcaacgttgtcgagaatccacttgattttgggccccgatgggtaggagttgatcagcaggccggtgcggtcaagccacttttcctggccttcttcgcccgcgatctctaggcaaatgtcagaggtgcgggtgtcttgccacacgattgcgttgtagacaggttcgccggtgtgcttgtcccacaccacggtggtttcgcgctggttggtgactcccagcgatgcaacctcgtgtggggtgatgtcaatggagaccatcgcctggctgacgacagatcggatgttgtcccaaatttcttcaggatcgtgctctacccagccctgttgtgggaagatttggcggtgctccttggaagcagaagacaccacttttccttgggcatcaatgaagatgcaccgagtggaagtggtgccttggtcaatcgctgcaacatacgcattggcctttgagattctcatggccttatttttgcacgtattgggccactaagcagtgttttaacaccacctattagaaccaccactccaatacatctgctacaccggcgtcgtcgttggtgcgggtgatgtggtctgacacggctttgacctctggtcgggcgttgcccatcgccactccccggccggcccactggagcatttcaatatcgttgggcatgtcgccgaacgttataacgtccttttgcgcaatctttaggcgctctgccagcatcgatacgcccagtgccttggtcacgccgggcgctgcgatctcaatgagtccgccggacatggagaaggtgacgtggacttgatcctcgggaacggaggcgcggacgatatcaaaaagctgcttggaatcgaggtaatcgctgcgcatcaacaatttggtggctggttcggaaagcacttcggcttcctcgaaggtgccgtgatcatttgagggccacgcgtggctgtattccggggtgaccaaaaacagctcatcggctggatcgtaagcggattttccagcgcgctcgacagcaatactgaccccgccatgctcttccaaagcggcacgcgcagccatgacggcactcgccataacctccggactaagcgtctgagctgcaagaatctcatcggcagcggaatcgtacagcaccgcgccattcgcgcagacgcaaatcggcttcacgctcagctgatccagcacataatgaatccagcgcggcgggcggcccgtggacagcgccagggtcacgccctgattggtcatccgcgtgatcacatcgcgcaggcgttgcggcacgcgctcagaactattgatgagggtgccatcaacatcggaggcaaccagcttgggcgctgaacccagtgcaatcattttttaaagattttccttataaaggtggtgcgtttcttggcgacctttgccgcgcgttttgcttgtcgacgttcccgttcggcgatttccaacattttcgcctgctccaacgttggggcgccgccgccgagggatttcgggcgccacaattctccaccttcgaatgggccatacttttgttcgtaggcggtgcgggtttcgtcgagaagctttttcatagcctcgtagaggcgttccgttgcttcgtcgggatcgccgctggcgtcgacgggttcacccacgctgatgaatacggggatgtgggagcggccgaagtcgcgctcgatgtctttggtgatgatgcgctggccgccccaaataataagtggcagcagcggaacgttagcgctgtcggcgatgcggacggcgccagtttttagttccttgatttcaaaggaccgtgacaccgtcgcctcagggaagataccgacgaggctgccggcgtcgagacgcttccgcgcatcttccatggaaccggcacctgcggagcggtccacagagacgtgcttcatccagcgcatgagggtgccgacaactggggtgtcgaaaatttccttcttcgccatgaatcgaaccaggcgcttaccccgcacgaatgcggggataccacccagaatgaagtcataataaccagtgtggttgatggcgaaaagtgcgccgccggtggtcggaatgttctccgcaccgaagatggaaatctgcacatcctgggctttcatcaccgtccgcacagcactaatgatgatgcgcccataaaacgtctcccgtgactcttcgggatgcagcggaaccttaggcagggaatcctctacgaaaaagccaaaccttttgaccatgtcgaccacgagctttccgcttaattaaccggcttgtttcactggcttgagcacgtctttgcccacgaatggacgaagcgcctcaggaacaacaacagagccatcggcctgctggttgttctccaggatcgcgacaagccaacgagtggtagccaacgtaccgttcagggttgcggcgatctgtggcttgccgttttcatcgcggtaacgagtctgcaggcgacgagcctggaaagtggtgcagttagaggtcgaggtgagttcacggtaggtgtcctgggttggcacccatgcctcggtgtcgaacttgcgggcagcagatgcacccaagtctccaccggcaacgtcgatgacgcggtaaggaacctcgatggctgcgagcatttccttttccatgccgagcagctgctggtgtacatcttcagcatcttcaggcttgcagtagacaaacatctcaaccttgtcgaactggtgcacacgcaaaatgcctcgggtgtccttgccgtaggaaccagcctcacggcggaagcaggagctccaaccggcgtacttcactgggccttcgttgagatcaatgatttcgtccttgtggtaacccgcaagagccacctcagaggtacccaccaagtacatgtcatcgcgttcgaggtagtagatctcctcggagtgatcacccaagaatccagtgcccgccatgatttcagggcgcaccaaaactggagggatcatcatgctaaatccagcttcgcgcgccttctgagcagccaacatgagcatgcccaactgcagcattgcgccgtcaccggtgaggtagtagaaacgtgcaccggaaaccttggtgccgcgcttcatatcgataagtccgagggattcaccgagctccaggtgatcctttggctcgaaatcaaaagtgcgaggctcgccgatggtctccaggacgacgaaatcatcttcgccaccagcaggcgcgccggaaaccacgttggagagcttcatctgcagctcattgactttcgcctcagcagcttcctgtgcagcctcagcatccttcaccttggctttgagttcgttggaaccctccagaagtgcagggcggtcctccggagaggcctgtccgatcttctttccaaaagccttctgctcagcgcgcaaatcgtcggcagccttgattgcttcgcgacgagattcatcagcactaatcagttcgtccacaagcgcggggtcttcgccgcgagtgatctgggaggcacgaacaacgtccgggttatcacggaggaatttcagatcgatcataaagaacaatctaccgtgatcggtagacatgtgggcacttagggcttatctgttttccagccttgctttttactaggcgctcctgtcccgcttcagtcaccaaaaccacacccctggttatgaccagatcggctaaaatgaacaccatgcctgaccaaccgctcaaccaggacggattccctaccgcatccaaaggggtggaacccgacaacctccccgaccgcgttctcgtggacggccttaaaccaaagcatcagcagcttcgtgaaattttggaggaaatctgcaccacccagcttcagcctggggacatgctgcctggtgagcgcatcctggaagaaaagtatggcgtcagccgaattacggttcgtcgggcgattggtgatctggtcgcgtccggcaggttgaagcgagctcgcggcaaaggtaccttcgtggcccactcgccgttgatttcccgcctgcatttggcctcgttttccgcagagatggccgcccagaagctatcggctaccagcaggattttgagttcttcccgcggtcccgccccagatgatattgctgatttctttggtaccgatcgcgcggcccagcacatcacgttgcgccgcctgcgccttggaaatggtcgaccctatgccattgacaacggctggtacaactccgaattcgcacctgacctgctggaaaatgatgtgtacaactccgtgtactccatcctggaccgcgtctatggcgtccccgtcacccaggccgagcaaacggtcaccgccgtagcagccgacgaagacaccgcacggcttctcgacgtcacccccggcgccccactccttcgtatccttcgacagtcactttctggcgataagcccgtggaatggtgcgtttccttgtaccgaaccgaccgatattctttaaaaacattggttacacgctccgaagatctctgacgtgaacccattttggtggcatgatggtgtcaattatgagtacaaactttgacacttcgacgtctccagagggtgaaaccaagaagaactcttctttccgcactgcggcctctgtgcagaccatgcttgttgcagctttggcagcaacggctgctgttggcgtgtactcctacaacacggacaattcagcaaacggcggcgaatcccccacaggacctgagcaaagtacagtgtccaccaccgcaactattgcctcatttaccactgctgacgtgggccaatgtgcaacctgggatgttaacaatgaaggtctagtgtctggttttgaacaaaccagctgcgatcaagagcaccgctttgaaatttctgctcgggaaaacttggcaacttacccaagttcggaattcggtccggacgcagctccaccaaacctcacccgtcaggcgcagctgcgtgaagagctctgccaatctcctaccttggcgtatttgaataaccgtttcgatccatcggggcgctacaccatcgccccgatcctgccacctgcggaagcgtgggctgcgggagatcgcaccatgctctgtggacttcaggcaaccgacgcttcaggcactccacaactcaccgtcggaccgatagcagccaatgaccaggcacgcgtttttgaaaccggcgcctgcgtgaaggtggaatcctccgcagagttccgccaagttgattgcacggaagatcaccacctcgaatcaattttgacagtcaaccttggtgtccccttcccacagggcgcgcccagcacggatgagcagaacaatttcctcggaaacacctgcacccaagcatccattgattacctaggctccgaagaaaacgtctaccaatccaccctgcagaccttctggccaacgattacctccaactcctggttgggcggttcacacagcgtgaactgcttcctcatgtcaccatccaccgagggtgctgcaacatttaacaccctcaacggttcagcgactggcacattcaccatcaacggtgaagttcccccacctcagccagagcgcgatccgctccgtgacactgcaggaacgacagcatccgcggaggtcggagtacctgtagaggagaacgctccatgattgaagtcagcgacgaacgcttcgaggaactggtcgaactagccttcgaccaagttccccagcaattcctggatcatatgcgcaacgtggttttactcattgaggatttcaacccagattcgccttatatcttgggtttataccacggcgttgctctcacagagcgcacattcaaccacggtggcctgccggattccatcaccatttataaaggtgcgttgcaaaattactgcaattcagaggaacaactagtggagcaggtgcgggtgaccgtgctgcatgagattgggcattattttggcctcggcgaagaggacctgcacaggctcggatacgcctaaaacgcctcattaggtgcacagaccaagaacccctaaaaagtgggcgtccttggtctgaaacagcagtttcccaagcctaaaaaacgtcgtttcggaccaaagacccaccaaaaatccgagcctttggtctcaattactcctgccatggcagtgggctgtcagtccagcgcacaacatcccattggctgaatttcttaccgtttggctccagcaccacgaagcggcagttgcccaggtaggtgttgaacgcaaagttgggatccacaccagttgcgtgtgttgccacgatgcggatgacggcgccgtggctgacaacggcaacgtcgcggtcgtcgtcaaggtcgtggctgtccatgattcgatcaagagtcggctggtagcggttcagcacgtctttgtaggtctcaccgccgggaagaccagcggcaggatccccgtgaagccagccgttgagtgcgcgggagtaattcatgtgggcttcttcatcgccgcgcatttcaaagtcgccgacgttgatttcctgaatgccttccacaacgtcgagtggaatcgcaccggactgcatgtcgcgagctttttcaaaggtagaggtggcaagcacggcggtttgttgggcgcgcaacacgatggagctgtacacatgggcgaggcgctcaccggagtaggtggctagttcgtggccaacttcaagggcttgtttacggcccaggtcggtgagttcagctcctggtgggcgggtgtccaggaggtgtttgacgttgttgtgagtctgcccgtgtcgtagcaaaataatccggccggccatggctagttaagtttccttccttcgcttgctgcgcgaacccattcgtccgccttgtgtagcttagctagttggtcggtttggggcgtgctgtcttccgcacggttggagggccaggagccgacgaagacgagttcttcggcttggaggtggagtgcgcggagggcttcggcgacggggatatcgcggatatgtccggatatgtccaggtggaagcggtaggttccgaagactttgcgggtggggcgggattcgatgcgggtgaggtcaacgccgcggatggcgaattcgttgagggcgcgcacgaggctgcctggcacattcggtagggagaaaatgacggaggtgcggtcgtggccggtcggttcggaaacggctgcttgggcttggacagcaacgaagcgggtgcgggcgccacggacgtcggcgacatcatcaacaaggcgttccagtccgaagagttcggctgcgcgggagggcgctgcggctgcgtcggcggttccttcggcaaccatttgtgcgccggcgccgttggagcttgctgaaagatacatggcgtccggaatggtggttgccatccagtttttcacttgttggtacccaaccgggtgggtggcgagggttttgacgtcggcaagcgaagtccctggccggaccatgatggaaaaggcgatgtcgagttcttcttcggcgatgatttgcacgttggagccctggtcaagggcgtcgaaggtgggggtgacggggccgtcgacgaagttttcgatggcgaccaccgcgaactgggcggtgccgtggcggacggcgtcgacagcttcttgtggcgatttggctggtagctgctcgatctcaccgtcgccgaatacgccggcgtcggcaaatttgtagagggcttcttcggtgaaggttccggcaggccccaaataggccacaacagttggtgcgtcgctcatggttacacagcttaacccgccgaactaaggtgggtgtccatgtctgttgctcaattagcgaaccgcttggcccaactctcccccgccgagcatggttttgcatggttcgaccctgaaatcaccgctggccatggcgttggcccgttgcatggcatggtgattccagccaaggacctcaacgatgtcgcaggcatgcccaccgcgttcggaaatgcatctcggcgaaaggtagcaacagataccgatccgttcatccaaaatctcatcgaccgcggcgcgatcatcgctggcaaaacccaaaccagcgagctcggcatgacggcgtattgcgaacccatcgacatggacgcacccagcaacccggttttgcctggtcacacgcccggcggttcgtcgggtggtgcggcggttgccgttgccaggtcgcttgtcgacgccgcccacgcctcagacggaggcggctcgatccgggttccagccgccgcgtgcgggctggtcgggtttaaacccgcccacgattccagcggcggaaacccctccacgcaggggtttatcacccgcgatgtggccacccaagtgcgcttgcacgcacttcaaccacgcaccaggcgcctgcgcatcggcgttctcgctgagcccatccatgctaattcgcttgtcgacgcccccttcctgagcatcctcgaatccaccgcccacctcctggagaaagctggccacgaaatagtgtccgtacccctcccttatggcgcttgggcttttgacgcttatacagaagttttcatgatgaaatccgctggactaaccaacctgggtagccccattacaagatggttgagtgaacaaggccgtagtctttctccttctgatagacaatcaagtgtcaaggcttttgattccgtggctgagactgtacacggagcatgggacatcgatgttttattaacccctaccttggcttatgcacctcccaagattgggtacttttcatccatgccacctgaagaagacttccttgcacaaaccaaatggacgccgtgggcaacgctgttcaacatgaccggtggtgcagccatcagcgtgcctgttgaaggtgtcggcattcatcttggtgggatacgcgtacgagatgaagacctcttaggattagcagcatttgtggaaagagctgtggcatgagtagttcagtaatgtcaccgcgtcgaataaaggcggaaatacttatcgttttagccatcacctttggcatgagcggcctgcgatcaatcctgcgcctcatcgacgatctcctcgcaccggttgcgctcaacgaccagcaagttgcactgaatgcctcaatggcaaactccgcatggctggatctcaccttgcaattgtgttccgccggagtgctgttttcctggggagcactagcgatctacctgctaggtgaacgttttcagtggattaaacccaaagactgggcatggggtgcaggccttgcagcactcattggtattccagggttaatcttctacgccagtgctgttcatttggggctgtccaaacaggttgtgcccaccacgttggaaacctggtgggaaatcccagtacttcttatctggtcagctgccaacgcctttggtgaagagatcgtggtagtcatgtggtttttcaccaggctgcgccagctgaagtggagtgtgcctgcagttatcgtgacatcttcagtactacgcggttcctatcacctctaccagggaatctctgcaggcttgggcaacatcatcatgggagtagcgttcgcgtacttctatcaccgcacgggcaaaatctggccactggtaatcgctcacttcttgattgatgcggtggcttttgtgggctactccgcaattggcgggaatttaagttggttagggctttaaactgaagttcctattttattgggattagaaaaacacgagagatttaaggcaaatccgctaaatacatctgtccctcctaggcgctactctattaaccatggattcaccaggacagggcgagattgcccgcgatagtcaaggacgcccgatactggaccggtatggtcggccggttcgggttcgtccgcaaccgcggcaaactcccccgactcctcgaacccctccggtgaatgaaacaagggtctatcagccaaggcaaacgccaccgcgccagactcctccaaggcagacacctccacgacaaatgcctcctaggcaaaccccaccgaggcaggttcccccacaacagcagtaccagcagcctggtcagatcgggcaggttcgtccacagccgccggtgattgcaggggatggggggaggcgtcgaaaagcaatatcttttaagccccgtggctgcctgggcacgatcgcgggcgtgcttgctgtgggcttggtgcttgtgtttgtggtgacgctgtgggcggattcgaagctgaatcgcgtggatgccacgcctgcgacgcaggtggcgaacactgccggaacgaactggctgctggtaggttcggattcgcggcagggtttaagtgatgaggatattgagcggctaggtaccggcggcgatatcggtgtgggccgtacggacacgatcatggtgttgcatatgccgcgtactggcgagccgacgctgttgtcgattccgcgtgattcttatgtcaatgtccctggctggggcatggataaggcaaacgccgcatttaccgtgggtggcccggaactgctgacgcaaaccgtggaggaggcaactggcctgcgaattgatcactatgcagaaatcggcatgggtggtttggcgaacatggttgatgccgtgggcggcgtggaaatgtgtcctgctgagccgatgtatgatccgctcgcgaacctggatattcaggctggttgccaggaatttgatggggcagccgcgctgggttatgtgcgcactcgtgccacagccctgggtgatctggaccgggtggtgcgtcagcgggaattcttctccgctctgctgagtacagctacgtccccgggcacgttgctgaatccgttccgcaccttcccgatgatctccaacgcggtgggaacattcaccgtcggcgagggcgatcacgtgtggcacctggcccgattggcgctggcgatgcgcggaggaatcgtgacggagaccgtgccgattgcctcattcgcagattacgatgtgggaaatgttgcgatttgggacgaagctggagccgaagcactatttagctccatgcgctaaaaccccaggtaatcgttcacaggaagtgtccagtcaactttttggttaattgattatcttacctagagacttggatacttccctccacggattgctaacgatccagttttatcgttggactcatgaaaaagatccacatgattccagcggccctcctcatcggttcccttgcgcttgttagctgcgcgccttcacaacctacccagaacgcgcagacggtttcttctgtcatgacggaaactcctacttatacctcttcatctaggtcggtggaatctaccgcggggacgatcgctgcctcggaggaagccacgatgacgctactggagaatagttcgggggatccgggatctgattctgggggtgcacgctatagcctcaattcgctcaaagtttctgagcaggccgcggctaacgccgtcttaaaggccgtgcttaacgacgtctcctaccaagagttcgcagactcctcctacttagaaatcacaggaacgccctccgccgacggaacatggggcatctcatttggcggaccttccgaatcggcctccgtggaattctccgacggcagcatcagcttctcccctgttgacatgacagtgcccgcaacacgattgcctcagatgggcgcattttatgaaaccctgaccgaagaacaattaggcatgctggagactggcctcgcggtttccaccgtggattcgagccaacaggaaatgcttctggacttggtctccaactcgatcggcctggcagatactgaaaccactgcgactgcaattagtaaaatccgagcaacgctttccgagacctacctgttcggaacccccgacggattaaccttggcgcttagtggcccacacgttgatttcgaagtctcccaccagggcagcaccgcgaaaattacttaccgcgatccaagcaccgacaccttaaccgccgaagatcgggtagataccgcaagtgtggctgctgctccgccggaggttgtttaggcgtttgccgagaaattttcattgggcctggatttcattgaaattcaggcccttgccattcccgatgctgctaggttcgtgttaagcaaccacaagttgcaccaccattcttccatccagagaatacgaattcgtttacctctagaaaggcactttcccatgtcttaccacgatcacagcgacatcgaatacctcaagaagatcggcgccaactcccctgacgccttcaaagcttttgtccattttgatgaggcagctctccgcggcccgaacaagaaaatcccacgcaactacaccgaaatgatcgcacttgcggtcgcattcacaacccaatgcgcctactgcatcgacatccacactgccgctgcgaagaaggaaggtgtcaccaccgaggagctcgctgaggttgcgctcatcgccgcagcacttcgggcaggcggcgccatgacgcacggcgcacttgccatgaagctttacgacgaaaactagaagcgattctgcacattttttaacatccccaaggcgtgatttcgattttcggaatcacgcctttcccatttccgcgttaaaataccaggtcaacacacacaggaaccgttcagaaaccttccagattgctcactttttaatttcacttttttgagaagttttacttttatattagttctcatgcgcctcaacaaacgactcccagcggcactctccggactgctgctctctgctgcccttcttgccggatgctccacttctggaaccgccgagaccacgacaacaaccgtttcatctgctgcggcatcaacaaccacttccacctcctctgcttcgtcttcctcttcctcctcctcttcctcctcttcctccgactcaagcaccaccgccgaaaccatctccaacaccgcggaagctgcccaagctttcttgtccaccctgtccaccgaagaacaagacgccgtactctacgactacgacgccgaagaaaagtccaccggctggtctaacttcccagtcaccttcgtgcagcgttccggcgtgaacctcaccgacctcactgaggaacagcaagcagctgccctcaacgtgctgaagaacctgctcaacgacgacgcctaccaaatgatcgaagacatcatggctagcgatcagtacctcaacgacgaaagcaacaccaccgaggattccctcggccagtactacatcgcattcttcggcgatccaagcagcgactccgactggtccatccaattcggcggacaccacatcggcatcaacaccaccttctccgacggtgccatcaccttcgccccaacccaccttggcacccagccttccgagtggaccaacgaggacggcgaaaccgttgcagcactaagcaacatgtacgaaaccgccttcgccttctacgacagcctcgccgaagagcagcaagcacagctctaccagggtgaagagttggattccatggtgtgcgcaccgggcagcacgtgcgactacccaaccggcaccggcttgaaaggctctgacctcaccgatgagcaaaaagaattgctcatcgatgtcatcgcaaactgggttggcctcgccgatgaggaaaccaccgaaactgaactcgatgccatccgcgaaaccctggatgacacctacatcaactggtccggcgccaccgagtacgacacctccaccggcgacggcatctacttccagatcagtggcccaaaggtctacattgagttcgctaaccagcaaggttctgcaggtgccgacatcgacggtgtcatcaccgctggatggggccacattcacaccatctaccgcgacccaaccaatgactacgctaactccgtaactcaggaagcagccagcggaatgatgggcggcggccctggtggtaatggtggcgagatgcctagcggtgacatgcctactggtgagatgccttctggcgctccatcaaactaacgccatttaagaggccgaacccgtgagacgagcatttacatcacctcacgggtttggatccctcagaggcgattctgtgaagtcggtttctgctgggcccaggtcagtttctccaggcggttagcattggagaggcgtttcagaccaaaagcgctcgggttcttccgatccttggcctcgaatgacagtttccacgcctacaaagtgctgtttcagaccaagaaccccacttttcgactggccctttggtctctttttcaagtccacccacaaagcgcgtgtccctcatcaaagaagggcacgcgcttgaagtgtttttaagagattttagcggatggtcacctggcgggacttgatgttctccagctgacggcgctcgtcggcgttgagctgtgcatcgttatccagttcagcgacgatcttctcgttgagtgcaaccaaaacatcggcgtaatcggtggatggacgctcaggatcgagatcccacactgggacgacgatgccgtgggtgcggaaagcaccagcgaacttagtttcttcgccgagattcagctcgccacgtgctgcgatgcgtgccaaagcgttgaacagtgcggtttcgttttcggtgcggacccaacggatgtgcgcttttccgcctgggttgacccaccaaacagcgcctgggacgtctgcttcgacttcgtgtgaaggcaggatggagtcattggctgcctgcatgtgctgcgcaacttctggggagaggttgtcgttttccgccagccaccagttgaagtcctggtgagtggtgatttcgagggtgtcggcgtcgttaagcaagctctttagctctggctgggtgccgtccgctgtggcggtggccagtgactcgccggcttttgcgttgatgacccagttcagcgcgaacgcgaggtccttgcttgggttgttggagcggatggcctgctgcattgcaacaaacgcttcgccgccgaatgcttcttcgcggacaagtgccgcagctgcgcctggaagcacggtacagagggtgatcttgcgatcggtgcctgcaacggtgatgggtgcggttgcagatggaatgaattcctgcagtgcaacgagctgtgactccattgccaggccctcgaatgggcgaggttcacgctcaagtgctgcacgttcagccgcgcgggctgcaagttttgcctgacgacggctcatgccctccggcagctgttcattcttcttagtcttctttgccatgcgcattagcgtacatggcgggcttgggatgtgcgttcaaaagctccgccgcacggtccggataattggtggcgagcatgtcgacgccctgttcgcgcgcccacagcatgtctttttgcttatcgacggtgaaaagataggtgggtaaccctttcgccccaatcatccttggatccatcttcgcccgctccagcgacaaccccaaaccggtgggtacaccgcagcgcacatcgcgcggattaccccaacgctcccacgacctgcgcagatgaatgcgatcaagctgtggagcaaggcgagccatgcgatacatcgcgggaagtgcaaaagaaatgatgtggatgcgtgggtcttccgtcagcccacgatattttaagatttttgtgatttcttcttccagcatgaccgcgtagcgcattgggtgcttggtttctatataaaggtgcttatctggataatcctcaaaaatatctaatagattgtttaaagtaagcactttttctggggtttctttggttccaaagttcaagctcagcaaggattccaagtccaaacgcgacacccgaccgcgaccattcgacacgcgatccacaatggggtcatggacgttaaccacttcgccacatttagtcagccggacatcagtttcaattccatgaatcggtagctctagagccgcccgaaacgcagactctgttaattcgggaaagcgagacgataaacctcggtgcgcgatgactttcatgaacccatctctcctggcctttatatacctgctatcgactctagtatccctccaaaccaccagccccgcagcgtgaacggaaataaatacactgcactaattttgtgatgcagattactttttcttttcacgacctagcaaggatctacgaggaaaatgtccggcgggttagatgaagggatttttgaggaagccggatacaatcccaatacagcaatcgattgcatagtttcttaagagggcttgattgtggctttaccgcccgatcggggtatgaaaattccgaccagaagcgccagtagaagtaaattattcagtgataaccattgggtattaagaaatttgtggcttagatctcaatttctgtatagtttgatcatactaattcatccacttccaaattttcacgaaggatcaccccatggacacctgggaacaaacccttggaacagggccactgctaggcattgcagccggcgccattgccctcatcttggttctcgtcatcgtttttaaactccatgcttttctcaccctaatactggtttcaattgttaccgcacttgctgccggcattcccgtcaccgcagtagtggacactctccttgacggttttggtaaaacactcgcctcggtcgccctattggtaggcctgggtgccatgcttggtcgattggttgaaacatccggtggcgcaaaatctctagccgacactatggtgcgaatcttcggtgaaaaacgagcagctttcgcactcggtgtcgcatcgctgatcatgggattccctatcttcttcgatgctggcctcgtggtcatgctcccagtgatcttcgcagtagctcgacgcctcaacggctccgtccttacttttggtatccctgcagctggcgccttctctgtcatgcacgtgttcgtcccacctcacccaggcccaattgcagcctctgaattcttcggcgcacaagttggatacgtactaatcgctggcatcatcgttgcactacccacctggtatttaaccggttacctgctaggtaagttcttaggccgaaagttcccccttcccgtacccgatctactcagtggtggagcacaggaagatgatcagcctcagaacccagctaacgcagtgtcgatcattgtcattttgctcattcctatgctccttatttttggcaataccggaacatcaatggcagtttccgccggcctcctagatgcagaatccaccatggtgaaaattctaggattcctcggcgaaacaccagtggcactgctcattaccttgatcattgccctgttcttcctaggcaaccgacgtggcattaatggttctgctctagagaaaaccatcgaaggcgcactcggcccaatctgttcagtcgtattaatcactggcgccggtggcatgttcggtggagtgctacgcacgtctggaattggaggagcgcttgcagactccatggcagatctaggacttccagttatcgcaggttgtttcatcgtggcagccgtccttcgtgtcgcgcagggttctgccaccgttgcgctaaccaccgccgcagcactcatggcacctgctgttgccgctgctgactttaacgaattccagcttgctgccatcgttatttccactgccgctggttctgttattgccagccacgtcaacgactccggattctggctcgttggtcgactcatgaacgccgacgtacccaccacgctaaaaacttggaccgtaaaccaaacctgcattgcgattgtgggatttgtgatggcctatgcaatgttcggattggcatcgcttgcatagtccgctgaccccattgattcacaggctttaagttcgagaccttaactgcgatttcttattaccgagaccggtcgatttcgggtgataatccgactgaaatcggtgttaagaaattgagcttgaggtcttagtaatgtggtatcgaacttaagaaatcgccctctgtcgtcaacgtactcagagcccttctaaggcgtcgaaaatctgcgatgagcataggtatggatagggccaataaagaggcttagaagcaattctggagcctcatgttttttggggtcgggctccaaaaatctctccacccagtcgaaaccaaacatacgtgacaaaaatactgaaaaccctgcaattttggtacctatgtttggtttatctcgccctcaaccagccctcaaccagacagggaggacaagaatctgggaaaacccaaatccttgtcacccatgtttggtgcgagccgaaccagggtgcccgcaatccttgaagatccaaatgttgggcatctgtttccgaccccaagccgaaaccgtcctatatggccaagcagagatgagtttgaagttcgttggtcacctggtttggtcgaggagcaaagaatgaaaaatggctttaggctcacaaaaagggacctcacagaatcgctcctaagggtttttaatgtgaggtcaataccaaaaagctccctccagatttacaagactttaaaagcactctgaggggcttagggatttgggagttgttaagggcgatttcttaagttcgatttcgtataaccgctaccttgattccaataccttccgctcaatttctcatttccaatttcagtcggaaaagcgctcaaaactgactggtatctaacctgagaaattgagcgctcgaaactgtaaacgtgaaatcgctgttaagatctcgaagttaacgccaatcgcctttgtgagttactcttcccagctcttcaccttgcgcagcagcagcctactctttcgttgggatgcaccaagtttgcggctcatttcggtgaggaccttgatggcgtcgttgatgtgtggtcccttgttcagcatgacgcattcagcgcgaagtgccattgctgcgtcggtgatttctgcgcgagatgggagtccgtttttggccatgttttccaggacttgggtggccaagatggttgggacgtgggcggcttcggcaagggccatgatcagttgggggacttctgccatgcggtcgaagccgagttcgacggcgaggtctccgcgggcgatcatgatgccgaagttttcgtggcgcatgccggtcaggaggatttgggcgaggccttcgtagcctgggatggtctcgattttaaggacgaggccaaggcgttcgacggctactggatctccgatgtcggcgagtgcttggaggaggtattccacgtcggcgacgtttcggatgaaggagatggctgcgatgtcggcgtatttgacgacaaagcgcaggtgttggaggtcttcttcagtgaggcttgggagtggaagttcggagtctgggaggttgattcccttgtatgcggccaggtttacgccttgtgggcgggcgtgggtgacttccaattctacgtcgttgtggccgtcggcagtggaggtcttgtcgatgcagactgcggcgatggctccgtcgtcgaaaagcacgcggtgcccgactttaattgcatcgactgcttgtggaagggtgcagctgatgcgtggtgtgcggccggatccgagggatggatcgtaggtgagttcttcgtcggtaaggatgaggcggtcgccgactttgaggttgatgcgctgaactacggcggggatgccgtagacccgggagcggtcgtagttgtgttccaggagggtgccgttggagatgtaggctttttgtgggccttcggcgaggaccgcgccatcaaaaaccctggtcacggtgaatgctcggcgggatccgcgggtgtctgggacgttgatgacgctgccgatttctagtttgtcgaaccattctggggtgacttcaatcggcagagcggggcgaccgggcaggctttcgggggctgggactggttcggagccgtgggcggtgatccacagttttgcgggcgtcagtacttttccggtttcgtcgcgggttactcgtgcgcgacctacttctgcgcctggggcgatttcgccggtgcgtacttttggtccggcgaggtccatgctgacgcggatttcccggccaacttcttctgcaacggtgtggacgttgtcgatcatctgcttccagacggtttcatcgtcgtgtgcacagttgatgcgagctagattcatgccgcttttggcgaagccacggacaagttcaatgtcggtggcggcttcggtgggcagggtgaccatgatgcaggatggagtatccggtaggggttcgccaaggagaatttcggcgtgctcgtcgagaatctcatcggcatcttcgaaggcatcgacgacatctgagggtggataaagtgggccttcacctgcgaaagctccgataacattgcgggcggccttgaggcgggcctgcactgctggttcggtggtagtcaagcgggtagctcccacagaggagaggcgttgctgcaggccacggaggtctttggtgcgaagatgcgcgtaatgcatgaggttgcgggcaccaacgtaatgggttggggagacctgcccgatggcctcgctgtgagtttgtgtcacctcatcaagttctagaattaactcgtcgagttcagtcttgatctcctggagaatgtcctggtcaaactcattcatttgagctccttaagctacaaacactctaaattccatccaacagtttcattgtgcccgtaaaccaaaaagttggcagcgcaagtgttccaatgaaacacttgcgtcgccaactaggcgccaaagatttagaagaactgcttctgaatttcgcgcagggtatttgcggaatgcttgaagcgttccatctcgtggtcggtgatttctagttcgacaacgcggcggatgcctcggcggttcaccacagctggggtgccgatgtagatgtcttcctcaccgtattcaccgtggagcagtgcagagactgggactgcaacgtcttggttctgcaggattgcgcgggtgatgcgagcaagacccatgccgatgccgtaggaagtggagcccttggcgtcgataatgtgataggcagcgtcgcgggtgtcttcgaaaattttctctagacggccctcaagctctgggtctttgtccagcattcggctaagcgatacgcctgcgatggtcgcggaggacaggactggaagttcagtgtcgccgtgttcgccgatgatgtaggcgtggacggagcttggtgccacttcgtagagttcgcccagcatgtagcggaatcgagcggagtccaggacagttccggagccgatcacgcggttccattccaagccggagaatttccacactgcgtaggtcaggatatccactgggttggacgccacgaggaagatgccgtcgaatccgctgtccatgacatcgccgacgatggatttcataatcttgacgtttttgtccaccagctggaggcgggtctcgcctggcttttgggctgcgccggcacaaatgacaaccatggctgcgtcttcgcagtcagcgtaggtgcccttggtgacgcgggtgcgggaatcggcccacacaacaccatggtttaagtccatgacgttgccttcgagtttcttttcatcgatgtcgatgatcgcaaggtgatctgccatgccctggttgatcagtgcgtatgcgtatgcaactccaacatctcctgcgccaatgaggacaatcttgttaccgacggtttctttcattttcgatcccacttcctgatttccctaaccggacaacccacaaagcagctcagaaaatcagcaagagcttgtgcccggattcctttgttacacctttaattatgcccgattatgtccgaaaatgtggtcagaccaagtgttatttttgttgaaaaaatcacattgtaaatcgagcaaaaccaacctatgccctgcagaattgtgcatgctctgccaagatgactcaatatggtttcgctccccagactagcgtctctgctcaccactcgcctggcaacgcttaaacccgcactaaaacctgccacccacctcgcctccctcggcgcgcaggtcattgcagagctagttccggggatccgaatgtcgccaaaccgcaggcgaatcctccctgcaaatatgggcgctggctttatcggagcggaaatcgcaatgtggtgggctctctcgccgtcattgttgccgaaaccgtggtgggttacggctgctaacctggctgttttacaagcggtggggcatgcggcagcgacgggaatccactcgatcctccccagaaccaaccggcgggtatccaggaaaatttacaacgccacccacatcgcaactggtgccatcacgttgaccaccacggttgtgggattgatcaggcatcgcacccaaatccggctgattgggcagaagaattttggaccgaaggagacgatcgcgggcattagtgtcggcaccttggggtacggcgcgctgctgatcaccggcgaattaacccagcacagtattaatgaggtcaagctcctaattgagaggtttttaccgccgtggataagtttcatcgcagcggtttcggtcattacattgaccactttgaccttggccgatcgcgttttgttgcggcgcatcttgcataattctgcaattcaagcagcgcaccttaatcgcatggtgttcccaggaactgagcagccgtgggagccggagcgttcgggtagcccgtggtcgtatgaaaaatggggtgcggtgggttcgcagggccgtgcagtgttgtcgggaggcccacgcaaagatgacatcatcacggtaaccaggctttctgacacggaaacacatgaaccgattcgtatttttatcggtatggttccgggacgatccttaagcgatcaggtggatcttgtcattcatgaaatgcgccgcacgggagccctgcgccgcgaccacatcgtgatcaacaattccacgggcaccggctggatcaccgattggtccgcccacacctttgagttcctcaccggcggaaactgcgtgacaatttccatgcaatattcttatcttcccagtgcactgagctggtacaaggacaacgacggccccattaatgcggcgagaatgcttatcgacgccgtcctccacgagctagaccagcttcccaccgggagtcgcccaaagctgttcctcgcgggagagtcactgggggcgtatgggttggctgaggtgtggggagacgtcgaaaagcttcttggaaccgctgacggcgtgctgctcagtggggcgccgcgtttttcggacgccatgaatgcgttgcgcacccggcgcgatgcgagcagctccgagcggctgcccgtgattgatagcgggcggcacatccgttttgcgggcgagcctgagcaccttgatatgccggctacctggcagtttccgcgcatgatcgtggcgcagcacgcctctgatccaattgtgtggtggaacgcggagctgtttattcggcggccggaatggttgaaaactcccaagcaagaccaccaagatgtctttccccgcttgcgatggatgccgtttgtaaccggctggcaggtggctttggatttgttcacttcaacctccgttcccggcgggcacgggcacaattatcacgaggagtttattgattattgggcagctcttttggaccgcgaagtcacccccgagctgcgccacagcattgcttattggatccgcgcgaaccacatcaaacgctagagtgattccatgacgcatgcgatcctctttgacctcgacggcaccctcgttgatcacgcttccgccgcccgcgccgccctgcacgcctggtcgccgaccgtgggcgtcgacacggatgttgagcgctggattgagctggataagtggggttttgcccgttttgagcgcggcgaaaccacgcatttaggtcagcggcgcgaccgcatcagggcgtacctcaacagagagcttgacgacgccacctgcgatgatatttactccggctaccttaaagcatatgagcaaaactggactgcctaccccgatgccaagggcgttctcgatcgcgcggtagccaccggtgcccctgtgggaatcctgaccaatggcgcagcccccatgcagcaagacaagcttgatcgcaccggccttggcctgccagaactcgtcatgttggcggcgtccactctggattctgcgaagcctcgccccgaaatgtatgcccgagcgctcacccatttgggtgcccgaaccgcaacaattatcggcgatgattggaccaacgatgtcgcagctccccgcgaacttggctggaatgctctctatttagatcgttccggaaccgatccacgcgccgatatccactccctggatgaactctttcactaggctggcctttattgtttccggaaaggggttgctatgaaaattggtgtcatcctgggcagtatccgcgaaggccgcttcggccaaggcgttgccgattgggtcatggaacaaatcggggcttatgacgcacccgatgtggaatttgaactcatcgacctcaaagctttcaacgtgcccctgttggaatccgcgacagttccaggttccgcggataaacagtacgacgacccgcgcgtaactgcctggtcacaggccattgatgcctgcgatgccttccttttcatcaccccggaatacaaccacggtgtgcccggcgcgttcaaaaatgcgtatgacatcctgggcaatgaatggctgaacaaaaccgtcggtttcatttcctacggtgcagtcgaagggatccgtgttgtcgaacagtggcgtcagatcgtcgccaccttcaacatgtacgatatccgcagccagctatccttttccaccttcaccgagaacaacaacggcacttttgcgcccaatgatcgacgccccggtgaactaatccgcctccttgatagcctcctaacggctgtccgcgattaaggctctgaaatactaatgagtgtgaaagcacatgaatctgtcatggattgggtcaccgaggagctccgcagcggtcgcctaaaaatcggtgaccacctccccagcgaacgggcgctctccgaaaccctcggagtttcccgaagctccctgcgcgaggcgcttcgtgtgctcgaagccctcggcaccatttccaccgccaccggatccggcccgcggtctggcaccatcatcactgctgcccctggccaggcgctttccctctccgtgacgctgcagttggtcaccaaccaggtcggccaccacgatatttatgaaacccgccaactccttgaaggctgggctgccctgcattccagcgccgaacgtggcgactgggacgtggcagaagcgttgctggaaaagatggacgacccctcgctaccgctcgaggattttttgcgtttcgacgccgaattccacgttgttatctccaaaggcgcggaaaaccctctgatcagtacgctcatggaagccctccgtttgtccgtggcagatcacaccgttgccagggcccgggcgctccccgattggcgagccacctcggcgcgtctgcagaaagaacaccgcgcaatcctcgcagcacttcgcgcaggcgaatccacagtggccgcaaccttgatcaaagaacacatcgaaggctactacgaagaaaccgctgccgccgaggcctaaatgtcccgcactctgtgggcggtttcagatctacacgtcaccttcgcccaaaaccaaaacaccgttgatgccctcatgccgcaggaccccggcgactggctgatcgtcgctggcgatgtagcagagaaaatccccgatgtggtacgtaccttatccgcgctggtcaaacgctttgacaccgtgatttgggtgccgggcaaccacgaactcttcaaccggaaaacagaccgcgtcaacggcaaagcccgctaccgagcattagtcggacaactccgagccatcggcgtgatcacccccgaagatccctatccgatctttggtggcgtcaccatctgcccacttttcacactttacgattactctttccgtcccctcggcctcaccgcgaaacaagccctcgcccaagcaaaaataaagctagacgacgaactagccatcgccccctacgtagacatccccgcctggtgcgccgaacgagtcacctacacagaagaccgcctaaaagccaccaaaggcccaaaagtcctggtcaatcactggccgctggtcattgagcccacccaccggctcttccaaaaagacatcgcgctgtggtgtggaaccaccgccaccagggattgggccgtacgattcaacgctctcatggccattcacggtcacctacatattcctgccgaaacccgcgttgatggggtaagccacgtggaggtttctttgggttacccctttgaaaaacacccacctcacatgaagcgtccgtggccgtttccggtcatgcagattaactaactctgttgcttaaatgggggtaattggattcgactgttttccacaccccattgacaattaaaggtgacacgccttacattcttgtggtctgaccatgaggttgggccaatcggtttcagcccgtttactcccgccgtccgtttcagagaagaggtcaccatgacaaccgcagtagatcaaaactcaccgcccaagcagcaactcaacaagcgcgtcctgctgggcagcttgagtggcagcgttatcgaatggttcgacttcctggtttacggaaccgtcgccgcgctggtcttcaacaagatgtacttccccagcggcaacgagttcctctccacaatcctggcgtacgcatccttctccctgaccttcttcttccgccccattggtggcgtcatcttcgcccacatcggcgaccgcattgggcgtaagaagaccctgttcatcaccttgatgctcatgggtggcggcaccgtcgccattggtttgctgcccgactacaacgccatcggcatttgggcaccaatccttctgatgttcctccgcattttgcagggcatcggaattggcggcgaatggggtggcgcactgctcctggcatacgaatacgctccaaagaagcagcgtgggctctacggcgcagttcctcaaatgggcatttccctgggcatgctgcttgcagctggcgtgatctctctgctcaccctcatgccggaagatcagttcctcacctggggctggcgcatcccattcgtcggatccatcctcctagtgttcatcggcctgttcatccgaaacggccttgatgaaacccccgagttcaagcgtatccgcgattccggccagcaggtaaagatgcctctgaaggaagttctgaccaagtactggccagccgttctggtctccatcggcgcaaaagctgccgagaccggccccttctacatcttcggcacctacatcgttgcttacgcaaccaacttcctgaacatccgcgacaacattgtccttctggcagttgcttgcgccgccctcgttgccaccatctggatgccactgttcggatccttctccgaccgcgtcaaccgtgcagtgctctacaggatctgtgcatccgcaaccatcgtgctgattgtcccttactacttggtcctcaacaccggcgaaatttgggcactgtttatcactaccgtgattggcttcggcatcctctggggtagcgtcaacgcaatcctcggaaccgtcatcgcagaaaacttcgcacctgaggtccgctacaccggcgctaccctgggttaccaagtcggagcagcactcttcggcggtaccgcacccattatcgcagcatggctgttcgaaatctccggcggacaatggtggccaatcgccgtctacgtcgctgcatgttgccttctctctgtgatcgcctcgttcttcatccaacgcgtcgcgcaccaagagaactaaaatctaagtaaaacccctccgaaaggaaccacccatggtgaaacgtcaactgcccaaccccgcagaactactcgaactcatgaagttcaaaaagccagagctcaacggcaagaaacgacgcctagactccgcgctcaccatctacgacctgcgtaaaattgctaaacgacgcaccccagctgccgcgttcgactacaccgacggcgcagccgaggccgaactctcaatcacacgcgcacgtgaagcattcgaaaacatcgaattccacccagacatcctcaagcctgcagaacacgtagacaccaccacccaaatcctgggcggaacctcctccatgccattcggcatcgcaccaaccggcttcacccgcctcatgcagaccgaaggtgaaatcgcaggtgccggagctgcaggcgctgcaggaattcctttcaccctgtccaccctgggcactacctccatcgaagacgtcaaggccaccaaccccaacggccgaaactggttccagctctacgtcatgcgcgaccgcgaaatctcctacggcctcgtcgaacgcgcagccaaagcaggattcgacaccctgatgttcaccgtggatacccccatcgccggctaccgcatccgcgattcccgcaacggattctccatcccgccacagctgaccccatccaccgtgctcaatgcaatcccacgcccatggtggtggatcgacttcctgaccaccccaacccttgagttcgcatccctttcctcgaccggcggaaccgtgggcgacctcctcaactccgcgatggatcccaccatttcttacgaagacctcaaggtcatccgtgaaatgtggccaggcaagctcgtagtcaagggtgtccagaacgttgaagactccgtcaaactcctcgaccaaggcgtcgacggcctcatcctctccaaccacggtggccgtcaactcgaccgcgcaccagtcccattccacctcctgccacaggtacgcaaggaagtcggatctgaaccaaccatcatgatcgacaccggcatcatgaacggcgccgacatcgtcgcagccgtagccatgggcgctgacttcaccctcatcggtcgtgcctacctctacggactcatggccggaggccgcgaaggcgtcgaccgcaccatcgccattctccgcagcgagatcacccgcaccatggctctcctcggtgtttcctccctcgaagaactcgagccacgccacgtcacccagctggccaagatggttccagtttctgacgcaactcgttctgcagcggcggagatttaaaagtttctctccttagctattaaaaggtgcccatccgtttggatgggcaccttctcgtttcttgcaatcggcatattcagtcaaaaaatgttgaaatcagcactttcaatttgggacatctactcttaggagaaaagccacaaacctttcccaccccacaaccgtgtgttctgcagtcgacccagtttagaggaaacatgagtgacttcacggaaaatacttggactgtccactacgacgaagatggtgatttcccaaaattcttcaactctctaaaggaacacgagcgcgctgcagttatcttgaccatcgaaaatattctaactcctctaggcattaacatttgccagactgaatggggaaaagcgctgggccagggcctttacgaaattaggattagacataccgtaaaaaaatctcaagaacctcactagaaattcaggctcagaactagccctcaacgctggagaaaactcaccggtgttgcttcgggtattttgtacttttcatggaaagaagattgtcttgctactcggcggatataacaaacagcgagactcttcaaagaagcgccaagaaactgaaattaagcgagcccgaaaagtcctcaaagcatggaaagccaaacagtgaccattgatagaatatgtgtcaaaacatatatttggatttgtgcttttacttgtctcgcgaattggcaataggagtcagcaacatgtcattaaagagttttagttctctagcacaatcagagaagtcaacatggagtaaagaagctaagcaagattacgaggacgcttccgcgctaatcactcaagaactcgcctcacgaaaagctcttggccaaaaactagtcaaggctcggaaacaacgaggagtcacccaagttcaacttgctgaagcttctggagtccaacaggcagaaataagcaagattgaacgtggcctcgccaatcccactttttccacacttgaaagcctcgcatcccacctaggacttcaattcacttttacagaatcagccgcatagcatccaacccttaataaataactccaaaagttggggcaccaattattgaataattggtgccccactttttggacttttattcagttcgatcagacgctaactctgatttttcagaaggcccttggaccttctctcggatctcctcttgaatccctagtttttttgacatcggttcacccaacatggtggaacgctctgcttctgggacaagtgccactcgcccagctgcgacatcgtctcggaaaattcccccgaatgtattcgcctctgatggtcgacgtagaaattgggggaggcagaggcgcctcagcgctagctttgttagtaaaccccactggatactcctcaggaaacatatgtgccaaagcccaagcagtattagaggaatatcctgtccgaaacacctcttgtgggcgcttgcctctttctaaatgaagaagctgagcagcatcaaaaggaatcaaatccttcagcaacgagaaggccgactcaaaatctcgaggcacaataccccttggaaataattgaacaagaccactttatattcccaatactaattagttttctgccgaccaggccctaccaattgcaaaagcacccacattcgcaatgaacgcgggtgcttgaatctcagacagtattagaaaggcatcttcacgccgaggttggcaaagaactcagcgagggagccgccgccaacaaagagtccaccgacgaaaccgaagatggccagaactggagccaagatagcagctagaccaaggttggaggagccggtcgcgttgtctccgtccttgtcatcttcaactgggacttcagattcttcgtcgcggtcctgcttgctcagggtgaactggtcaaccagctcgccggagactgcgtccttagtggtcacagtcaggccttctggggtcagttcaacgttggtgtagtcctgaacctggtcctggttccagactgcggtgtaggtgcggatcttcttctgatcgacggtttcctggaaatccagtccggtgtcgtaacgctggccgagctggaagtcgtagaagtcgtagaacttggagcctgaggaagagttggttgcaaggtaaacaacttcgccggccttagggttcagagtttcaccgacaactgcttcgcggcctgcatcgactggggtgaagccgttcatcaggtgggagcgggtgtagatgtggtcgtgtccaccgagaaccaagtcaacgttcagttcagagatcactggggtgaggcgttcgcgctggtacttaatgcgagcgtcatccatgtggtaggcctgggagaaagtggaatggtggtaggtcaggacgatccagtccttgtcgtcaccgtgtgctgcgacggtgtcgcgaaggaatgcgatgtcgtcgtcgatgtccaagtagtcgttggagtccagggacaggaagagtgcattgttgtactcgaagaagtagttctcatcgacctggttagggcgtgggtacatcgcgttgtaggcgtcgtagttgtactggtcgtggtttccattgttcacggccagacggtagttgcgcagggtttctggggagatgtatgcggagtgctcgtcccagctggagtggtttgcctgatcacccgcggagaggatgaaggaggttcctgggttttcgatggtggcgcgttccaggttgtttgcccagttctggacttcttctgcacggttggagtgggtgttgtacagctgggtgtcgccgaagaagaggaagttccagttgtcaccgtaggtgccggtgttgaaggtttgcacttcggaccagccgtcagcttcggagccgacgcggtaggagtaggtggtgttttctgcgaggctatctacggttgcgcggttgactgcgccatcgcggtattcaacgtattcaccttcagctcggtcgcgggaatcgccttcggtgttcacgatgctgacgttttcagaaactgcatcaacggtgattggggatgcgaaggtatcgtccagggagatctgtgcaacctggccggttaggccctgcgcggtgatccagttgaaaatgagctcggactgggtcgctccaacgccgagaactacgtcgtgtggaactgcggtgaatggtgcatcgcgttcgacgccggaatcgaatccgacggagggtgccgtagcaacggttacagcttcatcggcgattgctggggtgagggaaaaaccaagggaagctgcggtgatgcttgcggtgagcatcatacggaaacggcgtgaagccatgggagaactcctagggagagattaagttagattagtacgaccaagtggaggttattagttatctgtcaaaatctctcaagtaggctgcgaagtcccttaagccacctcgtcatttaatccgagcgcctaatagtgttcactctctagacatgaaacgggggtggcttaattacgttccttctcccggatcagatctagcgcgaccatgcctccaatgatgacttttctgatttcatcaggggcttcttcatcgaaaataagggcgtaggtgcttcggcctaggtatccgttgccagcgccggaccattttcgggttactttcgcaggaatccgatcgcccatgcggaactcaaattcaaatccaaggaagttaccgtgcatttcaataacgcggtcacctggtagttcgatgtccatccgcttgttgaagaaggtgaaacgcttccgcacatgagcaatgggattgccatttggatcatcaatttcataggtgtcgcgaacaaagttcatgggatcgcgcacctgcatcaatggggtgccgaaggcgtcttccagtgtgaatctgcggtcgcccttgaccagccgagagcccaacgacccttcagttttgattctgataacaacttcgccgtctggattgtagatctcaaagttgttagacaggaaggaagaggtctgctggacaatcaacgtgtccgaaagaaaaggattcattagccaattattttactagccacgcagaagcagctacaaccagcgcttccacaccacgatcaagagttggctgcatatctggcgcgaacgctggagagtgatttcccggcgcgttgtcctgatccgccatcatcctcgcaccagctgccgtctcttccgctggctggaaaacggccatcaacgttccgttccacaattcccgatgagaattgaacgcctgcaccgcacccaacagtgatgaaatatgcacatcgtggccacaggtatgcgccaccggagtttcttgaccggtggtgttatccacctgtgtcactccggttgctgcgtattctttgccggatcgctccgccatgggcaacgcatcaatgtcgccacgaagcgcaacaaccggaccttccccattgctgatcaccgcgacaacaccggtgtcaccaatgcgttggatgtttcgaactcttgcaaagacaactgcgggtgctgatggaagaactagtacagttcttcgcggtagctacgcgtgttgtccaggtcggaaagaagcgcgacgatagtcatgcctcaggcgtaatccgaggtggagggatgcgtcgaaaagcaaaaatcttttaagcttctaccccgcacgggatgcccgtggagtgatgagggcagtagccatcgggattcttgtccaggtattgctggtggtaatcctcggcgaggaagtagtcagacgggctaatgacaccgatttccgtggtgatttcaccaaaaccgtgctgcttcagcgtctcaccataggcatcgaccacggcttttacgcgcgcagcgtcctcttcgttctcggtgtaataagcagagcggtactgcgttcccacatcgttaccctggcggaaaccctgagtcggatcgtgtgcttccaggccgcgggcaacaagctgctcgagggaaatcttcgaaggatcgtaaacaacctccacgatttcagtgtggccggtgcgcccagaacacacctcgcgataagtgggattaggggtgaaaccgccggcgtaaccaaccgaagttccctcaacgccatccatctgccaatacatttgctccacaccccagaaacaaccaaggccaatccaaattcgctgctggccttctttccacggaccagtcacaggagttcccaacacagtgtgcggcgcaggattttctaaaacaggatgcctgccacctttaagcgcctcatcagcggtaaccatcacgggttcgggtgcgaaaaaccatgccataacaggaatgttcctttcgaaaattgaggaagccttatgcccttcaaccctacttagctgccaattattccgggcttgtgacccgctacccgataaataggtcggctgaaaaatttcgttgcaatatcaacaaaaaggcctatcattgggaggtgtcgcaccaagtacttttgcgaagcgccatctgacggattttcaaaagatgtatatgctcggtgcggaaacctacgaaaggattttttacccatggctgtatacgaactcccagaactcgactacgcatacgacgctctcgagccacacatcgccgctgaaatcatggagcttcaccactccaagcaccacgcaacctacgttgcaggcgcaaatgcagcactcgaggcactagagaaggcacgcgaagagggcaccaaccctgaccagatccgcgcactgtccaagaaccttgcattcaacctcggtggacacaccaaccactccgttttctggaagaacctctcccctaacggtggtggcgagcctaccggcgaactggctgaggctatcaaccgcgacttcggttctttcgctaagttccaggatcacttcaactccgcagcactcggcctgcagggctccggctgggcagttctcggctacgaccacatctccggtcgcctggttatcgagcagctcaccgaccagcagggcaacatctccgtcgacatcaccccagttctgatgctcgatatgtgggagcacgctttctacctgcagtacaagaacgttaaggcagattacgtcaaggctgtttggaacgtcttcaactgggacgacgcagcagcacgcttcgcagcagcttccaagtaagcatttttagtacgtgcaataaccactctggtttttccagggtggttttttgatgccctttttggagtcttcaactgggtagcgttaggattcaccatttccggcgggcatccggcgaaaaatggtgaatccacacactgttgccgggcagtaagtacttttcgccgatcccgatcgctaggccagctgtggcaagccccgggttgcaaattttcgtccccggccagagcgaaatcgccaattcccgatcgaaaattcgcgccaatccatagagatcatgcaaaaactcgttcgatttccaggcttcccaagcgatccgtgacgagaagtttaacagcaatcttgcagcaagcctccaggattaacaccaacccccatggccacaaaaacaccagccccagaatcgcccctaggggcccctaacgcacaatctggaccaactcctagtcatcgggaaaactcaaccccttaaaacggcacccacgacacttacagctcagccctcttctaatgcatacctcgatcccgccacgaacttccggaagttatccaccgcaggtgccggccccgcgttgagtcgccacaccaaacctagttccctataagcgggtggactaagtgggcgttgcacgattcccactgtgggaaggtacggatcatccatcggaaccacaccaacgccgagacctgcgctgacaagccctgcgacggtggtgagttccatggattcgaaaaccacattgggaacaaaaccggcttcttcggctaatgcatccatgaggagtcgggtgccgaaacctgctcgcatcgccacgaaaggttcttccgccgcagtaatcaacggcaattctccttggccagaaaaggaggcaagccggtgatctgcgggaacagctagggcaagtcgttgacgaagcagtggcgcccaccctaaagaggtaccaacctcggcaggtttggggccaactaatgcgaggtcagtttcatcagccaaaacacgatctaccaggagcattgctgccgcttggtggagttggaattctacgttggggtgttcggcgcggaatgttcggataagttcggggaccatccaagtgcccaaggaatgcatgaagtccagtcggattgtgcctttttctgggtccatgaggcgtttgatttcagttgcggcggagttgaattctgcgacgatggcgctggcgtggttgaggaaggcgtggcctcgttggttgaggacgagtttgcggccggcgcggtcgaaaagtggggtgcctgcgtgtttttccactcggctgattcgtctggaaagtgtgggctgcgggatgcctaatctttcggcagtttcggtgaggtggcctgattgagcgactgaaatgaagctgcgtaggtcgtcgattcgcaggtctccgccgtcgttgcccatggtcacagcctacatgcacaaagtgaatcaaaaacagctatttctaacattttactaatatttgctgttggcgcatgatgaactccatgagccaagcaatagatagcaaggtcgaggcacacgaaggccacgaaggccacgaaggcatcgagcgaggaacacgcaattacaagcgcgctgtgtttgcgatgctggccgccggtcttgctgctttcaatggtctttattgcacgcaggcattgcttcccaccatgacggaagagttgggaattacgcccactgagtccgcgctgacggtgtcggctacgactggaatgttggcgctgtgtattgttccggcgtcgatactttcggagaaatttggtcgcggtcgggtgctgacaatttcactcacgttggccatcatcgtgggattaattttgccgcttgtccccaatattactgctctcatcctgctcagaggtctccaaggtgcgctgcttgctggcactccagcggtggcgatgacctggttgtctgaggaaattcaccccaaggatattgggcatgcgatgggaatttacatcgcgggaaatactgtcggcgggctcactggacgtatgattccggcgggactacttgaagtaactcattggcaaaacgcactgctgggaagttctatcgctgcgctgatcttcggcgtaatcatggtggtgttgcttcccaagcagcggaaattccagccgaagaatatcaatctgcgccatgagatttcggcgatggctgctcattggcggaatcctcgtttggcgttgctttttggtactgcgtttttgggcatgggtacttttgtgtcgctgtacaactatttgggtttccgcatgattgatcagtttgggctgagtgaagtgctggttggtgcggtgttcatcatgtatctggccgggacctggagttccacccaggcgggtgcgttgagggagaagatcggcaatgggtcaacggttattttcttgagtctgacgatgatcgcgtcgatggcactgatggggattaataatttgtgggtcacgttggttgccctgtttgtgtttaccgcggcatttttcgcactgcattccagtgcttcgggatggatcggaatcatcgcaacgaaggatcgcgcggaagcctccagcatgtatttgttctgttattacgtgggatcctcggtgattggttgggtttctggattcgcgtttacgcatttgccgtggttggcgttcattggctggttgattctgcttctttgcggagtgctggcgatttgtgtgacgctggcaaggcttgcccgcaacgccaattaatacgagtttgtccgtgtttaaatcggcgctattgttgaatccatgagaagcgattccacatggagcagtcggacttggcacagaaaagctagtagaccagtatcgatttggttgatggttctggtaatcgccggaataatccacccgctcctgccggaataccgttgggttctcattcaccttttcacccttggtgccatcaccaattcgattgtggtgtggtcgcagcatttcacggaaaagtttctgcatttaaagcttgaggaatcgaaacgccctgcgcagctactgaaaattcgggtgctgaatgtgggaattatcgtcacgattattgggcagatgatcggtcagtggatcgtcaccagtgtcggcgcgacgattgtgggcggtgctttggcgtggcacgcaggcagtttggcatcacagttccggagcgcaaaacgcggtcagcctttcgcgtcggcagtgatcgcgtatgttgccagcgcgtgctgcctgccgtttggcgcatttgccggagcgttgttgtccaaggagctgtcgggacatctccaggaacgagtccttctcacccacacggtgattaattttctaggtttcgtgggatttgctgcgctcggttcgctgtcggtgctgttcgccgcgatttggcgcaccaaaattcgccacaatttcaccccgtggtctgtggggatcatggcggtgagcctgccgatcatcgtcacgggcatcctgctcaacaacggctatgtcgccgccacaggcctggccgcgtacgtggcagcatggttgctggccatggtggggtgggggaaggcgtcgataagcaatttaagcttttcgacgtccacctccaccaccgcacccctttggctcgtgggcacgcttgtgtggctggcggtgcaggcggtgatgcatgacggcgagctttaccatgtggaagttcccacgattgcgctggtcatcggctttggcgcgcagcttctgatcggtgtgatgagttatctactgccgtcgacgatgggtggcggcgcgagcgcggtgcggactggaacgcacattttaaacactgcggggctgtttaggtggacgctgatcaacggtggcctggcgatttggctgctcaccgacaattcgtggctgcgcgtcgtggtgtctctgctgagtatcggagcgttggcagtttttgtcattctgctgcccaaggctgtgcgggcgcagcgcggagtgatcaccaaaaagcgcgaaccaattactccgccggaggagcctcgactcaatcaaattaccgcgggaatctctgtgcttgccctgattttggcagcattcggtgggctcaaccccggtgttgcgccggtggcaagctcaaatgaagacgtctatgctgtgaccattaccgcaggtgacatggtgtttatccctgatgtgattgaagtgcctgctggtaaatcactcgaagtcacgatgctcaacgaagacgacatggtgcacgatctgaaatttgccaacggtgtgcaaaccggacgtgtggcgccaggtgatgaaattacggtgaccgtcggcgatatttccgaagacatggacggctggtgcaccatcgctgggcaccgcgcgcaaggaatggatctggaagtaaaggttgcggctccgaattaaccaagggctgctgaaaaactccccgccttggtctcaatcgcacacttcgacccgcgaaaactgtgcatttgagaccaaggacggctctggagaatccttccttggtttaaatattccccagcacaggtgccgtgcgcgcaccttgtcgaagccaatggcgaaccgctgcggtggccctgcaatcatcgccgttgtagctgagcaattgagcacgagcggcctcagcttctggttcggcagccgtggaagcaatgagatatgcgtggaggctatcttcacctgcgaagtcttcttcctcccaatggaatccagctgccggcgcgagttgtttcagacctaaaccaccggggccaacaagttgggagcgcgcgacagcaaacatgtcattccattggtcagagctaatgaagctgcggatttcttgctcgtcgggcacacctttgactttgccgaagaatctgcgagcagtggagagcatccagtggttttcgccgttgctggcatagcagaacacaccgaaggtttgtccctgctggcgagctttgtcccggcgcgatttcagccaggaccagaagcgagcaaagttctcaccttcggcagcctcaccgagatcggaccaaatgacaaaaggtatgtacgttttgccgtcccaagctccccacaaataggcacctaaatctaggtaggcttccacatcgacgtcgatttccacatcgaaacgtggggcgctggtgtgcgcctcgcgtcgaaggacggggatttcggcgcgccaggcggcagcgacgtgggagatttcgccgaggttggcgtcgataagcgctgttgtggtgttgatgcctttttcgcggtaggtgtctgcgcggtcgccggtgaggaagaggctgatgtcatcggcggctttgagttctggttcgcatttgggccagaatctgcaggttgcgcactcttttacccgtcgaggtgctgtcggcgccggggtcagcaacgcgcggtgagctgcaggggcgtagcgggtgacatccactaggtatgcccaatcgcggtcctgtcccacgacggcgccgatcgaagactcgggtgctgctccagcttcctccaaacccatcaacgcgagggtgaggcgatagccatcgatcgtgtggtggcgcagcgttgccttgagctctagcggctgacccaaaccgaggcgggtgacggcaatgccctgcatagttttgtgcggatccggacgggcgacacggtgattgctcaccatcacgggcatgtagcttccatcagggttgcgcaccaagacatccacttgcacttcccatgccaccccttcgagggtgcccgtgaacactgcgccggtaatcaaggtgtcgccggctgcaattgcttcgagggtttcaaactccgccaattcagcatcattgtctagatctgccctggtgaaaggaattcggccccgctttttgggctgctctgggagacgatccaaaacttccgtcaacccaacctcacggcgggccctgcgctgcattgttgcaggtaaaggagagatttctgggaaatttatgcgctggacctgacggtacctacatcccaccagatcacttggcgttaaccgttccgattgcattcttcccacaatgacatgagcttattgcaacatcgtgggtaaagttgaatcgagaagtcgagaaataaccgaccgatgaaagagttgagacgataatgggcatcttcgaagccatccgagccgcacgcgcgaagaccaaagctgagatcaaagcagccgaggcaaaagtaaaaactgaggcgaaaaacaaagcaaagctagatctcaagcgcgagaagcttcttgtccagcaggaaaagaatctgctcaaggttgaagaaaagggcctgaagaagcgcaacaagcatgagctgaagatggccaaaaatatccttgagcaaaagcgccaaggacgcctaaacaaagacaaggtgaagcgctgggctggcaccgcacgtgtgctcactccactactgctgcctattatttatcgactctccaccgaagcacgcgatcaggttgttaagggacgtgcccgtcgtgcaggtgtcaccgcggagcagcttagccaattcgcaggtcacgcagcagcgctgaaggctcgtattcaaggtgttcgcgaaaccgcaaagaactccagcctccctgctggctttgtacgcgatgttgaagagcgtctcaatgagctcgaggctgctgcgaataactctgagttcatgtctccacagcagaggaaccgtgcgcaccagtcgatcagtcgtgatctgaaccaggtgtcagatcagattcaggatcgactactggacaagtagctgctggtcgagtcgctgccgggattattttgcttccaccacagtggttgtggtggggatgaaataggagatgaccgcagccacaagcgcggcgcagcatccgatgatcagagtggtcatgaatccccctaaggtgggtactccgccactcatcattccggccaacactgcaccgatgacagctgatgagccggtggtgcccagtgaacgcataagagagttgaaaccattcgctgcggctttctccgtggctggtacggcacccatgatcaaggcaggcatggaaccaaatgccaggccaatgccgataccgaccacgagactacacactgagaacagcaccagggtggtcaaaataagtgcgttgtctgcatctcctcccggtgtgcggttgccgatagtgaacaacactgtggcagtaagtgcataaccgactgcgatcacaacacccgcaattgtcagcgtcacacgaggaccatgagcagcgctaatggctgcacctgcattcgaaatcaacatcatgcctagacccatcgggatcagccagatgcccatctgaagcatgctctggcctagaccgtagcccagaattacaggcagctgcatgacctgaggcaggatcagattcattccatacatggtgaaaccgatgaggatggacgcaatatttgtcatcaacacggtcgcccgaatagtggtgcgcagatcaatcaaaggggatttctggcgggtttcgaaccagccccaacccaccaaaatcaccagcgctgccacgaataacccaatggtcagggcacttctccagccccattctgatcccttggacaccgcgagcaacaatgcgataagtcccattgcaaggccgagagcaccgaaataatcaaagccgccactcctcacgatcctgggtctagcaggaatcgccttccaaatgaccgcgccaactgtaagcgctaccagagcggtgaaccagaacagcacccgccaggacgcaaactgggcaatagcagcagccagcggtagaccgagtgcaccgccaatgcccatggaagaactcatcaaagcaatggcagaccctgctttctcccggggcaacaaatcatgcatgagagaaatgccaagaggaatcaggccagagccaagcccctgaaaaccacggccgatgatcatcggaatcaaatccaccgacacagcgcagatcactgatccaagaatgaacgggacaagtgagatgagcatcatctttttcttgccgtacatatctgcaagcctgcccatcacaggagtcgccactgcgcccaccaacagcgtcacagtaatgatccaagaggcattagcagccgtggtgttgaagatctcgggcaaccgaccaatgatcggaataaccagggtctgcgctagggaaacagtgataccagctgaggcgagagtgaccaccagcaggccgtatttgatctgtggtgtggctgattcgggaggactcgatgacattatgtgtatggtacacattttgtgcaagatgcaatagctggcaaactggagagccatgagcaccgaccccatcgcggccttggaatacgaatccaccatcttcgcccgtcaccggaatcaatacaccggccaagcaggtacgaatgctggcgtcctcgattccagcggctacaacctactcacgctgctccagttacgtggcccctccaccatcggcgaactcagcgccatcaccggcctagacgcatctacccttaaccgtcagacaaaagccctactaaccaaaggatttgtcgaacgcatcccagatcccgacggtggaatcgctcggaaattccaccccaccgacctcggcaatgaactgctcaacgaggaacgcacatccagccaagaaaaatatgccgagttactttcagactggcccgaagaggatctacgcaccttcgtcaaacttcttgaaaaactaaataaagccgtggagacacgcgtcggaaagcattggccgcgcccctgactcagcccaagccagagcccgtgcccctgctaaagcctcgggatgctcccgtaggccaaccccggcgcggatacctaaagccttgcagcaacccccgctacagcagcccctgctcacgtgcggctgcgacagcggaggtacgtgaccgcacgccgagcttgtcgtagatgtgcacgaggtgggatttcaccgtggcttctgagaggaagaggatacggccaatgtcgcggttggaggatccaccggcaaccagcttgagaacttccagttcacgtggggtgagtgaggttttgggggtgcgcacgcgagtcatcaggcggttcgcaaccatgggtgacagtgtggagtcaccttctgctgcggatcgtactgctgccaggagttcgctcggtggggcgtctttgagcaggtagcccagtgcgccggcttcgattgcgccgaggatgtctgtgtcggtgtcgtagttggtcacgaccaggacttttggcgggttatcgatgtttcgcttgatggctgcggtggcgtctgcgcctgtggaaacctgggttccttggacgccggggccgaatcggaggtccatcaagatgacgtcgattccgccttcttgggctgcctgcaccgcaccttcggcggtggagacttcgcccaccacttcaatgtcctcggcgctttccagcacagctcggagtccgagcctcacgatttcgtggtcatcagcaagcagcacgcgaatcattgtttgaactaggtccttcccaatggcgcacttcgtttcgaatgaaaatgcgccttcaagagtatcgatgagcagatgaatcgtactttagtctagccttactcatcgtcagttggagaacttagttcaacctcgcctgtagcacttgagtccgaatctgccaaaaccggcgccccgacaaacccctctggtggctccaccggcaatgctgcagataccgcagtaccctgcccatatgcagattccactataacttcgccgtgcaattccatcgcacgctgctgcaatgcggttaagccgatatggccaaggccagcgggggtactggacacttccgaaggctcaaaacccacaccgtcatcaaccacatcaaggcgtacttctgtgtcttcgtaggttagtgtcacgtggcagtttttcgcctctgaatgtttcgccacatttccgatcgcaccttgagcaattcgcagaagggtggcttcagttttcatgggcagttggcgaacatcaccgtcgacagaaatcacaaaattaatacccaacaacggttctgtgacgcggtgaagtgctgcttccaaggaggttttagacagcgctgccggttgcaacgccgcaatcatcgcgcgagcctcactgagattgtcggaggctgtttgtcgggcaaggcgcatcttcttcacgatcgcctcctttggcttctcttccatctcagcaacgagaatctcctgttcagagacatgcagcagcatttgaatggaggagagtccctgggcgaccgtgtcatgaatttcatgcgcaatacgttgacgttccgcagcaatacccgcatttcgttccgtcaccgccagctgggagcgagtttcaatcaactgatcaatcaattcctgcttttcattattcacccgccacaacgtgcggaacgcgtaatcaatagccacggtcacgatcgcagagaccaccggacccatcacaccaccaaaggtcaaccccacggaatactggctggcaatcgcaatcgctgtcgcacccaaaatcgcaataatgcctctcacgtcaggcatcacctgtagatagaggaaaaacagcgggaacagcagataaatggacacgggcacgatcggcaccataaaaatccacaccagcgtcagcacaaacagccagcccagctgcatgccgtggctcaaatctacgcgtttggttgatccatagaagtacagaaaaccccacacaaacaacagcacgcacgacagcgcaaacatcggcagcgtcaggcgggcggaagctcccaaccccacgaccagcagcgaggctgtcaaaatgtggatactgttgcgatagctcatcgcgcccggttgattccccttcttcacaagggtttcaacatcgagctcattgcgtccggtttccgacacacgatctaggcttgactgcatgcgtcgtacattacctactatcctcgctgcttccatcatgctcaccgcttgtaccccggcggaacctgaagcaaccccagagaccaccaccgaggcagccccggaagtaattactgacggccttcccatcgacgcgatgcccgcggtcgaacgcaccgcacaaaccgcatgcccctacctgggcaccgactgggtcgccgataccaacggccagcgcgtcacgggttacggcacagacgaacgcttttcgacgccctcctgcgttttttactcctaccccgaagaaccacaactcacggtgattgtccgcgatatggccaccacggatgacgctatcgcggtagtggattgggcagcccccatcgattccactgagcccgctgaggaacccgcagggtggtccggtggccgccgaggtggaaacgatacttcaggcgcactctacgcggttcaaaacggccccaccgcggtcatcgtgttcaccaatcaggatcaatccctcaaagcgcagttaatcgctgaggaagtaatccagaatcttggtctctaactattagaaggccacatcgttatatggcatcagtgtggacacccatgggaacacaacatccatgaggaggaagaacaccaacacaatgagcgccaatacgatgagaagttttacaaaccaaggtcctggaagatagtgccacagaagtgaatacatttagttttcctccaaagctgcagggcgttcgccacttgatttatcgatttcttccaccaacattgcgtgcacaatcatgcgctcagcgttggagaactgcgggtgacacgtggtcaaggtaagcagagcttctgatccttcacgcactgcagtgtcgaagacgcccggtgtggggtaggtggcatcgatgcgatccggagtggtgatgcttcgtccggacacattcacatagtcaccttcagccatgcggctgacctggttttcgttgaagcaatccgcagcttctgctgcacgatctgcaccgttggtggacatcggcatcacgcggtacacatcccaggaattgtaagtctccaccacgatcgcatcgcagacttccaggtttcctagatcattgaatggcgcacccttgcccactcggtggcctgccactgcaaagtttccggcttcaccaggcatttgggaatccacataacggccaggaccggcaagaaggtcttcctcatcggttccttcaatcactgcgaagttgaagtcagagccgaaagctggaacatacatccgggcaaatgcctcaccaagttccggggtgagcttttgtcgaggattcacccgagcttcattccagtcttcatcaagcttttgaccagccgattcttgtaatttcccagattccacgttggtccaataggcctcatagtatgcgaataacaaggccaaaatgcctacggtgagcaagatttcaccaacaacctgggaaacactcactcgaggccgcggctttttaccattgcgagaagattccgcgcttaacgtggctgtcatcgttactgttttcgtccaaaatctttgttaggcgaatctcaacgtccttttaggtacccgtactttcagacacgtaccatgagacaagtgcacatgagatcaattcatatctcaaacattgtacatctgatcagcaatagcgattattgcttgattgtgtgtttttagatcttcggttctcttcactcaactgctgtgaagtgccacctgtttggaaaggcgaacacgatagtgctcgatattttgatttacccggtgtctggagtgatgaagctgtggcacctgcttcttcacaacgttgcgggtttggacgattcactggcgtggttcttttcccttttcggccttgtcatcacgatccgtgcaattatcgcgcctttcacctggcagatgtataagtcgggccgcactgccgcacatattcgtcctcaccgcgctgcgctccgggaagaatacaagggaaagtacgatgaagcgtccattcgggagttgcagaagcgccagaatgatttgaataaggaatacggcattaacccgctggcaggttgtgtgcctgggctgatccagataccgattgtccttggtctttactgggcacttctccgcatggctcgccctgaaggtggtttggaaaatcccgtcttccagtcgatcggcttcctaactcctgaggaagtggaatctttcctcgctggtcgcgtgagcaatgtgcctctgcccgcttatgtttcgatgcccactgagcagctaaaatatttgagcaccacgcaggcggaagttcttagtttcgttttgccactgttcatcacagccgcaatcctcaccgcaatcaacatggcgatgtccatgtaccgcagcttccaaaccaacgattacgcatccggattctctaacggcatgctgaagttcatgatcgtgatgtcgatcctcgcgccgatcttcccactgtcccttggcctcacaggaccattccccacagcaatcgcactctattgggtcagcaacaacctgtggacgctcctccaaacaatcatcatgatggtcattttggaacgcaaatacccacttaccgacgatttcaaagtgcaccacctagagcagcgcgacatctaccgcgcaaaacaaaaagaaaagcgcatcttcctgtggacacgacgcaaaaaccgcgccctgatgattctcaccccatggaacgcctcaacgcttcacgcaacaaacgtggaactcaccaaaacccgtactgccgaaatcaacgaagcaaaacaggcccgcaaagaaatcgcgaacaagaggcgcgaaacgcaacgtgaaatgaaccgcgccgccatgcagcgcttaaagcagcgtcgcgctgaggttaaagctaaaaagaaggggcttatcgacgcctcccccaacgaagataccccttcggaaaatgaagaaactaaattgagtagtccgcaggtggagccgacaacaactgccgagccaaatcgcgagccgtctcaagaggactgatgttgtggaccaatcgagatccagcaagtccaccatcaaggaacaccaacagctgattcgcctgggtggtgcctgggtagccgttcttctcagtgagcaaatcagtcagagtcttatgacaccactcgcggtgctctaacactgctgcaacaatgcccttttcgctatcagtttcggggcgagggtactcactagccgcattctgaaagtgcgagccgcggaaatctttttctggttcttcctcaatgcactgatcaaagaacgcgatgattttatcttccggatccttcataccgacggtgcgctcacgccacgcttcacgccacagctgatcgaggttctccaggtatgcaataaccaaggcgtccttcgatccgaaaagggaatagaggctcgccttcgccacgtcagcttcacggaggatacgatcaataccgatgacgcgaataccttctgtggtgaaaaggttggttgcgctatcgaggagacgctgtcgggggcttggtcgattgcgacgacggtttgccccggcacttgttttactcttgcctgaagcgctagcagccacgttcggccacgtcctttcgggttggtctgtttcaagatacgacgaactgtctaacaccaatatagacaaaccggttcgtatagttttaatccacaggcaagtctagcgctttttccaccccaaaatgaccaaaaggcctgttgatatcgaaatatcaacaggccctacggatttaaagcagattacttcttccgagtgaagaactgcacgatcgtcagcaaaatgacagcaccaatcagacatgtgatgaagctgaagatcaagccgccaccggcaacatccactccgaagattccaagcagccagccgcctaacaaaccaccgataataccgacgactatgttcagcaaaattccttgctgagcatcagtgcctttaatcttggaggcaatccaaccagctagaccaccaataatgatccatgtaatccaacctagggcaagcatgtggttctccttttctttcggtgaatgctgccaattttaaccggctccgctccaaaggtgtcgacctattccaattattcattgtattgttattaaaaggtgatggcctaatttctcgatttaagcgcccgaattccccggaaggattaagtacctcagtggagattggagaggcccttagaagcaatcctgtgaggtcaaacttttaggagtctcggccatgaaatcactctttacaagacaaaccaggcaggcgtgacaagatcggcgaaaaagccgaacttttggcacgtgtgttcggtatctcattgcctaaaccagacgggcgtgccaaaacctggcggaaatccagattcttggcacgtctgtctggctgcccttggtttctccctttcgaatggcccgaactaacccgcaaacaccaatgccccggcctccctgcacaaaatcaggaaaccggggcatcgaaacttaaaagaaactacttcttaatcttctcaggtgggcgaaccaccatcattgggcacggtgcggattgcagcagtgcgcgggaggtggagccaaggagcatgcccttaaatccgccacgaccatgggaaccaacgactaggagctgcgcgttttcagatgcttctgcaagtgcgcgaactgggcggtcacgggtgatgatcttcttgacggttacacttgggtacttttccaccagtggtgcgaggcgttcgatcagcatgtcggtttgctgacgttccacttcatcccactgctgttgagcagctgcaagacctgcaagtgatgcctgtacctgcatgtccatccaggtgtgaactgcaacgagttcggcgccacgagcttcagcttccgcaaatgcgtattcggttgcctgttgggagacttcggagccatccacaccgacgacgactgggccgtacttgctgtcttcgttgactgcgctgtcttcacggacaacaacgactggacactttgcgtggctgaccactgcaccggagacggagcccatgaccattccggagagtccgccgagtccgcgggaacccatgacgatcattgtggcatcgggagacatttccaacagcatgtcgatgggactgccttcagcgatggtgtgcccgatcttgatttctggcgctacctcatgggcgatgtcacgggcttcgttaatcttttccagggcttcggcctggaggtcatcgaaaagctcttgtggtggaaccattccctctgcgtagaggaactgaggcatggtgtagctggaagccaagcgaagtggaatgccacgtttgttggcggtatttgcagcccaccgaacagcttgttttgaggcgtccgagccatctactgctacgacgacaatgtcttcagtgctcatgtcggtcgacctttcattgattggtgaatcctgcgttacagttcgtggaaactcatgatctctaacacctctaagtgtagcgcggatacccgatccgcacagctggttagtaccagtatttttgaggcttttgacactaattccatgccgtgccaagtgcagctatggagcggaacctgacttcggggtcgtaggagtaggtgactgtaatgatctcatctaacttgtagcgatcagcgaattcctgcagttgtaataccactgattcggctgttccgatgaaagtcatttccaatgaatcttcgatgtgtttccagatcatcgggtcgagtttgtctttcagattccgcactggtggggcaagtttgccgcgggagttcgtcacgattccggcgaacatttggtgcagtgtggagatctggaattcggcttcttcctcggtgtcgcacaccaggacattcgctgcggccatgacataaggattggctgctagttcgcgataggaggcgatggcgggccccatttggaagggtgcgaagtggctggcgaaggcgaatggaaggtctaatttagcggccatcgcagcgccgttgagggaagatcccagcatgaatagcggcacacgggaatttattcctggatgcgcgatgatgttcgggcgttcttcgggggtgtccaaataattctggagggagacgattgtggagaggacgtcgtcgacaagcgaacttgcccgacccaattcccgcgccgtcatggggtcggttcctggtgcgcgccctaggccggcctcgatgcggccggggtaaatggcctcaagggtgccgagttcttcggcgacgtgcagcgcggagtggttgggcatcatgatgccaccggagccaacgcgaatgcgtgaagtgtggcctgcaatatgacccatgagcagcgtcgtcgcggaagatgccaagccttccgagttgtggtgctccgccacccagaaacgcgcataattgtgctcttcggcgatctgcgcagcgcgaacactgtgtgcaatggcctcgccggccgtcatcccttcactcagcgcgacgagatcaagcacgctcaatcgtggttttgggccttccccgactacactagacatgttaaaaacttatccagcattcaccactgcggcatcagtgtttgaagggaaaagcaggtcaaacaaggtgcggctgatttgagcgatcacagcaccgagatctgtgctgaagaattcaatgattgggttgatgattgcgttgaagtccatgtctaacagggtagtacaaaagccaaaaatgaaagcgccgctacccatccgcgacggcctcaacccttcccgtgtgcgcttgccgctcgacgcggcgccgatccgcgccatcgattttgttgaatacctcatttccacgcagcgccaccgcaatccggccgacaacgccgaagcgcttcaagcgcgtttcgacgccgaccttgttgtcaaccactacggcgagccctacgcccccgacaccatggttcagcccgacgacgacatttggttctaccgcatgcccgccgccgaacggccgatcccttacaaaattcatgtcattcacgaagacgatgacatcctcgtcattgacaagccaccctacctagcaaccatgcctcgtggccgccacatcaccgaaaccgctctggtgaaaatgcgtgtgctgactggaaacaacgatctcaccccagctcaccgcctcgatcgcctgacttccggtgtgttagtcatggtgaaaaaaccagaactccgtggcgcttaccaaaccttgtttgcccgacgtgaggcgtccaaaacctatgaggcaatcgcagaattcgttccagggctacttgatgatggtcccgcgatttgggaatcccgcatcgaaaaagaacgcggcatcgtgcaagccttcgtcgtggaaggccccgtcaacgcacgcactgaactggtgtcagtcaccccagtcgaagacgccgaacagagcatcctcgaagaaatgcacggcccactcccccgccaagcgcgctacgttctagccccctcaacaggcaaaacccaccagctgcgcatccacatgcgcgacttcgcagcccccatcctcggcgaccccctctaccccgtcctccacgcagtcgacgatgaggactacaccaccccaatgcacctcatcgcccgcacgctaaccttcgtggatcctcaaaccaacgaggaacgtacctttgtgagtaatcgacctacgggaagtttgtaggcctcgtagacatcacccagacgctcaagcactttttcaagccggtgtagttttccctacactggcttttctgtcgcttcgagcacttcggccccatcttggcatgtcagcccattttaaggctctctacaagccctataaaccacggaaaggtgcgcttgtcgacgcttgcccccaggcgcaggtgccgcgtgcacaaggggcccaagacccccacaaacacaaaaaagagagggtgtagtgaacacacaaccatgtgtatccaccacaccccctcaaacacgaataaacccagaaacacacagtgtttctgggcttatccatactattttaagtttttggtcggcggtaacctactctcccacaccctcccgagtgcagtaccatcagcgtaaccaggcttagcttccgggttcggaaagggaccgggcgtttccctgctactatcaccaccgacacaaccacacaccaaaccaaccaacaggttggttgtgctgtgtcagacactgcataatggacgcgaacacatattgttctgttttcgttacgttgcgttacaccaaaccataaatggtttgttgttatcggtaaattagtaccagtcacctccacacctcacagtgcttccagatctggcctatcaaccccataatctctagggaacctcaaaagaaacctcatctcgaaacaggcttcccgcttagatgctttcagcggttatccctcccgtacgtagccaaccagccctgctcctggcggaacaactggcacaccagaggtacgtccgtcccggtcctctcgtactagggacagccttccttcaagtttcaacgcgcgcggcggatagagaccgaactgtctcacgacgttctaaacccagctcgcgtgccgctttaatgggcgaacagcccaacccttgggacctactccagccccaggatgcgacgagccgacatcgaggtgccaaaccatcccgtcgatatggactcttggggaagatcagcctgttatccccggggtaccttttatccgttgagcgacaccacaaccacaagtaggtgccggatcactagtcccgactttcgtccctgctccacctgtcagtgtcacagtcaagctcccttgtgcacttacactcaccacctgattaccaaccaagctgaggaaacctttgggcgcctccgttacattttaggaggcaaccgccccagttaaactacccaccaggcactgtccccaacccagatcatgggccaaggttaagacatccaatccgatcagagtggtatttcaccaacgactcacacacaactagcgtcatatgatcgaagtctcccacctatcctacacaaaccgaatcaaacaccaataccaagctatagtgaaggtcccggggtcttttcgtcctgccgcgcgtaacgagcatctttactcgtactgcaatttcaccgggcctgtggttgagacagcagggaagtcgttacgccattcgtgcaggtcggaacttacccgacaaggaatttcgctaccttaggatggttatagttaccaccgccgtttactggggcttaaattctcagcttcgaaaaaacaagttttcctaaccggtcctcttaaccttccagcaccgggcaggcgtcagtccgtatacatcaacttaaacgtcttcgcacggacctgtgtttttagtaaacagtcgcttccctctattctctgcgaccacaacacgctcccaacgaaaagttgttcacacgccgtggccccccttctcccgaagttacgggggcattttgccgagttccttaaccacagttcacccgaacgccttagtattctctacctgactacctgtgtcggtttagggtacgggccgaatatcaacatcgctagaggcttttctcgacagcacaggatcacccacttcaccctttacgggctccgcatcacgcctcacacaaaaacagtgcggatttaccaacactgcgtgccacacgcttacaccacaatccaataagtggctgagctacctccctgcgtcaccccatcacttagctactaccagatcaggtcccacgcaaccacacaccacaaaaaagcaaagccttttcgcgggtgcttatgggtggttagtatcactgattcaccatggtcgctcatactcgggtacgggaatatcaacccgttatccatcgactacgcctgtcggcctcgccttaggccccgactcaccctgggaagattaacttgacccaggaacccttagtcatccggcggatacgtttctcacgcatcattcgttactcatgcctgcattctcactcgcacacactccacccaaggtcaccccaaagcttcaacgcatgcacgacgctcccctacccaacaatcctataaagatcattgccgcggcttcggcggtgtacttaagccccactacattgtcggcgcggaatcactcgaccagtgagctattacgcactctttcaaggatggctgcttctaagccaacctcctggctgtcttcgcgaccccacctccttttccacttagcacacccttaggggccttagccggcgatctgggctgtttccctctcgactacgaagcttatcccccgcagtctcactgccgtgctctaacttaccggcattcggagtttggctgatgtcgctaagatgttggtcccgctaaaccatccagtagctctacctccggcaagaaacacacgacgctgcacctaaatgcatttcggggagaaccagctatcacggagtttgattggcctttcacccctacccacaactcatcccctcagttttcaacctaagtgggttcgcgcctccacaacctcttacagctgcttcacactggccatgggtagatcactccgcttcgggtccaagacatgccactaaaacaccctcgttaggattcggtttccctacggctaccccacacgggttaacctcgcgacatgccgctgactcgcaggctcattcttcaaaaggcacgccatcacaccacaaaggatgctctgacggattgacagcacacggtttcaggtactatttcactcccctcccggggtacttttcaccattccctcacggtactaatccgctatcggtcatatcaagtattcaggcttaccgggtggtcccggctaattcacagcagattccacgagcccgctgctactcggggtatcaacaaccacacacaccaccatgatcttcgtgtacaggactctcaccttctacggcaggtgtttccacaccacttccactaaccacgcagcacatgcccacatccggcagaatatgaacgtcattgccccacaaccacctacatgcaacccctgccgggtatcacacacataagttttagccatcatccacgttcgctcgccactactaacggaatcacaattgttttcttctcctacgggtactgagatgtttcacttccccgtgtaaacctccacaccagctatacattcactggcaggtaaccacacatcactgcggctgggtttccccattcggacatcctcggatcaacgcttagttggcaactccccgaggcataacgcagcctctcacgtccttcatcggcttgatatgccaaggcatccaccgtgtgccctacaaaacaacaaacaaaatactataacccacacacaaagtgcgggcgcgttcggtatcacacaacaaaaaacaaaaaaataaagatgctcgcgtccactatacagttctcacacaacacaccacccccaccacaaccaaagaacacaacattctctacccgtgttgacgatgctcgatgttagaaacaacccacacacaccaccaaaaggtgatgcttgcgatgtcattccagacacccaacagcatgccacctattaatcacagcactgtttgctgtgttgttgtcacccgaggggtcatctccacccgattaaaaatatgttgatggcaaccacatacgggttccaacaccaacaacccaccaaccagacacagtctgatgtgggttaataaagctccttagaaaggaggtgatccagccgcaccttccggtacggctaccttgttacgacttcgtcccaatcgccgatcccaccttcgacagctcccccctaaaaggttgggccactggcttcgggtgttaccaactttcatgacgtgacgggcggtgtgtacaaggcccgggaacgtattcaccgcagcgttgctgatctgcgattactagcgactccgacttcatggggtcgagttgcagaccccaatccgaactgaggccggctttaagagattagctccacctcacggtgtggcaactcgctgtaccgaccattgtagcatgtgtgaagccctggacataaggggcatgatgatttgacgtcatccccaccttcctccgagttaaccccggcagtctctcatgagtacccaccacaatgtgctggcaacataagacaagggttgcgctcgttgcgggacttaacccaacatctcacgacacgagctgacgacaaccatgcaccacctgtgaaccgaccacaagggaaaacgtatctctacgccgatccggtccatgtcaagcccaggtaaggttcttcgcgttgcatcgaattaatccacatgctccgccgcttgtgcgggcccccgtcaattcctttgagttttagccttgcggccgtactccccaggcggggcgcttaatgcgttagctgcggcacagaagtcgtggaagacccctacacctagcgcccaccgtttacggcatggactaccagggtatctaatcctgttcgctacccatgctttcgctcctcagcgtcagttactgcccagagacctgccttcgccattggtgttcctcctgatatctgcgcatttcaccgctacaccaggaattccagtctcccctacagcactcaagttatgcccgtatcgcctgcacgcccgaagttaagccccgggatttcacagacgacgcgacaaaccacctacgagctctttacgcccagtaattccggacaacgctcgcaccctacgtattaccgcggctgctggcacgtagttagccggtgcttcttctccaggtaccgtcaccataaggcttcgtccctagcgaaaggagtttacaacccgaaggccttcatcccccacgcggcgtcgctgcatcaggcttgcgcccattgtgcaatattccccactgctgcctcccgtaggagtctgggccgtgtctcagtcccaatgtggccgtacaccctctcaggccggctacccgtcgacgccttggtaggccattaccccaccaacaagctgataggccgcaggctcatcccacaccgcataaagctttccacaccacccctacggtggtgtgaatattcggtattagacccagtttcccaggcttatcccaaagtgtagggcagatcacccacgtgttactcacccgttcgccactcatccaccaaagcaagctccggtttcagcgttcgacttgcatgtgttaagcacgccgccagcgttcgtcctgagccaggatcaaactctccacaaaaaaacaataaaaaagattgttcaggccgtgaaaagcccaacacctgacaaaaacaacaacacccccaccaaccacacacaaaggtgacagttggagaatggggtgttactggcattatcaaaaaataatgattctaaaaaaacaccacaacccacataaggatcatcgtgccttcaacgtgggcctgaatcccttgacggggaacaagcagacccacaaaatcatgccaacaataagattattgtttacagtgatggataaaattggcgatccaccacccggcatgacccaccacacatcacccaaggtgatctgtggtagtgacaaaaataataaatggcacactattgagttctcaaacaacatacgcacaccataagagcatcaacatttgtttgtgttggtgtcttgttggcagcttgttcaacgttacttcatcttgtttactttcaccaaatcggtgtttgttgacttcgatgaagtgttgttggtttgtcgagcgtttgttttcctagatccgcctcactgtccacataatctcttatgtgttggggcgttgttggtcgcgctgactggaattaatttacacacccgcacaacagtccgcaacttcccaggtcaagagggtttaagcgctacttgtacaggcccctactttcagcgacctggtctaaaagggcgtgaatgcgcgcacgagtgaaaccaaggtggatggattcgtcgataagcggtgctacataagtagccgcgaaggcggcatctcgccgctctcggatgagtgctggggcctgggcgctgacgaacatgccaatgccacgcttcttatagaggatgccggcttcgacaaggagggtcaggccgttgcgtgcggtggcgggattaatgcgatggaacgcggctagttcattagtagaaggcacgcgttgatcaatgctcaaggttccgtcaacgatggagtcctcaatcaaagaagcgatctgtttatacagaggcacggtcacgacgatcccgatggttggttactcatataactaaccctatgcctctttatagccattaaaaacagtattaacgacattactttcgggtaataccaagtgttatgcagtctctacccacttaaaatggacgcatattcgcaagataaggcatgcttggatgaatagattttaactcaacgtttactaaacagaatcggaattaggagccatgcttgaacgcacacaggtattcgtggatacgtcctacctgctcgcaagcttttacaactcttgggagacaggggcacgtgcccaattagaaatcgacctccccgaagtagtcggggtattaggaaggatgattgaacaacaacttaaacagccagtacaacgccaaatgtggtacgacggaatccccgattccggcccccaccgctatcaacgagcactacgcacctgcgatggtgtgcaacttcgtgctggccaattaattgaatggggcgaacgccgcacacaaaaggcagtagatacccgccttgttgcagacctcgttctcgcaggtgttcgcggacaatgctccgatatcgtgctcgtcagtggcgacgccgacatgatccccggtgttcaagaagctgccaatgcaggccttcgcgttcacctctacggcttcggctgggattccatgtcctcccaactgcgccactgctgtgacaccaccaccattttggatcctcgagaagattttgctgaatgcatgcagctgcaggttctcgaaggtccactaccccctgtcgttcgggtaaagcccatcaacgatgcagaacccatcgaggatttggatttcactccagttccaggcgtcgcctcaccatttgaagaggtcagcgcgaaagatgagaaattctctccacgcccaagtgaacctgccgaagctttgtcggaacaggtctgtgaagcgcagtatgagatctccaaacacgaaggtcaaaccgctgattcaggagaaatcaccgagtctttcgaggccgctgaaatcaaggtaactgagttttttggagaaccagctgctccagtagcggaatcaggcgtagaagctcccactccggaagctcccacggttcctgaagcagctaagcccactccggcgaaacctaagactccaaaggcagagccccaaaagcaagaatcccccaagccgggaactccaaaaccaaaagctccaagccctgcggatattccaccgaaagccccagctgacactgaggaacattcggaagtcgaagctgaaatcgaggactcacgtccaaagatccccagcccttcgatgatggctccccgccgcaagcttcgttcccgctacgttccgcttcccaacgaagtgtgggcaacagcaggattccaaactccttacgatgtcgggcaacagtacgcatcgtggtggtttgaaaacgcagctaccagcactcaaagagatcaggctcatctattgtctggtggcggacttccaccagagatcgatcgcccgcttctgcagtttgcttgtgaaactctccacgaatacaccctgactgaagcgcagcgcgtagctttacgcgatggctttcactccggaatccgtggtgtattgctcaaccagcgagatagctagaatcacaaaaaactggggctaattcctttcggagttagccccagttttttgtgtttaggttatttcttctcggactcgtctgcggatgcttctggagcatcagcttctgggcttgcggtttctggggtagctgaaggggtggaggtttcgtcgataagttcttccgcatcctcgacacctgcctctagctggcccttaggcgttgcggacgtgcccagcgcctccgcgcgaagttcagccaaacgagctgacgcccgcatatcggtgccggactgcgcaatctcagccatgcgatcactaacagtgttctgggtaagttcctgcgcgcccaaagcatctgcgtatcgacgctcgatcttctcacgcaccgcatcaagggtaggaacagaagaatcctgagtgccaaactgattcaaagaatccatagacttagtgacactttcctgcatcttcgcctgatcagcctgcgcacgtagagcatcaatctgagacatctgctctttcaggcgcatctcagactctttagacttcgcaacagcatccttcgccgcaacctcagcctgctgatgaagcgcagtagtctgctccaactgctgttccacagctaccaactgggaagcaaaaacctcagcagtgttgttgaactcctgagccttaacactgtcgccttcgtttgcggacttatctgccaactgaattgcctgacgagcctgttcctgcaacttatcgcggtcagtaaccaagcggttcaatttcatctcaagctgcttctgctgaccgataatctgagaagcgtgctgcataatctgctggtgctgcttctgggcagcttctgtagcttgctgaatttggatctttggatctgcattctcatcgatcttgttgtcgaacgatgccatgagatacttccagcccttgctgagcggattagccattatcagtcacttccctgaggttttagttacgtgtgtctaagtgtgtctaattgaaaaatcatttctgcgcccgcaagcaaatcactgaatccgattcgctgctcagaacccgagtctacgcaaaactgcactctgctgaacgctcatttgaaaaaatgggggatggttcggggtcttcatcaggggtgaaggtggtgcgcccttaggtttggagggacttcgtaagattccggctttacttcgggcgtcacttcaggcctgtatcgccagttttggccttggcgcccgcgatttcgccccagacgacctcaattcaagggggtccaatcctaaaaccggactaaaaccagactgtaaagtgtcagcacgttgtgcacactcaatatcatatccttgcgcacgcccgatcccactaggttgtgcacacacaaagccacagcagtgtgcacaccaaccctcaccctcgggacaagtttctagcgcagtagatcccccggatctatcgacttaaatcgcttctcagcctcatcacgtttgcgttgccacaacagcgtcgggtgttgcatccacaccccacgaatgttgtaagaactgatatacgacttaccccgggcaatcgccacaaccggcaacgaaatcaacaactcaagctccccggttatcgcatcccagaaaccaagctcagttgccgtcaccgtccgataaaactccctgtccctcatcgtacgaggaacagaaatacgcatcccctggaacaccaccttctgattattcccagcaaacgtaaacacatcaggatccaccggctttttaccaaaacgacgtacccgtcgacgttgctcggtctgctgcatcttagacaccggaacagattcctcctgccgaacaagcgagacatctgattgcttctcaattcgacgacgggcatagtgatcagcttgctgttgaagcacgacgggatcaatcgggggttgttgctccacacaccccacaatctcccaggccgcagccggagtgagattattcggcaacccctgatgtggacgacgattgttgcaatgatcacggaactgttcaatatagtgcgcacattcctcaagtgtgtgtggttgatgagcttgaaggaaacgaaatagtgtgcggtggccgcgttcgtttttaccttgggtttgaggatgcccaggcttgccggtaatgcttaaacaccccaccgtcgcgagatagctttccaaacttccgacgtatccttgccgcatccggttaaacgctgagccgttatcactgagtaattcatgcggggcaccaaaatgagcaatcgcttgttctagcactgttcgggcatcgactgagttttcattcgcgggaaagacacaggttccgacatcaaaccgagtggcatcatcaaggatttgatagatcgttacccgagtcagatcactatcgtgcagcgtgtaaatgaaaccatctatttgccacatttccatagcttgacctcgttgaaacctcaccaccgacgactttggtcgcttcttagggttactttcgactgctcctgcagcgcgtaacaagcaagcgatagttgagacggatggaatcggtgcagtcagttccccggtggcgatgccttcgaatcggatagagatcggaccgtattcccatccttgggctttcaggcggtgcgcggatggccaacaagatactggtgatggattcatcgtatgttcgccgggaggtgatctgggcgctggagcgtggatgcagcgctgcactggcatcttgttggtatcggttgcggatgttgtagaagctgcgccgcgatattttaagccgactgcagaactcttcgatcgagggactgttcggtgcgaacagatcgaaatcgatgatcttgcatcgggtttctgggggcaggggtttaggtatgatctcaattgtgagcagccgaggactatgcctgtggtgaaggtctagggtgtgcacaaggtcatgacacaaaacatcacgtaaccgcacccctgtccaccgggcggtagctgaccagccctgcatgcacgtgtggacggcgacatacgaggtctgcggcagctcccgcagatcgtcgagggtgatggttttctcggtgccgttgggatcgtcgccgagggtgatggtgtatccctcccactcgttgtcgcgggcggcgatccactcgggggattcatcatcggtcggcggcaggccattggtccagtggaactgcgagatgtccttgtccgtgtaggtgttctgcctgctcatccggggacgcagccggttgaggaagattttgcgtccgatctccgtgatgctggcggtgaaccgctgggcgcgggcccggtcagccagcgaccaatagctgagcacgatccagaacaacaccaccatgacgatggtggtgatcacgatgatgtaggcctgcgccgcacggtcagtgttcatatcgccgaagaccatgtggaccatgttgtagtcgccatggaccaaaaaaccaggccgacgtgcatgatgacaaagcccgtcatcaacaccatggcgatgaagtgcagggaacgtgcaccctggtggccgccgaagagtttgacgtaccacgggaagcgggaccggatggccggggccatcgctattccggtgaggatgagaaacggcgccaggataaagatgacgaaggtgtagcccagcatttgcaaggcgtcataggggggtgaagtgctcgatgcctggggcacgaaagcccaggtaaaccttcaatgtctcccacgcctcggggaagacgtcccaggaggtggggataatgccttgccacagcccggtggcgaacagcagaacgacgtagacgatgccgttgagcacccgcaacatcgtcgacagaccgtgccagtgtcggcccaggccgatgttctcccgacccggcagaccgatcaacggggaaagggacttctcgtccatcagtgaggtgtagacccttcctccttgggcagtttgcatttggtgacccggagccattccgtgcccggggcgcagtcattgcgccaccacaaccgcggcatggacgacagaatctcccacccggagcgcaatagcatgccgatgagaacgaaattgatcaggtgcgtggcccgcagccacagggggaaatctgggttgatctccacggattactccttaaatcgtgaccgtcaatagctacatacaatggaaaattacgtatgatgcgtctcacgctaacctgataagaaaggaaaaataagggacaatccccgcagagggggtagccaagcggtgtcaggagcagtgcccgagacgccgtaccatcaacgatggctcgctttccccgatgctgtgtcgtcctacaggccgttagaatccagactcgcgggcactagccgcgcgactgccgacaaccgcacgccgtgtaccggaaggcttggaacgcctagggtgttcctcatggcaacagatgacgttagcaaggcctacagctcaccgacctttgatgcggaggcactgctcggaacggtaatctcggccgaggaccccgaccgcgtgctcatcgagccctgggcgaccggcgtcgacggggtgatcctcgatgtgggctctggtaccgggcggtggaccggtcacctcgcgagcctcggacaccagatcgagggactggaaccagcgacacggctcgtagagctcgctcgtcagacacatccctcagtgacctttcaccacggcactattaccgacctctcagactcgccgaagcgctgggcaggcctgttggcctggtactccctgatccacatgggcccgggcgagctgcccgacgccctggtcgcactgcggatggcggtggaggatggtggtggcctgctgatgtcctttttctccgggccttctctggaaccgatgtatcatcccgtggccaccgcctaccggtggccactgcccgagcttgcccaggcactggagaccgcgggtttccaggtcaccagtagtcactgggatcctcggttcccccatgcctatctcaccgccgaggccagcaagcagaatctcgcctgacagtggtggcctactcggtagtcgtcttctcagaaaacatctcatagcaccagtgtggttacctgccggaggagaaacgagtagtcagccggaccataactggcgaccgcctggggcagcggtccatccaggccccggatggtctgcaaggaggtcggcgccgatcacttcgtccaggcgtcgacgaaaacgcccagccaccacaaaacccgcattcccccttttctgtcccgaggcacctcagactgcggccccgaacaaaacaccgacaccgtaggtcagggccaggccgagggcaccaccgatcaccaggcgcccgcacgcgcgcattggggaggtacccgagatctgggctgagatgaacccggtcaccgccaggaccagcagcgtgactacgaagaccacgccggcgtcccagcctgcaggggcgatgaataccgacaccatcggcagcagtgctccgagcaggaaagccacggccgaggagaaggcggcggccaaggggctggtcagttgctcattatcaataccgagctcgagctgaaggtgggcgcccaaggcgtcgccctgcccgatctcggtggccgcctggttcgcagtctcaggggagatgccgtaggagtgtaggatctccgacagctcgacgtgctcggccgtcgggtcttcggccagctccttcgcttcttttgcgatgagcacccgttcggtatcacgctgtgaggagacagagacgtactcaccgagagccatagataccgcccccgcgatcgttgaggccaaaccagcgccgaacacgacggtgtcactggcgccggtggcgatcacaccgagcagtagcgcagcaatggagacgataccgtcattagcacccagcacaccggcacgcagagtattcatacgattgtggtggctgggtacgtgcggttcgtgcagggggtgagcggtgttagtggagatgatcatcagtcctttatcggtgcaggagaccctataagcacagcttattaagggcctagttttcccacaacgaagcagagccaaccctcgccgtctttcggggctaatctcttcgttgacacgtcccgttactctccgggagatctcctggaacgtggactccggcctcgagatgcgagaagaggcacctactcatgctcaagcatgcggtagaggggggccggttgactttgtcctcgcgggcgacctggcccttgggtacgtgggccacgatcttttccatgatcacctggggttgctcgttatcgaacttcgtgcccctgacgttgttagcggttggccgccttaaccaggtcgataccctcggcctggcactcatggatccgataacgctcgaactccacgaagggagccgaggagggtgaattactcctggagatcacgtggagaaggtgaaccggatctccttcggcatgatgtggacagccttaaactctgggtctgccacgatctcgtgccagatatcagcgggaatgacgaggctgtctcccgcgctcacaccacggtcttcggcagagaactgaacgatgcatcgcccctcggtgacgacgagcaccgattcggttgatgctctgtgtctgggccaggaaattcccgacgccgcttccatccgtttagtttcaaacagcgctccttcttctaacggcgtcacccggggtcgccctgcggattccatcgtaaaactccttcgccacacgtcactcactggagggaatctagtccccgacctgccatgccgccaccctaccggcacaggtcatgagcgatgagaattagtccttatcgttattggatagcgctcggtagagggtggctctgccaattctgaggtcttgggcgatcgacaccttggactcaccagcttctacccgtttccgggctttctcgacgtcgtccggggtgagggcgcgtttgcggcccttgtacttgccggcctttttcgccaggcgatcccctcggcttggcgctcccggatgatggagcgttcgaactcagcgaaggagccgagaatgctcagcatgagctgggcccgcaaagcattggattccgccgagaagatcaggttttccttgatgaagtgcacgctcgcacccttggtggtgatttggtcaatgatcttctgcaggtcgaccttcgaccatcacaatgacaggccaggaacaactattggtacgagggacatgaaacatcgcagtcaggttctccttgtttagggccgatatcaggtcctagttctggttctgtggcggcagcaccgcgacgagctgggcgtcgaagtcctgcggacccaggctggcggcaccgcctggcgaaccgaggtcgtcgaaaaaggcggcgttagcgccggtgtagtcccaccattcgtggggaacatcatcttcgtagaagatggcttcaaccgggcagacgggctcgcaggcaccgcagtcgacgcactcatcggggtggatgtagagcatccgtttgccctcgtagatgcagtccacgggacattcctcgacgcaggctcgatccaggacatcaacgcagggctgggcgattgtgtaggtcatcggatctccaatactacggataaagacgtggaaaataggttcactgtcatcctattagctccccgacccttcaccaaggggcacatattttcgattatccccgccaccagtagcggtaaggatagtggaaccggtcagctggtcaccgtcgcatgctggtacaaacatcaggggcaggaggccggtgatcgaacggtgccggtccatggtctcgccgcggaagacggaccctcggcgggctcaaacaccccaggggaagtccctatctttcttattgcgtcagtttggcaatggtgatcaaaacagcggagtcctcgattgcttcgaggctgtgccgagatcgcggcacgatcaacagatcaccgctgcgacctatccaggtctcatcgcccgtcctgagttggacacgcccttgtaggacataaatcgtggattcatcgtgattgtcgcgctctccgagctcagcaccctgacgtatcccgacgacggtctgccgcagaattttttcgtgcccgccgaagacggtatcggcggcacgagcactaggggcggcgacggcctctttaagttgcttgcgggcgagggcctcgatcgatattttgtgcatataaacaacctttcggagccggtctgggaagcatcgaatggtgaggagacgatgtttttgttcatgcgccttccctgatgacccgagaagttagcgcagtacgtaaaaaagtggactctgacgtgtcagtggtagggatcctccgtgggcgggccgatgcgcaggatagcggtcagcgcttggtttcggtcactgacatcgagatgggcgacgattattcatgaggaacgcaagtttattgcagcatcacgcgacgagtcaactacatccgacccattgcgcaagctcttcgattgcggttgatcgtgatggtcaaaaccagcggccggtcagggatcgctctttgccacacgtcagggacttaagctcgtcagtaattgttggcggcggcgacggtagcgaactcgatggcgacgacatggccggccatggtcaaagaatccgcgttcgtggcataacccggtcgtaacgtctctcggacttcggcatctggttggattactccgatggtcttccgcgcggtgctgttgcaaagtttgggcagtaggaagagcgacgtgaaataatcacagccatgggtaccttctccggtcgtcatttcccccgtgacatcattctgtaggcagtgcgcaggtcactgccgctacggggtgagctgacctaagatctggaggaaacgatgacttcagcggggcgtgccggtcgatcacaccacgattctcaccgctgggtccagacatacgcccctgagctggacaagcaaacacggtggtaccggcaggtacctgactagcaggccagttcctggcgggtggataagacctacatccgggtacggtgtcatcggtaatcggtggtgacgtcgctgaccccgaggagttccatgtcctcctgggctctcaccgcgtcggctacacgtttaccgatgacaccgtacccgtttactgcaaccttgattttattcggcatgctgattgtccttcccggaaatcctggtttggcccgatggtcgtatggtcgtgtttctcatctggggtggtcggggaatgtccttgttcagagctcgttgagcatctgctccatctcggcgatctcggcctcctgatcttcaatgacctgctcagccagagcgatggcctgcgggttctggccatcagtgacctcatcgcgggccatatcgaccgcgccctcatggtgggcggtcatctgctcaaggtagagccgggcagcctcggtgccctgggcgtcctcgagggctgtcatgtcctcctcgctcatcattccactcatcccgccatggtccatctcacccatatcaccggtgaccggatcttcttcccaggtctcgagcatggtattcatccggtcgatctccgggccctgggcatcgataacaccctgggtgaactcgatgacctcggccgggatatcgtccttggccaggaggatttcactcatctccacggcctgttggtgatgcgggatcatcatctgcgcgaacatgatgtccgcatcattgtgctcggcggagacctctccggccgcccccgtctctgtctcaggatccgtggtggccccggtcgtttcggtggtgtcgggggcggacgtagtggcgatggtcgtggtgtcggtgttttctccctcagtgttatctgcgcaggcggacaaaaccagggtggaggtcaaggcgagagcggcgatggtgatagtgcgcttcatgggggttccctttcggaggttgtgtatgggggagtcgatgaaggattgaaagtcagcggacgggggctgcagagctcacagcagccttctcctccttcccgtcggtcggagctaggtgagccgggtccaggtcgatccggcgtagcagctgggcgttgagggcgacgatgatcgtggacagggacatcaagatggcggccgccgccgggggaagcagcacaccgataggggcgagcacaccggcggccagcggaacggccacgatgttgtacccggtcgcccagaccaggttctggaccatcttgcggtagctggcatgggagagctcgatcatcgacagcacggcccggggatcatcactggccaggaccaccccggcggactccatcgccacatctgtacccgcgccaatcgcaataccgacctcggcccgggccagggccggggcgtcattgacaccgtcgccgaccatggccacgctcagaccgcgctcctgcagctgggtgaccttggtgtccttgtcctgcggcagaacctcggcgaagacctcatcgatccccagatccttgcccactgcctgggcgacctgggtggcgtcaccggtgatcatcgccaccttcaccccgcgggcctgcagggcgcgtaccgccgcgcgggattcggggcggattttgtcctccactgccaccgcaccgatgatctcaccgtcgcggacgacatggagcactccggcacctcgctgtgcccaggaaccggtgatgtcggcgagctcacccggggtggtcagattgaactcgcgtagcatgttcggcccgcccacgaggatttcggcaccgtcgacggtggcccggatcccgcggccggaggcggcggtgaaaccggttgcgcgcagctgacgctgcgaggcctccgggtgtgcggccgcggcagtcacgatcgcgcgggccacggggtgctcactatcggcctcagcggcggcggccagggccagcagctcaccctcggcgatacccgtggccggagccacgccggtgacggcgtgtgcgccttcggtcagggtgccggtcttatcgaacaagacgacgtcgatggtgcgcatgtgctcgagtgccatgcggtccttgatgagcaccccggatttcgcggcgcgctcggaggagatcgcgatgaccagcgggatggccaggcccagggcgtgcgggcaggcgatgatcagcacggtcaccgcgcggaccacggcatcgtcggggctgccgatgatggtccagaccacggcggtgatcagggccgtgatcagggcgaaccagaacaggaaggctgcggctcgatcggccagggcctgggcccgggaggaggaggcctgggcgtcggcgaccatgcgctggatgcctgccagggcggtgtccccaccggtggcctccacccggatacggacggtgttgtcggtggccacggtgccggccaccacggtctcaccggtatcccggtagacgggtcgggattcgccggtgatcatggcctcatcgaattcggccgctccgtcgatgatggtcccgtcggccgggacgcgggcacctgctcggaccagcacgacatcgtcgacggccagctctgagatcgctacggtgcgggtggtcccgtcgacgaccttctcggcctcatcgggcaggagcgctgccagcgcgtcaagcgcggaggaggctgcaccaagagcgcgcatctccagccagtggcccaacagcatgatggtcaccagcagggccagttcccaccagaaatctaggtggaacccgcccagccccagggtggtgacccaggaggcgataaacgccacggtgatcgccatggcgatcaggagcatcatgcccggttggcgggatttcagctcggtcattgcgcccttgaggaagggggtgccgccgtagaggaagatgatcgtgcccaggaccggaggaatccagtaggctcccggaatctccggaatattatatcccagcaggtcggcgaacatcgggctgaagaacaccaccggaaccgacaggatcagcgaccaccagaagcggtcccggaacatcgcggcgctgtggccggcgtgttcaccgtgactgtggacctgatgttcttcatcgacagtggaatgcggatgatcgtgcggcatggcctggccgtgggtggcggcatccgcatggtgctcgtgaccggcatgattcgggtggtgggtgtggtctgtttccggagcggggtgatcaccgtggtggtggggagtgctcatgaggttccttccgctcaacccggtcggggtcgagatgatgggtgaatcgatcaggacaagacggtgtagccggtctcctcaattgcccggtggacggtttccaggggcacggaacccgtgaccgtgacgatggagaccccaccggcgatgaggtcgacctggacgtcgtcgacctggggcagagcgctcaccgcctcggtgacgttgtcggcgcagtgtccgcaggtcatgcctgtgacctggtaggtggtgggaccttcaggtgttgcgtcggttgccgcggccacggccgaggcggagacggtcgcggacggtgtagagggcgcgcagcatccacaaccgtcggaggccagcggcagcaagggggaagtcggggtggtcatcggatcgctcctgtgggatcgggggatcaggcggggtttcccctcccatcgtatacccctatggggtattgtcaaggggttgatacggatcgctgccgaggtcatcagaattattgtccccgggagtggggtcactgagcatcagggacacgttttcctggtgcaggggaagacggatggtgaagaccgatccggcaccggggccaggagaggtggcggtgagagtgccgccgtgggcctcgatcaatgccttggagatggtcagaccgataccggccccgccgttgtcccggctgcgggcggcatccccccggtagaagcgttcgaagatgtgtccgagctggccaggtgggatgccctcgccgtcatcggcgacgtggatgagcgcggtggacgccccctgtcggtggacgctgatccggacctgcccgccggccggggtgtaccgtagcgcgttcgacaggagattgctcatcacctggccgaagcgttgccggtccacgagcacccggacggtgtccataatggtctcgacctgtaaatcgacgcctttgtcagcataagcttcccccgcggcagcagcggcggtatggagcagatccccgagcccttcctccgccaggtccaaatcgatccggtgttcctgggcccgggagacatcgtcgatgtcttccatcaaccgggtcaggcgggtgagttggtcagccatgatcgtgtgggtggcattattccagtccacgaccccgtcctggagaccatcgaggtagaccgtgagcaccgataagggggtgcccatttcgtgggccagatcagagagcatctggcggcggacctgttcggtgtgttccagccggtcggccatggtgttgaaggcatgcgccagggtggtgacctcggggcctgcttctccggcgggcacgcggatacggtagttgccggccgtcaggctggtagcggcgcgggtgagatcctgcaggggggtgcgcaggcgacgcgataaccacaggctggccagcagggcgctgatcaaggcggtgggcagggcgacggccagggtgatcaggttggcgtcccggtaggcctgctcggcatggaacagctccagcgaggggtcctcccggccggtcatcaacatatgatcatggaacagggtcgggcccaccatcgtggccacggccgcggccaccagcaggctaatcaccacgaccaacacctgggcggccaggaagcggaaggtcaggccgggtctgtgattcatggctgccccacccggtagcccacgccacgcacggtgtcgataaacccccggccccgggtgtcggtgccgagcttgcgacgcaagttgccgatgtggacatcgacgatgcgttcatcgccgacccaggtggtgtcccagacctcggtgatcaggtcgtggcgggtcagcacctggccggggcgcagggccagggcaaccagcagctcgaactccgtgcgggtgagctccacggtcgtctcccccacccacacctgatgggcgacggggtcaaggatgaggtcaccaacgatcaagggggtggtcacctgcggtggggtggtgctggtgcgcgggcggcgcagcaccgcatgcacccgggtcaccagttcccggatgctaaaaggtttggtgatgtagtcatccgcccccagggtcaaaccgctgatcttgtcgtcctcgctgccacgcgcggtgagcatgaggatgtagcagtccgagaaggtgcggatccgtcggcacacctccaggccgtcgagttcgggcagccccagatccagcaccacaacatcgggggaaaagcgacgggcctcgtccacggcctgggtgccggtgtgcgcctggcgggtgtcgaagccggcccggatgaggtaggaggccaccatctgagccaggggttgttcatcatcgacgaccagcacccgccccgggggcgtggcggtggtcggtgtgcggtcagccatagaccccagtatcgcttcggccggggggaataccaccctcgttcagtgcccggcggggaaatcttcatcaaatcttcaaacatcacccttcgaccgccgtcacccctgtgccccaccccgggccggcggcatcgcctcccctggtcggttcagcaggcgtcaccagggatttcactgcctgcaccgcatacccggggcgggtagaaggacatcgtccacggctgtggggtggtgtcccggtggtgacccagcccaccggagtcacccccttttcgccctgttataaggctgtgagcagggtttttgatttctgggccgtcaggcacccgtgctagaaaaggtatggcatcgaccttgaggcggtgtcttctcacggtcttaccacgatccaaggagattgacgtgaaacgagcagcgatcgcagccgccgcccttaccctcgccctcacggggtgttcggccgccgacccggaacccaccgccgacgggacggtgtcccaggatacattcctgactacccatggcctggccgccatggacgcggtggagatcattgatcacctcgaccggcagaaggtcactgagcgtcccacggatctgatcgcctcagtgcgtgccgatgaactgctgctctcgagcgatgaccaggaagtcgtggtcgatcttcccgacaatcagacgtatgtctcgatcgcaccctacctcacctccacccacgactgcttctaccacagcctcacgacctgcctgggggaactcgacaatgaggatatccaggtcacgatcaccgatgaagcgaccggcgaggtcctgatcgatgagcaaaccaccaccttcgacaacgggtttgtcggcttctggcttcccgatgatgccaccggcaccatcgagatcacccatcaggggcgcaccggtgtcaccgagttctccaccaccgaggacggggccacctgtgtcacggacctgcgcctgacctgatgcctcagcagcgggtttcccctgatccttcccctgtgtcactcagacttgcaccaaggacggtttaaccatgacaagtagtttttcccggcgacagtttctgctcggcgggctcgtactcgccggcaccggggccgtggccgcctgcaccagcgaccctggacccgctgcctcggcaccaggtccctcccttcgccccactcccacccccactgcgctcggtgagccgacggtgcgccggacactgaccgcccggcccctctccctggatatcggcggcatcgaagccaagacgtggggatacgtctctgacaccggggatgcggccattgaggccaccgccggcgacgtcctccaggtcgatatcaccaatgaactgcctgagagcacctccatccactggcatggcatcgcactccacaacgcagccgacggtgtgcccggcatgacccaggaccccattgaacctggcgagtctttctcctatgtttttgaagtcccccacggtggcacctacttctaccattcccacaccggcctgcagcttgatcgcggcctccacgccccactgatcatccgtgacccgcaagacgctgaggaccaggacgtcgagtggaccatcgtgctcgacgactgggtcgatggcattcagggcactcccgacgatgagctcgacaagctcaccggaatgggttcgggcgaccataacgggaggatgggaatgggaggtcacggccagatgatgcacggcaccccggaccgggtactgggcggggatgtcggcgatgtgatgtatccgcactacctcatcaacggacgtatcccccgtgctcaccggaccttcgaggctcgcccgggcgacaaggcccgcctgcggtttatcaactccggcggtgacaccatcttcaaggtggccctcggtggtcaccgcatgactgtcacccacaccgacggcttccctgtccagccctgggagaccgaatcgatctacctgtcgatgggcgagcgtgtcgacgtcgaggtcatcctcggcgacggcatcttcccgctcacggctttggcggtgggtaaggacgaccgcgccttcgccgtcatccgcaccgccggcggccaggccccccgccccgatgtcgacttccccgagttgtcgtccaccggactgcttctgtcctccctgaagccagcagaccgtgcactcctgcccgagggcacaccagaccgagaagtcagcatcgacctgggcgggcagatgatgccgtatgaatggagcattctcaccgacggccaatcctcctccgcgaccgtgcaggagggccagcgcctgcggatggtcatgcgcaacaggaccatgatgccccatcccatgcacatccacggccacacgtgggcgctgcccggcagcggcgggctacgcaaggacaccgtccttctccgccacggtgaaaccatgatcgccgacctgatcgctgacaaccccggtgagtgggcatttcactgccataacgcctatcacatggaaaccgggatggtcagctcgcttcgctacgagtaacccccacagcagggttgagtgccgaggtgggcagagtcgctgcagaccacccaccgggcagcacgatgaccttcctcggtgttgtggtcttccgggacaaccagaacaccgtcttcttcctcaccgccccggaataaggagatctaatccatgccgagcacaccccgcagagccgccatcgcggttgccgcggtgctcaccgccgtgaccctggtggcctgttcctcaggcgacggcgcccgaaacgccgtcgccgtcggggggcaccttccagttccactcaccaggaggccaaaccgagattatctacgcagaggaggaacgtgccccgctgccggacttctccggcccgtcgctgatggaggagggtgaggagatcagcctgtctgattttgaaggcgaggtcgtcgtcctcaacgcttggggccagtggtgtgcaccgtgtcgggcggaagtcgatgacctgcagcttgtccaggagactctcgaccccctcggtggcacggtgctgggcatcaacgtccgtgactacaaccagaccatcgcccaggacttcaaactcgacaacgcggtgacctatccctcgatctacgacccgccgtttcgtatcgctgcggccctgggtggggtgccgacctcggtcatcccgaccaccattgtcctggaccgaagccaccgcccggccgcggtgttcctgagggaggtcaccgcgttgtctggttagtcctgggaggtgatgagctcgaggacgatcttgccgcgggcgtggccctgctcaacgtgggccagggccttaccggcctgttccagcgggtaggtcgtatcgaccttcgggtcgaccagcccgtactggaccaccccggtgatctgtccgaccatttccggggtgcggcgcagcacctgtccaccgagttctcccacggtggcagcatcagccgccgagatcacgtgcgccggattcttcgctaagggagcaaccacccgcaacgcctccccgccgactaggtcgaagactacgtccacaccgtcagggagcagcgcacgcacctgctccgcgacggcgtcgccggtggcgacgaagatagcaccggtggattcgatgagctcgcgcttgtcctcgtggtcaacgccgacgacctggaacttgtggacccgtccgatctgcgcggccatcagcccgaccccaccaccggccccattgatcagcaacgactggcctggttcaagctcgacctggtgagtgccggcgtaggcgctcgccccagcgaccgggatcgcggcggcgtcggtgaacgagatctcctccggctttagcacggtactctctgccaccagcagggtgtcctcggcatatccgccgacgccgggggccaccaggccgagcaccggatcgccgaccgcgaagccctccacaccgtctccaacggcggtgacgatcccggaggcctcctcgcccaggggtgccggaagctctcgcggggttccggcaaccccggaacggaccttccaatcaagcgggttgaccccggccgcgtggaccttgaccccgagttctcccgggcctggctggggggtgttgcgggtgatcagttcctggttttccgggccgccgtactcgttggacacgtataccttcgacatcgtgtgcttcctctcctcgtgaatttctttcctgtggtcacggccgtttgcggccttgcctgtcacggtaggaagatgatcaccgcgagaccatgacgtggatcaaagagtgaaagaagtgatcacgaaggaccccaccgacattgggggatctatcgcgcaggccccttcgtgccgctaaggtcggtgtcgcttgccacagcgtgcccagggcctctcgatgccctaggtgaggcctgcccctgttcccagcaggagcaggcatttttctccgtcgtcacccttcggggacggcaggaccctgacatgcatatcccacaccgcctcaacggttgcgcaccatgaatcccgaaaaaccggctagtaccggttaaacctgcggcagtggggaggccctgaggcgaaggtcggtgatgcaggtggctccgtccgtaccggtggtgaagtaggagtagccgatgaacccgttgtcgaaggtggttgcctgctccgagacgagcaccgcacccgtgccgtcctcaatgatctccaactcctgggcgattgagaccacctgcgcgctctacctgcccgtcgaggccctggccgaggtcgtggacgcctacccgcaactggcgttggcgatcatgcggatgcagcaggaccaattggtccggtcccgggaacgcgagaccgcacagaccacctcgactgtcgagcagcgcgtggccgccgccctccaacacctggacgccaagctcgggcaaatccgacaagacggatccagcctgctgcaggtccgcctgcgccgcgacgacgtggccggcaccaccgtcgagtccgcctcccgggcaatggcgcggatgaagaaaaccggtgtcatcgactccggccgcgaatggatcgccattaccaaccaccaggccctggccgacctggtcgccggcctctaaacgcccacatccctctctctttcccaggacaatttcccggtaggagagatttgtcgttgtttgatccaggtcaaggaattaacccggaaaggaccgtatctttaaaggtgcaagcacaggaacatgacgataaaagatgaaaggacctggttacgatgaccgcccccgccacgctgaagaacaccaccttgcgctctgatgagttcacctgtccgagctgtgtcgccaagatcgaaaacaagctgaatggtttggacggcgtggagaatgcggaggtgaagttctcctccggacgcatcctgatcacccacgacccacagaaggtctccgtacgtgacctggtcaccgcggtagccgaggtcggttacaccgccaagccgtcggcgatctgacgcactcccgaccccacaagcccgcccgcaccagaaagtgccggcgggccatctgtgcccccgggctacgagcaccacagtctttttgcgatccatatctcactttgcgggtacttgatgcggatcaaggtactttctccggattgttcataacttaatgagtatcacagaaaacacctgatcttcatcatgaaaggacaccaccatggccgaagtaacctttgccagtctccacgagaaaatgaacttcctgctcaaggaccacggggtcgagaacttcgacgagtcggatctggacctcgaatccgtctcctcactgcacgccaaggcgaacgcgttatgcgccgcccacggcggtgacccctcccgcatggcgaacgataccctcgcccagctgcacccgaagctggacttcctgatgaaggggcacggcgtggacaccgacactgcccgcctggacttgagcacactggaggctgtggatgccaaggtcaacgccgttgtcaacgcccacgatcattagcgactggaccatctttccgaagtgggagccgcgctgtcctcatgtccacaccgacccgtgaacgacagggaccgaatcttctcgcaagaactcgagccctgaatacaggcgacatccagggtgccatacgcaacggctactcccgcctatcacagtgtggcggcgttgtaccgcgtgagccgtcctgcgggccaggacgacactatccacctaggacatctcaaggagacccgtgacgcctaccagtgacgcgtagatgacgacctcgccctgttcccctcccttgcggcgcccgacccacacggccgccacccgatccgggaatggctgagcactcacaccggccctctcatggaccccggctgtaccgccaaaccctcggcctactaaacaccccctatccgagtacccgggaaaggagcatgatcgacgccacgtcatctccacgccaggaacccaccagcaccgtgcggtgctggtgggttcctggcgttgacaggccacgtggcatgctcttctgctccacctcgtcaggtcggaggtgtgtgggtgattgatccaggtcaaggaagtttctccggaattgtcctaacttaatgagtgtcacaagaaaaagaccctcaaaaagtaaaggacacccatcatgaagacctggaaaacctggggcatcgtcgccgtctcaggcctgttgattatcctgtcctggctcacccccgctgggtggctgtcagacggattcatgatcgccgccgcggtggtcgccggctggcagatcgccctctccgccgtccaggccctgcgcattaggatgatctcgattgacctgctggtcatcgtcgccgccatcggcgcgctgttcatcaacaactactgggaatccgccgccgtcaccttcctcttcgccctcggcaaggcactggagaaggccacgatgaaccgcacccgcaaggcactgtctgacctggtggacgctgcccccgagaccgccaccgtgctgcgcgacggtgagcccgaaaccgttgagatctgggaactggcccccggtgacgtcgtgctcgtgaaaaacggcgagcagatccccgtcgatggacgcgtgctctccggacacggtggggtcgatgaggccaccatcaccggagaatccgtcccggccgagaaggccgcggactccgaggtcttcgccggcacctggctgcgctccggtgtgctgcgcattgaggcgatcggcatcggctcggattccaccctggccaagatcatccaccgtgtcgaagacgcccaggatgacaaggcaaaaacccagacgttcctggagaaattctcgaagtactacacccccggcgtcatgatcgccgccctggccgtcggcctgatcaccctgaacgttgaactggccctgaccctgctggtcatcgcctgcccgggtgccctggtcatctcgatcccggtctcgatcgtcgccggtatcggccgctccgccaaggacggcgtcctgatcaagggcggggaatacctggagacctccgcgaaggtcgacaccgtagtcgtcgacaagaccggcaccctgaccaacggccgccccgagctgaccaacgtcgacgtccttgaccccgcctactcggacgatgaggtgctcaccctggccgcccgcgcggaaaccgcctccgagcaccccctggccgaggccatcatccgcggcgcggagaacaggggcttgaccgtggcgatggtagaaaaggccgaaccggtcgccggccgcggcatccgcgctgacgtggacggtgccaccgtggccgtgggctcagccgacctgctcgatcacaccccggataacacccgcattctcgagctcaacgaacagggcaggaccgccatgtacgtcggcatcaacggcaaggccgtgggcatcgtcgctgtggccgacaccatccgagatgatgccccggccgcgatcaggtccctgcacaataagggaatccgcgtggtcatggccaccggtgatgccgaacgcgtcgcccgcaacgtcgccgccgagctcggtgtcgatgaggtgagggcagaactgatgcctgaggacaagctcgagatcgtcaaggagctgcaggcgcagggccgggtcgtggccatggttggcgacggtgtcaatgacaccccggcactggccaccgcggacatcggtgtggcgatgggtgcggccggttcgcctgccgccatcgagaccgccgatatcgccctgatggccgacaagctgccgcggctgccctacgccctgggtctggcccagcgcacggtgcgcaccatgcgggtcaacatcggcatcgccctgctcactgtcacgatcctgctggccggtgtcctgctcggtggagtgaccatgtcgattggcatgctcgtccacgaggcctccgtcctgctggtcatcgcgattgcgatgctcctgctgcgccccaccctgaaggaagacaaggacaaggcagacgtcagtactgctgacgccgcgaaggagacgctgagcgcctaacgacacaatcgccacagccagccccgccggtttcctccaggtcttcccggtggggctttcccctgtgcaccagatccccgatctcatgtagctgcactgtgacggtgctgttgcaaagttgggcggagagcagcgaagactcagtttctcattccctgatcgccgctgcgtgtgggcgttgttaggccgtctcgaagacccggttgacgatcaccgcgtccgggttcggttgcccgtgagggcaaacatcatgccttgccctttccgcaatgagtgcatcgcctccatccctttcaacgtccgatatgcagatgtctaagttcttaaacgcgcctttcggcccgaggatccgtttcagccgaccatggtcgccttccaggatgttgttgaggtatttcacctaccggtgttccactgttggcgggcagattccctctgacttcaactcggtgattgccctggctagggagggtgctttatcggtgttgatcactctgggatacccggctgacgcattggatctgagggccttggccaggaaacgcttcgctgcggccacgttccgcttcggagagaggtaaaagtccagggtctggccaccggcggtgatcgccagatcagaggtagcaccacctgccgccgacccggatataggtctcatccacccgccaggaactggcctgccagtcaggcacctgccggtaccaccgtgtttgcttgtccagctcaggggcgtatttctggacccagcggtagatcatggtgtgatcgaccggcacgccccgctgaagtcatcatttcctccagatcttaggtcagctcaccccgtagcggcagtgacctgcgcactgcccacagaatgatctcacggggaaatgacgaccggagaagatacccatggctgtgattatttcacgtcgctcttcctactgccccaactttgcaacaacacccaaaatcccaccctgacctcagaaaaagtgcccctctagattcgcttcaaacggtctaaggaggccaaacccacactctggccccttcgacattttcgacgccttaaatcgccaccaaatcagccatccccaaaaccccgcaacagacacaaaagcctcaaaagccgcaagaccccaaagctcccaaaaaggacgaaaaccgccgagaagaagttctcctcagcggttttcaccaaaacacaattggaagcttatgcctctgcagaaccctgctgctctgcgacctggcgacgaacgtcatccatgtcgagtgccttaacctggttgaccagatcatccagtgcaggagctggcatggtgccggcttcgcggtagaccatgatgccgtcgcggaaaaccatcagagttgggatggactggatctgcagtgctgcagccaggccctggtttgcttcggtatcaagcttggcgaaggttgcgtcggtgtgggtttcggaaaccttctcgtaggttggggcgaactggcggcaaggtccgcaccaggatgcccatgcgtctacgaggacaattccgtcgccggtaactgtgctctcaaatgtttcttcggttacatcgatggttgccattaagaatctccgttcaagatttgtaaggtctatatatagaccaactttcagcggactgtagttattcccggccaaggattttcttcattgaccggcagctcgtctgattcactgcacatcgtacattggacggtggacacgtttcagagtccgctggatttcatcacatcggaaggaagagaattttgagtaccaaaaattaccacgtcgagggtttgacctgcgcaaacggtgtagcttccgtagaggatgaaatcggcattgttgcgggcacccagggtgtggatattgatattgagaccggccgcgtcacggtgactggtgaaggtttcactgacgaggaaatcattgaggctgtcgcgaacgcgggctacaaagtttctgggcggtagcacaattacacattcatctcatcgattccgatgagattgccacccccaaaatggggcgcctatttttttgaccgccacccacggtagcgcttgtgcgctcagccggggtggccgtttgcgtgtacgggttttgcttatcgacgcccacttctgattttaaaggcaaatattttgtgtcacagcgagtaatcttttcgggcatgaacctaacccggaatgacaggctcgatcgactgcccgtaacttccaaacataaaaagattcttggcggctcaggtatcggctgggcattggatgccatggatgtcggactgatctctttcgtcatggctgcgttggccactcattggggcctatcccctactgaaacttccctgctcggatccatcggtttcgttggcatggccatcggcgcttcgctgggcggtttgctggcggacaagttggggcgtcgacaagtttttgcgttgtctttgctagtttatggcgttgccactggcgcgtcggcgctttcagtgtcgctggcaatgttgatggcgctgcgcttcgtcgttggacttggcctgggcgctgaactccccgttgcatccactctgatttccgagttttctccacgaaaagttcgtggccgcatggtcgttatcctggaggcgttttgggcgctgggctggatcatggctgcaatcgtcggaacctttgtcgtggcaggatccgataatggttggcgttgggcgttagctcttggctgtgtccctgcaatttacgcggtgtatgtccgtctcggacttccagaatcagtacgtttcctggagaagaaaggccggcacgacgaagcagaagccatcgttgtttccttcgaagaagctgccgctgccgaaggtaaagctgccgatgccaccaccgctgtggttcatgacaacgctgccgagggttccgtatccatctggtcagctgctttgcgcaagcgcaccgtcgcgctgtggatcgtgtggttctgcatcaacttgtcctactacggagccttcatttggattccatcgctgctggttgccgacggtttcaccctcgtgaagtctttccaattcactctgatcatcaccttggctcagcttccaggctatgcggttgcagcgtggttgattgaaaagtggggccgtcgcagcacattggccacgttcctggttggttctgctatctctgcagcgctctacggcttggcaaatgtggagtggcagatcctggtcgcaggttgtttactatccttcttcaacctgggcgcatggggcgcactgtatgccattgggccggagctttatcccactaatgtccgtggaactggaacgggtgctgccgcgggattcgggcgcattgcttccatcatcgctccgctcattgttccgccagtgattgcttttggtggaccaattgctttgttcgctctctttgccaccgcgtttgcgatcgcagcgattgcggcgtttacgctgcctgagcagaagggtaagtctctcgctgattagtgagatccttccaccagtttttcacctgcccaacgatggtgcgtttctgcgcctggcggaagtcctccaaattgcggggcaggttcgcgataaccgtggcaccctgggtgcgggtgaccacgatatcttcgcgcagctgcatggtactggggttatagtctcttgatgtcatctgctgctctccttaaaatctcgattatttgctctgctttatcgtcgggagcagctttcgctgcttccctgaccttgtgaaactcagagcgaatgttaaacacccgcacctctcgggattctggattgcgataagcctccagaattgatccccacgcatccttgttctttgccacttcctgcgcgccttcttctgtaaggcgcgccatttttctgcccatttcatgggagatggaaatcaggccttcatcttcaagcatggacaaggttggatagatggttcctgggcttggagtccagttaccttctgtttgctcactgatggtggtgatgatctggtagccgtgcattgactcagcttccagcagcaccaaaatcacattgcgcagatcgcctctgccagcacgtccaccgcgaccacgtccgggtcgcctgccgtgatgatgtccatgtccgtgcccttcagcgtgccgttgagcatgacgcctgcccggccttcccctgaattctccggatccgcgtgatccacaagattcattgtttagttcttcaaaatgcatatcattatctcctgttcttgaactgaagttaacgatatatcgcaacatatctctacgtcaacgatatggctattctagaacaactttgcaggtcagtctatgtcggtaagtcttgccaaagataggattgcctgggctgagtgacttagaatcactaaaggcagtgccccacatcggagtcactgcctttagaaaaatgaacttttcttaaccgcgcgccatgtccacaaaacgtgaatagtgcagctggtgcgccacctggacggtatcgatcgggccaccacggtgcttagccaaaatgatgtcggcctcgcccgcgcgctcgtcgtccttatcctgggagtctgggcggtatagcagcataacgatatcggcgtcctgctccagcgagccggattcacgaaggtcagcaagctgtggtcgcttatcggtacgggattcaggtccacggttcagctgggaaatcgcgatcaacggcacatcgagttctttggccagcagcttgagctgacgggagaactcggagacttcctgctgacgggattccacgcgtttaccggagctcatcagctggaggtagtccaccacgatcattttcagatcatgcttctgcttcagctttctggccttggagcggatttccatcatggtgaggttcgcggagtcatcgatgaacaaaggtgcctgggctaccttgtctaacttctgcaccatcttttcccatgcggtttcatccatctttccaccacgcatatcagccaggcggatttctgtttctgcagagagcaaacgcatcacgatctctgacttggacatttccaaggagaaaatgacagacgccatgttgttcttgatggatgccgaacgcatgaagtccaaggcgatggtggatttacccacaccaggacgagctgcaacgatgatcatctggccaccgcgcagaccgttggtgaggtcatcgagatctttgaagccggttggaataccggtggcgatgccgccgtcgttgagcatttccagctcagccatggtttcatccagaatatcggctaggactgcatagtcttcgctctgattcttttgggaaacggcgaagacttcttgctgcgcgcggtcaatcaccgcgtcaatttcggcgccttcatcgccctcgtagccgagctggacgacgcgggtgccggcgtcgacaagcctgcgaagcactgccttttccgaaacgatttccgcatagtagcgcgcgttggctgcggtgggaacggactggatgaggtcgtggaggtacgcgccaccgccgacgcggtccagatcgttggttcgatcgaggcgaccggagacaatcacggggtcaatatcacggttgtcactgaacaggtcaatgatcgcctggaaaatcagctggtgggacggcctgtagaagtcttctggggtgaggatatccagaatgtcgatgaccgtggtcggactgagcagcatcgcgcccagcacgcccatctcagcgtcattgtcatagggaggttggcggaagtctcggtattcacgggactcgtccttgcgacccctcttcttgaagccctgagagtctcctcccctagttccctgaccaaaggcctgggccggggagaaatcttcaaacgccggagcagggacatctacgtgtgcgtcatccgcgaaggaatcgcttggctcctgtggaggtacgtagtcatcatcaaaacttgcggcgtgtgtatctgtagccattttcttttccccaatctgattctaagttcactctagcccctgcataggcctttccagaaggcacgaaagcccccaccccgaggctttgtgatttccaactcaacaagccgtacagacacattcttttacaaaaacaatccacagagcgttaggttaacaaccctaattatccacagtttttaaaagttgcacacatttgcactccacgcctgtggataacttgtggataacttccccacaattgacatgaattgagtcatatctgcaggtcacgacggcgtgtcacactgtggataactagtctcaatcggtggataactattctcacctgcggttttagtgtcccaaactcaccgacaataggcctaagcaggggttatacagaaagagaatagaaggttaactatccacaattactcacagttatccacaggcctgggataactttaaattcgggaaaatatcccttgtatatttgtcaaagtgtgttagataaaaaatacttcagccccactcctgctgtttggagtggggctgaagaatgctgttgtcgttgggtgatttacctcttctgtgggtagatcaccgccgtcgcgtgcgcgttgtcgttacgctgcgacgacctcaaacttcacgcgggaaacaattccgtcggtgagctttgcttctacctggtacttaccggtggtcttaaccaggttcttcgggagaacaatggcacgcttgtccaggttcgggccgccggctgccttgactgcgtcgacgatgtcgtcagtcttaacggagccgaacagttttccgctctcggaggtgcggactgcaatggtaacaccttcaagtgcttccagtgctaccttaacttcgcgagcgtggtcgaggtcgcgaatctcgcgagcctcctgggcacgcttgatgccctcgatctgcttctcagcacccggggtggctacgattgccaggccacgggggagcagcaggttacgtccgtagccgttcttaacctctacgatgtcgccagcgacaccaaggttttcaacggcggcggtgaggatcagcttcatgatccctgcctttcgtggtttttgagtgtttgtgaatgttttagaaaagaaaagctttagaacggtggctcatcgtctgcgccgccgaacccgccggagccagctggtggtgcagaattccaagggtcattgtccggtgctgcctgtgggctgcctccgccaaatccaccttggttgaagttgttaccctgggactggttttggtttccaccaaatccgccctggttgctttgctgctggttgccttggtttccaccgaagccgccagagttctggttgctgaatccaccttgctggttgccttggtttccaccgaggccaccaccttggttgccgccaccgtagtttccgccagagtttccaccgcgcggtgtgcgctggacatctgccttggcaaatgttagtgatggtccgacttcatccgcttcgacctcaaaaacgctgcgcttttcgccctcacgggtttcataggagcgctgcttgaggcgaccggtgacgataacgcgcatacccttggacagggactctgcaacgttttcagctgcctgacgccaaacgttaacggtgagaaagagggcttcgccgtcttcccactggttggtttggcggttgaacgagcggggagttgatgcaatgcggaagttagccactgctgcacccgatggggtgaagcggagttccgggtcagcaacaatgttgccaacgacggtgatgttagtatctccgattgccataatccttcaactacctctctagagccttaaagttctttacttgtcgagtcgcagaaccttggtgcgcaggacaccatcattcaggttcagaacacgatcgagctcgagtacggtcgcagactcacacttgagatcgacgacggcgtaaacgccctcttccttcttgtcgattgggtatgcaagacggcgcttgccccaaacatcaaccttcacaacgtcacccttgtccttgcggacaacctcgaggaatttatccagggacggggcaacagtgcgctcatcctgagaaggatcgagaatgatcataagttcgtattgacgcacggacctcatcacctcctatggtctagtaattgttttttcggccatgccgtcgttggcatagcaggagggtcgttgcgtcagcaacctattcaaggtacaccaaacgcgcggaaatgtcgattcctgatttatgcgttttcgttcacagttcccgcatggaagttatgctctgcttccagcggcctcgcttcagcggtggagatgcttgccaacgtcaaagctgaagccgcgagcatgcctacaaaggtggttgaagtcttagattttttcatctgttacctgcctttctaccttccttaacgcacttagttagaggaaagttcccacgggaggagggagacgtcgaaaagcaaaatcttttaggcgggcgtggtggcccagaaaaccgcaatcgtcaccggaatcaccgtgatcagcacaatcgcgatgctgaacagcgtccaaatctgcttattcgatttcttatacatgaagctggcaaacgcgccgccgaaacagagaaaacccacaaaaacgctgaccatggtgaccagcaaaactgttgtgctcaacttacttccttcaatgcttttcgacgctcgcctgcgccgaagggcccggccaacaaatcgcgcccggcgtgcgcatccatcaccggatctgcacgtcgtccgagcatctgccggattacacctactatcatgaccacaatgaaggcatctcgggaaatcacgatgagatccaacatttcatgggggagtcccttgttgtccgtgccgagcatgtgccacatcaaaattggccacaccatggcgtctgtaaccatccacgggaacagcactttccactgaggaaatgccagaacagccaacgggaccagccacagtgaatactgaggactccacaccttgttaaacagcaaaaacgccgcgacaatcaaaaaggccagctcagcgactcggggagtgcgctgcaccttgagcccaaggatcaaaatggccacacacgatgcaccaaacaagccgaagctcagcacattaagcagcactggatcattcaaattgatcggcaaattacggtcgatgacctggtaaatcgtggtccactccgcaccacgctcccggttcaggcgcaagaattcattccacgccttggggtacgcgatcatcactggcacattcaccacgagccatgtcaccgcagccgctgcagccatggtgataaacggcttgagattcttattcttgaccgccagcaccaaatacgcaccaagaagataaagcggccacaatttgaacgccgtacccgcgccgatcagcacacccgcaaccaaggggtttccgcgtttcaccgcaagcatcgcaccaatcaccgccgcaatggctggagtatcccagttggtaaacgcatgcacagcaaccaggggagacgccgcaacaaggacggtatcccacactcgattgccagtgagctccaccatcatgcggatgaccaacacccaaaagaacgccaacgcaagcgcggtgacgatgaaataaagaccagattcaggcagcgtatgaaacggaatgacatcaacaaccgggtacaaaaaccgcgtgataatgccacaaatccactggaaaattccgcccaacaccgggtactccatgtacctggtgagatcaccttcctgccacgaaaaggcataagggaaacctggcgcatcaattccgcgccccccatagagcggaacgatgtcgttgtaacaggctgaggtgtactggcgacttcccgaccagttcaaagaaaccacaccatcagtacctctagaaccctggatgcaattggcttttgttaaaaaccccatggccaaaaacaccagggaagtggtgatcaaaacacgcaggggagtccagaaccgctgagtgcccacctgcgcaaaacgaccaaaccgaccgccgattgcattgataaaatcccgtgccaccggttcactatcaccgggcgatacgcggtctaccttctgctggtccaatttctggtccatcggcggtcggctcctttttaaggtcgtttaggctacgaccggattttagccgatccctaagagatctcccgggatagtcagccccggcaggatttctacctgaccgttaccggtctcctctgcaggtgcagtgggatctacagcaggggtatcgattactgcatttggatcctccactggagcttcctcggttgctccttctggatcattagtcgcgatgtttggacttggagtccacacatattccggaactggtgggttaccgtaccccaatgctggagcgatatcccaagtttcgagaggggagttctcgagggcgttatccatggtctgcttccagatcgtggcaggggagttagaaccatacatactgccaccccaggtgttatacaatgcagtgttatcagcagttccgacccacaccgcagtagctagctgaggtgccgcacccaacatccacgcatccttgtttgcaccggtatcaccaagctgagtggtaccagtcttggatgcagaaacctggccatcagccagagcgtttccgttggagtatgcagcgattggccccatggccttgagcagattcagtgcaaccttttcagaaacacgacgctcgccgtcgccatcctcgaactcgtagagaacctcaccgctgacagtctccaccttggacacgaagtgcgggcggtgccagacaccttcattagcgatagttgccatcgcagaagccatatcaagtgggcgggactcatactgacccaagatgatgccctcataaggggtctctccgttttcagtcagtgtctcagggatagttggcaaagacttcgcgatacccaaagcatgcgccatgtccgcagtatcctgtgaaccattttccagatcctgctgcaaacgaatgaagctggtgttgtaagaatgcaacaacgcctgctcgatggaacaggaaccacaaccgctgccaccgacgtttccgatttgagcatcacccacagtcaccggcgcagagctgtatggctgagacagtggaataccttgctgaagtgctgctgccagaccaaagatcttgaatgtagaaccggtctgaagcggagcgtttgcaaagtcccaaccagtcgcatcctcgccgccgtaataagcacgaaccgcaccattagaaggatcaatggagactaccgctgcacggttgttctcagacagaagatccaactggttttgtaccgcttcaacggcaccttcctgagtctttggatcaatggtggtggtgacctgcaaaccacgggtttgcacatcatcctcagtgataccaagctcagacaactccgccatcacttggttcttaatcaaaccattagtgccggtggcttcggtgtacgcactgttggacgcagggtcagtggtttcagggtaggtagcaactgcgcgctcctctgccgagatagcgccaatttccaccaggccgtccatgacatagttccaacgcgtttccgcctcaactggatttgtccaaggatccaactggcttggcagctgaatactggccgccagcactgcgccctcagcagccgtgagctcttctactggcttatcaaagaatgcatgagctgcagcctgcacaccataggcatttcgaccgaagtacacagtgttgagataagcctcaaggacctcgtccttagaccactcattggccatcttcgcggaatagaccaattccttagccttacggatcagcgaacgctcatcaccaaccacagccttcttcacatactgctgagtaatggtggaaccaccacccgctgaagaatcaccagtgattacgccaagtgctgctcgggcatagccagtaatggaaaaaccggggtttgtgtaaaactctcggtcttccgcagccaccaccgcatttttcacagtgtcaggcacctgatcgatcgtcaccatctggcggttgccttctggaggaacgatgcgtgccaattcagtctcaccgtcagatgcgtaaatctgcgaaacctggggtgaaaccaactcttccggttctggaacatcaaccatgatgtaagcacccatgaagaccattactggaatcaaaatgacagcaacaatggcaccaatgatggtgtttcttacagcgtagcccttagagtcgctctttaagcgccttttgccgctgctctttttggcaggaggatttttactattcgtcaactggtgtttccgttcaatcagatctggttcttatctgaagcttgtgctgtagagaatactgcgcctaagcctattcatctgaatctgagaatcagctggccgtcgcggtttccgccttaagcaggtgattccacttgcaggtgggacatacttcaacagtatgcaccgttgcctgccgtccattctttaccaactgttcgatttcttcttcacttcgagcagaacctgccgcccgaccgatttcatcgccataaacccacaaaaccacacgtagatcctcgctgccacaaatcgggcaaggataatctgcgaggtgtccgtgatatttgctcgcagtcaccaagatgaactcggcgtcacaaattgtgtctttttgcaccaaccccgcccgaaactgacggagagtctgcctacgagctagttggtgactgatctcattttgatattgcaccacgattaaaaagtgtagccgtaagccgaccaatgaaacgaccctctagaagcatcgtttagaattgcttttaagtgaataaggaacagcacagaattaaggcctcggagttatcgctcacgctacttctcaagtgacgccaaggtaagttgtactttttctgtccaaattattgctttttccgtagataggttatcgaacggaaattacttggcaataccgctatgctggcaggcatgcctaatttaaacgctgaggagctagcagtccgcgtgcgacccgcgctgacaaaactctacgttctctatttccgccgctctgtgaattctgacctctcgggtccacagctcactattttgagtcgcctggaagaaaacggcccatcccgaattagtcgcatcgcggaacttgaagatattcgtatgccaaccgcttcgaatgctctgcatcagctggagcaactcaacctggttgagcgtatccgcgacaccaaagaccgccgaggcgtgcaggttcagctcactgatcatggacgcgaagagcttgagcgcgtgaacaatgaacgaaacgcagagatggctcgactccttgaaatgctcaccccagagcagctggaacgtaccgaagacctggtggatatcattactgagcttgcagaggtgtacggtagctggaaagagaccgacagcggttcttaacagttttctccatctcaactccggaatttgatgaaacaaccccttcgcgtacttatttcttgtcgacccgaagaaaattcgggtggcaaacgtagtgaacaaaatgatgctgtttttgagttcgccgcatggctagctcgtacttcagacatcaatgttcgtggaatcacaactttcatacgcccttggccgtcttcctccatcagtaagctcggaggaaaatatcataagtggtataagaatttagattcttactaccgcagtcgcacgatcaagggactcaaagaggccggagttgagaagtcccaatgggacgatgatgtttcagtttttgtagatggtccttctgaatccacgctgctcacccatgctgctgaagaattcgaagcggacctcattctgcttggctctgatgcgaccgcaccaaaaggccgctttctggccagctccaccgcagatgccctccttcactcctcgcccgtcccactaggacttgtgccgcgaggggtgaagctttccaaaaagggtgtcacccgcgtcaactacgctttcaccaatgaaagcgatgactttgagcaaggtttacgctcttccgcggagctcgccaccaattggaacgttcctcttcggatccttgctttttcacccacaggcattacttccgcaccaacgtcgcggagcttggatatttccactgagctttcctccgagtggcgtgaactaacgctcgccatgcttgatcgagcccgtgatggcgtcctcacagaccacccaaacttgagcgtgagcagtgaaaccggttctggctggggttggagcggtgcaattgatgctttgcgatggaagaaaggtgacctgctgtgcatgggaagccatcgcacagacaccctttcacgtgtctttgtcggttcggaaacaatggaaattatccgaaactctcctgtaccgaccatcatttatcccggtctttaggctctccaacagcagaggactagacttaagtatgcctgcaaaggaggacaacttcatgaacacccaaccagagcatccagaaaatgatctagtcgacgaagccgatttttctaaccggcccaggatctactcggacgatcctgattccttggctgatgcgccagacccagcgctggagcatgagaagaacaagaaatcttcacgccaagcactcatttatctgtttgcagttccactagttacattcgtttctgcatacgtattggcctgggtgtcacgactccagggcggtcccatctgtgacgccggtgaggccgtgtggatttgttcccgtgctgcagaactgtggtggccaattaccactagcgtcatcgcatttggtggcatgcttggatctgcatggatcctctatgacaaataccgaaattacctacgctggcgtccttggatgggcgtgttgtggattttgattccattcagcatgctgtggggaacctcggtgctcaccttgtccatcttggggcactaaaaacttcacataaatgacaaaagtcggaacctttgaatctttcaaaggttccgacttttctctttccctacttagcgccggtagatcctaggactacttcgaactccagcagggaagcgccggaagcgacaggcttcttatctgagccgtgggctccctggccatgaccgcccttggccttttcggcatcacgccacgcgttatagctgtcttcatcagcccactgggtgactacaaagtagcggtcttcaccggaaacagggcgtaacagttgaaagccctcaaatcccggagcggaatccacggcattttggcgggctgcgaagcgcttctcaagctcttcaccagcgccttcgggtacggaaattgcgttgatcttaacgatgctcatacccagccaccataccctttttaagaagtaacgagcggatcaattccttgctcagcgaaatccgcagcaattgctgcacagcgttcgcgcttgcaatgacgggtctcaacattggcgaagcaatcagggcacatcaacacgagctcgcggcaatcatcttcgttgaggcagtgctcaaatttgttggtgggagtatcgcaatggatgcagtgtccgacctctttgtaatcctcgccgaattccatatgcatgcgcttatcgaaaacgtagagggagccttcccacaggcccttgttgccaaactgctcgccgtagcgaacgatgccgccatcgatttggtagacctctttgaaaccacggttgatcatgagtgaactcaggatctcacaacgaattccgccggtgcagtaggtgaccacaggcttgtctttgagatcgtcgtattttccagactcaatttctgcgatgaaatcatgagtggtttctacgtcagggacaacagcgtccttgaacttgccgatctgggcttccattgcgttgcggccgtcaaagaacacaacttcatcgccacgggcttccacaagctcattgacctgctgtggtttcaggtgaacgccgccaccgacgacgccgttttcatccactttgagctcatctggagcgccgaaggcaacgatctcatcgcggactttgacactgagctttgggaaatcctcagcgccaccctcggaccacttaaactgcatgcggttgaaacctgggtactcgcgggtctttttaatgtacgccttgcaatcatcaatatctccgcccacggttccattgatgccgtgagtggagatcaggatgcggccacgaagattcagtgactcgcagagctcacgctgccacagctgaaccgctttagggtcagagagcggggtgaatgcgtaataaagaagaatttttgaggtagccacagttcttcagtctagtgcgatgtgtggctaccttaaaaacgaggcttttactcataacgcaaggcgtcaattggatcgagctttgctgccttgttggcggggtagtagccgaaaaacaggccgatagccatggaaaataccaaggcgatcacgattccactcagtggtggcaaggaaatgtagccaatagcgctggacatgatcaatcccaaaatgccgcccaaaagcacgccgaggatgccaccgatgaaacaaatgatcatggcttcaacgacgaattgcaggcgaatgtcacgtcgacgagcgccgagggcttttcggacaccgatttcgcgggttcgctcggtgacagacaccaacataatgttcatcactccgatgccaccgacaagcaaggaaattccgccgatggctgagatacccaaactcattgcgccgagaatggtgttgaactcttcgatctgtttacggaagtccaacatggcaacgtggtgcgagtcattgttggcgtacagcgcgtcgaagtaggtttgcagtgaacccttaagtgaatcctggtctacgccctgagctgcacggatacttaacgtgttcaatccatcttccgtgtgggtgatgtcattggccaccgtatatggggtgtaggtgtggacggttggattgcttcccacaagtccacctgctgcggcttctttatacacaccgataacccgcaaaaatgtctcttgaccgttgagttcaaaagctacttcggaccccagagcgaggttggggtttgcgtcgaaaagcgtattaaaggtgtctggggcgatgaccgcaacggggcgctgagcggcaacatcgtcttgcgtgatggcgcggccgtagttcatttcgacgccattcatccacatataatcctcgttgacgccgaggagatcggatttaagatctgcggtgtcgccgatgagagtgccttgcgtacccattccgccaacgctgattcccgtgatgctgcctgcgaaacgatcgcgcagcgtatcaactgtttcttccggaatcagattgccactagagtttgcagccccagaaaaagcgaacatatcgggttcgggggaatcttcgtcggggcgttcctccacctgcgccgacagatcattcgcgcccaagctttccaaactattcaaagtttgatcctgcagggctttaccaatggtcaaaattccgatgactgatgcgataccaatgatgactcctaacagcgtcaacaatgcacgcatcttgttgcttctcaggctggtgagcgccaaaagaattgattctgcaaggctcatgagtgtttcacctcagacccaatgatgcgcccgtcaaccatggtgaccacccgatcagattcatcagcaagctcagggttgtgagtaataaacacgatggttttgccctgctccttgttgagctggtggaaaatatccatcaccatccggcccgttgcagaatccaacgcaccagttggttcatcagcaagaatgatctcaggatcgttcgccaacgcgcgagcaatggccacgcgctgcttctgaccacccgaaagctcattgggctcatggttgagacgctcacccatcccgaccatttccaataattcaaccgcacgacttctccgctgcttagccggaatgcccgcatacatcatgggcatttccacattcttcaacgcatcgatccggccaatcagattgaagttctgaaacacaaaaccaatcgatttagcgcggtggctcgccaaagcatcatcgctgatatccaacacatccacgccatccaaggtgtacgtgccatcagttggcttatccaacaacccaatgatgttcatcatcgttgatttacctgagccggacgtacccacaaccgacacgaattcgccacggtccacatggaaatccacaccgtgcaacacggtgagttcaccttcagatccaatgttgtaggtcttgacaatatttcgcatttcgatgaggctcataggctaaatcacctggcccacggtttgcttggcagaaacggcaggggctgcagggtcaaaaggggccgcaggactaaaaggagccgccgcctgctccaccgtatctgcgtgaagtttcacagtttctccgatgaggccccggtagtttccaggctgggtgagcactcgagcgtcttctgaaattccagcaccgctgactgcgatatcaaagtcatcggattcagctgtttttacttctacttcttctactttgttgtcgtcgctgatgatcaaaacagcgtctttgccgtcatcatttttgtacacagcttccaaaggaacggtcagtacgtgtggtgcgatttcatggacgatgcgtactcgagcggatccgccgaggttgaggccttcgcggtcgccggtgacggaaatttcgatggggaaggtgacgtcagtgttggtggttgtggcgcctgcggcagctccttcacctgtagctggggcactggcggcagctgcaatgggggagactttggatactcggccggcgaattctttggttccggtcgatggggtagtgaaggtgacgcgggatccgatggtgacgttgctgatctccgcttcttttacattcgcggtgatcttcagttcggaatcatcagcaacactcaacagtgcgccggctgctggttgaccttgggctgcctgcacggatgaaacaatgcctgagtatggggagcgaacggtggtgttgttgatatccatccgcagctgggacgtggatctggtggcggcttcattatctactgatgccaaacctaaagctgcatcgatggcgcttgattgggcttccaattggtgttgggtggaaagctgcgcggtctcgaggccaagtgctgcgtcttgttgtgctgagtgggcttcggcaacggcgcgctgtgcggcggctagttctgagtcaacttttccgagtgaatcaatgtagatccgctcggctatttctagagcttcagtggtggatgcgacgcgtcgctcagcttcctccaaagcggtgtaggactgcaagtaagtctgatcttggctaggccacgtggaggttttggaagcaattgattgttccaggcctgcaacctttgcttcagctgcagcgactgcctctaggtcacctgcagcgcgggcttgagctagttcggattccgcagaagccaaagattctctctcatcgagcagaccaatgacatcgttgaggttgctgcgatcgttgttgagcagtccgaagtccgcgcgcagtcgttcaatttcagcagcatctgcttgctcacgagctgccttgagagcatccgattgagcgaccatggtggaatccaatccgccatccacatctcgctgcttcgcttcaaaactgcggatcgcatcctgatatgcctgtgaggacgcccgcaacgaggaccgcgccgagttgatctccgggctcaaaccactatcaagaagttccctggactgctcatatgcttgctgcgactgcgcgatggaattgcggttcgccatggctgcacgcgcattgttggcatcagtttcatccaactgtcgttgcagggcagaggcatccaactcagccaacacctgatcagctgccacacggtcaccaaccgcaaccggcaagttcgcgaccggcacagtcagactggtgtaaatggtggtggttcgcgcagcttcaatatttccgttgacagacacacgcgccacgattccctcggaggaaatctcccgaacatcagaagtggcaatcacctggtcattcgatgatgaacgcagaaaataaaacgaggcagccgcaatgatcaaaatcaggaccacggccacaatgattaatttcttcggggccaaggaaagcgaaggtggtagtgccacagtgagatggccccgaggatcaggtaaccccggggcactcctttcataagttcttacaacaagtctgtatccaaaatgccagggtacggacataccattcacaacacatcagggaatccacctactttgttttcccctagaaatcccccatttcatcactcccgaatgggggtaatgcttgatcgatcaattgagttgcttgatcgatcaggtctgatttctgctgggaatccccacattttggaacgtagcgtcgataagcgtgcggcgaagctttttcggtcgcggccgttatctttttaagaggagaaattttagatgagcacgtccaccatcagggttgccattgccggagtcggaaactgcgcgacctccctcattcagggtgtggaatattaccgaaatgcggatccttccgaaactgtcccgggtttgatgcacgtcaaattcggtgattaccacgttggcgacattgaattcgtggccgcgttcgacgtcgacgccgaaaaagtaggcatcgatcttgccgacgccaccgaggcttcacaaaactgcactatcaaaatcgccgatgtcccacagaccggcatcaacgtgctgcgtggcccgactctcgacggcctgggcgatcattaccgcgcgaccatcgacgagtccaccgccgagccagtcgacgttgtccaggcgcttatcgacgcaaaagccgatgttttggtgtcctacctcccagtgggctccgaagaagccgacaaattctacgcacaagccgccatcgatgcaggctgcgcctttgtcaacgctctcccagtattcatcgcctccgaccctgagtgggctaagaagttcactgacgctggcatcccaattgttggcgatgacatcaaatcccagatcggtgcaaccatcacccaccgtgtcctcgcacgcctttttgaagaacgtggcgttcgcgtagatcgcaccatgcagctcaacgtcggcggcaacatggacttcaaaaacatgcttgaccgcaatcgcttggaatccaagaaggtctccaaaacccaagcagtgacctccaacattccagatggtccactgtctggaaaggtggaagaccgcaacgtccacatcggaccatccgaccacgtccaatggctcgatgaccgcaagtgggcttatgtccgcctcgaaggcaccgcattcggtggagttcccctcaaccttgagtacaaactcgaggtgtgggattcacccaactctgccggcatcatcatcgacgctgttcgcgccgccaagatcgccctcgatcgcggtatcggcggaccgatcatgccagcaagctcctacctgatgaagtccccacctgagcagcttccagacgatgttgctcgtgaacgcctagaggcattcatcatcgaggcgtaaaattaggctaaaaatttgggttaaggtccagtttcgatccggactttaacccaattcttttgccagattcacgttttagaaataatcctcgcaccactgttgaccggcttcaacaaagtcttcggcagtaccgaacacatgagtcgactcggtatacatatcccgcatgactagacctggatctattccttcaagcattcctactgatgtggaaacactcggcatatacttttcttttgcgaaaggaatcggccaacctttatctaccaacctcggattggcaataatgtactttccctgttccgtgggcaaattgattggctcaacaacttcccacggtgctggatcagcgatgttgactacaacataacccgactcagggttggaagttttcaacatcccaagggctgggttgtttgtcccaggtgggccatcgtaaaaaccaccgctaagtatcagttcatccaccgcattatcaccacagatgtacatgtgaacgcttatatttccgtcctcatcatgggaaattccagatttcccttgcgactctacgttgacgtagtttccgcagcctgcaagggccaaaaccggaagaattggtgcaatccacttcaacttcatgagcttcaccttatacatctctataagaactcgcccgctaaacagcctgaaactgctcgacaaaatccagtgccttaacgcttccggtacaaagctttgcgctggtacttcggctctgaagtaaccaaaactccgaggttgcggaaaatgccctcatcaactgatccgaggatcgtggtggtgtggacatcgcagccgcggagatttttcagctcgtccagagcccggcgggcagtttcggagttcgcagcagacactgacaaagcaataagcacttcatcagtgtgcaggcgagggttgcgggatcccaggtgctgggtcttcagcgattggattggctcgatggattcaggggagaggagatccacgctgcgatcaatgccagcgagttccttcagtgcattaagcaccatcgctgcggagcatccgagaagttctgaagtcttgccggtgacgagtcgaccatcgttaagttcaatggcacaacccggcgcgccggtggattcttcaacatcaagtgctcgggcaaccacgcggcggtcttcaacggtgcaaccggccttgctcatgacaatggcgatgcgcgctgaaatggtatcgtcctgctcctcgcgacgctcgtcgacaagcgccttgaagtaacgccgaacaatttcttggcgggcggcttcctggcacgcggcgtcgtcgataattgcgcttccgaccatgttgacacccatgtcggtgggggatttgtacggcgatgagcccgacagcatttccagcatggttttcagcagcgggaagacttccacgtcgcggttgtagctggtggctttggtgtcataggcggcgaggtggaaaggatcgatgatgttgatgtcatcgagatctgccgtggcagcctcataagccaagttaactgggtgctcaagaggcaggttccaaatggggaaagtttcaaactttgcgtagccggacttgattccgcgctggtgatcgccataaatctggctcaagcaggtagcgagctttccagaacctgggcccggtgcggtcacaacaaccaaattgcgggtggtttccacatactcgttgatgccgaaaccttcctcgctaacaatgcggcgagcatcagttgggtaacctggaatcacgcggtgaacagcaaccttcaggccaaggcgctctaggcgctgcttgaacgcgagtgcctgatagttgtcatcctccaactgtgtgagcaccacatgctccgccaaaaagcccagctcacggaacacatcaatgaggcgtaaaacatcttcctcataagaaatgtcgaggtcggcgcgggttttcttgcgctccagatccttcgcattgattgcgacgaggatttccagctcatctttaagctcagtgagcatagcgatcttgttgtcaggcgtgaaacctggcagcacacgggaagcgtgcatgtcgtcgaaaagcttgccgcccatttccagatacagcttgccgccgatctgctcgcggcgctcattgatgtgctgcgactgcatcttaatataaaggtcgcggtcgaatccgatgctcatagcgccaactccccagttgcttcagctgaaatctaacccctgaaacattacctggacaccctatgaaatgggcaaggccccagggaggaggcttatcgccgaggttggtggaagtcggttttcgcgaggggtcggggcgtagcgatttaaagggctttgaggttgcagtgacccatagattggttttgagtgggttaggcccttagaggcgattctaggagcgttacttttgaggcgattgaggctgctgtgattcctgcggggtcactgcaggttgactgttcaacttctcgttacagatcagcggagaacttaaaaatcgaacgaattttagcaatcccaacactccgtcccccaacttgcacctcctgtgaggttccacagcaaggatccaccacatcccacggcaaattccggagtctgtggtggattcgtgcaggatccggcgacgaaaagtgcaaaaatccaccacaaatttcaggatcaaaaattttgtggtggatttttgcactaaggaagccactgacccccgggctggtgggggtcagcgccttaacgcttttcgacgttttactcttggatgtttccgtctacatcaacaatgtgtgcgcggatgaaccactggaatttctccagctccgcggcctggctgatgtagatgtcttcagttactggatccactgggccggctgatgccatggactcgcgaactccggtcagcacttgggtgtacacgcgattgaggtcagtgaggtgtgcttggacatttccggcattgcgctcatattgcagtggggtgcggtcagcaacgtggccttctggggttccaactggtgcgcctccgagggtggaaatgcgctctgcaacttcgtcagcatagccacgaacaaggtcaacctgtgggtcgagcatttcgtgaacagcaatgaagttggggccagtgacgttccagtgcacgtgcttcaagatgaggtgaagatcgttgtagtcggtgagacgctcctgcagtccatcaataagctgctttgcgtcattctcgttgattccagggactgtgtagtttgccatgacccctattatagcactgcttgataaattgtcaccggcccttagcctaagcttatttatattaggttgtcctatcctgaaagtgccgattcccgcaggccacgcttagttttttatcaaatcggcacaccggctactaaggttggtgattatgcctgaaggacacgtgattcatcgactagctggggaactcaccaagaattttggcgataccattttggacgccacttcacctcaaggacgctttacttctgaagcggcgatcatcaacggtcaccgcatcgcggttgcggaggcttacggcaagcacctgttcgtcgagttcgatgcggatcaccctgagcacattttgtatatccatttggggctgattggcacgttgcagtttgaacctgcggaagaaacccgcgggcagattcgcctgcacctttccgacggggagatcgcagctaatttgcgcggaccccaatggtgcaggttgatcaccgatgcagagcgcacccaggccattggaaaattgggcgctgatccgattcgcgatgatgccgatccggaaccaattcggattaaggtgcagcgctcagggcgaagcattggttcgttgttgatggatcagaagcttttcgcaggtgtgggaaatatctaccgtgcggagacacttttccgcctggggatttcaccgttcaccattggaaaagacatcaccacggcacagttccgatccatttgggcggatcttgttgggttgatgaaagacggtgttgtgactggtcggattgatactgtgcgcccggaacacacaccggaggcgatgggtaggccaccgcggaaagatgatcacggcggtgaggtttacacctatcggcgaaccggtcaagagtgctttctgtgcgcaactcccatcaaggagcaggtcatggagggtcgcaacttattttggtgtcccggctgccaacgctagacagattcaccttttgctgtcatcattggctctacacgtttaaatgaggaagttaaggagtcggccgtgcgcttttatcagcaactacacctgctgcaaaagcctgcgccgccatgccttctaaacgtgttgaacttctaaaaacacatttttaagccctcccggcgcagctgaaaactcagtcgccgggagggcttttttgtacccgaatttgtacccgaatttaaggaatcgctatgaatcatgttgttaattttgcttcacatttggaagacgcagccctgaagcaagccgaagctactgccaccatgccgtttatttacccgcatgtggcgttgatgcctgatgctcactttgggctgggttcgtcggtgggaacggtgttcggcaccaagggtgcgatcattccggcggctgtgggtgtggatataggttgcggaatgataggagtgtgtaccaattacacggcctctgacctggagggacgtgatttggtgacgcttcgggattacatcgagcgggtgattccgttgtctcctggaaattacaattccaccaccttgaaggaaaccgcgaaggtgaaggtcgcggagttggaggaactcgcggagcgcgatggtgtagatttgtcgcactctccgacgtggaagcgccagttgggttcgcttggtggaggtaatcacttcattgagttgtgtcttgatgagttggatcgggtgtggatgtttttgcactctggttcccgcggtgtgggtaacaagattgcccagaagcacatcaagatcgcgcaggccgagtgtaagaatgaggagcttcccgataaggatcttgcgtacttgaccgaggggactgaggagtttgagtcttacatcaaggaactgaattgggcgcagcgttttgcgttcctcaacagggaagaaatgatggacagattcgcacgggagctgggttttttcgtcgacaagcagcttgaagaggtcgagcgcatcaactgccaccataactacacggtccaggaggagcactacggcgagaccatttggctcacccgtaagggtgccgtgttggcggacgaaggcacgccggcgttgattccggggtcgatgggcaccgcgtcgtacgtggtcagtggcaagggcaacgccgaggcactgcggtcggcgccgcatggggcgggccggaggatgtcgcgcaaccaggctaaaaagcgcttctcgacggccgacctggattctcggatggcgggcatcgtctaccggcccggcaaggagtggatcgatgaaattcccgacgcttacaaagacatcgatcaggtgatggccgatgctgccgatttggtgacaattcgccataaattgcgccagatcgtcaacgtgaaaggcacctaaagcgcattaacggtaaagtgcgagaggtattttgacgggtttagattgagggatgtggatagtgctgaaaatccgacggctgcttctacgccgtgtccttccgctactcatcaccttggcgctcctgtgcggactggtgcttgcgtggtttatctatcctgcgaaggctgagcccaaaaaagttgatgtagttctggtgctggccggttccagcgatggtcgacacgaatatggtgccgagcttgttgaagaaggctacgccagcaattacgtcgtctccaacccgagtggctccaaagacaaagtgggatatgcccactgcgcaggaaagtcacggccaaaaaatgcggaaagtttctgcatggatccttaccccgtgatcacctccggcgaagcccgcacgtttaacgagcttgccaaaaaggaaggctgggaaagcgtattggtagtgaccagccgcacgcacacccaacgcgttcgcaccatgtttgaccagtgctataccggtgattccacagtgctcaacgtcaacagcctaggacgtaccgggcttcacaatgcagtactccacgagattggcggcttcattaaattttggattaccgctccgtgcgcggacacaaactaaggacgttccagctccaacagccactgttttgcttccaagcctcctctgtagccacctaacgccccatcagtgcgcagtactcggtgacaaggagcaaagattggcaaggggttggtggcgcaggcgcttcccactgcacgaaccgcgcccacattattaagctcagcggcgatctgtttgtaagttttactctccccataaggaatggacagcaaaaattcctgcactttaccgcggaagctcagcagattttggcttggccaatccaggggagtgctgaactctttacgtttccctgcgaagtattcttcaagctcagcaactgcctgttccagcaccgcattggttcccggggtcgacccgacagtacaagctgcgtagttttcatcggagaatgccacataggttagcccttggtcacttgcaacaagaagaagctctccgattggtgattcatagcgtagatggtgcatttttcaagtcctctttataccctcacaacaatttttcctgaggttttaccctgctcaacgagccggtgcccctccatgatgtttgcagcgttgagcccatccagcaccgttgctgtcacggactcaaactgaccccgatcaaccatgtcggcgatcttattcagaattttcccttgttcacccatatcaggagtgttgaacatagcgcgggtaaacatgaactcccagtgcaaagcgatcgctttttgcttaaaagcgcccaaattgggatccactggatcatcgatgagcactaggtgggactggggtttcatcaacgtggcgagctctacttcacgcccagtagtccacgagctgaaaacaaaatccacgtcggagatttgctcactcaaatccttggagtgatcaatcacctcatgagcaccgagctttgtcacccattcttgtgattcagggcgagaagctgttgccactactttcagaccagtgagagctcgagcaagttgaataagagctgaaggcacacctcctgaaccgcccaagaccaacagtgttccagtagttgactgagttactcccaatcggtcaaaaagtgactcccatgcagtgagcgcgacaagtgggagagcagcggcgtcgtgtgcccccaagctttgtggtgcgtgacccaccagccgttcatccaccacctggtactctgcgttacttcctggacgctgattggatcctgcgtagaacactttgtcaccaacattgaagagcgtgacctgcgatccaacagccaccacctcacctgcagcatcaaaacctaaaattttaggatgcttttgcttcccggcccgcatgcgtaccttggtatcaacagggttaattgagaccgcctcaatgtggactagcagatcatgtggtccgggagttggtcgatctacttctacatcgatcaggaaatctggttgatcagaagggatggaatctaacattgcaacagcagacatagtgggatcaggggtatccatttgcgcgctcatgcccccgatgttagcccttgggtacgtttcatgcccgtgttttctctgctcagcgatgtaatctgccgattctgtatttgacgtgcttttttagcacgccattaagctaaaaataaggttagggtgcgttatgttttcaggtatcaaaaggtgctaatgcctttattgtgtttcgcattgtcatttaccacatgaagaagcggacccgtttaggttgagaatcaagtacctgtcatcgagaatttcctcaaagatctcaagcccaaacaagactcgtagcagaatgtggcgcaggcacactggctaccagctgagttagattgataacttagctggatatccacctttttaatctggctgaattcttcacagcgggctactgtttttcgagactaactttaacgatctagaacttgcccgaaatattgctcaaagcatctctcaaagcactgcctaaagcactgcccagagccttgcccggagctttgctcaaagcatctcaagcatcaggcaagacctccccataagttcactcaagcaagttctcccgaacagattcacccgagaagtcgacagaccccattaaacagcccgattcaagaaaggcttcgcagccatgagcaccaccaccgcgcccgaagcacggtttcctgtcgtccctttgaccgccatgagtttcgcggcatttgtttatgtcacgttcgagatgtttgcagttggcctcatcaagccgatggccagcgatcttggagtgtcagaatccagcatcggcctgttgatgactgtgtatgcgactgtcgttgccgtggtgacgatccctgccatgttgtgggtttctcgatttaacaagcgcacagttttcctgattactctggcatttttggccacgggcattgttgttcaggcactgaccgttaattatggaatgctagccatcggccgcactatcgcagcattgactcacggggtgttttgggcacttgttgggccaatggcagcgcgtatgtccccaggtcacactggtcgtgcagtaggcgttgtgtcgattggatcaaccatggcgctggtcgttggttctccgctggcaacatggatcggtgaactcatcggatggcgtcctgccacctggattcttggtgcgctgaccattgcggccgtggctgtactcattccaaccgttccatcactgccaccacttccagacacggaatcagagtccaaagaaaagaaatcccttccatggggtctcatttccctggtcattttccttctccttgccgtcaccggtgtttttgctgcctacacctaccttggcctcatcatcgctgaaacagcaggggacagcttcgtgtccattggcttgttcgccttcggtgcactcggactcattggcgtgacagtggcaacccgaactgtggatcaacgcatgctgcgtggaagtgttcacaccaccactttgtttgtcattgctgcaattctcggacagatcgcattcggattagagggcacactagccgtagtagctatcttccttgcagtcaccgtgtttggtggagcatacggcgctctcccaaccctgggaaccaccatcttcctccatgcgggtcgcgaccacccagatactgcatcctccatttatgtggtcacttaccaagtgggtatcgcgtctggcgcggcacttggcgcgatggctgtggatgccgattgggttgctggcactttgtggatcatggctggactgtcattggcttccacgttggccttggcgctgtggtcccgcccgctactgaagtagcagcccaaattcagcccactgaatcaaccccaaaaccacccaaaagtcacacttagcaaacaattaaattcatcacaaaccacccctgtacaaaattagcaataaaggtcaggggtgttttgcaaatgttcacattgcgaaatttttgttgagctacagatttagctagtgtttttgttccagaaccctaaatgaggttctacccttaacagagcttcccgcaaaaacaccgattaacaaggctaaatgatatgaccatcgacctgcagcgttccacccaaaacctcacccatgaggaaatcttcgaggcacacgagggcggaaagctctccattagttccactcgtccgctccgcgacatgcgcgatctttcccttgcttacacccctggtgttgctcaggtttgtgaagcaatcaaggaagatccagaggttgcgcgcacccacacgggcattggaaacaccgtcgcggttatttccgacggcaccgctgttcttggccttggcgatatcggacctcaggcctcccttcccgtcatggagggcaaggctcagctgtttagctctttcgctggcctgaaggctatccctatcgttttggacgttcacgatgttgacgctttggttgagaccatcgcagccatcgcgccttctttcggtgctatcaacttggaggacatctccgctcctcgttgcttcgaggtggagcgccgcctcatcgagcgtctcgatattccagttatgcacgatgaccagcacggcaccgctgtggttatcctcgctgcgctgcgcaactccctgaagctgctggatcgcaagatcgaagacctcaagattgttatttccggcgcaggcgcagcgggcgttgcagctgtagatatgctgaccaacgctggagcaaccgacatcgtggttcttgattcccgaggcatcatccacgacagccgtgaggatctttccccagttaaggctgctcttgcagagaagaccaaccctcgtggcatcagcggtggcatcaatgaggctttcaccggcgcggacctgttcattggcgtgtccggcggcaacatcggcgaggacgctctcaaactcatggccccggagccaatcctgttcaccctggcgaacccaaccccagagatcgatcctgagctgtctcagaagtacggcgccatcgtcgcgaccggccgctctgacctgcctaaccagatcaacaacgtgctcgcgttcccaggaattttcgccggcgctctcgcagccaaggctaagaagatcacccccgagatgaagctcgccgctgcagaggcaatcgccgacatcgcagctgaggacctcgaggtcggccgcatcgtgcctaccgccctggatccccgcgtcgccccagcagtcaaggcagctgtccaggccgtcgccgaagcgcaaaacgcttaaaaatttgcttatcgacgcctccctccccgtcgaggcgccaatattttaagagcaaacttgaggcccacagaagcaattctgtgggccttcaaattcactgatcaagaactcaccacaaccccgagaccagacctttaaatcaaacaaatttttgcactttatccaattcgcaaaaatccaccacgaatcacagaatttctgcgtcttgtggtagatattcgcatgcgcgttccactgcgaaaagctagaccaacttgaggtagagggcgtcgaaaagctctcttgccttggagtaatggtgcgcaaagcgcggctgatgcgtcgtgccgaatggtggcgtcgcgcgcgtgccgcctggttcgagctgctcaaggacgataagtgcggtgccgcggagggtggcgcgcttcatttccagagggatgactggggtgtcgagggcgtcggaaagcatcgcgaggaattctgggtggtcggtggagactcgtcctgatgcgatgacccgttcaggggctgcgccggctttccccatgtgttcccaaacgcgctggtaggagagtgcgagggcttcgaaaacgccgcgccacaagtgttcagggccggtttgttcctgaatgttggtgatcgtggcctgcgctgaggctgcccagccgatggagcgttccccggagaagaacggcaggacagctggggtgccttcgaggggttcgcggatcagcacttcgtcgaggttttcaggcttgataatggtgcgttccagccaggtgacggcgcgtccgacgtcgttgagtgcgccaccaacgatgcactggtcgcgggaaacgcggtaacaccacaggccagaggggatctgttcgggaacgctcggaaggatcacgcgcatggcgccggatgtagcggcggcgactgcgacggttttagaatccacggcgcctgggccaatgttggaaggccagccgtctggaatggcatggaaccaagggatttcttccaggtgcttccactttttgtcgacaactttggcatcggtggctggttcatcagggtttctgatctcaccgaacagagccggatcaacaccgatgtgctccaagatagtcagatcaagttcgccggtatgggcgtccaaaatgccactccacgcggcaatcgaagtagccattccggtgatgcctgcaagtttgaagtagacgtactcaccgatggtcatcacatacttggctttgttgaactcttcctcgaactcagttttcagccacagcaggcgcgatgggtggtaggaggtgtgcaggcagacgccggtgcggccgtggtaggcctcctcatcgatttccgcgcgcagctgctccacatactgtgcagaacgagaatccgcgtaggtaatgcacggggtgagcgcattgccttcaccatcgaccaagattaatgaggatgcaaaagaatctagcgcgacagcggcgatctgatctttgatgttgtgatgatcagccgcgttcaaaatgccattaataactgaggtgatctccgaaaccacctggtcagcatcaatggtggaaacgccctcaccggtggtgaattcatgggattcgcgctgcttggtgcctttgattgggcagccggaagcatcataaagtccacctcgtgatgcagtggaaccaatatccatagcaaggacataaggtccacgtgagtcatcaaaagggatggacattgttggaattgatcccataaggtttcctttaaaggtctgactaataaagaatattctttaaggatatagcgtgatcacgcgaaaacatgcatgggagtattgctcaattgctgtgcttctcccagatcaaccaccttgtcgggatcgccaagccttggccccagtgccaccaagactgcaaaaactactgccagaatcagtgcgagccaaacccacaccttaaaaaatctctccccaaagatcttggcaattaatgctcccgcaccggcaccaagagtattgaaaataaggtcatcgatgtcgctgtagcccagcatgaaaacatactgagatatctcaatagccaggctaaatagcgcgcccacccgcatcgtgtgaatgactgaattcttatgccacgacccagatgtttttaacaggacgtagaacagcactccgaaggggacaaagaaagcgaagtttcctccgtaaccaaatagcggagaaaaccatgaactggattcgatgaagtcattgaatggcactaaagaaatcgaacgattcctatgggcttccggtacccacaacaatccaatgacgaagaatgatttcaacatggtcaacgaaaccatgacagcgctgtaagcaatcagcgcgagggcaatcatcgaagtggaaggggctctcatgagtcctgatcatataaggacaacatggatttttcgcccgcgcaagcggaactgctgaaaccttctaggcgataaaacttgaatacatcatcatcgccatcacagatagtgaaccgcccatgatgattccgctgactaccttggaggatttaagcgagacaagcgctgctacggatgctccaatgagtccgccgatcgtattaaacaacaggtcatcgacatctgaatatccaatagcaaacacccattgcagaacttcgatactgaggctggtgacgctggcaaacaggatggtttctacgaaggggaatcgatggttgaatctacggagcattttgtacaggaaaaacccaaatggcatgaacagtgcgatgttgccaaaagtgttggtccaaggcccccaccaaattggtggatcagcaaagccgttgaaaagctctaagtcgatggatctgtattggtgtgcttctgtgttccacagtccgcctaaagaaaggcgacttttaagaagtgtcatcatcacaagcagcaccaggtacacgccgaaggaaaacgcgaacagtaaagaagaggcattgaagctcttcttcactgattcgtccttttgtggcggggcatggtgggaaccgtgtggcacttgtggagcctggattccggaggcgtgaatggttgacatatggccaaccctagggggatggcctgtgtgttcactgttaggtttcctcaaaatctttaacgaacaacgaagagcttgcccgagagtatcttgggtcgcatggacacaaaattaggcgctgaattgggtactgaatttgatctcattgttgttggtttcggcaaagcaggcaagactatcgcgatgaaacgctcggcagcgggggataaggtcgcactgatcgagcagagtccacagatgtatggcggtacctgcatcaatgtaggttgcatccccacgaagaagttgttgtttgagactgcaacgggcaaggatttcccggatgcggttgtggcgcgtgatcagttgattggcaagctgaatgccaagaatcttgcgatggccacagacaagggtgtcaccgtcattgatggaaaagctacgtttacagctagccacgaaatcacagtaacttcaggtagtgacactcttgtgctgtatgcgccaacgattgtgatcaacacgggctccacgccggtcatccccaatgtcccaggcaccgacaatccgcatgtttttgattccactggcattcagcacatttcgcccctgccgaagcacctcgcgatcatcggcggtggccccatcggtttggaatttgccacgcttttcagtggacaaggctccaaagtcaccatcatcgaccgtggtgaattgccgctgaaaaatttcgacagggaagtagcggagctggccaaaaccgacctggaggcccgcggaatcaccttcctcaacaacgctgaactcaccggattcagcggtgacctcaccatcgcgctcaaagaccacgacctcctcgccgacgccgcacttcttgccatcggccgacgcccggccaccgacgggctcggccttgaacaggcgggcatcaaaacaggcacgcgtggggaggtgcttgtcgacgcccacctccggaccaacatcgacggcatcttcgctgtaggtgatgtcaatggcggcccgcagtttacctacgtgtcctacgatgaccaccgcattgtgctggatcaactagccggaacaggtaagaaatccactgcacaccgactgatccccaccaccacgttcatcgaaccgccgttatccaccatcggtgacaacactgaaggggaaaatgtggtggtgaaaaaggccttgattgcagatatgccgatcgttccccgaccagagattattaaccaacctcacggtatggtgaagtttttcgtcgacaagcaatctgatgcgctgctcggcgcgaccttgtactgcgccgactcccaggagctcatcaacaccgtggcgcttgccatgcggcatggcgtcaccgcctccgagcttggcgacggcatctacacccaccccgccacctcggagatcttcaaccaattattgggcagttaacgcagcggatcgaacggcttgatgatcgggttggtgttgcccgtagccatcagctccgccaaatacttaccggtggcagggcccagcaccacaccccacatgccgtgaccaccggcaacgtaaatgttctccgccttggtctgcccaatcaacggacgcccatccggagtgaccgggcgggaacccacccactcatcctgacgatcgttgaaatcaatacctctcataaccttcttcgcctgcgaaacaatcgcatccacccggccctgctggaacggctcatccggaccgcggaactccatggtgcccgcaatgcggaaacggccctcatacggcgtgcaggccatgcggtggtggggaaggtacacagaatgcttggcaggaatatccgttgccacagagaaggaatagccacgaccagcctgaacaagagttttcacaccgtattcacgcgttagacccggcagccaggcacccgttgccacaaccaccttgtccgcttcttcacggctaccatccgccaaaatgaccgcgggacgatcacccttcgccacatgcacaacttctgccccggcgcggatcacgccaccacgcttcaccacagcatccgccaatgactgcacgtatggacccggctcgatgaaacgctggccttccaaacggtaagccacctgaatttgctcattcagcatcggcgccaactcttgtggattctccagtcgagacatctccactttctggccgtgcctgctcacgccatcaatttccttacggaaacccgccgattggcgctcttcctcaaaaccaataacaaatggaccttcatgggtgaggccttccacgccaccgatcgacagttcatcaaaagcttcgagcgcgaccttatcgatctccgtgaggtccgccatcgtggaatcccacttgcgttgaaaagcctgcgccataaattgcgccaagaaaagccacagtttgggatccacacgaagtggcatatgcatcggcgacaccggattgaacagctctttcggaccatacgtccacagccccggctccgacaacggaatagttttcgccggcgctaaccaaccagcattaccccacgaagaacctgcagcgacaccatcccgatcaaggacgctcacctcgaacccgtgctcctgtaaatgccaggcggtggcaagacccactatgccggctccaacaacaatgacttttccagacgaactcatgaaaccctcctgagggtggggtggactcctagtgcccccagtattcatgagttcgtacttaaatgtattggtttggaaattcctatggggttatttcttgcggcctttcaaaactagccagctggcaaacgcagcgaacgccaaaatgagtgcgacgatagcgccaacaatgagcggggagattccagtgctgctttcctcagttgcggtattttgagctggctcatctggttgagtgcttgggctagaggattctgaggtggttgcagaaaccttttcaaacactgggcctggctctgcatcaccaaaagcatccgctgctaagcgataacgaaggggaaaagactgctggttgctggcatctctgattgtactgccactgagatcgtcatagtgcacaacgaggtagtaatcgccttcaaacgtaaacgtgctggtggccttagaagtagtgccaaatccgccttcagcagggaacatattcagataagtcagtgcaactggcgctgcaaaatactcactggtgccctcacgtggagcgatatccgtccacatatcaactccggcgtcctgtcgtgttggcgaatacactgcaacacccaatttgtccgtcacgccaggatcatctggtgccgtgttttctacaacttccacaaagccatgcagctgctgaccagttgccataggcaggcgataaacgtgattttcaccaggtacgatctctgcttcaacaccttcacctggagttagctccgtagcgttggtaaaccaagatccgccagtggtgggtgcccatgtttgtactgcggccacgtcgagatctgggatttcacgctgttgatcaccgagtggaagccctgacgtatccgcgtgattaaggcgctttaccacgatctcaacaggtaattcttcttcccaattgaaaggctggcttctggtgattgcgagaaccagttcatcggtatcgcacttatctccaatcacatctgactccacactggcaaccaaaggccgcgcaccgtaattatcaagaatttgatcattgctgatcgaacgatgacaggtttgatcttgttcatctccgaaaagcagttcattcctaatgctcaggtagtcgttcccgagtccaaaagtcactggcgcaacatacgaggtggttacctgcacacgttcataatcttcaacgggaatggaccagtactgagttacttcgccgtctttattatctagtgctggaagatcggctttgaacaattccacatcatctggaattggggtcaggcttgtttggctgctgttgccatcgatttgttccaggtctgattcatagcccactgccgtgcgggtggcagctcgcttcagttctgccacaagcgaatccgcatcgctcgcatctgcataagtaccgtttccagcctgcgcaatgcactccagttccgcgcgagcagactcatcgacgttgaatccaacagtgttaatcaccagatcaacaccctggtcggctagttctgcagcaacctcacacactggagggggcgtacacgttgcaatgccatcagagaccaatacgatggtgccagattggccttcaggcaattctgctgcagccttgcgcagggattcaccaatcggcgtatagccccgcggttggaggctatcgatgtgttgtttaagctgctcagcctgcccattagttggcccgcggacgacggtgatgtcctagcaaccggcttcataatcttctggtgtttcaccagtgtttccgccgtaggtcaccaaacctaagtcgagggttccagcgagctcatcaataaactgattcgtagcctctttggcggcatctgacctgctttgcccaccagcatctggagtcaccatcgatcccgagctatctaacaccagcatcgtgggaactccgcgggatgtagattctgtttgcgcattcgcggtggagggcacgcttaaaactatgagaagaatacttgttattacggcaaggaatatcgtttgccgttgtctggtggattgtccagctaggtgcacaatgaacactctctcagtcgtcgagcagaaaaatggactaccgtcagcattttcagcgggaggtcagtttctttgagaattacatagcgatcgcagcaaataccgatcttggtaattcaaactagcaactttgtgagaagttcgacctctgaataaagaactttttgacaacaatgttcttatttaaataaaaaattccgcgtgcatcattcaatgcatacggaattatttaagattgcagtggcaattagtagcgtgggatctccagcttgatgccggcctgtgcagcagcctgctcgattgcaggaaggtttgcgtacacaagaccggagatagcaactgcggttgcggccagggtgtagccgtaccaagcggaaccgaatggggttacatcgtcgaagtccttagaggaaccccagatgtcgcgctcgtagtcgctagcaccgagtgcgtcgccaacctgagaagatgcagaagaaccggtggtggactgagccattgcaggagtagcggtcagtgcaagtgcacctgcggtcagcagtgcaacggaagcagtacgaagtttacgcatgagaatatccttaaaatcgattgttaattacccagataaagattagcaatgtttcttactttaagcgcagttaattgcaaaattacccctattacgggaggtctagagcttatttaattattagctttccaatacaaaatttaaatcccagagcgatctgccccacacttacttgatgcgggaacaaatttgaaggtttttcagttgctataggtatgactacagttactcaagaccttctagcacttgacgaagacgcacagaacctccttttccgtgaggctcgcaccgcaaatgctttcactgatgaaccaatctctgacgagcagatcgaagcaatcttcgacctagttaagtgggcaccaaccgcaatgaactcccagcctctgcgcgtggtaattgttcgttccgaagaagccaaagctcgcctcgtgccattgatggcagaaggcaaccaggccaaggttgctgcagctcctgcggtcgcacttcttgcagccgacatcgacttccacgaagaaatgcccaagctcttcccacctttcccaggcgcacgcgacatgttcgaagccgatgaagcttcacgtgcttcctccgcagaactcaatgctggccttcagatcggatacgccatcatcggtatccgcgcagcaggtctcgccgctggcccaatgaccggcatggatgcagacgctatctccaaggagttcttcccagacggccgccaccgcgttctggttgccatcaacatgggtaagccagctgacaatgcttggtacgaccgcctgccacgccttgagcaggacgaagttgtcgaaaccctctagaaaccactctagaaatagctttagaaagacttaaatagatgccccggctagttacatactggccggggcgttttccatttacacatctgttcgactcgcgcccgaatgatgtcgcatcaacatgagaagctacttccatacttttactgattgataagaatggacaaagacaatgaaccgcacactccgaacacttggctggcttgctgccgtaattcaagaagatccggagccctggttcaccactgatcccgacaccgattatgtcccttatgtaaatagtttctcatttgaatccctttccctcgttccagatgctctgatgctgctcaaacgttctcttcaccttgcgatggagcaacaggacctcccagtgaaggatctacaagaagcactgaggcacgtactagttttcaaattccacttcagggaagaatgggagctggaattagcatgggactccgagcggaccaagtctgcggtgagaattattgagagcacaaaagaatctcttgccgatcaatacagagattacaaatacgcattcttgcctgagctaattttccaggaatcacgcgggatctttgactttgagctggagggatacaccctcaaagtaggacaaagcacgctttccattccttgggacatgatcgccaatggttatgtccctgcaagtcttcggaattttggagaattaatggaccgtgacaccggagatcttgatgcagatcccattctgagacctcgagaactcaaatttgagatccataattgtccagatcttaatccttggataatgcgggaaacttttgatttcatgatggaaatcgcaactgaaacaggatggttccatgctctcaaccccgcatataattccgtctacacctacgatcttatttctcgcatgccagatttccttgttgaagggagctttcgtccgcattcagtgaaacgatcttgggaaaaaattcaaaagatagctaaagctgttgagtcttatgcatctcacgattactgcatgtcaacgctgacacatgactacagggcaatcgagttatccctgacgcctacaaaaactgaggaaccaagcacataagaaaacctcgcctgcccactaatcacaaagcgggccggcgcggcttctaggggaatctaaaccgagggggattacttcaccacaaggttaaccatgcgtcctggaacaacgatctgcttgatcaggttcttgccggagatttgctcctgcaccttctcgtcggcaagcgctgcctcgatgacctgctcctggctggcgtcggctgcaacggtgatgcgaccgcggaccttgccgttgacctggactggcagttcgatttcatcgtcggtgagccatttttcctcaaaggtggggaatggttcgtaggtgacggtgtcgtcgtggccgagcttcttccagagttcctccgcgatgtgtggtgcgataggggagaccatgacgatcagtggcaggactgcgccagctgggatggtgtctgggtatgttttggtcaggtagttgacgtattcgatgagcttggcaaccacggtgttaacgcgcaagttggtgtagtcgtcgcggacgcctgcgatggtgcggtgcagttgcttgttgtcatcgtcggtgaggacttcatcgcgagtgagcacttcgccggtgttttcatcgacgacgagacgccacagacgctggaggaagcgctgcgcaccgacgacgtccttggttgcccatggacgggaggtgtccaaaggtcccatggccatctcgtaaacgcgcagggtgtcagcaccgaagttgttgcagatatcgtctggggcaacggcgttcttcagggacttgcccatctttccgtattcctggttgacttcttcgccctggtagaagaactttccgtccttctcttcgacatcatcggcaggcacgtagacgccacgggaatcggtgtaggcgaaggcctggatgtagccctggttgtacaggcgacggtatggctccttggaggagacgtggcccaggtcgaagaggaccttgtgccagaaacgtgcgtagagcaggtggagaactgcgtgctcgacgccaccgacgtagaggtctacgccgcctggatcgtttggtccgtgggtttctgggcgtgggccggtccagtagcgttcattttcgatgttgcagaactgctcatcgttgcttggatcgacgtagcgcagctggtaccaggaggaacctgcccactgtggcatgacgttggtgtcgcgggtgtacttcttcttgccatcgccgagatcgagttccacctcaacccattcgcgggccttagccagtggtggggaaggctcggagtctgcgtcttcagggtcgaaggagacaggcttgtagtcctctacctctggcagctcgactggaagcatggagtctggcagagcatgtgcttggccgttttcgtcgtagacgattgggaaaggctcgccccagtaacgctggcgagcgaacagccagtcgcgcagcttgtactggatggtgccgcggccaagttccttttcttccaaccattcgatggtcttggcaatagcctcatccttggcaaggccgttgatatccaggccgttgtcgttcgcagagttgactgcttcgccagattcggtgaaagcagcctcttcgatgttgccacctgcgacaacttccttgataggcagacccaaaacggtggcgaattcgtagtcgcgctcgtcgtgagcaggaaccgccatgatggcgccggtgccgtagccggtcagaacgtagtcagcgatgaacactgtgatctgatcgccgttgactgggttggtcgcgtaaacgcccaggaagacgccggtcttttccttgttttcctgacgctccaggtcggacttcgcggcgatggaggcgcggtatgcagcgacagcttccgcagggctcgcctggccattggtccaacgggcatcaacgccctcgtaggaaccagccttctccagcagcacgtcgaccagctcatgctcaggtgcaagaaccatgtaggtcgcgccgaacagagtatctgggcgggtggtaaacacggtgacggtttcgccctctgcactgaaatcaacttcagcgccgcgggaacggccaatccagttacgctgcatggacttgaccttctcagtccaatcgagcagctccagatcatcgatcagacgatccgagtacgcggtaatgcgcatcatccactgggacaaattcttacggaaaacagggaaattgccacgctcggaacggccgtccgcggtcacttcctcgtttgccaacacggtgcccaagcctgggcaccagttcacggtggagttcgagcgataaacaaggcggtagtcatccaccgctttttgcttttcgacgtctcccagcgcgttgtaatccgccccgtccttagtcttcagctcgccggactccagcaacggaatcagctcactgatgggacgtgccttctgctgctctgcatcgaaccacgaattgaaaatctgcaggaagatccactgagtccacttgtagaactcaggatccgtggtggccaccgcacgacgggaatcatggccaagacccagcgcaccgagctggcgcttcatgttctcaatgttggccatggtggtggtgcgtgggtgtgtaccggtttggatcgcgtactgctctgctggcagtccgaaggcgtcatagcccaaggtgtgcagaacgttcttgcccagcatgcggttgtagcgggcgaaaacatccgttgcgatgtaaccgagtgggtggcctacgtgcaggccagctccggatgggtacgggaacatatcctggacaaagagcttgtcctcaggaagtgctttaccgtccgcaggcgctaaatcacccactgggttgggtgcgttgaatgtgccgttgtcagtccagtaattctgccactcaccttcgatcttgttggcgagttccggggtataacggaacgccaggggagtggtgccttcgctcgggttagtcatggttaaacagtgtagtaggtacacgggacatctcatgtgtggagggcaattcttcctcccctcaataagtagatagacttgaagaattatgtggaaaccactgcttatcgccgtcggactgctcagtcttgtctgcggagcaatcggcgttgtattgccagttatccccacgactccgtttttattgctgagtgctttctgtttcacgcgcagctcagagcggttgcataattacctggtctcgcaccgaatctttggcgagtacatctccaattactacaaccacgcgatgaccccgcagcataaattccgcacacttttgacactgtggtgcggaattatcctttcctgcttcctcatcggggcaaccattccgtggatcatcttgccgctgattgccaccggcgtgagcatccacatcattcgtttgaagccccgaccagaggcgactcctactgcgagctctcctgaagcggattcagggtccgagccacattttgctgacgatcataaggcttgatcgcttccaacagtgtgcgcgcatctaaatacgtcaccgacaggtcgtagtgggtctgcaagttgagccaaaactgtggatcgggacctaaataagcagctaaacgcagcgcagtgtctgccgtgattgcgcgtttgccgtgcacgatctcattaatcctgcgtggtggcactcctattgcccgcgccaagccgttttgggacagccccaaaggctccatgaattcctcacggaggatctctcccggcatcactggccggtcattgttgttgcgttcgcctgcgtcctgcaccggcatatcgcccccagtcattttctagttgagattcattatcataacgcttgacagtacaactatgtcgcatggggtaccttcagcgtgttaactgcaaaatgacgcattgcgtcataccccaaaatcatcttccttacctatgacgcaatacgttatgggtaagggaatcacaccttggaacacctagtagcgaaagtgattttttacaggtttacatcccgaaaaccgacccaaaaaaattccgagaaaatcccatccttgatccagtcatggatacggcaccccccttttttttaaggcgcctttgaacaagttcccgcccgcggtttaaaattccccaacccaaaattttttagaaaataagccaaaaagtaacccctcagtttcgcccctgccacccaaacagagaccaacccatgccaatagtcatttgatggatcccaaagccttaaaacgccaatgaaggccgatttcagtgaaagagataaaaaatgaccacattcccgcaaaggaacatggtcatttaagaatgtgtggaaactacagccagcgcggtggctctggaacctctccagtggaagaagtgactccatcggaaccgcggccagcggcgtagcgaacaatgcctgcaaggctaccggacactactacctcgtcctgccctggggcggcggggtagcgagtgctggagggctcgtcgagaagcacaagtccctcgccggctccttggcttgtccacttttgtgtgatttctgcagctaaggtgcgcaggatgacctctgggatgtcgccaaaggttgccactgcaccgaggtcaactgcgtggatccagacttcgcgggaacgcatccacaatgtttcactagctgggacagtgcgtccctgagctgtcagaacctcgtgtgaccaagcatcttcagacgtttcacgccaagccacgtccaggcgtgcgacggagtgttcatgcaggttacgcaacgcatcgggattgagcgtggaaccgtaggcaatttcctcgttgcgcgcttctggcgacacgtacattggggtttcctcaccagtatttgcccagtgcatgaggttgcacagtgcgatggcgttgtatgccacgtgggcaatgaggtgggaacgagtccacccttctagcagggaatgctcgccgaactcagcgttgtccacgagggagagctgacgggagtagtgggatgtgcccaacctggccagtgtcagccgctcctccagcggaagatcgtggaaagttgtcatttattcaaacaccgtcttgttttcaatgaagccgaggcccgcaatctcaacctttacggtttcgccgtcaccgatgtagcgctgtgggttacgtgcgtggccaacgccgcctggggtaccggtgacaatgacgtcgccagcatccaatgggtagatgtgggtgatgtattcgatgagcttttctgggctaaagaccaggtcattggtaggggtggactgtaccttctcgccctcgaggtaggttgccagctcgccgccgaactcaaaagaatctggggtagtcatccaaggcccgaagccagcggacttttccaaagacttgccctggtgccactgtggagtctttgcaggtgctgcgtactggaaatcgcgggtggtgtaatcgttcatcactgcgtagccagcgatgtactcagcagcatcggcctgcttgacacggcgtgcgcgcttgccaatgataactgccatctcgccttcccagtcgagagccttgttagcccactctggaacgacaacatcatcgaaaggtccgatgagcgcgtcagggaacttaacaaaaagggttggggtatcagggaggtcgcggcccatttctttaatgtggttggcgtagttaaggccgacgcacacaatcttcttaggtgctggaactactgcatctagctccttgttttcaaaggtcacagcctcaccagcagcgttttctgccagctcgcgccagttggattcctggagtaattcaccgacgttggcaaagccctcgatggtggtagcggtgttttcagattcaacacgagcagcaatggtggtgccgttggtgcggattgttgcaagacgcataagttctagattccttccggagtaaaagtacgtgcgaggttaagggcctcgaaaattggtgtatcagagaagcagaacaagtcgacgccgtcagagccagcgacgatattccacttctgccacgacggtacattgatcacatcgccgtggttagcttcaaaggttttatctccaacattgattgttgcggaaccctcaaatacctggaagcaacggtttcctacctcatgaatgggggcagtggatgcacctgggcgcaggcggtggaactccgcgcggatggtggtcatgacatcgccaccggtagttgggttggagaagcgaatcgcagcatgtcccggcgcgactgttcctgggtgtcctgcttcttccaatgccagctgatcgttgagtgctgcgtcggtgtgctcccaggcgtagcgcccaattggtgagtaggaagtttttcctgggaaggagactgggcgaagtcctgggtgggcccacaggcgttctgaacgggagaggtctggggtggattcgtcagtgagtttttcggtgccgtactcaaagaatccggtgtccatttggtaggcaaatgggatatcgagcccgtctagccaggccattggctcggtcgcgatgttgtggtggccgtggtagttccagcctggggtgagcaggaagtcgccgcgtcgcattggtactggatcgccgttaacgacagtccacacgccttcgccttcgataacaaagcggaatgcgttttgtgagtggcggtgctctggagcgttctcacccggagcgaggtactgaattgctgcccacagggtaggggagatgtaggtattgccgtctaaacctgggtttgccaggccaatggcacggcgttcgccaccgcgcccaactggaacgagttcaccggagcgctgcgcgagcttcaggagttccgcccaatcccacttgtgtgccacagctcgtggttccgggtggtttggcatcaacccaccgatttgagtccacaggggctttagatgcaggtcatccatgcgtttatacatggtgtccagctctgcctgctcttctggagttgcgggtgggacttcttgcttgacgtgttcagttgcgtaatcgtttttacctggggcgcccattgttggagtcctcctttacggatgttgtagatgcgtatgaagggtgtgattgcccttgagataagcaatccccaacacctgcatacgtctagcccttgaagtgtttgtgacttcgaacatattgggctttgaaaggtgactcaagataattccgctatgtggaatctaagtattcccctcaggaaacgggggtgtgacagctctgaaaattccccccattcaccctttttcgggcactcggtaatcagctaaagccttgttcagatcccgcatatgtcgttccaaaacctgcaccgccttcggatagacctcccggaaccgattcgacggcacagccactgtaattgcacctaaaacatcacccacatcgttgagtaaaggctccgcaactgcactaacgtcctgctcaaagaagccaaagtttgcgccatggcctcgatcccgggtcctgcgaagacgctttcttaaattctcaaattcctcatcgcccaggctggaatacagtgcccgaagctcccgggctgacatctctgcaagcatcactaatccacctgaattttggatggcgggcatgacttgacctcggcgattgcccacgcgcaccggcagggaaccttcaacactgtgaataaagtgaacgctatctccctgcagaatcaccaagtgggttgtttcgccagtttccttgccgattgattccatgtagtggctgcattttttcgtcaagtcagcgccaaggcctggctgcagcgcggaggtcgccaatgcagagcctggaaggtaggtgcgggactcgcttctgactgcaaaaccccggtagaccagcattgacatggatcgatggatcgtagacgcgcccaccccaagggtttcggcggcaccggaaatggtcaaacttccagagtcacggagcagcaaaatgagctgcaatgcaatgtcgacagagcttagaaattctttcgggggtaacccctgggtgggggcgacgttatccataatcactctttccagatagcggaatccctttgattgtaacttggctcacctcgattatgtgtttatgacatcacacgcaccagaatcgggaggacttgtgacagagtcaactctcggagcatcgaatagctcccaaacaattgaaaataaaggcctcaccatcttgggcatcagcggccgacgcttggctgcggtgctcattggctggttttttgtcattttcgacggctacgacctcattgtgtacggcaccgtccaatcggccctggctaaggagtggaacttaagctctgcaacgctgggcaccatcggctccaccgcgttctttggcatggcgatcggcgctgtgttcattggtcgactgtcagaccgcgtgggccgaaaagcagcggtgattggatccgtgctgattctctctgtcttcaccatgctgtgtgcatttgctccaaacccatgggtgttcggcgctttccgtttcatcgcaggccttggtctgggcggcttggtgccttcagttaatgcgatgacctctgatttggttccacgtaagaccatgtcagcgtgggcaacggtgatgatgtcgggcgttcccatcggtggttctatcgcggctgtgctggcacttgtggttgttccttcctcggaggagtggggctggcgcttcatgttcctcatcgcgttgatcccactggttgtcggcttgccgatcgccatgaaggtcattccttccgataaggccatcaaggcggatcacgacattagagaaggccacgatgagccagcaggtttcaaggatctgcttgtcgatcgctaccgctggatctccatttggttcgcgctcgccacatttgtcaccctgctcgcgtggtacggactgggcacatggttgcctcgcctcatggaaactgcaggttatgagttcggccatgcattgatgttcaccctggctctgaacctcggtgcagtgatcggatccgtggttactgcgtgggccggcgatcgcttcgggccaatccgttccggtgtcatcgctgcaggtatcgccggtattgcactgctcctgctgctcacttacccgcctgtcaccgcggtttatgtcattctcattttggctggcgtgggcacccacggcactcagatcctcatcattgcagctgtcgccaacttctacccaagcaacctgcgtggcacagcactgggctgggcgctaggtgtaggtcgtattggtgctgttgtggccccgcagctcgctggcctgctgctggcatggaacttgggcgtgaactccaacttcatcatgttcggcaccgctgcgctgctctctgcgctggctctcagcgtgttgctgcgcctgcagaaaacctacagcgtcacccacaaagtcgaaatccaaggctaaccccctttttcaactcacagttaggaaacttcacccatgtctcttccacattctgatgaactccgcggccaaaagatcattatttccggtggcggaattggtggcgcagcaggtgcacttgcgcttgctttgcgcggtgccgatgtcactttgtacgaacgcgcagctgagttcaaggaggtcggcgctggcctccagatcggtccgcacggctggcgaatgctggaatcctggggtctgctcgaccaaattgtcgtggccggctacctcccagaagacatgcagttccgcgacgctgtcaaccgcgaaaccatcctgaccatgcgtttcgatgaagaattccagcagcactacggcggtcgctacctggtgattcaccgctctgacctgctcaacatcctggtcaccaacgccgaagcagcgggcgcgaagctccacaatggcgtcctggtcaccgattcccgcaccgtcgacggcggtatcgaggtggacatcgaatcctccatcaacaagggcgaagataacaagactttgcttgtcgacgccttcctcgccttcgacggcatccactcggtcatgcgcaaaaagcttgtcgacgacgcccccgtcgcctcctcctacgtcgcctaccgcggcacctccaagctggcagaagacgccgaaatgaaggacctgaaatccgtcatcggctacatcggaccacacgtgcacttcatccaatacccactgcgcggcggagaactcctcaatcaggtcgccgtctttgaatcccagcgttacctcgatggacgcaccgccggcgacatcccagaagactggggcaaccccgaagaattagaccgcgcctacaaccactgcgaccccttcatccaggaccgtctggacaccctgtggcgcaacaactggtggcaaatgtccgaccgcgagcctctagagaactggcgtatcggccgcatgttgctgcttggcgacgccgcccacgcacccctccagtacctcgcctcaggcgcggtcatggccatggaagacgccgaggctgtcgccctcttcgctgccgacgctgcgcgtgctggcaacctcgattgggaagaggtactcgcagaggtggaagctgaacgccgaccacgctgcagccgcatccaaaccgtaggccgtttctggggagagctctggcatgtggaaggcaccgcacgtctcatccgcaacgaagttttccgccaagcagaccgcaatggctggttcatctatgcagactggctgtggggttacgatgcatccaagcgtgcccacatcgccaaccctgagctcggagaaatgccacaagcactgaaggaatggcgctacgccctcctcgaacagaaatagcagcctcacctgttaagggaaaattgtgtgcttttcccaggcaggctctttaatgtcgagttcttaagttcgatttcttaacagcgatttcagtcggaaaaccggggaaaaccgagcgaaatcgctgttgagaaattgagcttgaggtattggaaccatgaactcgacaccgtgaaatcgcagttaagaaacaaccgcgaaatatgggcgtttaaggcgtcgaggtttccgtatgggtgtgagtctagggagagccagttaaggcccttagaagcgattctgtgaggtcaaacttttagggatctcggtcgtgaattcacccttttcgaggcagaccagacaggcgtgacaagattggcgaaaaagccgaggttttggcacgtgtgtccggtttccaatcccctaaaccagacagacgtgccaaaacctggcgaaaatccagattcttgtcacgcctgtctggtttctccttttgagcgacccaaaccacgcccgaaccaccgttccacagcccccacgaaccctcaagacagaaaagatcgcaccagccgcatcgagctggtgcgatcaaaccgcagtaaaaactacagaaaatgcgggtttctacttgtgatgttccacatccgatggagtgatgtcgaaggcaacgcggtcgtcttcttcgatttcatctggggaagtggtgtgcagctggcccttggcgaatttgttcacgatgactgcgattgcgccgtcgccggtgacgtttgctgcggtgccgaaggagtcaatcgcgatgtaagcggcgatcatgagggcgacttgttcggtgttgaatccgagcatggaggccagcatgccggttgctgccatgatggctccgccgggaacgcctggtgcggcgatcatggtgatgcccagcatgaggaggaatccgatggagaggccgacgcctacttccatgtcgtacatgaagacaacagcgaaggtgaagaggccgatcttcatcatcgatccagctaggtggatggtggcgcacagtgggacaacaaagcctgcgacgttgacatcaacatcgtttttcagggtctgctggtaggtcactgggatggttgccgctgaagaggaggtgcccagtgcagtgaagtatgcagggagcatgtttttgaacagtttccatgggttcttcttggatactgcaccagcgataatgaactggatggctaggaagagcagggttcccacgacggcgagaatcagtaccttgccaaaggcggacatgatctccaggaggccaccgttcatgcccatgccgaggaagatgccgaagatgaagagtggcagcagtgggatgacaaaggcggtgatggtcttcatgactacgcgctcgagttcgcgggttaccttgaacagggtgtctgatttaattacagccatgcccaggccgaggcagaatgccagcagcagtgcggtcatcacttcaaatggtggtggcatctcgatgttgaagtagggctggagggcacctgcatcaaggtcgatttcggtgacgctttggtggtctttcagcagccatgggtagagcgcttgggatgctccgtaggcgatcagaccggagaagacggtggacgcgtaggcgattgctgcaacaatgccgagccatttgccagcgcctcggccgagccctgcaatggcgggggcgatgagggagaagatcagcactgggatgaagaagcccagaaagttgctgaataggccgttgaaggtggtgaagatctcagcgagccacaccgggaagaagaggctgcagatgattccgaggatgatggcaacgatcactcggaacagcagcgacgagctcatgctctttatgtccatggttgttccttatttctaatcaggtgctgtctgagcaatgctcggcagcgcgtgatggaattttgtgtgcggcttggaagtgacgggtcacaaggacagctcgtgtagaccctgcctggagccttgacaaactccaccaaacaactgcgacgtgtgtcagattactgcaggcttgtggtcaaacctagttctttggaggcggagcatcataccttttaatgtcaggatcgtgcagtgaagaattcaggatgaattactcgctggaatattggtggggatagagttgttgttatgacggtgatcggaattattcttggcagcctttttggcgttcttgcagtccttctcatcgtggttggtgctttggggtgggcggctaagctccctggcaacccggttgtgggcattcgtgtccctgaggtgcgtaaatcccaagaattgtgggatatggcgcaccgtgtcgctggcccgttgtgggtgctgtcgggagtttcctttgttattgcatcgctagttgcgtttgttgcttctggttggatgtggcttgttgtggcgttgggtgttgtggctgccatcgtgttcattggtatgggtgcgggtatggctgcgcatactgttgcgatggttgacgcgaagcgcagtcgcgaaaccccgcaggcgcctgtttccgctgaaattgaagaggccggtggtgtgactattacctcgccgattatcaacaagactccgctgaatgcccccaagattgacttggatgcagtgcgtagagctgcggaaactacgcaagaacccaaaaatgattaataattgagacaagcttcccactatgtgataaagtcccattttgtgaataactcttgtctcagtcaaagcacccagtggtggtggcgcgctaactaagcgagcctgacacctcaagttgttttcactttgatgaattttttaaggctcgtacttcgttcgacgaagaagcgggccttttgtggtttttagcccacaaccggcaagccctggatcgaatgaagctcgcagcgagtaattatttgatgtttcccagaaaggcttcagccccacaatgatttcctcggtaggtgccccatgagcacgaatccccatgttttctccctagatgtccgctatcacgaggatgcttctgcattgtttgcccacttgggtggcacaaccgcagatgatgcagccctgttggaaagcgctgatatcaccaccaagaatggtatttcttccctcgcggtgttgaagagttcggtgcgcattacgtgcacgggcaacacggtggtaacgcagccgctgacggactcgggtagggcagtggttgcgcgcctaacgcagcagcttggccagtacaacaccgcagagaacacctttagcttccccgcctcagatgcggttgatgagcgcgagcgcctcaccgcaccaagcaccatcgaagtgctgcgcaagttgcagttcgagtccggctacagcgacgcgtccctgccactgctcatgggcggtttcgcgtttgatttcttagaaacctttgaaacgctccccgctgtcgaggagagcgtcaacacttaccccgattaccagttcgtcctcgcggaaatcgtcctggacatcaatcaccaggaccagaccgccaaactcgccggcgtctccaacgccccaggcgagctcgaggccgagctcaacaagctttcattgcttatcgacgccgccctccccgcaaccgaacacgcctaccaaaccacccctcacgacggcgacactcttcgcgttgtggctgatattcccgatgctcagttccgcacccagatcaatgagctgaaagaaaacatttacaacggtgacatctaccaagttgtcccggcgcgcactttcaccgcaccatgtcctgatgcattcgctgcttatctgcagctgcgtgccaccaacccgtcgccgtacatgttctatatccgtggcctcaacgaaggccgctcctatgaactttttggcgcatcccctgagtccaacctcaagttcaccgctgctaaccgtgagctgcagctgtacccaatcgcaggtacccgcccccgtggactcaacccagatggctccatcaacgatgagctagatatccgcaatgagttggatatgcgcactgatgccaaagagatcgcggagcacaccatgcttgtcgatctcgcccgcaacgacctggcccgcgtctcggtcccagcgtcgcgccgggttgcggatcttttgcaggtggatcgctattcccgcgtgatgcacttggtgtcccgtgtgacggcgacgttggacccagagcttgatgctttggacgcctatcgggcgtgcatgaatatgggcacgttgaccggcgctccgaagttgcgcgctatggagctgttgcgcggcgtcgaaaagcgcaggcgtggttcttatggtggggcagtggggtacctgcgcggcaatggcgatatggataattgcattgttattcgttcggcgtttgtccaggatggtgtggctgctgtgcaggctggtgctggtgtggtccgcgattctaatcctcaatctgaagccgatgagacgttgcacaaggcgtatgccgtgttgaatgccattgcgcttgctgctggttccactttggaggtcatccgatgacacacgttgttctcattgataatcacgattcttttgtctacaacctggtggatgcgttcgccgtggccggttataagtgcacggtgttccgcaatacggtgccagtggaaaccattttggcagccaacccggacctgatctgcctttcacctggacctggttaccctgccgatgcgggcaacatgatggcgctgatcgagcgcacactcggccagattcctttactgggtatttgcctcggctaccaggcactcatcgaataccacggcggcaaggttgagccttgtggccctgtgcacggcaccaccgacaacatgatccttactgatgcaggtgtgcagagccctgtttttgcaggtcttgccactgatgttgagcctgatcatccagaaatcccaggccgcaaggttccaattggccgttatcactcactgggctgcgtggttgccccagacggtattgaatcactaggtacctgttcctcggagattggtgatgtcatcatggcggcacgcaccaccgatggaaaggccattggcctgcagtttcaccctgagtcagtgctaagcccaacgggtcctgtcattttgtcccgctgtgtcgaacagcttctcgcgaactaataaaaaaaggatttgattcatgacttctccagcaacactgaaagttctcaacgcctacttggataaccccactccaaccctggaggaggcaattgaggtgttcaccccgctgaccgtgggtgaatacgatgacgtgcacatcgcagcgctgcttgccaccatccgtactcgcggtgagcagttcgctgatattgccggcgctgccaaggcgttcctcgcggcggctcgtccgttcccgattactggcgcaggtttgctagattccgctggtactggtggcgacggtgccaacaccatcaacatcaccaccggcgcatccctgatcgcagcatccggtggagtgaagctggttaagcacggcaaccgttcggtgagctccaagtccggctccgccgatgtgctggaagcgctgaatattcctttgggccttgatgtggatcgtgctgtgaagtggttcgaagcgtccaacttcaccttcctgttcgcacctgcgtacaaccctgcgattgcgcatgtgcagccggttcgccaggcgctgaaattccccaccatcttcaacacgcttggaccattgctgtccccggcgcgcccggagcgtcagatcatgggcgtggccaatgccaatcatggacagctcatcgccgaggtcttccgcgagttgggccgtacacgcgcgcttgttgtgcatggcgcaggcaccgatgagatcgcagtccacggcaccaccttggtgtgggagcttaaagaagacggcaccatcgagcattacaccatcgagcctgaggaccttggccttggccgctacacccttgaggatctcgtaggtggcctcggcactgagaacgccgaagctatgcgcgctactttcgcgggcaccggccctgatgcacaccgtgatgcgttggctgcgtccgcaggtgcgatgttctacctcaacggcgatgtcgactccttgaaagatggtgcacaaaaggcgctttccttgcttgccgacggcaccacccaggcatggttggccaagcacgaagagatcgattactcagaaaaggagtcttccaatgactagtaataatctgcccacagtgttggaaagcatcgtcgagggtcgtcgcggacacctggaggaaattcgcgctcgcatcgctcacgtggatgtggatgcgcttccaaaatccacccgttctctgtttgattccctcaaccagggtaggggaggggcgcgtttcatcatggagtgcaagtccgcatcgccttctttgggaatgattcgtgagcactaccagccgggtgaaatcgctcgcgtgtactctcgctacgccagcggcatttccgtgctgtgcgagccggatcgttttggtggcgattacgatcacctcgctaccgttgccgctacctctcatcttccggtgctgtgcaaagacttcatcattgatcctgtccaggtacacgcggcgcgttactttggtgctgatgccatcctgctcatgctctctgtgcttgatgatgaagagtacgcagcactcgctgccgaggctgcgcgttttgatctggatatcctcaccgaggttattgatgaggaggaagtcgcccgcgccatcaagctgggtgcgaagatctttggcgtcaaccaccgcaacctgcatgatctgtccattgatttggatcgttcacgtcgcctgtccaagctcattccagcagatgccgtgctcgtgtctgagtctggcgtgcgcgataccgaaaccgtccgccagctaggtgggcactccaatgcattcctcgttggctcccagctgaccagccaggaaaacgtcgatctggcagcccgcgaattagtctacggccccaacaaagtctgcggactcacctcaccaagtgcagcacaaaccgctcgcgcagcgggtgcggtctacggcgggctcatcttcgaagaggcatcgccacgcaatgtttcacgtgaaacattgcaaaaaatcatcgccgcagagcccaacctgcgctacgtcgcggtcagccgtcgcacctccgggtacaaggatttgcttgtcgacggcatcttcgccgtacaaatccacgccccactgcaggacagcgtcgaagcagaaaaggcattgatcgccgccgttcgtgaagaggttggaccgcaggtccaggtctggcgcgcgatctcgatgtccagccccttgggggctgaagtggcagctgcggtggagggtgacgtcgataagctaattcttgatgcccatgaaggtggcagcggggaagtattcgactgggctacggtgccggccgctgtgaaggcaaagtctttgctcgcgggaggcatctctccggacaacgctgcgcaggcactcgctgtgggctgcgcaggtttggacatcaactctggcgtggaataccccgccggtgcaggcacgtgggctggggcgaaagacgccggcgcgctgctgaaaattttcgcgaccatctccacattccattactaaaggtttaaataggatcatgactgaaaaagaaaacttgggcggctccacgctgctgcctgcatacttcggtgaattcggcggccagttcgtcgcggaatccctcctgcctgctctcgaccagctggagaaggccttcgttgacgcgaccaacagcccagagttccgcgaagaactcggcggctacctccgcgattacctcggccgcccaaccccgctgaccgaatgctccaacctgccactcgcaggcgaaggcaaaggctttgcgcggatcttcctcaagcgcgaagacctcgtccacggcggtgcacacaaaactaaccaggtgatcggccaggtgctgcttgccaagcgcatgggcaaaacccgcatcatcgcagagaccggcgcaggccagcacggcaccgccaccgctctcgcatgtgcgctcatgggcctcgagtgcgttgtctacatgggcgccaaggacgttgcccgccagcagcccaacgtctaccgcatgcagctgcacggcgcgaaggtcatccccgtggaatctggttccggcaccctgaaggacgccgtgaatgaagcgctgcgcgattggaccgcaaccttccacgagtcccactaccttctcggcaccgccgccggcccgcacccattcccaaccatcgtgcgtgaattccacaaggtgatctctgaggaagccaaggcacagatgctagagcgcaccggcaagcttcccgacgttgtggtcgcctgtgtcggtggtggctccaacgccatcggcatgttcgcagacttcattgacgatgaaggtgtagagctcgtcggcgctgagccagccggtgaaggcctcgactccggcaagcacggcgcaaccatcaccaacggtcagatcggcatcctgcacggcacccgttcctacctgatgcgcaactccgacggccaagtggaagagtcctactccatctccgccggacttgattacccaggcgtcggcccacagcacgcacacctgcacgccaccggccgcgccacctacgttggtatcaccgacgccgaagccctccaagcattccagtacctcgcccgctacgaaggcatcatccccgcactggaatcctcacacgcgttcgcctacgcactcaagcgcgccaagaccgccgaagaggaaggccagaacttaaccatcctcgtctccctatccggccgtggcgacaaggacgttgaccacgtgcgccgcaccctcgaagaaaatccagaactgatcctgaaggacaaccgatgagccgttacgacgatctttttgcacgcctcgacacggcaggggagggcgcctttgttcccttcatcatgctgagcgacccttcaccagaggaggctttccagatcatctccacagcaatcgaagctggcgcagatgcactggaacttggcgtacctttctccgacccagttgccgatggccccaccgtcgcggaatcccacctccgcgcactcgacggcggcgccaccgtagacagcgcactcgagcagatcaagcgcgtgcgcgcagcctacccagaggttcccatcggaatgctcatctacggcaacgttcctttcacccgtggcttggatcgcttctaccaagagttcgctgaagctggcgcagactccatcctcctgccagacgtcccagtccgcgaaggcgcaccgttttctgcagcagctgcagcagccggaattgatcccatttacatcgctccggccaacgccagcgagaaaaccctcgagggtgtctccgccgcatcaaagggctacatctacgccatctcccgcgacggcgtcaccggcaccgaacgtgaatcatccaccgacggcctgtccgcagtggtggacaacatcaagaaatttgatggcgcacccatcctcttgggcttcggcatctcatcccctcagcacgtggcagacgcgattgcagcgggtgcttccggtgcgatcacgggttccgcgatcaccaagatcattgcttcccactgcgaaggtgagcacccgaacccgtccaccattcgagatatggacggtttgaagaaggatctcactgagttcatctctgcgatgaaggcagcgaccaagaaggtttaggcctttaaatgtggcaatgtttcacgtgaaacattgccctaaagtacagatgtacaaagaagccgcctcctagctctcgggctgggaggcggcttctttgtttgcggtttaggaaatctcagggttttggagatcttagcttcgagccggtggggtaggagcgcccgccggaggagcaatcttagggtaggtccgagccccagccgttggagtggcatcagcttccgccttctccacgcgctcacggttgggagctggatcccagtgcccattcacgacgcgcttctggaagaccatcgcgccacccagaagaaccgctgcgatgatgagcaacaagatgagcccgccagcaccttccaccttggctgcagaaccaacaacgattccgaaccaaccaaagtccgcatcaccgaaagtggtgttctctgacccgaaggaaccaagcacaccaagcaggaaagcagggaggaaggtaatcagaagaccgttggcaaaggcgccaaatactgctcctcgacgaccacccgtggcattaccgtaaacgcccgccgcgccaccagtgaagaagtgggggaccaaaccaggcagaatcaacgcgacaccaaaagctgggttcagccacgatgcaagaacagtcaggccaaccaagccaccgacgaaggaagacaagaaaccaatgagaacggcgttctgcgcgtaggggaacacgatcggtgcatccaatgcggggatagctccgggaacaaccttcgcagcaataccttggaatgcggggaccagttcaccaagaatggtgcggacaccaaagagaatcacggcaactgcaacgccgaactgcagaccttgagtgaaggactgcatgatgtagttgcctacgttggtggcgccattggggaatgcagtgaaggcttcttcttctcctgcgcgcaccaggaacaaaatagccaaaatgatgtacatgatcgccatggacagagctgtagaaaccatggagtcgcggaggaagcgcaagccttccggaaccttcatatcctcagtggaagggctggccttcttgcccttgccaccgaccagtcggccgactgcaccggcagctacataacctgcggtgccgaagtgtccaatggcaatggaatcatcgccagtgattcggcgagtccacggatgcgcgaacgcaggcaacgacaccatgagaataccgagcaagagagcacccacacccaccacaatccacgcatcaaatccggcggtggccaagatgatggtgagcatggtggacatgaacagcacgtggtgtccggtgaggaagacataacgcaggttggtgaaacgagccaacaccaaagagatggcgaagcccagaatcatcagccacgccacctgcgcgccgtattcagcctgtgcgattccggcgatggcttcattcgttgggacaacaccacgcatgcctgtggcacccatgatcatcgcacccagtggctccagggaggcagtgaccaacgtggcacccgcaccaatgagcaaaaagcccaacgttgctttgattgctccaccgataacctgaccgacggaacgccccatggcacccaatcccacggcggtgatgataccgatgaggaaagccggaaccgcaaggatttcattaacgaggaaaagaggaatggttaaccagtccataatattttcgtccttttaaagtagttagatgtcgtagcgttcacgaagcgcagcatcgatttcatcggtgctcgtgaagtcattgatcacgtgaaccgggattccaacatcacccaacgtgcgggcgatttcaccagaggtcatgatgagatcagcttccttggctttgcccttggcggagatagtgtcggttgcctccaccgtcatgtatggaccccaaccccaggtgtcgaaaacttgctcaagggtgtttttgaggaagagggaggtacccaagccgttgccacagacggtgaggatcttgtcgtgggttttggattggactgaggctgcaggagcgtcagtgggtgttacagcaggagccacagcaggagccttctgcttcgccggcgctgctgccttctctaagattgcttggatctcctcgggactttgtgcctcgtcgagatcctttcggtattttcctaaagctttagccaatgccgccatcgcttgggtatgtgcggtggcatctttggcagcgagagcaacgatgagattgacgggatcattcttactgtgaccgaaggaaacaggggaggccaggcgcacccacgacatagcggtctcgcggactgctctgctggggcgggcgtgcgcgaaagcgaaacctggagcgaccacaatgtaggggcctttttcttccacgctggcgatcatggcatcggtgtaggcggaatcaatgctgtttgtcttttctaggagtacacctgcggcgcggatgccttcacgccaatcggtgaccgtgcggtcgagttctatgcgttctgcctttagcagatctttgagtacaaacataagtagatgttaattcactgcatgttgattcggatagggtcaaacataaagccacacttgctagatctccgtacgccccacgaagacacctcgaagttcccacgcgaaatgtttcacgtgaaacatctgctgatttttgtctccaagtggagttgaatgagagttatgaacactccggcagttcaggttcaaaatctaagtttgagttttgggtcgttcacagctgtcaacggcctcagcctcacggtggagcaggggagcattcacggcttcctcggccccaacggtgcaggaaagtcaacaaccatcagggcactcattggagtgctaaaaccccaaacaggttcagtcgctattctcggccaagatcctgttgctcaccccgatgtccttcgaagagttggctacgttccaggagatgccacactgtgggacaacctcactggggcggaagttttcagggcgctcgaatcactccgcaagactccatccaaccgagctctagaaaacgagctcattgacgccttccaattggatccctcgaagaagatccgcgaatactcgacaggtaacagaaggaaagtcagtctcatcgcggcgctcagtcatgagcccgagctcctcatcgttgacgagcccaccgcaggcttggatcccatcatggagcaagtctttgtcacctatgtccgcaaggcacgaaccaacggcgcgtccgtgttactcagcagccacattctcagtgaggtggagcagctgtgtgattacgtcacggtccttaaagaggggcgagcagttgcatctaatgaggtgagctatctgaggaagatctccgctcaccgcattactgccacgattccggcggtacctcaacaccttgctggcaggggagaagtggatttcgatgctggccatctcagcatcacctgcgatgcctccgaggttcccgatattttgcgcatcatcatcgacgctggcggccaggacatcatcagcaccgcggcgtcgctggaggagatcttcttgcgtcactatggagaaaccgtgagtggttcagaaagcaaggcatcacaatgatccgtcttaatctacgtcttcgtcggatgctcattctgtggtggctgcttggcatctgggtatttctcatcatcaccccgccgtcatatgttgccacctatccggaccttgcgagccgtgggccggttgtctcaagtgtgcaaaataatgtgggcactcaagcaatgtatggctatcttccatcgcctggcaccattgggcaattaaccgcctgggaaactggagcatggttatgcgtgttgtcgtcggtgatgatggttttgctgtttagctcgcttcatcgcaaacctgaaagctcgggtctcgtcgagtatgtgtatgccgcggggcgcagcggttcttcccgtttcggcgcggcgatcgccacaggcacgattgtgtctgtcctcaacggtgcggtgtgcgccttcatcctgctcgcttttcgatatctaagcattgatgaaatcacggtcgctggcagcatagcgttcggcgtaaccatcactctcaccatgctcgccaccatggccatcacgagcattctgcagagcttgtgggggaggggaaccaacttcaaccgccttggcctcctcagcgtgggtgccgcatttttgatcagaatgttcgctgacacatcgtcgtcaagctgggcaactcacctcaactgggtgtcaccgcagggctggcgcacagtgatcgcacccttcacggaagacagttggctgaaggctttggtcttggccatcgtgtgcgcggcgctcatcggcgttgcatttaccctcgattcccggcgccccttcgatgaaagcctgcttcaccttcgaggttcgaagcgctaccgcgagcgaaaaatccgaagcctgtacagcctgaacatggtgcttcacagaggaaatctgatcacttggtcgatcgtcatcggcttggttctgctgattttccttcccctcatcgactcactcctgccgtcgctgcaaggcgatgccgcgacgatgcaagccgtcgaagccttcttgccagcgggcgaattgcagatcaccttcatcgtctacgtcttccaaatcgcgtctattctgctcagcatcgcagtggtcttgcccgtcatcgggttcatcggccaagagcgcgaaggcctcatcgacgcggtccgcagcacgggcgtgcgccgctggtcgcccctatggggctgcgttcaagcatgcttatcgacgctaacctcctgcaccattttcgccattctatgtgctctcctgggtttgtatctccaaccgtcaacagtggaagacgggacctccctcatggtgctttccggcctctcaattgccgtccatgcactgttcttcctaggaatcgcaatcgcagtagcgggacttgcaccgcgcgtcatccaccttgcctggctccccattattgcggcgtcggtagtgactctcctcggcccattgttctcactcaccgagcagcaaatggaattctcgccactgacacattcatgggcaaactccgatgaagcagtgtggccgttgctcacattcgcgattattggtgtcgcccttgggggagtaggcctacttggggcgcagcgaaggaacctactttagcaactggctaaataagattctctggacgatactaggcattatgactcaaccagcccccatgtgtagccgccgcatgtttcttcttggaacagcaacaaccttcgcaggtgcttttcttgcagcctgtggtactgaaccagatcaggaggtagcggctactgaagtccccgtcggaagctctgtcatcttgggttccgtaatcattgcgcagccaaccgaaggcaacttcgtggcttactcttctgcatgcccacaccagggatcacgcatcaccaaggtagagggagacactgttatttgcacgaaccataagtcagtcttcaacatttccgatggttcagttgtgtccggcccagcccagaacggactcaccagcgccaatctcaagcaggacggcgacactctgagcgcgtccgtgcagtagaaaaacagacaaaaaatggcgatgtttcacgtgaaacatcgccatttttctaccacgcacctcgcacataggacggtgggtaggggatctcatcgcgagttttccccagttcatgcgcagcaaatagtggccaggaagggtagcggagggcagctcgacccagcgaaataatgtccgcatctccacgatcaagatgcccctgcgcctgacccacatgagtaattaatccaaccgcggaggtagggatacccacctcttgcttcacacgacgagcaaatttcacttgatagctcggctccacagggattgtcgcgggtactgcacctccggtggaaatatcgactgcatccacacccagctttttcagatctgacacaagcgagacggtttgatcgtcatcccacgaaggttcatcatcaatccagtccgtggcagagatccgggcaatcagtggcatcgagcccggaatcactgcacggatcgcctgggctacttccctaaatagtcgtgtgcgattctcaaacgaacctccataaatatcagtacgtttatttgcgacgggagtgaggaactgatgcaacaggtaaccgtgggcaccatggacctccacagcatcaaaccctgcacgcaccgcgcgctctgcagcagcagcgaaatcctgaataaccttttcaataccttcgcgggtcaattcggtcggatctgcaagccccggctgagcgacagcactaggcccaaaggtttcccatccaccctcgtcaactgattgagtaccagtagggaagttaggaagggccggatatgtgctcgctttgcggcctgcatggttaagttgcacaccgatcagtccaccttgagcgtggacaaaatttgtaattctctcccatgcctcaacttgggcctcattccataggccagtgcaacgcgatgagattcttccctctggactaatgccggtggattccgcgatgaggagtccgaagccgccaacagctcgggctccgtaatgcacgaggtgccaatcaagtggaaccccatcgaggttattggcttggtactggcacatgggcgcgagccacatcctattgggaatttctaatccacggattgcaatgggagtaaggagggaagtcatggtgtcgagaatagtccaaaaatccacaatccttgcgctgattcaaccacgcaggaagtcaattgattaacgacacagtgacgaaactaaatagagcgataaaattaatgggttaatcccactatttcatttcaagtaacttgattcaccgagcatcagggaaaccaatattgggttcacctaaaactgctggtcatttccatcgcccatgcccccacgcgatgtcttctcacagtaccacccacaagccacaaggagggtatggaggtgggcgtctaaagccaaatttttcccggtgtttgaggcgattgcaccgtacactaatgtgcatgcttgaacgcctcaaacgcctagatccgctcattgtcctcattgtgctggctgtcattgtggcgatcatcattccagttcgcggggttgctgcggattggtttgatgtcgccgtcaagattgccattgcgctgctgttttttctttatggtgcccgcctatccacccaagaggcgctgaatggtctgaagcactggaggcttcacctgactattttggcgatcactttcggaatattcccacttatcggcattgggctcgagccgatgactgcatttgtgtcggaagatatttatcggggaattttgttcctcacgctcgttccgtccaccgtgcagtcatcggtggcgtttacctcgatcgctaaaggcaacgtagctggtgcgattgtgtcggcatcgctctccaaccttgcgggtgttttcctcactccgctgctggtcatgctcatcatgtctgcgggcgggggagttcacgtggattcccaggtcttcctcgacattgcgattcagcttctgctgccgttcatcctcggccaggtatgtaggcgttgggtgaagaattttgcggccaacaaagcaacaaaaatcgtggaccgcggctcgatcgcgatggtcgtgtactccgcgttttctgccggcatggtggctggcatttggtccactgtgagcgttctagagattatctacctcattgttttcgctattctgctggtgatggccatgctgtggttcacgctgttcatggctacacgccttggatttaaccgggcagattccatcgctattcagttctgcggaaccaagaaatccctggccacaggcctcccaatggcggcagtcatcttcggtggcgccaatatcggcctgctcatcttgccgttgatgatcttccaccaagtccagctgatgatttgtgcatggcttgcagctcgttatggtcgtgatgcgcaggaacagaaagccaacgcctaaaagtcctcagtagctagccaagctggtcaagcaatgaaagtggtcaccttccgggggccacttttttgcattctaggcagttcgggccggtgtgaataaaacaccttccccaaatagacagcatggtctagattagcttgaaacgaaagcgtacattcgcagcaactaacggaaagcacactcatgactcacactctgcaggcaactaatccccttgatcaaaccgcttggcacgcttggcatttctcccgaaacaaagaggccatcagccgcaccggcgccaccagcctgagtgccacagagtggattagcgccaccacactcaaggacgcgcacacttttccttcacttcccgggcgatggtataaacgaggcggcggggtagtgggagcacatttaccaccagctttcgcaacaactggaacggtgcaactgcgccccggtgagctcttgatagcggaagatttcaccctcaccgtcattgaacggcttggacagtttgcacttcaggtttttgatgcacgcaatccgaagcgttttgaattccactccatcgcagctttcccaccgtccgaggaatggcggattgaggctcgcttcttcccggaacctgacactgttaacaccgctgcagctgatggagttatcgttgccacgcctactgcgggttgggtgcactttttgaagggccgtctggattaccgtcttcgtgtaaccgttcagaaaaataatctacgggcactatttagcgacaattcctcgacgttgggcgtttatcagcatcgttttgtcgacatcccacgccctgatgccgagggaaacaccatcattgatttcaaccgcgcttatcttcccccaaaggcattgaaccgaaagttcctgtgcccatcgcccagcctgaacaaccacctcaatctcaccgtggaggcaggggagaagtgggtggttgctggaggataatacttgctaaccgtcctaaacgggcaagtcagctgcgttgcgctcttccacttccgctcgcatgacagaagtcagcagtcccggaaaacgcgcttccatatcttcgctgcgcagcgcacttagaatggcagttccttcatagcgctgagtaatcagacccgcctcacggagtacgcggaagtggtgcgttgaggtggatttagatactggaagctcgaaggcaacacatgcctgatcattatgtccgcacgacagctgcgacaggatttgtcgcctaataggatccgacagcgcaaacatgatggcatttaaattcatctcggccaaagatggatgttccaatttgcgggccatgacaccctccaaatgatctcgtaaaacagtattgaatttaggtacgactctaatcgtaccttgccctcaagccaagctagttgtacgatcaaactcgttgtatggcaaacgtcgtactagtcgatcgaatggagcctttggtgtccaagctgtttaccccaattcaaatccgcgacatcaccatccccaaccgcgtgtggatgtcaccgatgtgcacctactctgcagccaccggttcaggtcttcccaccgattttcaccaggctcattacgcagctcgcgcagcaggtggtgtcggattagtcatggttgaagcaactggagtgaaccccgtagctcccatctccccagtcgaccttggactttggagccatgaccaaattgaaccattctcccgagtgacagcagctattcgcgccggtggggcagtaccggccgttcaattagcccatgctggccgcaaggcatccaccgatgctccgtggaatggtggcggatatgttggaccagaaaccaatggatgggagactgtcggccccagccctctggcattcccaggtttgcctgctccgcgcgagctgacggtttcagaaatccaagaggttgtgcagcagttcgctggcgccgccgttcgtgccgatcaggctggttttgatgtcgtggaaattcacgcagcacacggctaccttttgcataacttcctttctccgatctccaacaagcgcaccgattcatacggcggatctttagaaaaccgcgctcgcatcgtgctcgaagtcattgatgcaatccgcgcagtgtggccagaggaaaagcctgtattcatgcgcatttccaccaccgactgggtggaggaaaacccacaggatgatcgcgagtcctggacgctgagccaaagcaggcagctggctttgtgggcatccgagcacggagttgatttgatcgatgcctcttctggtggcctcgacatcgtccccattccgcatgaccgcgattaccaaaccgcgaaggccgcagatcttcacgcaagtaccggagtgacagtcgctgctgtggggcgcattgatgacgcccaaactgcgcacaatttggttgattctggcgatgtcaatgcagttttcctcggccgtccactgctcaaggatccttcctgggcaaaccaagcagccctcgcactaggtgcggaacccaggtatgttcaccaatacgactacgtactttaaaggagagttgacatgaaggttttcatcatcggcgctgcgggtggcatcggcaatcgactttccagcctgcttcacgccaggggagatgcagttagcggcatgcaccgcaatcttgagcaggcctcaaaaatcacagacactggggcaactgccgtactcggggatctcatccacaacagcacggaggagcttgcggagcttttccgcggtcacgatgccatcgtattttctgcaggcgcccacggaacagggcaagaaaataccacgcttatcgacggcgccggcctccgtaaagccgccgacgctgccagcgcggccaacgtttcacgcttcatcttggtctctgcgtttccggaatcctcccgcggggagaacaccaccgagaactttgagcactatatgaaggtgaagaagtccgccgatgtctacctcagtcacactgacctagactgggttattgtccgaccaggcgtgcttcaagatgaggcaggggatggtttagtcactgctggcttagcgattaattacggcaatgttgctcgcgataatgtcgcagcgttcattgatgaagctctgcatcaaccgcagttgtcaaagatcattgttgaactcaccgacggttcaactccggtggcggaagccgtagaacgcctcatcaagtaaagacgaaaagagggagaatgtttcacgtgaaacattctccctctttagctacttctaggaagagagtgaagaagtgtagtgctgtgactcgactgcttcaggtcgcgcccatccctggaagtgctggaactgctcttggatctgagcgccccactgtgctggcttgaagttctgtgcgatgtcggtgaagtgctggatctgatcaaacatagtgatttcctttgctgaggttgaatgagttcggggagtaaaaacagctgcgctgcgattctcaaggggagcagggctcctcggtcaatgtttcacgtgaaacattgaccttaaagagcgactaggagctgagggagaaagtgctcttggctggctctacagtttcggtgttaaaccaattctggaagtgctgctggaactgctcctgaatctggacaccccactgtgcgccctggaagttctgtgcaatgtcggtgaactgctggaactgatcaaacatagtgatctccttaaagtgattgttgtaaagaagcaagaacgtctgttgtaaaaggtttaaaaaagcttaaggtatcgctagacttgccacgatgaggctttacctccaaccgcagccctcccagaacatcggttaccgatggcgtctctctggcagctgagttggcagcaaagctaatcattccggatcgcattgggggatgtttcacttgaagcgtcccctcatgtgttcttaggaagagagggaagaggtacgctccggcaggggagcagcctcagggcgaacccactgctgaatctgctgagggaagtgctgctggaactgctcctgaatttgagcgccccactgtgcaggctggaagttttgtgcaatgtcggtgaagtgctgaatctgatcgaacatgttgaactccttttaagtggttgagtgagatttaggaagaaagaacgactgcagagaagatgtcggaaacgcttcccaggacagtgttgaagatgttgacgatgtatcccatgaaaagaactcactttctcgtgtacttgcaaggtgtgccagcgacggtgtgttccgttgctgtgacttgaagttaacaccgaaaaaatttttcccacaaacagcggtcagaccaattttcaactccgtgacctgcacaaatgcaaaaatactgaagtttatgggaattcccccatcatcatgatctagctgcggaaatggcatatcatcatggctaaccaacaaaggtcatctcaaccggcttaagaaaattctgccagctttctgctgattgaatcgtgccagctcagggcatatctcacctaaagtaaacaccatgaaatcaatcttcatttccggtgcggcgaacggaattggcaaagctgtggcgttgaaatttcttcacgaaggttggctcgttggagcctacgacctcgcggaaatcacctactcacaccccaatcttcgctggggctacctcaatgttcgacagtccgagtcgtgggacaaagccctagaagactttgcgacgcacaccggaggcaccatcgatgtggtggacaataatgccggcgtaattattgagggaccgctgcaggacgcagaggaggggagcgtcgacaagcttcttgcaatcaacgtcaatggcgtgactcttggtgcccgcgccgctcatccttatttggcgcgcacgccgggcgcccagttgttaaacatgtcctcggcgtcggcggtgtacgggcagccccagatcgcggtgtattcggcttcgaagttttacgtcgcaggtcttactgaggcgctgaatttggagtggcggaaagacgatattcgcgtggtcgatgtttggcctttgtgggcgaaaaccgatttggtgaacggcgtgaaggctaagtcactgaagcgtttgggtgtccggatcactccggaacaggtggcacaggcggtatgggatgcggtgcatccgaaatctcggtgggcgaagggaaaggtgcatcacggggtgtcaaagttggataaggcgctgtatctcatgaaatctctgtcgcctgatcgggtagcgatgtgttttgcgcgactaatcgccggataaatgaattgattattttaggctcccagggattaagtctagggtggaatgcagaaatatttcctacggaaggtccgttatgacgcctgcaggtccagcacaattactcattgttgctcttgtagtaattgtcctctttggttccaataagttgcctgatgttgctcggtccgttggccgttcgatgcgcattttcaaatctgagatcaaagagatgaacaaggatcagatcgaaagctccgatcagaccttgaagaactaaggttcctcgcatctaaaaaccgcctgccttctctgtttagagaaggcaggcggtttttgttttgaggctttgtgaggcctatcggacgtcgatgaacttcttcagcacccagcccttggctgctatgacgattgcaccaagaacgatggctgcaacgccaacggtaatgaagaagaccttttcagatcctgcatcggttggatcgtagtaaccacccagggtgccggacagggacgtacccatggagacagccatcagccacacggcgaacatgcgggactggaatgcctcgggtgcgaccttggttgcaagtgagttgccgacaggggagagcagaagctcagcgatggtgaagaggaagtagacccaaatgatcagtgccattggggtagagttctctgcaccgccggcgaacggcaggaagaagaacagcgcgcaaccaatgacaatgttggcgacaccgaacttcactgcagtagaccactgctttgctccgagttttgtccacaaggtggcaaagattccggagaagatgatgatgaagattgggttgaaggagttgatcaatcctggaggaagatcaatgccgaagaagttacggtccaggcgggtgtcggagtaaaccgcgaggaccgtgaactgggtttggaagatcgcgaagaaaagcacgccaccgatgaacatcgggatgaatcccaacaagcgggacttttccgctgcggtggtcagtggggaaacgtacatctgagcaagcagagcaatagccgcaatcagtgcgatcgctgcggtgatgttggacagccattccagcttgatgatgcccgttgcgatgagagcgacaactgctgcgacaaccacgactgcaccgataatccagcgcgcatattcattcttaggcagtgggttaggaacagtatggcctgccgcaccgatggtggttttacgcatcgccacgtattggatgagacccaaagccatgccgactgcggcgataccgaagccccagtggaatcctccccatccccacagagcgttggtgatcagcgggccaaagaggccaccgaggttgacgcccatgtagaagatggagaagcctgcgtctcgacgcgtgtccgtgcgtgagtacagctggcccagcacaacctgcgctgccgtcttcacgccacctgagccaaggccgatgaggaccaagccgatggacagtcccgtatatcccggaatcaaggccagggcaatgtggcccagcatgacgatgatcgcggagtagaagagtgtacgttcagagcccaatactcggtctgcaatgaacgaagccacgagggaggtcatgtagacgaagccgccgtaggcgcccacaatggacagtgcagctgtctgattcataccaagtccgccatcggtgacggagtagtacagatagaaagcaaggatggactgcatgccgtagaagctgaatcgctcccacatctccacgccgaagagatttgccagcccccaaggctggccgaagaatttcttttcgcggtgagtttccgccacttcagaccctaggtgggggtcggaaggttcaggactcacaccgtcttgagttgtgtcggtgttcataacctctatgatcctccacctaaaagcacaactccaattaggcacccaacgatcccgcaactgaaacacagttgaaaatagctagaggcttaagttgatcacaggggattgaacggcaaatgagggaaatgtttcacgtgaaacattgaaagaagtcagatacggcttcacaattccctaaatcccacaaatgcccctcgcttgaaaagcactttcggacaccatgtgctcaataaggaacaaaatgggggtaaagaagtgtgcgcgaaggatattaagcgttccacaatctccagcgcgaccacccaaacaggctgcacgccatcagtggacttccacacaaatggcccccaatttgaaataattcacaaataggggattggggcgcattgcctattggaaaactgccaaccattggcgagccacagccaactttagcaattcctcatcaacatcttgccctcggacatagaggaagtaaaagtttctatccatgcccatcaagctagccaggaactgaactcgacgctcttcattctcaaccaattcgggcaccgattggctcaacctctgcatcattgaaagccactcatcggccaccgcagcatcttcgaccatcgcttgttccatcgccccgaacactttggcattcgctttccacacctccgtcatggagtccagccatctaagaatggactccaaagtgtgttcagggagatcaaaaacttttaggacaggggtgcggaccgcgggttcaagttcccgcattttagccatcatgagatcgggcttgttacggaaatgaaggtaaaggtttgcccggctaccacccgctgcctgagcaatctgattcatggaggtggaaccataaccgtgctccaagaagagttcgtgggctacatcgataaacctttgacgggtctctgcggccttgagatctttcagattcattggtgttgctcttcttgttgagggacgggctctgatcagtgtagaacaacgcaatcgttttcggttcgcttcgcctgtgaattgatggagatcggtctggaatccaaagaatgccaatgtttcacgtgaaacattggcattctggagggttgcgtcgaaaagcgaaatcctacgcgcccggcgcgagcacgatgtcgaagcgcgtgcgcgcccacgtctgatcgccgagatcccgaccatctggggtaggagtgcctggcgcctgctcctcaaacttcttgatcaacgagtccttgaccccgaagacggaatcgccgatttctagctgcggatcaccctcaacgaaaatgtgagtgaccaaggtgcgcaattcaggagcggtcaccatgaagtgaaggtgggcgcagcgcaccggcgaacgaccaaccgccttgagcatgttgcccacggggccatcgtgggggattggataaggaaccggagtcagaccccagaagcggtaatcgccattggcgtcggtgtgcatatacgcgcgacccgccatgcgctcatcggcatattggacatcgtagagtccatcttcatcgcactcccacacctcgatacgagcattcggaacgggattgccttcagtgtcggtgacggttccttcaatccacgctgcctgcccctgggcgccgccggcgatatctccacccagctcaacctcaggagcgtcatcgaggaagaatggaccaaagactgtagcttccgttgagttttcatacgcttcgttgttcaccgcgatggtctgcatcgaggcgcccaaggtatcggaaagcaacacaaactcttggcgcttgtcatcagtaatgtggccaaccgctgtgaggaaatcaatggcgtaattccactcatcctcggtgaggcgcacatcccggatgaaatcgtgcagatgcacaaccagcgattccatcagctgcttgaggcgcgggttttcacacgcatcaaaagattggaggacacggttcaccagattttcttcaacagccttttgctgcgcgctgatgttgtggtctgcggtggtggttgtcatgattttctccttgaaaaatcgccgggttagttactgagtactgcgctaagaactgccggatcctcaccgttgagtgctgcttcgagcaatctgctgaggttttcccgggtcactgggcgaggattgttggcgggaactttctccaacgtgacgtccactgcctcagcaattcctgaagcctcgaagccgtagtcggaaagtcgtttcggtgcgttgactgacaagcggaggcgttgcaggccttctagtgcggtgtcagttccaaaggctgcggctgcgcggcgttcagcttctggtgcgtcgcctgcgttgaatgccaaaacatacggcagcacggttgcgtgggtttgggcgtgggggaggttgaaggtgcctcccaaggtgtggcagattttgtggtgtagtccggagcctgcggaggcgaaggatactgctgcgaggtaggcgccgtagagggcttcgtcgcgtccttcgatgctgtgcgggttcgcaacaattttcggcagtccctggttgagtgcgcggattccttcggctgcaagcactgcgttgatgggatcggcgttgggtccccacaaagaatcaatgcagtgcgccaggccgttgagtccggatgccacggacatctccactggaagcgacatggtgagttcggaatcgtaaatgactgtttcggggagcaccttcagatcaacaccggttgttttgcgcgctgcttccgtcagaccccacacgttggttgcttccgatcctgcgtaggtggtggggatcgcgacgatgggcagggcagtggtcatggcaattgctttggccaaacctatggtggatccgccgccaacacacaccagcagatcaatctcattgtcggttgccactgcacgcgcacgttcggctacttcgatgggcacgtgcatgacaacttcgtcgtgccagatcgccacctcaatttctgaggccaccttatgggcgatcgacatttctcgttcacccgcaatgaccatgaccttggctgagccgcggcgttcaacttcctgctttaagaatgcactggacttgccatatccaaacatgactttctgtgggagggtgtcgtggttgaatgcgagtgagttgttcacagcgagaatcactttctaaaaggtgtggtggtttgttaggtgctagccaaagagatcggagggggtttaagccttcttgaagatctggccggtgaatgctgcgtgatcgagttcttcaagtgagcggccacgggtttcaggaacaaacttggtgacgaacgccagggcaatgactccgacgactgcgaagataaggaaggagaaggtgatacccacgccggagaccagtgctgggaagaacaacgctaggacgccattgatgccccaaccgcagaataccgaaataccggtgccgatacccttcattcggactgggaagatttccgccagccacacccacactgcaacgttgaggaaagtctgcatggagagcacgaacccaacaacaaggatcatgatggcgaatggtcgaatggagttaccttctggaaggagagtgccggcagctgcgatcaaaaggtggaaggtggtggtcagtgacaggccgatgatgaaggtggtgcggcgatccaggcggtccatgttgcgcagtgcgatcagtccaccgatgacggcaacggcaccgaaagcaatgttggcaaccacagccatttctgcgctcatgccggattcctcgaggacgcgggttccgtagtacatgatggcgttgatgccggtgagctgctgggcaactgcaacaccgatgccggcgatgagcagacgaaccagccatttgttgctgaggacttcgccgatggacatgtgggtgtgcttgctagaaacctggcctgaagcctggcccgaagactgcttaacaccaggaagtgccgcattgttttcagagtgcaccgcgatgatttcatccatttcggctttcgcacgctcaggggtacggacggtctccatgacgcggcgggcgtcgtcgtaacgcccctggttgaccagccagcgtggtgattccggcatccgcagcatgccgaggaagagggcgacggcagggagggcacagacggcgaacatgatgcgccagattccatcaataactccgtgtagggtgacggcgataagcgcgttgatcacgaaggcaagcagctggccggtgacgatagcaagctcgtttcggccggtcagggagccgcggatttctagtggtgcgagttcagcgaggtacaccggaactactgtggaggcgccgccaaccgcgagacccaacatgatgcgcccggtgaccaaggtggcaaatcctggtccgtagaactgccccagctcaccggcgggggagaatacgacgaggattgatccgaggaagaacagcacggacaaagtgataattgcttttcgacgcccgatttcgtccgagatacgcccagcgaacagcgcgccaaaggctgcagcgaaaaccagtgaactgatgacaacgccgagctgcagcacgttgagtccgagttcttgtgccatgtggccttcggcgccgttggcgacaccggtgtcatagccgaagagaagtccgccgagacaggcgacgagggaaatttgtccaagtcgacgcgctggtcggcctgctgttggtgctgtagtggccgatgtacttgatgtggccttgatgtccgtcatgttgtgtccttttatctttgatgaagtcacaattgttgctatatgcagctcttaaccgatccagaaagcagagttatggaaaagggtttggagcatttagccctgtgcacttgtaaagcttgttcaaacgacttaaaacaaccgggaaggtggccggcctacgcttttaggagaaggagggacgaaggtgtgagtcccatttcctcgctagttcaatgattctggttctttcattggggttgcccccgatttcgaactatcatctaccggacatcttgttcgtaagataagcttttgtcaagactttttgtgttgtgggttactttttgtcgatatagttacccaagacaacctgtttagccgtcacaaaacaccccatgcgggggcaaaatcaaaaacaacctttagaaaaacggatcaaatatgcaaaccattcagctactcaccaaagcaggacttttagtagacgcactttcggcagggccaaatactcattctgagctggcaaaacagttaaatgagccgaggtcgtcgatctatcgaataacgtcttcgttagaggaagtcgggtacgtcaacatcaccagcagtggcttgttagggcttggcgtaaacatcctccacctgggcgaaagtgccgttgacgccctgcttaacagaactttattgcgggaaaaattaggctggctccgcgatcagctgggcatgaccgctttcttttgcaccctccaagatgaccgcatcatcagtctggattggcaggagggcgcagatattgatctgatttacctcgcccctggccgcacgctcccgtcccaaaaaggtgcagtctcccatgtgctccagggcaaagacctgcgcaaagggtggagtattgatcacggcgagctcaccgttggagtgtcatccttagctgtcgcggtgaaaaacgctaacggcgacgtcttaggtgcagtggcggtagctgggctgagtgcaagcgttgagagcaaaatcgacaccatccgggacacgttgaaggaaactgcgtgcgcaatcgcaaacatgccgccagccaaaacgcaggaattcgatccatcacgaatcaaggaacccaattcaccttcggtaatcaccaaagcggcaacgctcatggatgtgctccgcactgaaggtcccaccaactccgctcgcctagctgaggtgctgggggagccgatcagttcggtgtacagaatgctccacaccttaaccgcgatcgggtgggttgagcaggacggaaagcgcggctcctatcgcgttggcctagccatgctcacacttgccgaattgcaattgcgccatatggatctccgcaagatcgccgcactaacaatgcggaaaattcatgcactcactggtgaaaccacatttttatgtgttcgtcacggcattcgcgcggtatgcatcgagagggtcgatggcgatcgtgtgaatagtcgagttctccagctgggaacctcgctgccgctccatgtcggtgccgcacctcgtgcgcttctcgcttttgagggacgcagggcctgggaaacatatgccacaaacttaggattcgagggccataactggtctaaaggaccgtccagaggcgagctattccaacacttggacgaagaccgcgataagggtttttgcctggtagacaatgaaattactcccgggatcgccgctgtaggagcaccgatttacaaccatcgtggtgaagtcgtggcaagcctgtccatgagtggactgcgggacggcatcctcagcgataccaccgactactcggccgtggaactgatcctgcaggggtctgcggagatttcccaagcgctgggagcgaccattgagcacaacgggggcaaccaaaaactaccccaggtaacccctctgagcattgtggtttaagcaattcattgacgtacaaagtgatgcgtgtcatgattgagacacttgtccggtaggtgagtcttcgtgagatacccccggccagtcatacagttcaaccaagctccaccacccagataaaaacctgcgggttgcgttttaggagaattcccatgagtgatcaaaaaattgttgttggcctgctaggcatcacccacccgcatgcgtcggcgcgggtgcgtgccctccgtgaaattgatggggtagaggtcgtcgccgccgcggatactgattcccgcctccagtacttcaccgacaaatatgatgttgaaccccgcgagatcgatgacgtcttgaacgacgatcgcatcaacgccatcatggttcactccaagagcaaggacatggtccctcacgccaagcgcgcgctcgcggccggaaaatccgtcgtcgtggagaagcccggcgggggaacagtggcggatcttgaggagctcctggccctcaaagaagctgccgatcctcagcgaatcgtgcaggtcgggtacaacgtccgcctgtctgaatcggttcagagattaaaagagcttctcgacgccggcctcatcggcgaagtcgtcagcgtgcaagcacgcggcgccgcaaaagtaggtgagcatatcaccgagcacctcaaccaacccgcagacatgggcggtgtgttgtggattcttggctgccacatgctcgatgcattggtggaagtcttcggagctccagaatccgtgaacgcccgagtgcataagaccgcaaaactctctgacgacaccagccgcgaagactcagcctccgcactgctgtactacccagatttctccgtcagcttcagcttcgacggccacgatgatctggaatggttcgaaagctcccgactcacggtctatggaaccaagggcatgatcgaagccggaatcctccctcagacactgcgcgtatacctcaatgagtcacgccagggctggccacagggttggaccgagtggacccagagctacttcaccccaccgtttgctcgcacagaatccaacaaattctcagagcttccagagctagaaaacatcagcaacttccgcacagaaatgcaggggtgggtgaattccattcgcactggatcccgcaatgtggcgccagttgaggatgctctcacagtcgctcgcattgtcagtgcatgctacgaatccgacaacaaccagggcatttccgtaaacatctaagaggagcactccatgaaaccacaacttattgcatcttgctggaccagcgcgggagacgccgcacccgatcgtgacgatctcagcagcccagtagcaatcgatgagcgcatcgctctagtcgctgaaaccggttgggcaggcattgggcttgttcacgccgatctcatcaaagcacgcgacaccattggctacgaggaattgcgccgacgcatccacgctgcaggaattgaaatcattgaggtggagttcctcaatggttggtgggcgactggtgcggaacgccaagagtccgatgccgttcgtgcggatctgtttgctgcggcgcaagctcttggttccccacacattaaggtcggagcaggagagggcaccaatggtgtggttcccattgctcacatggccagtgcgtttactgatctcgctgcggaagctgaagctcatggcgtcaagctcgcgttggaagcaactccgttttctcacctgaagaccatctacgacgcgctggaagttgtcagccattccgatagcccatcggctggactcatggttgatatctggcacaccgcgaaaatcggaatccccaacgatgaactgtggcgcaacattccactgtccaaggtcaacgcagtggaggttgatgatggtttcattgacaccccaattgatcttttcgatgactccaccaaccgtcgcgcgtactgcggtgaaggcgaatttgatcccgcaagcttcatccgtggcgccatcgacgccggttggacgggcgcatatggtgtggaaattatttccgcagagcaccgaagcctcccggtgaaagaagggctgcaacgtgctttcgacaccaccatcgcagcgtttgaacaagctgctcgtctcgccccctccactaactgatctttgaaaggctgaaaaaactcatgactcttcgtatcgcccttttcggcgctggccgcatcggtcacgtccacgctgccaacattgctgcaaaccctgatcttgaactcgttgttatcgccgatcctttcattgaaggcgcacagcgtttggcagaagccaatggggcagaagcggttgcatcaccagatgaggtgttcgcccgcgatgatatcgatggcatcgtgatcggttcaccaaccagcacccacgttgatctgatcacccgcgccgtggaacgtggcattcctgcactgtgcgaaaaacccattgatttagacattgaaatggtgcgtgcctgcaaagagaagatcggcgacggcgcttccaaggtgatgctggggtttaaccgacgcttcgatccttctttcgctgccatcaatgcgcgagtggcaaaccaggagatcggcaacctggagcagttggtgatcatcagccgcgatccagcgcccgcaccgaaggactacatcgcaggttccggtggaatcttccgcgatatgaccatccacgatctggatatggcgcgtttctttgtgcccaatatcgtggaagtgactgcaaccggcgccaatgttttcagccaggaaatcgcggagttcaatgactacgaccaggttatcgtcacgcttcgtggctcaaagggcgagttgatcaacatcgtgaactcccgccactgctcctacggctacgaccagcgacttgaggctttcggctctaagggcatgctcgccgccgacaacatcaggcccaccacggtgcgcaagcacaatgcggaaagcaccgagcaggcagatccgattttcaacttcttcctcgagcgctacgacgccgcttacaaggcagagctcgcaacttttgctcaaggaatccgcgacggccaaggcttctcaccaaacttcgaggacggcgtcatcgcccttgaactagcgaatgcatgccttgaatcagctcaaaccggccgcaccgtcaccctcaaccctgccaacgtttagtcaacgtctagttaatgcctaaggagaaaacctcatgaaaaacatcaccatcggaatggtcggcgtcggccgcattggccgcatgcacgtcgccaacatgcttgccgttgctgaaactttgaaggaacgcgacctcaacattgagatcgtgctcgcagacgcaatgcccggttttgcggagcaggtgggcgcggacatgggcgtgaaggcggcggcaagcgtcgataagcttattgaggacggggtggatgcccttttcattgccaccagcaccgctggccacgtcgatgttttgcgcaagggcatcgcggcaaagctgccgatgttctgcgagaagccgatcgcgtcggatgtgcctgagtcgctgaacatcatccgcgaaattgatgcggctggcgcgacggttcaggtcggccaccagcgccgttttgacctcggttaccaggaagctaaacgacgcctagatgcaggcgacctcggctggcttcattcgctcaaggccgtatcgagcgatgcgtttccgccaccggtgtcctactgcgctacctctggtggacttttccgcgatgtgtcgctgcacgatttcgacatcattcgctggctgaccggccaggatattgtcgaggtgtacgccaagggcagcaacaacggcgacccagaaatcggcgcagtcggtgacatcgataccggagcggccctactcacgcttgccgacggcaccctcgccaccgccatcgccactcgttacaacggtgcaggccacgacgttcgcctcgatgttatgggctctaaagattccacgatcgttggcctggatgaaaagtctgcgttcgcttctgcggaggagggcatcgatttcccaaccggcgaatcgcacccaacgtttgccgagcgcttcgccgacgcatacaagaatgagtgcattgcgttcgtggagttgatcctgggagagcgggaaaacccttgtacccctgcagacgctgtggctgcggcgattgttgccgatgcagctcagctgtcgctggtcactggcgagccagtgaagattcctactgtacgggaaattcttgaaggttctgcgcagccagttgaggtgcgtgcgctggttccatctgcttaaaaccttactgcttatctaaaagccgtcccgcagcagtgggtcggcttttacgctcccaccaaatccctaaagttgcagttgagactttgtgccgcggtgaacaaaagacaccccctctagatgggagcctaacggccaaacggacacacttgcaggttccaagcccatttaagcaatgtgaacgccttaaaacggcacagaagctactctcgctaaagtaaacacctaattcaccttgatcccaccgaaaagcaatgacagattctcctatagttcacatgaatttaattagaaacttttaatgtatctcccaggtgttggacactcattgacttgctatttctcaacctcatcctgcctaaccaaaaggatggggttttagcttttgccattttgcgtccacataaaactttcaactcttcattggatctaggaaaaattatgaacatctcaaagctcggactgaggatcgcggtcacagcaacggcgaccacaacggcgcttgccctcggtggcacgcacatggcagttggtcaagaaactgatctgctcaacgctatggaaacactcgctggggttccctcagacttggtggtcactgaaatcctccccgataccaccagctatgacaattttgaattctttgaagttcacaacaccggcagtgcacccgtgaccattggggaaggggagtacaccttcgcctattcctttgacgattccgccgatacgtcccgcgacaaggcactggatcttggcggggaagtcacggtagatgcaggcgaaaccattgtggtgtggattgagtactccagttcaactgttgataccgctgcgtttagtgagcaagacttccgtgatttctacggcatggattcctcagcccgcatcttccgagcaactggccaggcgggtctcgctaacggtggtgatcgtggcatccgagttctgtacaatggtgaagtttctggttggtcccactacccatcagatagcgcagcggttcaaaagggaattgacttcgcgctgccaaaagtaggggagcaggccagcattgcagtgcgcaccaaaactgatccaactccaggatcaattacttctgatcagttgattcctggcggattggacactccagaagagcctgaagcccctgaagactctctttttgaagggcgcactccccctagggatgcagcaccgctgatcctcactgaactaatggtcaactccaccaacatgggcagttctgatggttttgagtatgtggaaatcaccaacactactgccgaacccatcgatttttccgattacaccttgaactacctgtacccgcaggatgagttcaccaacaccaacgaagccgtctgggctgcggaacctggtgatgtcattattcagcctggaaaatctctcgtgttttggatcaaaaatggccccaatgatgaggcaaccgcagcagatttcaatgcagaatatggcaccaacctggaggctggaaaagaccttgttgaaatctcctcaggtgggatggccaatggtactgccagaggaatgcagattcagaccaacactggccacatagtcaaccgtggtttctacaacatggctggcgcttctgatgtgaaagccaacgagggtcttcatttcgcagtggatgagtctgatcttctgaagcaaacgcttgtcggcagcggtgcgccaaccccgggcactgtgtacacttcgcagattcctaatccactgtctgccgttatcgctgattcttctgtaccactcatcacagataataccgcaaccagtatcaaccctgcggagccgtttaccttcgccttcaatatcaccgatgatgtccaggtgcgcacggcaacactgcatgttacttccagtgctggcgaagccgcgacaaccatcaacctcaccgaggatgacggctctttcaattgggctctgcctgcagcggatctcaccggaaaatcctggttcgaatacaccgtaaccgccaccgacggattcaacagcgttaccaccgagccggtacgcgtcaccgtcgacggcgccaacaccgacccgctgcgcctcaacctggaagaaaaccaatgggtcagtggcaccaccgatgttatcggtgcttcagatgtcttcggcgacaagcttgaattgcttatcgacgacgcgcctgcagtcaccaactccagcctgtctgcggccccgacgtttgcgatggaagtaacccaaactgatgtgttcttccgcaacggcatccttgccggtggggaagaactccgcattttcgatcaaggaacttacgccaacaccgaaaccatctccacaccagtcccgctgtatcacatcaatgaggacggtaccctcacagtcagtgtgtatgcgggaactaaagcagcaccagaaattgacctcaacgagaacaatgacgatttccagatcagaaaccttcgactaattctgcctgatggccggaccctcacccctgccggaatttccgattctaatgcgtggctcaacatgggagacagcgctggaaaactcgatttcttcgatgccaccttcgccctccctgaggatgctttcaccggtgtggcacacgcatgggataccacccaaagcacagatggagaacaccacatcaccatttcccgcgaagacggcggggaaatcagccgcaccatccgggttgataatactgccccagaactcaccgtttctggagttgaagaaggacaagaactgcgcggcaccgtagaaattgatgcccaggcaaccgatgcgggtgcgggcgtgaagagcgtcgagacgcttctcgacggcgaacgcgtgcaacttccactaaccaccggttccatcgctttggataaaggtgaacacaccttggttatccgtgcagaagatgaagtaggaaaccgcaccgagaaaaccatcacgtttagcactccggatgaaaaccccatcagtggtgactacgctccaagcaatggggccaccgtgggcgtcggtgacgttaagttatctgcacgagcaagtgatccaagtggcgatactgtcaagatgacgttcctggaagccgattcaccaaaattagatagtggtcgcgtccgaatgtcatcaggaacggtagaagatgccggaagtgtctcgcgcgccgaggcgaaaatgttggagaggggagacgtcgagaagctatccagcctggatgggctgggcatggaagttacctccgacgccgcactgccgtaccagctttttgaagtcgatgcggcggatgcactcgcggccgacactgaagtgcgcctgaattgggcgggatccgccgatggtcgcgcgcaggtgatcatgtatgttttcgatggcgaggcgtgggttgaggtggatcgtcacttgaccggcgatgagctggaagagtttacgctgcagggcgtcgtcaatgcggaaaaatttgcaatcggcggcactgtcaccgtattgattcagcactccgaaggcttcgccggtgcggatcattcaactagaaattccgacgtgaccgcagcgcacccggatgatgtggctcgctctgagtacgatttcaccctcgcgtgggaatctgacacccagtactacaacgaggaattccacgagcaccaaaccaacatccatgactacgtgctcgccgaacgggagaacaagaatattcagttcatgttccacactggcgatgttgtcgacgactgggatcagcccgcgcagtgggccacagccaaccccgaataccagcgcctcgacgacgccggcctgccatattctgtccttgccggaaaccacgatgttggccacaccagcaatgactacaccgaattcagccgacacttcggcgaacagcgctacgtagacaacccgtggtacggcgaatcctaccaagacaaccgagggcactacgatctattttctgccggcggaattgacttcattaacgtagcgatgggctggggtccagacgacgaagaaatcgcgtggatgaacgaggtcctggccaagcatcccgagcgtgtggcgatcctcaacctccacgaattcatgctcaccaccggcggacttggcccgatcccgcagcgcattctcgacgaggtcgcagccaccaacccaaatgtcagcatgatcatgtccggccactaccacgacgcattccaacgcaccgactcctttgacgacgatggtgatggagtagatgaccgcaccgtcacctctatgcttttcgattaccaaggcctaccggagggcggacaggggtacctccgacttctccactttgataaccaaggccaaaagatgatggtgcgcacctattcaccatccctgaaggattacaactctgatgaaccctcactgttggggcctgcagaagaccccaacatgtatcaagaattcgaagtgtcctacgagcagctcggcatcaaaccagagggccgcaccctgatcggcgattccttcagcgccgatttcttgacctccaatgaaattggaatagttgatgaggttccttctggaacgatcgcttccacgaactggaaggacgtaaccgaaggtcgccacagttggtatgttcgctccgaggatcctttcggcggcgtcgagatttcacccgtgcagtccttcattgccggggaagaggctggcgggaacgcgcccggcactggaagctccaatggcggttcatcccacggattatggggtgcgcttgcgggattctttgccggagcggcagccctggctggagctgcgatcgcatttgtccccggaatttgggactatgtgaccaacgcattcaagcgataattatggataggtaaacgctctacacggtttaagtgtggagcgtttttcaatgtttcacgtgaaacattgcaacaaaaatggcgcttttcgacgcccccgccgcctcttcaccgctgttaagtggcgggcattatggttgtcggggcgagatgaaccctcaatgtttcacgtgaaacattgagggttttacacccaattaagaaaaaatgaattaaaccaaaacttcttaatcgcaggggttaaggtaagttcagctaatcaatgaaacttcccctttcagcccgttgaagaaccaatgagccctgcccgcacccagccccgagcggctttcctaaggaagctccgacccatcacatgtagcctttccttggttctcgtagggtgcagcaacacggcagagtccacgaccaccgatacggcaggctccactgaaacttcatcacagatttcacccaccactccagtcagcaccaccgaagcagcgccgcctgaagatccaagcgcaaacgctttggaagagtatgctcagatccttgccaatccaagcatctaccccttaaccgaaatttcacaattcgtccccacaggcacatatgcctacacacttgttgaagcaacttccgattccatcccagaactactactccgcgccgatagtcacgaattcgcgccaattttggttttcacctatgacgaaaacacacaatccgcaacccaagctggaggagtcctaattgacggtgtcgccagcgccggcggttcacgagtcaaggtcagagcttcaaattcaggagcaggaatctaccaattgaattggtactcgatacaaccagttggcgaaagctctttgtacggaatccaaggaaactccctgacacaaatcgcagaccccgaggatttcatggtccgtgaactattacctgaccaccacgaaattacctgggttgattccaacgacccctccggcctatcaaccgttcagactggtggagccaacattcaacaagcagccccaactcccgttcaacagcctgcgtcaaacctgcactacttctctggtgtagtaacgatgcagaccgccggcgaactcatgcgaggtgaacgaactcccaatggtgagcctgccactgatctctatctcgtactggtccttgattccccaattgaaatcacagcacgaaacgcagctacagaccctcagactcgtaccatttccgaagtcagcctcggccgatacatccccgctgatggtgacaatgattggataggctacctcgacacccacgtggaaatcactgcaacaacggatcaggtctggttcccaaccgacaccggtctacctcttggaatgcttcgtctagcggactacaaaagcatctcataaaccgacgcagcactcgtcgataagcacttttcgactcccccggccaccaaaaaagcccgccttgcagcgggctttacggttatgcgttttgcttttcagcacctacgttttcctcatcaggaaacggcatatgggaaagatcaatatttggatcctcgtcctggttcttcacgatctccacggcctcagacttggtttccacggttgggaatgagccaagcagtggcttctgtgaagactcggtcatgaacagcagcgccacacctgcgattgcagagaagaacatgatgtagagcgctggaacgatatccaggccagtcttctgcagcaggaactgggtgatcagcggggttgtaccaccgaacaacgacacggaaatgttgtaggaaatacccattccagagaatcgtgacgcggttgggaacagcgctggcagggcagatgcggacagtgccacatacaaaccggttggaatagcaaccatggacagtgcaatcagtacggcgccgatggttccggtgttcatgatcaagaaggcaggaaccatcaagatcagcgttgccgcaacagcagtcgcgtagacaggcttgcggcccacgcggtcactccacataccaacaaatggcagcagcagggacataacaaccagaatcggcacggtcacagcggcagcggatgcggagtgcagaccgatctgctcctctagatacacaggcatgtaactggttagcgcgtaaccggcggtgttggtcgctgccacaatcgcaataccaatcagcagtggacgccagtggtggcggataacaccagccaggcccaggcgtgcataaggatcttcagtgtccttttcaacaactgcatttggctcgtcttggttgttctcaaacgcaggggtctcagggatacgagtacgcaggtacaccgcaatgatgcccagcgggatcgcagtcaggaaaggaatacgccaaccgaaatcctccatggcagttgcgccatagaagtgagtggtcacccaggtagtaatcgccacgaccgaagcacccgcggcaaagcccaggtaggaacccatatctaggaaagctccgaagaaacctcgtcgacgatccggcgcaaactcagcaacataggtggtcgcaccagcatattcaccaccagtcgaaaatccctgcaccatcttcaacaggtacaaaagcaccaaagcccaagcgcctatcgacgccgccgtcggcagcaagccaatcagcgccgtagacacggccatcatggccatggttacgtacaaaaccttctggcggccaaccttatcgccaagcggacccagaaccaggccaccaagcgggcgaactaaataagacaccgcgaaaccaaacatcacggccaacaactgccattcttgcggcaggccttgggtaaatactgcggtcatcgtgaccgtcaaataaccataaattccgaagtcgtaccactccatgaagttacccaccacagtgcctttaatggccggacggatcttctttgggggaacaacgttgacgtcatcgactgttagtcttggttcgttcttgattttcttttttgagcgaatcgggctcacgagtaaaacctctcgtcatatcttatgagtgcataacggaatgtttgtttgtagatgatcatcatccaacgcacccctgggcggtgttaacttcttcctgtaagactccttaaagctttgcctataaaagggaagtgaaaacaccacctctcttttcaacatgaatcgaccttagtaaggttcggggtgaaaagtcagatcgttttcaagtctgggagctggaagaatgcaaaaagaccccacactcatgcaggtgagcgggggtgggttacaaattggtcacatttccagatctgtctgaaaaatcaataaattcaggctcttcacggcctgtgtggggaagttttcttatatttttcttgggaaagttactgttttcggtgccgtggagggcaccgaaatgggcaactttatgcctttgagtcaccctcccgaacctcaattgtggatcccggtgggagcgcttcaatcatccgaattttggcaagaatcggattttgctccaacactttcgcgctggcaagtcgagcacgggtagttttcacttcatttcgtgcacgttccagatcagtttcggcttgaattttcgcaacgatcgattcctgcaacgctcccgagtactcctggggaagattcagatccttcagcaagattgacgagacttccacgcccacattcttcgcagcagcttgagcagccaccaaaacaggctctagatcaatgcgcaccccgatgaaatcctccaaaggcatagcgataaccatttcccgcaatgcgatctgagctgccaaataaatctcttcatccgggttctgtgaatccgcgacgaacttcaccggatcaatcgtggcagcggtgagcgccatggtgatggttacggccatcgcatccgctgtaggaattgattggggatggacctgaatcagtcgcctgcgcaaatctacctgtcggaactgatccccagggcgagaaaactcacgaccttgcatgcgcgagatctcaccggcacgctggcgcaacacggcatgtccaacccgagcaaccggcgagcgcagggcagaagtgcgccacagaccctgactgggatcattgatgagctggccagcctggtgcatgctccacccaaaatcctgcgaccgcgacctgaaaatacccatacaatcacctcaaacgtttagcgattatcgccgctccggaaccaccaacagcggggcagcggtgcgtcccccaaaacttatagttttaggatcgggccgggccacaggctatgagcagcaaaaatccgtagcgacgataacctattcaatgagtagtaggacttgaacccacttagatcctgaaatctgtgccaatgccatcgcatcagttcaatcgggaacaccccggaaatccggaagtgcccagcaaccacaatgcgaagcacccgccagaatagcgcagcccctatccaaaggataggggcttaatcaatttgttgtgattaaccaaccaaaaaggcgcttttcgacgccgcggtgctggaatttaagtgcgagctctccattgaagtgaagccgccaatagatccgcagccagcagattattgtgaaacctccggaaaattgttccaccatgccgcatgagcttgacgtttagctcataggctagatccagcatgaggtccagatgtggaaattccaagtccccaaaaatgatggcctctaaaccttccaaggtgaaataccatgcggtcacttcagaagctttatatcgattatggtgttccacttgccaaaatccatccgggtgggatagctcatctgccgatattgaagagcgggcagtattgatgaaaatttcaacattcggtgcctgcttatcccgatcatcaaatgcaacaaacgtttccagcatcccagcgctaagcgctaataagcgttgatggttcttagacttattagtagtgggcattgctgaacaaacccataaatgacgttgggtattaaagggatctggataagtttgatagaggtaccacccaacaacatctcgaagtgggcgataatttggctgttgtgcaagctgaacaaatttggcggactctgtactaactacatagctacctggtggaattcttttctcacgatcccaggacaatggggaagagactccattttcactatcaaaaacaaagtcttcctccccacgaggtttgcccgcatccctgatatttcgaactgaggtagattcctcagtcatggaaatcaaggtcttttccaaaggattcaagtcttcattggcaaagggaaagaattccagggaaataatgtcatcccatcgtcgacgatgtcccgtaaagcggttcaccacattcaccgactgcccaacataggcttcacctgtagcaaagctcagccgatagagccctctaaaatgtggctcatcacgaagtacaaaagcgatcgattccaaatcccggacatcgaatcttttccctgtgaaaaactgcttttccatagttacatactgcgctacacctgcttaaaaggtccgaaattgaacataaaattgcagcttccagaagtcacacttctggaagctgcagtaggaaaactcaaagctcctctacaattctcatggtctcaacggcaacgcgggtgaccttagcaatcagctccacaatgtagcgagggttacccacttcatcagcccaatcattgggatcattaacaatgccggacgccttatctttcttcacctggtaacggtcaataagccatgcgatggcagaacgtgaacctagttgatagttttcagcttcttcggggatgccgctgatggtgattgagctgttgtaaatcaaggtggtatggtcctccaccaatttcttggtctctggatcacgaaccttagcccacttcatcttggtaacacgccaggtctcacgatccgtgggatcagctttttctttgacctttacctccacatcccatggttcaacatcttcatagttgatatgaagatccatcaattccttgccggctgtcacaaagtgatcaaagcgtgcgcgatcagtaggggtttcaatatgtggcagcatcttctttagatcagccgcataggcctcacgataggcaggatcatgcaactgtgcataaacaaagtagaagatgtcatccttggtgacatcctcacccaagcttgattggtagagctttaagatctcgtcggtgatgttatcgacgcgccggtaaccgtcaaggatctcgccttcaactcccttttttggggttgtggagaaaagtccattaccgaagtctaattcgccttctcgagtttcgatgggttcccaagtccatcgggtaaagaactgtccggcgttagaaccccacatagcaagatctggaagtagatttgttgcaagggtagagaatggcttggcactacctgggttgacgatataaaagccctggttgtcatgttccggggtcgggaacattgacggtaactggtatcgacgctggttcaatgaaacatggaagtatgtctgttgagggaaaaatggacgatacaaggacatttggatgctgcttggatcaaaagaaaaagtatcaccgcgtgacaaggacatttttagattggaatcccaggatattttcttgctatccgctaaatcagggttctgcttaaggaattgattaacgtcagcttccttaggagatgtcactccgttatccacaacccacgaattaaaccgttgctgagcttgttcataggtttctaataaccgggtgatattagtttttacctgcgcagatgttggcccatagcaccaggcatcgcggccagtctttagaccagcagaaaaggtttgaaaaacctttaatgcagatttgtttttcttatcaccgagtacaggccaggtatcaaaatctacagagcgctggctgatccaatctccatattcattaggcgaaatagtctgccactcagcgccctcaattgtggcaacggcaatctcgttcaacttcgcatccgcgctgagattgtcaccaatatctttataaagaatcctgcaaccagacaattgtgggtttttcacggcaacaatgatttgagtacccacacggacattaaagacgttgccgccctcgcgcttagccaaatcaccacctgttcgggaattgccacgaaggttgaaaacataaatctcggagaagtcctgtgccaaacttaggcgcacaccatcagcggtattgccgtcaacccaaccgttgttagaaacaaaagcaacaaccccttgtgtgtgaatacgatctgttgcccaccggaaagcacgtaaataggagtcgtacagagagttcttatttgttgcggtcgaatacttcgcataagaatcttcaatacgtcgatcaagagtggggtacttgaggtttgcgttattgtcattcgcactcgattgccccacagagtaaggcgggttacccacaataacctgtacaggagtaagtctctgacgctccatacggtcattgttagcagtaaaaacatctagatcgagtttgtcatcgtcttcatacatctggaaggtatcacccaacacaatgccatcaaacggctcatagaccggcgcatcttcaccattacgcagagcacgctctccctcgagaccaaaataagtggtctcaatgttaacggccgcaacataataggcaagcaacatgatctcagtagcgtgcagctcattggcatatttacgggccaaatcttcaggcttaattagacctgactgcaataaacgcaccataaaagtacccgtaccggtgaaaggatcaagaacatggacatctttatcgcttaagccacgaccaaaatgcttcttggacacatcatcggcagctcgcagaataaagtccacgatctcaacaggggtatagacaatacctagagcttcagattgctttttaaaggcctttttaaagaatcgttcgtagaggtctttaattactgcttgtttaccagctgcggagcttacttcagcagcacggatacgaacagagtcatagaacttctcaagtttttccgtttcagagttaagttcagcactattaagagcatctgccatgcgttgcataacctgggaaacagggttttgcttagcgaagcttgattcagcaaatagagcgtcaaacactggtgcggtgatcagatgctgtgacaacatgctgattgcctcgtcgtcagagatggactcattgaggttgccacgtagaccttcaacaaatcgctcgaactcttctttgatcgttggtgaagcattgtctaagagcgctttaatacgggttatttgtgcttgggcgatgtcagcaacatcatctgcccaatcttcccagtaggttcgggtaccaactttatctacaagcttggtgtagatcgcttcttgccactgttctaaagagaacagtacgtattgtgtagcggattcagcactgtcatagggtgcgttatctctatctttacttgtagggccagtatgctcagtctcaacaggtagatccttaatatttccctcattgagcgcaatggagttcaccattgcgttaaaacggtcatcgtgagcacgaagggcgttaagaacctgccatacaaccttgaagcggcgtgaatcatttaacgcagctgatggtgcaacacctgggggaacagcaactggcaagatgatatatccgtaattcttacctggagatttacgcataactcggccaaccgactgaaccacatccaccatggaattacggggattaaagaagattacggaatccaaagccggtacatcgacaccctcagaaaggcagcgcgcgttagtaagaatcttggtttccattgactgggtaggagctttaagccaagttaaacgagagtttcgttccagcgcattcattgatccatcgacatgctggcatgccacgctcaaattgaggttgtgctcatctacgtcatcgtttttaacctcaagctcagtcgtataagcattgacaactcgtggaaaagactccgcgatttgctgagaagtcttaatgtctcgcgcaaatgcaacagctcgttccattgctgcgtcagagcttgagaaaccagtcttggtgtcttgctctttacccgaacgctttgccaagccattccacgcgccaataattgcggaagtcatgtccagagtgagttcttcaccaggtgttgaacccaaaacagttaaggcactggctgcaacttgctcatcaactgtcatcactacaactttgtagtcagtaagcaggcctttttctactgcttccccaaaacccagccggtgaaattcgggtccgtagattgcttcatcatccatggaagaaacttcagctgaatgatctgcagccttgcccttcacggagtcgtcgaaaagccttggggttgccgtcatgtacagccgctttgctgccttgatataagaagcgtcatgaatgcgggtgaagtttgaagggtcttctccagccaaggtgatgcctgtggtgcggtgggcttcatcgcagatgacaagatcaaagggctcagccccagcttcttgagccgcgtgaacagcaggaagggactggtaagtagagaacaccacggtcaatcctgctgctcgcttacgatgctccagtttttccgcaatcaatgcaccatcagtacttaccggaacttcaagatcataagcagcaatatcttctgcagccttggagaccttggagtcagaacatacggcgacaggacgaagatccattgtcttttgtgcagtccactctttgagtgtttgcgaaagcaagctgatggaagggactagaaaaagaatgcgagctttattgccattgagtcgcgcaacctcttcagaaagacgcagggcagtaaaggtttttccggtaccgcaagccatgatgagcttgccacggtcatgagtttggaagccttcaattgctttttcaatagcagtttgctggtgaggacgagggctatacggctctttaagctgcaggttaatagttaattcagaacctggataggcaatatcccagtcaatcggggattccgcaattgcagatagaccaatgcggttagttggaatggtttggttctccaacatcttttccgcatttgaactccacttatcagtagtggaaataacgagtctattgctaaaggagcgtgttccttcaggggtttcaaaagtgcgtcccgaggcttcaaagaaggaatctagctgtccttttgccagggaagtagtgggaagataaaacttgcactggatcgccgtataagcatcatcgtccttgttataagccactaagtcgatgccagtatccatggtgccaccgttatatggccaatcgacccaacgatggacttcatcaaactcagtggagagagtggggtcagacttaatgaagttgaccatgagtttttcaaaagccaaaccctgcgcagactgggaaggcagtgtgcgcagggcggatacagcatcagtaatcgtggacatgcattccattgtgtcctattcactcaaaggacatgtccatttggtggtcttagattcgaagtgctacttcaggctaacgagccagccggtgcgggaggattccttctggaagcactgctcgcaaacgtcttctgggatgacgccgtagcgcatgagcttgccgaatccccagcaaccgaggcagataccaaagacggattctaaggtggctgctgcgatgagcatgactaggactacggaagctgcaacgttaaatccaaaggccataaggataagggaagtaccgctaaagcccaggccgatggtctgcgcgaagcgctttggtgggccaggggtcaggatcggtgctttcttcagcagtggtacaagtacgtgtactgaaagacgtccaaagggggagtaacggggtccgccggcgacgcgcaatgcgaagccgaaggtcaagatgcttgccaaaataatacgaaggtcaccagaggcaaaaagcgtggcggcgctcagcaaaacaaccaaacccgcagtgcagcgagctgcatattcgttaacggggttagggaaatcaaaaacggccatcgctgggttctcctgtagagaggtaataaattcttaaaactaatcacttatgaactagttgttctatgaagcatagacctattggtctacttaggcaataggtgctttaagcagcggaaatccccgtgttagcagtcactaacacggggatttgatcggtattttaaaactctacttgttgtcctcagcaagccatacggaggtaaaaggtgcgttggatgcaacagcatcttgaaccgcacgggtaaccacacgctttgcggttgccactgcgtctacaacctcagcaccctttgcgagctctgcggtgataacagctgcgaaggtgcagcctgcgccggaaacgcgctcttcaccaatctttggctcagagaagacgtggtaggaggatccgtcgaaaagcacatccacggcgttctcgccggggaagtccatgccacccttgacgactacgtactgggggccttgctcataaatgaggcgggcagcctccttgaggtcctcgacggtctcaagcttctcaaggccggagagggtggaagcctcgaagttatttggggtaacgacggttgcttgaggcagaagttctaccccttgatctttccccgttgtggaataaagttcacaccatcgtatcttcaatccctgcaggtcattgggcgagttacggagatgttgcagtggcagccggaacaaatgctcagtccattggtaaccatcttgctgaacacccagtactaaacgctcatcgagttctaagaacagatgggtcaatctcagatggtttcagatggttaaacgctgaggaaacccgctcaccaaaagaagtattggaaagtgaaggtgtggaatttacttcttccaatagggcaaaccctcaacagcgattgactccagaggaattgctcgccttctttgcagctgagaattaactcacccttgcccttataccccataggggtatagccttgagggagagagtacttcacctgaaaggggccagtgacatggcattaaagaactacaccgttgagggcatgacctgcgcacactgcgtggcatcggtaactgaagaggtaagcgaagttaatggcgttagcgctgttgacgtcactctagaatcaggaaacgtcgctgtcagtggcgaaggtttcagcgatgcagagatccaggctgctgtagaggaagccggctacaagatcgttgcctcctaaagcacccaagaacatttaaaaacctgcctcttcaccattttatacctggtgaagaggcaggttttttcgtcgaaaagcgtggtttaacccgggttgaccagcacctttggtgccttaatggccggggttgcggtgacaaaaactggggaggtttcaggaatgaagcgggacgcggtgaaggcgaagagcgcaatgatgatcatgtataccgcaggggccagcgggctgccggtccaggagaccaatgcggtggagataaatggagccgagccgccgaagattgcgtaagtgacgttgtaggtaatgccggcggaagtaccgcgggtgacctcttggaagacctcggccatcattactgaggtaacgcagttagcggtaaccgcgccgattccaagcattacctgcgcaatcaaagaagcagtcaaagtaccttgacctgcaatgatgtaggccgggatcgccataattactgtgcttaaggtagcgaaagccatgatgttccggcgggggaatttatcaattgcgcggccaacaaatggggccacaattgctgccatgctgagagcgatgatgtttccagccagcactaacgtgccctccagtccgacggtgctgcgcaggaaagtggtcatgtacgtggtgaaaatgtagaagctcagaccggtgcaagagataaagccacctacccgcaacatcatcttccactcagtacgcaatgcctgcttaataggagcttcggggcgttcggatgcggggcgtacattttcctgggcaccggtgcggatccaccagccgataagccctagtggcacggccatcaggaatggaatgcgccagcccactcccaacattgacgtcggggcgggctgaacgattgcgaaaaggctagcacacacaataaatagaacccctcgccgaagcattggcgagggggatggggacgtcgataagcaattaagcgcggcacaaactgcaaggcgctgaccagctcaattgcggggtcgaggggctaggatccgaggatgttttcgatgtcgtcgagcacttcattggcgccgagaggacccaaccccatgaaccagctctcgtcattgacctccagggcatgaccttcttggacggcggggaggttgtgccacagctcgttggacaaaatgttgtcctgctcggtggcctcgggcttgccgtaggtggagtagaaaatccagtcgccgttggcatcggtgatgttttcgggggagatctccacggcaagatcgtcgatattttggatctctgggcgagaaagccccaggtccttaaggattgcaccgatgaaagagaggtttccgtacaggcgggtgcgaccaggcatgaagcggacgagtgagatttctgggctgccgtcgatggtctcgcggactgcatcgacatgggtttggtactcgttgagaacctcgacggctttgccctcgagaccgagcgcgtcggcggtgaggaggaagttttccttccaggggaatccggggcgaatactcagcacggttggtgcgatttgggagagctgatcgtaggattcgtcgacgcgcagcttgctgcccagaatcaggtcaggcttgagggcggcgatggcttcgaaattgagctcactcgtggtgcccacagtttgtacatctgccagctgattttcgaggtaagcgggctggctggaggcgtctttcgggctggcgatgccgacgggagtcacgccgaggctcaaaacctggtcgatttcaccgctgtcgagaaccacgactcgttgtggctgctgctcaagggtagtttcgccgcgtgaatgcacaacggtgcgggggaattggcctggttcggcgtcgcttcccagagcggcggtggcggaatccgctgtagaaaataggcggccgccgacagctacatcgtcgctggtgcttgtggcttcatcactggccgtggaacatcctgcgatacccaaagccaaaacggtacccacgataactgcgctgcgtgaaagcgacctgaaggtcgttcgaatagattgcattaggctatcctaacgcaagttcttaacctattgccagtctttggccataactttctacggttaaaaagttgcattgacctgcaagtttactgctcggccgtcacgggggaatggaaaaagtacgcttggtgttcatatagcgaacccattttctattgcgatgagaggaacaccaccatgcgcgcaatcactcacaacactttcggcgaccccgccgacgtcctacagattaccgagaaggaaattcccactcccggcccaggtcaggttcgtattcaagtgacgctggcaaccatccacaaccatgatttgtggaccgtgaagggctcttacggcttcgtcccagatctgccggccgccgcaggcaccgaggcagtcggcatcgtcgacgccctgggcgagggcgtcgaaggtttgcaggtcggtcagcgtgttgcgtccggcaccagctttggcatctgggcggagtacgcgcttgtcgacgcctccggcctcattcccgtaccagaacagctctccgacgaaagcgcagctcagctcgtcgcaatgcctttcagcgccatcagccttcttgatttcctggatatgaaaccaggggagtggctgatccaaaactccgcaaacggtgccgtcggccgcatgctcgcacagctggcagaatcccgcggcatccatgtcgttggtctcgtccgccgtgacgccggtgtccaagaactcgctgctcaaaacatcagcggcgtcgtttccactgagaccccaggctgggaaaagcaggtcgaagacatcaccggtggcgcaagcatcgccgtcgcacttgattccgtcggtggatcctccgcagctgacctggtgaaactgcttggcgaaggcggcaccctcgtctccttcggcgccatgggcaacccaatcatggaaatcccatccggccccgtcatcttcaagcacatcaccgtcaagggcttctggggaagcaaagtcagccgcgaaatgccagcagagaagaaaacccagttgttcggcgagctcattgcgcgcatacttgatggaacattgacccttccagttgattccacctttgatgccgctgacatcgtctcggccgtgcgcgcctccagcgagcctggccgtgccggaaaagtgctcattcgtttctaaacgtttaaggcccattagacccctgatttaaaaggatctcacatgatcattatcggagcagttttcgccatcctcgcagttctactgcatgttttcatcttctacatggaatcattcgcatggactagtgagaaagcacgtggagttttcggcaccaccgaaatcgacgccgagaacaccaaggagatggcctacaaccaaggcttctacaacttcttcctggcagtcatcgccggcgtgggtgttgcgttcctcttcgctggttcaactggcatcggcgcagccctcgcactcgctggcaccggttccatgctggcagccgctgcagtgttggctttgagctcacccgacaagcgtggtgcagccttcaagcaaggcacgttcccgctgctcgcagtggtgttccttgtgattggattgctggtttaagcagttttttaaaggaacttgccctggacttcacttttgtgaagaccggggcatttttgtttttcttctacaaaatttctccgtcaatgagccaagccaatgacctgtagttatcaagcatttctgattcttccacgctcaataaatctgcatcgtagaggcgatgcatctgttccaggttaaagggacgcatccgttcaagtagttcttgtcgttcagcccggagttccgctgttgtacaaactttgaaaatcggtgttgaattttcagacataactaattgtaacaacgctttgcaccttcaacgactgtttgaaatccaatagcaaagctccctttatgcggcttttaacgcgcaaaaagggagcttgtttaagatttctacttgttgtcttccgccaaccacacagaggtaaacggtgcgttggatgcgacagcgtccttcactgcgcgggtgactacgcgcttagcggtggtcactgcatcaacggcagagttgcccttggccagctctgcggtgatgacagctgcgaaggtacagccagcgccggagacgcgctcgtcgccgatctttggttcagagaacacgtggtagtcggtgccgtcgaaaagtacgtccacagcgttgtcgcctgggaagtcgatgccacccttaacaacgacgtactgaggtccttgctcatgaatgaggcgggctgcttccttcaggtcgtcgatggtctccagcttgtctaggccagacagggtggtggcctcgaagttgtttggagtaaccacggttgcctgtggcagcaccttcgcgcgaagggcagtgtcagtatcaagtgccgcgccgggctcctggcccttgcagatcagtaccgggtctaggacaacgtgcttgaagctgttttcctccaaagcggttgccacagtatcgatcgttgcaggagtacccaacataccgatcttcaccacatcaagatcgtgcgctgcggtggcggcctcaatctgattagcgataacctgcgcatcaaccgggacaaaacggtgattccagttgtctttaggatcaaaggccaccaagcatgtgatggcaccaatgccataaacatctaaatgctggaaggtcttcaaatcaacctggatgccggcgccgccggtagcttctgaacctgcaataacgaatgcgtaattaaccacacttcaaacctagcccctcaggtggaggattccgacattaccgtctgaaaaatttcatccgtaggctaaagagcatgtcgaaaacgatcatcgtgcgcaccgaaattgaaatccctggacacccaaccgccatccatatcgcagagatgcaggagcttcccccatctgaggctcaaggcggcgtgcagatgtgcaaaatgcagcgcattattgaactagcaggaactgccgaaggggatgtcgttactggtgcaggtgttattggcggatctaatttccagctgaataacgagccaaatgaagtggttccccatccagatacctatgcggatttccccgatatcaaggcggttgttatctccgcggagacttttgaaggcctgtggctggaagcgggagcgaagttccctgggttaaattaaccacttgcagtataccctagtggggtatattgtctgctgttagaagatacccgacagaaaggggccaataatatggctatcaagaactacaccgtcgaaggcatgacttgtggacactgcgtctcctccgtaaaggaagaggtcggagaggttgctggcgtcaccgctgtggacgtcaccctagaaaccggtgccgtgcaggttaccggcgaagacttcaccgacgaggctgtcaaggctgctgtcgttgaggctggctacaaggttgttgcataaacccctgaaaagtttaaagccgccccctcaccgtaatgctcacggtgagggggcggctttttgcgtcgagaagcatcttttaaaaaacgacgttgaccagaaacatgtaggccaaggtgccaccgacgatggacagcccggcggagcctttcaaccagtgcagcagcgcggtgaatgccaccgcgatcagtgaagcacccacaccacctggcgcactgacctggccaaagagcgtgtaaatgaccaatacgaccatcactccgactggcattgtgcgccccaaaactcccatgagttggttgctgttgacgcgtttcatcgcggcgaaggggaagatgcgcagcagcaaggtgatgatcgcgatggggatcaacacggcggcgacgttgagcagcgtgacgccttctggcaggccaaactcactcatgggaagtcctgatctccagtttcttgtccaggttggggaagcggacgcggagaagaaggatcaaaaagtacgtggtcaaagcgataaccagcatctgctcgggcgccacaaaaccggaaaccagagccaataccaccgcgaataatggcagcgaataatccttgttatttttgaatgcctcccacgccagcaccacaaacagcgcggtcagggcaaaatccatgccttttagatcatcgggcagcacttgaccaaccaaggcgccaataattcctgggataacccacagagcttggcacaaaatttgaacggtaagcacccgcgtgccactgatatcgccaggtgggcgggctgacacgatggcgtaggactcgtcggtaagcgcgtaggtggaataggcgcggccggcgccggacttgatgcggtggcgtgggaaggtgagaccgtagaaaatgtggcggaaattcaccatgaaaccagcgaccgccgccgaaaacgggccgatacctgcggtgaccatgccgattgccagaaattccatcgaaccggcatagatcacgaaggagaaaatcggcgtccaccaccaggcgaaacctgtctggaccatcaacagcccaaaggccaaacccagcggaatcagccccaaaccgaccgttaaagtctcaccgattccgccgcgaatttcttttaaattttcggaactcatctaattatctgaagggtccgacggaaacgtggaatacaacggcaaaggcattgcttgtcgacgcatcacgtcgccccaaatatcgacgcggcccggcgcgataatgtccgacggcaacgcaggtgtgacgaaccaatcaccctgctcaatttcctcgttgagctggcccggagcccactccgcgtagcccgcaaaaaagcgcatgccctcaagatcatcagccacatcttcaggtgcagaacgcagatccacgtgcaccaggcggttggcgagcttgttgaagctggtggaattttcaatatccacgcccggcttggtcacgcccaaaccaaccacagcctgctggctcaacggcccaccgatgtacagtgcctgtggcttcgaggtgaggtccacccactcgggcaacacattggccacagcaacatcggaacgtgaagaaatgttcacaccaaaagtggtggcaggagaatgctcgatgatcaacacgatgctgcgctcaaaatcctccgacgccatatcgggcgcagccaccaacaacatgcctggagctacctcattgcgctccatcgcgttaaacaacctgtcggcataaaaatcactcattgttttctccttcccaccagctcttcagctctgcgatggcaacttcacgatccaaaggaccgcgctccaaacgaagctccttcaaaaacgcccacgccttacccacttcaggtccggcttggatgttcagaatctccatgatctcattgccatccaaatctgggcgcaccctggcaagatcttcctttgcggcgatctccgcgatgcgctcttccaaatgatcgtaggtggcttgcagtcgtgctgccttccttttatttcttgtggtgcaatcagcacgcactaacttgtgcaaacgtggcagcaattcacccgcatctgcggcatacctacgcactgcagaatccgtccactggccttcgctgaaaccatggaaacgcatgtgcaggaacaccaactgcccgacatcgccgaccatttgctttgagtacttcagcttgcgcatccgtcgcctcaccagcttggcgccaactacctcatgctgatggaagctcacgcggccttcctcattgaagtcacgagtatctggcttaccgcaatcatgaagcagagcagcccaacgaagcaccaggtcagggccatcttcttcctgatcaatcgcttggcgcatcacctgcaacgagtgcgcgtacacatccttgtgctgcatgtgttcatcttgagtcatctgcatcgcagggatctccggataaataatctgcgcgataccggactccaccatgaggtcaatgccagcctcagggtttttgccaaggatcattttgtccaactcaacctgcatgcgttccacagtgatccgagtaatctgctgcgccatttcagtcatggcggtaataactcgtggtgcaagggtgaaattcagttgggaaacaaagcgggcagcgcgcagcattcgcagaggatcatcattgaatgattgttccggagtagctggggtatccaaagtgtgggtaagtagatcttccaagccacccactggatcgtggaaagttaattcaccatcggcttggatctccacagccatggcgttgaccttgaaatcgcgcctaatcagatcgccttccaaggtgtcaccgaaggtcacttcagggttgcgggagtttccgtcatagagatcagaacggaatgtcgtgatttcgatctgctgaccatgcttttctgcagaaagggtgccaaacgcaattccggtatcccacaccacatcggcgtaatcatccaggatcgcctttgtctcctcagggcgtgccgacgtggtgaaatcaaggtcatgccccaactcacctaagaaagcatccctcacggaaccgcccaccaaatatagggagtgtcccttgctggaaaatgctgccgctaggggcacaaggatgtctgaaagctcaccaattgcctggtgagcgcgcgccattaaagcaaggcggtctacttcctggtccactttctgtgggggaacttggttctgagcatcctgggaattcacgaatctgagtctacccagtagaagtgtgggcaaaaactgctctaaatgtgaaattagaataagttttcgcactttgcaccgtaggagcccgtttaaggccccgcagccaaagaacgggtaaaagggtgcatcagtacaggttagctcgttagaaagccacacagcgagtcgagttttgagggccatttttagcaattgcaaggatccaccacaaatcagtaaatcgaacgtatttgtggtgtattttcgcgcgttgagggctcaaaaatgcaaggatccaccacagaatcgcaaaaattcgggatttgtggtggggatttgcatctgagcagccgacacggcgccgaacccctcactacgcgagtcaattaacccccgggcggttcattaataccgaatacccacctctcacgatacgattggttgaatgagtgacttgaaacccgaggggactactagcggagcgcctaaacgcaggcgccgccgccgttctcgccgtccttcaggtcagaaccaaaacccaaaccaaaacaggcagggacaacaggggcagcaaacccaaaatcagccccaagcccagccacaaagccaacaggcccaaccccaaaagcagaaccagcagggccaaaatcagggccaagcttctgagaaaacctctcagaggccaaagcgccgtcggtcccgcaggaacccgaagagcaacaacacccaacaacacagccaaaacagtcaaaacaaccagaacagccaaaactcccagcaaaacacccaaacccaaacctctcagtcgaataagcagaagtctcaggacaaccgcaggggtaagggtcgtaggtctccaaccaggaggcgttccaacacgagggtgaatcaggcgtggcagcagtcccgtttggttacttctgatgagacttccgcaggtggtctcgtggtgtcaggtttggctgaggcggtcaacgctaacaatgaggttgatctgtcgaagatttatgttgcgttgattggtcgccttgatcgtcgtggtcgtttgttgtggtcgatgccgaagggccatgttgagcctggtgaggataaggctgcgactgctgagcgtgaggtgtgggaggagaccggcatccacggtgaggtgttcactgagttgggtgtgattgattattggttcgtttcggaagggaagcggatccataagacggtgcatcatcatttgttgcgttatgttgatggcgatttgaatgatgaggatccagaagtcactgaggtggcgtggattccggcgaatcagttgattgagcatttggcttttgcggatgagcggaagttggctaggcaggcgcatgatttgttgcctgagtttgctttgaaggaaaaggcggagggaaggtccaccccaaggtgattccgaaccccaacccgaaccccaaagccaaaactcttcgcctcgtttcagcgctgaccgccatcactgtggtgggttttagcgcttcacctgttcatgcgttgccgattccgttggatccttctgatccggcggtgtcggagttgtgggtgaatccgaatgcgcgggctgatgatgagctttctggtgtggatgtagagatctcggattttgtcatgccgaatagcaatctaactgtgcaggtgggggagtcttttaaggcgcaggttcgggtgactaatcgttcgtcggagacgttgagcaatattacgttgcaggcgcgtcgtgcggaggcgtcgtttgatatggcgagtgctcgggtggcggcgacggataataattatggctacttcggcgcgatggtgactcttgatgatgagttggagccgggggagagtgttgagactgaggtggagatttctaccgatagtttgtcgatttctcagccgggttcttatccgacgatgttggcgttgtcggggcagcttgatggggtggcgcagcatttggattcgcagcgtttccttctgccagtcctcagcgatacaactgatacagaagacaccgccacccccacgacgatgatttacccgatatcagcccagacgaatgtgttgggtggtgagaccggcgaggcgccggaagagccgcctttgctggtcagttccgacgcgcttgcgggcgagttggatgagggcggtcgtttgcaaaagcttatcgacgcctacctccagtcttcacccgccgtgcagcaagccacgtgccttgctattgatccgcagcttcttgatgtggtggatcgcatgaccggcggttacaccgtgaccgatactcgtcccagtacggtgcggcagaatcagcggcttcgtgagttgtggactgccgataatcaacccaccaatggtgtcgcgggcacgggtgcggaaaacgctgccattttcttggagaaactccgacaggccacagccacctcgtgcaccgtggcgttgccgtgggcgaatgctgatctaaatgcagtgagccaaaccggtaatcagtggttgatgcgcgaggcgctacagcgaggtgtcaccacctttgaagaagtgttgggtgttattccggaatccaatgtggtgattcctggaaatggttttgtggagccctccaccgtgggtgatctcggatgggcggaagtaacgcttaatccggatcaggcgtgggaggtgcagtcagaggagttggttgctgcccctgatgccacagagcaaagcgcattggataaccctaagccaacgccaggcacggtgacgccgccaacccctatgtcaacggtgtccgtgttggtttctgataacacggtgtggcgcacaacgagcgcggatcggttccactctttggctccgggaataactggggtgtcgtatcagggatcgttatcggcaaccttggctaccttgggacaaaaccctgagactgtgggctattccaatccggattcgcgttatgactacgccatggattctgagagcgcccgcaatctcaccggccaggcggcgctgcgcttgacggtggacaacggcgatgaagactctcccgtgttgatcatgccgagcgcggtgctgggcgccgaagacggcgcgatgttgcttgagaccaccggggctttgcttgccgacggctccgcccgacctttttccctgcagcaatatgtcactgccaatgcggaacaaagaaatactttggccacagcaacaactccaccggatgacactgcttttggtgcaccctacgacgatcctgcgtcattgacggaaaccgaaattctgcgaaccactcagcaggcggagtacatcgatgatctcactggcatcatgtccaatgatcccagcattgcactgacccgttatgggtttacagcaccgctgcggcaagatctgctgcgcgcgttgagtatcagtgagcgtcgttcgttagctcgccacacccaggcaacctctgctgccgataaattacttaatcgcaaccgcgatactctgcagaagctgcgtagctctgtggcgttgttgccgccgggaaatgtgtatacccgaacctcggaatcgtctccgttgttgattgtggcgcaaaacggtttgccattgcccgcggagactcagattttgtattccggaaatcaggatgcgcacatcaatactccgggtgtggttcgtattccggcgcagggttccatcaccttgcagatgactgcggatttgcccgatgacaatctgcgcactgatctcacgttgtggttggcatccccagatggggccaccattagtgaacctgtggaaattactgtccagcctcgcccgaatttgggcaccacgctgtttttcgtggcagcgggcattctggcagtaggagggttgttgtttatacggaagaaacgaaacgtcgaaaagcgctcgcccggtacgggatcgcccaaaccgccaccaacccactaacgtatcgcatagttattttcgccgtgctcgccgttaaggcgcgcactcgtacatgaatggtcaacaagtgagttcttcgctttcgaataattcggagcagtccggcctgcgtggcaggatcgttgctccagcaccgccggcgcctgtgcccgaggcgcgcaagaaggctgtcgcacgcacggatggtgatcgctcgagtttgaaaaactcgcctacggcatccgccacccaggcagcccagacgcgcccggcagaaccggaaccagaaaagcacacctccgattctgatgtggtgcgctcgactggctccatggcaatagccacgctgctgagtcgtatcaccggtttcctgcgcaccgtgatgattggtgcggcgctgtcgccggccatcgcttcggcgttcaacactgccaacacgctgcccaacctgatcactgaaatcgtgttgggtgcggtgctgacatcgctggttattccggtccttacccgcgcggaaaaagaagacgccgacggcggttccgggttcttcaggcggctgctcaccctgtcggtgacgctgctgggtggtgtcaccatcctgtcgattatcggcgcgccgctgctgacacggatgatgctgtcctctgagggacaagtcaacgtggtcatgtccacggcctttgcgtattggctgctgccacagattttcttctacggcctgtttgccctgttcatggctgtgttgaacacccgtgaagtgttcaaacccggcgcgtgggcacctgttgtcaacaatgtgatcaccttgaccgtgctgggcgtgtacatggtgctgcctgcgcgtttgcacccgcatgagcaggtgggcatttttgatccgcagatcattttcctcggcgtgggcaccacccttggtgtggttgcacagtgtctaatcatgattccgtacctgcgtcgcgcgggcattgatatgcgccctctgtggggtatcgatgcgcgtttgaagcaattcggtggcatggcgatggcgatcatcgtgtacgtggcaatctcccagttcggttacatcatcaccactcgcattgcgtcgattgcagacgatgctgcgccgtttatttatcagcagcactggatgttgctgcaagttccttatggcatcatcggcgtcaccttgctcaccgcgattatgccgcgactgtcccgcaacgcggcagacggcgatgatagggcagtagtctctgaccttcagttgggttccaagctaaccttcatcgcactgatccccatcgtggtgttcttcaccgccttcggtgtccctattgccaatggcctttttgcctacggccaattcgatgccaacgccgccaacatccttggttggactctgagcttctctgctttcacgctgattccttacgctttggtgctgctacatctgcgtgtgttttatgcgcgtgaagaggtctggaccccaaccttcatcatcgccggcatcaccgccaccaaggtcgtgctttccctgttggcaccgctgctgtcgagctccccggagcgtgtggtggtgcttcttggtgcggccaacggtttcagtttcatcaccggcgcggtcatcggcgcgtatctgttgcgcaacaaactcggcctgttgggtatgcgctctttggctaaaacctccctgtgggcgttgggctctgcggcggttggtgcagcagcagcatgggcgttggggtggctgattcaagccgtcgtgggcgatttcttgctgggcactctaagctccgtaggctacttgttgtacctggctgtgttgggtgtcttcttcatcttcgtcaccggcatcgtgttgtcacgttctggtttgccggaggtccaaaacttgggccaggcactgacccgcatcccaggtttgagccggtttattcgcccgaataccaagatctctttggatgtcggcgaagtctccgagcaggatttctccacccagctggtcgcgccaagcgagttcgcagcaacccctgtgccgccaccgatgtccgccggtattgtccgcggacctcgcctggttcccggcgccccagtcggcgacggtcgtttccgtctgctcgccgatcacggcggcgtccaaggcgcgcgtttctggcaggcccgcgagatcgccaccggcaaggaagtcgcgctgatctttgtggatacttccggcaacgccccatttgcgccactgtcttcggcagccgcagcgggcatcgcctacgaggtgcagcgccgcaccaagaagctggccagcttgggcagcttggcggtagcccccaacatccactccgaggcgtaccgcaacggttgcctcattgtggccgattgggtgcctggctccagcttgagcgccgtcgcggaatccggtgccgatccccgcgccgccgcgttcgcgctcgcggaactaactgaaaccatcggcgaggcccacgagatgggtatcccggccggcttggacaacaagtgccgcatccgcatcaacaccgacggccatgccgtcctcgccttcccggcgattttgcccgatgcctcagagctccgcgacgccaagtccctggcctcggccgccgagatgcttatcgacgcgaccctcgctcccagcgacgtcaaggcaatggtcactgaagcccaggggctagctacagaagacaatcccgattacgcatcacttgccatggcgatgcgcacctgcggactgttcaccgaggaaccaacccaccttgtggtgaagaaggaaaagacaccaaagcctgcgacacgtgatggtttcggtgcctccgactacaccgtcaagggcatggcagccatcgccgctgtggtgatcatcttggtttccctggtggccgccggtaccgcgttcctcaccagcttcttcggcagcagcaccaacgaacaatccccgttggcctctgttgaagccaccacctctgcaacaccagaacctgtggggccaccggtctacctggatctggatcaagcccgcacgtgggatgacggtgcaggaacagatgtcaccgacgtcaccgacggcaacacctccaccgcatggacctccaccggcggcgacggcctcctagttgacctgtccacgcctgcccgcctcgaccgcgtcatcttgaccaccggcaccggctccgacagcaacgtgacctcgaccgtgaagatctacgcattcaacgacgcctcaccacactccctgtcggaaggcatcgagatcggcaccgtggattattccggccgcagtctcagccacagcatccgcgattcctccaagcttccgggtcaggtggaatccgtggtgattctggtcgatgaggttcgttcctcacaaacctcagacaccaatccacagatgcagatcgctgaagtacaacttgttggttggtaaattacgcgtttgtgattgacccccattaaggtgcgcccgccctcagtttcactaactgaaggcgggcgtttttaatttatatatagcttcagctcacaggtattttccagaaagaagagccctcaaagtatgtagcacctcagcgacacctcccacttgagtgggcgccgagaagtatctctcaatggaaaatctgcccatactaagccgcataagggatacggggtgtgtccctcaacctgcgggggatcttatgacagtactgcctaaaaaccatgacctaagcgatacccaactcgtcaaacagtttatatctggcgactccagggcattttccaccatcattcaccgccacgaacgacatatgatgcaggcagccagaaaatacgggcggaaaccagaagacgcccaagacattctccaagaagctctctttcgcgccagccgaaacatgcacctttatagagcagaagcagctctcggcacgtggctccacaaacttgtcctgaatagcggcttcgattgggctacccaccgctcccaagtagaattccccatccttaacgaaccaacaatcgatttagaaaaagatcctcgcctagccaccgaccccttgggctacctcgatgtcgccatgacaattcgatccgccatcgaccaattacaccccgatcaacgcatcgccttaatacttgtcgacctcggcggctacaccgtagaagatgtggccgaaatcgaaggaatcaaagtaggtaccgttaaatcacgccgagggcgcgcacgcaaagcgttgcgcgcccttttacatgcagatttcttcgggcccgaagatggctccatacagtgcgaaagcaactgatggaagtttttcaaagtgtctgacgttgaaaacggtgagttcacaactagggtgaatggtgcacgtgatgctgcacttttacgtttactactttgagggaaacaatgtctgaagaacaatctgccgtagcaccaaagattcatgatgtcgccatcatcggctccggtccagctggctataccgcagcagtatatgcagcccgcgctgacctcaaccccatcatgttcgagggctatgaatacggtggatctttgatgaccactactgacgtggaaaacttcccaggctttgaaaagggaatcctgggcccagagctcatggaaaacatgcgcgctcaggccgagcgtttcggcaccgacatgcacatggagcttgtcgaccgcgttgatctcaccggcgacatcaagaagctgtgggtcggcgacgatgagtaccacgcgcgtgctgtcatcttgtccatgggttctgcacctcgctacttgggtgtgaagggcgagcaggaactgctcggccgcggcgtttctgcatgtgcaacctgcgatggtttcttcttccgcgatcaggacatcgccgtgatcggtggtggcgactccgcgatggaggaagcaaccttcctcaccaagttcgctcgcagtgtcaccatcgtgcaccgccgcgaagagttccgcgccagcgccatcatgctggagcgtgctcagaagaacgagaagattcgcttcgtcaccaacaagactgtcgaagaggtcatcgaggcagacggcaaggtcagcggtctgaagctcaacgacaccgtcactggtgaagattccgtcttggatgtcaccgccatgttcgttgccatcggccatgatccacgctctgaaatcctcgcaggtcaggtcgaggttgatccttccaactacgttttggttcaggagccttccacccgcaccaaccttgatggtgttttcgctgctggcgacctggtggacagccactaccagcaggccatcaccgcagctggttccggttgccgcgcagcgatcgatgcagagcattacctagcttctctggcctaattcacagttagccttaaaccaaaccatgtaccaatgaatgtcggattccccaggagtcccgtcattgttaatttaggagaaaccatgagcaatgttgttgcagtaaccgagcagaccttcaagtccaccgtcatcgattccgacaagccagtcatcgttgacttctgggcagaatggtgtggcccctgcaagaagctcagccccatcattgaggaaatcgcaggcgagtacggcgacaaggcagtcgttgccagcgtcgacgtcgatgcagagcgtaccttgggtgccatgttccagattatgtcgattccttctgttctcattttcaaaaatggtgcaaaagtcgaggaatttgtcggtctgcgccccaagaacgaaattgtggaaaaactagagaagcacctctagctggtattcttactgcagtcacgtggatgaactatatccattgataattttgaacatgaatgatggaaggagcagggtgtctaaagtcctgagagttggcgatcgcagcccgcgcgtggcagaagtgcgcactacgctcgctcgcctcggtgtgattgaaggctattccagggagatgtctgcaaagacagaatcccagaagttccacgaagaagagacgcttttcgacgaagaactcagcctcagcatcaagtcattccagcaagctcgaggagtcgttccctccgggcttattgacgaccccaccctgcgcgcaatccgcgaagcctcctacaccctgggaacccgcgtgctggcctaccagcccggcaaccagcttgttggtgacgacgttgtagaaatccaatcccatctccaagagctcggcttctacgccgaccgtgtggatggacattttggcgagctcacacacaaagctgtgatgaactaccaactcaactacggcatgcaggtagacggcatctgtggccctgacaccatccgtgcgctgtcccgacttggtctgcgcatcaagggtggctctgctcaagctatccgtgaacgcgaacgcatgcgcaatgcaggcccacgtcttgctggcaagcgtgtggtcattgatcctgcgcttgggggctccaacaagggtcagatcgtgaaaggcccctacggtgagatctctgaggaagaaatcctctgggatttggccacccgcctggaaggtcgcatgatcgcaacaggcatggaaaccattctgtcgcgcccgcacatggatgatcccagcagccgtgatcgcgcgtcgatcgcgaatgctttcggcgctgacctcatgctgagcctgcactgcgattcctacccgaatgaaaaagctaacggcgtggccagcttctacttcggttcggaaaacggcaccaactccttgaccggtgaaacgctctccgcgtacatccaaaaagagatcgttgcccgcaccccactgaacaactgtggcagccatgcccgtacctgggatctgctgcgcctcacgcgcatgcccatggtggaagttgtcaccggttacctcaccaaccccgatgacctggcagttctgactgatccacaaatgcgtgatcacattgccgaagccatcgttgtcgccgtcaagcgcctgtacctccttgatgaggaagcacagcccaagaccggaaccttcaagttctctgagctgttgcaatcagagcaggctggctaaatcgcgcccatctcttgaaggagtcgctgggcatccttagctgtgagcagcaccgttgcgggtggtaattccatccgcagacggggtaacacgggatggtcagcaaccacttcgaaaccggctgattctaacgcctccacatcaatcaggccgatttctaaacgcctagctgcgatcgcatccgcttctgtgttttccgagcggtatccaaacgcctcaacggctgggtagtcgcgccgaatgagttccatgagggaagcgtcgagaagcgccgattccatgcccgtgccccggaaaacctcgtcgatgaacaggctgctgatgatcgcagcgtcgctagacaccggtgccgtaggcagcgccttcgcgcccggggcggcatcgcgctcgcagaaaatgaccgacgccaacgccggagttccattgcggtaaccaatgttgaaaccgcaggattcatattccagcagcgtggtggacagccaggcttccttctcaaacaccggatcagctttagctgcaacctcaggtgcgagctcccaaaacaccgacttgcgggcctgggggtgcaggaaatctatgtgttcctgcacgatcgggaaaagggaagcctggagcatggcgccaaacttaaaattattggccctggatcaaggacatgatgcgctcgaaatcatccttgtcgccgaattccaccacgagcttgcccttcttcttacccatcatcaccgagaccttggtatccaaattatccgccaaggactcagccgcacgggtaaagacctcaggagttgcagccttttcgcgtggcttcttctcctcatcctgatcaccacggttgtgcagcagcaccaattcctcagtagcacgcacagacaggccctcagcgatgattcgggtcgccagggtgtcctgagcatcctcgccggccttgagccccagcaatgcgcgtgcatggcctgcagacagcacaccggctgccaccttggtctgcacgttgactggaaggcccagcagacgaatcatattggtgattaccggacgggaacggcccagcttatcggccagctctgcctgggtgacaccgaactcctccagcaactgctggtaggcggctgcctcttccaaaggattcagctgcaccctgtggatattttccaaaagggcgtcgcgcagcatcgcgctgtcttcagtttcacggacaatcgccgggataacctcaaggccagctcgcttggatgcacgccaacgacgctcacccatgatgagctcatagccatcctcggacctgcgcaccacgatcggctgcatgaggccgaactcgctgatcgaatgcaccaactcgtcaagtgcctgcggatcaaactcatggcgaggctgctgcgggttggggcggatctgctcgatcgggatctcaaggtaggatgcgccgaactcagactgctgtgctggctgtgcctgcggcgcttcctgctgtgctgactgcgttggagcaggagctgctggctctggaactacctctggctttgtggcctcagtgtgttgtggagcggcctgcgcaggagcctcaggtgcaggagctgctggtgtggactcacgcttgggagctgcagcagtacgcgcacccacggtaccgcccaaaatgatgtcagccgcaccgccaccaagacctggggaattacttggtcctgagggaataagtgcggccagaccgcgccccagaccgcccttacgcttttccgtctgggacttgtcggaacccttgttctgagccatcgctcttagacgcacctttcgtacagcacaacaattaacgtattcaaagaagtttactgctatttcgcaggttttaggccgatcggaccggattcatcgctaggcaagtaatcgccacgagtggccaattctttagcagcatccaaatacgccatggcgcccctggaacctggatcatattcaatgacagtctgcccatagccaggagcttcagacaccttcactgaacgtggaatcttgttacccaacaccacgtcaccgaagtgatcattaacctctgtggccacctgttctgcgaggttggtgcgggcgtcatacatggtcagcaagatcgcggaaatatgcagctggcggttcaggtgctgacgcaacatagtgatgttgttcagtagctggcccacgccctccagagcgtagtactcacactggatcggaatgagcacttcattcaccgcggtcatggcgttaatggtgagcagacccaaagacggtgggcagtcaatgatcatgtaatcaaaatcgtgcttgtcaatgaactcacggcccaacgcatccgccaaacggtattcgcggcggaccaagctgaccaattcaatttctgcgccagcaagatccagggttgctggaatgcagaagaggttttcgttagctgtggatggctgcattgcttcatcagcagtgcattcaccgatcagtagttcataagatgacaaggtgccagagcggtgctcgacacccaacgctgtcgacgcatttccctgcggatccaaatccacgacgagaactttaagcccatgaattgctaaagacgcagccaaattcaccgtggaggtggttttaccaacgccgcctttttggttggcgatggtaattaggcgtggttctttaggtttcggcaacgtcagggagttgggtgtcatcacctgagctgcacgacgcgccgccgcagcaattggtgtgtcttcccaagtagtgtcttccatcgacgtcaaccatccctatcttcctgtgcatgcgaattcttcatgcacacgtcatcgattccacattagtgcttaacgctgtacccattccaccgaagtggatggttacttttccctgcggattgaaataagtgttgtgggctcgctcaacagcgcctcacccacggtataaaccttaatgtcagtgccgccagccttgcggatttccttggcgtcacgctcaatttcttcctcaacgctggagcctttcatggccaccatgcgtccaccgattttcaccagcggcaacgaccaggtcgctagcttgcccagtggagcaacagctcgggaggtgacaatatcgaccaatccgacctgcttgcgcaccactttttcctcagcacgaccacgaacgacggtgacattgtccaagttcagggcttcttttacctcgttgaggtacaccgaacgcttgagcaatggctcaatgagagtgatgttgagatctgggcgtgcgatagcaagaggaattcctggcagtcccgcaccagaaccaatatctgcaacagagatgccctcatccatagcttcgccgatgacaccacagtttagaatgtggcgatcccacaggcggggaacttcacgggggccgatgaatccgcggacggatccatctgttgccaaagattcatgatatgcaatggctttttcgaggttgtccccgaaaatttcagcggctgctggaggcgtggtcatgaaaaaagtccccttcgggcaagatatcgagcggtacaacactcaactataacgactcaacttaagaagcttgagtgttggctgccgaatggtgctttttagcgtcgacaagcgcttaaaatggcgcgctgcaggcagcaaaaaaccgccagcccttagtgcgtgggctggcggtttttagtgaagttttacttcttacgcttcttggggttttctggcttcacgccaggctttggagcggtagtgcgctttgctgcgcgcttttcctcctcctcagctgcttcctcagcgtccatcttggcgaagatgtagcgctgctggaagaaggtccacacgttgttggacatcatgtagacaagaagaccgatggtccagatgaagccggtgaacaaaatggtggctggcatgaaccagagcatcatcttgttcatcatttgcatctgcatggccatctgatcgctggaagcggcctgctgcttgccggctgccttgcgagcttcctggcggttgacggacagacgcgcgttcatgtgagttgccacgacaatgatcaaaatcattggagctgcaaccagcgcgatgttgaggcgggagacatccaggccaaggaacgcgtcgaacgcgtcagcaggcatggtgatgtaggacgacagtggcgcaccgaacaggtctgcacgcaggaaggactgaacctcgtcgacaccgaagatgtagttcggggtgttcgcgttttgctcaacggtcatttccagctggccaacgccagaaccggtgcggttgaaggagcgcagcacgtggaacagacccaggaacactgggatctgcaccaacattggcaaacagcctgcgatggggttaacgcccacttctttttgaagtttgcgggtctcctccatcatcttctgctggtcatttttgtacttctcgcggatggcctgcatctttggagccatgtcttgcatcttgcgctgtgaacgcatggtgttgaccatcggcttgaccagaaccatacgcacggtgaaggtcaagaacatgatcgacaaggcccaggtaattccggaatctgggctcagcacaaagctgaacgctttatgccagaaccacagaatggccgaaattggccaataaatgaaattgagcactgtgagtcgaaactccttgggattaatagggactatgtacttgttggcaggacttctatgtcaccgtttcggtggaccaaaatccatggttcggcaccgggtcgaatccacccggatgccagggcccacatttggacaaccttgcagcggagagaatagttcccttaaaagccccatgaactgagacggctttcaatgcataggtgctgcaaactggatcaaaacgacaggtggaacccatcttaagacccgaaagatacttttggtagaagcgaacagcagaagctgccgtcttcgccggaatacttttcggttctgggatgtcgaaaggatcatcacttgttggtgcgcacacggctagctttccccaacccgtagcggatgtctcgttcaagttccgccgaggttgcattcccagcccccgccaacgcgcggatcaccacgtgatgagtgggggagagtagctctggtgatttttctgcaatgcttgcacagatatgacgaagccgtcgggaggtgcggtgacgaaccaccgcatttccgacggccttagaaacgacaaggccgaaccgcggaccaccgaatgaggcgacttcgccctgtttttcggtgccatccaacgattcggcactatcccacaggtgcacaacgacagttttactgccagcgcgacgccctttcctcatcaccgtgcgaaattgcatggaagagttcagcttatgttgcgctggaagcactgttgcttacaccttatttattgtggtgacgctaaaaaattacgcggtcagctttgcgcgacccttgcgacgacgagccgcaacaattgcacgacctgcacgggtacgcatacgaagacggaaaccgtgaacacgtgcacgacgacggttgttcggctggaacgtccgcttgccctttgccatgtgaaacactcctaaatattttgttgacggatcaccggacacaccggttctagtggacaaagtgcgcgaagatttccgcgctagccctataccgggggaacggatcacccaacgttggatgattttttttgagattgcagattcgtgaatgaaaccgcagcaacgctttatggaaagtgttgctctcaagcacattcgttgcgcctggaaatttgaccaagaggtttggacaaagatccgggagtcacacgatgtgacagactggtttagcttacgggaaaacgacctgcgaaaacaaatctgtcctttggcaattcggcgggggcacccgtaattacaaagctggcattaaacactggtgagagggcatatcgcccgtccaaacgcttttcgacgccaccctccggcaaactccactcggcaaagaattcacaggggttggacatgtggattgaactgcgggtaacaatgaaaattgcacacagcatcaacagcctgtgaaaacttcaacctgtggataacaggtaatgttcaccttgagatcaagggaaacattcaaataactgcaggtgagagcgaatttgaggttgatgcacattttccacaggtagtgcgctatcctgtggataaacgtttttgggaaaagttatccacagctgtggacaacattgtggaaacaatggttatgggcgtttttcgatgtgaatggagctgtagaaacatcgagaacgcccacgtggataacaaagcggaattttgccctgctttttagcttctccgccacccttcatccacggctgaataaaattatttttcgatagtttcgccaaaaggagatacctaacata

SEQ ID NO: 2 - DNA, 1572 bp, Corynebacterium glutamicum
gtgagccagaactcatcttctttgctcgaaacctggcgccaagttgttgccgatctcacaactttgagccagcaagcggacagtggattcgacccattgacgccaactcaacgtgcatatttgaacctgacgaagccgattgccatcgtcgatggctacgccgtgctgtccacacccaacgcgatggcaaaaaatgtcattgaaaacgatttgggcgatgctttgacccgtgtgttgtcgctgcgcatgggccgatcattcagcttggctgtcagtgtggagcctgagcaggaaattccagaaaccccagctcagcaggagtttaaatatcagcctgacgcacctgtgatctcttccaacaaggcgccaaagcagtatgaagttggtggtcggggagaggcgtcgacaagcgacggctgggaacgtacccactctgcaccggctcccgagccgcacccggcacctatcgccgatcctgagccagagctggccaccccgcagcgcattccgcgcgaaaccccagctcacaaccctaatcgggaagtgtccctcaacccgaaatacacttttgaaagcttcgtgatcgggccgttcaaccgtttcgccaatgcagccgcagttgctgtggcggaaagcccagcgaaagctttcaacccgctgtttatttccggcggttccggcttgggcaaaactcacctgctgcacgcagtaggaaattatgctcaagaattgcagcctggcctgcggattaagtacgtctcaagtgaggaattcaccaacgactacatcaactccgtgcgagatgaccgccaggaaaccttcaagcgccgctaccgcaacctggatatcctcatggtcgatgacatccagttcctggctggcaaagaaggcacccaggaagagttcttccataccttcaacgcattgcaccaggcagataagcaaattattttatcctcggaccgcccacccaagcagctgaccacgctggaagatcgcctgcgcacccgcttcgaaggtggcctgattactgatattcagccacctgacctggaaactcgcatcgcgattttgatgaagaaggcccaaaccgatggcacgcacgtggatagggaagtcctcgagctcattgccagccgctttgaatcttcgatccgtgaattggaaggcgcactgattcgtgtgtctgcctattcttcgttgattaatcagccgatcgataaagaaatggccatcgtggcgctgcgcgatatcctcccagaacctgaggatatggaaatcaccgcaccggtgatcatggaggtcactgcggaatattttgaaatttccgtggatacactccgtggagcaggcaaaactcgtgcggtcgcgcatgcacgccaactggcgatgtacctgtgccgcgagctcaccgatatgtcattgcccaagatcggtgatgtgttcggcggaaaagaccacacaactgtcatgtacgcggatcggaagattcgccaagaaatgacagaaaagcgcgatacctacgatgaaatccagcaacttacccagctgattaagtcgcgcggacgtaac

SEQ ID NO: 3 - DNA, 324 bp, Corynebacterium glutamicum
ttgattgtggataactttgtctatctgtggatagatttcaaggtacggattttatccccagtctgtgcagatgtatccccagcttatccccaatttttggggagttgtgcacagggcggaaagttccgcggaatcacatttcctgtgacaaagctcactgaattacaagtttgtaattacactgctgtgaataaggttgtggataactttgtgagctgggcttttatcggaagttatccacaaaatccctgcacaacccctaaattacaaaaagacccatccgaagatgggtcttcaagagcagcagagctaaattttgtaatt

SEQ ID NO: 4 - DNA, 1182 bp, Corynebacterium glutamicum
atggagtcacaaaacgtgtccttccgtgtggccagggaagacctggttaccgcggtagcctgggtcgctcgcaacctgcccaccaaaccgactcagccggtacttcgagccatgctgatcactgccgatgatgagggtcttgaactcgccggttacgactacgacgtatccacccgagttcgcctctcagctgaggtttctcagccaggtcgcatcgcagtagccggcaagctgctgtctgaaatcacaggatctttgcccaacaagcccgttgatttccgcatcgacggatccaaagcttttgtcacttgtggttcttcccgcttcgagctgccactgatcccgcttgatgattacccaatgctgcccaagcttcctgcaggtaccggttccatcaacgccaagctgttcaccgaagcagtctcccaggtggcatccgctgcaggtaaagatgattctttgccgatgctcaccggtgtcagcatggaaatcgtgggcaaccagatcaacttggctgctactgaccgtttccgcctggcgctgcgcaccttcgaatgggaagcaaacgacccagagctcaacgttaaactgctgattcctgcccgcaccctgctggacaacgcgcgttctttggattccggtctcaacgattccatcgacatcgctgtcggtaccggcgatcaggttggccgcgaaggactattcggcgttcacaccgataaccgcgaaaccaccaccaggcttctcgacgccgatttccccaacatcgcaccactgcttcccaaagagcacaccgcgatcgcatcagttgaaatcgcaccgctggtcgacgccatccgccgcgtatccctggtggcagaacgcaacgctcagatcgtcttgcacttcagcgaaggccaggtcatcttgactgcaggcgcaaccgaggcaggccacgcggaagaaaccctgccgtgtgcattcaccggcaaggaactgaccatcgcgttcaaccctggctacctgaaggatggactttctgtagttccaacttctcgagcagtcttcggattcactgagccttcccgcccagcgatcatgatcccagagcctgaagaaatgccttccgccaacgaaaatggcattttccaaactccggacacctatttcacctacctgctcatgccagtgcgcctgccaggc

SEQ ID NO: 5 - DNA, 1182 bp, Corynebacterium glutamicum
atgcacatccgttctttggaattacgtgattaccgttcctggcctgaactcaaagtggatttggaacctggaattacagtttttatcggccgcaacggttttggtaaaaccaacatcgtcgaggccatcggctatcttgcgcatttgtcatcgcatcgggtgtcctctgatgcgccattggtgcgggcgcacgctgaaaacgcccgagtttcggcggttgctgttaatcaaggccgagaattggcagctcacttgctgatcaaaccccatgctgcgaatcaggcaagtttgaatcgcacaaaagtcaggactccccgggagctgcttggtgtggtgaaaacggtgctgtttgcgccggaagatttggcattagtcaaaggcgagccagcagaacgtcgccgctatttagatgacattattgccactcgccagcctcggatggcgggggtcaaggccgactacgacaaggtgctgaaacaaaggaacgccctgctcaagaccgccaccattgcgcttcgtcgaggttacggcaccgaggaaggcgcagctgcgctgagtactttggatacctgggatggccagttggcacgcctgggtgctgaagtgatggcagccagatttgccctgctcaatgagttggggccgaaaatctatgaggcttacaccacgatcgccccggaatcccggccagctgcggtgaattacaaaaccaccatcgatcaaggcctgtcgcagttttccgaattcgatgccggcatcatcgaagccacgctgctgacagaattggcagcgaaacgtcaacgagaaatcgaacgcggctcaagcctggtcggcccccaccgcgatgatgtcgatttaatgctcggcgatcagcccgccaaaggctttgccagccacggcgagacctggtctttcgcgctttcactgcgaattgcagaatttaacctgctgaaatccgatggcaccgacccgatcctcatcttggatgatgtgttttccgagctcgacgccggccgtcgcgaaaaactcgtgggcatagcgcaagaggtggaacaggtgctcatcaccgctgcagtccacgacgatctgccggagaatctcaagaaagtgctcactgcgcagcacaccgtcaccgtccaagacaccggcaccgggcggatttcactcctggatgtgcaacca

SEQ ID NO: 6 - DNA, 534 bp, Corynebacterium glutamicum
atgacagatccaattgagcaggcatttgaacgcatccgcgccgaagccatgcgcagaaatggatccgttcccgacctcaataaaaacgatgcttttcgacgcccacctgcgccgaaagggggcgtcgaaaagcgcaaaaaaggccgtgcaagcggcctagacggccgccagaaacgatatgtgcgcggcgcggagtcgctgggatcggtgctgaacaaggaaattcagcgtcgtggctggggcaaagacattgccggcggttgggtgacgtccaactgggaagagcttgttggcgcgaagattgcgcagcatacgcgcgtggaaatgatcaaagataagaagctttttatcacttgtgattccacagcgtgggccaccaatctgcgcatgatgcagcggcaaatcctgcaggtaatcgctgaaaaagtgggtccaaatattattacagagctgcgtatttttgggcctcaggccccaagctggcgcaaggggccgttgcacgtaaaaggacgcggtccgagagacacatacgga

SEQ ID NO: 7 - DNA, 2133 bp, Corynebacterium glutamicum
gtgcgtggtactacgtggggacctaagcgtgtaagatggaaacgtctgtatcggataagtagcgaggagtgttcgttaaaagtggcaaacactgaacacaattatgacgcttcatcgatcaccatccttgaaggtcttgaggcggtacgtaagcgcccgggcatgtacatcggttcaactggaccgcgtggactgcaccacctgatttgggaagtcgttgacaactcagtggatgaggccatggctggccacgccaccaaggttgaagtgacccttctggaagatggtggcgttcaagttgtcgatgacggtcgaggaattcccgtcgatatgcacccatccggtgcaccaaccgtgcaggttgttatgacccagctgcacgccggcggtaagtttgactccgattcttacgccgtttccggtggtctgcatggtgttggtatttctgtggtgaacgccctgtccacccgcgtggaagccgacatcaagttgcacggcaagcactggtaccaaaactttgaaaagtctgttccagacgagttgatcgaaggcggcaacgctcgcggcaccggtaccaccattcgtttttggccagacgctgaaattttcgaaaccaccgagtttgatttcgaaacgatttctcgacgtctgcaggaaatggcattccttaacaagggtctgaccatcaccttgacggacaaccgcgccaccgacgaggaactcgagctcgaagcactcgctgagcagggcgaaaccgcaacggaactatccctcgatgagatcgacaacgaaaccgaactcgttgaagagaccaccgatgctccaaagaagccaaaaaagcgtgagaagaagaaaatcttccactaccccaatggcctcgaggactacgttcactacctcaaccgcagcaagaccaacatccacccttcaatcgtgtcattcgaggcaaagggagatgaccacgaggttgaggtggcaatgcagtggaactcctcctacaaggaatccgtccacaccttcgccaacaccattaacacccgcgaaggcggcacccacgaggaaggtttccgctctgcgctgacctccctgatgaaccgctacgcacgtgagcacaagcttctgaaagaaaaggaagcaaaccttaccggtgacgactgtcgtgaaggcctgtccgcggttatttccgtgcgcgttggtgacccacagttcgaaggccagaccaaaaccaagctgggcaacacggagatcaaatccttcgtgcagcgcatggccaacgagcacatcggccactggttggaagcaaaccctgctgaagccaaggtcatcatcaacaaggctgtcggttccgcgcaggcacgccttgctgctcgaaaagcccgtgacctggtccgacggaagtcagcaaccgatctgggtggactgcccggtaagcttgccgactgccgttccaaggatccagaaaagtccgaactttacatcgtggagggcgactccgcaggtggttctgcgaagtccggccgtgactccatgttccaggcaatccttccactgcgaggcaagatcctcaacgtggaaaaggcccgcctagacaaggttctgaagaacgccgaagtccaagcgatcatcaccgcactgggtaccggcatccacgacgagttcgacatcaacaagctgcgctaccacaagatcgtgctgatggccgacgccgatgttgacggccagcacatcgcaacgctgctgctcaccctgcttttccgcttcatgccagacctcgtcgccgaaggccacgtctacttggcacagccacctttgtacaaactgaagtggcagcgcggagagccaggattcgcatactccgatgaggagcgcgatgagcagctcaacgaaggccttgccgctggacgcaagatcaacaaggacgacggcatccagcgctacaagggtctcggcgagatgaacgccagcgagctgtgggaaaccaccatggacccaactgttcgtattctgcgccgcgtggacatcaccgatgctcagcgtgctgatgaactgttctccatcttgatgggtgacgacgttgtggctcgccgcagcttcatcacccgaaatgccaaggatgttcgtttcctcgatatc

SEQ ID NO: 8 - DNA, 966 bp, Corynebacterium glutamicum
ttgatacaaacatacattctgaaaattcagtcgcttaaatgggcgcagcgggaaatgctgaaaactacattaatcaccgataccctagggcacgtgacctctactgaacccaccaccacagcccatgttccactacctgatggatcttccactccagtccaaatttgggcgtcagataacaaagactcccaactggtgatgctgtggccaggtttcggcatgggtggctattactatcgtccgcttgcggcagcgctaaataaagctggattccatgtggcgattggtgaacttcgtggtcaggggcaaagttccgcgaaggcttctcggaaaagtcagtggggataccatgatctcgcatcggtagattttccgctgcagattgccgctgcgaaaaaggcgcttgacctggaggaaggccatcccatgaggtttttgtcgcattcgatgggtgggcagatttcttgtcttttcgcagcgaggccggaggctgagaaatataatcttcgggcgattttcggggtgggtgcagggtcgccgtttaggcctacgtttagtccgaaaatggggaagcgtttgggattgggtgcggtgctgcttggtgggattggtggccacattgtgggattttggcccggcaaagttttaggaaaagacctggtgggttatggccgacaatcgggaactcacatgagggaatggcgtcgattccataagcacaattctttggacgatctcaccgcgcaggacatcaactatgtggaggtgatgaagaaggtgagcattcctattacttttagtcgttgtcctgatgatgaggactgcccgcaggcatcgattgatgggttggcgagttttgttcccgcagcgcagatcaaaatgatagaaattccagaagccctgggacataaccggtgggctcgggaacctgaatcaacagtgaaactcttcctggaacaagctctt

SEQ ID NO: 9 - DNA, 669 bp, Corynebacterium glutamicum
gtgagcaaccctaataagaaacctttagatcccgcacaaagattctccctccccaccagatgggcgatgttctttgtcgggatctttattatgtccttcgccatcggcatcaccgtccacgcaggactaggaaccaccacaatttcatcacttcccgtggtgtggactgctgccagcggattatccctgggctggaccacaatttacttcaatggcttcatgattctgtgccaaataattgtgctgcgttcccagttcaaaccacaaatgttagtccaaatcctgtgggcattcctctttgggtttctttgtgatttaagcctgcaactaaccacctgggcgcaaactgacaattattttgtggcctggatctgggttattgtgtccaccattttgatgtcgatcggagtttttattcaagtactccccaacatcactttcatcgctggtgaaggcattgtctctgcgctggtgaagaaatttcccaacgtggaatttggcaccatgaaacaaatcgtcgactggactttcgtctccgtcgctgccattttgtcctggatcaccatgggtggacttattggcgtgcgcgaaggaacagtgttcgcggcgtttttcatcggattcttcgtccgccagtggcgcaaactctacctccgctccatcggtcac

SEQ ID NO: 10 - DNA, 510 bp, Corynebacterium glutamicum
ttgccaagtcctggaacgttgatgctctctgcgtttttgtcagcaacgctgagaatcgcgtcgagtgcggtggagctgttggcctcgaggtgggcgccgaaatctgcggcggtgccaccattttggtattcctgccagagtccgtcgagggagtcagcgatttccgggaggaggcgcctggagcctttggctacgatgtcggagtcgatcttggttgcagcacccattgcgcctttgagtgcgatgccgctgatgccggattgcttgcccacggtttcttcgataaatgctgacatatctgcaattgctgcgtcggcattggtggaaacaagtaagtccctgagtgaagtcatgttctacatcttaagtgaaatgagaaaagaccggcgttcgacgcttcgtttaagcggacgcacggtcattctcttgaaaaagcgttgcaacccttcctccacagaaactgaaaaccacatcagtcactgcaatcacaacagtcacaaagcttacatt

SEQ ID NO: 11 - DNA, 441 bp, Corynebacterium glutamicum
atgacttcactcagggacttacttgtttccaccaatgccgacgcagcaattgcagatatgtcagcatttatcgaagaaaccgtgggcaagcaatccggcatcagcggcatcgcactcaaaggcgcaatgggtgctgcaaccaagatcgactccgacatcgtagccaaaggctccaggcgcctcctcccggaaatcgctgactccctcgacggactctggcaggaataccaaaatggtggcaccgccgcagatttcggcgcccacctcgaggccaacagctccaccgcactcgacgcgattctcagcgttgctgacaaaaacgcagagagcatcaacgttccaggacttggcaaggtctacaagggcgtgcgcggcaaggctgccaaagtaatcgagcaggaacttcctgcaattggccagttgatcgaaaagaacgcacaa

SEQ ID NO: 12 - DNA, 1071 bp, Corynebacterium glutamicum
gtgttcatgcttgcacagcgaacactccccattcacatcaccgccccccacctacccgtcgcgcgcgtatttcatcaaattcgcgccacagacgccgatcgcacctctctgcaacgcgatcttgaactctcccaagctggcatcacgcggcatgtgtcagcgcttattgatgcaggtctcgtggaggaaacccgagtggattccggggcgcgctcggggcgaccgcgcacaaaattaggcatcgacggccgccatctcaccgcctggggagtgcacattggcctgcgcagcacggattttgcggtgtgcgatttagccggccgagtgattaggtatgagcgcgtggaccatgaagtttcacactccacgccgtcggaaacgctgaattttgtcgcacataggttacaaacattgagcgccggcttgcccgagccccgcaatgtgggcgtggcattatctgcccacttaagcgccaacggaaccgtcacttccgaagattatggctggtcagaggtggaaattggggcacacctccccttccccgccaccatcggatcaggtgttgcggcgatggccggttcggaaattatcaacgcgccactgacccaatccacgcagtccacgctgtatttctacgcccgcgaaatggtctcccacgcctggattttcaacggcgctgtccaccgccccaacagcggccgcacgccgacggcgttcggaaatacaaataccttaaaagatgcttttcgacgtggactcacaccaacaactttctccgatttagtccaactctcccacaccaacccgcttgcacgacagatcctcaacgagcgcgcccacaaacttgccgacgccgtaaccaccgccgttgatgttgtcgaccccgaagccgtcgtcttcgccggcgaagccttcaccctggatccggaaactcttcgcattgtggtgacccagctccgagcaaacaccggcagccaactgagaatccaacgcgcagacgcctacattctccgcaccgcggccatccaggtggcgctgcatccgatccgtcaagatccgttggcatttgtg

SEQ ID NO: 13 - DNA, 261 bp, Corynebacterium glutamicum
atgaagggcttaagcgcggaaaatgtgctggccatcgccgatgaggtgtgcgcggaacacggcgttgtggtgcgggatttcgcagcgcttgcagccgccgcagcagtaagcacggccaacttccacggcgtgcgcgtttttggatcagctgaggcgatggcaggaaaagtttctgaaatgatcagagcattaaagccattgagtggtcgaaacgagaccttcgcggcagtcacccagagagtacttttagagatcaacaaa

SEQ ID NO: 14 - DNA, 246 bp, Corynebacterium glutamicum
atgccccaaaattggtatcaaagcgataccattttgggcatggcaatgactttaaggcttaacgacgcccaggaccgcgccctcaccctgcttgccaggacccaaggctgcagcaaacaggaagctgccacgcgagcaatcattgcggcagcaagcagggcggtcgacgacgctgagatcgccgggctcgcccggacgatgctgcacgagtatgcgggcgtcgaaaagcgaattaggcaagcccga

SEQ ID NO: 15 - DNA, 2568 bp, Corynebacterium glutamicum
gtgagcgacgacaataccggacaatttgaccgcgttaatcccattgatatcaatgaggaaatgcagtcgagctacatcgactacgcgatgtcagtcatcgtcggacgtgccctcccagaggtgcgcgacggcctgaagccagtccaccgccgcgtcttgtacgcgatgttcgacaacggctaccgccccgaccgcagctacgtgaagtctgcaaaaccagtggcagacaccatgggtaacttccacccacacggcgacaccgcaatttatgacacgttggtgcgcatggctcagccatggtccatgcgatacccgctggtagacggccagggtaacttcggttcccgcggcaacgacggccctgcagcaatgcgttacaccgagtgccgcatgaccccactggccatggagatggtgcgcgacatccgcgaaaacaccgtcaacttctcaccaaactacgacggtaaaaccctcgaaccagacgttttgccatcgcgcgttccaaacttgttgatgaacggttcgggcggcattgcggtcggcatggccaccaacatcccaccgcacaacctcaacgagcttgccgacgccatcttctggctcctggaaaacccagacgccgaagaatccgaagctctcgaagcctgcatgaagtttgtgaagggcccagacttcccaaccgctggcctcatcatcggtgacaagggcatccacgatgcctacaccaccggccgcggctccatccgcatgcgcggtgtcacctccatcgaggaggaaggcaaccgcaccgtcatcgttatcaccgagctgccataccaggtcaacccggataacctgatctctaatatcgcggagcaggtgcgcgacggcaagctcgtgggcatctccaagattgaagatgaatcctccgaccgcgtcggcatgcgcattgtggtcaccctcaagcgcgacgcagttgcccgcgtggtgctgaacaacctgttcaagcactcccagctgcaagccaactttggtgcgaacatgctctccatcgtcgatggcgtgccacgcacccttcgcctggaccagatgctgcgctactacgtggcacaccagatcgaagtcatcgtgcgccgcacccaataccgcctcgacaaggctgaagagcgcgcccacctcctccgcggcctggtcaaggccctggacatgctggacgaggtcatcgcgctcatccgccgcagcccaaccccagatgaagcccgcaccggcctcatgtcgcttctcgacgtcgacgaggcgcaggctgacgcaattctggcaatgcagctgcgtcgcctggcggcactggaacgccaaaagatcatcgatgagctcgctgaaatcgagctggaaatcgctgacctgaaggccatcctggcaagcccagaacgtcagcgcaccatcgttcgcgatgagctgaccgaaatcgtggaaaagtacggcgacgagcgtcgttcccagatcatcgctgccaccggcgacgtgtctgaagaagacctcattgcgcgtgaaaacgttgtcatcaccattacctccaccggttacgcaaagcgcaccaaggtcgatgcctacaagtcgcaaaagcgtggcggcaagggtgttcgtggcgcagagctcaagcaagatgacattgttcgtcacttcttcgtcagctccacccacgactggattttgttcttcaccaactacggtcgcgtgtaccgcctcaaggcattcgaacttccagaggcatcccgcaccgcacgtggacagcacgtggccaaccttctggaattccaacctggtgagcaaatcgcccaggtcatccagttggaaagctacaacgacttcccatacctggtgctcgcaaccgcacacggtcgcgtgaagaagtcccgcctgctcgactacgaatcagcacgttccggtggcctcatcgccatcaacctgaacgaggacgatcgcctcatcggcgccgcactttgcggtgaagaagacgatctgctgctggtctctgaattcggacagtccatccgcttcaccgccgacgatgagcagctccgccccatgggccgcgccaccgccggtgtcaagggcatgcgcttccgcgacaacgaccaactgctgtccatgtccgtggtccgcgacggcgaattcctcctcgttgccacctccggcggctacggcaagcgcaccccacttgaggattactccacccagggccgtggtggcctcggcgtggtgaccttcaagtacaccccgaagcgcggtcgcctcgtcagcgccatcgcagttgaggaagatgacgagatcttcgccatcacctccgccggcggcgttgttcgcaccgaagtcaagcagatccgaccatcctcccgtgcaacaatgggtgttcgactggtcaacttggaagaaggtgtagaactgcttgccatcgacaagaacgtcgaagaccagggcgaagcatccgcagaagcagtagcaaagggtgcagtcgaaggaccagcatccaagactgctgccgaagaaaccgactccgttgacaacggatccgacgaaaacggcgaggaa

SEQ ID NO: 16 - DNA, 342 bp, Corynebacterium glutamicum
atggcatcccgagaagtatccatcacccgaatctcaccactagcaaccttccgagttgcactggcaatgtccatcatcggactcgtggcgtggatcatctgcgtaaccgtcctctatttcggacttaacgtggctggcgtctggcagaacttcaacgatgtcatcggcggtgttggtgcagaacaaaccatcaccttcgggctcgtcctgagcatttccgcacttctgggagctatcggagcgattaccgtcgctgtgcttgcaccattgtgtgcaatcatctacaactcgattgttgacctcttcggtggactgcagattcaactgcaagaagaagtagac

SEQ ID NO: 17 - DNA, 1035 bp, Corynebacterium glutamicum
atgtctacaaaccttctggaatcgacgccgccctttacccaacttcgcaccggagtcctccagaagtacaccccgggcctgctcttatgctccattgcggtactcatcgctatgatcgtgaatcactttttctctggtgtgagtccgcttatcgtcgcgatcattcttggcatcatcctgaccaacctgattcagctcccagcatcgacctcacccggcatcacgttggcgtcgaaaaagcttttgcggctgggaatcgtcttccttggtctgcagttagttttctcagatattttgtcacttggtttccccatgctggcggtgattgtgtgcatcgttgccggtggtatttttgggaccatcctcatgggacacctgctcagaatgaaaccaacccaagttctgttgattgcttgtggcttttctatttgtggcgctgcggccgtggcaggtgttgaaggagtaactgattccgaagaagaagaggtcgttactgcggttgcacttgttgttattttcggaacgctgatgattccttttatcccattcgcaaccaaagtcttggggttatcccctgaaatcggtgggatgtgggcaggcggatccatccatgaaatcgcccaagtagtagcagctggaggagtcattggtggtggagcattaggtgttgcagttgtggtgaaactcgcccgagtactcctacttgcacccattgctgccattttaagttttcgccagcgccgccagggttacacgtcccccgatggaaagagaccaccggtcgttcccctatttatccttggattcttggcgatggtagttttgcgctccactgttgcgctcccagacgaggtaattgcggctggaggtttcctacagacagccttgctctctgcagcaatgtttggtctcgggtgtggcgtaaaaatccagaacctgatccatgttggggtcaagcctttcattctggctttcggatccacgacacttgtcaccagtatcgcacttgcaggcaccctactcacccacctcgga

SEQ ID NO: 18 - DNA, 894 bp, Corynebacterium glutamicum
atggataatgggtggccgaacctgcaaactctcgcactctttgtggcgattgtggaagaggggagcctcggtgccggtgctcgaaaagtcggaatggcccaacctaatgccagtcgggctatcgcagagcttgaggcagacatgaaagccgaattgttggtacgtcatcctcgaggatcacatccaacagctgctggacttgcgcttgttgagcattcgcgcgatctgcttcaatctgtacaagaatttactgaatgggtgacagagggacgaactgagcagccgctgaaattgcatgttggggccagtatgaccattgccgaggctctacttccagcttgggttgcggacatgcgcacgcgttttcctgcctgccgtgtcgacgtctctgtgatgaattcttctcaagtaattgaagccgtccagaaagggcacttgcaactaggttttattgaaacaccgcatgttcccgtacggcttcatgctcgtgtggtgcaagaggacaagctgattgtggtgatttctcctaatcatgagtgggctaatcgcacgggtaggatcagtcttcgggagttgtcggaaactccgctgatagtgagggaagtcggctcaggtacccgagaagcattacaagaattacttgcggattatgacatggctgagccgattcaagtgttaaacagcaatgctgcggtacgtgttgttgttgaagcaggggcaggtcctgcagtacttggtgaattagccttgcgtgatcatcttgcgctcggcaggctgttgagtgtgccatttgaaggcagtggagttactcgtcctcttacagctgtgtggagtggaccccgcagattgccgattctagcgggagaattagtgtccatcgcatcgaaccacatc

SEQ ID NO: 19 - DNA, 420 bp, Corynebacterium glutamicum
atgacaataatgaacgagattccagaatggttgactcttgtatctgttgaagcaggaaagagacttgggctgcctgggccattggtgtttccgccggagttggtcactttggcagttgaagggattgagcttattgaacttgagccttcatggacttctgattttcctctgccggaattcgggttcctagctgcggatatggttgatttctatgatgattatgagtttagtgaatggattccgggtgcgtggcctcttgctttagatggtggaggaggtttcttttgccttgatctccgtgctgccaacgctgatggagagattcctgttgtgtgggtgcatgccagcaacttgggttggggtgatgatgaggcagtacgcgtagctgcctcgttggcagatttgttgagtccgtcgaaa

SEQ ID NO: 20 - DNA, 870 bp, Corynebacterium glutamicum
gtggatgtcggcctagttacagcttttctcggtggcacactcgcgctacttagcccttgtgccgcactccttttaccagcattttttgcatcctcagtgggtgctggcccgcgcatgatccttcacggtgttgtgttctacgcaggacttctagtacttctcgtgccacttggccttggtgcgggaatcctcggcgagctgtttatcacccaacgccagaccatcatcgtggtttcatcgatcgtgctgattatcctaggttttgtccagatcttcggcggcggattcgacttcggaaaagcactcccaggattagatcgtctgcaatctaaggccactgtgacctcaggtctaggaaagagctttttactaggaatgaccagtagtattgccggtttttgttccggaccaatcctcggcgccgttcttactttggctgccaccagtggaaactccatcacctcagcactcattttgagtgcttatggtgcgggaatggtgctgcccctgatggctattgcagcgctctgggccaaactcggacagcgtggacagcagatgctccgcggccgggaattcaccttcttgggcaggcagtggcacattgtttctgtcattagcggtgccctgatcatcgctgtcggaatcctcttttggtccacgaacggccttgtcagcatgccggagctcgttccaatggacacccagatctggctacaggaagccacattctcactcgggtcaccactctttgacatcgcattgatcattgtcgccgctggcttgttcttgtacttctggaacaaacgacaaaagcgaaaagaagaagctcagcgacccaaagaaagtggatgggttattaaccctcgc

SEQ ID NO: 21 - DNA, 762 bp, Corynebacterium glutamicum
atggttaaggagaattcagtgaaccaacagagtaaaaagtggctcgtaccgacactggtcgtcatcattgcagtgctcctcatcgcagttgttctgttgatgtaccgaggaaatgcgagtgatacggccgagggcgtttcagccgctgcgacttcggactcggctgctgcttcgactgctgcttcgggttccgcttctggtgctgcggactccgatctgaccagcgtggaagcacgcgacccttccgaccctgttgcggtgggagacgttgatgcacctgttgggttagtggtgttttccgactaccaatgcccgttctgtgcaaagtggagcgatgaaaccctgccacagatgatgaagcatgtggaagatggaaacctccgcattgaatggcgtgaagtgaacatctttggagaaccatctgagcgtggagctcgcgcggcatacgctgcgggtttgcaggacgcatacttggaataccacaacgcactctttgccaacggtgaaaaacccagcgaagacctgctcagcgaagagggacttattaagcttgctggtgaccttggactagacgaatcgaaattcactgccgatttccaatcccctgaaactgcagtcgcaattgcgcaacatcaacagctgggaatcgatcttggcgcctactccaccccagctttcctcctaggtggccagccaatcatgggcgctcagcctgcttctgtatttgaagccgccttcgagcaagcactggcagcgaaagaa

SEQ ID NO: 22 - DNA, 369 bp, Corynebacterium glutamicum
atgagcatcgagccaggaatccccacgcttggaccgcttgaagaacaagtcatgcacattctgtgggatcacggaaaattgacagtccgtgaagtcatcgaattccttccaggtgatcctgcgtacacaacgatcgcaaccgtcctgcgtcacttgggcagaaaaggcatggtcaccaccgtcaaagatggtcggactgcccggcacagcgcgttgatgaacagggagcaatacaccgccggcatcatggaccaggtgctgtcgaccagtcgggatcgcagtgcatcgattctgcattttgtggatacaatcacggcaactgatcgcgagctgcttctggagtacctgcaacagcaggagggtaggaaa

SEQ ID NO: 23 - DNA, 993 bp, Corynebacterium glutamicum
atgactgcggcttcggcgttaactgtagcgctcataattgggatttcactggctgtcattggaatttttggtcctgcgcttcttcgccacgcagcgccagcgctggctaaaactccgcacctagcagtggcgttgctcatcggcggtatcctcgtttggccaaccacgctgcttgccttgagtcttgcgttggcgtgggtgttggtaggtccagcgcttcttccacaaaaagctgctttagtttgtgaacagtgcttgaccgcggctaatccgttttcggtggagtccattcagacgacgctgcccaccgtgctgctcctggttattccgacggtgattgcggcgatgtgcaccgtcggcatcgcggcgcagtttatggcccgggtgcggtgctcccgttccacggcggcgcgtgtgcagcatgaagcttatcgacgcccccttctcggctacaacgtttccgttgtccacgatcaccgtccttgggctctgacgttttcacctcgtcttggaggaataaccctctcttcaggggcgattgatcagttggctgatgatgaactcgaggcagtccttgcccatgaacaggcccacatggatcaacgacaccacattgtcaccgcattggtggacagtatcgcagcacaactgcgatgggtaccgtttattcgagaagccgcagaagtcctgccggactatttagaaatcgctgctgatcaacaagcctgcagaaaagtaaacaccacggcgttggttcgggctcttttagttttgggggagaagaagataccgacaggaaccattggatcagctgccggaacgttgtttgctgcaggtcctggacgtattccgcatctggtgggttcatccacagggcggaaagggtacgttccggctcttgcagcaggtagtcagattctactgttgggatttgtcagcgttattgtgctgctgtcctatgcaattgcactactaaccgggtgttccctgccg

SEQ ID NO: 24 - DNA, 180 bp, Corynebacterium glutamicum
gtgcttgtgtcgatgagttctcaaaaggctcttaaacgactacgtgaaaatatcgatgtctttgatttcacactcacagatgaagaaatggcgggtatcgccgccctagacaagcaacaaccccttgcgggattcacccaccgtgatccacgaatgctcgaacgactgcaatcgctggac

SEQ ID NO: 25 - DNA, 528 bp, Corynebacterium glutamicum
atgctgaaatgtgcagtcgatgaagccgctggcggacgcgcccaagctttcgtatcctcaggcgataacattggtggcagcccgttccaatcctccattcttggtgatgaacccaccttggaagcactcaaccaaatgggtcttgattactcagcagtgggcaaccacgaatttgataaaggctacgcagacttaagcagtcgagtcgctgaccttgctgattttgattatctcggcgcaaacgttgagggcgaaaacccagatcttgcaccatatggaatttctcaccttgatggtgtgaaggttgctttcgtaggcaccgtatcccaagaaactccgatgttggtcaattctgaaggcattgagggaatcacgtttactgacccacttgaagcaaccaaccgtgtagctgatgaactcgtgggaagtggcgcagcagatgttgtcgttgcgctttaccacgaaggcattaccggcaccgaagcatggtcagaaaatatcgacgttgttttcgcaggtcacacccac

SEQ ID NO: 26 - DNA, 1236 bp, Corynebacterium glutamicum
atgcagtctggaaactacgggcacgcacttgccgatgtagatttcagcttcaaccacgacaccggtgagctcaccgtagatgatgcccgcatgctcggagtcgacgatatcaacgcgtgtgaaaacccagatgacaccattgcagatattgttgctcaggcggaacttgatgctggtgaagccggcaaagaagtagtagcgaccatcgatggcgattttctccgcgccagcgacgaaggagcagaatctggctccaactacggcgctgaatcccagctcgtcaacatgattgccagtgctgtgcgttggtccatgtccaccaataccgccaccaccgcagacattgggcttatgaacgccggaggactccacactgacctattcagcggcgatgttacctacgccgaagcttttgaaatccagcctttctccggtgaagattcatttgtcaccctcaagggatcagacttcaaagatgcccttgagcagcagtgggaagaaggttctgcacgaccagtggcagcacttggcgtatccgacaacgtttcctacacctacgacatcaaccgtccaatcggtgaccgcgtcacttccgtgaccattgatgataccccacttgatccggaacgcgactacgttgttgcagcttccctgtacctccagtccggcaacgaaggtatgaccgcactgacccgcggaaccgcacctgcacaaaccggcatcgtggatgtacagtccaccatcggatacttgtccaacaacaatgtcaccccacgtactggtcaagcccagatttccatcaccccatccggtgagttcaatgcgggtgaaaccatcacccttgacatggcaggactccgctacacccaaggcgacactgccacggaagtaactgtcagccttcgagaagaaattgtttcagcaccaattgatcctcagctcggagaagctggctttggcgaagctggaaccgcgacagtgagcttggacattcctgcaaccctttcaggtactcaaaacctcgttgtcaccaccgataccggcacccgtatttccatgccagttgagattgttggcgcagaacaaccagcaccgcaaccagcaggttcctctgttttaggaactggagtgctcagtggactcctcggcattgttgtaggaattctaggaatggtcggtctggtgaactggattgacccaagcttcattcaacagatccagcagcaaatctttgct

SEQ ID NO: 27 - DNA, 165 bp, Corynebacterium glutamicum
ttgcccagcaacccggtcgcgattgccaggcaacaaaactggggtcaagacggactcgccaacgtccccgacttgatccaacaagaacaaccacacgaccactacgggcgcccggttacctatgacaccggaatcgatgccacaacgacacgccgtaaaagcaag

SEQ ID NO: 28 - DNA, 435 bp, Corynebacterium glutamicum
atggcgatcgagtccatcgcgtacaccagtgaagcactctcaaccggcagtggccggctggggcatgtgcgctccacagatggtgcgctcgaatttgaaatgacaccgccaaaggctttgggcggatccggtgaaggcaccaatccagaacagctgttcgcggtaggttacgcagcctgtttccactctgccatgcactctgtcgcacgcagccgcaagatcactcttgaagacacagcggttggtgcccgagttagcatcgggccaaacggcgctggtggatttgagattgccgtagaactcgaagtatcgattcctcaattgccacaagcagaagcccaggaacttgctgatgccgcgcaccaggtgtgcccgtattccaacgccacacgaggcaatatctcggtaactgtgtcagtcatcgacgaagaggct

SEQ ID NO: 29 - DNA, 1413 bp, Corynebacterium glutamicum
gtggaaccagtgccccatcatgaaattcatgaaatgactgttgatggtgctgaagttgttttagtttcagtctcaccgttgtcagtgaacgggccctgttattatcttcccgtcggaatcactaatggcagcttcaaacgcgttggcgatgaagaccggaagctcagtcatcttgaaatttacgagctccaaaataggtttgttcaaaccaaaacagatagaaatccagttccagattcaagcatcgacgatctcaacaatcagctcgcggcgtcatttaagcagcgcctaattgagtcaaatagtcgctcccttggaacagacgataactggttactgcgcaaaaatatcactacatcaaagggagaactgacgattgctggcttactggctctcggaagctatcctcaacagtttttcccccgagtgatcattgatgttgccgtacatccaggtctgcataagtcaccaatcggtacctcaattcgttttgaagaccgaaaaatctgcgagggaaatcttctcgagatggttcaagaggctatgtctgccatcaaacgaaacctacgtgtacgccgcgtcgttgaaggactctcaggtaaagatgttctagaaatcccagaagaagttttgagagaggctctagcaaacgccgtacttcaccgtgattattctgagctagctcaaaatgaagcaattcatgtagacatctataaggatcgagttgagatcacgagtccaggtggattacccaatggtaaacgcccagagtcaatactggacggatactctgaaccaagaaatcgtgtgctttcaagaatcctaatggatattccatggacacatgaagtacaaggagtacttgctgaaagcaacggtactggcgttccccgaatgttcaatttgatgcgtgaagcgggacttccggtaccgaattttaagattgatatttctagcgtcactgtcgaactcagccgtcacggtcttctagatgcccaaacaagtgaatggcttgtagaaaaactcggatcagatttttctaacacacaaggcattgctcttgttctcgcaaaagaacttggagcggtaacgtctcgagatctccgcaatcaaactggtcatgattcagaagacatgcgcagcttacttgacgctttggttgatcggggcgttctaaaccaaaacttacagaaccaatatcagcttgcgacatcgtctgtgaatgtaactcaaagcgaacaagaagtcttagatgcaatcaataaaacaactcctgtcacaattcgagaaattgccacaaaaacagggaaaactgcatcgtctcttcggccgctgcttcgtggccttgttgaagcaggtcttgtggttgcaactgctccaccatcaagccgcaaccgagcgtacttgaaggct

SEQ ID NO: 30 - DNA, 438 bp, Corynebacterium glutamicum
atgaactggatactcgcctgtgaatcaaatccttcaactggagtgaaatctggttcgcttagccccaataggatgtatccaccgttggtgtttgcgaatgcgcttaatgattcccagaagctttttgatcctttgcttaaaggtaaccgaccccaagatttcacttctacggtttcatcgtcttttccgtttttcctaagacgctcaaggtctttctctaattcgaatggttccacggtggcgagtgccccacaatctattaaacgtattaggtatccctgtcagtctacttcactgagaccctcagtttctacactgagagcgtcactttatacactgagaccctcagtttctacactgagggcgtcactttatacactgagaccctcagtttctacactgagggtcttagtttttttagtgaggagcgcgctacgt

SEQ ID NO: 31 - DNA, 1278 bp, Corynebacterium glutamicum
atgaaaaactccaagctacttcttattgctgcggtatccaccgcatctatcctgctggcaagctgtggcactgacagctctgcagatactgcaactgcgtctagctctgcaacagcaagctccgaggcacacgatcatgatggccacgaagccgaaggcagcagcactgccgttgaggtgtcctccccgcaggcccgcatcgtcaccacctacgacggtggcatcattaccctcgacgccaacactctggaaatcctggaagacaccgaactagcaggttttaaccgcctcaacagtgcaggagacggacgccacgtatttgtctccacaggtggcggcttccagctctttgataccggcgcatggaccgaaccacacggcgatcacacccacagctacaccgccaccccagaactcaccgacatcacctactccaccgataagcctggtcatgtagtgaaccacgccggcaagaccgtgctgttcggcgatggtgacggcaaaatccagatcttcgacaccgcttccctcctcaagggcgatgaagtagaacctgagatcaaaaacgccctcaaagcccaccacggcgtggcagtagtcctcgaaaacggcgacctgctgcacactttgggcgatgaggattcccgcaacggcgccgtcgtattcaacgcagccggtgaagaaatcgcccgcaacgaacagtgccccggcgttcacggtgaaagcgcagcactcggtgacgccatcgcagttggctgtgaagacggtgtactgatctacaaggacggcgagttcaccaaggtccaggcacctgattcctacggtcgcatcggcaaccaatcaggcagcgacgtctctcctgtcgtcctcggcgattacaaggtagataaagacgccgacttggagcgcccagagcgcgtttccctcaccaacaccgagaccggcgagctcaccctcgttgacctcggcacctcctactccttccgctcacttggccgtggccctgcaggcgaagcagtagttctaggcaccgacggcgcactccacatcatcgatgccaacaccggcgccatcaccaacacctaccccgtcatcgatgcctggaccgaaccagaagtatggcaagaagcacgcccaaccctgttcatcaacaaggaccgcgcatacgtctccgacccatcaaacaacgaactccatgttgttgacctggccaacggcaacatccttgccagcgccaccctgccaggaacccccaacgagctcaccggagtgagcggc

SEQ ID NO: 32 - DNA, 954 bp, Corynebacterium glutamicum
gtgatactgaaagacattttcaataatggggagctctttggggcttcctccgcgaaaaatttccgaaaactactagctgttccagccgttgccgcctcactagcttttggtatcaccgcctgttccgctgtagatgacacccctgacattgtggtcaccaccaacatcctgggtgatgttgtaagccatatcgtgggagattccgcagatgtccaagtactcatgaaacccaacgcagatccacattccttcggagtctcagcacaagacgccgctgccatggaacatgccgatctcatcgtggccaatggactaggacttgaagagggccttcaatccaatgtggacaatgccaaaagccaaggggttcccgtcttggaagtcggcgaacacatcgatgtcattgactactcccccggcgttccagatcctcacttttggacagacccggcgcgcatgatcgccgccacggaagttatagaagctgaactgatcaaagaactcgatccttccctgactgaatcgatcacacaatcagcccagcactaccgtgaggaacttgttgcccttgatgaggaagtcaccgaattgctcagcggcgtggccccagaaaaccgcaagctggtaaccaatcacaatgtttttggatacctggccagccggtttaactacaccgtcattgacaccatcatcccaggtggaagcacattggcggcgccttcagcatctgacctcaatgacatctccaccgccatcgaagacaacaatgttcccgcaatcttcaccgatacctcaagcccacaacggttagctgaagtgttggccagcaacgctggcattgatgttcaagtggtgtccattttcacggaatcactcaccgatgcagatggtgaagcacccacctacatcagcatgcaaaaaatcaatgccgagcgcattgcaagcactttgtcc

SEQ ID NO: 33 - DNA, 849 bp, Corynebacterium glutamicum
atgaagttttttactgacgccctcatagtgccttttgacgtttcattcatctcccgcgccctggtcgccggatgcctggccgcaattttatgctcactcattggaacgtgggttattttgcgcaggctaacctttttcggcgacgctatgtcgcacggcttgctccccggagtagccacggcatcactattgggcggaaatctcatgttcggcgcagcaatcagcgcattaatcatgtcagccggagtggtgtggaccagcagaaaatccagcctctcccaagacgtcagcattggcctgcaatttattaccatgctttccctcggcgtggttattgtgtcccactccgattcccacgccgtagacctcaccagtttcctttttggagacattcttggcgtgcgaccctcggatatattcatcatcgccattgcaacagtgttgggtggattgactatttttctcttccaccgacagttcactgcactcgctttcgacgagcgtaaagctcacaccttaggactcaatccccgctttgcacacctactcatgctggcactgatcgcattagctacggtggtgtcgtttcaggtggtgggaacgcttttagtgtttggacttctcattggtccgcccgccacggctgcacttttagtgcaagacaaagcaagtatttcactgatcatgatcgtcgcgtcgcttcttggatgcgcggaaatttacctcgggcttttaatcagctggcacgcaagcactgccgcgggagccactatcactttgttaagtgctgcgatattttttgccaccttattgacaaagagtgccattagtaggttaaacttcaccgcg

SEQ ID NO: 34 - DNA, 657 bp, Corynebacterium glutamicum
atggcagaactcagcgtccggaatctcacatgcacatacggcaatcacatcgcgctcaacaacatcacggcacgcttcccaaccggaaaaataactgccctcatcggcagcaacggctccggaaaatccacactgttggaaactttggcgggcatgctggcaccccgcagcggaagcattaacaaccttgtgccagaaatcgcgttcgtcccccaacgcagccacgtctcccataatttgcccatcacgatcagacaaacagtcagcatggggcgatggtcagccaagaaaaactggcaacgactcactgccgcagattgcaacatcgtggacagctgcctcgaccggctcgaaatctccggcctcgccgaccgccccctcggcgaagtatcaggcgggcagcgccaacgcgccctcatagcgcaaggtttagcgcaacaggcgcccttattgcttctcgacgaacccctcgccgccgtggactcccacgcggcaagtcttatcgaagatgtcattaaccaacaacgcaaccaaggaaccacaattattcttgcgactcacgatcttgatcaagcacatcaagcagatcagattatcgccttggaaaaaggaatcataaagccacagcgcaaagccactgaatcaataaagaagcgt

SEQ ID NO: 35 - DNA, 981 bp, Corynebacterium glutamicum
atgaagctaccaagactcgccgcagcgctcattggtgctgcgctgttaatcacgggttgttcagctaccgggggagcaccacgggcaacagatggggcatcaggcggaggaaccgtcgatacgcctcggttggttgtcgcgatggtgagccacggcgcgccgggcgatactttttgggatttggtccgaaaaggtgctgaagacgccgcccaaaaagacaacgttgaactccgctattcctctaatccggaaatccctgaacaatccaacctcgtgcaaaatgccatcgattcacgcgtcgacggcatcgccatgaccatgcctaatgctcaatcactaggaccggtcgctcaaaaggccgtggatgcgggcattcctgtggttggtctcaacgctggaatgaacgaataccaagattatggaatgacaggattctttggtcaagatgaatccgtcgcaggagcatccgcaggagcgcgccttgccgaggaaaacgcacaaaaagttttgtgtgtgatccatgaacagggcaactcctcccaggaagctcgctgtggtggcgtgtctgaaggtttgggcaaacaagtagaaaccctgtatgtcaacggcatggatctcacctcagtgaactccaccctgcaggcaaaacttgctcaagaccgcagcattgattgggttgtgggactccaggctggtgtatcaatggctatttctgatgcggcagacgctgcgaactcagaagtaaagatcgccacctttgatacaaacgcacagctcatgaccgctattcgtgatggcaagatccaattcgccattgatcagcaaccatatctgcagggctacatggccgtggattcgctgtggttggcgcaccgaaacggcaccactgttggtggcggacgacccgtgtacacaggaccagccattgtggatgccaccaacgttgatgtcattgctgaagccgttggggagggtctgcga

SEQ ID NO: 36 - DNA, 1023 bp, Corynebacterium glutamicum
atgacaaaaatcaagagtggggaggcgtcgacaagcattgttgagcgcgccttaaagcgccccgaactgaccagcctgcttggcgccgtgcttgtttttacgctgtttatggtggtcgcgccggcatttaggtcatgggattcgatggcgaccgtgctgtatgcgagttccacgatcggcatcatggcggttgccgtgggcctgctgatgatcgctgatgaattcgacctgtccaccggcgttgccgtgacaactgcagcgctggcggcctcgatgtttagctataacctgtggctgaacacctgggtgggcgcgctgattgcattggtgatttcgctggccatcggctttttcaacggctttttggtagtgaaaaccaagattgcatccttcctgatcacccttgccactttccttatgctgcagggtattaatctggcggtcaccaagctgatttccggcaccgtggccacgccaaccatcgcggatatggaaggttttccttcagcgcgtgcggtgtttgccagctcgattcccatctttggtgtgaatattcgcatcactgttttttggtggctgctgtttgttatcgtcggcacttttgtgttgtttaagacgcgcatcggcaactggatttttgcggtcggtggcgatgaagaggcagctcgcgcagtcggcgttcccgtgcgtggcgtgaaaatcggcctgttcatgttcgttggttttgccgcctggtttgtgggcatgcacaacctgttcctctttgattcgattcaggctggtcaaggcgtgggtaatgagttcctctacatcatcgctgcggtgatcggaggcatctccatgactggtggccgcggaacagtggtgggcacaatgattggtgcactcatctttggaatgaccaaccaaggcattgtttatgcaggttggaaccctgactggttcatgttcttcctcggcggcaccctacttctggctgttttgctcaatcaccgattcgagcgtttcaacaaggagcgatca

SEQ ID NO: 37 - DNA, 759 bp, Corynebacterium glutamicum
atgacagacctcattcaactccgcgaagtatccaaaaaatacggtgctttccaggccctcaacgacatcaatttgaacgtccgcgcaggcgaagtcacctgtgttctgggtgacaacggcgccggaaaatccaccctcatcaagattctctccggcctgcatcccgccacctccggcgaagtaatcgtggccggcgatgtagtgaattttggatccccccgcgacgccctcgacgccggaatcgccaccgtctaccaagacctagcagtggtcgggcagatgagtgtgtggcgcaacttcttcctcggccaggaactcaccggccgatttggcgttctgaaacaagaagaaatgcgccgcatcaccgacgaacaactccgcgaaatgggcatcgaactccgcgatgtcgacgtccctgtggcctccctttcaggtggtcaacgccaagttgtcgccatcgcccgcgccatctacttcggcgcgcgcgtcctcattttggacgagcccaccgcagcgctgggcgtgaaacaatctggcatggtgctgcgctttattgccgcagcacgcgaccgggggatcggcgtcattttcatcacgcacaacccccaccacgcctaccttgtcggtgatcacttcatcctgctcaacttaggcaagcaggtcatggacaaatcccgcgcagaagtcgagctggaagaactcaccctcgccatgtccggcggcggcgagctcgactcactcagccacgaattgaagcgt

SEQ ID NO: 38 - DNA, 816 bp, Corynebacterium glutamicum
ttgaatatgagcacgattggcaacctcaagttagtagtggatggcgcacgtaaagcttatggaacttatgcggattaccgcgaccgcaaggtgtctgagacttatgatgcgttgtcccaagctgctggtgaatatgcaccaaaagctgagcaggctgtagagactgcgcgggaatcagcgaaggaattttatactgagtcgcgcgataaggctggaaatgtcaccaaggctgctcgtgctcgtctggaaaaggcgctcgctgaggctgacaagcagggcacttctgcgttgaaggacgcacgtgaatcgggcaagaaattgaaccggaaggcgcgtcgaaaagcagacaaggccgctaaggcagcccgcaaggcgactgaaaagaaggagtcgcactgggtgcgcaatctgtcgttggcggcgctagcgacctccggcatcgtcgcggtggcctacgcgtttttgaacaagaccaagaaggaaaccccaggcacccagcctccacgggttgaggttcagttgaagaaggccgtggagcaggatgagcctgaggttgtggctgaggctgctgtggaggagccagagttggtgtactccacagaaagcccagaaaccactgaagccccagctgaggccaccgaaactccagcagaaaccaccgaagaagaagccaaaaccgaagctgaactagaggcagagctcgaggctgaggccgatgcggagcaggaagcggcagaagaggcggaagctgaggccattcaggctgagtttgataagaagaatgcacctcagcgcacccagagcgaaaagaagaag

SEQ ID NO: 39 - DNA, 561 bp, Corynebacterium glutamicum
gtggttggcatttcgctcgatgtagttatgatgggcgttatgacttctaagaccgcaactgcgattctgcatacaaatcgcggagacatcaccatcgacctgttcggcaaccacgctccagagaccgtcgctaacttcgttggcctggcacagggcaccaaggactaccagtccgcaaacgctcagggcgacagcgaaggtccgttctacaacggatctgtcttccaccgcgtcatcgacggcttcatgatccagggtggagacccaaccggcaccggccgtggcggccctggctacaccttcgctgatgaattccacccagagctgcgcttcgaccgcgcatacctgctggcaatggcaaatgcgggcccaggcaccaacggttcccagttcttcatcactgtgaccccaacccctcacctgaacaacgctcacaccatcttcggtgaggtcactgacgctgagtctcagaaggttgtggatgcaattgcaaccaccgcaaccgatcgttacgaccgcccagctgacgcagttgtcatcgagtctgtagagatcaccgcg

SEQ ID NO: 40 - DNA, 687 bp, Corynebacterium glutamicum
ttgaaagaccagttgaagattgttggattcatgaatgtagaacggatttatcgacaagcgccagcaagtacgttgatctctttagccatcatcgctgtgtacgcagtgacggccattcaatcgagatcagtgacagacaacctgggttcaaccagtatcggtgacgcgtggattctgtacgcaccgctgatggatgatggtggctttggtccactgcgtgccatcggaggaatgttcctgcacattggccccgggcacatgctgttgaaccttgtgttgttgtggttgctgggaagagaaattgaacgagacttcggttctgcgcttttcactgcgatgtactttgtgggcggtattggtgcgtctgcagctgtcatctggatggatccctattcaccgacagcaggtgcttccggcgccatttacgccatgatggctattttggtggggctttttgtgttaagaagcgcggatatccgagcacccttgatccttatcgccatcaacatcgcctataccttgatgtccaccaatgtttctctgtggggacaccttggaggtttgatcactggagctttaattacttggccaatggttaaagcgaaaactcaaagaacacggtggattatcgtgctcattggttttgctgtagttgtggctgctgtcattctaggaattgaccgggtg

SEQ ID NO: 41 - DNA, 978 bp, Corynebacterium glutamicum
gtgcagttccgtccccggacactgatggtagtgctcatcgcggttacgttggtggtgattcttattcatttgagtctgactgttggttccatcactgcatcgcaggcgtggtcggcggtcgtaggagtgggtgatgcttctgatattcgttcagtgcaatcacggcgcttgcctcgagtgctgacagcggtaggagtgggcgctgcgctgggattatctggcgcttgtttcagtccgtgtcacgtaacagtgctgggctcaccagacatcattggatttaccacgggagctgccacagctgcggcgatcagcattattttctttgatgcaggtgtggtcttaaccggagtggcagccattcttggtggacttgcgaccgcagtttttgtctatctcatggccagacaaaatagcaataccggcgggttgcgtctggtgttggttggtatcggaacaggtgcatttttgggtgctgctcgtgatttcttcatggtgcgcgcagatattacgggtgcttcgacggtacagctgtggtctgccggttcgttgagcgggcgcgactggaatcatgccctgttggtgttgatttcgtgtgcagtgattgtgccagcactgtgcattattgtccgccgtttacgcctgatggaaatgggtgatgatgcagctggggcacttggaatttcagtggagagaacacggttgatagccattttgttggctgtgctgctggtggggatcgccaccgcagctgcaggtcccatcgcttttattgcactggcagcacctcagattgcccgggctctggcccgggaggatggagtgctggtggctgcgtcgataagcattggctctgggctgttagttgcggcggattgcctagagcaacacgttgatactgagctgcacacgcccgttggcctggtgaccagtttgctgggcggggtgtatttgatgtggcttttgagccgaaaggaggca

SEQ ID NO: 42 - DNA, 996 bp, Corynebacterium glutamicum
gtgtccggggacggaactgcacagaaagctttgcaacccgaatcgtctggtttcttttcacagcgccgttttctcgatgaaacagggctaaacatcagcacctggagaacacgcacccggttaagccttgcagttgcctatctttccgatggcgacagcgcagaatgggcagctcatcacgttggtttttctggagcaagcaacctctccaaagcatttcgcactcatatggggatctcacccaatcagattcttacacttccagaaccgcaacatcttgatccaccactgccccaactcgcatctttagagattccagcaaatgaaacatggtctcggatcaatggatctcacatcatggtgtgggcttttcaaggaacatccaccgttcgagtagctgatagagaactcactgttcatcaaggtgaagggttaattcttccagctggaatgcgcctggatcttcacactcctgcgggcggactcatgttgccgttgggctaccaagttccagattcccattcaatcagtgcccaacatgtggacatcattcagtttgattgctctattcagcagcttttgcaatgcacgatttctgcctacactccttttcacccgcacaaagcggccccggatcagtgcttctccctaccttttccaaaatgctccacgaaaaacacgccaaccaaaaatcacaatgatgaattaatttctttggcagttgatcttgcagtctcccgagaaactaatgtttctgctattcgcggcggaattgcggaagagtttgcacacatgactggcattgcggtgcagcgctggggacttctgcgaagaatgactttggcgcgcattcaattaagcaaagggctaagcccgggggtagtcgcacggaacctcggatactcacacttacctgctttcaaccgtgctttcaccgccactcatggttgcacaccgatgcagtaccaagctgactgtgcgcgcatccctaccccc

SEQ ID NO: 43 - DNA, 777 bp, Corynebacterium glutamicum
atgctgcaagcgcatgatctcacgctgagttacggcgggcgaaatattgtagaagggctcagtctggaccttccggaaagaggcctcagcatcatcattggccccaacggatgcgggaaatcaaccgttttgaaagcgttgggcagactgctgaaaccacaattggggaagatcacgctaggtgggcgagatatttccagcatgggcaccaagcatgtggcgaaacacatcggggtgcttccgcaacccccatatgcgcccgatggggtgagcgtcacggagctggtcagccgcgggcggtatccgcaccaacatctgctgtcgcaatggtcaaaagacgatgaagccattgtggcgcgctcgctggcggaagtcggcatgcacacccatgctgagcatttagtgtcggaactttcaggcggccagcgccaacgggcgtggatcgccatggcgctcgctcaggaaacagacattttgcttctcgacgagcccaccacgttcctcgacgtagcccaccaaatatccgtcctcgatttatgctccgacctgcaccaacgtggtcgcaccctggccattgttctacacgatctgaacatggctgcacggtatgccacccacatcatcgccatgcgggacggcaccatcatcgaccaaggaaaacccgaagaaatactcactaaagcgctgctcaaagaagtttttgacctcgacgcactcatcctcaaagaccccaacaacggccgaccactcatcgtgcccacagacaggagaaactca

SEQ ID NO: 44 - DNA, 822 bp, Corynebacterium glutamicum
atgaaagaaaccgacaacctactgcgcgaaaactcccacgaccgcgacatctctgaaatcgtcgccaccatcactgcccttgaccacccatcaccctcacttctgcgattcacagcttttgttccaggatcagcaaacaacccagtgtgggcagaagccaacgtggcaatcaggctttacctcagcgaagaattcgacgacgccacccgcgtctacaccgtccgatcctttgatgccgcaactgaaagcatcgtggtggatgtggttcaacaccaccacgaaagccccatgatgcgctggtcagacaccgtaaaaatcaacgacaccctcgtgctcaccggaccccgcccacactttgtcatccccgaaggcgaacaagcagcactcttccttgatgacaccgccatccccgctctcgccgctattttggatcaatggccaacagatcttcgtggcaaaggatgggttgtcactgacgatcccgcagccttcgatgaactacccagcatcgacggactggaactgaacctgctcgcgccgggatcagatccaactgttcagccacttgcccaacaggcatatgacctggaaaacccagaaacttacgtggtgtgggcagccggcgagcgagatgaaataaaatccatccgcaggcacttccgcaagcaggtgggattggaaaaagatgcagtggccgtgtttgggtactggaaatacaacaccaccaacactcagatcgatgcagtccgcaaagaaaactacatgaagatgctctctgaagggctacagctggaaaacttcgacgacctctcattggagatt

SEQ ID NO: 45 - DNA, 270 bp, Corynebacterium glutamicum
atgccaaaggcaagagtaactaaaaacgagaccgcaccggtttcaagcaacccaagcgcaaaccgcaccccggttaagatcaattccgccggaaccccaatgtggtacaaggtcatcatgtttgccttcatgatcgtcggcctagcctggttgatcattaactacctcgtgggcccacagatcccattcatggctgatcttggtgcatggaactatggcatcggcttcggtctgatgatcatcggcctactcatgaccatgggttggcgt

SEQ ID NO: 46 - DNA, 1938 bp, Corynebacterium glutamicum
gtgaccttcgtgatcgctgatcgctatgaactggatgccgtcatcggctccggtggcatgagcgaggtgttcgcggccaccgacacgctcattggtcgggaggtcgcggtaaagatgctgcgcatcgaccttgcgaaagatcccaatttccgagaacgcttccgcagggaagcccaaaactccggaaggttgagccactcttcgatcgtcgctgtttttgacaccggcgaagtagacaaagacggcacctctgttccctacattgtgatggaacgcgtgcagggtcgaaacctgcgcgaagttgtcaccgaagacggcgtattcaccccagttgaggcagccaacatcctcatccctgtgtgtgaagcgctgcaggcatcccatgacgccggcattattcaccgcgatgtgaaacccgccaacatcatgatcaccaacaccggtggcgtgaaagtcatggacttcggcatcgcccgcgcggtcaacgattccacctccgccatgactcaaacctccgcagtcatcggcaccgcccagtacctctcccctgagcaggcccgcggcaaacccgccgatgcgcgttccgatatttacgccaccggctgcgtcatgtacgaattagtcaccggtaagccaccttttgaaggcgagtcccctttcgccgtggcctaccaacacgtccaggaagaccccacccctccttcggatttcatcgcggacctcaccccgacctctgctgtcaacgtggatgccgtggtactcaccgccatggcaaaacaccccgccgaccgctaccaaacagcctccgaaatggccgctgacctgggccggctatcccgcaatgcagtctcccatgccgcacgcgcgcatgtagaaacagaagaaaccccagaagagcccgaaactcgcttctcgacgcgcacctccacccaagtggcccccgccgcaggcgtggctgcggccagtacggggtcagggtcttcttcgcgtaaacgtggatccagaggcctcaccgccctggccatcgtgttatccctaggtgtcgtcggcgttgccggtgccttcacctacgactactttgccaacagctcctccactgcaaccagcgcgatccccaatgtggaaggcctcccgcagcaagaagctctcacagaacttcaagcagcaggatttgttgtcaacatcgtcgaagaagccagcgccgacgtcgccgaaggcctcgtcatccgagcaaacccaagcgttggatccgaaatccgccaaggggccaccgtcaccatcaccgtgtccaccggccgagaaatgatcaacatcccagacgtctccggcatgacacttgaggacgccgcccgcgccctcgaagacgttggtctcatactcaaccaaaacgttcgggaagaaacctccgacgacgtcgaatctggcctcgtcatcgaccaaaaccccgaagccggccaagaagtagtcgtgggttcctctgtatctctaaccatgtcttcaggcaccgagagcatccgagtgcccaacctcaccggcatgaactggtcacaagcagaacaaaacctcatctccatgggctttaaccccacagcttcctacttagacagcagcgaaccagaaggcgaagtcctctcagtttccagccaaggaactgaactacccaagggttcatccatcacagtggaagtctccaacggcatgctcatccaagcccccgatctcgcccgcatgtccaccgaacaggccatcagtgccctccgcgctgctggctggaccgccccagatcaatccctgatcgtcggcgaccccatccacaccgcagccctcgtggatcaaaacaaaatcggattccaatccccaacccctgcaaccctcttccgcaaagacgcccaagtgcaagtgcgactcttcgaattcgatctcgctgcactcgtgcaa

SEQ ID NO: 47 - DNA, 1407 bp, Corynebacterium glutamicum
atgagtcaagaagacatcactggaaaagatcgactccaagaactcatcggcgctgattatcgtctgcagtggatcatcggacacggtggcatgtccaccgtatggctcgcagatgatgtggtcaatgatcgcgaagtagccatcaaggtactgcgcccggaattttccgacaaccaggagttcttgaaccgtttccgcaatgaagcgcaagcggctgagaatatcgattctgaacacgtggtggccacctatgactaccgtgaggttccagaccctgctgggcatactttctgcttcatcgtcatggaatttgtccgcggtgaatcgcttgcggatcttctagagcgcgaaggcagactgccggaagacctggctcttgatgtgatggaacaggcggcacatggtttgtcggtgattcaccggatggacatggtgcaccgcgatatcaagccgggcaacatgctgatcacagccaatggcattgtgaagatcacggactttggtatcgctaaggctgccgctgctgtgcctttgacccgcaccggcatggtggtgggtactgctcaatatgtttcacctgagcaagcccagggcaaggaagtcaccgcggcttctgatatttattctctcggtgtggtcggctatgagatgatggctggccgccgcccgttcactggagattcttcggtgtctgtggcgatcgcgcacatcaaccaagctccgccgcagatgcccaccagcatttcggcacagactcgcgagttgattggcattgcgttgcgcaaggatccgggtcgccgtttccctgatggaaatgaaatggcgctagctgtttctgctgtgcgccttggcaagcgcccgcctcaaccgcgcacgagcgcgatgatggcgcaggcggaggcgccgtcgccaagcgaatcaacggcgatgctgggcagggtggcccggcctgcaacaatcacccaagaagcggccccgaaacgcggttccggcattggcattggtctgttcatcgcagctttgcttgccgtgattattggcgcggtgatctatgcgggcaccaccggaattttgttcaacgacactccggaagaaaccaccacacctgaaaccattacggaaacatacaccccaaccgtggaggaaaccacctctcagtgggtaccgccaacgcctccaacacggtcaacattcaccgaacctgaaacaacttcacaccgtccgacgacaagtgaagagagcacatccgaggaaccaaccacggaagctccaacaagtagccgaactgtgcctcaaatccctacctctacacctaggacgagtgctagcgttccagttgagactaatgcaccggctgatgatttaatcgacgccgtaaatggcctattggatgtaggaggagcgcag

SEQ ID NO: 48 - DNA, 1422 bp, Corynebacterium glutamicum
gtgaaccgctcgattcgaatcacatccctcttctctttgctcctgatcttggtgctcgtagcaaacctcacctggattcaggcttttagggacgatgatcttgctcagaacccactgaacgcacgtggtttcctggaggcgaagtccactccgcgtggacagatttcaactggtggccaagtactcgcagagtcctcccaggacgatcagggtttttaccagcgcagctacatcaccaacccgactgcctacgcaccggtggttggttacctctctgatgtttatggagcagctggcctggaattgggatacaactctatcctcaacggcagtgactcttccctgtttacctcccagtggctggatgtcatttctggcagccctacccatggcgcaaacattgagctgaccttggatcccaatgcgcagcaaactgcttatgaacagctgagccaaagcggctacgagggtgctgtggtggcgcttcgcccaagcactggtgaggtgctggccatggcgtcatcgccaagctatgaccccaaccagatcgtggatccagcaaccgcagaggacgcttgggctgagtacacctccactgaaggtgcaccgctgctcaaccatgcaacgcaggaatcactgcctcctggatctattttcaagatcatcactactgcggcagctttggaaaacggctactctgctgattccaccgtgactgcagaggcagcagtgaccctgcctggcaccaacaccaccttgaccaactacggcggtcagacatgtgcgggcggtggcaccactaccctgctcaccgctttccagctctcctgcaatactgcgtttgtggagaccggcattgatgttggcgcggatgctttgcgcgcgtctgccgaggacttcggagtgggacaaacctacagcttgggactagataacgttcctggcggcttgggtgaaatccccgacgatgccgcccttggacaatccagcattggccagcgcgacgtgcaaatgaacgtgctgcaggccgctgtcatggcaggaaccgtatccaacggtggcgtacgcatggaaccatatttggtatcccgcgtcaccggtcaggacctgagcgaactgagcacccacaagccgaaatcagttggtggagtcgagccagaaattgcagaacagttgaagactttgatggaagcctcagagcgcaatacttcgggctacaccggaattcagatcgcttccaagactggtaccgcggaacatggtgatgaaaacacaccaccacacacctggtacgtggcattcaacaacgacattgctgttgctgtgttggtgaaagacggcggtggatttggcaccagtgcaactggtggtcaggtcgcagccccaattggccgagctgtgcttcaggcagccggaggattt

SEQ ID NO: 49 - DNA, 1143 bp, Corynebacterium glutamicum
atggcatgggtggcgccgtttgctgatcaaatcatgctgcctgtggtggcggtgctcaatggcattggtttggtgatgatttatcgccttgatgaggccacgggctacagcacggtcaatagccaattgatgtggacggttgttggcgtcacgctgatggtggctgtgttgttgctgttgcgtgattacaagtcgctttcgcgttattcctacctcctcggtgtggtgggcatcgtgctgctggcgctgcctctcgtgtggccgcagccaggcggcgtggaagcccgcatctggatttggcttggacctttctccatccagccaggtgagttctccaagattttgctgctgctgttctttgctcagctgctagccaccaagcgtgctttgtttactgttgcgggctaccgtttcctcggcatggatttccctcgtttgcgtgacctcgcgccgattcttgtggtgtgggcgttggctattttgatcatggctggcgccaacgacttcggtcctgcactgctgcttttcactaccgttttggccatggtgtacctggctaccggccgtggttcctggctgttgattggtgctgtgttggtggctgtcggcgcgttcgcggtgtaccaagtttcaagcaagattcaggaacgcgtgcaaaacttcgtggatcctgtggcccactatgacaccaccggttaccagctgtcccagtccttgtttggcatgagttggggcggaatcaccggcaccggcattggtcagggttaccccaacatgatccctgtcgtgcactcggacttcattctcgcagccattggtgaggagcttggtctgattggcctggcggccatcatcgtgctgtttggtgtgtttgtcacccgcggtatgcgcaccgctaccctggctcgtgacagctacggaaagctcgtggcatctggtctgtcgatgaccatcatgatccagattttcgtcgtcgtggcaggtatttcttcactgatgcccatgacaggtttgaccactccgtttatgtcccagggtggttcatccctgatggctaactacattctgatggccatcatcttgcgtatttctgacagtgcccgccgacctgtcatgtccaagcaagcatcggaggtggctgcg

SEQ ID NO: 50 - DNA, 1353 bp, Corynebacterium glutamicum
atgttgaaacttaaatatgcggtggcatctgaccgagggttagtgcgcgggaacaatgaggattccgcttacgctggcccgcatttgttggcgctggctgatggtatgggcggccatgctgctggtgagatcgcttcccaaaccatgatcaaccatttgcgtgcgcttgatgttgatcctggtgataacgatatgttggcgctggtgggcatggtggcaggcgaagccaacgcggcgattgctgagggcatcgccgaagacccggcgcgcgacggcatgggcactacgttgacggcgttcatgtttaacgggcgtgacctggcaatgtgccacgtcggcgatagtcgtggttatgtgcttcgcgacgataagttggtacaggttacagtcgacgatacttttgtgcagtcgttggtcgctgagggcaagcttgatccagaagatgtttcaactcaccctcagcgttctttgattctgaaggcttacaccggccatcctgtggagcccactctggagcaattcccggccttgcctggggatcgtttgttgttgtgctctgatggtctatcagatccggttacacactccacgattgaagaaacagtgcgtgtaggcaccccgcaggatgcgtccaccaagttggtggagttggcgctgcgttctggcggtccggacaatgtgacggtcattgtggccgatgttgtagaagtcaccgaggcggaagcagcagcggaagcatcagtgcctgtcacggctggtgcgctcaatggtgagcagcctgaagatccgcggcctgataccgctgcgggacgcgctgcggcgatcacacggcgagctcaagtgattgatccggcaccaaagatatctgatgctggaacggaggatattcccacaattgaggagccaccagagaaaagttccagcaaacttgcggtattgatcgtagccctggtcatcctcatcggtgtagttgccgcaggatggtggggctactcccgtattgacagcactttttacgtcgcggtcaatgatgaggaagccatcaccgtggaacacggtgtggattaccgcatctttggcaaggatttacattcgcaattccaggtggcgtgcctgaatgaagctggcaccttgtcactcaaggaatcctgtgaaaacggtacgtctttcaaattggatgatttaccggcatctgttcgcggtagtgtcgcaggattaccgtctgggtcgtatgacgaggtccaggcgcaaatgcaacggctggctgctcaagctttgccagtgtgcgtgaacttagaagtaacaaccggtggcgatagaaacgaacccggagtcaattgtagggaggtctca

SEQ ID NO: 51 - DNA, 462 bp, Corynebacterium glutamicum
atggattctctggtccttcttgggcttcgcatcgctttgcttgtggtgttgtggtttttcgtcttgatggcgctgcgcgctatgagggcagatttgaaagtgacgggtcaagcgtcgacaagcagctcctccgtcgcggcaccgcagggccttgcccgggcttttaatcgctccagcccgcctcgtcttttgacggtggtcgagggcccgttggcgggctcctcgattgaggtgtcggaggatatgacgatgggccgtagccctgagtgcacgtttgtggtgggcgatgattacgcctccggcatgcatgcgcgggtgtttaagcgtggttcggagtggtttgtggaggatctggattcgcgcaacggcacttttgtcggtggtacgcgcattgatcagcctgagcagattgcggtgggcacggatatccgtattggtcgtacaacagtgaggcttgttccc

SEQ ID NO: 52 - DNA, 864 bp, Corynebacterium glutamicum
atgaacagtttggccaagctggacagttctatgcaacgcggccttgataatgcgttggcgtttgttttccgtggtcgcgttgttccggctgagcttgaggagcttttgaagcaagaggctgaggacaatgtggttcatactgagtttggctatgttgaggcgccgaatgtttttaaggtttcggtgagcccgaacgattttagtaatcttgtcgatcgttttcctgatcagccggctcgttttggtgatcagatgatgaggttctgcaggaacagtggctggacgttggttgggccggtgattgtgttgattgaagaggattcttcgttgcacacgggccagttgaagtcggtttcggagaaggatccggatccggagttaagtagcggttatctgcctttggaaggcgacggcatcctgcctgtcgcagaaagtgagtctaagaacgtgtctgacagttccccttacactggtacggagtttttgccggcgcaatcagcggatcgccctttggttcagggtgtgccgcagtctcaggttgatgcgaatcgccaggctgcgatgaagcccgcgggccctacggtgactttgctgctgcaggatggttcgagccggacttatttggttcgggagggttcgaacatcattggtcgtagtaatgatgcggatcttcgtttgccggatactggtgtgtctcgtcagcatgtggagatcacgtgggatggccgggatgccattttggttgatttgaagtcgactaatggcaccacggtgaatgacactcctgtggataattggttgttggctgatggtgatgtcattacggtgggtcattccaatatcgaagttcgtattgttagtccc

SEQ ID NO: 53 - DNA, 147 bp, Corynebacterium glutamicum
atgcatcccggtggtttggcctataactctggcgccgttcacctctataatgacgctatcgtgcgctttggtttagaccgtgtgaaggtttttctaaatggaatttcagtcacagggagggacaaagccatgcccttaggcgttttc

SEQ ID NO: 54 - DNA, 720 bp, Corynebacterium glutamicum
ttgattcatgagcaagacgttcagaagctgttaaactacatcacttcacactttggtgttgaccctgaaagatggtttcatcctgaaggctaccaaagcattgccctagcgattcttgactccatttactcgactggtaatcgctatacaggtgtactcaaccttgtcaatcgatactgcgggctgcgcgcaaatgaaggatcacaccctgaagccgatactgccactgatctcatcgagacattctaccggtggggaggggtcgacgaatttgttctcaaaacgaataatcggtggagaacttcctccaagattcacgcaccctataaggcatacgcagctttggaagcagcaaaggtacttgcgggtcattccatcgaatccatcagcgatgttgtcggcaggttcgattcgcgcgaaagccgtgaacactcagatatcgcgagagaatggttgatgataaccggccaaagtagtgcgttgacctggagttacttccttatgctcgtaggtgtcccaggagtgaaagcagaccgaatgatcgtccgtttcgtcactcacgtgctcgagcgtccgaaagagatttccaggcacgaagcttcacggttgattgaggaagttgcggacattatgtgcgtcaactacatctacctcgaccacaccatctggcggttccaatcagggcgcccctacctccaagaagactcctcccctttcgaa

SEQ ID NO: 55 - DNA, 219 bp, Corynebacterium glutamicum
gtggatgtagccagcttcaaatttgaataccccttgaggctacctactaggggatatcacttttccaagaaagattatttttctccatacttcatttgggtctttggatttgaagagcaggtttgcctttctgctgcactcgccactcttagaagcgaaagcgatcaaagtgtaaacgaagccatcagcgcaaaacaagacacgcaacttagccagaaa

SEQ ID NO: 56 - DNA, 471 bp, Corynebacterium glutamicum
atgacttacaaagcagactatgatcttgactttgaaaaagtagtcttccgcatgtcacagctgtttgaagatctcatcccgtcagaaaacgcctacgacccatacaaaaaatcaacgtggccgactctgaccatggctgcaacatgggtacaggacgactgtctcatagttgtatttagggctgatccaagaagagttgcgccaatggatggtgcgactttcgtgggctacttttgcaagatttacccccaatacattcctgacaatatcgaatttggggcagtagagctaatgtatgccgactggatggcaggtgatgggtttatttggaagatcgatctcaaggctccgcaaaagatacattggagaaatgcattcgatggtctaaaagctccggcagatttagaggaattattggactacgccgcggagattccgatgtggttaaacccggaaattgaaaagtggatg

SEQ ID NO: 57 - DNA, 954 bp, Corynebacterium glutamicum
gtggggactttggcaagtagttcggagacattaatagtcatgatgcgttattttccttcacttttcgtatccagcagcgttgagttgctggacatcggcaccgactcggacaaagttggcgccggcgtcgaggtagtcctgtgcttagttcaaatcaaaggcattgacacccacaggtttaccagcatcacggaaagtttggatggatttttactccggccacaacgtctggctggaagctcagccacgtgctttctggtcgtgcgccacgacgagcactacccagctgcggcaaacctcattgctttcgataagggatggtccaccctcatcgcccctcagctggaagatccagaggcggaggagttcaccgccggattcctcaccgaataccaggacaatctgatcactgcgggcatggagcaccaggcgctcgcgagcggcttcccggtggggcgtcgcttcaagtccgatattgctttacgacgctgcgatgcggtgaccacccacatcggccacgaacactccgccgatggtcactggaggatctacgtattcgctggccaagccaccccacaagattccgagtctgcactgaacaagtgggcgcagtggatggaggaaagcgaagactcaccactcaaccgcttcaccccagaagccggcgaccgcaacgcagtcttcgatatcaaggctacctaccagcagcattaccactccttcgacctgttcgatgcgccagaggtcttcttcccacgagttggaccatacaagctgcaaaacctcgaaaacgtttggaccgcactggattcccaagacatctttgagtcccgtggcatcagtcgcgatggcgcaattgttgtcgttcgcccagaccagtacgtcgcagcagtcctcccactcgaagacaccgcagcactggctgagttcttcaatggcaatctgcttgagcca

SEQ ID NO: 58 - DNA, 1470 bp, Corynebacterium glutamicum
atgactattaatgtctccgaactacttgccaaagtccccacgggtctactgattggtgattcctgggtggaagcatccgacggcggtactttcgatgtggaaaacccagcgacgggtgaaacaatcgcaacgctcgcgtctgctacttccgaggatgcactggctgctcttgatgctgcatgcgctgttcaggccgagtgggctaggatgccagcgcgcgagcgttctaatattttacgccgcggttttgagctcgtagcagaacgtgcagaagagttcgccaccctcatgaccttggaaatgggcaagcctttggctgaagctcgcggcgaagtcacctacggcaacgaattcctgcgctggttctctgaggaagcagttcgtctgtatggccgttacggaaccacaccagaaggcaacttgcggatgctgaccgccctcaagccagttggcccgtgcctcctgatcaccccatggaacttcccactagcaatggctacccgcaaggtcgcacctgcgatcgctgcaggttgtgtcatggtgctcaagccagctcgacttaccccgctgacctcccagtattttgctcagaccatgcttgatgccggtcttccagcaggtgtcctcaatgtggtctccggtgcttccgcctctgcgatttccaacccgattatggaagacgatcgccttcgtaaagtctccttcaccggctccaccccagttggccagcagctgctcaaaaaggctgccgataaagttctgcgcacctccatggaacttggtggcaacgcacctttcattgtcttcgaggacgccgacctagatctcgcgatcgaaggtgccatgggtgccaaaatgcgcaacatcggcgaagcttgcaccgcagccaaccgtttcttagtccacgaatccgtcgccgatgaattcggccgtcgcttcgctgcccgccttgaagagcaagtcctaggcaacggcctcgacgaaggcgtcaccgtgggccccctggttgaggaaaaagcacgagacagcgttgcatcgcttgtcgacgccgccgtcgccgaaggtgccaccgtcctcaccggcggcaaggccggcacaggtgcaggctacttctacgaaccaacggtgctcacgggagtttcaacagatgcggctatcctgaacgaagagatcttcggtcccgtcgcaccgatcgtcaccttccaaaccgaggaagaagccctgcgtctagccaactccaccgaatacggactggcctcctatgtgttcacccaggacacctcacgtattttccgcgtctccgatggtctcgagttcggcctagtgggcgtcaattccggtgtcatctctaacgctgctgcaccttttggtggcgtaaaacaatccggaatgggccgcgaaggtggtctcgaaggaatcgaggagtacacctccgtgcagtacatcggtatccgggatccttacgccggc

SEQ ID NO: 59 - DNA, 1467 bp, Corynebacterium glutamicum
atgagtgaacctgcgcttgaactataccccctggggtattactgtagattctcaataccccgaggggtatctagtttttacgttgagaaggagagctcagtgcttattgaacgcatctacgacgaagaccttgcgcaggccagctatttcattggctgccaagcccacaacaccgcagtcgtggttgatccgcgtcgcgatattgccgtctatctggacatggccaagaaaaacggaatggagattgttggagttaccgaaacccatatccatgcggactatttgtcaggaacccgtgagttagctgctgcaactaatgccaccatgtacgtctcaggggagggcggcgccgattggcagtatgaattcgacgccgagcgaatatgcgacggcagcgagattcgcctgggaaatctggtgctcacagctgttcacaccccaggccataccccggaacacttatcgttcctgctgaaggacggcgcgttcgcagatgagccaggattcatgctcactggcgatttcgttttcgcgggtgatcttggccgaccagatttgctcgatgaagcagctgggggagtggacactcgttttgagggggctcgccaaatgttcaagagcttgaaggaaaaattcctgacattgcctgatcacatccagatcttccctggtcatggttccggttccgcgtgtggcaaagccttgggttcggttccttcaacaacacttggatatgaacgtcaatttgcgtggtggggaaagtatctggaggcagatgatgaacaaggattcattgatgagcttctggaaggccaacctgatgcacctgcatacttcggcaggatgaagaggcaaaataggcaagggcccgcaattatgggcgctcgcgagctgttgccacagctggaagcttctgatctgcacgacgtcattgttgttgatacccgctcagccgatgaagttcaccagggcactgtagctggtgcagtgaatattcctgcgggcaattcgatggcgaaatttggctcgtggaccgttgatcccgagaaggattcccgagctttggttctgctcgcggcaagccaaattggtgccatggagatgtgggaccacatggttcgcgtgggaatcgataatgttgctggttttatcaccaactttgatggggtggacctagttgcaccgcaaactgtgtccccagatcagctggatgaattggaatacgatctacttcttgatgtccgcaaccgcagtgaagtcgaagaaggctacatcccaggagcactccatattaatggtgcatccgtgctgtggaatctggagaaactgccacgtgacggaaagatcgtgagctactgcaagagtggaacacgcagctcaatcgccgcaagcaccctgcgtaatgctggttttgatgtggtggaacttcaaggatcctatgacaactgggtccggcacaacgcacaa

SEQ ID NO: 60 - DNA, 789 bp, Corynebacterium glutamicum
gtgcgtggtaccaaaacaatctgccgattaagtaggaagtccccaatgaccgccgttttgctcctcactctttttctatctctttttattggcatttcgctaggactgttgggcggtggtggttcgatcctcactgttccaattctgacgtatgtggcggggttggagcctcgtgaagctattgccgcctcgctgtttattgtgggcacaacgtcgctggtcagtgccattagtcacgcaagaaatgggcgggtccggtggaagactggcctgctgtttggtgccgcgggcatggttggcgcgtttggcggtggcgttctcgggggctacattcctggcacgattttgatgatcgcgtttgcgctcatgatgatcgccacgtcgactgcgatgttgcgggggcgtaagcagaagaagggggcgtcgaaaagctctctttggcgcgtccttgttgatggcctggtggtcggcgcggtgaccgggcttgttggtgcgggcggcggctttttggtggtgccggcgctggcgctgctcggcgggctgtcgatgccggtggctgtgggcacgtcgttggtggtgatcacgatgaagtcgtttgcggggcttgccgggtatctgaccagcgtgcagctggattgggggctggtgctgatggtgactgcggccgccatcgtcggttcgcttgccggttcgcgccttgcggggcgcgtgcctgagactttgctccgcaaagggttcggggtgttcgtgctggtcatgggcgtgttcgtgctcggcttggagctttta

SEQ ID NO: 61 - DNA, 291 bp, Corynebacterium glutamicum
atgtctatcaccattactgaaactaacaagcgccgaaatttggatcagatcctggatgtgcgcgaaaattttgaaattgccgagggcataatccccgaggcagtacatattcccatgggtgagctcaactttcgcttcaaagagctagatcagaatcggccggtcattgtggtgtgccgcagcggtaaccgcagtacacaggtggcaaatgcacttaaacaggcgggatataccgcgtactctatgactggcggaatgagtgcgtggtaccaaaacaatctgccgattaag

SEQ ID NO: 62 - DNA, 591 bp, Corynebacterium glutamicum
atgacttccgctcaaccgattacttccgtagatgcacagactctaaaatcgtggatcgataagcatgaaggactcaccgtcattgacgtccgcactgcacatgagttttcaaatttgcacattaaaggctcttacaacgtgcctctaactacacttgctgagcattccgaagagatttcctctcgtgttggagaacatgttgttttggtgtgtcaatccggcattcgagcaggtcaggcacaacaaaagctggcacctttgggaatttccaccgtggctgttttggagggtggcatcaatagttttgctaaggctgacggtgatgtggtccgcggaacccaggtgtgggatatcgaacgtcaggtgcgttttgccgctggatcattggtgctcgcagggcttgcgggaggtaaattcctttcaccaaaagttcgcaccctgtcgggaattattggtgcgggtctgacattttctggcgtttccaacacctgtgccatgggcaaagctctgtccgccttgccgtggaataaaactaagccagttcctaccgaaaccgagacattgagcaagcttccaagccctaaggagaac

SEQ ID NO: 63 - DNA, 174 bp, Corynebacterium glutamicum
atgcttgatgaaggcgaagactgtaaagccgtagtcacccaacttgccgcagtcacaaaagcgctggacagggcaggcttcgccatcattgccacaggtttggaacagtgcctcaccaaccctgatggcgacatggacaaaaaggaactagaaaaactgttcctgtcgctggct

SEQ ID NO: 64 - DNA, 855 bp, Corynebacterium glutamicum
atgagaactgtttttcaattggtgcaggatttccacaaggaagctaggggagaggggcttccaatcaagtggggtccatcgcgtggagaatttggcatgctggagtttcctgcagatgtcattcccgagaacatcaaacacattgcgcagacaaagttccagactgaagcaacttcggtggaggatattcgtcgtgcgattaacctgctgagtgatcaggcggagcgtgcgggtgcgtcctttaatcctggtttcattcttgcgcaggtgggctccaccatcgtggaggtttatggcggtgctccggttgcttggctggatgcggttgagctgttgattagtcctgatgtggagtgggttggggttcatggctcaaggaagctcgatattaatgtcagcggagaattgtccggggtgatttctgctggtgacaagttgggtgaactgcttggcgatgattggacaatcaacattgttcacggcgagtacaaaatccagatcgaagatgctcgaccaagtactgcattccttgcggacgcgactgaactgattaatcaggcaaactctgagattgttccgttccatgttcggatgctcagcaactcgaaaattgtgatgtctggctttagtgattattcactagcgggtgatgcgattacatctgcgggaaaactggctgaattggcgaggccttttgcccactggaaagaaaacgtcattcctacgatagaaatagccatggactatgaaccatcaccggtggcagatctttggcagggagattcttcggagacacctgagcctttcgacgattttgagcgcttattgcgggaagaaatgcttattcctgagatt

SEQ ID NO: 65 - DNA, 840 bp, Corynebacterium glutamicum
atgcttattggcatgagcaatcaaacagtcaatcaagcagtgtcgtcaggggtgaaagcatccccgcacaggttcaatcgttttgaaatcaaatacttgattacagagcaagatgtacctgcactccgcgagcagttggcaacgaggatgagcacggatccgctttccccacccggaggctaccgagtggaatccctttacttcgattcagccgatttacggtgctacaccgaaaagatcgagggtctgaaattccgaaggaaactacggatccgtacctacggtgatggagtgctcactccagaatccaccgtgtcggtagagatcaagcagcgggttaacaaagtaactcaaaagcgtcggctggatttgccctttatatatgcgctcgccctgggcgatagcacgggcgccgcggtaggcgagcaggtggacgtcgagaagcttcttgaaatctctccggaaaaccagcacgctttgattcacgaaatggcgtcgtttgctaaaaattatcggctgcgacccatcgccaccacgaagtatcaccgcgaggcattcgtcggcgctgatgcggaggaaagttcgcgagtcaccattgaccacggtgtttcaggccgtgatcgtgattttctgcttggccaagaccttgaagaccgcccaacggtggcgcaaggattggcagtcgtggaaatcaaatgcgatgaacgcgtgccgttttggctcactgatatgactgctcaactggaaatgtccgtgattcggatgtccaaatactgcgaaaccatcgaagcgtttcacaaccgtccggcatcagctttcggcgctgtcgaccccatcttc

SEQ ID NO: 66 - DNA, 711 bp, Corynebacterium glutamicum
atgttgagcgatctgagctccatttttgacttccaagacctctccggcaccttctctgtcgtcgacgttctcatcactttggtcttgtccttcgtcctgacctccatcgtgggtgtggtgtaccaaaagacccaccgccacatctcctacagccagtcattcgtacaaacgttggtgctggtgggaatggtcattgcaatcatcatgctggtggtcggctccaacattgcacgtgcattcgccctggttggcgcgctttcggtgattcgattccgcaacgcagtgaaagaaacccgagatgtgggcttccttttccttgccatggcaatcggcatgacttgcggtacccgcttctacgttctggcgatcgctgcaaccatcgttgtctgtggcgttctgttcatcatgtaccgcttcgactggttcaaggctgatatccagcgccaggtcatcaaggtgcaggtcccagccgatggacaagctgattccggcaggtcctacgcagaagaagttgaactgatcctcgcacagtactgcacttcctttgagatgatgtccgctgaatctgtccgcggcggagccctgaccgagttctcctacaccgctcaaatgcgcaagaacgtgaagccacatgagctggtcgccaagatgcgcgatgtgaactacggccaaaaagcgactgtcctgaccggtcacgatcaaacggatgta

SEQ ID NO: 67 - DNA, 1653 bp, Corynebacterium glutamicum
atgcctagctttaaatctgctcgatggaggatgaacagacgcctcttcctaggaacttccgcagctatcatcgctgtcggtggcgtgctcggtggagtgcaggttgtaccttatatttcctctggtgaaatccaaacgtcagcatcatcgactgccacgatcgatgtcggtgcaggcaatgtcgatatttttgatacctccgtttcccatgaaatcagcctgcaggtttcgcaggaaagcctcgatgagatgctcgcggactatcaagaagacggttccaaaacctgggtgaaagcaaccatcacgattgatggcgtgaccattgaaaacgtcggcatccgcctcaagggcaactccacgctgtccgggttgggtcgaacatctgaagaaggcggacctcaggcaccagaaggcgtcgaagagtttacagatctcagtgaagaggaaatcgcccagtttgaggaacagttcgcggcgcagcaagagactactgacgcttcagagaccggtgaaactgcggaaaatgaagagactcgcggccccggcggtggcatgggtggtggcggcatgggtggcatgacttcggtcgatgccgacgatgtcagcacctggccacttctgatcagcttcgacaaatacgaagacggccgcgtctaccaaggcatgacccaactggcactacgccccggcaccaccgtggtcaacgaagcaatggcgctggccctgaccgcagaaaccggccaggtctcgcagcaatccagcttcacaacgttttcgcttaacgacgagccctccaccactcgactccttttgaagcaccccgatgaaaattatgccgacgcgctcggcaacggagtcctcttcaaagcagattccaacagttccttcacctaccaaggcgaagaccaaactgaatacgacggacagttcaagcagatcaacggtgacggcaacggagacatccaaccgatcatcaacctgctgaaatggctcgacaccgcaagcgatgaagagtttgctgaacacctctctgactacgtcgatgtggaaagctttgctcgctacgttgccactcaaaacctgttggtaaattccgacgacatggctggtcccggtagtaattactacctgtggtacgactacgacaccggcctgatcagcgtgatctcttgggatttgaacctcgcaatgtccggctcaactgatgctggcccagatgatgaaatctccatgggcggaggtggcggtggcggaatgcgtcctggtggaacgaccgacactgaaattgaaggtactgcgaccgaggatatgcctgacatgggcaatatgcagcaacgtgaacgccctgaaggaatgccagacatgggtgagatgcctgatatgggtgaccgggaaggcggtggatcgatgggaggaaaccagctcaaggaacgtttcctcgcttccgatgcattcacggaaatctatgagcaggtgtactgggagctgtatgaagaaatgtatggttccggaactgccatcgagttgttggatgagattgcagcgtcaattccagaaactgatgcggtgactgcagatgagatcgctacggaagtggcgtcaatgcgggaatggatcactgcccgcacagaagcgttggctgctttgcaagag

SEQ ID NO: 68 - DNA, 1119 bp, Corynebacterium glutamicum
atgccaaagaattacgacatcaacggggcgatccgcagacgggatatgctcagacgtcggtaccttcctgattcggcaaattcaactcctgtacctgaagaggtttctccgctgacccgctatgtcaccgacggcatcccgaagcgcccaccgctgggtgccactgttgctgacggtttaaaattcgccgaaggcgcctccaaccgcatggtcatgtcgctgtaccctgcgccatccaagcccgcaatcgaggaattggcagaggcctgggacctccaccccaccatcgtagaagacttgctccttggtcagcagcgcccaaaactagaccgctacgaagacatcatttttatcgcgatccgctccgcgcgctacatcgactcccgcgaagaggtggacttctccgaattccacatcctcatgaagcctcaggccatagccattttgtgccaggataaccaatggattgacggcaccagcgccgccagcttcagcaaccccgaggagatcgataagcgcataaaaacattgcttgccgacgccgagttactctcgtccggcccccgcgccgtggcctataggcttgtcgacgccatcgtcgacggcttctcccccgttcttagaggcatcgccatcgaccaggaacagattgagcgccaggtgttctccggcgacgccgccgtcgccgaacgtatttacaacctgtcccaagaaatcatcgacatgcagcacaccaccagctcagttaccgaagtggtgcaacgcctcaacaaagacttcatccgaagtggcatgtccgaagaactccgcgcctacctcgacgacgtcgccgaccacctcacccgcgacaacacccgcgtctccgaataccgcgaatccctatcccaaattttgaacgtcaacgccacccttgtagcccaacgccaaaacgaagacatgaagaaaatctccggatgggccgccatcatcttcgccccaaccctcgtgtcctccatctacggcatgaacttcgacatcatgccagaacttcactgggcgtttggctacccgttggctctcttagcaatgctcggattcaccctccttttgtactggatcttcaaacgcagtaagtggatg

SEQ ID NO: 69 - DNA, 447 bp, Corynebacterium glutamicum
atgcctacttatacttgttggtcgcaaagaattcgcatttctagggaagccaagcaacgcatcgctgaggcaatcaccgatgcccaccatgaattagcgcatgctcccaagtatttggtgcaggtgattttcaatgaggtggagcctgattcttatttcattgcggcgcagtcggcgtcggaaaaccacatttgggtccaagcaacgattcgttcggggcgtacagagaagcaaaaagaggaacttctgcttcggctgacacaagagatcgcgctgattcttgggatccccaatgaagaagtatgggtatatataacggagattcctggttccaatatgacggaatatggccgtctcctcatggaacctggcgaagaggagaagtggtttaattcgcttcccgaaggcctgcgggaaaggttgaccgagctagaaggatcgtcagaa

SEQ ID NO: 70 - DNA, 1269 bp, Corynebacterium glutamicum
gtgtcaaccattccgctgaatcgtctagccgttatcgctgccatcattggtgtcggtaccgggctgtttgttgctgcactgaactggtctgccattggcgtggagcgtttagtttatggcgctgaccatttgcataattacaatccggtggccaatgtgtcgccacttcgcctgtccatcacggtgattgtgcttagcgtggtggcctcctgggcgtggttttttgtgcaccgcacggggccgaaagaggtttcgattgtgggtgcgatccggggcgagaagatgccgattttggagaccatagcgtccgcatttttgcaggtcaccacggttgctgcgggtgcgccggtgggtgcagagaacgctccacgtattgctggagccttggtgggagagcggtttagtcggtggttgcagctcgatattgatgcaaagcgcatcttggtggcctctgccgcgggagctggtttgggagcaagcttccaccttcccctagcaggcgtgctgtttgcccttgaggtcctactggttgaggcctccactcggaccgtggttatcgcaattatcaccacgaccgccgccgttgccaccactggatttttcgtgcaaaccccagatgtgttcagcactgtcccgctgacggaaagcccatggatgctgcttgccgcgatggtcaccggagtagtcgccggcatgtgcgggcactggttttcagcggcggcgcacaaaatggcgcaggcctcgcccaagggtgtgaagattttgtggcagatgccgttgggtttcgtggtgatcgctgcggtgatttatttcttccccgaaaccctggcgaatccccgttggcttgccgattccatgctcggcgatggcctgatcctcagcaccattttattggtacttgttctgcgcaccgccatgtttttgctcgccttccgcgtgggcatggtcggcggtaacctgatccccgcattcgcactcggatccatggtcggtggggtagtgggtgctgtattggaacccatcactaacgtcccgatcgccgcttttgcgctgcttggcgccgccgcatttttgtccaccaccatggcagcgccactgttcgggctcatcgccgcagtggaattcaccgacatggaagcccaaggctaccttccgattttcctcgcagtagcctccgcggtcctcgccgtgcgcgtgtggtctgtcatcgccaagcacgagctccgcgccatcccgatcacgtacgcgagctggacgggcgagcttaaa

SEQ ID NO: 71 - DNA, 690 bp, Corynebacterium glutamicum
atgaatcctataaccgaattattagacgcaacactatggatcggcggagttccgattctgtggcgcgaaatcatcggcaacgttttcggattatttagcgcgtgggcaggaatgcgacgcatcgtgtgggcatggcccatcggcatcataggcaacgcgctgctgttcacagtatttatgggcggccttttccacactccacaaaacctcgatctctacggccaagcgggtcgccagatcatgttcatcatcgtcagtggttatggctggtaccaatggtcggccgcaaaacgtcgcgcactcaccccagaaaatgcagtagcagtggttcctcgctgggcaagcaccaaagaacgcgccggcattgtgattgcggcggttgtgggaacactcagctttgcctggattttccaagcactcggctcctgggggccatgggccgacgcgtggattttcgtcggctcaatcctggctacctacggaatggctcgcggatggacagagttctggctgatctggatcgccgtcgacatagttggcgttcctctacttttgactgctggctactacccatccgcggtgctttacctggtgtacggtgcgtttgtcagctggggatttgtcgtgtggctgcgggtgcaaaaagcagacaaggctcgtgcgctggaagctcaggagtctgtgacagtc

SEQ ID NO: 72 - DNA, 1122 bp, Corynebacterium glutamicum
atgctggatgagctgcgtgagatccatggggatttgtccaagccactgccaattggcgatgaaggcggacacatccatgttgagctgaatcaccaaaacacggggtccttgcccgtgggattccgccttggtgacaatgacacccgcatccttgcagtggccaagaatctgcaggaagagggccacaatgtggttctggtgtcgaaggacctgccgatgcggattaaggcgtcggcaagcggaatcgccgcacaggaataccgcgctgccctggcgcgcgaccgtggttacaccggcatgacccacgccaatatcaccgatgaccagctcagcgagctctacgacaccggcgaggtgcgcattgaggagctcgaaaagctgcccgtcaaccacggcttcaccctcaaatccaacagcggttcggcgcttggtcgtatgaattccgacaagatcatcgagcttgtccccggcgaccagcaggtattcggtatcagcgggcgtagcgctgagcagcgggttgccattgatttgcttaacgacgacgccgtcggcatcgtatccatcggcggccccgcgggtacaggtaaaagcgcactcgcactgtgtgccggcctggaagctgtgatggagcgtcgcattcagcgcaagattatcgtgttccgcccactctttgccgttggcggacaggaacttggctacctgcctggcgaccaagaagaaaaaatggggccttgggcgcaagcggtttttgacaccctaagctccatggtcagccaaaacatcatcgatgaagccctctcccgcggcctcatcgaagttctcccacttactcacatccgcggacgctcactccacgatgctttcgtcatcgtcgacgaggcccaatccctagaacgcaacgtgttgctcaccatgctgtctcgcatcggccagaattcccgagtagttctcacccatgacgtagcgcagcgcgacaacctgcgcgttggtcgctacgacggcatcgtctctgtggtggaagcactcaaggatcacgaactgtttggccacatcacgttgcagcgttccgaacgctcccgaatcgctgagttggtcacccaagttttggatgcgccgtctctg

SEQ ID NO: 73 - DNA, 132 bp, Corynebacterium glutamicum
gtgcaagattggcctctgaacttgcaaaaatccaccacgttttggctgatcagagcgatttgtggtgaatcctcaccattactgctgtcgaaggtgggaaaggttgaggagcgccaagactatcgagctcac

SEQ ID NO: 74 - DNA, 384 bp, Corynebacterium glutamicum
atgagcaatcgtgagtacggcctaggattccgcagtttcattgttggcatcattttcgctgcggtgtggcttgttttcactggagcaaatgagttctcccagatgcaagttatcggagcttgcaccaacttcgtcctaatttgtgccgcactcaccttttggggctataggcagcgattaactgcgaagcgggtaatcactagagtttcggctggcctcacacttgccatcggcgctgcattcgccgccatctcggccccctttgatgagacaggcctttggggagtcgggcttatcttcatcgctattggttcatatgcgggcgctgccctagtgagctcgatagtcttggcgctcctcaacctttcccaccttcgacagcag

SEQ ID NO: 75 - DNA, 765 bp, Corynebacterium glutamicum
atgacggtggtgatccaggtagccatcgcgtcgaccatgccggtgccgctgaggacgccgactaggacgcctgcggcgagaaccatggagacaacgccgacgatgctggaagagtgcgccagcatttcggttgcttggtccttgaccttagggaagttcactgcaagtgccagtccggcgccagccatgaagacgaaggccagtgggaagatatcggcaaccaggagaaccatgacgaccagggtcaggactgcgttgaaccagaacagcttcggtcgaagtgttgcgcggtgtggatcgagcagagtgtcggtcatgttctcggtgagggtggagtcgtcgaggttgatgtgctgctcggtttcaacttcgcggtcctcaacaagtacgccaccagtaggtcctggctttggagcgtcctttgccttgcccagtccgccgaggcctgggaagcccttcttgttggagctggagcctgagcccgttcctgtttctggggcgtcgagtcctggcccaccgaagcgggaggagtcaatcttgcccaggcgcttgcgctcggagagaccgaggaaccatgcgaacagcaggcagatgacaacgccggcgatgagggaaggaaccattggtacgaaaacatctgctggctcgaggccaagtgctgcggctgcgcggacggttgggccaccccaaggaaggatattcatggtgccgttgatcaggccggcagtacaggtgagaaccacagggctcatgccaaggcgcagg

SEQ ID NO: 76 - DNA, 1467 bp, Corynebacterium glutamicum
atgatcctcaccttcatgaccctgatcatgctgggtcgactcaccccaatggtggccatgctgttggtccccaccatcttcggtctcatcgccggcgcaggactcggccttggtgacatggcgcttgacgccatcaaggacatggcgcctaccgcggcactcctgatgttcgcgattatgttcttcggaatcatgatcgacgtcggactcttcgaccccctgatccgcgtgatcacccgcgttcttcacgatgaccccgcaaaggtcgtcatcggcaccgcagtacttgcaggtgttgtctccctcgacggcgacggctccaccaccttcatcatcaccacctccgcgatgctgcccatctacctgcgccttggcatgagccctgtggttctcacctgtactgccggcctgatcaacggcaccatgaatatccttccttggggtggcccaaccgtccgcgcagccgcagcacttggcctcgagccagcagatgttttcgtaccaatggttccttccctcatcgccggcgttgtcatctgcctgctgttcgcatggttcctcggtctctccgagcgcaagcgcctgggcaagattgactcctcccgcttcggtgggccaggactcgacgccccagaaacaggaacgggctcaggctccagctccaacaagaagggcttcccaggcctcggcggactgggcaaggcaaaggacgctccaaagccaggacctactggtggcgtacttgttgaggaccgcgaagttgaaaccgagcagcacatcaacctcgacgactccaccctcaccgagaacatgaccgacactctgctcgatccacaccgcgcaacacttcgaccgaagctgttctggttcaacgcagtcctgaccctggtcgtcatggttctcctggttgccgatatcttcccactggccttcgtcttcatggctggcgccggactggcacttgcagtgaacttccctaaggtcaaggaccaagcaaccgaaatgctggcgcactcttccagcatcgtcggcgttgtctccatggttctcgccgcaggcgtcctagtcggcgtcctcagcggcaccggcatggtcgacgcgatggctacctggatcaccaccgtcattccgaacgcaatgggccctcacctggcagttatcaccggcctgctgtccatcccaatgacgttcttcatgtccaacgacgccttttacttcggcatcctcccagtccttgcagaaagtgcttcccacttcggcatcgagcctgtggaaatggcccgcgcatccatcactggccagcccgttcacatgcaaagcccgctggtcccagcgatcctcctgctggtttccctcgccaacgtcaaccttggcgaccaccacaagaaggttctgtggcgcgcctgcatcgtgtccatcgcgatgctcgccgtagccctcttcatcggcgtcgtgccactcagcgca

SEQ ID NO: 77 - DNA, 1653 bp, Corynebacterium glutamicum
atgtctgttggtggatccgactggaaaaacttcaaggaggtggacatcattcgctttgctacccgaatactggtgattcaagtggctaccgtcgcgttggtggtagctatttgcaccggaattttcgcagttttgatgatggatcagatgaaaactgaggccgagcacacagcgctgtccatcggacgttcggtggcatccaacccgcagatccgcgaggaagtagcgcttgatactcaaacaggagcaaacccatcggccgaagaattagccgatggagatatccaagcggttgcacaggcggccaatgaacgcactggagctttgtttgtcgttatcactgacggtttaggtatccgcctgtcccacccagatgaggaacgtctgggggagcaggtgagcactagctttgaggctgccatgcggggtgaagaaaccatggcgtgggagactgggaccctcggtgcgtccgcgcgagcaaaagtgcctatctttgcgccggattctagtgttccagtcggtgaggtcagtgttgggtttgagcgagacagtgtgtattcccgcctgcccatgttcctcgccgcccttgctcttatttctgtgttgggaatccttatcggcgtgggtgtagccatgggcatgcgacgccgttgggaacgcgtgaccttgggtttgcagccggaggagctagtgacccttgtgcaaaatcagactgcagtcatcgatggcattgatgagggcgtgctggcgctgagcccaaacggaacaattggggtgcataatgagcaggcgcaatccatgattggtgcaggtcctatgagtggcaggacgttgaaagaactagggcttgacctgggtcttgatggcgttgtattgcatggtcagcatccggaaaccgttgcccataacggcaggatcctctatctggatttccaccccgtgcgccgtggggatcaagatttaggctacgtggtaaccatccgcgatcgtaccgacatcattgaactcagtgaacgcctcgactctgtgcgcaccatgacccacgcactccgcgcccagcgccacgagtttgccaaccgcatccacaccgcaacagggcttatcgacgccggccgcgtccacgacgcggcagagtttctaggcgatatatcccgcaacgggggacagtcacatccattgatcggatcagcgcacctcaatgaagcatttttgagctcatttttaagtactgcttctatttcggcatctgaaaagggcgttagtctgcgcatcaactctgacacgctcatccttggcactgttaaagatccagaagatgtagcaaccattttgggtaatttaatcaacaatgccatcgacgccgcggtggcaggtgaagccccacggtggattgagcttacgttgatggatgatgccgatacgctggtcatttctgttgcagattctggtcctggaatcccagagggcgtggatgtatttgccacagccacccagataggagactctgaagataatgaacgcacccacgggcatggcattggtctaaaactgtgccgggctttggctagatcacatggtggcgatgtctgggtgattgatagaggaaccgaagatggcgctgtatttggagtgaaactaccgggagtaatggag

SEQ ID NO: 78 - DNA, 570 bp, Corynebacterium glutamicum
atgccatgcccgtgggtgcgttcattatcttcagagtctcctatctgggtggctgtggcaaatacatccacgccctctgggattccaggaccagaatctgcaacagaaatgaccagcgtatcggcatcatccatcaacgtaagctcaatccaccgtggggcttcacctgccaccgcggcgtcgatggcattgttgattaaattacccaaaatggttgctacatcttctggatctttaacagtgccaaggatgagcgtgtcagagttgatgcgcagactaacgcccttttcagatgccgaaatagaagcagtacttaaaaatgagctcaaaaatgcttcattgaggtgcgctgatccgatcaatggatgtgactgtcccccgttgcgggatatatcgcctagaaactctgccgcgtcgtggacgcggccggcgtcgataagccctgttgcggtgtggatgcggttggcaaactcgtggcgctgggcgcggagtgcgtgggtcatggtgcgcacagagtcgaggcgttcactgagttcaatgatgtcggtacgatcgcggatggttaccacg

SEQ ID NO: 79 - DNA, 654 bp, Corynebacterium glutamicum
atggatcaaacacttaaagttttagtaattgatgatgatttccgcgtcgccggcattcacgcctccatcgttgatgcgtcccctggattttcggtggtcggtaccgcgcgtaccctcgcagaggcaaaaaccctgatcgccacattttccccggatctcctacttgttgatgtctacctccccgacggcgatggcattgacctcgtgggcacctccaatattgatgcgtttgtgctcagcgcagccgatgacatcaaaacagttcgacgcgccatgcgtgccggggcactcggatatctgctcaaaccatttccccaaaaacgtctcgtggaacgccttgaccgttacgtccgctaccgccatgtcttatccggcacccaaggactttcccaagacaaaattgaccaggcaaccgcaatcctcaacggcacccaagcgccggtcaccgtctctagatccgccacagagcaattacttctcgacgccctggaaggccaagaactctccgcaacagaagcttccgaagctgccggagtttcacgtgccacagcacagcgcaggctggcagcgatggctagccaaggtgtgatccaggttcgccttcggtacggacagtccgggcgaccagaacatctatattcaaagccactgctc

SEQ ID NO: 80 - DNA, 912 bp, Corynebacterium glutamicum
atgaaaatctttgttggttttggcgattatccactcaccaccaaggcccttaaggaggcaggcgcagaaatagtggactccctcgaaaaagccgaggggtttgtcttcactcaaacaccaggcacagaatttcccctacttcccgacggagtgaggtgggtgcaatttcccaatgcggggctcaacgcatatttcacagctgggcagattgatgacaaacgccggtggtcaaatgcatcaggggtgtatggccaacaggtagccgaagcagcaatggctcttttgctgggactgattcatatgcaccccaccatggtgcgtgccgatagttgggcaccaagcactcaaatagatcagcagaccagatggcttgatggtgcaacagttgccattgtgggagctggtggaatcggtaaacatctggcagccatgttgaaaccttttggcgcaaagtctttagcagtaagcaggaccggtacacccacccaagattttgatgcaacggaacctatatccaacctgcaccaagtacttgccgacgccgaccatgtggtgttgtgcgtaccgcttaccgcagacacctatcatctgatcggaaaagcagagcttaaagcaatgcagtccactgcaattttgatcaacgtggctcgcggagaagtagtagatacagaagcattagttgacgccttagatgcccaagaaatatccggggcaggcttagatgtcaccgatcctgaaccattgccggacgatcatccactgtgggggcgcagcaatgtgatcattaccccgcacgtagccaacacgttgacctcgatggatcgcatgcttgccccagtggtggcagaaaactaccgacggtttctcgctggagaaaagatgctgaccgaggtggacatccacaaaggttac

SEQ ID NO: 81 - DNA, 429 bp, Corynebacterium glutamicum
atgagcatttccaacgcaatcctgcgtggtgtgtctggcgcttatattctgcagtccggctacggaaaacttggattgcctaatgaggccgctgctggcattcagggtctagctgcaacgggtatcccagcggtggctgatatggattcagatactttcggtaagtttgttgcctactcggagttgggtatcggtggagctttgcttgctccatttatccctagccgtcttgcaggtttgggtcttggtgctttctctacaggtttgttggccatttacttccgtaacccagcgatgactcaagacgacggaatccgcccttcccaggatggaaccggattgtctaaggatcttttccttgctgctattgcgggtgctttggtgttcgcacctgctaagaagcgtaagaaggcgaagaacaagtctaag

SEQ ID NO: 82 - DNA, 1002 bp, Corynebacterium glutamicum
atgaccatccccggcaccatccttgacaccgcccgcacccaagttctggaacagggaattggccttaatcagcagcagttgatggaggttctcaccttgcctgaagagcaaatcccagacttgatggaattagcccaccaggttcggttgaagtggtgtggggaagaaatcgaggtcgagggcattatttccctcaaaactggcggttgccctgaagattgtcatttctgctcacagtctgggttgtttgaatcgccggtgcgttcggtgtggctggatattccgaatctggttgaagccgctaaacagaccgcaaaaactggcgctaccgaattctgtatcgtcgccgcagtcaaggggcctgatgagaggctcatgacccagctggaggaagcagtcctcgcgattcactctgaagttgaaattgaagtcgcagcatcgatcggaacgttaaataaggaacaggtggatcgcctcgctgctgccggcgtgcaccgctacaaccataatttggaaactgcgcgttcctatttccctgaagttgtcaccactcatacatgggaagagcgccgcgaaactttgcgcctggtggcagaagctggaatggaagtctgttccggcggaatcttaggaatgggcgaaactttagagcagcgcgccgagtttgccgtgcagctggcggagcttgatccgcacgaagtccccatgaacttccttgatcctcgcccgggcaccccatttgccgatagggaattgatggacagccgtgacgctctgcgctctattggtgcgttccgccttgcgatgcctcacaccatgcttcgttttgctggcggtcgcgagctgactttgggcgacaagggttccgagcaagccctcctgggaggcatcaatgcgatgatcgtcggaaactacctgactacgctcggccgcccaatggaagatgacctcgacatgatggatcgtctccagctgcccatcaaagtccttaataaggtcatc

SEQ ID NO: 83 - DNA, 237 bp, Corynebacterium glutamicum
atgaacgacgatctccaaatggccatgattctggcagacaccccgatctttcatccaaacaccggcaagcccttcgatggtgaacataagctgtcgccctctgcgcgagcaggtttggaagcaccccgttattgccagctctgcggtcggcgcatgaaagtccaagtccgccccgacgggtgggacgccttatgctcccgccacggtttcgtcgactcctcttatctagggcgccga

SEQ ID NO: 84 - DNA, 339 bp, Corynebacterium glutamicum
atgctcccgccacggtttcgtcgactcctcttatctagggcgccgataatgcgtggccatctcattgacggtgacggccgctgcatccactatcacggacccttcgacgtcgtcggcaacaaatgcgccacatgcaacgagtggtgggcgtgtcatcgctgccacgaggagattgccaatcatcctttcgggaagatgcttatcgacgccccgagctcccttcaatgcggccactgcggggagcttatggcctacggggtgcaaaaatgcccgcgatgcgggcataacttcaatccagggtgttcactccacactccgctgtactacgaaatgccctct

SEQ ID NO: 85 - DNA, 117 bp, Corynebacterium glutamicum
gtggtgggtcatgccgggtggtggatcgccaaattatccatcactgtaaacaataatcttattgttggcatgattttgtgggtctgcttgttccccgtcaagggactaggcccacgt

SEQ ID NO: 86 - DNA, 141 bp, Corynebacterium glutamicum
ttgagacagcagggaagtcgttacgccattcgtgcaggtcggaacttacccgacaaggaatttcgctaccttaggatggttatagttaccaccgccgtttactggggcttaaattctcagcttcgaaaaaacaagttttcc

SEQ ID NO: 87 - DNA, 273 bp, Corynebacterium glutamicum
atgcgacgagccgacatcgaggtgccaaaccatcccgtcgatatggactcttggggaagatcagcctgttatccccggggtaccttttatccgttgagcgacaccacaaccacaagtaggtgccggatcactagtcccgactttcgtccctgctccacctgtcagtgtcacagtcaagctcccttgtgcacttacactcaccacctgattaccaaccaagctgaggaaacctttgggcgcctccgttacattttaggaggcaaccgccccagt

SEQ ID NO: 88 - DNA, 1449 bp, Corynebacterium glutamicum
atgtcttacacatcttttaaaggcgatgataaagccctcatcggcatagttttatcagttctcacattttggctttttgctcagtcaaccctaaatatcggcccagatatggcaactgatttagggatgagcgatggcaccatgaacatagctgtcgtggccgccgcgttattctgtggaacatttatcgtcgcagccggcggcatcgcagatgtctttggccgagtacgaatcatgatgattggcaacatccttaacatcctgggatctctcctcatcgccacggcaacgacttctttagccacccaaatggtgatcaccggccgagttctccaaggactggcagcagcggccatcatgtctgcatccctagcattagttaagacatattggttaggtactgaccgccaacgagcagtctccatttggtccattggttcatggggtggcaccggattctgcgcgcttttcgcgggtcttgttgtagcaagcccctttggttggagaggaatcttcgccctctgcgcgatcgtctccatcgttgctattgcccttacccgccacatcccggaatcccgtccggctcaatccattggcatgcatttggattggagtggcatcatcgttcttgccctcagtgttctatctcttgaattgtttattacccaaggtgaatcacttggctggacgcactggatgacctggactctccttgccgtttctttgacatttcttgcagttttcgtcttcattgaacgcatcgccagctggccagttctcgacttcaaccttttcaaagaccacgccttcagcggtgcgaccatcaccaacttcattatgagcgctactggcggagtagttgccgttgtcatgtgggttcagcaaatgggatggggtgtctccccaacaatctcgggactcaccagcatcggcttcgcagcctttgtcatccttttcattcgagttggagaaaaggccatgcagaaagttggcgcccgagcagtgatcatcaccgctggcatcttggtagcgaccgcgaccgccctcctaatgatcaccgcggtcagcgagtcaacgtacatcgtcatctccctcgccggcttctccctttatggccttggcctcggactcttcgccaccccagtcaccgatactgcgcttggaacacttcccaaagaccgtaccggcgctggtgcaggtgtattcaagatgtcctcttccctcggcgcagcactcggcatcgcaatctccacttcagtgttcctcgcacttcgcgacggcacctccatcaactccgacgtcgcactcgccggaacagtttcacttggcatcaacgttgtattcgcagcaacagccaccatcaccgcagcagtccttattccaaaagccgctggcaaagtctcacaaaccagcatcacccttcctgagccagctatcgctgtaaaaatc

SEQ ID NO: 89 - DNA, 1245 bp, Corynebacterium glutamicum
gtgcgcattacaaacgcccaggttaagaactacgcagagttagttgatatcaccatagagggtgaaaaaatttcctcgattaccccctcttcaattcgatcagaagaagatcaccgcgcggacgattacgatgccgcaggaagactggtcgcaccccagttcgccgaagcacacatccaccttgactacgcaaacaccgctggaatccctcgcgaaaactcttccggcacactttttgaagccatcgaaatctgggccgaccgcaagacccaaggcttccacatcaaagaagacattaaagcgaaggccctccaggcagcccgtcgggcagcagaacacggcgttggtttcatccgcactcacgtagatgtcaccgatcccacgtttgctggattcgaagcaattgcggagctgcgcgatgaagtccgcgagtggtgcgatatccagattgtcgccttcccgcaaaatggcatttacgcctacgaaggtggccagaagctaatctcagatgcaatgtctgcaggtgcagatgtcgttggtggcatcccacaccttgaacccacccgagacgatggcgtcgagtcggtgaaatggctgttcgaccttgcagagaagcactcagcccccatcgatatccacactgatgaaattgacgatccacattcccgatttgtcgaagtcctcgccgcagaagccgcaaaacgtgacatgggcgcacaaaccgtggtgtctcattctgtggcgatggcctattactcacctggctacatggcgcgacttttacccaagctcgcagcatcaaaggttcgttttgcagtatgccccaatgaaaacctccatctgcaaggacttggtttccaaggacccgtcccccgaggtgttgcaccggtaaagcaacttaccgaatggggaattccagtaagtttttgccaggactcactcaatgaccccttctaccccatgggcgatggagatctactccgcattctcgattctggattacacgtgtcccacatgctcacagccagccacttgaagaatgcactatcgttcatcaccaccaatccagccggaaacctaggcctggacaattacgacattgcagaaaactccccggcgaacctgctggttcttgatgcgagcagcgagaaggaagctgtacagagaaaagcttccgtacttttgagcatccaccgcggcaaaaaggtgctctccagggagcccgaacaggtggactggaacatc

SEQ ID NO: 90 - DNA, 306 bp, Corynebacterium glutamicum
atgatcgtggaaatcagacccttgctactttggcacaagtggatacagcagcagaaagctgcggactcaaaggaacagttggggatgcgtcagccgtttctggagcagatgtctccggcggaaatgaagctcagcctaacggatagcaactggctggtgaaggcgaagcccccagaatcatcagttgaggtcagtggagcgggagacactccagacgcatccatcaccgatactgcagctgtcctcggaccagttacctcgaccacctcaaccccgatgaaaactatcgaggttctcggacaaggc

SEQ ID NO: 91 - DNA, 615 bp, Corynebacterium glutamicum
gtgaattctcacccgcaacactggtgtatttcagttacatccgtatggttattggttatgagctttcttaactctgcaaaaaccaagaccgtagccctcaccgcaaccttcgttggtgcagcaacccttgcaactcctgcaatcgcatccgctgacatcgtcgacaacgccctcgcagccctcccatccggtgagatcagctgctcccaggctgaaaagtactggaccaccgaagctgattacaacagcaaggttgcacaggccaacgccttggcaatgtttgactcccgcggcccacagatccaggcagctctcgcacgcgttgacgaagcagcaaaccgctgcggactcaagggcggcaccgtagctgcgcaggctgaggcaactgaggctgcgcctgccgctccagcacctgcaccgcaggataacaccggcacttctcagactgcccctgccccagcagcaccagcagcaccagcagctacccctgtggttaaccttgcacctgcaggatcaccaactttcaccattgaagttccaggagttggcggggttcagctgccagatctataccaaatcgtccaacagttcttggcacagttcggaatcaagatc

SEQ ID NO: 92 - DNA, 924 bp, Corynebacterium glutamicum
gtgtttgatgaactcactgctcgtgcccacaattcagcgctgaggtctattgctcgcgtcgtcgcggagacggtagagccaatgggggaggatgtggcgagggtgggcgtcgtaaagcaattaaaggccgggaacgtgctggcggtgactggggctggggtgtcgacggactcgggcatccctgattatcgcggcccgaagggcagcttgagcaggcatcggccgatgacgtaccaggagtttcggcatgatccggcggcgtcgcatcgctattgggcgcggtcgtttgtggggtggcgggtgatggatcaggcgcggccgaatcgaacgcactacgccatggttgagctggagcagcatggttttttaagtggtgtggtcacccaaaatgtcgatggtttacacgcggaagcaggcacgaaaaacctggtcgcgctgcatggtgatctcgcccatgtgatgtgtttgaactgcggtttcggggaggatcgacacctctttgatgaacgtctcgaagccgccaaccccggctacgtcgcttccattcgcctggaaccgggcgcagtcaaccccgacggcgacgtcttcctcgacgaagaacaagtacgccgcttcaccatgatcggctgcttgcgctgcggctcgctcatgctcaaaccagacgtggtttacttcggcgaacccgtgcccgccgcgcgcaaaaaagatttaaaaaagcttctcgacgcctcctccagcctcttaatcgccggctcctccctagccgtcatgagtggataccggatcgtcatcgaagcgcaacgtcaaggaaaacaagtgtctgtcatcaacggcggcccaggtcgggcggattcccgcgtggacattttgtggcgcacccgcgttgcaccggcctttgatgacattttggacgcgctggacctt

SEQ ID NO: 93 - DNA, 972 bp, Corynebacterium glutamicum
atggttgacgccctcaatgatctccgccgagaactcacaaacgcgttaaggtccgtgtggaaaaacctccccactgataacgccccgcaggccgatgccttgccagacgatgtagtggaagagattgcgataaatttctaccgtgatcccaaaaaccgcggcaaactcaacgaagacaaaacagattccttgccgatgctcgcgcgcatacgttcacgtggactttttgaagacgattggcgcgcccgccccaccgaagaccgcccctggccagtggtattagtccacggaactggatcaacaaaaggtgattggcaagacttgggagccgatctacgccgcgacggctgggcagtgtttgcacccgaatttggccaacgcgccaccggttcagtcgcagaatcatccgcacaaattggcgcctatatagatacagtattgcttgctacaggagcctcaaaagtcattgtcgttggccactcccaaggcggcgtgttgctgagatactggatgcgtgttttgggtggtgcatccaaagtcaaacacatggtctccctcgctgtccccaatcacggcaccaccatgggcggaatcgtcagcccgctaatccgtaacaatcgtggcgaaagtgtggttaattctgtcgttcaatcatggttcggcgaagctggatttgaaatgatccgcggacacgacaccatcaacgccatcaatgaaggcggcgatttggatccagacgtgacatatctgtgcatcgccacccactttgacaccgtgattcagccccctgaaacctgcttcctagaggcccggaaccccgaagaactcaagcgggtccaaaacatctgggtggaaaacctcgaccccaattcagtcgtgctccacgaagcaatgccttacgatccccgcgtacgcgcactggtcagggcggatttgagcaaattggtggagatttccgagactgcggagaac

SEQ ID NO: 94 - DNA, 900 bp, Corynebacterium glutamicum
atgtcccaggaaaattctggtttgttcaagcgcgcgattacacgtggggtggctaaggtgcgccggaatccgcgcgaggattttgcggaggaattcacccaagaactctacgatcacgcaacaaatatcaccctgcccctgacggcgcggctgaagccgaaggggtttttccaggatgattggcgggcgcgaccaagtggtgcgcgaccgtggccgatcgtgctaattcacggatccggggccagcaagggttcatgggaggaaatgggcgctgagctgcgcagcaaaggttgggccgtgtttgcccctgactttggaacgcgtgccaccgagccaattgcggcgtcggctgcccaaattggtgcgtatattgatgccgttttgttggtgacgggcgctgcgcagattgtgctggttgggcattcgcaaggcggtgtcgtggcgcggtattggatgcgcacctacggcggatacatgaaggtcaggcacatgatttccatctctacgccaaatcacggaacgctcatgggaggcattttaaacccgatgacgaaggtgaaatcgggagagggaacgatcgaaaagctgatgcacagactattcgggcccactggttttgaacagctgcgcggacacgacatcatcgagtttttggccgacggtggggacctcgatccaggcgtcacctacacctgcattggtacccattttgatcctttcatccaacctccggaggtggcctttttggaggtcaacgaggacgatgatccaaatcgagtccacaatatttgggtcgaagatgaacacccgcgcgcaatgattgcccacaacgatatggtgcgcgatcccagggtgatcgaaatcgtacgcgcagagctcgaccgggtggcacgcctcggc

SEQ ID NO: 95 - DNA, 888 bp, Corynebacterium glutamicum
ttgtacaggaaaatagtgcaaaaatggggtttaagcttcgtggagaggattgtcatcatgaacaacgtgcaacagtttcatcgattttttgatgattccgcagtctattatccctgcttcgtcccgcttgaccgagccatcggcgaacactttgatcgtcagaacaaaccgatgtccagattcatcggaacgctcattctgccgttagccaaactggaagaagccgcccaatacaccggcgatgaagtccttcgcgtgtcggcagtaatcagtactgatgggctcgctgatctgcgaagggatttttacgaactccccaacatcgacatcgcctcggtggaaatcaagctggtcggcgcagccctcaccaacaccgcttggttgggagatgtggaaaaactcatccaacaacatcgcaacactttcgtatgggttgagattccgacagccctggtcaccgcagatattgtccgaaaactccgccacatgggagctggcctgaaatacagaactggaggtgatagggaagagctcttcccctcaccgcaggacttggtcactgtgctgcgcaccgccatcgatgctgcattgccgtttaaactcactgcaggcctgcatcgtgctctcaggtatcgtgacgagaaaaccggccgacttcacttcggattcctcaacattgcagccgccgtggcgacacttcgtgctggaaaaggcgaggcagaggcactgaagatccttgaaggcgatgatgccgctccgcttattcacgcactacaaagcggcgaaaactggcgggattccttccgcagcttcagtacctgcaatgttgttgaaccactcaacactctgattgatcttgatgtgttggcggaaggagacgtacatccc

SEQ ID NO: 96 - DNA, 513 bp, Corynebacterium glutamicum
atgactcaagatgaacacccccgacaggccgactcccatttcaacatgcttttaccggatggaaatgaaaacgcacaccagctttctgtcgctctaaatcaggtggcacatctgttggcctatgatgcggactcttcaattcatcggcctgatgggctaagtctggcgtcctatagaattctcttttcactgtggactgatggcccgatgagtccactccaggtgactgacaagactggaatgaaaaagtctgcgatttctaacctgttaaagccattgctcgctgaatctctgattgtgcaggtgacggcagaaaatgatcgacgctcaaaggttttaagccttagcgaaaaaggcactacatacattcagaaaacagccacccgccaaaatgctttggaatccgagtggtttggcaccctgaccgacatcgagcaggatttattggagtcgttgctcaggaaactgctcgactccaaccgcgcatccaaggttcgtaaaaaccgatctaac

SEQ ID NO: 97 - DNA, 300 bp, Corynebacterium glutamicum
ttgcatatcactcctcgtgaacaagaaaaactgatgatcgtggtggcggctgaccttgcacgtcgccgtaaagatcgcggcctaaaacttaaccacccagaggccgtcgccctcatcacgtatgaactgattgaaggcgcccgtgacggacgcacagtcgcagaccttatgagctggggaagcaccattttgactagggatgatgtcttagaaggcatcccagagatgatccctgacatccaggttgaagcaacgtttgatgacggcaccaagctcgtcaccgtgcacaatcccatccga

SEQ ID NO: 98 - DNA, 486 bp, Corynebacterium glutamicum
atgatcccaggcgagtacatcctgtccagcgaatcactcaccggaaatgttgggcgcgaggccaaaaccatcgaaatcatcaacaccggtgataggcctgtgcagattggttcgcatttccacttcgctgaagtaaaccccagcatcagctttgatcgcagtgaaggttacggcttccgccttgatattccatccggcaccgcggtgcgcctcgagccaggcgatgcccgcaccgtcaaccttgttgccattggcggtgaccgcattgttgcaggtttccgagatctcgtcgatgggccgttggaggacctcaaagtcaacgtgtgggagggacgcgaagacggttggcgtcgttcctcagctgctggtgatgctccacaagaattgccacaggtcgaagctgctgaacgtggccggaaactagatgacgccactgatgtggacacaaatgtgggcacagaagaaggctttgaagaaggtcgaaat

SEQ ID NO: 99 - DNA, 1710 bp, Corynebacterium glutamicum
atgagttttgagatttcccgcaagcagtacaccgacctttatggtccaaccgttggcgattcagtacgtcttgctgatactgagctttttctctgtgtggaaaaagattacgcagcaatcggcgaagaagtagcattcggcggtggcaaggtcattcgtgatggcatgggccaaaatggcaccttggttcgcgatgtagatattcccgataccgtcatcaccaacgtcatcgtccttgactatacgggtgtgtacaaagctgacgttgcgcttcgagatggcaaaatcttccgaatcggaaaggccggaaacccgaatgtcatggaaaacgtcgacatcgtcatcggcgttgccaccgacatcattgctggtgaaggcaaaatccttaccgcaggtggcatcgacacgcacgtgcacttcttgggcacagaccaggtcaacactgcattagcatcaggtatcaccacgatgatcggtggaggcaccggcccaagccaggcgtcgatggctacaactgtcacgccaggtcagtggaatacctacaacatgcttagtgcttttgaaggcatgcccatgaactttggcattttgggtaaaggccatggttcttccaaatctccgctggctgagcaggttcgtgcgggtgcaatcggtctgaaaattcacgaggactggggtgccacaccatcgtcgatcaacactgccctagaagtagccgatgacatggacatccaggtggcactccactccgataccttgaatgaggccggttttgtggaagacaccattgaagccattgcgggccgagtcatccataccttccacaccgaaggtgctggtggtggacacgctcctgacctaatccgagtggctgctctgccaaacgtgttgcctgcatccaccaacccaacgctcccatacacccgaaacactgttgaagagcacctggacatggtgatggttgcccaccacctcaacccagatattccagaagacgtggcttttgcggattcccgaattcgtgccgaaacgattgcagccgaagatgtgcttcacgatatgggtatcttctctatcacctcttcggattcccaggcgatgggccgagtaggagagaccatcacgcgcacgtggcaggtcgccgaccatatgaaacgcacccgtggatcactaacgggagatgctccatacaacgacaacaaccgcttgcgtcgattcatcgcaaaatacaccatcaaccctgcgattgcgcacggtgtggattatgttgtcggttcagtggaggaaggcaagttcgctgacctcgtgctgtgggatccaaagttctttggtgtgaaacctgatctggtgatcaagggtgggttgatggtcaattccctcatgggtgattccaacggttccattccaactccgcagccccgcaccctgcgcaatacttggggtgcgtttggccaggcagtttccagaagctccattacattcctatcccaggacgctatcgatgcaaatgttcctgatctgctgaatctgaggaagcagatccggggcgttcgaggtgtaaggaatctgaccaaacgagacatgaaactcaatgcagaaatgcctgatattcgtgtcgatccagagacctaccaggtgtttgtcaacggtgagttgatcaccagcaagccagcagagacagtgccaatggcacgtcgctacttcttgttc

SEQ ID NO: 100 - DNA, 471 bp, Corynebacterium glutamicum
atgattatcactgcgatcgacaccaacatctacgatcaaccggagtttgttgaaggacgcgatgtcatcggtgtgcgctttgaagatttagttttggataagcgcattcaacgggttgcactccccggaggagaagaactggggttgcggttaaaccacgggcatccgattctgcgtgaaggtgatgtgttgaaagctgatgataagacggtatttgtggtggagattatccccacggatgttttagttatcacgccaagcgatattcaccagatgggatttgtggcgcactccctgggaaacaggcacctgccagcacagttttccaagccaggtgaattgacagagaaggcagccatgatcgtgcaatacgatcacacggtggtcagcttcttggatgagcacggcatcgagtatcagcgcaccgaacttgttccgccaattcctttcaggcatagcgggcacacacat

SEQ ID NO: 101 - DNA, 678 bp, Corynebacterium glutamicum
atggatcttgacgctgattttctgctgttgcatttatcggattcagcacttccaacgggagcgtttgcgcactcatttggatttgaaacttatatggatgcagagcgaatcaccaatgcagaggagttccaagactggctgaaagtcctgcttaaggtgcaattgaccagctctgatgctttggcaatgaggatgttttacgccaccccgacggtgtctgagctgaaacggctggatgagcgcctttttgctggaactccggcgagagaaattcgggaagctaatgctcgaatgggtacgcgcatggcagagatcgtggctgaaacctactccgtgcccctgattgttgagtatctcgaattgattcaacatcgagagctatcagggcacccggctttggctttggctcttgccacccacagcgcggggattgatgtggatcgagcaatccacgctcacctcacggcaacggtgagttcgctgatccaaaatgcggttcgtggcatcccactggggcaaatggcaggtcagcgggtgatgttcgccatgcgtgagcatatcggtgcggccgtgaaacgtagcgcgaacttggatgagattgatttctgttcgggtgatccaggcttggatatttcacaaatggttcatgaaacccaacgcgcacgactatttatgagt

SEQ ID NO: 102 - DNA, 615 bp, Corynebacterium glutamicum
atgggtccaatcagaatcggcgtaggcgggccggtcggcgccggaaaaacgcagctggtagagcggattacgcgagcgcttatcgacgaagtcagcatggctgcaatcactaacgatatctacaccattgaagacgccaagattcttgccgccaatggagtgctgccagaagaacgcattgttggcattgaaactggaggatgcccacacactgcgattcgtgaagacacctccatgaatgatgcagcgatcaaagaccttgtggaacgcttcccagatctggaactcatctttgtggaatctggtggagataatctctctgcaacgttctcgccagagctggtggatttttccatctacatcatcgatgttgcccaaggtgagaagatcccgaggaaagctggccaaggcatgattaagtcggatttgtttatcattaataaaactgaccttgccccatatgttggtgccaacctagatgtcatggtggaagatgccaaagcattccgcaagaacaaaccattctgcctgactaatctgcgcaccgatgatggtttggataaggtcttggaatggatccgccatgaggtgatgatgcaggacttgcaggaagcc

SEQ ID NO: 103 - DNA, 849 bp, Corynebacterium glutamicum
atgacacaaacccaaccagtgggaaccctgcgactgaccatcgatgatcaaggaccccaaggtcaaagccgtgcggtggagcaatttcaccagggtgcgcttcgagtcatccggccacactacttggatgattccggacaggtttgctacaccatcattgccattggtggcggatacctgggcggcgatgtgtatgagcagcaattcacgatcaaagacaacgcaaaagctttgatcaccacgcaatcggccaccaagatttatcgcacaccgcaaggaccagccacgcagcacaccgaaatcaacgtcggtgaaaatgctgtgctggaatacttggcggatcaaaccatcgcgtaccgggaggccacctatcatcaattcaccaaggtggcgctgcacccgagcgcaacgtttgtgatgagcgaacaaatcaccccaggctggcaccccgacggcaaacactttgcttacgatgaaatgcgtctacacaccgaaatcacggactccaccacagggcgactcgtgctcttggataatttactgctccggccggactcccgagagggaagttttgggtggacggaacagtacacacattcagggcagatgattgtgatgggggaaggcgtcgataagcagcttgttgctgagctgaatgagcaacttgccgcgcaccctgatgtgtacggcgccgtcaatttcttaagcgcgccgggcacgttactgcgcggatttattgcgcgcacgctgagcaaccgcactgaggagttgattaacctgcacgaacacattgcgtcgctgttgcgcgggcggtggcgcgggcaggaaccggtgaatttgcggaagtac

SEQ ID NO: 104 - DNA, 777 bp, Corynebacterium glutamicum
atgtttctcacactctcaggagctgacatgtctgcacttattaaaggttcaggacctcatcatgtggttgtcttaaatggttggtttggtcatgctgcgggctggggagctttcgctgactatcttgacctcggcaactacacctggcacttttgggattaccgaggttacggcaacagaaaagacgacgcaggagaatttactctggaggaaatttcagcggatatcgttgcatacatcgactcgattgaggcagaaaaggtttccatcctgggccattccatgggtggagtgttcatgcagaaagtccttgcagacagcgccacccccatcgcttcactggttggaatttctgccgttgctgcagctggaacaccattcgatgaggattctcggaagcttttcacctcagcagggcacaacccggactcgaggcgagccatcatcgatttcacctcaggatctcgccaacctgccgcgtggttggatgatctcaccgactcgacggtgcagaattccactccagaggccgttgaaaagtacttttttgcgtgggctgattgtaatttcgcagcggatttaggcacccaagatttgcccgtgtacattctcaccggcgatctcgaccccgcggtcactaaaactgccgtggaatccgcattcggcccgatctatcaaaatctgaccgttgaagaactccacgatgtcggacactacgcaattttcgagcaccccttaggccttgccgccagggtgcttcgatttctcgacgccgtc

SEQ ID NO: 105 - DNA, 669 bp, Corynebacterium glutamicum
atgctgaggaggccttcgcgcaggcagaggccatatgcggtgccgaacaggatcgaggcgataacgaaaagccacactggaatggagtcgccaccaaaagctgccagcgcaaaacccgcgagggcacacagcgcgcccacgattccggagccacgaccccacgcgaatttcctacctaaaaattgtgcgatcaggcctgcgctgaaggcgatcgccgcgccgattccggggagaagaatggcgttgccgaaggtggagtcgatgcgcgcggacatcacgatcagggaggtggtgatgcagctgaacacccaaattgccatcggcaaggacaccgcgagggcctttttcatgcttcgttcgtgtttgattccgctggatgcgccaagtgcgctcggggtgctgcgggcatcgccaagcgcaaatcccacaaccaccgcgatcagcgagagggcaacgcttatggcaaagggcgtaataatgcttgtcgacgccatccccaacccacttgtcacaatcggccccatcatgaaaccggcggtcagaataatgccggccaatgtcacgccgcttgctccgcgcaatctgcccgcccatgcggtgcccgcgctgacgactaatccaacgcccagaccaacgatgaatcgtcctaccaggagggaaggaccatca

SEQ ID NO: 106 - DNA, 1152 bp, Corynebacterium glutamicum
atgagatcaggaaacgccaatcgcgtcttcataggtgttaccatcctgctgtttactgcaggatgggcagccaatcatttcgcgtcagtgttggtgttgatccgtgaacaattagacgtatcaagcgtgctggtcaacggcgcttttggtatttatgcactgggacttcttccaagtttgctcgcaggcggtgtgcttgccgaccgttttggtgcccgcatggtggtactcaccggaggtgtactttctgcgcttggaaacctttctcttttagcgtttcatgatggtccttccctcctggtaggacgattcatcgttggtctgggcgttggattagtcgtcagcgcgggcaccgcatgggcgggcagattgcgcggagcaagcggcgtgacattggccggcattattctgaccgccggtttcatgatggggccgattgtgacaagtgggttggggatggcgtcgacaagcattattacgccctttgccataagcgttgccctctcgctgatcgcggtggttgtgggatttgcgcttggcgatgcccgcagcaccccgagcgcacttggcgcatccagcggaatcaaacacgaacgaagcatgaaaaaggccctcgcggtgtccttgccgatggcaatttgggtgttcagctgcatcaccacctccctgatcgtgatgtccgcgcgcatcgactccaccttcggcaacgccattcttctccccggaatcggcgcggcgatcgccttcagcgcaggcctgatcgcacaatttttaggtaggaaattcgcgtggggtcgtggctccggaatcgtgggcgcgctgtgtgccctcgcgggttttgcgctggcagcttttggtggcgactccattccagtgtggcttttcgttatcgcctcgatcctgttcggcaccgcatatggcctctgcctgcgcgaaggcctcctcagcatcgaaacttacacgccactcaaccgacgtggcaccggcatcggcatctattatgtgttcacgtatttgggattcgggctgccagtgcttctcgacgccctcctcccgcaccttggcgcctccattccgctgtacgcgctggcggcgctcgcccttggctccgcagtaatccgcggcgtacaaatcaagcgcgggtatgtggtt

SEQ ID NO: 107 - DNA, 675 bp, Corynebacterium glutamicum
atgttggccgaaaatgctgtccaaggcgagttcttgaacaaagtttccctgtgtacgaagctcctggtagcgggctacgtcgaggttctccgggctttgagcaagcaagatggtgaactcggagaactgggcctcgaggttttcgaatctcagctcaggatgggaagcggtttcctcgatgatcttgcgggcgattgcaagtggctcgtcgttttcctcgccgtatggaacaagatcgatgttgtccaatgccatttgattgatgactgcccaagacctcaagtcatcgcgaatcagttccgcttcggtgaggtaagtctggacatcggggttattcagctggtcaacagtctgggattccaagaaatcgacagcgcggtagccctggcggcgaagctccgaaaggaaaagttcgcgtccttctgcttcttttccaggctgatcaagcaaggtgatggcataagccagacgctcataatcagaaagctccgcgagctcgtcggcgttgagcaggaatcgctgcgcatcggaaaatgccctcttaccattggcgatgcagaaacggtacagtttgtcctgagcattcgcaggctcagatggggtcgcggtttgcgccttgagcagcaaattggagccgcccaatcccactggaatatccagggtggaattagcaat

SEQ ID NO: 108 - DNA, 2775 bp, Corynebacterium glutamicum
atggattatgcctttgagcagtcggcgactgcgctgctagatcgtgcaattgatatgcccatgaacgatgagcagatggaagcttttcaacttgcattgagcgtggcacaggaaaccgaagatcaagatactgagtttaaagctcgactgtttctggccacgctgggcaatatcaacgaggatcacacctcaatgctcacccacttttccgcagctgtcggcatgcatgaccgcgatccggctcgcttcccaggccagggcgacggttcctacccggatcttttttggctgtacaaaaacgccctcaacctggtcattagctcagtgttgttcacccgtgagcagatggacaacatgctcgatcagatggatgaacacttcacgcgcgcgggtatcccgcgcatcgcgattaatattgagcgccgcgacgacgccctgatgaacggctccctcgagcgtgcgctagagctgcaagagcttatcgacgcctcccagcacgacgatcccttcgacgactgcccaacctgccaaattgcaggaaaagcggcactcgcaatggcagcagatgattacgacgaaacccaaaacctcgtctcccaaatcatcagctacggatccatcggctgcgtcatggaaccagagaccaccctcgctgcgttcatgctgcgtgtgcttaagtccggcgatgctgattatgcccgctacctgcaagatgtcagtgcgaaggcaaacccagaattccagtcccttgattccgttggacgccacctagaattcctcggcatcactggaaaccattccaggggcttgggctttctcacccgttaccagcaccgcttgatcacggatcctttggcaactctgggacatttccagttttacttgggcgcctacacgttgctgtcctccactgaacgcgcaggtttcggggatcttgttgtctccggtactggagaggtgtttggccacgatgaggatctgaacgtcgaaaagcttaaagaacgctgcctggaattggcgcgcaacctggcgcgcgagtatgacgcccgcaatggcaacgacaatttcatgaagcgtttcgaggcctcaattgctaattccaccctggatattccagtgggattgggcggctccaatttgctgctcaaggcgcaaaccgcgaccccatctgagcctgcgaatgctcaggacaaactgtaccgtttctgcatcgccaatggtaagagggcattttccgatgcgcagcgattcctgctcaacgccgacgagctcgcggagctttctgattatgagcgtctggcttatgccatcaccttgcttgatcagcctggaaaagaagcagaaggacgcgaacttttcctttcggagcttcgccgccagggctaccgcgctgtcgatttcttggaatcccagactgttgaccagctgaataaccccgatgtccagacttacctcaccgaagcggaactgattcgcgatgacttgaggtcttgggcagtcatcaatcaaatggcattggacaacatcgatcttgttccatacggcgaggaaaacgacgagccacttgcaatcgcccgcaagatcatcgaggaaaccgcttcccatcctgagctgagattcgaaaacctcgaggcccagttctccgagttcaccatcttgcttgctcaaagcccggagaacctcgacgtagcccgctaccaggagcttcgtacacagggaaactttgttcaagaactcgccttggacagcattttcggccaacatgccgttgttcaagacaccggaaacggcgaagccatcctagatgaaactatcgggtacatgatcggcgccggcatgcgtgaaaccactgcccgcaccgccagccagttcgcgcagctttactcatttgtgggcaggcaggaacgctccattgaaatggcacgactcgctttcgaggaacttcaagcggcaggacttccccaccgtgaggaagaactgcgattgggcatgcaactcgcccaggttgaaccaattgaagcccgcgaaatcctggaaaagctgctgctgcctaaattcgagcagaatctgacacttgatgaacttgaaactgaagcactccttcctttgggtgctaccgttgctatccacgacccccaggctgccgcagcaattttgcgccacgctcgcgaaaacgccgcagggttcggcaacttcgaactcgcagtccaagcgatgaccatgatcacggatgtcctctacacccaaaacatgcacgagcaactgctggaggagctcaaccactctctcccctatgctcaaatgcttgatgatcaacaccaagctgaactgaaactgctggacagcatcgccatcgtccaggcagacctcggttccaccgaagcgctggaaaccctgggcaccgcaatgggactcgcagaaaccacagctcagaagctatacgtgcaggaatccctcaaccgcgcatacttcacttttgcccgccctgaagattgcatcagcggagcagccgacgcttctgccctggccatgcaaaacgatgacccttccaatgcagctgcccagttggagcagtgtgcacagtacttgttccaattgggccacgaaactgacggcgcaagcctgctggaatctgcattcagggttgaaggcatccccactgagcaggcactgtactacgcaaatgcactgtcttccatctatgaagatttcggcgattccgcgaagtcgcagtactgggagcagcaggcgcaggaaaagcagcagcttctggag

SEQ ID NO: 109 - DNA, 1824 bp, Corynebacterium glutamicum
atgcaagaatcctcacgtgataatttccaagttgacctcggcggcgttgttgatcttttgagtcgccacatttattccggtccgagggtgtatgtgcgtgagttgctgcagaatgcggttgatgcttgtactgcacgttctgaacagggtgaggagggctacgagccgagtattcgtattcggccggtgaccaaggatcgtgccacgttttcactggttgataatggtacgggcctgaccgcgcaggaggcgcgggaattgctggcgacggtggggcggacgtcgaaacgcgatgaattcggtctgcagcgggaaggtcgcctggggcaatttggcatcgggctgcttagttgtttcatggtggcggatgagatcaccatggtgtcgcatgcggagggtgcgtcggcgattcggtggactggtcatgcggatggcacctttaacctggagattcttggggatgacgcaacggatgtcattccggtgggcacgactgtgcacctgactccgcgccctgatgagcgcacgttgctgacggaaaattccgtggtcaccattgctagtaattatggccgctacctgccgattcctattgtggtgcagggtgagaaaaacaccaccatcactacatcgccggtgtttgcaaaggatactgatcagcagcacaggctgtatgccggccgggagcgccttggtaaaactccttttgatgtcatcgatctcaccggtcctggcatcgagggtgtggcttatgtattgccggaggcccaggctccgcatatgtccaggcgtcacagtatttatgtcaaccgcatgttggtctctgatgggccttccacggtgctgcccaactgggcgttctttgtggaatgtgaaatcaattcaaccgatttggaacccaccgcatcgcgtgaagcgctcatggatgacaccgcgttcgcggcaaccagggaacatatcggtgagtgcattaaatcgtggctgattaatctcgccatgaccaagcctcaccgcgtgcgggaatttactgcgattcatgatcttgccctgcgcgagctgtgccaatcggacgcggacctggctgaaaccatgttgggtcttctcaccttggagacctcccgtggtcgcatctcgatcggtgagatcaccacgttgtccatcaccgaggatgtgtcgctgcagctggctaccacgttggatgatttcaggcagctcaacaccattgcgcgcccggacaccttgattattaatggcggctacattcacgacagcgatctggctcggctcattcccgttcactacccaccgcttacggtatctactgctgacctgcgcgaatccatggatctgatggagcttccgccgctgcaggacattgagaaagccaaggcactggatgcgcaggtcacggaatcattgaaggattttcagatcaagggcgcaacgagggtttttgaacccgcagatgttcctgccgtggtgatcattgattccaaggcgcaggcctcacgggatcgcaatgaaacacaaagcgcaaccactgatcgttgggctgacattttggcaacggtggataacacgttgagccgtcaaacagccaacattccacaggatcagggactgtcggcgttgtgcttgaattggaacaattcgctggtcaggaaattggcgtccactgatgacaccgccgtggtgtcgcgcacggtgcgtttgctctacgttcaggcattgttgtccagcaagaggccactgcgggtgaaggaacgcgcgctgcttaatgattcgctggcagatctggtttctttgtctttgtcatccgatatc

SEQ ID NO: 110 - DNA, 1416 bp, Corynebacterium glutamicum
gtggtgcgcatggaagcaacaacgatcgatgacgcaatcgcgaagctcattgacatctacgacacctcgaccaaactggccaaagaaaccctcaacaatgaggactacgccgcatacgccgatgttgtttaccccaaactcaccgttgacgtgctggaatggaaacccatcgaccgcaccgaacccttcggctatgtggatcgagccgggcgatactccgccaccttgtccaaaccacgcgtgattgagcgttacctccgcgaacaactcgagcgtctcaccagtaattatccctgcaagatttacgtatctgagtcagatatccgcatcccaccggagtacattcgcggcgcaccttccgctaccgaagctcgccgtgctggtgatgttgcagatatcatcccacgccccaccctggatgaagtccacgacgcaattatcgacggcgactggcacgccttcaacggccccgaactcccgcttttccacttcgggccgcaacgcttcgacatcgcctgcgcccgcatcgagcactacaccggcatcaacgtggaacacgtgcagaagtacattctgttcaccaactacgccatgcacaccaccgagttcgtgcattttgccatgtccgaactcacctcggaagactcccgctacgtgggtctatccttgccaaacgggcaggtaattgaccgagagaccgccaccagcctcggtacggaaacccttgatctgactagccgtttccaaatgcctcgttacgatctcatcaccgaagccggtgacggtattaccattatcaacatcggtgtgggcccatccaatgcaaaaactatcaccgactgccttgctgtgctccgcccagaagcctgggtgatgatcggccactgtgctggcatggacgcccgcatgcgcatcggcgacctcatccttggcaacgcctaccagcgcgaagaccacattctgaatacccgcatcccacttggtaatccgatcccggcaataccagaaatccaaaaagctctagaagccagcgtcgacgaaatctacggatccgacaacagcctcatgcgcaccggtacggtcttatccaccgacgaccgaaactgggaatggcacaccccagaaaacctctggaactggctcaaaggatccaccgccgcagctgttgacatggaatcttccaccttggccaccaacggatatcgataccgcattccatacggcaccctgctgagcgtctctgacctgccactacacgcagtgccgaaacttcccgcgcaagcgcaggcgttttactccaactccaaggaagcccacgtcatgtgtgctgttcgtgcaatggaatacctggcagtagatcctgaacggttgcgtacccgtaaactgcgcaggaccttgggtgaggtgccgtttcgc

SEQ ID NO: 111 - DNA, 579 bp, Corynebacterium glutamicum
ttggcagctgatgtagccaccagcgcgcccgcccgaggattcttccatccctcaggaaactctcgcgacctggtcgtatgtggaggtttcgctgcgaccggtgcagcttcagaaatacgccgagccaacgtggcgcttgtgctgggcgccggtttgaaccaattcaccatggcattcggggaggctttcggtgaactcgcggaagtgctccaagtggatcttgaaacacagaccaccaacccgcgcattaaccatttcattagcgcagataacacaactgttgtagccgcagtgcttttaaagcttcgtacacaaaatttccacgcaccgcgccggctatacctggacgataatcctctgacatgccctggcggcgacgcccttgcagccgacggccgactcgatccacacagcctcatgcgccaacttaacggtattttgccagctaacaagttcgtcgcctccgatggcggacacttcatcggaggggccaacacctacttcgacctggaatcacgagacagcatcgtgcttttgggaaccgccttcaatccatcggcctcggcttccccaccgccg

SEQ ID NO: 112 - DNA, 552 bp, Corynebacterium glutamicum
gtgtactcaatttcagaaactatcgcccgaactcttatgccccgcaccgatcacgttttcgacctgatgggcaacggaaacgcctggttcgtcgatgccctagaacgcctcgggcgaggcatcatcaccgtccgccccacagttgaaaccgtggccgccgcggacacctaccaccgcgtcacccgccgcccggcggtcgctaccaccacctatggtgctggtttcaccaacaccatgaccacgcttgccgacgtcgccctctcccgtatcccacttcttttagttgtgggcactgccccgagcgccgggcctcgctgtttcgacattgaccggcaaggactcgcacgtgccgtaggtgtggaaaccttcaccgtgcatgcagatgacgttgctgcggtaactcttcaggcttggaataatacgccggaaaacacacacgtgatcctggaaatcccctatgacctagcagctgccacagccaccgatccaacagtgactacatacctgctgcgccccggatttcagaaactcccgatgtcaccgaccttgtcc

SEQ ID NO: 113 - DNA, 660 bp, Corynebacterium glutamicum
ttgttaaaagcgcagcgcacacgctttcccctcagcctgctgatacccccgttttgccacctaaaacaacctctcatcttcatttcatattcacttcatagggttgaatacatgaagaacgcaaaacttttcctcgcgctcatatccgctcctcttatcctcgctggctgcagctccaccgatactggaacagcagaatccaccatttccagcgaaactgcttctgcagtagatgccaccacttctacctcctcaagtaccgccacctctgccgtgattgatgacgatccggtattcgacatcatcgacatcgtccttgcccaataccccgacaggatcatcaccgacattgaccgcgaagactcctccgatcaatacgaagtcgatgttgtggttggccaagaagtccttgaacttgatgtcaccaccagtggccagatccataccgacgaccgcgacaacgatgatgatgacgacatccgcgaagctcacgcagccacagtcaccgcagctcaagccattggcctagcgctggatcaatacccagacggaattattgattctgttgaattagacgaagacgacggccagctgaaatggaaaatagacctcgatgacacttccggcaatgatcttgctgacgttgaaatcgcagcagtt

SEQ ID NO: 114 - DNA, 3456 bp, Corynebacterium glutamicum
atgacgtcgatgaatctgcctattgagttggctacgctgtctgaccaggctgtggacaaggtgcgctcctggctggagtacagcaaaaaggaaagcgtgcccaatgccgatgcgaagcgtctagctgcagtgttgcaggatcctaatggtttggaattcacggttggtttcgtggatcgagtggttcgaactgaggatcgtgaagcggcagcgcatgcgttgtatgagttgggcaagattgctccgtcgacgatgtcctttttggatcgggcgcagattcaggccggttctttggtggggcgggcgttgccgcaggttgtggttcctgcggcgcgggctcgaatccggcagatggttgggcacatgattgtggatgcccgcgacaagcagttcgccaaggctgtcgctgagattcagtcggatgggcaccgcctgaacatcaatttgctaggtgaagcggtgttgggccgaaaggaggcagcgaagcatttggatgacacggtgcggttgttgcgccgtccggatgtggaatatgtgtccatcaaggtctcttcggtggcatcgcagatttcgatgtggggtttcgaagacaccgttaattatgttgtggaacagctgacacctttatatatagaggccgcgcgggcgccgaaaggcacgaagttcatcaacctggacatggaggaataccgcgatctgcgcctgactatggaggtgttcaagcggctgctctccaatccagagctgcatgaactagaagccggaattgtgttgcaggcgtaccttcccgatgccctcggtgcaatccaggacttggcgcagttcggccgcgagcgcgtcaacacaggcggggcgggcgttaaggttcgcctggtcaagggtgctaatttgcctatggagcacgtccacgcgcagatcaccggctggccagttgccacagaaccttccaaacaagccaccgatgccaattacaagcgcgtcctctattggacgatgcgcaaagaaaacatggagggcctgcgcctgggcgttgccggccacaaccttttcgacatagcattcgcacatttgctctctgtggagcgtggggtagcggaccgtgtggagttcgaaatgctgcagggcatggcgtccgatcaggcgcgcgccgtcagcgttgacgtcggtgagctgctgctttacgtaccagccgtgcgcccacaagaattcgacgtggccatttcttacctcgtgcgccgcctcgaggaaaacgccgcgagcgaaaacttcatgtccgccatcttcgacctcgacgccgacaacccgtccttcaagcgagaggagagccgcttccgcgcctccatatctgacctcgccacgctcatcgacgtgcccgcgcccggccccaaccacacacaagaccgcagcaaagagacgcttctcgacgcccccctcgtcccatttatcaacgagcccgacaccaacccagcgctcatccaaaaccaacagtgggccacaaaagccgtcgccaccgcagcagagcccggttggttggaaaaacaaacaaagccggaggtgttggaagagggggacgtcgacaagctaattaacgatgtgcgcgacgctgctgaagcgtgggcagcgcgcccagcccgtgaacgcgctgagattttgtacaagaccgccgagattttgcgcgtgcgacgcggacacctgatctcagtgacggccgcggaggtgggcaaagctgtggaacaaaccgacccggaaatctctgaagccattgatttcgcccgctactacgcgcatttggccctggaattggacgacgtagacaatgcggaattcaccccagatcgcgtcgttgtggtgaccccgccctggaatttccccatcgcgatccccgctggatcgactttcgcagcactcgcggcgggcgctggcgtgatccacaaaccctcaaagcctagccaacattgctccgctgcagtggtcgaagccctctgggaagccggcgttccccgcgaggttctgcattgcatttacccagctaatcgcgatgttggatgtgcgttgatcagccatgaacacgtcgaccgcgtcattttgaccggctcctccgagaccgccgcgatgttctcctcctggcgaccagaactcaccatcaacggcgaaacctccggcaaaaacgccatcgtggtcaccccatctgccgaccgcgacctcgccgtcgccgacctggtgaaatccgccttcggccatgcaggacaaaaatgttccgcagcctccctcggcatcttggtaggcagcgtctacgaatcagaacgcttccggaaacagctggtagacgccgcatcctcactcatcgtcgactggcctaccaacccctccgcaaccgtcggaccactcaccgaactccccagcgataaactccaccacgccctaaccaccctcgaagaaggagaaagctggctgctgaaaccccgacaactcgacgacaccggccgactctggtcacccggcatcaaagaaggcgtcaaaccaggaaccttcttccacctcacagaagtattcggaccagtcctcggcctgatgaaagccaccgacctcaatgaagccatcgaattccaaaacggcaacgacttcggactcaccggcggactccaatccctcgacgccgacgaagtccgcacctggcttgaccacgtcgatgtcggaaacgcctacgtcaaccgcggcatcaccggcgccattgtccaacgccaatccttcggaggctggaaaaaatcctccgtcggcctcggatccaaagccggaggacccaactatgtcatgctcatgggaacctgggccgacgcgccaagccaccacgccccacgcgaaacaaacccgctgatcagcaaactggatctccccggagaagagctcgaatggctcgaaaaagccaacgccagcgatgaaacagcatggaacacggaattcggcagcccacgcgacccctccggcctcgatgtagaagccaacattttccgctaccgaccagcagaggtagtactccgactcgacgattccgccacaccccgagaaactgcccgcgcattgttggcagcccgtcgcgccggggttactccgcgagttcttcaaacaccaggtgtttcagagcaagtccgcgaagtattgtccgctgctggagtgagtgcagaaacagtcgatgattcggtatttatttccaacgtgttgcgcggcgaatacgacgagaactccagcgtccgagtccgctacctgggcaaagttagcgacactgtccgtgaacgcctatctgtacggcccgaagttgttctgcttgacgatgcagtaactgcctccggtcgagttgaattacgttactggctcaaagaacaagcaatttccatgacgttgcaccgttttggaaacccagttgcggccttccacgagttggcggaggaacttaaacgt

SEQ ID NO: 115 - DNA, 114 bp, Corynebacterium glutamicum
gtggtggatcctaaccaatctggcagtggggtcggtgaattcattattggcgggcttttcaaaggtcatatgtcgattttggggcgaaaaatcgacacgttttctcgatgtgtt

SEQ ID NO: 116 - DNA, 945 bp, Corynebacterium glutamicum
atggagcacggcgtgaccgttattaaaggcactgaatttgatgttttcccactaaacctcggtggaaatacctttggctggacctcgaatagggaacagaccttcgcggttttggatgcattcgtggcagcgggaggaaactttgttgacaccgccgattcttattctgcatgggttgaaggcaatgagggtggcgagtcggagcgggagctcggcgcgtggattaaggaacgtggcgcagacaagctgatcattgctaccaagtctggtgcgttggagcctgttgctggtcgttcccgtgaggcaactttcaaggctgtcgagggttccctggagcgtttgggcgtggaatcgatcgatattttttactaccactacgacgatgaggcagtcagcattgatgagcaggttgctatcgctaatgatctgattgcacagggcaagattaagcacctcgcattgtctaactacagcgcggagcgtttagctgagttctttgagaagtctgtaggcactccagcgcagccggttgctctgcaaccgcactacaacctggtgtcgaggaaggattatgaggagaacgtgcagccactcgccgagaagcatggcgttgcagtcttcccttatttcgcgcttgccgcgggtcttttgaccggaaagtacacctccaaggaggatatttcgggtaaagcgcgtgcggggcagttggatcgttacgccagcgatgaggcgtttgccgtggtgacagagttgcgtgctgttgccgatgagttgggtgttgcgccaacgactgtggcgcttgcgtggttggttgcgcatggtgtgaccgcaccgattgcgtccgtgtccaaggtagagcagttgaaggatttgatggctgtgaaggatgtggagctgagcgctgagcagcttgcacgtttggataaggtttcggagcctttcgct

SEQ ID NO: 117 - DNA, 1614 bp, Corynebacterium glutamicum
atgagctcaacaacctcaaaaacctcagaaagacaacagccagacgcaccgacgagcaagctcagtaaatggagcgataaatttctcaatggtgtggaaacacttggaaacaagctgcccacaccatttacgcttttcttgatacttttcctgatcacggcgctggcttcatcgatcatggcgtggatgaacgtatccgtgattgttccaggctctgatgaggaactatttgtaaaaggcctgttcaccggtgaaggcctaacctggttgactacgaatctcggggcaaactacatcgggttcccgccgttgctcaccgtgttgccaattctgttggcagtgggtgttgctgaacgttccggcatgttggctgcgctgattaggaaactttttggttcggcgaaaaagatcgttttgccatatgcagtcggtgtgattggcgtgaccgcgtcgatcatggcggacgctgccttcgtggtggtgccacctttggccgcgatggtgtttaaagctgctggtcggcaccctgtggctgggctattgggttcgtttgcagctgtgggtgcaggatattccacagcgattgtgcccaccagccttgatgcactttttgcgggaattaccaacgccgtgatggagacacttccaggcattgcgacaactgaagtcaatccggtttctaactattacttcaatattgcatcctcgattgtgttgggtctgttatgtggtttcctcattgataaggtgctggaacctcggatgtggcgtcagaaaatcgctacggagtatgcagaaagcattgaacccaccagcgcagcagatgatgaggaaatctctgcaaccctaaccgcacaggaaaaccgcgcgctgacaatttccatgtggaccaccctggcgacggccatcatcgtgctggttgtggtgctgattccgggatccccatggagaaatgaggatggtggattcttgcctacctcgccactgctgagctctgtggtgtttattgtatttttgtttttcatggtgatgggcctggcctacggcatggtggtgggcacgatcaagaacatggatgatgtcgtgaacatgatgggcgaagcaatcaaggacatgattggtttcttggttttggccttcattttgggacagtttgtggcgctgtttaactggacgggcatcggtacctggactgctgttcagggtgctgcgggattggaagcgatcgggcttaccggattccctgcgatcattgcatttattattttggcgtcatgtttgaacctgctgattatttccggctctgcgatgtggacgctgatggctgcggtgttcgtcccgatgttcgctctgcttggctatgaaccatcattcattcaggcagcattccgcgtgggtgactcggcaactcaggtgatcacaccgctgaatccgtacatgattgtgatcctcggtttgctccgtcgatacgaaccggatgcaggtttaggcaccttgatgtcaaggcttatcccatttgtgatccctttctggctagcctgggctacattgttggcaatttggttctacgccgatttgccgcttggacctggctctgcgatcttcctcgaagga

SEQ ID NO: 118 - DNA, 1332 bp, Corynebacterium glutamicum
atggagcaagggattgccgcgcgcaaagcggaggcagaatctaacgccagcacgaagggggagagcccggattatccaggccagcaggttatttggcgcctgatccaggaagcaggggagtcgttgcgtgatgaactgcgcacactggctttcacgctgcacgaccatccggaagaagcgttcgaggaggtgttcgccaccgaggaaatcacaaaacttctgcaaaatcatggttttgaggttcagagtggagtttatggtgttaaaaccgctctagaaactagttttgaaacccctggttatgatccagcgcagcacccaagcattgcgatcttggcggaatacgatgcccttccagagatcggccatgcatgcgggcacaatatcatcgcagcagctggtgttggcgcatttttagctgtcaccaacatgatcaaaactgccgaagtgaaaggcgtggatcacctcgactttgaaggccggatcgtgctgttgggaacacctgctgaggaggggcattccggcaaggaatacatgatccgaaatggcgcattcgatggcattgatgcgtcgattatgatgcacccctttggcttcgatctggcggagcatgtttgggtgggcagacgtaccatgacggcgacgttccacggtgtctctgcacacgcgtcttcgcagcctttcatgggtaaaaatgccctcgacgctgcaagtttggcgtaccagggcttcggagttttgcgtcagcaaatgccaccgagcgaccgccttcacgccattattacggaaggcggaaaccggccaagcatcattccagacactgcaacgatgtcgctgtacgtgcgttctttgttgccggaagcactcaaagacatatcgaaacgcgtggatgatgtgctcgatggggcggccttgatggcgggggttggcgtcgaaaagcaatgggatgtgcacccagctagcttgcccgtgcgcaacaatcatgtgttggcgcggcgttgggcaaaaacgcagaatctgcgtggtcgaacggcgctttcggagggtattttgcccgacactctggcagcatcgactgattttggcaatgtctcgcacctggttccgggcattcatccgatggtgaaaatttctccggaaaacgttgcgctccacaccaaggaattcgccgcttatgcgcgcacggaagaggccatcgacgcagccgtcgacgccgcaatcgggctggcgcaagtcgccgttgacgcgcttgcagatccgcaaatgcttatcgacgcgaccctcgagttcaccaactccggcgacgtacttaaagtaggggactatttggct

SEQ ID NO: 119 - DNA, 699 bp, Corynebacterium glutamicum
atgaatgcccggaaccaggtgcgagacattgccaaaatcagtcgatgctgccagagtgtcgggcaaaataccctccgaaagcgccgttcgaccacgcagattctgcgtttttgcccaacgccgcgccaacacatgattgttgcgcacgggcaagctagctgggtgcacatcccattgcttttcgacgccaacccccgccatcaaggccgccccatcgagcacatcatccacgcgtttcgatatgtctttgagtgcttccggcaacaaagaacgcacgtacagcgacatcgttgcagtgtctggaatgatgcttggccggtttccgccttccgtaataatggcgtgaaggcggtcgctcggtggcatttgctgacgcaaaactccgaagccctggtacgccaaacttgcagcgtcgagggcatttttacccatgaaaggctgcgaagacgcgtgtgcagagacaccgtggaacgtcgccgtcatggtacgtctgcccacccaaacatgctccgccagatcgaagccaaaggggtgcatcataatcgacgcatcaatgccatcgaatgcgccatttcggatcatgtattccttgccggaatgcccctcctcagcaggtgttcccaacagcacgatccggccttcaaagtcgaggtgatccacgcctttcacttcggcagttttgatcatgttggtgacagc

SEQ ID NO: 120 - DNA, 366 bp, Corynebacterium glutamicum
gtggatgaacgaagccggtttgcgcgcagcgttttcccggacggtgaagaaccagatccacgtttcactttggccaatgagcgcacgtttctagcatggacgcgtacgtctttggcgtttcttgccggtggtattgcttttgaggcgttccagatcagtggactatcggatactgtccgtacaacaatcgcggtttttatcattgcggttggcatgatcattgccgctggtgctgcggtgaggtggatgaatgtggagcgtgcaatgcgtaaacagaagccacttcccgtacctgcgattattccgtttctgtctattgcggctttggtggcctctgcggctgtcttggttctgattattgttcag

SEQ ID NO: 121 - DNA, 315 bp, Corynebacterium glutamicum
atgcgcattcatgaggatccaggtttgcagcctgaacggactgtgttggcatggaatcgtacgacggtgtccttggctgtgtgttcggcaattttgctgaggtggactaatttctatgggatttttgcactgctgccggtggtgattctcagcggaatggcgattttcatcttgtttacgcagcgggttcgttatgaacgtcaggctatcgggcttgcggataataaattgccacctaatatagttggggttgtttctttaacggtgacacttttggcgttcggggccgctggaattgtattcgtcttcattgat

SEQ ID NO: 122 - DNA, 2052 bp, Corynebacterium glutamicum
ttgctaaaagtcctggccagaaaactctctatactgtgcagcatggcaccaacgatcaccgacatccatgttctgcttcgtcgcggtgagcgacaatcagtgatcatgaccctcactgcctcttccttggaggccgggaaaatgtcttttagtggcgggtatatcgtgggcgagacgatgatcttcctcgtcgatcccgatgaagtcgagatacgacgcagccctaacagcctccacgtcctgcgtaacggtagcgatattctgcgccgcaacgagcatcattgctgggtatttgagaatttcaataaacccattgacccacctgttcgattgggtcctcgggatatcatctgcccgagcgccttggcctgggttcttcaacagcattccatctcccggtccttatcccaccaccttcacgcggataagatcactgcgggagagattgctggacgccccacctggatcctccgtgaggaacctacttcaggagggcaggacccaagtcgattggtcagtcttgaaatcgaccaggaacacggtgtcatccttgcagtggagactggacaagaacgactcgaagccacggagatttcttttcctgacactcttcctaatccttcctgggacggagcctgggaaccattccattatccagattcgacaccacacactgcccctgatgttgctgaaatacccggttacattcagtcactgccgccgcagtctgaagatcctcgcagactacgagtcttcgtcaatgagatagcactcgaaggtgatttccctgactaccgtcaaggacaatctgtgcgacttactttgggaattagctcctcccctgtgccactcgaaggaatgacaaccagacgccggggccgggtacgcaaccttggggaagaagctagtccaggcgatgacggtatgccccagtggccaatcctgctcactggtgatgggtggacggcgctggcctacactcccatcccaaaacgtggagatgcagagatccaggggtggttttattattccgcctacggaattgttgatgttcccacagatctacgggtagagcgtattttcgctggtatcggcacaagtggcaccaacgagcgtttgtggcaggagatagacaatacttcttcggcttatcactcggaagattggtggatccgcgatgtcgttttagacgtcacgttggatggagctgttccgcctccgcttagacgtgacgtcttcactgctgtcgatcctattgtggcgggtgacaaattgtggctgtgtgacgtgcactttccggtagcccgctgctgggagaccacgaccggccgatacttggggcagactttagtcccagcaccactgcgagatcgatcgtacgtccttgagctgcacagcgaccaacaattaggagccgtagcggcaagtgggaagagtggttggattctcacacctggtcaagcagtagccactaaagctcctgattggactcctcccacccgggcaaccgatctgcctcaggtcccctccccctgggagatcgtcgctgtccgtggccaaggtctgtttgagctgcaggtggaaactagtagacgcaccgccctcggtcgagttaatgcgaccggtggcgtcgacatcggtgaactcccgcccaacggctataccatcagttctgtggttcagatcggtgatgaatacatcgtgggcaggtgggtagaggaataccggctcaactccaaactggaggtcatttctaccaaagagctagatatctccgcatccggatggaagagcaaggggacggttgcttatctgtcggaagacactcacatatgtttcttcgaccaggtcagcggggccgagcttcccagcctgggtatcgccgagggacaccagggcgaggttatgtcagcaacttcttcagagagcatcgtgcttatctaccggcgcaacccgaacaattcaatgtcgattgtcccgacttccgttgccacctatgacaatggcacctggacgactatgccgctacaggaagctccagcggaactgtcc

SEQ ID NO: 123 - DNA, 780 bp, Corynebacterium glutamicum
atggagcgcgaacaacgacacaaagtgatcatgcgaacgatcgaccgccccggaatcacacgcattgatgctcttactgaactaactggggtttccgcggtgaccattcaccgggatctcgtcgagctagagcaagcaggtttcctcgcccgcacccacggtggagcgaaacgtgtgcccaaacgcggtactccccaaccgtttgccgtgcgccaggctgaggaccgagaggccaaacgcattttggcccaggccaccgcccaactaatcgctgatgatgaagcagtaattttcgacaacggcaccacctgccaggcagtggcccaagagttggcggggcgtcccatcacggcattgtgtctgtctctacattcggcggtcgccctgggaagccgagctggcaccaacgttttcatccccggcggccccgtggaaaacgactcactcgccttatctggcccggctgtgatcaccgcgttacgagatttctccgccgatgtcgtgatcctcggttcctgctctacatcactggagcacgggttggccaccactacctacgacgatgcggaaaacaagcgcgcagccatccatgctgccacccgacgaatccttgtggtgtccgcccgtaaactcaaccacgtttccactttccgtttcgcagacgtcgcggacttacaccagctggtcacaacctccgatgcgccacgggagattctcgccgagatccgggatctcggcgtgcaggttattactgttcccgcccctgacgagcaacgaagt

SEQ ID NO: 124 - DNA, 390 bp, Corynebacterium glutamicum
atgcgaattgaaatcacaagcgtatttgttgatgaccaggccaaagcactcgatttctacaccacgaagctcggatttgagctcaaacacgatgtaactgctggtgactaccgctggttgactgttgttgatccagaaaacccagatggtgtgcagcttttgttggaaccaaaccagcacccagatgcagcgacttaccaagctggaattaaacgagacggtattcccgctacacagttttatgttgatgatgtgcaggaagaatatgacagcctcaaggataaaggcgtggatttcatcatggaaccaaccgatgtgggcccttcagtgattgccattctcgatgacaccgtaggaaacctaattcagattgttcaattgaagcagaac

SEQ ID NO: 125 - DNA, 510 bp, Corynebacterium glutamicum
atgtctcccacacatcgcctcgtcatccttagacacgccaaatcttcctggtccaccggagtactcgaccataaacgcccacttaatcaacgtgggcttcgcgatggcgtggcagctggccaatggctagctggcaacatcggcgaaattgatcatgtgctgtgttcagatgccacccgcacacaattaacgtgggaacgcgtccagcttggtggcgcaaccgccaaaggctctagcttccacaatgacatctatgaaaaccaagtgtctgaatttaaacatttaataacagggctcccagatgtagttggtaccgccctactcatcgggcactggccaggcgtggaagaactagcccattattttggcatccgcgatgaacatcccggttgggatcagatggaagaaaagtttcccaccagcgccattgcggtgttggaatttaacaccccttggtcaaaacttgagagaaactctgctcggttgacagattttgtcattccacggggt

SEQ ID NO: 126 - DNA, 1509 bp, Corynebacterium glutamicum
atgaacaccccactccagctcaacactgaaaacctgcaggaaatcgcttcgacttccggagtgcagatcccagcgttcaaccgcgctgacgtcgccccgggcattgtccacttcggtgttggcggattccatcgcgctcaccaagcgatgtacctcaatgaattgatgaatgagggcaaggccttggattggggcatcatcggcatgggtgtcatgccttccgatgtgcgcatgcgcgatgccctggccagccaagatcacctttataccctgaccactaaagctcctgatggaactcttgatcaaaaaatcatcggatccatcattgactacgtgttcgctcccgaggacccagcacgggccgttgcaaccctcgcgcaggactccatccgcattgtttccctcacggtgactgaaggcggatacaacatcgatccggcgacagaagatttcgaccacaccaaccctcgaatcgttgctgaccgcgaagccctgcaggcgggcgatacttccactttgcagaccttctttgggttgatcactgccgcattgatttcccgaaaagaatcaggatctacgccatttaccatcatgagctgcgataacatccaaggcaacggcgatctggctaagcgtttcttcctcgccttcgcacattccgtgtcttctgagctcggcgaatgggtggaaaacaacgtggccttccccaactccatggtggaccgcatcacccctgaaaccaccgacggcgaccgcgatgacatcaaggaaatcggctacatcgatgcgtggccagtggtttctgaagatttcacccaatgggtcctcgaggatgccttcacccagggccgccccgcgtacgaggaggttggcgtgcaggtcgtctccgacgtggagccttatgaattaatgaagctgcgcctgctcaacgcctcccaccagggactttgctacttcggccacttggctggccaccacatggtccacgacgtcatggcggatacccgcttccaggatttcctcctggcttacatggagcgcgaagccacccctaccctcaaggaacttccaggtgtcgatctagatgcttatcgacgccaactcatcgcgcgattcggcaacgccgcagtcaaagacaccgtaccgcgcctgtgtgcggaatcctccgaccgcattccaaagtggctgttgccagtcgtacgcgaaaacctcgcagcaggccgcgacgtcacactttctgcagccatcgtcgcatcctgggcgcgctacgcagaaggcaccgacgagcagggcaacccaataaagattgttgaccgtttgagtgagcgcgtccaagaaaacgcatcaggaaatcgcaccgatattttgtcattcatccgcgaccgtggaatcttcggagacttggtcgatgctgaaccattcaccaaggcatactccgagacactgtcctcccttcatgaccgtggcgcggaagcaaccatcgatgcacttcttacgcaggtaactgtc

SEQ ID NO: 127 - DNA, 1335 bp, Corynebacterium glutamicum
atgtcagtacagcaaagcgggttgctcgaacgtctcggcattccccgacccttgattttcggatttatcggcctcaccatcttcatgatcggtgacggtgtcgaaaccaacattttggaacctttcctcagttccgaacatggtttcagcgtttccctcgcgggaaccctggtgactgtttacggtgttgccgtggcgatcgcagcattcttcgcggcggcactttcggacctgtggggtccacgaaaagtgatgatcctcggtgcttcaatctggatcgtctttgagctgatcttcctcaccgtggcactgaccaccgaccatacttggttgatcttccttgcttatggtctccgcggctttggttatccattcttcgcctacggattcttggtgtggatcaccgcaactgcctcacctaagcaattgggtaccggtgtgggttggttctacgttgccttctctgcaggtcttcctaccttgggtgcgctggttgccaccatttccatgcagtacgtgaacttgaccttctatgaaacgttgtgggtttccctcgtgctggtggtcatcggatcgctcatcgcactgctgggagtgaaggaacgtcgcggacgccacccactggttgccaaccccgacgatgtgaagcaaacacttggccagggcttcaaacttctgcgcaatgatcgacgtgcacgttttgtcacctacatccgcaccatcaactccattccgacctacgcgatggctgtgttcttcccatcatttttcactgacgatctgaagtggcagctaagctggttcctcatcctcaccactgtaatttacgcagtcaacctgccgttcaatcctttcttcggtagcttcggcgaccgccacggttgggcacgaactgtgttctggggcggatcaatcggtggcgcagtcaccctcgcgttggtttacttcattccgatgttcggcgttcaggctggcatgtccaacggtgtcgttttcggaatcaccatcgcagccggcgcactctttggtgtgtccctcgcgggcttcgtgccactttccgcaatcgctgtctcccttgatcccaagcaccccggcgcagcgatggccacatacaacctcggcgttggtggcgctgtagctgtgggaccgctcctggttgcagtcttccacccactgattggtccaaccggattgatcctggtcatgatcgccctctacctgctctccggttggatgactcttcaacttcgcggcacccaaccaggattcgacggagtgccagcacttgctgaagacgcccacatcgaagaccttgcagatgtaaacgcaaacgcc

SEQ ID NO: 128 - DNA, 189 bp, Corynebacterium glutamicum
gtgttcacctttgttttaaatgttgagtccagcgctaaagcatcagaagccaaaagccagaagctaaaaacactgagaaaccgtcacgttaaatccgtgttagattcaacaaaatctggcttagcttcagcgctgaactcacaattccgattagttcgtggtgcgaatcacgtgaaactaacaacaatc

SEQ ID NO: 129 - DNA, 837 bp, Corynebacterium glutamicum
gtgattcccgccagctcacaagaaaagcgtcgtgagcgcatcgtttcttatgtcacccgtcatggattcgctcgtgttgaagcattagctgagctttttgaggtcagcgcaatgaccattcaccgtgatttggaggcgctggctgcagacaatttggtggagcgcattaggggtggcgcgcgttcggtgtcgccgtcgatgagtgagttggcagtggagcagcgtcggcatttgcatcgcactgttaaagaggcgttgtgtactgcagcagcacggttgattccggagggcgctgtggtggcgattgatgattccaccacgttggagtctttggttgagaagttgccgcagcggtcaccatcggcgttgattacgcattctttgaagacaatggcggatcatcgtgtgcgcgccgggatgagcgatatccgtttgattgcgtgtgcgggattgtatttcgcggagactgattctttcttgggcaaggcaacttcagcgcagttgaatgagctgtcggcggatatttcttttgtttctacgactgcggtgcgcgctacgggggaggttccggcgctgtttcatcctgatatggaggctgctgatacgaagcgggcgttgattgggattggtagcgtgcgtgtgttggtggtggattctagtaaatttggttcggctggtgtgttcaaggttgcttcgattgaggagtttgaccacatcatcattgatcagcagtgcacccgtgagcagcgggatcttttgcgtaattcgcgcgcgcagatccatgtgattgaccacaatggtgatgaaattttggataccccaacggaagaggatttt

SEQ ID NO: 130 - DNA, 1419 bp, Corynebacterium glutamicum
atgaaattttggataccccaacggaagaggatttttaagatggctttggttcttggaatcgatagttccacccaatcctgcaaggctttgcttgtcgacgccgccaccggccaggttatcgacgaaggccgcgcgagtcacccgagcgggtcggaggtagatccacgtgcgtggatcgctgcgctggatcaagctaccgaggggttgttagaacgcgcggacgctgtatctattgcaggccagcagcacggcatggtggcgttggatgaaaacgatgaaatcgttcgcccggcgttgttatggaatgacactcgttctgcccaggctgcgttggatctcaatgaggagatcggcggcgatcaggctgcggtagatgccacgggaagtgtgtatgttgcttctttaactgccaccaaaatgcggtggatgcgtgatcatgaaccagaaaatgcagcgcgcacggcgtcggtgatgttgcctcatgatttcctcacctggcatttgatgggacgcggacgcaaagtcaccgaccatggtgatgcttctggaacgggctactacagcacgcgtgatcgtgcgtggcgcaccgatctagctgccttggcgctgggccatgaggtggaacttcctgaactcctggccccaaatgcgattgcgggaacaactccaggtggagtgaaagttgctgcaggcacgggagataatgctgcggctgcgcttggccttgatttgcagcctggtgatgtcagcgtgtcgatcggcacctctggcgttgccggcatgaccgttcaacatagcgtccacgatccatctggtttggtcactggtttcgccgatgccacgggtgcgtatttcccgctggcctgcacgcttaatggcgcaccggtgttggaattcggccgccgcattctgggcgtggaatgggaagagttcgatgcgcttgcactggctgctcaacccggttcaggtggcgtgacgctccagccttatttggagggcgagcgtacgccgaatcgtcccgcagcacgtggcgttttggctggactaaactgtgcaacgacccgcgaggactttgcccgagcaactgttgaaggcttgttgttggcattggatgatgctgtaacggcgctggttgaggccacgggagtgcccgttcagcgcatccagctcatcggtggcggcgcgcgttcacaggcggttcgtgagattgcccctgagattttcggccatgagattgtggttccagaacccgctgaatatgtggcgttgggtgcagctcgtcaggcggcatgggcgctgtcgggtgaggccacgccaccgcagtggccaactcccggttccgatccgcaccgcgcacctaaaaacactgagctgagcacgcgttatgcgaagctgcgtgctgcaacgcagggttggtac

SEQ ID NO: 131 - DNA, 822 bp, Corynebacterium glutamicum
ttgtggttgctacctgcattaaaaggactccgcttcgcctgggaaggtacccgcgtggatatcggcgatgtaggcctgcgcggcgtcgtgcaaggaatcgcccaaggtggcgtactcgcggacgaagcgtggcttcttgccgcggttgaggccgaaggcatcctgccacaccaaaacctgcccatctgtgccattgccggcaccgattccgatagtggtgatggaaagatcctcggtaacctcgcgcgctgcctctgctggaaccatctccaacacaaccgcaaacgcacccgcctgctccaacgcgcgggcatcggcgatgagctttccagaactcgcgccacgaccctgaaccacgtggccgcccaaggaatgctcggactgcggggtgtacccgatgtggccgacaaccggaattccagcatcaacaatgcgtcgaatcgtctgcgcgatctccacgccaccctcgatcttcaccgcagccgcacccgtttcacgcatgacccggatcgcggactccaccgcctgatttgggctcacctcataggtaccaaacggcagatcaaccaccacaagcgcacgcttcgtagcgatcgtcaccgccttggccagcacaatcatctcatccaaggtgatcgacaaggtggtatcgcgacccagcacaacgttggcagcggaatcaccaacaaggagcatatcgacgccagcctcatcaaaaatgcgcgccgaaagcgcatcatagctggtgagaaccgaaactttctggccgtttactttagcttcgcggaaatgacgggtgcggattttctttgcatcaatgcc

SEQ ID NO: 132 - DNA, 837 bp, Corynebacterium glutamicum
atgcaggtagcaaccacaaagcaggcgcttatcgacgccctcctccaccacaaatccgtcgggctcgtccccaccatgggtgcgctacacagcggacacgcctcgttggttaaagcagcacgcgctgaaaacgacactgttgtagccagtatttttgtcaatcccctgcagtttgaagcactcggtgattgcgatgattaccgcaactatccccgccaactcgacgccgatttagcactgcttgaagaggcaggtgtggatattgtgttcgcacccgatgtggaggaaatgtaccccggtggcttgccactagtgtgggcgcgcaccggttccatcggaacaaaattggagggtgccagcaggcctggccatttcgatggtgtggctaccgtggtggcgaagctgttcaatttggtgcgccctgatcgtgcatattttggacaaaaagatgctcagcaggttgcggtgattcggcgattggttgccgatctagacattcccgtggagattcgtcccgttccgattattcgtggcgccgatggcttagccgaatccagccgcaatcaacgtctttctgcggatcagcgagcgcaagctctggtgctgccgcaggtgttgagtgggttgcagcgtcgaaaagcagctggtgaagcgctagatatccaaggtgcgcgcgacaccttggccagcgccgacggcgtgcgcttggatcacctggaaattgtcgatccagccaccctcgaaccattagaaatcgacggcctgctcacccaaccagcgttggtggtcggcgcgattttcgtggggccggtgcggttgatcgacaatatcgagctc

SEQ ID NO: 133 - DNA, 813 bp, Corynebacterium glutamicum
atgcccatgtcaggcattgatgcaaagaaaatccgcacccgtcatttccgcgaagctaaagtaaacggccagaaagtttcggttctcaccagctatgatgcgctttcggcgcgcatttttgatgaggctggcgtcgatatgctccttgttggtgattccgctgccaacgttgtgctgggtcgcgataccaccttgtcgatcaccttggatgagatgattgtgctggccaaggcggtgacgatcgctacgaagcgtgcgcttgtggtggttgatctgccgtttggtacctatgaggtgagcccaaatcaggcggtggagtccgcgatccgggtcatgcgtgaaacgggtgcggctgcggtgaagatcgagggtggcgtggagatcgcgcagacgattcgacgcattgttgatgctggaattccggttgtcggccacatcgggtacaccccgcagtccgagcattccttgggcggccacgtggttcagggtcgtggcgcgagttctggaaagctcatcgccgatgcccgcgcgttggagcaggcgggtgcgtttgcggttgtgttggagatggttccagcagaggcagcgcgcgaggttaccgaggatctttccatcaccactatcggaatcggtgccggcaatggcacagatgggcaggttttggtgtggcaggatgccttcggcctcaaccgcggcaagaagccacgcttcgtccgcgagtacgccaccttgggcgattccttgcacgacgccgcgcaggcctacatcgccgatatccacgcgggtaccttcccaggcgaagcggagtccttt

SEQ ID NO: 134 - DNA, 951 bp, Corynebacterium glutamicum
gtgatttcaacaaatgagattgaaaatattcactcaactcgtcgggatattgaaatagcgcttgatgaatcttccactagtgagccaaagagattttcggaaatttcacacctttacctcgcacttgccgaaggtaaaatatcctttccggaaagcccaagtgaacttcgagaactctatgaccatttaatgcacggcgagctaggtaaagaaaatgaattagatggtgagattttccgccaaggacccgtggaaatccgcgatagtcggcaaaaagtgattcattcaggtttttctccagaatcacagatcatcgaaggaatcaacgcaattattaagctggcgcactcagaagaggaatccaaccttgttggcatcatgatgtcacacttcatgtttgaatcaattcacccgttttatgatggaaacggaagaactgggcgctaccttctcgggatacaattaagcaaaattctctcccctgctacagcactgacaatgtcttcggcaattaatcaatttcgaaacaagtactacaaagcgtttcatgccgtagaacaccgattaaatcgcggagacggaacaccgtttgttatttccatgcttgagctgttaattgcagcgcaagaaggtctcattgagaatataaaacaaagaatcgactttttggcaagccttgaggacgccattaaaacgcttcggggtaccaattcctttaagaaccatcagatcaatctgttgtacattctcggccagattcagcttttcggtaaggacgaaacactttcacttgaatcggcagcaaagtttcttaaagtttctaaggcaactgcaacgaggtattttagaactctccgagaaatggaattagttcacgaggtcagcaaacgccctttgcggtttgcgctcacggataaaggtcgtgagatagtaggtcttgaggtaaaaatt

SEQ ID NO: 135 - DNA, 630 bp, Corynebacterium glutamicum
atgtacgccttggttacttttgcgtggtgggactttagatcagttcgacctagaatcggcgccatgcctatcgacttcctccaacccgccgatattgttgccccacaacttctgggatgcacactcacacatggaggcgttggtattcgtatcaccgaagtggaggcatatttagattcgaccgacgaagctgcacacacctaccgtggcaaaaccccaaggaatgccgcgatgtttggccccggtggtcacatgtacgtctatatttcttatgggattcaccgagcgggaaatattgtgtgcgggccagaaggaacaggtcaaggcgtacttcttcgtgctggtgaagtggtttcaggggaatcaattgcacagagccgacgaggggaaggaattcctcatgcacgtcttgcgcaaggcccaggaaattttggacaagcgctcggtttagaaatcagcgacaaccatgcttcagtttttggtccctcatttttaatttctgaccgtgttgaaacacccgaaattgtgcgaggcccccgcattggcatcagcaagaacaccgaagcacttttaagattttggattcccaatgatccaacagtcagtggtcgccgagggtatccgaaggag

SEQ ID NO: 136 - DNA, 654 bp, Corynebacterium glutamicum
atgagcacttcttttgagtccattcccggagttactatctccgctcgaaaagccttgagcactgcggggtttaaagatctggaatcgcttgcaggtaccaattacgaagaagtggctggtctgtcaggaattggcgcacgtactttggagcgattgcaagcagcgctggtggagaagagaatgagctttggcggtaaagtgccagaggcagaacagcgcaccgcgacgtggacaacgctagattctgcagcaccagaggcaacagaaacctcagaatccccagagtacttcattcaaaacctagacattcctcgcagaattacccacggccggttgttgttggaaattttcaacagagcgacaggccagaaaccttatgtagcagggtcttcgattgttggttatgggcgagttcattatcgctatgccacgggtagggaagggatcactattcgtgtgggtttcagtccgcgaaaggcaaagatttcactttatggactaaccagtgcgcctgcgtctcgagaacttctgaagaaattgggtaagcattctgttggtgtgtcctgcctatatatcaacaaaccagaggatgttgatcttgaggtgcttgaggaaatgatccgtatttcttgggaagcggaacctggcgaatgt

SEQ ID NO: 137 - DNA, 924 bp, Corynebacterium glutamicum
ttgcctaaggcttctaggattgtcgttatgctccttcacccagatgcgcagttttatatcgataccttgcccactctcagcgcggaggagcaggtgagttttggtaaagacgctcctgtttcagaggctgatgcaacccatgtggcgacagatcaagatattgctggggtgccggtgagggtttatacgcctttatctggggctggggatttgccgtgtttggtgtacttccacggcggtggctggtccggcggcaccctcaacatgatcgatgccacggttcactctctagtggttggcctgccgatcatcgccatcagcgtggactaccgacttgcacccgcacacccatttccagcggctatcgacgacgcgtttgcagtggtcagtgccgtattggatggggtgtctgggctgagtattgatacttcccgagtggcaattggcggtgacagtgccggtggaaatattgccgcggttactgcacaacagctgcgtgaacgggctgtgggttctactcctgtattggctcaccaggtgcttatttttccggtaactgatgtttccactacatctacgccgagctatctcacatttggcaaagattgctacctgacaaaggacgcgatggaacgctacatcgaacaatatgccgatgggcacgaccgcaccgaccctcgactctcaccgctactggcatctgatttgagcgacctcccacccaccaccattgtgtacggcgaatgcgacgtgttagcccatgaagtgcgagcctatggacaagctctactagaggctggaaattccgtgacgatgactgaattcaaaggacagatccacgcctttattaacctagggggaatcagttccgatgcgcgggctgctcgacgactcatccgcgccgaattggaagcagcactttgt

SEQ ID NO: 138 - DNA, 627 bp, Corynebacterium glutamicum
atgcaggttagaaaggagccttcgatgtctaagactcgtacttttctgtttgatctttatggtgttctcatcaaggagcatggtgcggcgcagtttgagcgggttgcgcgtgcggtgggggagccgtccaagaacgacaagctgcatgaggtttatgagtcgcttcgtctggatctggatgccggccgcgtgagtgaggtgaattattggaatcagatcaaactattggtgggtttggagtttttggatatccaggaggtcatcgcggctgactacaggggcctttatgagcgtgatcaggacatggttgattatgtgttgtcgttgaaggcgaaaggccaccgcatcggaattttgtcgaatattccggaggggttggccaagctgttgaaggagcacaattcggagtggcttgatcagcttgatgcggtgactttgtcgtgcgatattggcgcggcgaagccggagccgaagtctttccatgtggcacttgaggcccttggtgaaaaagctgaggatgtgacctttattgatgatcgcgtgcgtaacattgaggcagcgcgcgaagaaggtctcagcacaattcacttcactggcttagattccttaaaagaaagcattcaggaa

SEQ ID NO: 139 - DNA, 558 bp, Corynebacterium glutamicum
atgacacctcaaccactgattttgcctttcggcgataaagttccgcggatccatgaaagcgcatggattgccccgaatgccacgattatcggggatgtcgagattggcccggatgcgtccattttttatggcgttgtcctgcgcggtgacgtcaacaaaatcaccatcggcgcccgcaccaacgtccaggacaattgtgttctccacgtcgatggcgatgcgccgtgcaccctcggcgacgatgtcacggtcggccacatggcgcttgttcacggcgcgacggtgggcaacggcacgcttgtcggcatgaaatctgcgctgctttccggcagccacgtcggcgccggcgcactcattgccgctggtgcggtggtgctggagggccatgaaatcccggcgaaagctttagcggccggggttccggccaaagtgcgcagattgcttgacgacgcccagtcccagtcatttatcccccacgcgggccgctatgtagaaacatcaaaagcccaggcttccatcgcggaagcactgagcttagatgaggttagggtacgagag

SEQ ID NO: 140 - DNA, 1143 bp, Corynebacterium glutamicum
atgcccaatcaggcccacttctctgcgtcctttgcccgcccctctaccccggctgcaaagtgcatgcaccatatccgcctcggccagcaactcattagaaatgagctggtcgaggccacaggtctgtcccaaccgactgtcacccgcgcagtcaccgctttaatgcaggcaggtttggttcgtgaacgccctgatctcacactctcatcgggccctggtcgtcccaatattcctctagaactcgctccaagtccatggattcatgcaggcgtggcaatcggcaccaagtcttcctacgtcgctttgtttgataccaagggtcgcacccttcgtgatgccatgctggaaatctcagcagctgatttagatccagacactttcatcgaacacctcattgctggtgtcaaccgcctcaccactggtcttgatctaccactggtaggtattggtgttgccacctcaggaaaagtcaccaacgcaggcgttgtcaccgcaagcaacttgggctgggatggcgttgatatcgctggccgcctgaactaccaattcagcgttccagcaaccgtggcatcagcaattcctgccatcgcagcttctgaactgcaggcttccccacttccccaccctgagcagccaactcccatcaccttgaccttctacgccgatgactctgtgggcgcggcctacagcaatgatttgggagtacatgtcattggaccactggctacaactcgtggatcaggtttggatactttgggcatggctgccgaagatgcgctgagcacccaaggtttcttaagcagggtttctgatcagggtatctttgccaacagccttggtgagctagtcaccattgctaaagacaatgaaaccgcacgggaattcctcaacgatcgcgcgaccctgctggctcacactgccgcagaagctgccgaaacagttaagccatccaccctggttctctcgggatcggcgttttccgaagatccacaaggtcggtcggtgttcgcttcccaattgaagaaggaatacgacgcagacattgagctccggttgatccccacccaccgggaaaacgtccgcgcagcagctcgagcagtcgcacttgatcgactactcaacgagccacttactctcgtaccc

SEQ ID NO: 141 - DNA, 1272 bp, Corynebacterium glutamicum
gtgagtttccgagatattttcgctgacaccagaccgctgaaagaaccggccttcaaacgcctctggcttggcaatgttgccaccgtcattggtgcccaattaactgttgttgccgttccggtgcagatttaccaaatgactgggtcctccggctatgtgggcttgaccgggctttttggccttattcctttggttatttttggcctttatggtggatccattgcggatgcttttgataaacgcatcgtgctgatctgcaccacgatcggcatgtgtgtcaccactgccggtttttgggtgctgaccattttaggcaatgagaatatttggctcctgttaataaacttttctttacagcaggcatttttcgcggtgaatcaacccacccgaacggcgatccttcgaagtattttgccgattgatcaattagcgtcggcaacatcactgaatatgctgctcatgcagaccggcgcaatcgttggcccgctgatcgcaggtgcgttgattccgctgatcggtttcgggtggctgtatttccttgatgttgtctccatcatccccacactgtgggctgtatggtcactgccttcgatcaagccatccggcaaggtgatgaaggctggtttcgccagtgtggtggatggcctgaagtatttggctggccaacccgtgttgttgatggtgatggtgctggatcttatcgccatgattttcggcatgccacgtgcgctttaccccgagatcgcagaagtgaacttcggtgggggtgacgccggtgcaacgatgctggcgttcatgtactcatccatggctgttggcgcagttcttggcggcgtgctgtctggttgggtggcccggattagccgccagggtgttgcagtttattggtgcatcatcgcctggggcgcagccgttgctttgggtggtgtggcaattgttgtcagccccggcgcggtgactgcgtgggcgtggatgttcatcatcatgatggtcattggtggcatggctgacatgttcagctcggcagttcgaaacgctattttgcagcagtctgctgcggaacatgtgcagggccgaatccaaggtgtgtggatcatcgtcgtggtgggtggacctcgtttagctgacgtccttcacggttgggccgctgagcccctcggcgcaggttggacggtattatggggcggagtagcggtggttgtactcactgcaatttgtatggtggcggtgcctaaattctggaaatacgagaaaccaaaaattaccggcatc

SEQ ID NO: 142 - DNA, 804 bp, Corynebacterium glutamicum
ttgagctccagagctttgaaggcgtcaagcacgcactccaccacatcgatcttcgccccgccctcgaatgggacatcatgggatttcccgaatcccccgacacgctgcccattttgctcagtgacctgcgcgaccccccttacgccaccactgctgtgccacctcaatccacgccacgctccgctcaccgatccacacattgacgcttccaggcgccaccgcggtcccttccacgccactcccagctacgcaggctttcacccctcatttaccgacgacaccgcccgcatgctgggcaacctagccaaaattggcgcggttgccacctgggaaaagacgcttgtcgacgccgcaagctgggccgaactcccccacccaccagtcatcgtcggggataccccgccctcgactgtcacgccggacaacgcctggtaccagtttcgcgtcggcaagcatcttggtcgcgatgcgttcgcggaaatcgtcatgtgccttggccacgtgttttgccatcatgtcccccaggtatggtcgacaacctgcgcatctcaggacgctgattccaccacgatgctcattgaagccgagaccgcgggggcattggccatcgctcgcgtcggcggcccgacccgtcgaggtggttccttcttcggcgatgcccttctcaaagaggggacgccacttcctgctggtttccgactagatgttgttctacacgccgcctcagaaattgaggatctgctgcgcggtgacaccacagccgttgtcagcggcgcttggtctgtggaggatcgccgaggttac

SEQ ID NO: 143 - DNA, 444 bp, Corynebacterium glutamicum
atggttaggctaaccttatttccaatgaatgtgaatcaacagttgggagcccgcaccgccatgaaccaccctgagaccgcaaccgtccttcgctccatctctgacatggttagcaccgaaaccaatccgcgccgtaaaagccgcctcgagcagctcatttacgccaccgccagcgcctggccccactaccccattgcccacgcagcccaggccgcggtgcaattagccaggccaatgcgggtttttgagctccagagctttgaaggcgtcaagcacgcactccaccacatcgatcttcgccccgccctcgaatgggacatcatgggatttcccgaatcccccgacacgctgcccattttgctcagtgacctgcgcgaccccccttacgccaccactgctgtgccacctcaatccacgccacgctccgctcaccgatccacacat

SEQ ID NO: 144 - DNA, 1941 bp, Corynebacterium glutamicum
gtgaaaattaaatccgtatttttgagcaccgctttaagcgcttccttactgctcgggatcaccccacccgtgctgggagcaacgatcaaccccagtttgcctctttctgcgttgagctcctcggacgatatcgccgtacccaacttcgccaaagaattaccgttagcttttgatgtaccagcaggcactgttccccaaagcttgagtggaacgctgcagattcctgccgagttttctggcggcgtcgtggagttttatgacggtgaccggctctttcacaccctgcgcctagaagttaatgattcccgagcacacattgaggttccgctgcaaagcgttcctgtcgaagacggccgcgccaccttttggttgcgcgccatgttggatcctgtaaacaaccagtggtgctacgaggagcaggaagtccgcttcttagacggaaacgtcacctttgaaggggcgacgattaacccagctgtggtggctgattacttcccgtcagtgctgcgcgcgttgacaatttacgtcccggaaaacccctctgaggcagtacaagaagccacgttagaggttgcgacctccctggattcggtgtaccgaagatcaggtctggatgtcaacgtagaaacgcttccaaccggcaccgatgctcctcctacacgtcctcaagattttgaacgccagattgtgctggttgacgaggcaacagaaagtaacacgcaaaaaaccgaattggtcaatcccggccaagacaatgcattcttgcgcctgaacggcaacgccgacgagctttacgatcaagcgcgcttgcttaccgacgcaaccctgccacttgccgtagacaccgaagtaacggcctcaggttttggtgatgtgcccaacctttctacagatgtggccaccctccaagaactgggtatcacgcagctcacctctgaatcagttgcgcgcacaagcgtcaccttgggcattgaacgctcccgcctgcggacctactcgcagtccatggacctgcacataacgggaacctacaccccattgccaccccaaaatgcaggacagatcacgttctccattggtgacaccgtgttggactccttgaccaccgatgacactggcatcattgaccgtgagttcaacgttcctggagacttggtcaaccgctacacggcgatcgtcgtggaattcaccagcaccggcgacgttaattgtggggtcacccagcccgtaggcctcaacattgattccgacagccttgtcacctcccaacattcagatgttcctgtactcaacggcttccggtccctaccgcagtccttccaacctcgtgtggacgtggcgtttgctgatcccagcgtgcaggaactctcccgcgctgtcagcgtagtgttgggaattcaatctatgagctcccagcgcatccgcccacacctggttaactgggatgaagccgtagccagcgagcgcccaacaattttcattgatgctgcgggcgcaaagactgatcaagtgccaagctacctcgcccaacaaggccaaaccctagagatcaccagcaagaacgaccaaaatgcggacggcgaacaactcacccgatccctgcaaaccaacgctgcgcttgttgtcggttccattcaggccgtgtgggatgccgataagaagcgcacggtgattgtggcaagttcccaggacaaccccgccgatttggatgccttgatttcgtggatgggagaagaccgcgaacgctggagtgatctcaacggcgacctgattgtcaaagtccgagaccgcgaacctgtgcaattgaccaccgtggaagccccagatcagcctggtcgatcggccacagcctttattgcgatcggcgtcagccttgtggtcattgccctgattgtcgcagccgtggtgtcagtgtccaggcgttcgcaaaaaggatacaaa

SEQ ID NO: 145 - DNA, 1539 bp, Corynebacterium glutamicum
atgagtaacccgtcgctagaacctctagaaccgatcgagctttctgacggtactgaaattgaagtttcagacgttgatccagaaccgcaagctggcaatgcgcagatggaagtacccagcttacggacatatgtttttcgcggaatcattgccattgcctgtttgatcattggtttttatgagagctttgtgctgatgtggcaaaacctccgaatcggcgtggccaactactcactacttgtggtgctcatggcgatcgtgttgtttatcggactggaccgcaagcgtgctcgtgcattgaacattcacgaccgcgaagtcgactacatcattggtggcattgtcgtactgatagccatcacgattaagagccagcttctgccacgttttgtggactgggaaactctgctgcgcttggatatgttcgcactgttattctttgcgtttggtatttccggcctggtgtttggcatgcgctctaccttttcttttgcacccggctggattttgctgtttggctacaacgcggtggcacacctgatcatctcggtgattttcggtggtggcttttggggcccggtgatggcaaacatcattggactgtctcttgcggtgttggtgtcctccaacagggacctggttcaggccacctatttggcactgatgacggtgttgtttggcgtcattattgccatcatcgtgtgggcgctgaccgatggcagtaagttcctcaccttggtcccagcagtgctggcaaccatcactgtggtgttggtgtcttcgcgttggaggcttggtcagtggaaaattcgtcgtagacaacccacggtggaaaaagccggacccgcgcttatcgcggtcgtggttgcgacagcactcttggcgtggattcctactccttatgtggagcgcgtcaacaacctccccgggcttcaaatgctggcaaagcctgccccaggtgttatcgcacctattggttggcacatcgacgatgtgcagtattacaactgggcttcgcgctacttcggccccggttcctctctgcttaggcagacgatgacggcagatcattacaacgaggcgtgggatccagatggactcgaccgaactgttgtggtggataccctccaatcggcggaacggttccagcagcgtgcctttggtgacgagacgctgtattccactctgagaggtcgaaagtcagataccgtccaggtggatctgggatacggcgtggacggacgcgcctacacggtgctcgatgaaactgacttcttgacgtacaccaagctggtttttgaatggcagaccaccaacaacaccgtggagaagatctccgtcatcgcggtggatgatcaccgcgcagaagcgaagttcccggagcttgcaccatcggttaccagaatgtttatccaggtggctaccattttgttccgtggaaatgacgtgaccatcgataccaatacccaattgaaagatcttgacctggtcagccaagttggccgtcagatcgtggcagaacaacaggtggggaggtca

SEQ ID NO: 146 - DNA, 636 bp, Corynebacterium glutamicum
atgatctgccgtcatcgtctgcctaagcagagaggaaccggggccgaagtagcgcgaagcccagttgtaatactgcacatcgtcgatgtgccaaccaataggtgcgataacacctggggcaggctttgccagcatttgaagcccggggaggttgttgacgcgctccacataaggagtaggaatccacgccaagagtgctgtcgcaaccacgaccgcgataagcgcgggtccggctttttccaccgtgggttgtctacgacgaattttccactgaccaagcctccaacgcgaagacaccaacaccacagtgatggttgccagcactgctgggaccaaggtgaggaacttactgccatcggtcagcgcccacacgatgatggcaataatgacgccaaacaacaccgtcatcagtgccaaataggtggcctgaaccaggtccctgttggaggacaccaacaccgcaagagacagtccaatgatgtttgccatcaccgggccccaaaagccaccaccgaaaatcaccgagatgatcaggtgtgccaccgcgttgtagccaaacagcaaaatccagccgggtgcaaaagaaaaggtagagcgcatgccaaacaccaggccggaaataccaaacgcaaagaa

SEQ ID NO: 147 - DNA, 1461 bp, Corynebacterium glutamicum
atgatggaacaagatctcagctaccgtgaaattcttcccctcaacgcgagtgaggagaagaaaaaggctgcactgattgatgccattgaagggttaagggtgcgcgatccgctactctctgcctcgattgcatttactagagggcagaaagtcgccttcattgctgtggtggtgggctttatcttgatgctcatttttgctcggcaagcagcacttattggactgtcagcaacgtgtacgttcatgtacctcattacattgttggacagatttatcatgttttccagaggtatccgcgcggaatccatcatccaggtatcggatgaagatgcgctggctttccctgaggacaagctgaaaacctacacggtgttggtgcccgcctatggcgaacctgaggtgattgcgcagctgctggcatccatgcacgcttttgattaccccaagcatcttctgcaggtattgctcatgttggaggaagatgatctgcccacgatcgccgcggcagaggcagcgggagtggatcaggtggcaacgatcattaaggtgccgccagcgcagccccgcaccaagccgaaggcctgtaactatggattgcactttgccacgggggaaattgtcacgatctttgacgcggaagacatgccagatcccctccaactgcgtcgcgtggtggtggcatttgaacgctcggcttccaatacggtgtgcgtccagtcaaggttgtcgtatcgaaacgccaggcagaatctgctaactgcgtggttcaccattgaatatgacgtgtggtttaacttcctgctgccaggcgtcatgcgcatgaacgcacctgtcccattgggcggtacctccaaccatctgctcacgggtgtcctgaaagatctcggcgcgtgggatcctttcaatgtcacagaagatgcggacctcggcgtacgcatcgcggcaaagggatattccaccgcggtgttggattcggtgacgtgggaggaagcaaactccgacaccatcaactggttgcgccagcgttctcgctggtacaagggctatctgcaaacatggcttgtgtatatgcgcaggccaaagtggttagtccaagagcttggcatcattcctgctgtgcgttttaccttcctcatggcaggcaccccgatcattgcggtgctcaatctgctcttttggtacttgtcgctcacgtggattctgggccagcccggcaccattgagcagatgttcccacctgcggtgtactacccagcgttggtgtgtttggtggtgggcaatgctgcgaccatctttatgaatctcattggctgccgggaaggccgcgaccccttgctgctcatcgcggttctcacgttcccgctgtattggctgctcatgagcattgcagcgttgaaaggcacgtggcaattgatcacgcgaccatcctattgggagaaaactgcccacggattggaggcg

SEQ ID NO: 148 - DNA, 1731 bp, Corynebacterium glutamicum
gtgcccatcgtcaaaccaatgccggcactgcccaggcgcgcgcccgtcctggcgagttcgcagatcgaagggtttgaacaccgtagagggtggcgtcgacaagcaaatttctggtttgctgcaagccttgccctgtactggtgcgccgcgctgtggatcgcgctggacgttgggtatttctggggcgacgcgctctcgcgcacccagggcgccctatccgcgctgtactcgcgcaaccccacgttgtcggcgatcggttacgtgtttacccctctgaccaccgtgttgcagattccattggtggcgctgagcccctgggtcccggaattcacgcgcgccgggttggcaggcgcattggtgtcatcagtgttcatggcggcttcagtgaggcaattgtggttgattgccagcgagcgtaacatccggtattggctcgcggtggtaggccttctgttgtatgcacttaacccaatgatcatcctgtacggcgcgacgggaatgagcgaagctccgttcatttacgccactctctgggcggtgcgcaggctgattcgctggacttctaccgacgacgtccacgacctcattacctgtggttttgcgttggcattggcgtttttagcgcgctatgacgccctcatcatggccttcgtagccatgtggactgtcggatttatgacatggcgcgcacgataccgccgtggcttccgcgaccgcatcggattcgcacttgtcgacatgctgctcctcgtctggccgatcggcttcgccttcgtcgcctggactggcgccagctggctcactaccggcgaactctttgcccaattcacctccacagacggcaacgctgcgatcatcgcagcatccggcggcggcgccatagggccccaagcgcttttcgacgcctccgtccgcaccttcctcatctccccagctctcctactcgtcgcagtagttgcagtcttttttgcttatcgacgccgcgaccccgaacccatcatccccttagctctcatcggctctgtggtgttcttccaaatcattacctactcacttggatctaccttcggcctgctgcgctttttcctcaccgccctgccgctcaccattatcttgctgttccaaattatcccgccccgccaccgattcccctcactgcgaccaggtgcgtgctaccgcgatcgcgtcaccggcaagtacgtgcccaaaacaatcaccggtgttttagttctcgcgatcttcggcggcaccggcatcaccctgtacggcatgagcagtgctaactgggcgccccaggaatatgccatccaagaactagttttcaacatgggatcgccatcgcaggacgccgtccacaccctgaacaccttctccactgaaatggatgtcgccgatttcgtcgactccctaaaccttggagacggcgaagtccttctctccaccacctacggcttcgccgtcctcaccgcatcaaacaaccaaaagcaattcatcatcccctccgacgaagacttcatcaccaccctcaacgaacccgctgagcacggcgttaagtacatcctcgccctcccacgcgaaggtcgcggcgccaccgacccgatcaacctgcgctacccagacatgtatgaaaccggcagccacatcgccacgatggaaatcgaattcatcaatcaaggccaaggacaaccaaattggcgcctctatcgggtgctcaccacacctgaacagtcg

SEQ ID NO: 149 - DNA, 621 bp, Corynebacterium glutamicum
gtggactgtcggatttatgacatggcgcgcacgataccgccgtggcttccgcgaccgcatcggattcgcacttgtcgacatgctgctcctcgtctggccgatcggcttcgccttcgtcgcctggactggcgccagctggctcactaccggcgaactctttgcccaattcacctccacagacggcaacgctgcgatcatcgcagcatccggcggcggcgccatagggccccaagcgcttttcgacgcctccgtccgcaccttcctcatctccccagctctcctactcgtcgcagtagttgcagtcttttttgcttatcgacgccgcgaccccgaacccatcatccccttagctctcatcggctctgtggtgttcttccaaatcattacctactcacttggatctaccttcggcctgctgcgctttttcctcaccgccctgccgctcaccattatcttgctgttccaaattatcccgccccgccaccgattcccctcactgcgaccaggtgcgtgctaccgcgatcgcgtcaccggcaagtacgtgcccaaaacaatcaccggtgttttagttctcgcgatcttcggcggcaccggcatcaccctgtacggcatgagcagtgc

SEQ ID NO: 150 - DNA, 1065 bp, Corynebacterium glutamicum
atggcccgcaagctgaaggacaaacttccccgaagttttgacaaaatcgtcgaatcgggcgattttgacgctttcaaagaggtcttcaccgagcgcgccctcgacgccaaaaaccgtcatggcaacactgccctccacatgcgtggagtacctgaagaattcaagatttggatgcttgaccagggcctcgatgtggatatccgcaacgaagacggcgacaccccgctgcacgtgcactcccatgactggaacttaagccccgattttctgctcaaacgcggcgccgatgtctgcgcagtcaacaatgaaggcgaatcggttgcctactccgctgccttcttcccagaaaacctcaaaaagcttatcgacgccggcgccgacccctactcgcgcgccaacgacggcaccacgccgctgatgcgtgtcattcgaagcgccgacaccggacaaatcatcgaactagcagaaataaccaagctactttccggcacagaattcaccgacgcagaattccgagaaacccaagaacgcatcatcgcaatgggtgaaagattcgaagatgtccgggaagtctacaacgaagaatccgtcgaccaagcatctgcggacatgatctggctctacgatcgtttcgacatccccgaagaactccgcgccaacacaccaattttgcacgacggagtaagcccaatagaactgcctggggatacctggcaagaacaattcatcgaaggctacgatctcctcgttcccgcaatgggcaaagcgaaatccctgcaaggcgaagccatccgaattgccggacgagtatccaacgaatttcacggcaacggtggcgtcaactgggacaaagacttcaaacgcatggccaaatctctcaaccacatttgtgagcagggcgttcctttgggtgagccagaattagaagaactggctgcggccgttaaatcagtgcgcaaaggagaacccaccgaggaggagatcgacacccttccacggttggccaccaaatgggtcgcacaaaacccacaaccgctgccactgggagaggttgactacaagcgc

SEQ ID NO: 151 - DNA, 756 bp, Corynebacterium glutamicum
ttgatcgtgttaaccatcgctattgtacttctcgcgtcagtcctcatcggtgctcttctccaacgcatgacaggattgggcgtcggtctagttaccggcccagtcctgacttctttgttagggccgctagcaggcgtgaccatggtgaatggtctgtccatcatcaacgcggtgaataatgcgtggtcggtgcgcaaacgcactgactgggccaaattccgaattcttgccggcgctttggtgcttggttctgttcctgctgttgcagtggtgtatttccttaacggaccatggctgttgattttcgttggtgcgatggtgctgctcgcgttgggtgtttccctgttcccaacagagaaattcgcactcaagcaagaagctaaactgcctatggtcatcttcggcatgattggtggattcatgtccactgttgcaggcatcgcagggccatccctgactgtttatgcgcgcctgagccgctgggattaccgcgactttgtggccaccttgcacccagttctactcgtggccaacaccgtatcgttcctgctcaaggttatcttgatcggtggactcgatttcggtggcgcacccgcatggctctggatcggtgccgtagcgatgatctttgtcggtgcttggttgggtgaaatcgtcaacgctaaggtgtccaccccaatggccaagcgcatcgctacgctcctggcagcagctggtgccgcagtggtgttgttccgaggcatcatggaattggtt

SEQ ID NO: 152 - DNA, 879 bp, Corynebacterium glutamicum
gtggcaacaaatcgtacatcttccgctggtgtcatcacgtctgttctcgcatccgctttgttcggagcgatctttttcatctctggggcgattgaggcaaaggcggaaacacttgttgcttggcgtgtccttctaacagcggcatgctatttgcttgcccttctgcaccctgctggtcggaaggtgtttaaggaattttgggacacactaaggtcccaacctcgtcaaattctgtactttatcttcctcgttgtactcatcacgcttcagctgtggctgttttcttggtcgcctaagagtcatgctttagatgcctcacttggttacctgttactgcccattttcctagtaattgtggggcggtttttcttcgctgattacatcaccaggctgcagtggattgcggtgggaatcgcgctgatcgcagtaaccttgaaatttgtcattagtgcgcaattatcgtgggtaacttttgccatcgctgcgggttatgcactgtattttgcgcttcgtaaatactcggggctgaacaacgcttttgcttacggcgcagaagttttagcgttaagtcccctggcatttttcatgctcgccactgtcgaggatccgctgtctaacgccatgttgtcaatggttattctggcgggcctcgctggcgcattagctatggcgttgtatctagccgcctcaactctgcttagtatgccgatgtttggcctgctcagttatggtgaaccaatcttgctgtttgttgcagcactattacttggtgaaacgttgaatctcagcgacgccattgtctactcactactggcgtgcgccctggcgttactgggatttgatgggatacgaaggtctcgaaaaaacctcgagaccgat

SEQ ID NO: 153 - DNA, 717 bp, Corynebacterium glutamicum
atggatcttgcactggctcaggttgattccaccgtttcggggctttatgacgccctcgatctcatcggcgtgctgctgaacggaataatcggtggaacgatcgccaggcaacgaggctatgacatcattggctttctgttcctggcgttattttctgcgctgggtggcggaatgatccgtgacatgctgattcagcaggggactgtcgcggcgatcgataatcagatctaccttgcgctcgcgttttctggcgcgctgattgccatggcggtgaactttaaaggcagggtgtgggagctgtttaaagttcacggcgatgccattgtgttgggcgtctgggcggtgacgggttccgtgaaggcgatgaatgcgggggtggctccgctgccgagtattttcatgggcgtgctcaccgcggtgggtggtggcatggtgcgtgatgtggctactggccagacgccgacgatttttggtggcggaactctttacgctgtgcctgcgacgctttctgccacgtcaatggttatttttcatagctttgaccaggtaattctgggtatgattatttcaccgttcttgggtatcgcgttggcggttactgcgtattggtgcggttgggtcattccggtgaacacggatttcgcgccggtgaatctgacggtcagccaattgcgggcaatgctgtccaaagcggagcgtaaagataaggatcagaaa

SEQ ID NO: 154 - DNA, 333 bp, Corynebacterium glutamicum
atgaaaacttatgcagtactaattgcggtggcagggttggcacttgctgggtgtagctcgtcggctcctggaatctggcgtgccactgaacccgcagatgcctaccttgaaatagccgatgacggcacgctgtccggaaccgacggctgcaacagactttttggtggctgggaaaaagacggctctaccatcactttcggcgccatcggtatgacagaaatgtactgcgaaggcgtcaacgattggctgtcccagatgcacaccgccaccgtcaccgatgccaccatgaccattttcaacgaggccggcagcaatattggcgagctaaaacgc

SEQ ID NO: 155 - DNA, 1659 bp, Corynebacterium glutamicum
atgactcttcagagttctgataaacgttctccttcactgttagacgcctcctccgaggtctttgtccatgatttggcagctttgtctcccactgatgccactgcatggggtatctcaggcttcgaaggtgatcttcaggatttctctcctgactattggaatgccatcgccgaacgcaaccgcgacatggttgccgatgttgatgcttttgatgacggcactgatgacaacgatgacgaagaagatttcgatgacgttgaccgcgtcaccgctgatgttctccgtgatcgcgtatgcctggatctggccctgcaccaccagggcgaaaccttagcgaatctcaacaacattgattccccagtccagaccatccgcgataccttcctcatcatgccccgcgagacggacgatgatgtggaaaatctccgcgaacgtctctcccgcgtccccgacgctctccacggatactgtgaatcactcgctgaggctgccagccaaggccatgttgcagcggtccgccaggtggaagaagtggtgtcgcaatgtgaggacctcgctgatgaggactccgttttgcagcaccttggcttggatgaaaatgatccagtagttgtagaggcccaggaagcttttgcacgagttgccggttggttagcagagcaactggctccgcatgctcctcatgtggatgcggttggccgggatcgctatgaaatgttctcccacctgcacgtcggcgagtttgtagatctggatgaggcttaccaatggtccctggaacagctgcgtgacattgatgctcagcagcttcaggtagcccagcagctgtacggccctggcaccacgatccgtgaggccatgaagaagctcaatgctgatgagcgctacctcatccgaggcactgatgctctgcaggagtggatgcaaaagaccgctgatcaggcaatcgctgatctagatggcgtttccttcaacattccagagcaggctcgacaggttgagtgcctcatcgatcctgctggaactggcggcattttctacaccccaccaagcgatgatttctccaggcctggccgcatgtggtggtctgtgcctaaaacccaggaagtcttccacacctggcaagagctcaccaccgtgttccacgagggtgttcctggccaccacctgcagatctcccaaactttggtggaaaaggatctgaacctgtggcgtcgagtcgcttgctggaactctggccacggtgaaggttgggcgctgtacgcagaatctctcatgaaggaattgggataccacgaagatccaggcaacctcatgggctaccttgatgctcagcgactccgtgcagcccgcgtggccattgacatcggaattcacctgaacaagaggaacccagagtgcaccggcctgtgggatgcgtcttatgcgcgcagcttcctgcgtgaaaatacgtccatgaatgaagatgcgctgtactttgagctcaaccgttaccttggttggccaggtcaggccgcatcgtatgccattggtcagcgactctggttgaacctgcgcgatgaggccattagccaggggcaaaccttggcgcaattccacagcaaggcattgtcctatggcagcatcccgatgggcattttgcgcgatcaggtgctgaac

SEQ ID NO: 156 - DNA, 1137 bp, Corynebacterium glutamicum
ttgagcgataaagaaccagacccccacgaacaaattccagagaagccatcccgcaaggttattgcacttcgttggtgcatcgtagcgccgctgtcgctagccgtggggtggctttttactatgtggggtgtgccagccgcatggatcctcggggcgatccttgttgccggtgtatgtgcgctgaccacagggcaagatcttccgatggccaagggggtgcatgtttttggtcgctcaatcgtggcgatgctggcggcgctgcctttgattagttcttctggttcggaacttgttcgtttcctcatcccgggtcttgtgatttcctttttcaccatcgcggtaggcatcgttggtggtttgttgctggcaagatccaggccggagattttgccggaaactggtgtgctgtccatgctggcgggtggcgcgtcggtgatgccgattctggcccgagagttgggcgctgatttccgctatgtggcgctgacgcagtacctcaggttgttggttgtgtccatgacgttgccgctggtgacgcactttttcgtccctggcggggcggatttgggatcgccgcctgagaaatggttggacgtgttgagtttgggagagttcgggacgtcgataagcgttttatcgctgctggtgctcttcggtattgtgctggccggcgaacctctcggcaggttgctgcgcttgcctgcccctgcggtgatggggccgctgatcctgaccgtgctggtgagttttgtgattccagatgatctcagcctgcaaccgccaaccgtgtttaagattatcgcgttcatggcgatcggttggatgtgtggcggtgccttgaatatgaccgcgctgaaggtgttttctaagcagcttccggccacgttcttgtttattttcgcgctgcttgcggtgtgcgcaggtgcggcggggctgctcacctggtggttggatatcagcttcttcgaggcttacctagcaaccagccctggagctctggagacggtgttggcgctgtcctcggaaggatctgcaggcccggtggtggtcacgatccagatcattcgactactggcaatcttgaccatcgccggtttgatccccacgctactgcgacgcattttgcgtagggatcgt

SEQ ID NO: 157 - DNA, 798 bp, Corynebacterium glutamicum
gtgataggagcgcaccacatggggttggaattagcagctagcgggtggggcatcctcatcgcaggcgccgccgtagccggatggatcgacgcagtaatcggcggtggcggactcgtcctcatcccgctgatcctcgcggtcatgccgcaactcgcacctgtgacagcgctggcctccaacaaactggcagccgtcaccggcacggcatcggcggcattcaccctggtcaggcgcgtcaaacccgacaaaaaactgcttgcgctctacgttctggtggcagctgtgtgctccggtgcaggcgccctggctgcgagtctcattgacaaacaaatcatgcgaccgctgatcatcgtgttgatgctggtcgttggcctgatcgtggtgttcaaaccaaacttcggaaccggcgaaagcaaagccctgcccaccggatggaaacgctgggccgccatcgttgcagtcggactcatcgcagcctacgacggcatcttcggacccggaaccggcatgttcctcatcatggcgttcaccgcactgctctcccaaaatttcctgtcctccgcagccatggcgaaggtcgtaaacaccgcaacaaacctgggtgcgctaattgtattcatcatcggcggccacatgtggtggaccctaggactcgtgctggcagtcgccaatgtcgcaggcgcacaactcggtgcccgaacggtgcttggtggcggtaccaggctaattagatacgcactactaaccctggttgtcgtcatgagcgtctacctcacctggcaacaaatccaaggaatg

SEQ ID NO: 158 - DNA, 624 bp, Corynebacterium glutamicum
gtggtgcgctcctatcacatcccggtatcagtcttgcatcatttgtgttgtttaaagtatatggctgttgaagtgccattttcgcggattagcatgggaatcaccagtatttctggacggttaaggatgattcatatgcgtaatcaaacaatcgctgcggtcgcagctttggtcctgctcaccgccgccacgcccgcgatcgctgccaccccggcgacagctggaaacggactctattccattgacatgggcgacgagcaaaagcttacctgcgtgcttttcgatgagccctccaccgaagcgcacgtcgtcgccagctgtgctgcgactttcccggtgacctggaagcttctcgacggcgctcacgaacaagccgcgaaacttgaaatcacccaggctcaagacggtgaactctcggtgacagccagcaagcagccgttgatcaccacgatgattgcgcccaccagcatcactaagcccatcactgtcaataggcttgtggttgttcctggtgagaatgaggttcgcttttatgctaccgatcctgatgttttaccagtgctgatcacgcctgactcctatgaagtgttgaccgattccgctgctaaagtgaaagcgacatta

SEQ ID NO: 159 - DNA, 405 bp, Corynebacterium glutamicum
gtggcagggaacattcctaggatgggaggcatggcaaagacaaaactagaaagcatctccgagcgcaactcggatgatccgcttagttaccccgacctgactcttgcaccaatatccacaacagtcacagtcgtggtcgccgaagacaccccaaacgataacttctcagaacttctcctcggcgcagcagaatcaacccgtcttttaggactcgacgagctccacatcatcgctccatcagtccacctacccgctctcgcagtagcagccgccgacatcgcacaccatctgccagagaaattccaattctgtgaagccgaaacctgcactcatctccaccccgacgatgacacctatctcacggctgaatccgttgctcaattgggtacgaagctgaagtctgcg

SEQ ID NO: 160 - DNA, 2388 bp, Corynebacterium glutamicum
atgagttcaagaattggcaattttcttataaatcgcatttccacgggcctgcccgtagaaaatattatccctcacctgcaagaagctttttcggccggacctaaaaaccttgtcattcaggcccctcccggcacaggaaaaacgacacttctccccccattagtagctaacatcttatgtaatgaaggagcgggaaatgccaccccaaccaaggttttagtaacggcacctcgtcgtgtggccgtccgagcagcagctcgcagactcgcccaactagatgatagccagctcggaacaaaagtgggattcagcgtgcgtggtgaacatatttcaggctcccacgtgcaatttatgacccccggtgtgttaatccgccagctcttaaacaacccagaattacccggcatcggcgctgtgattatcgatgaagtccacgaacgtcaactcgattccgatctactgctaggaatgcttgctgaactcagtcaactgcgcgacgatttctccctcatcgccatgtccgcaaccttagattcagataaattcgcaaacttattagacgctcaggtccttagtgttgaagcaccgattttccccttagacatttcttatgctccagcccgcgcgcctcgcctcaatgcaaaaggtgtcgactgggatttcctcgaccacatggcgcagaaaactcacgatgcggtgacacattcagagcactctgcactcattttcgtcccaggtgtgcgtgaaattgatcgagtaatgagcacgctcaaatcgctcggccataataatgttttcccacttcatggccaactcagcccgaccgaacaagaccgcgccctcgcaccgtcacaacagcagcgcatcattgtctccactcccgttgcggaaagctccctaactgtgcctggagttcgcatcgtggtggattccggcctctcacgaagccccaaacgagactctgcccgcggcatgacaggactgatcaccagcagttgcgcgcaggcttcagcaggccaacgcgcaggtcgcgctggccgtgaaggaccaggacaaataatcagatgctattccgaagaagacttctcccacttcccacgatttgtgacaccagaaatcagctccgctgacctcacccaagcagccctctggctcgcccaatggggaacgtcacctgcggatttaccgcttcttgatcaaccccctcacgcagcctggacggctgcacaacagatcctgcgcctcatcggcgcgcttgaaggtgacgctatcacgagcctgggacatcgcttatcgacgcttcccctctgccctcaactcagcgcttctctcctccgcttcggtgaacaatccgcaaaaatcttggcggtggtgtccgaaaacccgcagggggacgtcgaaaagcaacaacccgacaagcgtgaagtggaacgccttcgccgtttggcacctgcgtcggttggaaaagcgagtgcggggcaaatcgtaggcgctgcattcccgcagctcatcggccgaaaaatagacaatggagaataccttttagccagtggaacccgcgcacgcctcatggattcagatctcaaagatgccgaatggatctccgttgctgcaattaaccgctcacaaaattctgccatcatccgcgccgccgcccgcatttcagaggacgatgccatagacatcatcggagtcgtggaagaaacccgcgcgatttttgtcaacggaaaagtccaagcccggaaggtcaaagcagcaggcgcgatcgaattaagttccactccgacaaaaccaacacccgccgaagcctcggaaacaatcgccacagcccttgccaaaggcggaatcgacctattccacttctccgacaaagcggcatccttgcgtgaccgactgaaattcatccacgaacaccgtggcgaaccctggccagatattgaaactgcggacccgcacctgtggttatctccagaaattgaggcgctcagccacggaacacgactaaacaatatcgatatgtatcccgcactccagcgacttctcccctggcctgaagcaaccaactttgaagaattcgctccttcccacctatccgtacccagcgggaatcagcaccgactagattattcatcaggcaggccagttatacgagtgaaattacaagaatgcttcggattagaagaatccccgcagctctgcggaatcccggtgcaatttcatctcctgtcacctgcgggaagacctcttgcagttaccgatgacctgcgtagtttctggtctggcccgtacagccaagtccgtgcagaaatgcggggccggtaccccaaacacccgtggccggaggatccatggaccgctcctgccactgcgcgcaccaagaatcgcatg

SEQ ID NO: 161 - DNA, 315 bp, Corynebacterium glutamicum
atggaaagtaggaaagtcattgtgggctgtgctgagaaacaagacttcaccaaacttttatcaaaacaaaagaccaggtggactcccacagcactgatttctctcggttgtatcgttgtcgctattttagctttagtagttttccatggttcttccaggtcgtgcatctttcaccaagtaatttgccctttgattctgggaatttctggagcaattgcaggaatcgtcgcaaagaaaccactgctgactggcattaatctcggcttcgcattcttcttagtgcctgcgtatttaatatttttcggcaatattttc

SEQ ID NO: 162 - DNA, 675 bp, Corynebacterium glutamicum
atggacaatgactttgaatctatcgagaaaatgagcagcggcgattggtacgtggctaccggcgcggaacgtgaagaagtggcacaaaaaacagcgttacttttccacgaatacaaccaaattggacctacagaccccgcacgaactgccgaaatactaagaactgtactaaatcctgccagcggaacctgcacgatcaaagcgccagccatcattgaatacggcttcaacaccacgatcggcgagcatgtgttcatcaactttggcctcaccattttagatatcgcaccggttcgcatcggggcacgcagcatgctcgggccaaactgtcagctcttcaccgcaggtcacccggtcgatgactgggaaatgcgctccggtgggtgggaaaatggcgcacccatttccattggcgaggatacgtggctgggtggaaatgtcaccgtcgttggtggcgtgagcattggcgataggtgtgtgattggcgcgggggccgtggtgaccaaggatattccggatgattctattgctgtgggcaaccctgcgcgagtagtgcggaaacgtgatgatagccggctcgaacgttcgcagctgccagaaggtgcttccgtggatgcgttggggattcttcctacaaaatcacctaggctgtcagaaaatattgccgaaaaatat

SEQ ID NO: 163 - DNA, 690 bp, Corynebacterium glutamicum
gtgcctacgcttttcgacgatcccctccaccaacttcccagaccaccgcgcagggttgcagctggcgtggtgcacctgcccaacttcctcggcttggccgagcaaaaggcactggtcgcccaggctcgagaccttgcgcgtgaagttgtgggcacaccgttggcgatggtccgacccaagctgaaaagtggtcagatgagtgtccatatgttgcatttaggaaagtactgggcatccaatccttatcgctatgtggatgtcgttgatggttttccagtgccaccactgccggattctttcgtggacttggcacaccgagcattgctgtctgcaggatctttaagcaattcacttcagtcttggtcggaggcatatcgagcagaagcggcattggtgaattactactcgccagatgcttcaatgggcatgcaccaagacgctaatgaagaatcggaagcccctgtgatctccctatcgatcggtgataccggaatctttcgactgggcggcactctaaaccgcaataaaccgtggacagatatcccactaatgagtggtgatctcatcgttttcggaggtgcaaacaggcaagcatttcatggcattccctctattgaggccaatactgcacctgcaggatgcgggttgaaagaagggcgaatcaacatcacgatccgccaacttgcacta

SEQ ID NO: 164 - DNA, 525 bp, Corynebacterium glutamicum
atgacaacaaacaaagctaatccaaatgaacttgtaatctgcgctgatgaaaagtcacggccccgctgggcatctagaagtgagctgtgttgggagtatttcgacaatgagtggggcagacctccggtggatctcaatgctctttttgagatcttgacgttggtagttttccaagtgggtgtcacctggcatgctgtgctgtccaaacgggaagggttccgtcaagcattcgcccaattcgatgttgcaaaagtagccgccttcaatgaggacgacgtggaacgcctacttgatgatctacagatttttagaaaccgaagaaaaatcaacgctgccatcaccaatgccaaagcgttgctggagttaaacgatgaaacaggcacctttgactcaattattgccgaccactcaactgacgccacagccatggtgaagcatctcaaagccttgggctttacccatatcggactgacctccttgagcatcctccagcaggccattggggtcacagagctgaaggctgcc

SEQ ID NO: 165 - DNA, 678 bp, Corynebacterium glutamicum
atgacaacagcacagtttctagcgctttttctggtgtggatcgcagcaattgcatcccctgggccagaccttttccagatcatcaggctaagtgccaaaaaccgccgtgatggcgtactgactgccgtaggcatcatggtgggaaactccatctggatcatagccagcctccttgggctctcggcactgatctccacgtatccagcaattttgaacctgttgcagctcgtcggtggcggttatttgacctggatgggcatcggggcggtgaggtcatggtggacgaaacgctccacacagcaagctgcagcggattctcaagctgtagagaatacgttggtgacagccacggctgcatctgtcggagtgtggccagctattcgatctggcattgctaccaacttgtccaaccccaaagctgtgctgttttttggttccgttttcgcccaatttgttagacctgacatgggaatcgggtggagtattttcattggagtcttcctcaccctcactggcctgctgtggtttgtggggttcgccgtcttggtccgcaaactagccgctggcctcacccgaaatggagccatcatcgacctgctaacgggggtgattttcatcgggctgggaatgttcatgatcttcgagggggttgtaggaatcggtggcagggtagtgggt

SEQ ID NO: 166 - DNA, 291 bp, Corynebacterium glutamicum
atgcaacctgaagaagtgcacatcaaggacgagaccatcaagttaggtcagttcatcaaattggccaaccttgtcgaatcaggcggagcggccaaagatgccatcgctaacggtgatgtcaccgtcaatggtgaagtggatacccgaaggggtaagacacttcgcgatggcgatgtggtgtgcatcggcgaggtatgcgcgcaggtgtctactggtgacgcagccgacgacgattattttgacgaagccaccgcaaacgatgacttcgatcccgaaaagtggaggaacatg

SEQ ID NO: 167 - DNA, 852 bp, Corynebacterium glutamicum
atgccagcctttgaggcaatgccaggaatgccgtattggatcgacctgtccacctcggacattgcaaaatctgcacacttctacgaaaacgttctcggctgggaaattgaagaagtcaacgatggctaccgcatggctcgtctgcagggactacccgtggcagggctgatcgatcagcgcggtgaatcaagcatcccggatacctggattacctacttcctctcctacgatctggatgccactgcaaagaagatcgcagaactgggtggacgaattctggccgagccaactgacgtgcacttgggacgcatgatcctagctgttgatactgccggcgcactgttcggcgttattgagccaggcagcgaggaatcattcgtcgctgctggtgaaccaggcacatccgtgtggcatgaactcaccactgtctccaaatattccgaagctatcgatttctacggtgagctgttcacttggacaacctctgaaatggctagtgctgaagacgatagtttccgctacaccaccgcattggctgacggttccgcctttgctggaatttttgatgccaaaggccacttcccacctcaggttccaagcttctggcagtcctaccttggcgtgctcaacgccgatgatgctgcagcgaaggccaaggaatttggtggcgatgttattcgtaagccatgggactcagaatttggccgcatggttctcatctctgattccactggtgccacaattaccttgtgtgaagtagaggaatacgtcgaggaagcagcagaaggcgatgatctcttcgacatcgatctcagtgctttcgaagagcagttccgcaagcaagaaggacag

SEQ ID NO: 168 - DNA, 342 bp, Corynebacterium glutamicum
atggaggaattagaatttgatgagctcacctccatggtgctcgactgcgcagacctcattccgcagggaaaagtagcaacctacggggacattgccaaaatagtaggaactggtccgcgtcaggtcggccggatcatggcgaccgctgggcaattcacatcttggtggagggtggttcgctctgatggtggctcccaggtagcgggcaccgcgcggtctaaatgggcagaggaaaatattgcgttttcagagctcagcgcaccaaaagtgagaatgcagcagcatcgtctttctgaagaagaactagaaactatcgcagggaagcttcaacaaatagctgac

SEQ ID NO: 169 - DNA, 930 bp, Corynebacterium glutamicum
gtgcaagttttttataacagggcagtaacgtttactggtatgaaaactccccgtctgctgaagatcctcagcgcgatggtggctgtcactggacttctcattccaacggtggtccccatggccgccgctgatgctgctgaactgtccgacaacgttcccgatcgcacccaaattgccatcatcaaccctgatggcagcgtgcaagaatctgacaacgccgaagaatcccgcccggcattatccctggccaagctgtatttgggttattatgtgttggctcaaggcgcggaagaagatattgaactagtcccagatatgatccgctactctgatgatttcaccgcggattatttggagagcgaatacccggaagcaattcctgaggttattgatgccttcgatttggaagacaccgaatgggctggtttctggggcaatgcaactaccagtgcggtggatattgcgacgtttgtagcagcactcatcgacgatcccacggcgcagcccttgcttgacgcaatgtctgacaccgctgagtatgcggcggatggctacgcccagaactttggcacttttacattgtccgatgtcaccggtactaaatttggttggtctgattccctcgatgtgcattcatcggtcagctttggccctggttttgtgatcgctgccaacacctacggtgacgccgaaacgctcaccgaagatgtccaagattccgtgtcttcgctgtatccggaggaagtaaccaccgcgatcgaggagcaggtggatcagctgtgtgagtgcgctgcagagactacgcatttgggaatgcacactggcgcggagctgaaagcacagcttgagggcactatttatggaaaaaccctcagctttttacctaattcagccccagcgccagcgtttatttacaacctgctggcacat

SEQ ID NO: 170 - DNA, 657 bp, Corynebacterium glutamicum
atggtggcgggcgtaaccgaccgccttgcccacaacctcattcatatcgtggaggttatggcctggggccagcggatagtccaggtcaaggatggttgtgccggacaattccgcagctgccgcgacctctggacgccactggaactccaacgcatcaccggaaccgcgccaccaaccaccgctgtggaacgatacagcccagcggcccgtcggattcgacgggtggaaaatcgcgcctccgacctccgggacgtcatcgacgctcacaccaccgataaatgcgacacccggcatggaatgatcaaggccagaacccaacatgatcatcgcagtatgcgtggtgcgatcgggaagatgtgcaatatagcggtctgctggatcaggatcgccggcgccacctgcccaagggggcgtgaaatctggaacagggtagtgcgcatcaatatacgatccgagctgctccagctgttcttcttcagaaagctgacgatccttaccgccaacctcgaactcctcacggaagcgtgcttcctgatcttgttcagtttcttgtggggtgttgttttcagccatgggcacaaccttagtgcgtgcgctcacgtcgctggttggaaagtgaaaatatcaacagtgttttgggtgggggtgagattggaa

SEQ ID NO: 171 - DNA, 933 bp, Corynebacterium glutamicum
gtgagcgcacgcactaaggttgtgcccatggctgaaaacaacaccccacaagaaactgaacaagatcaggaagcacgcttccgtgaggagttcgaggttggcggtaaggatcgtcagctttctgaagaagaacagctggagcagctcggatcgtatattgatgcgcactaccctgttccagatttcacgcccccttgggcaggtggcgccggcgatcctgatccagcagaccgctatattgcacatcttcccgatcgcaccacgcatactgcgatgatcatgttgggttctggccttgatcattccatgccgggtgtcgcatttatcggtggtgtgagcgtcgatgacgtcccggaggtcggaggcgcgattttccacccgtcgaatccgacgggccgctgggctgtatcgttccacagcggtggttggtggcgcggttccggtgatgcgttggagttccagtggcgtccagaggtcgcggcagctgcggaattgtccggcacaaccatccttgacctggactatccgctggccccaggccataacctccacgatatgaatgaggttgtgggcaaggcggtcggttacgcccgccaccataatccggtgtcgatcacgggttggggttattcctcgggcgcggcgttagccgcgattaatgcatcgcttttcgacgccctggtcctcacctttccggacctgggtagcgtcgagaagctccctgccgaaattcgtggagacgctgtagtgcccgcggcggctgcgtggccgacgacctttgtgcagatcgcggcgcaggatgagatcgcggagcggccaggagagcttggcgacgcgaccgtgaaggaatacgtttcccgccaccgtatttccacaccgaaggtcgcgcgcgaaaaaatcaccgacgtggcggagttccttaaaactgtttgc

SEQ ID NO: 172 - DNA, 405 bp, Corynebacterium glutamicum
gtgtcagcggtaatgcctgcgcagctccctccagggcctgccgagcgtactgtgtactcctacggtgttcgcgcaggggatcagttgcacatttcaggaatggtggcttttgattctgacgcgaatattgtcggcgaaggggacattgaggcgcaggctgaacaagtctttaagaacctgcaagcagtagtcgaggaggcaggaggaacgatcaacaacattgtttccaccactacttatcttgccgatgtcaccgatgctcccgttgttaacgctgctcgctcccgctatttcaccggagaagtattgcccacccacaccgtaattggagttgctgctcttgctcggccacagtttctagtcgagatctcagcggtggcctatttgggggacctttcaaaagac

SEQ ID NO: 173 - DNA, 639 bp, Corynebacterium glutamicum
ttgaggagaaggttttctatgagtggcaccgccatcatgtacgacacgacagttgttccatcgaagaaagaaatcgcgcaggcttggactggttatgtggatcttcagggaagctaccgcctggtagatacggtggatggggaagttggcgttgaggtgctgatttccaaggatcgggaggggcgtttactccagattccgtttagttatcgttcggcagagattaacccagagcagacactttccacattggagcatggtgtgttgggcaagcgttgggtgactaatgcgttgggtgacccggtggcagtgcgggagtttattcgcactattttgacgggcgatgatggtgcagctcgtagcgatggcgtgaagggctatctggatattaaaggttccggcgatgctgagtcggtggatttacaggatgtaaagcttactgaggttacaaggcagcgtgcgattggttcggtaaccatcaacggtgagcgaaagcaattctcgctgcggttgcctcagttgctgaagaatttcagggagacagcggcgggccatacagctacgactcttcgtattgtggcgactcatccggaaaaggacgatgttgagctgctggtcgctgagttcaactggatggaa

SEQ ID NO: 174 - DNA, 741 bp, Corynebacterium glutamicum
gtgagcgtaatcgagggcaagtaccagctgaaacctcaaggccgaggtggcctgtggtggtcaatcgtgggtgtggcagttgttttgttgctgcttccaacgttgatcaacctggtggttccggataaagccaatgactacaagcagctagaaatcgatcttctgggtgtggattggtcagtgccaatcaccacggaggaatccgctgcggtgctgtgtgaggaaacatctgatgaaatcacacagaagtattgggactgcaacggggacaccacggtggtgaccatgatcgtcgagggcgtgaaagatccgtccaatacgttgcgtcgcatggtgggttcatcgctgataaccagtgtggatgacagcctagaggcagtatctagcgaagatggccgtgcgcatgcgttgtatgtgccaggtcagcaagaaggatctttgtggacgctgcctatcgtggcactgagcgtgcagggttcgggtgattatgaagacctcacagcgatcgcaattatcaacggcacctcgttggattattacagcacccacatttggtccagcatggccgctgaccgcgggttgccgtaccagcaggacttccccctgatgctggaagaggagccatggcaagacacccccggcggggatcgtcccttcgagctgcccaatgatttctttgatcagtaccccgatctttttggcccaggctccgtcattcccaaccttgaaggagaatcccta

SEQ ID NO: 175 - DNA, 2067 bp, Corynebacterium glutamicum
ttgaggtttcagctggtacttgccctcgattacgctcacactgacaggctaccttctggggtggacatgatccccaacgctcaacccacttgtggcaccaaccacaaaccctgtggcggtaaatcccctagagtaggccacatgaaggatctttatcgctttgtcaatggcctgtggcttgacacccacatcattcccgacgatcgcgcggtggacggcacgttccacaagctgcgcgatgatgctgaagaagacgtccatgagatcgtcaaggaagacactggacgcgcaggcacactttatgcctcatttatggatactgacgccatcaacgctgctggtgttgcaccgctcgatgcggatctgaacaggctgtctgttgctaactcatcgtttttcgcagctgctctcggcgaactggaccgtgaaggcgttggcgcgccagtaggtttctgggtggagaaggattcttcctccaacgaatccgtcgcctatgtcatccagtccggcctcggcctgcccgatgaggcttattaccgcgaggaggcacacgccgaaactctcgcggcctacaaagagcacgttgagcgcatgctcggctacttggataacagccgcctcttcggtctgtcggctgcttccgctgccgcacgaattgtcgccctggaaacggaaatcgctgctggccactgggatgtcgtgaagacccgcgacgccgtagccacctacaaccccaccgaactcggcgcgctgccaccaaaggtccgcacgctgctcagttccgcaggcctcccggaccagcgcctggtatcgatgatgccgtcatacctcgaccacctcaacggcttgcttgtcgacgaccgcctccccgattggcagctatgggcaacctggcacatcttgaggtctcgagcaggactgttgaccgaggaaattagccaagcaaacttcgacttctatggcaccaaactgtccggcgccaccgagcaaaaagatcgatggaagcgtgctgtcggcctggcagagcgcatggtgggcgaggaaatcgggcaacgattcgtcgaaaggcattttcctgcaagctccaaggagcacatgcttgagctcgtcgactacctggttgccgcctaccgtgatcgcatttccaacctcgaatggatgacgcccgccacccgcgagcgtgccctggaaaagttgggcaaattcaacgcgaaaatcggctaccccgacaagtggcgctcctacgaaggcctcgaattcggctccgacctggtggacaactcccgcaagggctccgcgttcctccatgactatgagctgggcaagatcggcaaaccagccgaccgcgacgaatgggtcaccaccccacaaaccgtcaacgccttctacaaccccgtggtcaacgacatcaccttccccgcagccatcctgcgcgcaccattcttcgaccccgaagcagaagccgcagaaaacttcggtgcaatcggtgctgtgatcggacacgaaatcggccacggctttgacgatcaaggcagccaatacgacggcgacggcaacctcaactcctggtggaccgacgaagaccgctccgcattcgagcagctcacctcacgtctggtcacccaattcagcggactcgtccctgccgtcctgacctctgaaggaatcgacaccgacggcgtcaacggtgaattcactctcggcgaaaacatcggtgacctcggcggattgggcatcgctgtcgttgcctacgaaaagtacctcgcagaccgtggccaaacctttgaaacctcaccagtccaaaaattcgaagcagaaggcgccgaggaaggcctggccgagcaagaattcaacggtctccaacgcctcttcctgtcctgggctcgcgtgtggcgcaccaaaatccgcccacagatggccgtccaatacctggccatcgacccacactcccctgcagaattccgctgcaatgtcatcgccggaaacgtcgctgaattctacgaagcattcgacgtccccgaagatgcacctgtgtacatcaagccagaagagcgcctagctatctgg

SEQ ID NO: 176 - DNA, 963 bp, Corynebacterium glutamicum
atgagtcgcatgtttagcatcaccttgtgggttgccatcctcctctcaaccccggcgctgtttttgagcttggccacgttcatcttcgtggatggcatctctgtcctcgtgaatatagtgttcgcggtgctctacttggtagtcattgttttcctgttaagtcgcaccccgctgtggccacgttttaaaggctccggcagcaagaagggaggcggattcgcgtgggcggcgtcatcattgttgtggggcgcgttcgttggtttcggcatcgtcatgttgtttgccggtccggtcatggatctcacggacaaactcggctgggatttcgttgccatgagtttcaccggagcgtatccagaagaaatcgccaaagcgttaggcgttgccatcatcttgttgagcttccgccaactcaaccgtccgtggcatggatttatcaccggcgcgctagtgggcttaggttttgaggtcaacgaaaacctcctctatggcgccaccggtgcaatcatggaccccaacgctgacctcgacggcgtccttatgatgtggcaataccgcaccatgttgggcccactcatccatacgttgctcaccggattcgcaggttacggcatcgcgttggcattcttccgcgcacgaaaaacagtcgcctggcgctggggcgtggcgatcggttggactctcatcgccttcgcactgcatttttcatggaacctgatgtgggaaaacgtaatcggttcctatgtcaccatcatcgtggtcagcgttgtcatgtacggtctggctatctacatcctctggagtaattgggccgaagcccgcaacgactccagctacgctttcgtcccgggaatcatcacaaacaccaaagatttatcgcttcttgacgcccccattccagtaggcgctgaggttcccgagtcgcgcattccccaacagatagaggaacccaaggcggagaac

SEQ ID NO: 177 - DNA, 759 bp, Corynebacterium glutamicum
atgaccaccgaagctcccatttggccagccgaactcttcgaagacctcgaccgcaacggaccaatccccctctacttccaagtagcccaacgcctcgaagacggcatccgcagcggagtcctcccacccggagcacgcctagaaaacgagatctccgtggcgaaacacctcaacgtatcccgccccaccgtccgacgcgccatccaagaagtcgtagacaaaggcctcttagttcgccgccgcggtgttggcacccaggtcgtccaaagccacgtcacccgcccagtcgaactgaccagtttcttcaacgacctcaaaaacgccaacctggaccccaaaacccgagtcctcgagcaccgcctccttgcagcaagttccgccatcgcagaaaaactcggagtttccgcaggtgacgaagtcctcctcatccgccgcctccgctccaccggagacatccccgtagcgatcctggaaaactacctccccccagcgttcaacgacgtctccctcgacgaactagaaaagggtggactctacgatgcgctgcgcagccgaggtgttgtcttaaaaatcgccaaccagaaaatcggtgcgcgccgagcagtcggtgaagaaagcaccctcctcgacatcgaagacggcggaccacttctcaccgtcgaacgcgttgcattggataattccggccaagtaatcgagttgggaagccactgctaccgcccagatatgtacaactttgaaaccactctggtggccagg

SEQ ID NO: 178 - DNA, 1017 bp, Corynebacterium glutamicum
atgacatgcgatcgtgagggtcgccacattccatcaaaaatgagtgaagggttgcatcgccacatgactaacttgacgagcactcacgaagtcctagctatcggccgcttgggcgtagatatttacccacttcaaagtggagtaggactggccgatgttcaatctttcggcaagtacctcggcggaagcgcagcaaacgtttctgttgcagccgcccgccatggacacaattccgcactgctgtcccgtgtgggaaatgatcctttcggcgagtacctgcttgctgagctggagcgtttgggcgtggacaaccagtacgttgccaccgatcagacttttaagaccccagtgaccttctgtgaaattttcccaccggatgatttcccactgtacttctaccgcgaaccaaaggctccggatctcaatattgaatccgcagacgtcagcctggacgatgtgcgcgaagccgatattttgtggttcacactcactggtttcagtgaagagccaagccgcggcacacaccgcgagatcttgactactcgtgcgaaccgtcgccacaccatctttgatctggactaccgaccaatgttctgggaatccccagaagaggccaccaagcaggcggaatgggcgttgcagcattccacggtggcggttggcaacaaggaagaatgcgaaatcgcagtgggcgagaccgagccagagcgcgcgggccgagcactgttggaacgcggtgtggagttggccatcgtcaagcagggacctaagggtgtcatggcgatgaccaaggacgaaaccgtagaagttcctccgttcttcgtcgatgtcatcaacggtcttggtgccggcgatgcattcggcggcgcgctgtgccacggtctgctctctgaatggccgttggaaaaggttctccgttttgccaacaccgcgggtgcgcttgtggcgtcccgtcttgaatgctccaccgcaatgcctactaccgatgaggtggaagcctccctcaaccagaaagtc

SEQ ID NO: 179 - DNA, 921 bp, Corynebacterium glutamicum
atgactcctccgattatctccccagagagctttgaagccctaaggcggatgcgtgcggctgaacccacgatggtggcggaacgtttcaagcagcgccgtaagcgtgaactgctcggtgaggacggcaagctgtttatcgtggctgccgaccacccagcgcgcggcgcacttgctgttggcgacaatgaaaccgccatggctaaccgctatgaactgctcgaacgcatggctatcgcactgtctcgcccgggtgtggatggtgtgctgggaactccagacatcattgatgatctggcggcgctcggactgctcgatgacaagatcgtggttggctccatgaaccgtggtggcctgcgtggcgcttcctttgaaatggatgatcgctacaccggctacaacgtgtcctccatggttgatcgtggcgtggatttcgcgaaaaccctagtgcgcatcaacttgagcgacgccggaaccgccccgaccttggaagccaccgcgcatgcagtcaatgaggctgcagcagcacagctgcccatcatgctcgagccgttcatgagtaactgggtaaacggcaaggtggtcaatgatctttccaccgatgcagttatccaatctgtcgccattgctgctggtctgggcaatgattcttcctatacctggatgaagcttccagtggtggaggagatggagcgcgtcatggaatccaccaccatgccaaccctgttgttgggcggcgaaggcggcaacgatccagatgccaccttcgcatcctgggagcatgcactcaccctgccgggtgtgcgtggcctgaccgtgggacgcactctgctgtatccgcaagacggcgatgtcgccgccgctgttgataccgcagcgcgacttgttcacacagatattcaacaattcacttcgcagagcatt

SEQ ID NO: 180 - DNA, 1512 bp, Corynebacterium glutamicum
atgtctgaaccacaaaccatctcgcactggattgacggcgcgatttccccatccacttccggcaagaccgctcctgtctacaatcctgcaactggccaggtcaccgccaatgttgcgctggctagccaggaagagatcgatgccaccatcgcttctgccaccaaggctgctaagacgtggggcaacctgtctatcgctaagcgccaagctgtgcttttcaacttccgtgagctgctgaatgctcgcaagggtgagctggcggagatcatcactgcagagcacggcaaggtcttgtccgatgccatgggtgaaatcctgcgcggccaggaagtcgtggagcttgctaccggtttcccacacctgcttaaaggtgcgttcaacgagaacgtctccaccggcattgatgtgtattccttgaagcagccactgggtgttgtcggtatcatcagcccgttcaacttccctgcgatggtgccgatgtggtttttcccaatcgcaatcgctgcaggcaacgcagttattttgaagccttcagagaaggatccttcggcagcgctgtggatggctcagatctggaaggaagctggtcttccagacggcgtattcaacgtgctccagggcgacaagctggctgttgatggtttgctgaacagccctgatgtctctgcgatttccttcgtgggttccaccccaatcgcaaagtacatctacgagacttccgcgaagaacggcaagcgcgtccaggcgttgggcggcgcgaagaaccacatgctggtgctgccagatgctgatctggatctggttgccgatcaggcaatcaacgcaggttacggcgctgccggtgagcgttgcatggctgtttctgtggtcttggctattgaatctgttgccgacgagctcattgagaagatcaaggagcgcatcgacaccctgcgcatcggcaacggtgccggcgacgagcagggcgagccgcacctgggcccactaatcaccgacgtccaccgcgacaaggtcgcttcttatgtcgacatcgctgaggccgacggcgccaagatcatcgtggacgggcgtaactgcgccgtagacgggcacgaggagggcttcttcttcggccctacgcttatcgacgacatcccactcacgtcccgcgcctacaccgaagaaatcttcggcccggtcctctctgtcgttcgtgtcgcatccttcgacgaggcaattgagctgatcaactccggtgaattcggcaacggaaccgcaatcttcaccaacgatggtggagcggcacgccgcttccagcatgagatcgaagtgggcatgatcggcatcaacgtaccaatcccagtgcctgttgcgtaccactccttcggtggttggaagaactccctcttcggtgacgccaaggcatatggcactcaaggttttgatttcttcaccagggaaaaggcgatcaccagccgttggctcgacccagcaacccacggtggcattaacctcggtttcccacagaacgat

SEQ ID NO: 181 - DNA, 888 bp, Corynebacterium glutamicum
atgcgttggttccataagaagggcgaactggcccgagatggttggcaaagcgttgtcgatgccaccaccccaggttgggaatataccggcatccgcattgccgaactgggcagtggtgaatcgcttgaactgaatgacactggtgtggaacgcatcttcattccacttcagggcagcttcgatgttgcccaccatggtcaggtgacccatcttcacggaagaaagtcagtctttgatggaccaaccgatgtgctctacctccccactggacaaacagcaacgctcagtggtcagggacgagtcgccgtggcggaagctcccactcaggaacccaaggagtggaagtacatcgctccagcagaaactcctgtggagttgcgtggagctggccgctcgagccgacaagtccacaactttggcaccccggaagctctcgatgctgctcgactaatcgtgtgtgaagtaatcaccccaggtgaaaactggagctcttaccctccacacaagcatgatgagcacatcccaggacacgagtccaagctggaggaaatctactacttcgaaagcgccccatcgcgagttggtggcagggccgaagcagcagaaggagctttcggaatgttttccacctactcctcaccagcgggggagatcgatatcaacgccatggtgtacagcggcgatatcgcgctagttcctttcggataccacggccctgccgtggcagcacctggctatgacttgtactacctcaacgtcatggcaggacctgatccggagagaatctggctgattaacgatgacccagcgcacgcctgggttcgagatacatggaccgggcaagcatttgatgatcgcttgccatatgagaacgcaaacaaggaggga

SEQ ID NO: 182 - DNA, 1728 bp, Corynebacterium glutamicum
atgccgtactaccaggctcgtaatgagcaggcgatggtgcaccagtctgttggatatgcacgcatgcaccgccgtcgtggcacatacgcatctgccgcatctgttggacccggcgcgaccaacctgttaaccggtgcggctcttgctaccaccaaccgtttgccagcgttgctgctgcctagtgatacttttgccacccgcgtggcggatccagtgttgcagcagttggagcagccatgggatatcgggctgacggttaatgatgctttccgccctgtgtctaagttctttgatcgggtgcagcgcccggagcagttgttctctattgcgttggctgcgatgcgtgtgttgactgatcccgcagaaaccggtgcggtcaccattgcgcttccagaagatgtgcaggctgaaatgctcgatgtgccggtggagttcttgcaggatcgtgagtggcacattaggcgcccacgtccagagcgtgctgcgttggctcgtgcgattgaagtcatcaaaaacgctaagaatccgatgatcattgctggtggcggagtgttgtactccgatgcggaaacgcagctgcaggcacttgtggagcagactggcattccagtgggtacctcccaagctggtggtggcgtgttggcgtgggatcatgcacaaaacttaggtggtgtgggtgccaccggaacgttggctgccaaccgcattgcgggtgatgctgatgtgatcatcggtatcggtactcgttacagcgatttcaccaccgcatctcgcactgcgttccaaaaccctgatgtcaccttcatcaacatcaatgttgcttccttcgatgcttacaagcatggcactcagttgcctgtgattgcagatgcacgcgaggcaattgtggagcttgctgaagccctgcagggattcaccgtggcagaggattacgcgcagcgcatcgcgaaggaaaaggctgcgtgggacgcagaagtagataagtcttttgccccctccggtcttgcgctgcctggacagccggagatcatcggcgcggtgcaggcgtcgacaagcgaaaaagacgtcattgtgcaggccgctggatccttgcctggtgacctgcacaagctgtggcgtgtgcgcgatgcgctgggctaccacgtggaatatgcgttctcgtgcatgggctatgaaatcgcgggcggtatcggcgcgaagcgtggacttgatgccgcaggcgatgaccgcgacgtggtgatcatggttggtgatgggtcctacctcatgctcaacactgagctggtcacggccgtggcagaaggtatcaaggtgattgtggtgctcatccaaaaccacggttatgcctccatcggccacctgtctgaaactgtcggttcgcagcgttttggtacttggtaccgcgaatatgacgctgaggcgaaaaacttccagggcgagcagattctgcctgttgacctggcgatgaatgcacgcagctacggcatggatgtcattgaagtggaaccaagcgcgaatgcgatcgaggatctcaaagcagcgatggcaaccgcgaaggcttcggagaaatccaccttcatccacatcaacagcgatccgttgatctacgcaccagacggtgctggttggtgggacgtgccggtgtcggagacgtccactctggatagcaccaacgcggctcgtgaagattacctgaaaaaccaagccctccagcgtccgctgctcggc

SEQ ID NO: 183 - DNA, 954 bp, Corynebacterium glutamicum
atgaccacttctgtacctgcatccaccaaagcttcatctgtggctggcgaaaacccaggcctgcgcatcggcaccgcacctgactcgtggggcgtgtggttcccagaggatccaaagcagatcccttgggagcgtttcctcgacgaggtcgtcaaagctggctacacctggatcgagcttggcccatacggctacctgccaaccgatgccaaccagcttgaagatgaactgggcaagcgcggcctgaagctgtccgctggcaccgtgttcaccggattccacaagggtgaagagcagtggaagcgcgcctgggatcaggctctcgacgttgctggtcttgcttccaagctgggtgctgagcacctcgttgttatccctgacctgtggcgctccgacgcaaccagcgaagtactggaagctcgcacccttgatgatgagaagtgggcaaagcttgccgccggtcacgaccgcctgggcaaggcgctgctggaagagttcggcatgaagcagcagttccactcccacgctgacagccacatcggcaccacccgcgaagtactgcgtttcctggaagaaaccgatgcgcgctacaccaacctctgcctcgacaccggccacttcgcctactacggcggcgacaacgtcaagctcattgagcagcacccagagcgcatcggttacctgcacctcaagcaggtcgatccgactttgcttttcgacgtactaaagaacgacaccccatttgccgaagccgtagcccaaggcatcatgatcgaaccaccacacggcatcccagacttggccccaatcatcgaagctgtctccaagatcgactccgagatcttcgccatcgtggaacaagacatgtacggctgcgacatcgattacccattcccaatcgctgagcgcacccgcaagcacatcttcggctgcacccacttcgcacgcgtcaac

SEQ ID NO: 184 - DNA, 1011 bp, Corynebacterium glutamicum
atgagcaagagccttcgcgttggagttgtcggtgcaggagccatgggtgctgaccacatcgatcgcatcaacaaccgcacctctggtgcacacatctctgccattattgagcccgacgcagcacgtgccgctgcagctgcagaagacgcgccgggtgcacaggccttcactcgcattgaagatgctatcgcagccgatgctgtcgacgcagtgctgatcgccgtaccaggtcagttccatgagccagtacttgtcccagcactagaagcaggccttcccatcctgtgtgaaaagccactgaccccagattctgaatcctcactgcgcatcgtcgagctggagcagaagctggacaagccacacatccaggttggtttcatgcgccgcttcgaccctgagtacaacaacttgcgcaaattggtggaatccggcgaagctggcgaactgctcatgctccgcggcctgcaccgcaacccaagtgttggtgagagctacacccagtccatgctgatcaccgactccgtcgtccacgaattcgatgtcatcccatggctcgcaggctcccgagttgtctccgttgaagtgaagtacccaaagacctcctcactggcgcactccggcctcaaggaaccaatcctggtgatcatggagctcgaaaacggcgtgcttgtcgacgtagagatgaacgtaaacattcaattcggataccaggtagcaaccgaagcggtctttgaaaagggacttgcccgcatcggccagccatccggaatgcagcgctggcgcgacggtgaattcctgatcaacgaacacaccgatttcaccacccgtttcgctaccgcctacgaccgccagatccagagctgggtcgacgcagtccacgaaggcaccctggtcgcaggccctaacgcatgggatggttacctggttgcactgtcatgcgaagctggtgtcaaggcactcgacggcggcgtcatcccagttgatgcggcacctcgcccagatttctacgct

SEQ ID NO: 185 - DNA, 870 bp, Corynebacterium glutamicum
gtggttcgtattgctcttgatcccacccccttccaccatgattacgatctgttggatttccccgacgtcaccgcacgtttggggtatgaatacatgcagctgacccctcatgtagatttcggtcctttcttccgccaccccaaggcagacgatgatctcgtggcagccctgaaaaagcgtgccaaggatgccggagtcaccattcctgcactgttgccagtgcagcgtatttcctggccggaggaaacccagcgtgttgcagcagtacgcaacatcaagcgcatcatccagttggccgttgatctggaagtagacaccctcaacacggagttttctggacgcccagaacgctccgaggattccgaagatgccttctaccgctccatggaagaactcctgccaatcctggaaaaagagggcatcaagttcaacatcgacccacaccctgatgatttcgtggaaaacggtattgaagcatggcgagtcatccgcggtctgaactccaagcaggtgggctttgtttacgtggcacctcactcattccacatgggtgatcaggctgaggcaatcctgccagcagtaggcgatcgccttggggctgtgtacctgtcagataccttcgaccaccacaaatcccacggcctgcgctacatcactaaccctccaggcaacgcagtgcgcgtgcaccagcacctaaaaatcggtgatggcgatgtgaactttgaagagatcttctcactgctgcgctctaccggttaccttgaccgtgaagatgcactgttggtctccaacgtgtttgcagaagatgaagcagcagatgaagtatcccgctaccagctggagaaaatccgctcactcatcgaaaacgca

SEQ ID NO: 186 - DNA, 1374 bp, Corynebacterium glutamicum
ttggacatcgacgccatgcgcaatgatcggtcctttagcgttcccattgcgctacttgccgcgggagcactgtttctagaaatcctcgacggcaccatcctgacaaccgcagtgccagctattgctcgtgacttcggtattgacgccgtggatgtcagcattgcactggttgcttacttggcagccgcagcagctggcattccggctgcagggtggctagcggatcgatttggtgtgcgcaaagtcctgttgctggctttagcggtgtttactgcagcctccttggtttgtgcagtggcgccggggctgactgtgcttaccggtgctcgcgttatccaaggtcttggtggtgcactactcgtcccagtcgggcgattagcagtaatccggggaacggatcccaaagatctccttgatgccatcgcgtttttaacctggccagctctggttgccccagtgatcgccccacttctgggaggtcttcttgccgataccattggttggcgatggatcttcctcctcaacgtgcccttaggaatcatcgcgatcattgctggactattcatcctgcccaagaacactgccgtgaatgtgaaacgatttgatcttccaggtttcctcggcgcaatgctggtgatggtggcgctgaccgtggctgcggagttaatttccaggggaagttcggctgaacttactatcgctgcatgcctcgtcttaagtgctgcggtggtatgcggttttgtagtgcgctggctgcgagttccaggccgactttttgatctcagcatcatgcgcatcccaggtttccgagtgggtaattcctccggaagtatctaccgcttggtaatcaccgcagcaccattcatgttcactttgctcttccaagtggcgtttgggtggtctgcaacattagcgggtgccatggtggtcgcactattcgcaggcaacgtggcaatcaaacctttcaccacgccgatcattaaacgctggaatttcaaaccagtactggtcttttctaacgctgctggcgccttggtattggcaacttttttgttcgttcgtgcagataccccactggttctcatcgtgctgctgctctttgtttcgggcgcattaaggtccctcggtttcagcgcctacaacaccttgcagtttgtcgatatctcaccagaacaaaccagcaacgccaacgtgttatcagcaaccctgcaccaactaggcatgtctttgggtattgcggtagcagtcatcgccatgtcccttgcacccaccgccaactgggcattcccactggcagcagcgttgttcctcattcctctaatcggcgcactatctttgcctcgcgacggcggtgcccgagccttttcctcctct

SEQ ID NO: 187 - DNA, 621 bp, Corynebacterium glutamicum
atgcgcatgatgctgagatcaaaaagtcggcctggaactcgcagccagcgcactacaaaaccgcataccaccgcagcacttaagacgaggcatgcagcgatagtaagttcagccgaacttcccctggaaattaactccgcagccacggtcagcgccaccatcaccagcattgcgccgaggaaacctggaagatcaaatcgtttcacattcacggcagtgttcttgggcaggatgaatagtccagcaatgatcgcgatgattcctaagggcacgttgaggaggaagatccatcgccaaccaatggtatcggcaagaagacctcccagaagtggggcgatcactggggcaaccagagctggccaggttaaaaacgcgatggcatcaaggagatctttgggatccgttccccggattactgctaatcgcccgactgggacgagtagtgcaccaccaagaccttggataacgcgagcaccggtaagcacagtcagccccggcgccactgcacaaaccaaggaggctgcagtaaacaccgctaaagccagcaacaggactttgcgcacaccaaatcgatccgctagccaccctgcagccggaatgccagctgctgcggctgccaag

SEQ ID NO: 188 - DNA, 1023 bp, Corynebacterium glutamicum
atgactattcgaatcggactcgttggctacggtgtcggcggcaggctctttcacaccccttacatccaagcttctacgcactgcgaattagtaggcgtagttgctcgttccgaaggcaccaaagcagccgttgcagaagatcttccagatgttgccatcgtgggatcgctgacagaactcctcgaactgggcgtcgatgcagtggtgatctccacccctccagccacgcgccgggaactggccttggaagcaatcaacgcaggtgtcgcagtggttgccgataaaccgtttgcaccatcagccgcagatgccatggaacttgtcgaagccgccgaaaaggctggagtgctgctcaacgtcttccacaacaggcgcaacgacacccacattgtcacggcactgggaatccaagaagaacttggtgcgatgcgtggactggacctgcgactagacctgatcgaacctgattccttggaggcaggtcctgaaggtggtttgctgcgcgatctgggctcacacgtagtcgatcagaccctggttctcatggggccggctacctctgtcaccgcccaacttggatccatcgaccttccagaaggcccaaccaacgcaaggttccgcatcgtgttggaacatgaatcgggcgccgtatcgcacatttctgccagcaagattgaccgcttggagtcctgggaaatccgcttggtgggcgagcgcggctcctacgtatccaactacaccgacgtgcagaccgtggcgatcaaacagggacttcgaccaaccaatgaccgcgaacactggggctacgaatcggaggagcggtggggcaccttggttaccgatgaaggctcaaaggtgattccttcagcacaaggcgattacacccgcttctacgatgcctttgccttggctgtggaaaacggtggcgcagggccggtgcctgcacgtgaaggtgttgcagtgctcaaggtgttggatgctgtagcccagagcgctgcggaaaaacgcaccattgagttgagc

SEQ ID NO: 189 - DNA, 456 bp, Corynebacterium glutamicum
atgagtaagatagttgatctgcgctatgggacccggcgttcctcggagttgagcaaacgctctgctgaagtctttgccgaagctgaagaacatcccattactgtgacacgtcgtgatggtgaagcgttggtattgatgtcgcagcgcgaagctgacgggcgagcccgcctgctggagttggctgcacagttaattactgtggccactgatcatcagggcacgttagccgaacgtatggcgaaagtattcccgtggatgctggccctgtcagtggcggatcgtgaggcgtgtgcccgtgagattcttgacgctgcacgagcatcgtttgcaaccgaacaacctcacctcgctcttactgaactgacctcatggaaagaaacagcagcagctgttgctgctggattgagtaacactgatctgcagtggtacgacgatccgcatctggtggagcgtccc

SEQ ID NO: 190 - DNA, 384 bp, Corynebacterium glutamicum
gtggtacgacgatccgcatctggtggagcgtccctaagcgtggctggaaagaaaagcgagttagttcctcgcccgcgcaagaaaaacgaattcgaaagccgctttgctaccactcacgcagcaaaagggtggcgagatttagtggcaagcatccgtaaccccatggcagagacgtgggattttttgaccgtgacgccgctgttgaccacgccgacgaactaccgacttaaaggtgaattgggtatcgttcaccataatgggaaggcgcatgatcggtggcaacataaatctactgcgaaagggtctgctcgaatctggttttatgttgagaagaacactgtgttcctcgagcaggtccatacccatcatcctaatgagacgaag

SEQ ID NO: 191 - DNA, 993 bp, Corynebacterium glutamicum
atgagcacatcccgccccacaatttatgacgtcgccaaagccgcaggcgtctccaaatccttggtttctctcgtgcttcgcggctcccccaacgtgagcaaagaatccgaagccgcggtcaagaccgcgataaaaaagctcaactaccagccaaatcgcgccgcatcagaccttgcggccaagcgcacgcagctcattgcagtgcttatcgacgactactccaacccgtggttcatcgacctgattcaaagcctcagcgatgtgctcacccccaaggggtaccgactgtccgtcattgactcattaacctctcaagccggcaccgatcccattaccagtgcactatcaatgcgccccgatggaatcatcatcgcccaagacatccccgatttcactgtccccgattccctacccccatttgtcatcgcaggcaccagaatcacccaagccagcacccatgattcagtggccaacgatgacttccggggcgcagaaatagccacaaaacacctcatcgatcttggacacacccacatcgcccacctacgcgtgggaagcggcgctggcttacgacgcttcgaaagctttgaggcaaccatgcgtgcacatggcctggagccgctttccaacgattacctcggccccgccgttgagcacgccgggtacaccgaaaccctcgcactactcaaagagcacccggaggtcaccgccattttctcctcaaacgacatcaccgccatcggagcactcggtgccgcccgtgaactaggtttacgcgtacctgaagatctatcaataatcggatatgacaacactcccctcgcccaaacccgactgatcaacctcaccaccatcgacgacaacagcatcggcgtcggctacaacgccgctctcttgttgctgagcatgcttgatcccgaggcaccccacccggagatcatgcatacgttgcagccctcgctgattgaacggggcacgtgcgcgccacgtgga

SEQ ID NO: 192 - DNA, 1233 bp, Corynebacterium glutamicum
gtgactcagcaagaacttcgcgtagctgtcattggtgcaggcatggcaggcaaagcacacgcagcgggctaccgcaccgcatccagcatctactccaccactctgcccaacatccgtttggtttccatcgcggatgccaacgtgcagctagctgaagaaaccgcagcacgctttggctttgagcgctttgatacctcttggcaggcgatcgttgaggccgatgacatcgatgttgtcagcgtcgtggtggctaacttcctgcaccgcgaaatcgtggaagcacttctggcatccggcaagcatgtgctgtgcgagaagccactgtcagacaccatcgaagatgcagaagccatgattgaggcagccggccgtgcagcaacaaatggcaccatcgcccgcatcggactgacctaccgccgttccccaggcgtggcacacatccgtgatctcgtgcagtccggcgagcttggcaaggttctacacgtcaccggccactactggaccgactacggatccaatgcacaggcaccaatcagctggcgttacaaggggccaaacggctccggcgcactggcagatgtgggaagccacctcacctacctggcagaattcgttgcaggatctgacttcgccgccgtccgtggtggccagttgtccaccgtgatcaccgagcgccccaagccactcggcgcgattgtcggccacgaaggcggcgcagtttccgatgaatacgaagcagtggaaaatgatgacattgcatcattctccggatccttcatcggtggcggaaccgcaaccctccaggtcagccgcatttcccagggacacccaaacaccctaggttttgaagtgttctgtgaaaagggctccgtgctctttgatttccgcaactcaggcgaattcaaaatcttcaccccagcaacctccggtgacatcagccaagaagccggctaccgcaccatcaccatcggaccaaagcacccatactggcgcggcggccttgcaatggatgcaccaggcgtgggaattggccaaaacgaaggcttcgttttccaggcgcgcgcattcctcgaagaaatcgcaggaatctccgaagctgaaagcctgccacgctgcgcaactttggaagaagggctacacaatatgcagctcattgatgctgtatcacagtcagctgcagcaggtggcgaaaccgttgcggtcccagcggctgctctgatccctgcaaacaac

SEQ ID NO: 193 - DNA, 1011 bp, Corynebacterium glutamicum
atgaaactcggtctctacaacgcgatcttccacgaccgcaccctgccagaagcgctcgcagccatcaaagctgcaggtctcaccggaattgaactcaacaccggcggatttttgcctgcaacccacatcccgaccatcgatgacatcctggtcagcgatgatgcccgcgatgaattcctcgggattttcgaaggcaccggcgtcgacatctacggccttaactgcaacggcaacccgcttcaccccaacaaggcgatcggggacaagcatgccgaagacattcgacgttccatccgcctcgcagagcgcctcggccaaaaccgtgtggtcaccatgtctggtcttcctggtggcgaaccaggcgcgaagtacaccaactgggttgtcaacgcgtggaactccgcagccttggatgtccttgattaccaatgggatatcgcagctgaattctggcgcgagaccgaccgcttcgccgcagatcacggcgtgaaagtggctcttgagctgcacccacagaacatcgtgttcaactccgctgacgtgcataagctcatcgatctcaccggcgccacccacgtgggcgtcgaactggatgcatcacacctgttctggcagcagatggacccaatcgctgtgattgatcacctcggcgagctcatcttccacgccgccgccaaagacgtgcgagttaataaggaatgggctcagctcaacggtgtgctggacaacagcttccgacgccttgacccatccgaaaaccgcaccaacttgggcggcgacgagtgggcgaatgaatggccaaagaactctgcttgggatttcgttgctctgggccgcggtcatgacgttgcttactggaccgaattcctccgcgcacttcaccgcgtcgatccaaacatgctggtcaacatcgaacacgaggatgtttcactcggtcgcgaagaaggcgtcaacgaagccgctaaggtgctgatcgaggccaacaaggcactcgaagagtccctggtttct

SEQ ID NO: 194 - DNA, 429 bp, Corynebacterium glutamicum
atgtattccaacaatttgtttctcttatccgtgtctgaagatagtgaagaatatgaatgctgcgtcggcctattagatggttcagatggacttgcttatatcgagaagcttctcaaaggaagaaggctgaagaatcatcatctagtgtgggatcagattgataaggccactatcgctcgtgaaccaatacacaaagggcaattggttcatctgatatttttgaccgcactaaccacacctggcgaattctcctttgtttacccaggtcaaaaccttatcgaagcaacacttgaaaaagattatgctgcacttgtacttgacgaagagcgcaaacaatttgtacctgaactgattcaaatgtggtcactccccgtcgggtgggtcgctcctgggcttgaagatttcttgtatcgcaattcggagtggtac

SEQ ID NO: 195 - DNA, 201 bp, Corynebacterium glutamicum
atggcacagggtactgtgaaatggttcaacggcgaaaagggatttggtttcatcgctcccaacgatggctccgcagatctcttcgtccactactctgagattcagggctccggtttccgtaatcttgaggaaaaccagccagttgaatttgaggtcggcgagggcgccaagggcccacaggctcagcaggttcgtgctctc

SEQ ID NO: 196 - DNA, 534 bp, Corynebacterium glutamicum
atgggtggattgtgcccctcgagatcgctcaatcgtctttattttcaattcattaagtcgttgacaattcgtaaaattgcgtctagaactaatgctataacggggagaatgaaaagctttacgcacactgctcacttggcgcagtctggaaatccgaggaacatttcacaagcagaggggtggttgcttgtagttcaatctatgggaattgctgtattgcttgcagttagttttcagtcccatttgtgggagtggggtgggatcataaggatgctcgcccaaatcgtatttattatcttgattatcttggtgtctagagggcttgcgaagactaggcgggttcatcctcggggatttaaatggcgtcttacctgcgcaggaatcttaccggtagttgtggcagtgattggtggatggttctggacggctcccacatttcatgacacatcgtggataattacaacagcagtggcagtgggagcaagccttcctggtgctttggttggtttggaattagtggttagaggaaacaag

SEQ ID NO: 197 - DNA, 306 bp, Corynebacterium glutamicum
gtgaatctcgaagaagcacgaatcgctttgaatgacaccattcattcacctgttcgtctggcgttgatggccgcgttaaattctgttgattcagctgattaccaaagtcttcgtgaagaactgggcgtaagctactcgttgctttctaaacacgctgcaatacttgaacaagccggttatttgaaaatttccaaagcttttgatggacgaacacccatcactcatctgaatttaactcgtgatggacggcaggcttttcaaagttacctttctgcgctggatcggttggtacgggggttaacaacc

SEQ ID NO: 198 - DNA, 414 bp, Corynebacterium glutamicum
atgactcctgatcttgcagcttttctggacaaactttatgccgaggggcaggaatttgatgcagagcaaccggatcggcttgatcgcaggagaaaccttgaatctgaaagcgctgcgctacttcgctcgctcatctacggaattagtccaaagtcagttctcgagctaggcacatccaatggttactcgactatttggatggcagatgtcgtgaatttaacaacagtagacaatgatcctgagcggtctttggatgctgcagcaaaccttcgcgccgctggagttgaagaaaaagttcaacgaatcgtcgccgatggagcaaccgtacttgccgattccgccgatgaacaatgggatttcattttccttgatgccgaacaatcactctatgtaaattggtggcctgacctgcaa

SEQ ID NO: 199 - DNA, 426 bp, Corynebacterium glutamicum
atgaaaattgaaattttcagcccagaggccatgcaatccgctgagttcgctcaccttttgtggcttgcttccggctattctgcagcacaattagaccacaccatcacgcatgagatttcccagatgaccaccatcggtatctttgaggatgcttcccccatcgcgtttgcgtcctatttcaatgaaccaactcgggcggtaattgagtacatcgcggtcctggaatctcatcaaggaatgggcctaggaagccagcttctaaacgttgtggcgacgagcttcccagaggtttatttagagaccgatgatgacgcggtggatttttatcgcaaacttggttttgttatctcgccaaaagagcgggatcctcgttggccagatcgggaacgctacgcatgcgtgtggaaaagagctgaagaaagggtc

SEQ ID NO: 200 - DNA, 990 bp, Corynebacterium glutamicum
gtgaatgtgaagttaactgacgccgcccgtgaagctggagtaggttacggtactgcttctcgcgcaatttctggacgaggttccgttgatgcagcaacccgtgacaaagtactcgccgccgccgagaaacttgggtaccgaaccaacgccatggctcgtgcacttagggaaaacaagacccgcaccgttggcctgatcgttcccggcattatcaataagttctacaccgaatccgccactgtcctccaagatgaattagacaaatccggataccaactagttgtttccacaactggaaacgacgcagaaaaggaacgtcgagctatcgaatccatgctcaaccgccaggtagatgcagtggtgcacgctccagttaatccccaagcgaagtttccaaagggcttcaaagtggtcgagcttaatcgtcgtagcgatctcaaccgacctactgtgaccagcgatgatgccactggtttgaaggaacttgctcttcatattttggatcagggataccgagatataggtatcattgtcggtcctgctgagctcagcaccgcccgagaccgcaaagccggattcatcaacgccctcgaaaccgaagccacacaacgcggaatccgcgaagaactacgattccgggtagttcactcccgctactcccccaccggcggttatgaagcattcgcagaattccgcaatgatctccctcaaatcgtggtgcccctgagcacgcaattaactctaggagttctcaaagcaacccaagaaaacggcataaaaatatcggatgacctggcacttgcttgttacggcgtcgccgaatggctcgcagtgtggggccctggcatcaccgttttcgcaccagacctcccagccatgggcgccgcagctgccacgcaggttttaacgcttctcgacgccgccccactccccgaaaaccacttaagcattccggggcagctcattgtccgtgggacaactccaaaggtt

SEQ ID NO: 201 - DNA, 402 bp, Corynebacterium glutamicum
atgactcgaaaatttagaagactccacgatctcggatatttcatcattccgtttgttgaatttttaagtattgcggcaggatactttcttattaaaactgcagcggatgagtttggaaagcttaattttatcgggacgattctcgtagtcggaggggtcgtttccctgtttaccgggtggccacttctattcgcaagagtgaatgattttaggtgggatgcagtttaccttgtgggtggagcggtatttttagcattcctttttctggggccaaaggaaatgacagttcttggactggtggcgatgtttgctggtccgggaatgctaatagcagggttttcatatctgagtcgtcgtattattgcgtattttgtggaattgaggcggttgcaacctagtgat

SEQ ID NO: 202 - DNA, 240 bp, Corynebacterium glutamicum
gtggaggggcagcggtgtttttctttaaagtttggattccaaatcaccgaattcgggagtgaagcacactcatatccaataggtagttccaccgctttcaatgccacacgcgcaacgcttttgtttaaattcaaccgccactgtgagcatatttcccaggactatccacgcattgcagtgatttcattttttacctgggctaccagcagctttacaaatgtctttcttgcagacaccgta

SEQ ID NO: 203 - DNA, 1473 bp, Corynebacterium glutamicum
atggctagtaccttcattcaggccgacagccctgaaaaaagtaagaagctgcccccactcacagaaggtccgtatagaaagcggctattctacgttgcactagttgcgacgtttggtgggctgctcttcggatatgacaccggagtaatcaacggtgcactcaacccaatgacacgtgagctcggactaaccgcgttcaccgagggtgttgtaacttcttccctgctgtttggtgcagcagctggtgcgatgtttttcggtcgcatttccgacaactggggtcgccggaaaacaatcatctcacttgcagtagctttctttgtcggcaccatgatctgcgtgtttgctccatcttttgcagtaatggttgtcggacgtgtgcttcttggactcgcagttggtggcgcttccactgttgtccctgtctacctggctgaacttgctccttttgaaatccgtggctcactggctggccgtaatgagttgatgattgttgttggtcagctcgcagcttttgtcatcaatgcgattattggaaatgtttttggacaccacgatggtgtgtggcgctacatgctggcaattgccgcaatcccagcaattgccctcttctttggaatgctccgagttccagaatccccacgctggcttgttgagcgaggacgcattgatgaggctcgcgcagttcttgaaaccattcgccctctagaacgtgcccatgcagaagttgctgatgttgaacacctagcaagagaagagcacgccgtttccgagaagtccatgggcttaagggaaattttgtccagcaagtggcttgtgcgcatcctcctggtaggtatcggattgggtgtcgcacagcagctgaccggcatcaactccatcatgtactacggccaggttgttctcattgaggctggtttctccgagaatgcagctctgatcgccaacgtggcgccaggagtgatcgcagttgtcggtgcattcatcgcactgtggatgatggatcgtatcaaccgccgtaccaccctcattaccggttattctctcaccaccattagccacgtattgatcggtatcgcatccgtagcattcccagtcggcgatcctcttcgcccctacgttatcttgactctggttgtggtcttcgtgggatccatgcagaccttcctcaacgtagctacctgggttatgctctctgagctcttcccgctggcaatgcgcggtttcgcaatcggtatctcagtgttcttcctctggatcgcaaacgcgttcctcggattgttcttcccaaccatcatggaagcagtaggactaaccggaaccttcttcatgttcgccggaatcggtgtggttgccttgatcttcatctacacccaggttcctgaaactcgtggacgtaccttggaggagattgatgaggatgttacttccggtgtcattttcaacaaggacatccgaaaaggaaaggtgcac

SEQ ID NO: 204 - DNA, 300 bp, Corynebacterium glutamicum
atgaattcagctgctcgcttgccggtgcgcaaggtggctgcgcgttggcgaagcttgtctgggccttgtttgcgccatagggatatattggcccgagtcatgccgacatactcgccgatttctcggggtaggcatcctttctctagcatgctggctgcaatctcaagtttctcggcggtgtcaaaagcattgccacctcgcgggccgcgggtcagtttcaccccggcggccttcgcccactttcgcccggtgaattcactgaccccgaccgctgtagacgcagcaagacctgacatacct

SEQ ID NO: 205 - DNA, 1203 bp, Corynebacterium glutamicum
atgggcccttattatgggccacgcacactccatcaagtgttgcgtgaggactacacaacactgtttgacgagttatctgcgttggggttgccagcacaggtgtgtggggccttacttcatcttgctccaccaccatcattacgcttttcttatatgtcgtgtgtagtgccgttatttgctgatgaaatcaaagtcgtaggacaaggcacacgattatcgttagaagagaaaatgatgatccaacgtttccatgacaccggggtcagtgcagcagaaatcggtcgacgcctgggtcggtgtcggcaaacaatttccagggaacttcgacgtggtcaagatgatgatggacgttatcgtgcacgcgactcctatgaaggtgcgatcaggaaactagcgcgtccgaaaacaccgaaacttgatgccaatcgtaggcttcgggctgtggtggtcgaggcgttgaataataaattatctccggagcagatttctggtcttttagccaccgagcatgctaacgatagctctatgcagattagtcatgaaactatttaccaggcgttatatgttcaaggtaaaggggcgttgcgtgatgaattgaaggtggagaaatttcttcgtaccggtcggaagggacgtaaaccgcagtcgaagttgccatcgagaggtaagccgtgggtggagggtgcgttgattagtcaacgcccagcagaagttgctgatcgtgctgtgcctgggcactgggagggcgatttagtaattggtggtgaaaaccaagcgacagcgttggtgacgttggtggagcgcacgagccggttgacgttgattaagcggttgggggttaatcatgaggcgtcgactgtgacggatgcgttggtggagatgatgggtgatttgccgcaggcgttgcgtcggagtttgacgtgggatcagggtgtggagatggcagagcatgcgcggtttagcgtggtgaccaagtgtccggtgtttttctgtgatcctcattcgccgtggcagcgtgggtcgaatgagaatacgaatggattggtcagggattttttcccgaagggcactaattttgctaaagtaagtgacgaagaagttcagcgggcacaggatctgctgaattaccggccgcggaaaatgcatggttttaaaagcgcgacgcaggtatatgaaaaaatcgtagttggtgcatccaccgat

SEQ ID NO: 206 - DNA, 435 bp, Corynebacterium glutamicum
atggtcgattttgacaccatcgcagcccgacttgtcaccgaaacagaagaagcaatcatctacgccacccgcgatggaataatcagactctggaacggcggctccgagaaactctttggatacacggccggcgaagcccttggaaaatcactcgacatcatcattcccgaaaaacaccgcaaggcccactgggacggatgggatcgcgtcatggaatccggcgaaactcgctatggctccgaaccgcttaacgttccaggcattcgtgccgatggatccaaaatgtctttggaattctccatcaccatcctgaaggacgattccggaaaaatcgaaggcgttgcagcttttctccgcgatgtcaccgccaattgggatgagaaaaaggccctgcggatccgaatcaaagagttggaacgccaaatcgagggccat

SEQ ID NO: 207 - DNA, 4530 bp, Corynebacterium glutamicum
atgaaaccacaaggactctacaaccctgcgcatgaacatgacgcctgcggtgtggcgtttattgcggatatccacggtcgacccagccgcagcattgttgatcgtgcacttgaggcgcttcgcaacattgaccaccgaggtgccgccggtgcagagaagaacactggcgatggtgcgggcatcctcatgcagattccggacggcttttatcgtgaagtatctggcattgagcttcctgaggcaggggagtatgccactggtattgcgttcttgcctcgcggtcgcatggcgatgatggatgctcagaaggaaattgagcgcatcgcaaagcaagaaggtgccgatgtgcttggttggcgcatggttccttttgattctcgtgatttgggttccatggctgaggaggcgatgcctagtttcgcgcagattttccttactgtgcctggaaaatctggtgaagatcttgaccgtgtgatgttctttatccgtaagcgttgtgagcgtgagctgggcaccaccaatggtcgcgatacggtgtatttcccgtcgctatcttcacgcaccatcatttacaaaggcatgttgaccactctgcagcttgagggcttctttgaggatctgggtgatgctcgcctggagtcggccattgctattgtgcactcgcgtttctccacgaacactttcccaagctggccgctggcgcacccgtaccgtttcgttgcccacaacggtgagatcaacactgtgcgtggcaatgaaaactggatgcgcgcccgcgaggcgcttatcaaaaacgacaagctgggcaatttgagcagcgtgctgcctatctgcaccccggagggctcggataccgcgcgtttcgacgaggctttggagcttttgcacctgggcggatactcacttccgcatgctgttgcgatgatgatccctcaggcgtgggaacacaacaagacgctgagccctgagctgcgtgatttctacgaataccactcttgtctgatggagccatgggatggtcctgcagcgctggcatttactgacggtcgttttgtgggtgccgtgctggaccgtaatggcctgcgacctgggcgaatcaccattactgattcgggtttggttgtgatggcttctgaatcgggagtgttggacttgagggaggagagcgtcgtaaagcgtactcgcgtacagcctggacgcatgttccttgttgacactgccgagggccgcatcgttgaagacgaggaaatcaagcagaaattaagcgaagcgcagccatatggtgagtggattcgcgataattttgtgcatctggatcgtctgcctcagacacgctacaactacatggcgcactctcgtgctgtgttgcgtcagcgtgttttcggaatcactgaagaagatgtggatttgttgctgctgccgatggcccgccagggtgctgaggcgattggttccatgggttcggatacgccaattgcggcgctatcccagcgaccacgcatgctttatgatttcttcgcgcagcgctttgctcaggtgacaaacccaccgttggactctatccgcgaaaagcctgtgaccagcatgttcactttgttgggtgcgcagtctgacgtgctcaatccgggtcctgatgcggcgcgacgtatccgtttggaatcgccgatcattgataaccatgagctggccaccttgatcaatgccaacgcgcatggtgagtgggattcctttggtgctgctgtaatttctggtttgtacccagtggctcaccatggtgccggcatgaaggctgcgattgctcgtgtgcgccgcgaggtttctgaagcaatccgcaatggcaagacgttgatcgtgctgtcggatcgtgaatctgatgagcgcatggcacctatccctgcgctgctgctgacttccgctgtgcatcagtacttggtgcagcaacgtacccgtacccagtgctccctggtggtggaatccggcgatgcccgcgaggttcatcacctggcgatgctcattggttttggtgccgatgcgatcaacccgtacatggcatttgaaaccatcgatgagctgcgcatgaagggtcagttgggtgatctttctttggatgaggcatcccgaaactacatcaaggcagccaccactggtgtgctgaaggtgatgtccaagatgggcattgcaacggtgtcttcgtaccgtggcgcgcagcttgccgatgtcactggtctgcaccaggatctcctggacaactacttcggtggtattgcttcaccaatttctggcatcggtctggatgaagttgcagctgacgtagaagctcgtcaccgcagcgcatttttgccacgccctgaagagcacgctcaccgtgaattggatttgggtggtgaatacaagtggcgccgcgaaggtgaataccacctgttcaacccagaaaccatcttcaagctgcagcatgcaacgcgttctggcagctacgagattttcaaggattacacccgcaaggttgatgatcaatccactcgcttgggtactattcgtggactgtttgagttcagcacggaccgcaagccaatttcggtgtctgaggtggagccggtcagtgagatcgtgaagcgtttctccactggtgcgatgtcttatggctcgatttctgctgaagcccatgaggtcttggccatcgccatgaaccgactgggcggtatgtccaactccggcgaaggtggcgaggacgcccgccgatttgatgtggaacccaacggtgactggaagcgctctgccattaagcaggtggcctcgggacgtttcggcgtgaccagccactacttgaacaactgcaccgatattcagatcaagatggcacagggcgcaaagcccggtgaaggtggccagctgccaccaaacaaggtgtacccatgggttgcagaagtccgcatcaccaccccaggcgttggtctgatttcccctccaccacaccacgatatttactccattgaggatctggctcagctgatccacgacctgaagaacgctaacccacgcgcacgaatccacgtgaagctagtggcagaacaaggcgtgggcaccgttgccgcaggtgtgtccaaagcacacgctgatgtggtgcttatttccggccacgatggcggaactggcgcatctcctttgacctccctgaagcatgccggtggtccatgggagttgggcttggctgaaacccagcaaacgttgctgctcaacggcctgcgcgatcgtattcgcgtgcagtgcgatggtcagctgaaaactggccgagacgtggttatcgcagctcttctcggtgccgaagaattcggttttgccaccgcaccgctggtggttgaaggctgcatcatgatgcgcgtctgccacctggacacctgcccggtgggtatcgctacccagaacccggatttgcgttccaagttcaccggcaaggctgaacacgtggtcaacttcttcaccttcatcgcccaggaagtccgtgagtacttggcacagcttggtttccgctctattgatgaagccgtcggacaagcccaggtgctgcgcaagcgttccggaatcccagctgattcccgcgcagcacacctggatttgagcccaattttccatcgcccagaaactccacacttcccaactcaggatgtgcgttgcaccaagacccaggaacacagcctagaaaaagccctggacaacgcatttattgataaggcttcggacacgatcacccgtgccgcagcgggtgtggaaaccagcattgttattgatagctccatcagcaacgtcaaccgttcagttggcacgatgctgggttctgcagtcagccgcgtggctggtgcccaaggtttgccagacggcaccatcaccttgaatcttcaaggctgcgccggtaactcctttggcgcgttcatcccacgaggcatcaccatcaacctcaccggcgatgccaatgactttgtgggcaagggattatctggcggaaagattgtgatcaagccttccgctcaggctccgaagcagctgaagaacaatccaaatatcattgccggaaacgtgcttggatacggcgcaaccagtggtgaattgttcattcgtggccaggtcggcgaacgtttctgcgtccgtaactctggcgccaccgcagtggttgaaggtatcggaaaccacggttgtgagtacatgactggcggccgagtcctggttttgggcccggttggtgagaactttggtgccggcatgtctggtggcattgcatacctggctaattccccggacctaaaccagaagatcaatggcgaattggtggatgttgttccactgagcgctgacgatctgacgtgggctgatgagctcattgctcgccaccgcgaactcaccggatccgagaccaagctgcgtgcacaagatttggtgaaaatcatgccgcgcgatttccaaaaagtactcaacatcatcgaaacggcccacgctgagggccaagacccagcaatcaagatcatggaggcagtgagc

SEQ ID NO: 208 - DNA, 1518 bp, Corynebacterium glutamicum
atggccgacccacaaggattcatcaaatactcccgacgcgagcctgcacaccgcccggtcccgctgcgcctcatggaccactccgaggtctacgaaaaggcaccggcaggtcagatcgaggaacaggctgcccgctgcatggattgcggtgtcccgttctgccacgaaggctgcccactgggcaacatcatccctgagtggaatgatctggtacgccaaggtcggtggaaggaagcctacgatcgcttgcacgcgaccaacaatttccccgagttcaccggccgtttgtgccccgcaccctgcgaaggcgcctgcgtgctcggtatcaacgatgattctgtcaccatcaaaaacgttgagctggaaatcgtcgaaaaagcattccgcgaaggctgggtgcaaccagtaatcccatccatgtctaccgggctgtcagtcgccgtcgtcggttccggccccgctggccttgccgccgcgcagcagctcacccgcgcaggccacagcgttaccgtctttgaacgcgacgaccgcctcggcggcctcatgcgctacggcgtgccagaatacaaaatggagaaccgctggatcgaccgccgcatcgagcaaatggaagcagagggcacaactttccaggtaggcacctcgccgcgcgccgctgaactagcgcttttcgacgcgatcctcctcgcaaccggcaccccagtggcccgcgaactctcagttccaggccacgatctcaacggcatccatgcggcaatggattacctcaccgcccaaaaccgcatcaacgaaggcgacggtgaagtctctccaatcaacgccaaaggcaagaaagttgtcatcatcggtggcggcgacaccggcaccgactgcttcggcaccgcactgcgccaaggagcagaatcagtcacccaatttgatatccgcccccgcgctcctttccagcgcgccgattccaccccatggccgatgtaccccaacctcttccgcaccgcaacggctcacgaagaaggcgaatacatcatcactggcgatgaatcagccgatgaaatcgcagccctgggcctcgccgaacgtgccgcaggctccacgcttggtgaacgtaaatttgctgtcaacaccgtggaattccacggcaacaacggccacgtcaccggactcaccggcaaccaaatccgagttgtcaacggcaaacgtgaaccaatcgaaggcaccgaattccccttcgaagcagacctcgttcttgttgcacttggcttcaccggcgcagaacaaggcggattggcacacgaactaggcgtaggtttcgacgaccggggccgcatcctccgcgattccgaataccgcagccccaccaactcccgcgtttacatcgcaggcgacaacggccgtggccagtccctgatcgtgtgggcaatcgccgaaggccgcgcatgcgccgcagctatcgacgccgatctcatgggtgaaactgcactccctgtagcagttgcaccacaggacgtgccgctggctgtc

SEQ ID NO: 209 - DNA, 240 bp, Corynebacterium glutamicum
gtgctgaccaggttcttccgatcttctgaagaaaccagagcccgacgacctttgtggttaatcaccacgtccccagttgttggttttgcagtcgtgattctctttggagcagcggcaattcaacttgtggtgtggtcgagttctgttctttttgcgctggcatcagctgctgtttatctagtatttgccctgctaggactagccagtgctgtctatgcgatgatgcatcccgtaaaacgc

SEQ ID NO: 210 - DNA, 1485 bp, Corynebacterium glutamicum
atgggcgaatcagtaagtactgacaggtacactccgcagcagcgcacgcgttatcgccagctgctcatggaagatcttgagatttttgatcggcatttgcagcattccgattttgaggatcagggttccatcggcctcgagttggaactcaacctcgtggataagcatatgcaacctgctttggcaggccacgcggtgctttcccatttagacgatgagtaccagtcggagatcggtaactttaatgttgaaatgaaccacccgccactatccgttaaaggcgatgctttacgacgcctcgagcaaggcatcacctcgcgtctaggtcgcgtgcgcgcggccgccacatcggagaacgtgaacgtggcgatgatcggcacgctgcccaccatcaccccagaattcctcgaagatccggcatggatgacccaagaaaaccgctaccgtgcgctgagcaatgcggtgatggaatcgcgtggcgagttagtgcacatcaacatcgccgaccgtgaacaaatcatccacgatttcactgatctcgcccccgaatcaacttgcacgtctattcagttgcacctgcaattagcacccaataagtttgctgcagcgtggaatgcgtcgcaagcaatagctggtgttcaagcagctctttccgccaactccccacttttcctaggccgtcgggtgtggcatgaaagccgcattccagtgtttcaacaagctatcgatacgcgtactcctgaacttgtgaatcaaggagtccgccccagagtatggttcggcgaacgatggatcaccagtgtttttgatcttttcgaagaaaacgtacgctacttctcccctctcatcgcagaatcccgcgccctgtctggcacaccaatgatgaagggaaaatcccccgcactccactacctcaatctccacaacggaacggtgtggcgctggaaccgacccatttacgcaccgggggaagagcgctctcatctgcgtttggaaaaccgtctcctacctgcaggtcccacccccatcgacatcaccgccgatgccgctttctactacggtttggttaaatatctggccgaggaaaaccgccctgtctggtcacgtctcctattccctgatgcggaaaagaacttccaatccggtgcacgttcagggctgttcgcccgcatgacctggccaaccctcggacaagtcaacgttgcgaatctggtccaagagcacctcatccctcaagccagaatcggactggaacgactcgaagtaaacaaagaccttatcgaccaatacctgggcatcatcaccgaacgcgcgaagtcccgccaaaacggtgccacctggcagttgcgtagcctcaacaagctggaagcacacggaagcatgccgggttccgatgctcgaaaagcaggtcttgcagcaatgttgcaacagtatttacagaatcaagaaagcggccaacctgtccacacatgggctattggttcg

SEQ ID NO: 211 - DNA, 369 bp, Corynebacterium glutamicum
atgcgaatcaacgcggacaaactgaccagcaacgcagcaactgccattagaccggtggggcctgatgccagggaaatggtggcgataatgacaccaatggcagcgggcaacaacctggaggtagcgatagcgcgctcgaaggaaacccacgcaagtagagctcccatcgcgatgattggctctgggcgagtgccgttgttgtatggaagccagaacgccaggaacaccatggctgcagaccagtgcgcaacgcggcgaccgttaaccaatgagccaaaccgtggcatgacctctctggtgatcacgaaccacatgatcagtccagcgagcaatgcgggtagacgaagccagattgatgaggttgagatg

SEQ ID NO: 212 - DNA, 318 bp, Corynebacterium glutamicum
atggtcatgatgaagccgtcgtcagaggtgttggcgccaaggaagtgccagaacaccaaaatcgctacgacaacaccatcaagtggcttcagcttgtaccagttggcaggcaggaagcggtgtgcttttcgaccatccaaaatatccatgcggtgcagtgtccacagggagaccaacacagacgcaaggccaatgaagatggctgcgtactttagaaggctgggggatgaagtgaagcgggagttgatctcaatatcaacgtttaagcccgctgaggccagggccgatgcggtggaggggtcgtcgacaagctcggtg

SEQ ID NO: 213 - DNA, 3471 bp, Corynebacterium glutamicum
atgagtaattcctcaccaaacgacccaagccctatgcgccaagtcggtggtaatgggggccatcaactagactcgatcaacgtgtcagatgtagttgagtcgaagaaactaaagggttctgcgcaagaacccccgcaggttgccccgggctggctgaagaaactggctatctcatcaggtctgcttggcctgttgatgtttgtgctgttgcctttcctgccagtgaaccaggtgcagtcttcgctgtcatggccacaaaatggtgagctttccagcgttaacgccccgctgatttcctacgcaccgcagtcgatggatgcgtccatccctgtgtccgcgctggacagtctcaatgacaatcagtcgttggtgatgggcacgttgcctctggacagtacggacgccaccaaccgtggtctgtttgtgcgcaccatcgacggtaaccttgacgtgattgttcgcggtgaggtgctgttggatctttcaccaacagaggtgaaccgtctgccagatgatgcgatcctagagatttcctccaccgaggaaaccaccagcgcggaaatcaccggcacggcattcagcggcgagaccgaaggcgatgagcggcctcaggtcaccggcgtttacaccgagcttgtcgacgacccctccaccgcatcggccctggcctcagcgggcttaaacgttgatattgagatcaactcccgcttcacttcatcccccagccttctaaagtacgcagccatcttcattggccttgcgtctgtgttggtctccctgtggacactgcaccgcatggatattttggatggtcgaaaagcacaccgcttcctgcctgccaactggtacaagctgaagccacttgatggtgttgtcgtagcgattttggtgttctggcacttccttggcgccaacacctctgacgacggcttcatcatgaccatggcccgcgtgtcccagaacgcggattatatggccaactactaccgctggttcggtgtcccagaatcaccattcggcgcaccatattacgacttgctggctctgatggcctacatctcaacctcatcaatctggcttcgtctacccgcattgctcgctggactgatcatgtggttcgtgatcaccagagaggtcatgccacggtttggctcattggttaacggtcgccgcgttgcgcactggtctgcagccatggtgttcctggcgttctggcttccatacaacaacggcactcgcccagagccaatcatcgcgatgggagctctacttgcgtgggtttccttcgagcgcgctatcgctacctccaggttgttgcccgctgccattggtgtcattatcgccaccatttccctggcatcaggccccaccggtctaatggcagttgctgcgttgctggtcagtttgtccgcgttgattcgcattctttataggcgcttgccgcttattggggcgtcgaggggggcgtcgaaaagcaaagtctttggcgcttcgatggctatgcttgccccattccttgcgtctggcaccgcgattctcatcgccgtttttggcgatcagactctgtcaaccgtcatggaatccatcagcgtgcgctccgcgaagggcccggcactgacctggtaccacgaatatgtgcgctaccaaaccgtcatggaacaaaccgttgatggttccttcacccgccgttttgctgtgctgatgctcatggcgtgtctggctattgtggtcatcgcgatcctgcgttacggccgcattccaggcgctgcgaagggaccatcactgcgtttgatgatggtcattttcggcaccatgttcttcatgatgttcaccccaaccaagtggactcaccacttcggtgtctacgcaggacttgccggcgcattggccggacttgctgccgtggggctgtcctatgttgcggtgaaatcaccacgcatgcgcaccatttccatcggtgcgttcctcttcctgctggcgctggctctcgcaggcgtgaacggattctggtacacctccagctacgccgtgccatggtgggataaaaccatccagatcaagggcatcgaagcatccaccgtagtgctcgtgatcgccgtgatcgtgctgatcatcggtgttattcaatcctttgtccacgatgtgaaaaccgcgcaagccgaaaccaatcactccatgggcgaactcgtggcggaagatgaagcaaagcgcgagcgtgcctccaggttcaccggccttgcggcctcccctatcgcaggagtgtccgccctcgttgtgctgattacctgcgcatccatgggcaaaggctttgtggaccaataccccgcgtactccgtgggtcttggcaacctccgctccctgaccggcaacacatgtggccttgcctccgacgccatgctggaaaccaactccaacgattccttcctcactccagtgaactccacacttggcgagtccctggaatccgaagatattcgcggctttagtgctgccggcatcccaccatcaatcagccaggaccaagcagacctgtctgctgttggtgccattgccaacactgacgactccaccgaaaccggcggatccgacgaatcatccggacaatccaccggcaacaccggcggtgtccgaggctccgaaggcatcaacggctccaacgcccgcctgccattcaacctggactacacccaagttccagtcgtcggctcctggtccgctggcacccaaaacccagcaaacatcaccaccgactggtacgaaatcccagaagccaccgaagaagcacccatcatcgtggtatctgcagcaggtcgcatcgaacactacgacatcaacggcgtccgccaatccggacaatccgtcatgctcgaatacggtcgccttcgcgataacggcgacgttgaagacctcggcgaagccatgatgtacgacatcggccccgagccatcctggcgcaacctccgctacccacttgaccaactcccagaagaagcggacgtcgtgcgcatcgtcgccaccgacgtcaacctcgacgaagaccaatgggtagcactgacgccaccacgcgtacctaacctagattctctgaacaacgtcatcggatccgaaaccccaggactcctcgactgggcagttggcctgcaattcccatgccaacgcaccttcgaccactacgccggagtcaccgagattcctgaataccgaatctccccagaccacggcggaaaatccaccctctccccattccaagactgggcaggcggcggatccatgggcacggccgaagcagtaaacaacgcctacgaaatcccgtcctacctccgcaacgactggggccgcgactggggttccatcgaacgctactcgctgcgcaccaactccaacggcgatgcacctaaggttgcagacatcaaccttgaaaccatccaacgttccggactctggaatccagggcatatgaaggtagatgaa

SEQ ID NO: 214 - DNA, 1983 bp, Corynebacterium glutamicum
ttgaatccttatggtccatcacgtgtgcctgaaggcgaagtgtatcggcctgatcgtctaaacaggaaagctacacttgttgcaattgtgggagctgccatcctggctttcgcatttgctttggtgttgtggatgggtttaaaacaaacaaaccttccagctttcggcccatcgaatgtcacgagggctgttgcttctgccaccatcgctgcggttttgattgtcacgggttttttgacgtggctgtggctgcgcgatgaacatcagagcaatccgcggtgggagttggaggacgtcaagccaaggcccaagtggcggacggcgctgacgtatctggcgtcttacttaagcccagctgcgctggtggttgcggtgttggctattccgctgtctgcgacccgcctgtatttggacggaatcagcgttgaccagggctttagaactcagtttttaacccgcatggctgacgatatcggcttgtcggacatgaactacatcgatatgcctaccttctaccctgctggatggttctggctcggtggtcgcttggccaatcttttggggctgcccggttgggaagctttccagccatgggcaattgtgtccatggcagttgctgcttctgtgttagttccagtgtggcagcgcatcaccggttccctgccggtggcaacaggcattgcgttggtgacaacctgcattatcttggcgatgaattccgaagagccctacgctgcaatcgttgcgatgggtattccagcgatgctcgtgctggcttcccgcattgccaagggcgataagtttgcgcttgccggcggcattatttacttgggtgtttcggctactttctatactttgttcaccggtgctatcgcgctttctgcggtcgcggtgtgcatcgtggtggcggctattgtgcagcgctccatcaaaccactgctgtggcttgcagtgctgggtggtggatccattgtcattgcgttgatttcttggggtccttaccttctggcctccatcaacggagcggagcgctctggcgattccgcaacacactacctgcctcttgaaggcacccaattcccggttcctttcttggcatcaagcgttgtgggactgttgtgtcttgttggcctgatctatttggtggtgcgtttccacaacaatgaggtgcgcgcgatgtgggtcggcatcgcagtgttttatgcctggatgggcatgtccatggcgatcacgcttttgggcaacacgttgcttggattccgtcttgatacggtgctggtgcttatttttgccacggctggagtgttgggcattgcagatttccgccttgccagtgtgtatcagctctaccccacccaaatcacagagcgcacggccacccatctgaccaatctaattgtggtcctcgtgctgcttggcggcctctactacgcgcaagatctgccgcagaagaacgcacgagctatcgatctggcctataccgatactgatggctacggcgagcgcgcggatctgtatccggccggagctgcacgttattacaaggacatcaacgatcatctgcttgatcaaggattcgagccttccgaaactgtcgtgctgacagacgaactcgatttcatgtcctactacccttatcgcggataccaagcttttacttcccactacgccaacccgcttggtgagttcggaaacaggaacgcattcatcgaagatctcgcgatccgaagctgggatgagttggctgatcctcaacaattcagcgacgccttgaacacctctccatggacgatccctgaggtgttcatcttccgtggctccatcgatgatcctgacgccggttggaaatacgacgtggctgaagatctgtacccgaacaatccaaacgtgcgcttccgcggcgtgtactttaacccggagtcatttgatcagatgtggcagaccaagcaagtgggacctttcgtggtggtaacgcacaatgag

SEQ ID NO: 215 - DNA, 759 bp, Corynebacterium glutamicum
atgcttaacgcagtgggcaaagcccaaaacattctccttcttggtggaacctctgagatcggtatttccattgtctcccgcttcctcaagcagggtccatcccatgtgaccttggcagcgcgtaaagattccccacgcgtggacgcagcagtcgcagagatcaaagcagctggcgctgcttccgttgctgttgttgatttcgatgcgctcgacaccgaatcccaccctgcagccatcgacgcagcctttgaaaacggcgacgttgacgtagcaatcgtggctttcggcatcctcggcgacaacgaagcacagtggcgcgaccaagcactagcagtggaagcaaccaccgtgaactacaccgccggcgtttccgtaggtgtactgctgggccagaaatttgagcagcagggccacggcaccatcgtggcattgtcctctgtggcaggccagcgagtccgccgctccaactttgtctacggctccgccaaggcaggtttcgacggtttctacacccagctcggcgaagccctgcgtggatccggtgccaacgtattggtggttcgcccaggccaggtacgcaccaagatgtccgcagatggtggcgaagccccactgaccgtcaaccgcgaagacgtggcagatgctgtttatgatgcagtggtgaacaagaaggacatcatctttgtccacccactgttccagtacgtctcttttgcgttccaattcattccgcgagcaatcttccgcaagctgccgttc

SEQ ID NO: 216 - DNA, 1464 bp, Corynebacterium glutamicum
atgaacagttctcacggcacgtccagctccggcgcttcggccggtgcccacggagcccttcccctagaagctcagaaactgaacggttggggccgcacagcccccaccaccgctgaggtacttaccaccccagacctagacatcattgtggatgcagtccgccaagtcgctgaacaaaacgactccaagccggactacctcaagcgcggcgtgattgcccgtggcatgggtcgttcctatggtgacccagcccaaaacgccggtggccttgtcattgacatgcagccactgaacaaaatccactcgattgatcctgattctgcgatcgtcgatgtagatggcggcgtcaccctcgatcagctcatgaaggctgccctgccatatggcctctgggttcctgtccttcccggcacccgccaagtcaccatcggtggcgcaatcggaccagacatccacggtaagaaccaccactctgcaggttccttcggcgaccacgtggtctccatggaactcctcgttgcagacggacgcatcctgcacctcgagccagaaggcaccgccgaagacccacagggcgacctgttctgggcaaccgttggtggcatgggcctgaccggcatcatcgtccgtgcacgcatccgcatgaccaagacggaaaccgcctacttcattgcggacaccgaccgcaccaacaacttggaagaaaccgttgcgttccactccgacggatcagagcacaactacacctattcttctgcgtggttcgatgtcatcagccctgagccaaagcttggccgctccaccatctcccgtggttccctggcaacacttgctcagctggaagaattggcaccaaagctggccaaggatccactgaagtttaatgctccacagctgatgaaggttccagatatcttcccatcctggactttgaacaagctgaccctttccgcagtcggtgtggcttactacgccatgggtgcaccagcgaaaaaccaggtgaaaaacctcacccagttctaccaaccactggatttgatcggcgaatggaaccgtggctacggctccaagggcttcctgcagtaccagttcgtggtccccacagaagctgttgagcctttcaaggacatcatccgcgatatgcaaaagtccggccactactccgcactcaacgtgttcaaactgtttggcccaggcaaccgcgcaccactgtcctacccaatgccaggctggaacgtctgcgttgacttccctatccgcccaggtctgggagctttcttggacgatctggacaagcgcgtcatggaattcggcggccgcctctacctggccaaggaatcccgcacctccgcagagaacttccacgccatgtacccaggtatggaaggctggttgaagactcgaaatgagatcgacccaaccggagtctttgcatctgacatgtcccgccgacttgagctttct

SEQ ID NO: 217 - DNA, 234 bp, Corynebacterium glutamicum
gtggtgggcatgtttgaaagattcaaaaaagccaaggctcccgaggtccacatcgcggcggaacgcaccaaccttccgcttaacgatttcatgacccgcctcttcgcccaggaactccccctgctcgatagcacctcacgttcagaggtctaccgcctgcttcgggaatacgacggcccaacaattagctcccaggaagaaatccccgcagagattcgtgaactcatggatctt

SEQ ID NO: 218 - DNA, 507 bp, Corynebacterium glutamicum
gtgagtagtcttggcaacatggataccaggatgagattgcaggtagcagcaggttccgcgctgattggtgctggggttgcggttaatgattacgtacaaagcccagtccgccgggccatcagttatggtgcgttggcgctttctggggcgacggtgattgcgatgggtcaggacccgactggggagcggtccatcattgcgaaagattccgcgacgatggttgatcaaatccgccaggagatcggcgatttgggtgtcacgcctggtccagaatctgatgtggatgccatcacggagcgaggtccgctggtgacgtggctgttgcttgctgtttttgtcgtggcatttttcaccttggcgtatttctccatgcgcatggatgtggcggtgatgagaaggatcgctaagttctttgaaaaacgtggcgcttccaggccattcacctgcactggcatggtgtacgccgcttttatttacgcaatctgtgagctggaggcccgcacaaaa

SEQ ID NO: 219 - DNA, 453 bp, Corynebacterium glutamicum
atgacctatcccgtgttgagtgttttggataattctggcgatcacaacatcatctggcatgtgcaaacttatcccgcggcgctgcccaccggggcgtggattgccgatgagcaacaactgactgacctgctgaaagacacagtagtgttccttacccctgggagcaccgctccggaaaatgcccccgtggcgacgatagaaggggtgcgggttgacgtcgataagcaggtggcagagtacaacaaacatgggatccgcctgcccagcttgggcgcgcgcactgtggaggcgcagtaccgcggcgagccggaggcagaggctgcgtggcgcacggcgatggagctcgtagagatcgcaggcggctggctagaaattgaagccaagcgccgggcgcggaaggcgctggctgaggccttcggcgcggaggtccagccactgccgcttgacaccgaa

SEQ ID NO: 220 - DNA, 1002 bp, Corynebacterium glutamicum
ttgaagccaagcgccgggcgcggaaggcgctggctgaggccttcggcgcggaggtccagccactgccgcttgacaccgaataggacaaatgggtctatcctggggcgcatgcccacgaattatgcacgcgacaacgtcatttccttggcgtctgcccgcgagcagcgttccgggaaacccgagcccaaacccgaactaacactcatcgtccgcgccaccaacgtgcaagcggacggcgaggtccacaggcaaattgggttgaactcggcgatgagcctggacgagctgcacaatgtactcaacatcgttttcggtgttggcggcgagcagtcaccctggcgtttcgaagaccaattccaccaacccagcgcccccgacaccaacctcggcgaactcctgcccgaacccggcgacttcctgttttacttctggggcctgtggcaattcaacctgcaatgcgtggaaatgtacccgcgcgacaacggcaccccgcgcgcgctgtgcatcggcggctccggcggcctcggcgacgacttcgaccaagccaccatcaacgccgaactcaccggcaccgacaccatccgcgacgtcctctccggcgtgcgccccgaagtcatcgacctcgtcgaccgcaccggcgtcttcgacttcatcccactgctccaagcgctcgacctcaaaagagaaccgcttatcgacgccacccgctaccacacctgccgcacgctgccagtggaaaacagcgccgaagcctccgacgcattctggtcctgcgtactcgccctgtcctgcctcggaaacgacgaacttttcatcgaagtgatcgaatccacaatgagcaccctcggctgggtcgccgacgacggctccccactacgtgcaccagagatcaccagcgcctgcgaagcctccctgaagatactcgcggaactcggtggctacggcccagagcggcttgcccccgtggatcgcctggacatttatagggagctgctgtgtttc

SEQ ID NO: 221 - DNA, 396 bp, Corynebacterium glutamicum
atgagcctgaaaacccaagctttccggttcatcctcaccggtggcctctcagccatcgtggacctcggcctgctgtcacttttgcagctagtgttcggccttcccgtacctgttgcccgcacgatctccttcatcgccggcaccaccaccgcctacatgatcaaccgccggtggaccttccaagcagaaagctccacctccaggttccttgctgtggtggccctctacggcgtgaccttcctgatcaacattggactgcaaaccctctgctccgcattgtttgagaattggggctggaacgaagccgtcgcgatggtggtcgccttcgtgatcgcccaaggcaccggaacggtcatcaacttcatcgtccaaagaaccatcattttccgagtgaag

SEQ ID NO: 222 - DNA, 402 bp, Corynebacterium glutamicum
atgaagaccttcaatcccaccatgattgccggactcatcggcgtactctacttcgtgctgctcaccctgattttctccatccaagacatggaactagcagcagaaatcgccttcggaatcgtcaccatcgtcggcctgatcgcggtgtgggacaacttccgcgaccgcaacaactccacctggaaaacctggaccggcctcgtcggcggactgctaatcgccgtccccggaatctgccttcttgtgggaaacctcgtgctcctcgcagtcgacggcaacccctcaaccatggtgaacaccctgctcagcgtcgcagggatcggcgcgatcttcctccttccgatcggcatcatcatgtgcctcatcgccggattcaaccgctactacgcagcccttaaggtc

SEQ ID NO: 223 - DNA, 633 bp, Corynebacterium glutamicum
atgcccggtctagttctctccacaaacgtcgcccatatccaacaagacccaggtggcgatgaccgcatcagcggcatcaacaaactccccgtcgccaccggcatcgatgtattcatccccggacccaactacggcgacggctccggcgtagtcggcgacgccatcggcgattccctccaccacggcggcgcccacaaagccatctacgcctacagccgcgaagaactcgacttctttgaccccacctaccgcaacggatacttcggcgaaaacctcaccaccagcggaatcgtgttggaagacctcctgatcaaccaacaagtgcgcatcggcaccacgctgctcgaagtctccattccccgccgaccctgccgcacgttcgcccactggctcgacatcaaaggctggctaaaaaccttcacccaacgcggcctccccggcagctacttccgagtcatcgaagaaggccacatcaaccccggcgaccccattgaagttctgcaggcccccgaccacgacatcaccatgtccatggccttccgtgcaaaaatgggaaacaaagacctcgcgcgccgggttgttgcagccaactgtctcccagcgcgctaccacgaggaactactaaaactgatc

SEQ ID NO: 224 - DNA, 939 bp, Corynebacterium glutamicum
atgtatgccatggcacaaaccactacccgcctccagccgggcatcaacgtcgcagcggtcattgtgacccacaatcgtgtggaattgctgcggcattccctcgaggttgttgccaatcaaacctatccggtgaaacacattgtggtggtggataatggggcggatccggacgtcgagaagctggttttagaggtggcgggagaccgtgccgtttacacgccttcgcgcaccaatttgggcggcggtggcggttttgcttttggttttttgacggcgttggcgctgggggcggacgcggtgtggtgcgcagacgatgacggccggccggaggggccaggggtgttgaagacgcttatcgacgccgcttctcggcataatctggaggaggtttctccggtggtatgcaatgctgatgatccggagcggttggcatttccgctgcgtcggggcttggagtggcgtcggatgcgcagtgagttgattgatccagccaacccggaggatgatttgctgccgggcatcgcctccttgttcaatggtgccctgatcagcgcttatgcaatggagcgcattggcgtgccggactatcgactgtttattcgcggcgatgaggtggagtatcaccgccgtttggtgcgttccggtttgccgtttggtacgtgtttgaccacggcgtatttgcacccggatggttctgatgagttcaagccgattctgggtgggcggatgcatacgcagtatccggataatgatttcaagaggtttttcacctaccgcaaccgtggctacctgatgagccagccgggaatgcgcaagcttctccctcaggaatatgcgcgctttgcgtggttcttcctggttcagaaacgggatgtgaagggattccgggagtggctgcgcctgcacaaactgggccgcgacgagaaattcaataggccc

SEQ ID NO: 225 - DNA, 342 bp, Corynebacterium glutamicum
gtgaccttggaaggatgcggcgaccccaaccaatcaatcgcaaacggcaccggcgcaaaatccacacccggctccggcaaaatcaaccgccacgtcagcgtcgtcccctccggagtgtgcctgctcatcaactgcgactgcgtcccccgcttagcggcgagagcctccaaatcatccggacgcacacaccacgccgccaccctcggctccgtcgactgcgtcgtagcgatcgcgaaattatcctgcgtcaccgcgtccgcctcaggatccgggccaatcaactccaggtacgacccctttggctcttttagtggcaccagcgcgttcgccgtccccgtatcg

SEQ ID NO: 226 - DNA, 597 bp, Corynebacterium glutamicum
atgggaacgcagattgatcacattgttattgcagcgccaaaccttaaagatctggtgtcgcggtttgagaagttgacgggggttaaggcggtggcgggtggtcgtcacgatacggggacggcgaacgcgctggtgccactaaaagagccaaaggggtcgtacctggagttgattggcccggatcctgaggcggacgcggtgacgcaggataatttcgcgatcgctacgacgcagtcgacggagccgagggtggcggcgtggtgtgtgcgtccggatgatttggaggctctcgccgctaagcgggggacgcagtcgcagttgatgagcaggcacactccggaggggacgacgctgacgtggcggttgattttgccggagccgggtgtggattttgcgccggtgccgtttgcgattgattggttggggtcgccgcatccttccaaggtcacagaaccccaggtcagtgttcacagtttcacggtctatggccatagtgagccggatgagctgccagagcctgcaatttttcaggagggtaagccgttgttggagttggtgttggagtcgccgaaggggcgggttaatctgagcgatttg

SEQ ID NO: 227 - DNA, 789 bp, Corynebacterium glutamicum
atggtatccatcgatacatacaacgcctgcgtcgacttccccatcttcgacgccaaatcccgctccatgaagaaagccttcctcggcgcagccggcggagcaatcgggcgcaatcaagacaacgtcgtagtcgtcgaagcgctgaagaacgtcaacctgcacttgcgcgaaggtgaccgggtcggactcgtcggccacaacggcgccggcaaatccaccctcctgcgactcctctccggcatctacgaacccacccgcggaagcgctgacatccgtggacgcgtcgcccccgtcttcgacctcggcgtcggcatggatccagaaatctccggctacgaaaatatcatcatccgcggcctcttcctcggtcaaacccgcaaacagatgaaagccaaaatggaagaaatcgccgacttcaccgaactcggcgaatacctctccatgcctctccgaacctactccaccggcatgcgcatccgcctagccctcggcgtggtcacctccatcgagcccgaaattctgcttcttgatgaaggcatcggcgccgtcgacgccgccttcatggccaaagcccgcgaccgcctccaagccctcgtcgaacgatccggcatcctcgtcttcgcctcccactccaacgacttcctcgcccaactctgcaacaccgcactctgggtcgaccacggacaaatccgcgaagcgggactagttccagacgtggtggaagcctacgaaggcaagggcgccggcgaccacgtccgcagactcctcacccgcatggaagaagaaaag

SEQ ID NO: 228 - DNA, 804 bp, Corynebacterium glutamicum
atgacctttggcgctgcctggaacgatatcgtccgcggattcaagcaacatgagttgtggctgcaactcggctggcaagacattaagcaacgctaccggcgatccgtccttgggcccctgtggatcaccatcgccaccggtgtcatggcgctcgccctcggcttgctgtactccgtgctgttcaaaatccccatcgcggaatttctgccccacgtcaccgtcggcctgatcatttggaacttcatctccggatgcatcaaagaaggctccgacatcttcatagataacgagggactcatcaaacagctcccctcggcgctgtccgtccacgtgtacagactcgtgtggaaacaagccctcttcctcgcccacaacctggtcatctgggtcattctcatgatgatcttcccccgacccctcggctgggacgtcctcctgatcatccccgcaatgttcctcctggtgatcaacggcgtgtgggtagtcatgttcttcggcatcatcgccacccgctaccgcgacgtctccccgctgctagaagccggaacccaactcctcttctacgtcacccccatcgtctggatgacttccaccctgcaatcccagagcgcagaaatcggcaaccgcgcacgcctcgccgaactcaacccgctctaccactacctcgaaattgtccgcgcccccatggtcggcgccgacctccccgcctaccactggtggatcgtcctcgccttcacattcgtcggccttggccttgctctcctcgcgatgaagcaatggcgattccgcgtcagctactgggta

SEQ ID NO: 229 - DNA, 1173 bp, Corynebacterium glutamicum
gtgggttttgatgtggccagggttcgggggctttatacctctttgggcgatggctggacgtaccttaattcacatcaaattccgcaggttccggagcgggtggcgtcgggagttgcggcggctttccgcacgcatgcgcagatttctgaggtgacgtcgcagccgattgcggtggatcagttggaggctgctcgcgaggcagttgcgtcgttggcgggtgtggatccggactgtgttgtgctgggtcccacgaggcagtttttggctcatacattggcgcgcggtttgggtgggtttgtacgtcgaaaagcgggcgtggtgttgtcgcgcgcggacgcggactggctgaccgcgccgttccgctccctcgacggcgtttttagctgggccgagcccgatttgggcaccggcatgctgccggattggcagtacgagaagcttgttgacggctcgacgcgccttgtcgtgctcagcgccgcgcacccgctgctcggcacggtcgccccagtgggcaagattgtggataaagtgcgggcgcgttcgcgtgcctgggtgcttgtcgacgccaccacctacgcagcctaccgccccctgcgcctagacgagtgggaagccgatatcgtcatgcttgatctcggcgagttgggcggcccgcagatttcggcgttgattttccgtgatacctcgatgttcccgcgcctggatcgcaccgttccactcgaactgcccgcaagctccctgccgcatgggctgctcggcggcgtgcccaacctggtgcggcacctgggaaacctggatgaaaacgccccgtccgtcgttgaggcgatgggggagatggcgaaattccacaagggactttttgagcatcttgtggaatcgctcgaaggacttcacgcggtgcatatcgtgggaatttccggcgatgccgcaggtcaagacgccgcgttcctggatcgagtgccccgcttgaccttcaccatggaaggcgtgcccgcagatatggtgtaccgccgattggtggacaatcgtttgatcactaccgtcagccctgctgacccgctgctcgaagcaatgggtgtgactgaagctggcggatcgatcactatcggactaagcccgtttagcacctactatgaagtggatcagctgaccagggtgctggcatcgcttgcc

SEQ ID NO: 230 - DNA, 954 bp, Corynebacterium glutamicum
atgcaagccatcgtccaaactgaggagaaggtcactgcttctctggaattacaggaagtccccgtcccgaccctgaagccaggtgaggtgctggtggaggtgaaggctgcgggcgttaaccgtgcggatcttttgcagacgcagggaaattatcctgtgccggcgggggcttcggagattctcgggctggaatgtgcgggtgtgatcgtggatgccggcgacactgggcaaacagtgggtcaggaagtcgcttgccttctcactggcggtggatatgcgcaatatgtggcggttccggaaggtcagttgatgccaattccagagggttacagctttgtggaagcggcctcgatcgtggaggttgcgtgcacggtgtggtcgaatatcggcatgctggcgggcttgcagaaggaggatactttccttattcatggtggcgcgggcggtatcggaacgtttgccattcagatgggcaaggctctgggtgtgacggttgcggtgactgccggttcaactgaaaagttaaaaacctgtaagaacttaggggccgatatcctcatcaattacaaggaggaagatttcgccgaggttttgaagaacaaggcggatgtcattctcgatattattggtgcgaagtatttgtcacagaatgtgaaggcgatggccaaggacgcgcacatggtagtcatcgggatgcagggtggcgtgaaaggggagctgaatttgggtcatcttttggccaagcgaggcacgatttctgccactgcgctgcgtggtcgcgatgaggcggataaggctcggattgtcagcagcactgtcgaaaatatttggccgctgctgcaatcgaaggaaattacccctcacatcgaccacaccttgccgctagccgaagcagccgccgccttgcagaaaattcaagacggcaccatcaccggcaagctcgtgcttgcggtt

SEQ ID NO: 231 - DNA, 582 bp, Corynebacterium glutamicum
ttgaaatcatacccgatagtctcgaacatactaaatcacctaatcagggggaattacatggatgtgttaaagatcgccatcatcgctgcagccatgattggtgtgccggttctggtggttttcctcattgtgtttgcggtgcacaagttggctaaggaagtgccgcggtctggtcgtcgtccgggtattgggttggggttgttgcttggttttgttgcggggctcatcgtgtggtttgtgtggttgagttggggtggttattacgagaatgagtttgggcagatgcaaggtccgtatcgtccgtggcaggttgttgcttgtggtgtcacgatggtcgcggtcactgtgattcttggtctgtggactaggtggactgcgtctggtccgttttattcggcgttgggtggtgcgtcggggtttagtttcgcgtgggccatggatgccattcctcaggatgaaaccggattgtcggcgtttggcttagtgatggtcattgttggtgttggtgcggggctaaatgtggtggcaactctgacgtcaatcggcgcaacgatctggaataaccggctaccctcgaatgca

SEQ ID NO: 232 - DNA, 297 bp, Corynebacterium glutamicum
ttgcctaaactagggcacatggccctgcacacgcacaagatagacggcgagacctacgctttttcgtggtcacccacgcaaacgcttctcgacgccctcctccaggccgacctacccgcccgctattcctgcatggaaggccactgcggaacttgccaatgtacgctgacgggagggccctcgcacatgctcaacaatgaagtactgagcaactacgagatcgtctccgaaaaccaagtgttggcctgccagacaatccgagacgctgacgggccataccactgttccttcgatgac

SEQ ID NO: 233 - DNA, 1476 bp, Corynebacterium glutamicum
ttggagaccttcatcactgatgtcattaatgacaatttgtggatgatcttgcccttcttgctcgttgctgctggcctctatttcggtgggcgtacgttgctggttcagattcggatgattccggagatgttcaaagcggtcgtcgagaagcctgcgaaggatggggagttcgcggacaagcaggacatttcggcttttaaggcgttcacgatttctgcggcgtcgcgagttggtacggcgaatgttgcgggtgttgcgctggcgatcactctgggtggaccgggtgcagtgttctggatgtggatcattgcgctggttggcggtgcgacatcgttcattgagtcgactcttggacagttgtggaaggtgaaggacggcgacagctatcgcggtggccctgcgtactacatgacgcttggtttgaatgctcggtggcttgcggttgttttcggtgtcgccatcacgttgacctttggttttgtgtacaacgctttgcagtccaacgcggttgttgaggcgattacggtatcactcggcaccccttctaccactgcaaaggcttttgttggcttgggcatggctggattgtctgcgctggttatttttggcggcgtgcagcgtatcgcaaacgtgacgcagtggatggttccgttcatggcgggtgcgtacatcattgtgggtgtggtggtgattgtgattaacattcagcaggttccgaccatgatcaacgacatcattgctggtgcttttggtttccgtccggttgctactgcgtcggtgtggggcgcgttctggttggcgtttatgaacggtatgcgccgtggactgttctccaatgaggctggtgagggttctgtcccgaacgctgctgctaccgcgactgtgtctcaccctgtgaagcagggtttggttcagactctgggcgtatatttcgacaccctgctcgtttgtagcattaccgcttttgtcatcctgctgtctggagtggagtacgcgaccggcgatattcagtcttcttctttgactcagtccgcgctggctagcgttgttggtggttggggaacccacttcattaccgtagtgatgttcttcctggcgttttcttccgtgctgggtaactactacttggcacaggcgaatattcagtacttcaccgattcgaagactgtcatgactgttttccgactcttggtgctgctcagcgtgttctctggcgcggttgcttcggtgccgttgatctgggctttgggtgatactttcgctggcatcatggtgctcattaacctggcggcgatcattccgctgggtggcgttgcagtgaagttgcttaagaattacaccattcagaagaaggctggtctggatcctgtgttccaccgcgacatgatgccagaggttcgtaatattgcgtgctggaacggcaaagatgcagctacatccaactatcacgaagcgatggaagtgatcaagaagagc

SEQ ID NO: 234 - DNA, 909 bp, Corynebacterium glutamicum
atgggagaaaaacggcggatgtggacggcgaaggaactgatcgggatggggtattcgcggcggaggatcaacagtttggtgaaggaggggaagttacaccgggtgttgaggggtgtgtatgcgttggatccgccgtcgggggaggttgtgtggtcggcgattcgcctggtcaggccgggtgctctgttggatgggaagtcggcggtggaggtttatcagggggtgtcgttgtcgttgcctgtgcgggtgagggtgagtacgtcgaatgtgttgagggggtcgcggaatgtggtggcgcggaggtctcagaggatggatgggattgctcatcgggggtttagggtggtgtcgttggtggatacggttgcgacgtgtcttgatgagcggagtgtgaatccttctgacctgcggagattagtggaggagaggtataagtcggggagcggggtgaagcagatggcgcatgatctgaagttgttgagaacgcggaggaaggcgcagctgcgggagtttttggaggagtgtatctatggtttggacagtggtctggagaaggtgatggtgcaggagctgcgggatgctgggtttcggaccaggcagaatgtggtggtggaggggtatcggtgggatattcaggtggtgggtgtggcgctgattgatgtggatagcaggaagtatcaccaggcgaataggcggaatttcatcattgatcgctggaagagcaatgaagccgtggtacaaggccatgtgccgttgaggtttacggatgattgtgtgaattatgcgacgggggagatcattaagttggtgaaacaggtggcggagttcaaacggaagcatccgcggaggagggtgaaaacgcaaggcgttgggccggtgtttaggtggcacaacgccttggttttaccc

SEQ ID NO: 235 - DNA, 1083 bp, Corynebacterium glutamicum
ttgggtcggcctgtgaaaaacctcgacatcgcccgctaccgccgccaaattatgctcggcgaaatcggccagcaaaaacaacaatcgcttttcgacgctaaggtctccgtcatcggcgcaggcggcctcgggtcacccgccctgctctaccttgctggcgctggcgtcggccacatccacatcattgacgatgacctcgtcgacctctccaacctccaccgccaggtcattcacaccaccgctggcgttggaacacccaaggccgagtccgcgcgcgaagcaatgctggcactgaacccttccgttaaagtgacggtttctgtcaggcgactggactggtcaaatgcactttctgagctggcagattccgatgtgattttggatggctccgataacttcgacacccgacacctcgcatcctgggccgccgcaaaacttggcatcccccacgtctgggcatccatcctgggtttcgacgcccaactctccgtcttccacgccggccacggccccatctacgaagacctcttccccaccccgccaccacccggatccgtcccatcatgttcccaagcaggcgttttgggtccagttgtcggcgtaatgggctccgcgatggccatggaagccctgaaaatcatcaccggcgtgggcacacccttgatcggaaaactcggctactactcctccctcgacggcacctgggaatacatccccgtcgtcggttcgccggaggtgctggaacgggtgcttgggtctgctggtgtttcggggatttctggcggttttggtgaggtgctcgatgttcctcgagtttccgcgctggttgacggcgtttcgctcatcgacgtccgcgaaccctccgaattctccgcctactccatccccggcgcgcacaacaccccactgtccgccatccgcgaaggcgccatcccaccctccgtttccgcaggtaaagaggttatcgtctactgcgcagctggtgtccgctccgcacaagccatcgcaattttagaatccgcaggctacaccggaatgagcagcctcgacggcggaatcgaaggctggctagattccctaggg

SEQ ID NO: 236 - DNA, 456 bp, Corynebacterium glutamicum
atgaacactgaccccgcttacgtcgccgaacaaaccggcaaactcatcgacgctttcctcaccaccgaccccctcgaaccgctgctcgacgccgccaaaaacggcgtctgcacagaggcgatgggcgcgctggtcaccttcgaaggcatcgtccgcgaccacgacggcggcgcccgcgtgacctccctgacctacaccgcgcatcccaccgcgccgcaggtcctttctgctgtcgcggactccatcgttgaaaaacacccgcgcacccgcctctggaccgcgcaccgcaccggcgccttgaaaatcggtgacgccgccttcctcgtcgtcgccgcctccgcccaccgcgccgacgccttcgccgcctgctccgacctcgccgacgccgtcaaagcccaggtcccgatctggaaagagcaaacgcgcctcgacggctccaccgattgggtcggcctg

SEQ ID NO: 237 - DNA, 471 bp, Corynebacterium glutamicum
ttggtctgttcagtgacagctctggttatcgttgcgtccactcgcgccgctgccggggtgtatgaggatcgctctggcccaattttggtgtcgtggctgcgtgcaaaaggttttgacacacccgcccccgtgatcgtggcggacgccaacctgcccgcattcctggacgagctggaatttccgcaggtagtacttatttcaggcggcaccggactcacgcctgatgacatcaccgtggacactttaatcccgcgcctcgacaaagaaatccccggcatcgcccacgctttttggaattacagcatggacgccgtcccgaccgcagtattgtcgcgcaccgtcgcgggcaccatcggcggcagtttcatcatggcgctgcccggctccacgggtgcggcgcgcgatgccaccgctgtcctcgacccactcattgatcacatcactggaactctgcaaggccaccatgaacac

SEQ ID NO: 238 - DNA, 468 bp, Corynebacterium glutamicum
atgagcgagctcacccacgttcgagcagacggttccgcacatatggtggatgtgacgggcaaaaatgaaacatcgagaactgctgttgccgaagggtttgtgaagatgaggggggacgtcgtaaagcagctttttagtgctggtctgcctaaaggcgacgcgctacctgtggcgcggattgcgggtatcatgggtgcgaagaagacgccggacattatccctttatgccacccgttgccgctgggcaaaattactgtggatttttttgagcttactgatggtgttcggattgaggcttcggtgaaaacgcgtggggttactggtgtggaaatggaggcgttgacggccgtgagcactgcggcgctgacggtatacgacatgatcaaggctgtggataagatggccgtgattgatggcattcgtgtgctgtcgaaaactggcggtaaatctggggattggtctgttcag

SEQ ID NO: 239 - DNA, 1185 bp, Corynebacterium glutamicum
ttgatgtctcgttcgccggagcaacatttggcagaaatttcagcgctgcttcccccacaaaagtccacgttcgtgaatctgcgcgaagcgttgggacgccgcacgttttcagcggtcactgcgcagtgggattcgccacgttttgataattcccaaatggatggcttcgcgcttggcccctcacatcttaacggtggcaccttcgcagtcggtccaaccattcccgctggtcatgatcctgatcagtggtacccacgaggcatcgaaaaagacatcgcgccgattatgacgggtgcgcgccttcctaaaaacaccgccgcgatcattcctgtggagaaaaccacaccgggaaatttcgacgccccacaggtagaaatccccgccaccccgcaaggtcagttcatacggttgcagggttcggatattactgccggcgacgagatcattccagcaggtacggagcttaactcggtgcacatcggggtgttggctagtcagtcgatcaagagcattgaagtcgcagcaaagccacgtgtcctcatcatcaccggcgggtctgaaatttcagaacagcacggacccgccacgatccctgatgccaacggccctctgcttcgttccctgtgcgcccgcaacaatatcgaggtcatcgcgggactgcacaccaacgacgatcctgaacgactccgctttgaactggaaaacgccattgaccagtatcaaccggatgtcatcatcacctctggtggtatcagccacggtaaatttgaggtgtttaggcagatcctcgaaggcaccccgaactcctggtttggacatgtcgatcagcagcctggcggtcctcaaggcatctccacttttgctgaaactcctgtcatttcacttcccggaaatccgatttccaccttggtgagtttcacacttttcgtcgcgccagcgctcaaccgccagccgctccgccacctcgatgcccgcatcaccgctccggtccagggcttgcaagacaatcgcgagcaattccttcgcggcaccatcagttaccgcaacggccacgtcctcgccacgcctctcctgggcaccagttcccacctgctggttcaagctgccaccgcagactgtctgatcaggatcccggcgcggactacggtggaggaaaacgacatcgttaagatttacccattcaac

SEQ ID NO: 240 - DNA, 723 bp, Corynebacterium glutamicum
ttgctgttgcagatcccctgggatcggtcttgggagttgcttaccgcgccggaatctttaggaaccgcacggttatctatcggaactgctctgttttctaccgcgctatgcgcaattgtgggtttcccgctagcgttggcgctgcatttatatgagcgttcgcaccccagggtgacatcagttttgacggtgctggtttatgcgcctttggtgttgtcgccggtggtgtctggtttggcgctgacttttctgtggggcaggcgtggttttttaggttcttggcttgatcaggttggattgccgattgcatttaccaccacggctgtggtgtttgcccaggtgtttgtagcgttgccatttttcatttccactgtgactactgcactgcgtggcattccaaaacagtttgaggaaatcgcagctactgaaggcgcaacccgctgggagatcatgcacaagatgatcattccgctggcgatgcctggaattttcaccggtatgattttgggattcgccagggccttgggcgagtatggtgcgacactgacttttgctggaaatattgcaggtgttacccgcaccattccgttgcatattgagcttggtttgagttccaatgacatggataaagccttgggagcggtgattatgcttttggctgtctatgtcctcatcattggagccatcggagcgttacgattgttttccaaggtgagaaaggtt

SEQ ID NO: 241 - DNA, 804 bp, Corynebacterium glutamicum
gtgaacaaaagtatccgtcgagctctctacagtttcatcactatttcggcgggtatctcactcgtagcgtgctcttcttcagacaccgcaagcactaccacccagaatgcctctgctaccgaagcagctggggtttccggaaccgctagcgttttcgctgcggcgtctttgaccaacgttgctgaggatctcgcggctgcgttcaacgaagacaatcctgatgcaaagttggagtttaacttcgctggttcttccgcgctggttcgccagatcagcgaaggcgcaccatctgatctgttcatttctgcggacatcgccaacatggacgatgcgctggcacttccagaatttgccggcgcaacctcgaaggtcatcgctaccaacaagctggtgctggtcaccgcagacggcaaccccggcgaaatttcagagcttgccgacgtcaaggactccctcgttgctatctgcgcccctgaagttccatgtggaaccatcacccacgaggctttggactacgcagacatcgagttgaacaccagctctgaggaagccaatgttgctgatgtcgccacgaagatttccaccggtgcagttgatgcgggctttgtttaccaaaccgacgctcagtctttggctaaaactcaggacaacactgtcattgaactcgaaggtatcgacgccaacgaatacccaatggcattgaccaccaccggtgaagacaacgaggtagcgaaggctttcgcagagttcctcagcagcgatcgtgccaaggagatccttgccagctatggttttggcacaaac

SEQ ID NO: 242 - DNA, 321 bp, Corynebacterium glutamicum
ttgtttaagtactgcgcctttcctacgattagttcagtacttaatccagagggaagtttcaacaacatggacattcattattttgcggcagctcgggcagctcgtggggtggcgcaggaaactgtggcaccaagtgaacttacactcagcgatctgctgaaacagctcggtgagcagcacactgaaaccaccgcagcgggcatgacgttggcgcaggtgtttgatcgctgcaccttccttatcgatggccgttcggctgattcttccgcctcgctcagcggggcatcacgagtggatgtgctccctccttttgcaggcggc

SEQ ID NO: 243 - DNA, 912 bp, Corynebacterium glutamicum
atggcggatctgagcattgaacacgtatcaaggtttttcggcgatgccatcgccttgaacgatgtgtcattgaccgtcccctcaggctccatcaccgccatcatcgggccgtccgggagcggtaaaaccacgttactgcgtttgctggcaggccttgattcacccgatgaaggcaccgtgagcattgggaataagatcgccaagctgggtgacactgcgctgtgtttccaggattcgcctttgtatccgcaccttaatgtgtgggaaaacgtggcatttccgctcaagctcaaagccaccaatactgcagatgaggtggtgaaaaagcgggtgagtgatgttttggaaatgctcgaaattgctcccctcgcccgccggaaaattaccgaactctccggcgggcaaaaacagcgcgtcggcattgctcgagcactggtcagagacgtagaggtttaccttttcgacgaaccgatggcccacctcgaccaagccttagcccgcgatattgtggccgatctgcgcaaaattcaacaatcgttgggactgacgtttgtatacgtcacccacagcaaatccgaggcattcgcgctcgccgaccaaattgtcgtgctggtagatggccaagtcgcgcaggttggtgaggcggaggagctcgtcgaaaagccaaaaaccctagaaatagccgagttcctctcccccaccgagctcaatgtgcgccggcgtggggacgccgtggaggcatggcgacccgaagacacccagctcgcccgcggtggcactgcgaccgtggaagccgtgacgtatttgggccgcgagtggcttgtacaaaccaccgaggggcacgccgtgtcggaggaaaaattcgacgtcggcgaaagcgtcacgctaacccagaagaaggtgtttagtttc

SEQ ID NO: 244 - DNA, 420 bp, Corynebacterium glutamicum
atgctgggtagtctttggcgttttgcggtgcgcaccgcagcaggcgcggtggcgttgtgggtggttattaagcttatcgacggcatctccctgagttttcccaccacacctctctatcaggacggtcagcacgacaatctgctgacattcctggcggtggcagcaatcattgtcgtgttgaatgccacggtgaaacccgtcttgaagctgcttggtttgccgttgacaatcatcaccttgggtctgttctcgctggtcatcaacgcggtaatcatgctgctggcggagtatgtgtcagatttgatcggtttcggtctacgcattgaaaccttcggtgcggccttctggggtgcgattgtgctggcgttagtgaactgggttcttggccccattaccggcctcctcggtgcaaaaaaggac

SEQ ID NO: 245 - DNA, 1023 bp, Corynebacterium glutamicum
atgattagagcagatttggcaactatccctacttatgtccctggccgtcgtcttgttgatgctacgaagttatctagtaatgaagttagtttttcccctctcccggcagcagttgatgcggtgacggaggctacttggggggctaatcggtacccggatatgggtgcggttgagctccgtgaggctcttgcagagcatttagaggttgagtttgaccaggtcacggtaggttgcggctcgtctgcgctgtgtcaacagctggttcaggcaacgtgcgctcagggcgatgaggtcatttttccatggcgcagctttgaggcttatccaattttcgcgcaggtcgcgggcgccactcctgttgccattccgctgactgctgatcagaatcatgatcttgatgcgatggcagccgcgatcactgataagacccgcctcattttcatctgcaaccccaacaatccttcgggcaccaccatcacccaggcgcagtttgataatttcatggaaaaggttccaaacgatgtcgttgttgggctggatgaggcttattttgagttcaaccgcgcggacgacaccccagttgccactgaggaaatccaccgccacgacaacgtgattggtttgcgcacgttctccaaggcgtatggcctggcgggcttgcgtgttggttacgccttcggaaacgcagagatcatcgcagcgatgaataaggtggctattcctttcgcggtgaattcagcagctcaggcggcagcgcttgcgagtttgaattctgccgatgagttgatggaacgggtggaggaaaccgtcgaaaagcgtgatgctgtggtgtcagcgcttggtgctgcgccgacgcaggccaatttcgtctggctgccgggcgagggcgccgctgagttggcggctaaattggccgagcacggcatcgtgattcgcgcgttccccgagggtgcgcgcatttcggtgaccaacgccgaggaaactgacaagctgctgcgcgcgtgggaggccatcaatgctggg

SEQ ID NO: 246 - DNA, 906 bp, Corynebacterium glutamicum
ttgcttctgggttatattgacgaagtgggtgaaactggggcattcgtttctcgacaggatcctcgatacaagacatcaccggccttcgggtatgccggcttcttgataccagctgaaaacgctcgggcgtttggttctgaatttacaaaacaaaagcgaatccgtttttccacggaaatagttaatgcacctaatcctgcaaggtgggaagtgaaaggagccgacctctttcgtccggatactccaattgtccgacctgaaaaccttagaatttttggttctctggtagaacgtcttcaaaaactgggtggacatctattttattacgtcgatgaaaaaccaatcgggactccacgacagacgaaactagatcaagtaggacgtgaacgggaagcaatgcgtgagacactcaatcgtctcgcaactcaggcgaatcgcgaagatagaaatctaatggttctggtcgacagcatcaacgaaaagtctaggaaagagcgaatcgctgaaatgtattctcatatcttttctagatcgggagagcatccagaaatgcgttcaatcgttgaacctcccatgcatgttgatagtgcattgtcgtcgaacattcagtttgcggactggattgctgcctatgtttcacgtgctatagataggcaactaattgaagactccagatatcaatggatagcggacgatataagtacgtttaaagtttatggttcattcactttggagtctaaactgcatctcttacggaatcgtccttgtgaagatttcaatacgagcgacatattaaagagaaatcgacctatgtttagttttgatgcagctactgcgattggttctcgcgtgggggttgcgcgggcgatgcaaatcaaggcggcttctgacagggcaaactctcgt

SEQ ID NO: 247 - DNA, 294 bp, Corynebacterium glutamicum
gtgagtcatacgatggcagcatttctagagatcaccttgaaaatcaatgacgaaggccgcccatcagcagctggcgtctaccaggaatacaagcaaccattcctcagctcaattgctggcgctacaagcaaagaactcctcatccgagaagaagacgtgcaggtgctccacggctgtgacaccgtagctaatgctgaagattatcttgtcagcgaactgttcacggccgatgttgtcggtggtctagctccactattgcaggctgatccagagattcgtatttaccaggtcgcg

SEQ ID NO: 248 - DNA, 120 bp, Corynebacterium glutamicum
gtgattttgatgaatgtgaccataagtaatagttatgatcagctttcggtttcagtgagtaggcgcgcgagtttctctatatcttcggataaatttgttccaggtgaccacactgcttcg

SEQ ID NO: 249 - DNA, 762 bp, Corynebacterium glutamicum
atgaccaaacggctcagccttgaagggctccgctatgcgcaggccgtcgcagaaactcactcattcagcgcagcagcccgcgaatacggagtcacccaacctgcgctatccaacggcatcgccaaactggaagatcggctcggtgaacaactcttcgatcgatctactcaaggcgtcaccccgacgtcctttggcctccacatcctccccctgatccaacgcgcgctgactgaaatcgacgcaatcaccgcggaagcgcaccgtttgattaactcagaagcacgcagcattcgagttggaatctccccacttatcaaccctcaactggttgcacgaacatataccgcggttcgtgagcttcccacagcacacgacctagtactccgcgaagcaaacatgaaagaactacatgaaggacttcttgcaggtgaacttaatgtaattctcattcccgcagtgaaaccactaccccattttgaacaccgcatcattgactccgaaccagtcgttatcgtcgaatccacccaggacagcaccgaccccatagaacttcgcgagactcagcacgaaccgttcattctggtacccgacacatgcggtttaaccactttcaccaatcaactgtttgaaacaaatgacctggcattaaacgcctattccggcgaagcagccagctaccaagtactcgaacagtgggccacacttggactcggatctgcaatgcttccactttctaaactcagctcccctacagcaccccat

SEQ ID NO: 250 - DNA, 1017 bp, Corynebacterium glutamicum
atgcccaaatacattgccatgcaggtatccgaatccggtgcaccgttagccgcgaatctcgtgcaacctgctccgttgaaatcgagggaagtccgcgtggaaatcgctgctagtggtgtgtgccatgcagatattggcacggcagcagcatcggggaagcacactgtttttcctgttacccctggtcatgagattgcaggaaccatcgcggaaattggtgaaaacgtatctcggtggacggttggtgatcgcgttgcaatcggttggtttggtggcaattgcggtgactgcgctttttgtcgtgcaggtgatcctgtgcattgcagagagcggaagattcctggcgtttcttatgcgggtggttgggcacagaatattgttgttccagcggaggctcttgctgcgattccagatggcatggacttttacgaggccgccccgatgggctgcgcaggtgtgacaacattcaatgcgttgcgaaacctgaagctggatcccggtgcggctgtcgcggtctttggaatcggcggtttagtgcgcctagctattcagtttgctgcgaaaatgggttatcgaaccatcaccatcgcccgcggtttagagcgtgaggagctagctaggcaacttggcgccaaccactacatcgatagcaatgatctgcaccctggccaggcgttatttgaacttggcggggctgacttgatcttgtctactgcgtccaccacggagcctctttcggagttgtctaccggtctttctattggcgggcagctaaccattatcggagttgatgggggagatatcaccgtttcggcagcccaattgatgatgaaccgtcagatcatcacaggtcacctcactggaagtgcgaatgacacggaacagactatgaaatttgctcatctccatggcgtgaaaccgcttattgaacggatgcctctcgatcaagccaacgaggctattgcacgtatttcagctggtaaaccacgtttccgtattgtcttggagccgaattca

SEQ ID NO: 251 - DNA, 801 bp, Corynebacterium glutamicum
atgccaacagcaagcccaatttatgatgtcgttgtcgtcggagccggcatttctggcctcatcgccacgcaactgttggaccgcgcaggtctaaacatcaaatgcttcgaagcctgctcaagagttggcggccgagcagtgtctgtccaacagtccgatttgttcctggacctcggcgcaacatggttctggctcaacgaaccacttgtgcagcaactcgtcaataatctcggcctcggcacattccctcaggccatcgagggtgatgcgctttttgagacgcttgtcgacgccccgagccgcctgcggggtaaccccatagacgctgcttcaggcaggttccaagcaggggcctcctcgcttgcgctcgggcttgcagcccagctcaagccaggagttttagaactcggggaccccgtccattctctcagtgaggaagatggggaaatcgttgtgaagtcttccaaacagattgtgagggcaaagcacgtcatcattgcggttccaccggcactcgctgccgagttgattggtttcaccctagatttaccagctgacgtgcgaaaagcagcgcatccacaacatatagctgtgatgaattgggcaaaggagaaatacaccttacccacacaagccgcatcggctgggggttttgggcatgagctgttccaacaaccactcggacatgggcgaattcattgggcatcaacggaagttgccactgagtttggtggacaccttgaaggcgcagttcgtgcaggaattcaggctgcgcttcaaacaggatttaatctaaaatct

SEQ ID NO: 252 - DNA, 1350 bp, Corynebacterium glutamicum
atgcgcctgaaatcgggcttgttgaggggagaggtgtgtgacatgaaagagttggaactgggcgaggcgagggacgtcgctgcaacgttggaagcgatgccgatccaggaggttattgatcaggttgagcgaacttctataactaaaggtgcggtactgctgcgtctgctcagtaaagatcgatcgttgttggtcttcgatgctcttggtccgcgactccaggctgatctcattggtgcttttcaggatgcggaagtgctggattatttcgctgaccttgaccctgatgaccgcgtttcactgcttgatgagctgccggcgtcgatcgctgacgagttgcttcgcagtctcgatccgcaggaaaagcaggtcacggagctggtcttgggttacgcaaaggggtcggttggacgttggatgtcgccccaggttttattgcttttcgacgacatgtccgtcgccgaagtcttagattttgtgcgcaatcatgctgctgaggctgagacgatttatgccttacctattgtgaaccgtgctcgccaagtgatgggcgtggtgtcgttgcgaaagctgttcatcgcagatcccactctaaaagtctcggaaatcatggtgcgtcctgtttcggtgttggcgtccgcggatattgaagaaaccgcccgctggttcctacagttggacctcgttgcgatgcccgttgtggatgaatcgaacatgctcttaggagtgctgaccttcgatgatgcgcaagacatcgtggagcaagccgactctgaggactccgctcgcagtggtggttcggaacctctccagcagccgtatctatccacgccgattcggaaactggtgaagtcccgcatcgtatggcttctggttttggcagtgtcagcaattttgacggttcaagttcttgatattttcgaagccaccttggttgaagccgtggtactggcattgttcattcctttgctcactggtactggcggaaacaccggaaaccaagctgcaacaaccgtgacccgtgcgctcgcattgggtgacgtccgaaaatcagatgtcttccgcgtcttgggcagagaaatccgagtcggcctcatgctcggggcattgttgggtgccgttggatttgtgatcgcatcgcttgtttacggcatgcccgtaggcactgtcatcggtctgacattgttggcggtgtgcacgatggccgcatcagttggcggagtaatgccaattattgccaaggcgatcggagcggacccagcggtgttctctaatccttttatttcaaccttctgtgatgcaacaggtttgatcatctactttgcaattgccaagttggtgctcggaatc

SEQ ID NO: 253 - DNA, 174 bp, Corynebacterium glutamicum
ttgacgggggaggggctgaacgtgatctttctaccaattcgcactgcgaacgttaatattccctcgttggcttacatggtcattgatgaccgggctgaatatgtgagaaaatccatcccttctttaagcaagggagtgaattacagaaaaggattgttcagcaatgagcacacc

SEQ ID NO: 254 - DNA, 1530 bp, Corynebacterium glutamicum
atggtcgttggagacaggcgagagtggcgtcgacaagcaaccggcatcattgccggcctcgtcttagccgccctggtctatcttctcttcccctcgaactccgtggaaaccgtcatgcaatccagtggcgtcgatccagaaactgaatacaccaacaacgcgatgcgtcttactgctgcagtcacaatcttgatggcagtgtggtggatgacagaagcaatcccactagcagcaaccgcacttatcccgttggttgcattccctgctttccaggttgtggactttgggaaggcagcagctccgtatgccaaccctacgatcttcctcttcttgggcggctttcttatggcacttggcctgcagaaatggaacctacaccgacgtatggctctagcggtcgtgctagctgttggtactaagccaaagcaattggtcttgggttttatggtggcaactggatttttgtccatgtgggtgtctaacactgcaacggccgtggttatgttaccgatcggtatgtcggtactggcactgaccgctgagactgtgggcggaatgaaaaaccaaaagaaattcgccactggactcatgctgtccattgcttattctgcttccatcggttcactcggcaccttaattggcacgccacccaatgccttgcttgctgcgtatatgtctgaatcgcatgatatccacatcggatttggtcagtggatgattcttggtgtaccaattgctgtcgtcttcaccatcatcgcgtggcttgtgttgaccaccgtgttcaagccagaaatgaaagaaatccctggcggacgtgaactgatcaaacgtgaaatcgctgaaatggggccgtggactgcacctcaggtcacagtgggtgttatttttgcggcagctgcactggcttgggtcttcattccattaactctagattggaccggttcccagctctctatcaatgactccctcattggcatcgctgccggcctgctgatgtttatcgttcccgctaactttaaaaccggcgaacgcattcttgattggcgtactgcaggcgaacttccatgggatgttctcttgctttttggtggcgggctttcactttctgcgatgtttaccagcacgggactttccctatggatcggtgaactagctaagggacttgatgcccttccaatcttcattctcatcttcgccattgctgtcctggtgttgttcctgaccgagttcacctccaacaccgcaacagcggcaaccttcctgccaatcatgggtggcgtcgccgtaggtatcggactgaccgcaggtggcgagcagaatgttctgctgctgaccatcccagtcgcactgtccgcaacctgtgcgttcatgcttccagtggcaacgcctccaaacgcgattgcattcggctccggctacattaagatcggcgaaatggtcaagggtggtctgtggctgaacatcatcgcagtcatcctcattacgattttcacctacttcgtagcgatcccactctttggcatcatgctt

SEQ ID NO: 255 - DNA, 1020 bp, Corynebacterium glutamicum
gtgactaccaaagacatttcccgcccagtatgcatcctgggcctcggcctcatcggcggatccctcctccgcgacctccatgcagccaaccactccgtcttcggctacaaccgctcacgctccggcgctaaatcagccgtcgacgaaggcttcgacgtttccgccgatcttgaagcaaccctccagcgtgcagccgccgaagatgcgctcatcgtcctcgcggtccccatgaccgcaatcgattcgcttctcgacgccgtccacacccacgcaccaaacaacggcttcaccgacgtcgtatccgtaaaaaccgccgtctacgacgcagtaaaagcccgcaacatgcaacaccgttatgtgggatcccaccccatggcaggcaccgccaactccggctggagcgcatccatggacggactgttcaaacgagcagtatgggtggtcaccttcgaccagcttttcgacggcaccgacatcaactccacctggatcagcatctggaaagacgtcgtccaaatggcactcgccgtgggcgctgaagttgtcccatcccgagttggcccacacgatgcagcagcagcacgagtgtctcatttaacacacatcctggctgaaaccctcgccatcgtcggtgacaacggtggcgcactgtctctctctttagccgctggcagctaccgcgactccacccgcgttgcaggcaccgacccaggactcgtccgcgccatgtgtgaaagcaacgccggcccactggtcaaagccctcgacgaagcactggcgatcctccacgaagcccgcgaaggcctcaccgcagaacagccaaacatcgagcaacttgccgacaacggctaccgatcccgcatccgctacgaagcccgctccggccagcgacgcgccaaagaatccgttagccctaccatcacctcatccaggccagtgctccgtctccacccgggcacaccaaactgggagaagcagctcatccacgctgaaaccctcggcgcacggatcgaagtgttc

SEQ ID NO: 256 - DNA, 522 bp, Corynebacterium glutamicum
gtgtggcacatacctactacggttatctctatgaacactgaagaggatggcctgagctttgcagttacggctaccttagttgaaggtaaatggcaggtacgcgagtttgaggatcacttctccaagctctctacctctattaatgcggttcgctcgctgcgtagcgaggggccggcgtttgcgctgttgtgcgttgatgatgaatattttgtgatggtgcgtcccaccccaagtagggtattccttttcctttcggatgcgccgatggctgtcgacgatgatttcgccgccgcggtgatggatgaactcgatgcggatcttccagatatcaaccctgatgatttggacgacatcgatccatggccagaaggtgatttcgatattttggcggatttggggctgtctgaggaggttctttccgtgatttgcgatgacatggatttggatccttccgaacaattgctgcgcatcgcggaagaactcggttttgataatgatctggctcgggtggtgggattcgac

SEQ ID NO: 257 - DNA, 417 bp, Corynebacterium glutamicum
ttggatattgctcgccaaacccctgagggggacgttcccgttggcgccgtcatttacgcgccgaccggggagatcctggcgaccgcaacgaaccgtcgagaagcagaccgcgatcccacggcccacgccgaaattattgctttacgacgagccgcccgccgtttttccgacggctggcggctgagtgactgcaccgcggtggtcaccttggagccctgcagtatgtgcgccggcgccttggtgggtgctcgaatcggacgcatcgtattcggagcatttgagccccgaaccggcgcctgtggatctgtatttgacgtggttcgagaccccgcggtgttgcacaaagtggaagtcagtggaggaatcctcgagcctgaatgtgctgccttgatgaccgaatttttcgaacttcacagg

SEQ ID NO: 258 - DNA, 201 bp, Corynebacterium glutamicum
atgagcgatttttccaacaaggcagaggacctcacaggtaaggctaaagaaggattcggcgaggcaactgataacgagtccctcgctgatgagggccgtgcggatcaggctaaggcagacatcaaggatgctgtcgaaaacgccggtgaaaaggtaaaggacgcagctaacaaggttctgggtgcgttcaagaaggacgac

SEQ ID NO: 259 - DNA, 351 bp, Corynebacterium glutamicum
ttgctctactctgtggtcatgaaccttgcacttttctttgcaattgctgtgaccgctttggtcggtgtttctttgctgcggaagcaagcctcagaggagcgggtgtttccgtggttttgggtgttctttccgttgacgctcatgtcgatttccggaattttgatgaagcctgagtcgcggacttctttcgatttcggatggtcaatgtatgagccgtccatttactccaacgaattccagccagatttcttcgatctctttaattcctccacaatttctttagtcacttatgttgtcacgctgcttgtgggagtaattggttctgtgatcgcgtggaagaagcgtcggatc

SEQ ID NO: 260 - DNA, 2403 bp, Corynebacterium glutamicum
gtggcgaaattgctattcaggttggggcgatggtcctataatcgcaagtggattgtgatttcggcatggctacttattttggccattgttggtggtctggccctgacgatgcagaaggggttcagtaactctttcactattgaagacaccccttcgattgatgccactgtttctctggttgaaaatttccctgatcagacgaacccggtgacggccgccggagttaacgtggttttccaatccccggaaggaaccacgcttgatgatcctcagatgatgactgcgatggatgcagtcgttgattacattgaggacaatttgcctgattttggtgggggagagcgcttcggcaatcctgttgaggtgtctcctgcgttggaagagatggtcatcgagcagatgaccagcatggggcttcctgaggaaaccgctgcaaaggatgctgccaatctggcggtgttgagcgaagacaaaaccattggctacacctctttcaacattgatgttgaggccgcagaatatgtggagcaaaaacaccgcgatgtgatcaacgaagcgatgcaaatcggtgaagatttaggtgtccgggtggaagccggtggacctgctttcggtgatccaattcagattgaaaccaccagtgagatcatcggtattggcatcgcgttcatcgtgttgattttcacctttggttctttgattgctgcaggcttgcctttgattaccgcggtgatcggcgtgggcattggtgcgctggcaattgtgctggccacggcgtttactgatctcaacaatgtgactccagtgctcgcagtgatgattggcctggccgtgggcattgactacgcgctgtttattttgtctaggtaccgtgcggagtataagcgcatgccacgtgccgatgctgccggaatggcggtgggcacagctggtagtgcggtggtgtttgctggcgcgacggtgattatcgcgctggtagccctcatcattgcggatatcggattcctcacggccatgggtatttctgcggcgtttacggtgttcgtggctgtgctcattgcgttgacgtttatcccggcgctgttgggtgtgtttggtggtcatgcgttcaagggcaagatccctggaattggtggaaacccaacgccaaagcagacgtgggagcaagcgcttaatcgtcgttccaagggtcgctcatgggtcaagcttgtacagaaagcaccgggtcttgtggtggcagtggtggtcttgggtcttggtgccttgaccattcctgcaatgaacctgcagttgtcactgccttctgactccacctccaatattgataccactcagcgtcagtcggctgatttgatggcagagggctttggcgcgggcgttaatgcgccgttcttggtcatcgtcgatacgcatgaggtcaatgctgattccaccgcattgcagccactgattgaggcacaggagcctgaagagggcgagttcgatcgggagcaggcggctcgttttgctacctatatgtatgtcacccagacctacaattccaacatcgatgtgaagaatgcgcagatcatcagcgtcaatgatgatttcactgcggcgcagattctcgtgactccatacaccggacctgcggataaagagacccctgagttgatgcacgtgctgcgtgcgcaggaagctcagattgaggatgttacgggaactgaactgggtaccactgggtttacggcggttcagttggacattactgagcagctggaagacgcaatgccggtttacctcgctgtggttgttggtttggctattttcctcctcattctggtgttccgttccctgcttgttccgctggttgctggccttggcttcttgttgtctgtgggtgcggccttcggtgcgacggtgttggtctggcaggagggcttcggtggctttgtgaacacccctggtccgctgatttccttcatgccgatcttcctcatcggcgtgaccttcggtttggccatggactatcaggtgttccttgtgactcgcatgcgcgagcactacacccaccacaatggcaagggacagcctggttccaagtacaccccggttgagcagtcagtgattgaaggcttcacgcagggctcccgcgtggttacagcagcggcactgatcatgattgccgtgttcgtggcgtttattgatcagccgttgccatttattaagatcttcggtttcgcgttgggtgcgggcgtgtttttcgatgctttcttcattcgcatgggtctggtccccgcgtcgatgttcctgatgggcaaggccacgtggtggatgcctaagtggctggatcgaattctgccaagtttggacattgaaggcaccgcactggagaaggaatgggaggagaagcaggctgcacgt

SEQ ID NO: 261 - DNA, 1263 bp, Corynebacterium glutamicum
ttggcacctatgtcagatctttcattcaccctcaacaacaagcttgccgatgacgcccccggcaagcatggtcgtacaggtgtaatccacacacctcacggtgatattgccacccctgctttcattcctgtggctaccaaagccacggtgaaaacccttacccctgagcagattcgggagaccggcgcacaggctattttgtccaacgcctaccacctgtatctgcagcctggccccgacatcgtggacgaggctggcggtgtgtctgcctttgagaactggcacggccccacctacaccgactccggcggattccaggtcatgagcctgggctccggctttaaaaaggtgctggccatggacaccaccaacttgacgcgcaacgatatcaaggcggctaaaaaagagcgcatggcgcttgtcgacgaagacggcgtggatttcaaatctgttatcgatggctcaaagcaccgattcaccccagaagtctccatgcagattcagcaccaattgggcgcagacatcatctttgcttttgatgaactgaccaccttggttgatacctatgactaccaggtggaatctgtggaacgtacccgcaggtgggcacagcgctgcctcctggagcatgaacgtttgactcaggaacgtgtggataaaccactgcaatccctatggggagtggtgcagggggcgcagttcgaggatttgcgtcgacaagcagtaaaaggcctgttggacctggatcgccaggccgccgacgaaggccgtcgcggcttcggcggtttcggcatcggtggcgccctagagaaggaaaacctgggcaccatcgtgggctgggtgtgcgatgagctgcccgaggacaagccacgtcacctgctgggcatttccgagccggacgatctgttcgtggctgtcgaagccggtgcggacacctttgactgcgtggcgccgactcgtttgggtcgacgcggcggtgtctacacgcttgatggacgcatgaatttgaccggtgcgcgtttcaagcgtgacttcaagggaatcgatgaggaagtcggcggatacgccagcgagaactactcccgcgcgtacattcatcacctgctcaaagcgaaggaatttttggccggcacgctgtgcaccatgcacaatctgcacttcatgatcaccttggtggataagattcgtgccagcatcgatgatggcacgtactacgaattcaaggaagaattcttaggccggtactacgcgtcgaaggtttca

SEQ ID NO: 262 - DNA, 738 bp, Corynebacterium glutamicum
gtgcaaaatcaatcacacaccccagaaacccagcctcaacctgggcagggcgcagccaagaaaacccccgttgcgtccggaaactccacgttcattcacattcagccaagcttgtaccccattttgctggcgctgtttgttgcagtctttctaatttcaaatatcaccgcaaccaagggcgtagaaatcggcccgttggtgacagacggtgcgttcttcctcttccccatctcatatgtgttgggcgatgttctagccgaatgttacggcttcaaatccactcgtcgtgccattcttactggttttggcatcacgatgctcgcggcgctgtctttctacatttccatctggctgcctggcgcaagtttctgggaaggccaagaagctttcgaagcaacgctcggccttgttccacagatcatcgtggcatcactggcgggctatattgtgggtcagctgctcaacgccaaagttctggtggctatcaaaaagcgcacgggtgaaaagtccctgtgggcgcgcctgattggttccaccgttgtcggagaatttgtcgataccctgctgttttgcgccatcgcagcgccagtgatcggtattgccaccgccccggatttcatcaactacgttgtggtgggcttcgtgtggaaaacccttctagaggtcatcctcatgcccatcacctacgcagtcattaggtgggtgaaacgccgcgaaggttatgaaaccttcgacgcg

SEQ ID NO: 263 - DNA, 1080 bp, Corynebacterium glutamicum
atgaccattgctcttgaacacccagtactgcactccacggcgatcgcgttgcctgctcgttttcaggcgagctatacgacgcgtttggtggcggtgggcgtcgataagcgtccttctgatttttggttggaaacagccggcacgccgcaggcgggcgatgtggtgattgcgcgggtgacggcgattaataatcacaagcgggtggagacgccggagtcgcgcaaggccattttgtttgagggggtgttggtgatgttggcgtatgggcaccggtatgcggcggatcagtttttagcgcatgtaccggaggatttggggccatgccatttggtggcggctggtggcatcgcgggaacggtgacggcgctgcacgatcgggtggatgaacccacagagattgaaccgttgggattgctcaccaatgcgcgcggaactgtgaatgtacgggactttgcggcttttgataatcctttgaaagtggaggctcccaacaagcgtgcgcaggtgatcgcggtgctgggaacgtcgatgaactctggaaaatccaccacgcttgcctgcttggtcaatggtttggctgcggcggggcagaaggtggcggctggaaagatcacgggcactggtgctggaaatgaccgcatgatttatcacgatgctggtgctcacagcgttattgatttcaccgactttggctacccaactacgttcaagctgaatttcgcggagattcgtgcgctgagcgtcaacatgattaatgtgctggctgattctggtgcggataccgtgatcgtggaaatcgcggacggaatttatcagggcgaaacctcgcggctgttgcgcgatcaagtgttccaggaagccgtggatcatgtggtgttctccgctgttgatgccttgggcgcgaaggccggtgtgcaggaactgcaggcggcggggcttcatgtggctgcggcctcgggagtgatgacggcttcgccgctggccaccgcggaagctgccgctgtgcttgaagttccagtggtgcccacttttgatctcaccaacccggagatcgtcacagcggtgctaacggatcatgcc

SEQ ID NO: 264 - DNA, 648 bp, Corynebacterium glutamicum
atgaagccccgccgcctgcagttcctgcacaccggccttcgcgcccaaggcatcaacagcggagaacaccacatgatccacggcttcctggaacacttgatcgcgcaacagccgcgaggtttcgccctgataaattccgtccgcgatttccacgatcacggtatccgcaccagaatcagccagcacattaatcatgttgacgctcagcgcacgaatctccgcgaaattcagcttgaacgtagttgggtagccaaagtcggtgaaatcaataacgctgtgagcaccagcatcgtgataaatcatgcggtcatttccagcaccagtgcccgtgatctttccagccgccaccttctgccccgccgcagccaaaccattgaccaagcaggcaagcgtggtggattttccagagttcatcgacgttcccagcaccgcgatcacctgcgcacgcttgttgggagcctccactttcaaaggattatcaaaagccgcaaagtcccgtacattcacagttccgcgcgcattggtgagcaatcccaacggttcaatctctgtgggttcatccacccgatcgtgcagcgccgtcaccgttcccgcgatgccaccagccgccaccaaatggcatggccccaaatcctccggtacatgcgc

SEQ ID NO: 265 - DNA, 1437 bp, Corynebacterium glutamicum
atgcctagcttatggcgtgctcgtcgcagacttttgctcattgccctaggtgtacttggtgtgctgcaggcactgctggcgatcatggtgtcgttgagcgtagccgccatacttgagggaaaccgagcacttgttggattgctgcttgctaccacgttgggtttgggggtggcgcagtggattcaaaaagtagtggcagaagatctaggccagcattatgtgcatgaggtgcgtcgtgaattggtgggtgctgcgctggtgcctggaaatacggcctcgttgggcgtgactgtcacccgagccagcaatgatctcaccgcggtgcgcaattgggtggctttgggcattgttccgatggtcaccgggctgccgttgattgcgattgtgctggtggcgttgtttatccaagatctccgcacaggcgtggctgttactgtgccactgctcatgtgtgtagccgtgctgccggtggtggcgcggtggactttgaaaagagcacgtgaactacgcaaaaaacgtggacgcatggctgcgcggatcgcagattctgtcatggctggagaattactgcacgcaacaggagcaatagaccgtgagctcaatgcagtcacccgagattccgaccgagtggtgatagctgctgtaagacgttcctgggccaccggttttagccgcgcattgatggccatggcagcctcgcttggcactgtcagcattgtgatttctggccacctggaagtaagtgaggttgcgggaataatgatgcttcttggcgttcttgccactccagttgcagaacttggccgcgtggtggaatatcgccaaaattataaagccgcgacacgcatcctgattccacttctgcaacgaggctcagaatttaaacactcccaacaaaaactacccgggttgcaagcaacagaaggaatccccggtgtctatgtcaaaggtatttccgcccttcctggagaacggatctacctccacggctctgcagatgcgacgagaaaatgggtcacctcgttgtctgcaatggaggaaggcacagatgtaatagtcaacggtcaaaggctttcgcagcttcctttgaaacaacgacgcgccctcatcggaatcgcctcagcacaccaccacttaagccgtggttcagtatcgcgcctggttggtttgcgagtgccggatgccaccgtggaagaaattgagcaagcactggaacaagttggtctgaacaacaccgggaaacaacgcttgaaaaacggcggacacccctggagtacttcgcagatcaacaaactgaaaattgccagcgccacccttcgaaccccaccgcttttggtacttgaaggcatcacccctgaaaacctcctcaactatcccggagtgatcatctccaccgttcaggagaacccatccgaaacatggcggcaagtgaacatc

SEQ ID NO: 266 - DNA, 879 bp, Corynebacterium glutamicum
atggcaggacgatacgcaccatcaccaagcggcgaccttcactttggcaacctccgcacagcactgctggcctggctgttcgcgcgctccgaaggaaaaaaattcctcatgcgggtcgaagacatcgatgaacaacgctcatccaaggaatccgccgaaagccaactcgcagacctatccgccctgggtctcgattgggatggcgacgtcctctaccaatccacacgctacgacgcctaccgcgcagcccttgaaaaactagacacctacgaatgttattgctcgcgccgggacatccaagaagcctcgcgggcaccccatgtggctccgggagtgtatccgggaacgtgtaggggattgaaggaggaggaacgcgtcgaaaagcgtgcaaccttggctgcgcaaaaccggcaccccgccatccgcctgcgcgcgcaggtaacctcgtttgattttcacgaccgacttcgcggcccacaaactggccccgtagacgatttcattctgctccgcggcgggcaggaacccggatgggcatacaacttagctgtcgtcgtcgacgatgcctaccaaggcgttgaccaggtagtccgcggcgacgacctactcgattccgccgcgcgccaagcctacctcggctcgctgctgggcacccccgcgcccgaatacattcacgtgccgctcgtgctcaacgcccacggccagcgcctcgccaaacgcgacggggcagtgacgcttaaagaaatgcttatcgacgcccccctccacaccattttctcccgcctcgcatcatcgctcggctacgaaggggtaaattccgcaccccaattgttggaaattttcgaccccacaaccctcagccgggagccgtttatttac

SEQ ID NO: 267 - DNA, 990 bp, Corynebacterium glutamicum
atggctgagcagttgcgtcaatttgaaggcagggtcctccctaatcaatccgaggacttggaagatcagggtttgggatttgacctgggaaccgttttctcccgcaggaaggttttgggattcatcggtgttggtggagcaggtgtggcacttgctgcttgttcaccttctggttcttccgcggcatcgagcacctcaagcgcgtccagcagcgcagctgcaaccaccagtgcagcagcagagactttgactgagatgaagtcggagactgctggtccgtacccgggcgatggttcgaatggtccggatgtgttggaggtctccggtgtggagcgccaggacatcaccaagtcgattgattctgacaccgtggcagagggcgtacctctgacgttgactatgaccattttggacatgaacaacaacaatcagccaatggagggtgctgcggtgtacgtgtggcactgtgatgcgccgggtcgatattcgatgtacgactctgagctggaagatgagacctatttacgcggtgtgcagattaccgataagtatggccaggtcacgttcgataccattttccctggttgttatgcgggccgttgggtgcatattcatttcgaggtgttcccggatcgagacagcatcacggattccacgaacaacattttgacgtcgcagattgccttggatgaagcatcagcagcatcggtgtatgcacttgatgtgtatggagattctttgaccaacctcaataacatcacgttggagtcggacaatgtcttctccgatggttgggatcagcagatggctaacctgaccggtgatgctaccagcggtttcattgcctcgattgatgtgccgattgatccaaccacggaacagaatcagtccatgaacatgccaagtggaggccagggaggccccggtggacaaggaggaccaggcggcatgactcctccagatggaatgacccctccctctgagcctcag

SEQ ID NO: 268 - DNA, 1110 bp, Corynebacterium glutamicum
ttgatcacagatctcaccacctgtgccaggctgagccataacaaggcattacggctgatcaagctgtcgaaatcaacggcgtattaccgcaacaagccgcgtccccgtcctgcaccgaaacctgtcctgcaggccgtgccagcaccaacagcacctggtgtggaacccacaccagagccttggcaggggaaggagccagcagtgtcgtcggtgcgtcaagcgttggcagaacacgaacgccagttcattgttgatgcgatcaccgcgtacccacaactgagcgttagtggggtgtttaacatgttgtttaacaaaggcatctaccgcgcatcactacgtacatggtggcgtgttgccaagcagcacaagttgttacacaaagaccgagtcagtgccctgtccccggggaaacgatcaccaacgccacgggttaagccgaggttggaagcaacacagcctggtcaggtggtgtgttgggatgtgacgttcttgccgtcgctggtacgtggtaagacctatgcgttgcatctggcgattgatttgttttcccgcaagattgttggggcgaaggtcgcgccgacggaaaatacctccaccgcggtggagttgttaacgcaggtgttagcggataatccgggtgtggtgacggtgcattcggataatgggtcggcgatgacatcgacgagggtgcggcggttgttagcggatcatggtgtggcgttgtcgttgattcggccgcgggtgagtgatgataatgcgtttgtggagtcggtgtttcatacgttgaagtatcggccgttttatccgaaggtgtttgcatcgatggatcaggcccgggtgtgggtggaggagtttgtggtgtattacaacacggttcatccgcattctggtgtggctgggcatactccgcagtcggtgtttgatggtagttggagggcggctcataggttgcgtgtgcaggcgttggatgcccattaccggcagttcccgcagcggtatgtggagcagccggtggttcaggaagttgctggtgtggtgcgtcttaatggtgcgcgtgatgatgggtctgtacaggagagggttggtggtgtagcgtcgctgttaagtgct

SEQ ID NO: 269 - DNA, 303 bp, Corynebacterium glutamicum
atggcctggtgcgccgctatgaccgacggggacttagacgctgatatctcaccccgccagatcgggttgatgaccacccgaaccgtggtcgaaatcgttcgactacgccacatgattgcccaacaactagaaagagccacgatcatggaaaacgagtacctcaaagaaatcgcagcgctgaagaaagaactcgcgcactacaagcaaaaagaccatcagaatcaaatggtgatcgatatcttgggaaaagctattgggaccaggcccaatcctggcgagggcttagacgaggaggacgccacc

SEQ ID NO: 270 - DNA, 138 bp, Corynebacterium glutamicum
gtgaaattcggcgttcattggtcacctggtttgggcttgcagggtattgcagggactcaccagagaaaagcacacattttgtcccttaaccaccaaagagaatccccaatacatgaaaaaaccagctccccaccgaag

SEQ ID NO: 271 - DNA, 1296 bp, Corynebacterium glutamicum
atgcggaggtacgcagttatgagttcagtttcgctgcaggattttgatgcagagcgaattggtttgttccacgaggacattaagcgcaagtttgatgagctcaagtcaaaaaatctgaagctggatcttactcgcggtaagccttcgtcggagcagttggatttcgctgatgagttgttggcgttgcctggtaagggtgatttcaaggctgcggatggtactgatgtccgtaactatggcgggctggatggcatcgttgatattcgccagatttgggcggatttgctgggtgttcctgtggagcaggtcttggcgggggatgcttcgagcttgaacatcatgtttgatgtgatcagctggtcgtacattttcggtaacaatgattcggttcagccttggtcgaaggaagaaaccgttaagtggatttgccctgttccgggctatgatcgccatttctccatcacggagcgtttcggctttgagatgatttctgtgccaatgaatgaagacggccctgatatggatgctgttgaggaattggtgaagaatccgcaggttaagggcatgtgggttgttccggtgttttctaacccgactggtttcacggtgacagaagacgtcgcaaagcgtctaagcgcaatggaaaccgcagctccggacttccgcgttgtgtgggataatgcctacgccgttcatacgctgaccgatgaattccctgaggttatcgatatcgtcgggcttggtgaggccgctggcaacccgaaccgtttctgggcgttcacttctacttcgaagatcactctcgcgggtgcgggcgtgtcgttcttcctcacctctgcggagaaccgcaagtggtacaccggccatgcgggtatccgtggcattggccctaacaaggtcaatcagttggctcatgcgcgttactttggcgatgctgagggagtgcgcgcggtgatgcgtaagcatgctgcgtcgttggctccgaagttcaacaaggttctggagattctggattctcgccttgctgagtacggtgtcgcgcagtggactgtccctgcgggcggttacttcatttcccttgatgtggttcctggtacggcgtctcgcgtggctgagttggctaaggaagccggcatcgcgttgacgggtgcgggttcttcttacccgctgcgtcaggatccggagaacaaaaatctccgtttggcaccgtcgctgcctccagttgaggaacttgaggttgccatggatggcgtggctacctgtgtgctgttggcagcagcggagcattacgctaac

SEQ ID NO: 272 - DNA, 630 bp, Corynebacterium glutamicum
gtgaatacagcggagacagcacattggattaaccgtctgcttcctgggacaccggaattccaccaggttggcgcgtttaaagtggcaggttacacgcttgaggatgaatcaattgcgtgttctgtcaatttcgggcgcgtcaacaccgggctggtcacggaaggcggcgcggaaacggtcgatgtgcgaagtgagattttgagcctggccagggccgacgtgtccgtgcctgggcgcgccgtcggcgctgctgcaacaatgcttctcgacgcctccctctccttcaaatccgccaccgattccagcgtcactcccatgcatgcccaaccgggacagatcttgccgtgcgtaggaattatggcgaatcttccccaagagggtttttctgtggtgcacggaattttggcggatccccgcatttggggcccggagattccgtatgttcgtgaagaagcaggtcaagtaaatgtggaagcacccgacgaggctggcgatctagcccgattgacgttgcctctgcagttgatcctgctcacggaggaagagtttgccatcgctctcaacgagggcagcgacgtcatgttcgaacgaatggcggagcaagaagtcgatcttctggatctgaaacgt

SEQ ID NO: 273 - DNA, 2325 bp, Corynebacterium glutamicum
gtggctttgtatagcaagtatcgaccggcaagttttggtgaactagttgggcagtcgcaagtgactgaccctctgtccgcagctttggatagcgggcgcatcaaccatgcgtaccttttttcgggtccgcgtggttgtggcaagacgtcgtcggcacgcatccttgcccggtccctcaactgcgtggaaggcccaacttccacgccgtgtggggtgtgtaattcttgcgtagcgctggccccgggtggccctggaacccttgatgtaacagagctcgacgccgcgagtaacaatggtgtcgatgacatgcgtgaactgcgcgaacgcgcgaactacgccccggcggaatctcgctaccgcgtgttcatcattgacgaagcccacatgatcagtacccaaggcttcaacgccttgctgaaaatcgttgaagagccaccagcgcacctgattttcatcttcgccaccaccgagccggacaaaatgatcggtacgatccgttcccgcacgcacaattacccattccgcctgctcaccccaggggatatgcgcaaagtgctgaaaaatgcggtcgatggcgaaggcgtccacgtcgacgattccgtttacccactggtcatccgcgccggcggcggcagcccccgcgacagcctctccatcctcgaccagctcatcgccggctcgggcccggagggcttgacatatgagcgcgccttgccgctgctcggtgtcacaagcttcacgcttatcgacgattcgatccatgcccttgcatctaaagacaacgcaagcatgttcaccacgatcgataacgtcatcgaagaaggcctcgaaccgcgacgcttcacgatcgacctcctcgaccgcctccgcgacttgatggtcctccaagccgtcccagaagcactaaacctcgggcttgtcgacgcccccaccgaccgcgccgacgccctaatcgaacaatccaccctgttcaaaggcaacgagctcgccaacctagcctccatggtgaactccggactcgacgacatgcgtggtgccacctcaccgcgcctccttctggaaatcctctgcgcccgactgctcctggcaagcaataccgtggcaggtccagcggtcagtagttcgactgacgctgcgcctgcagctactccgggtggtctcactggtattgctgctgcccgcgcgaaagcacgggagtatggacagaagaaggcagctccagctcctgcaccaactcctgcgcccgagccagtgcgcgaacagtctcttgcaccaacgcctgaaccaacgccagcggctgaacctacatctcagcccgcgccggaaccggaacccgccagggaaccagtggtggaagtgcgggaggcgagcgtcgaaaagcagcctgcaagcagtgatcccctcgaaaccattcgaagccgctggtcagagctgcgcaacatcgtggaaaaacaaagtgtgcgcacctcaatcatgctgaccgaagcgcgagttttgggactgcgaggcgataccctcgtgctcggtcacagcaccggggcgttggctgcgcgtttgaacgctgctgatcacaacggaattttggtcaaggtgttggctgaggaaactggtctgcagctcaaggtcgaatgcattgtgggcacgaacccagccgaagctggatttaccgcccagcctgctgtgcaaaagagcacgtggaaccccaactacgactccaaaccagccactccaagtgcgcctgcgcagcctcagacgcctaagcaagaatccgtgcccaccgagccagaggagcctgagagttcggctgaaacttcgggatgggggcaaccggtaaaaatcggtgggccagcacctgaggcacagactccaacgcctccgcctgctccggtggttccggctactcctgctgctccggctgcgggtgctgcgaaaccagcgtggaaggaacgcgtcgaacaagccgcggcaaatgcagcgcaacaacgtcagcatcgccagggcagctccgagcccttcgagcggggtgttccgctgccaccagaacctgacctgccaccggacccctatggatacccagctgacgagggtttccccgaacgaaaccaagggttccagcaacagccagcgcctcccgttgagcaaccagctcctgagcctgcgacggagccagttccagcagttgcgcctgagccggaggtcagccagctatctgaagaagagcagctgatccgcgaagcagacgaagagccaggtgaaatggatcgtcgtgatgcgaaaaccatcgcgatggaactgcttgctcaggaactcggcgcgaaacctttg

SEQ ID NO: 274 - DNA, 717 bp, Corynebacterium glutamicum
atggatcgaatcgtcgataagcgtgaagcttgtgacaccgagcagcggcaaggcgcgctcatatgtcaagccctccgggcccgagccggcgatgagctggtcgaggatggagaggctgtcgcgggggctgccgccgccggcgcggatgaccagtgggtaaacggaatcgtcgacgtggacgccttcgccatcgaccgcatttttcagcactttgcgcatatcccctggggtgagcaggcggaatgggtaattgtgcgtgcgggaacggatcgtaccgatcattttgtccggctcggtggtggcgaagatgaaaatcaggtgcgctggtggctcttcaacgattttcagcaaggcgttgaagccttgggtactgatcatgtgggcttcgtcaatgatgaacacgcggtagcgagattccgccggggcgtagttcgcgcgttcgcgcagttcacgcatgtcatcgacaccattgttactcgcggcgtcgagctctgttacatcaagggttccagggccacccggggccagcgctacgcaagaattacacaccccacacggcgtggaagttgggccttccacgcagttgagggaccgggcaaggatgcgtgccgacgacgtcttgccacaaccacgcggacccgaaaaaaggtacgcatggttgatgcgcccgctatccaaagctgcggacagagggtcagtcacttgcgactgcccaac

SEQ ID NO: 275 - DNA, 309 bp, Corynebacterium glutamicum
atgacccagccagatatgtcccagatcctcgcccaagctcagcagatgcaggctcaactacaggccgctcagcaggaaatcctggcaaccaccgttgtcggaaatgcaggaaacgggctggttaccgtcactatggccggcaacggcgaggtctccgcagtgaccgttgacccaaaggtcgttgaccctgaagatgtcgaaaccctacaggaccttctgctcggtgcattcaaggatgcccataacaaggtcgcaaacgttgctgaagagaagatgggcccactatcccagggcatgggtggcctcttc

SEQ ID NO: 276 - DNA, 654 bp, Corynebacterium glutamicum
gtgtttgaaggcccactccaggatctcatcgacgaactttctcgtctccccggcgtcggccccaaaagtgcccaacgcatcgcatttcacctgctcaacgtagatccttccgacattacccgccttcaggaagccctcggaggcgtgcgtgatggcgtccaattctgccgcatctgctgcaacatttcccgcgaagaagtctgtcgcatctgctccgactccggacgtgacggcggaacaatctgtgtcgtcgaagaaccaaaagacatccaagttatcgagcgcaccggcgaattctccggccgctaccacgtcctcggcggcgccctcgacccgctggccaacatcggcccccgcgaactcaacatttccacgctcctgcagcgcatcggcggcgtcctgccagaccgtgagctcgcagattccacgcctgaaaataagcttttcgacgccacccccaccgtccgcgaagtcatcctcgcaacagaccccaacaccgaaggcgaagccaccgcctcatacctcggccgcctcttgaaagacttcccagatctggtaatttcccgcctcgcatccggaatgccactaggcggcgacctcgaattcgtcgacgaactcactctctcccgagcattgagtggccgcctgcagatc

SEQ ID NO: 277 - DNA, 750 bp, Corynebacterium glutamicum
atgaccaccctcaacatcggcctcatcctccccgacgtcctcggaacttacggcgacgacggcaacgcactagtcctgcgccaacgcgcacgcatgcgtggcattaatgctgaaatccagcgcgtcaccctcgacgacgccgtcccttccacccttgatctctactgcctcggcggcggcgaggacaccgcacagatccttgccaccgaacacctcaccaaagacggcggcctccaaaccgcagccgccgcaggccgccccatcttcgcagtctgcgcaggtctccaggtactcggcgactccttccgcgccgccggccgtgtcatcgacggccttgggcttatcgacgccaccaccgtctctttacaaaaacgcgccatcggagaagtcgaaacgacaccaacccgcgccggattcaccgccgagctgaccgaacgactcaccggcttcgaaaaccacatgggcgccaccctgctcggccccgacgccgaaccactcggccgagtcgtccgcggcgaaggcaacaccgatgtctgggcagcctccgaaaacaccgacgaccaacgccaacaattcgccgaaggcgccgtccaaggcagcatcatcgccacctacatgcacggccccgcactcgcccgaaacccccaactcgccgacctcatgctcgcaaaagcaatgggtgtcgcgctgaaagacctggagcctttggacatcgacgtcatcgaccgcctccgcgccgaacgcctggcg

SEQ ID NO: 278 - DNA, 1269 bp, Corynebacterium glutamicum
atgaagctttcactgcctgcacccctacgccgtttacgcagcgctgccgccatcatctcagcaaaagttgcgacatccgcgtccaaagccacaggtcgcggatccggtggcatgatcggcggactggtggccagcaaggtagacccggacatcatgtccaacctcatcaacaaccgcccaacagtgctggtcacgggcacaaatggcaagtccaccaccacccgcatgctggccgccgcgatgcgcagcacttacaccgtcgccaccaatgaaggcggcgacaacatggacgccggcatcatttctgcgctgctcgctggccgaaacgcctcacacgtggtcttggaagtcgatgagctgcacgtacccgccgccatcgaacgcctcaagcccgacgccctcgtgctgctcaacctttcccgcgaccagctcgaccgcgttggcgaaattaacaaaatcgaacgtgtcctgcgcgatgccgtgcgctctcgacctgagatgaccgtcatcgccaactgcgacgacgtcctcgttacctccgtggctttcgacgccgaaaacgtcatctgggtcggcgccggcaccggctggcaaggtgaatccgccacctgcccacgcaccgaatcccgcatcctccacgacggacgccactggagcgccgaaaagacgcttctcgacggccgcaccttcgcacgccccaccccctcatgggaggttgacggtgataccatccattcaccatccggcgatctcaccttggatctcaacctcccaggtcaggccaaccgtggcaacgcggcacaagcaatcgcagcctccaccgtatttaatgtgcccgtttcctccgcactgcccgcagtcaactccgtcaacaacgttgctggacgctattccaccatcactgtcggtgaacacaaggtccacctcctgctcgccaaaaacccagcaggctggcaagaagccctctccatggttgatcgcacagctgatggcttagtcatcgtcgtcaatggccaggttgccgacggcgaagacctctcctggctttgggacgtccgcttcgaagacttcgaaaacctctccgtcaaagcctccggcgagcgcggcaccgacctggcagtccgcctcacctacgccgaaatcgaccacgaactcatctccaaccccgtcgacgccatcgcagcctgccctcctggccgcatcgaagtcctcgccaactacaccgcattccgagacctcaaaaaggctctggagaaagggaccgaacaa

SEQ ID NO: 279 - DNA, 1080 bp, Corynebacterium glutamicum
atgagcaccacttcggaatcacaagatcacgccgcaagaatcgaagctgagcgccaagaagctattgaggcggctccttttgtttccgtcagcattcaatcaagtggaatccacccatcgacttcacgcatggtcaccattgatttggtaacgctgtcccctaatttggagccggtggaaacttttcatgccgtgttggattccaaaactgatcctggccccttccaccttcatggcgtgacagaggaagaatttgccagcgctaagcgtttcggccagattttgaaaagcttggaccgcctcatcgatggtcgtaccctgttgatccacaatgctgcgcgaagttggggctttattgtttccgaagccaagcgcgctatgaatgatgctgcgcgcgccaatcgcaacagcaatcgtggaaatcgccgtggtggtcgcggacgccgcaggcagcgcgtggggcacatcccaaagccgctggtgatcgtcgatacgcttgcatcggcgcgtcgacaagcaatcgctttagacgacgtgcgcatccggggtgtcgcacacaccctcggccttgacgcgcctgcagcggaggcgtcggtggaacgcgcgcaggtgtcgcaccgccagttgtgccgcgaagaaactttgcttgtggcacggctttatggtgcgttgaagcagtcaggaccgctggcggaaatcgatccccagtccttgcgcgccgataagtttggtttgcaacgctcgatcatccgggtgcaggcgcaggaagcttcgccaacgctggtcaaccctggtacgtatgagccgggaaagacgctgatcgctgggatggaagttgtggtcgcgccggaaattgagatggatccggacatcattatccaagcgtgcgtcgatgcagatttgtcctattctgagaagctcacccggcaaacctcagtggtggtgtgcaatcaaacccgcgacattgacggcaaagcgatgcatgcccagcgtaaaggaattccgctgctgtccgatgttgccttcttagcagctgttaaaagggtaaaagaagggaagaaagtggacgtcgaaaagcgc

SEQ ID NO: 280 - DNA, 867 bp, Corynebacterium glutamicum
gtgcaaagcaatctgctcgccgtgcttttcgccctagcatcggcattaacaatcgcatggggcaccgtggtcagacaccggatcgcgctccgcaccccaaaagatggctccctaaggagctcacctttactcaatgctctgatgacaccgatgtggtgggcaggcatgagtaccgcgatgctggcatatttcttacaaacagtagcacttggtttcggcaccctcttggtagtgcaaccagtgcttgtcctgtcgctgatgttcacgctgccgctctcagcacgattcaatggctaccgactacgccgaactgaaatcttctgggctaccctcctcaccgtagccgtgggcatcatgatcgttttgggacgcccccttcccggaaacccccaccccccactcgatcgatggattccagtacttttagtcggcgttgcagtaatgggtggaatgtggctgcttgcggaatacgtattaaagaaggacaaagccctcatccttggtcttgtgacgggtgcattgtttggctacgtagcagtgatgtccaaagccgcggtggatctttttgtccatcaaggcataacgggactcatcttgaactgggaaggctacggcctaatcctcaccgcattacttggaacaatcgtgcagcagtattcctttaacgctggcgaactacaaaaatcgctacccgccatgaccattgccgaaccaattgttgccttcagtttgggctacttggttctgggcgaaaaattccaagtcgtggactgggaatggatcgccatgggcatcgcactactggtgatgattgtttccaccattgcactgtctcgtacaagcacaatgccggccggatcgaaaagg

SEQ ID NO: 281 - DNA, 1263 bp, Corynebacterium glutamicum
gtggccctggtcgtacagaaatatggcggttcctcgcttgagagtgcggaacgcattagaaacgtcgctgaacggatcgttgccaccaagaaggctggaaatgatgtcgtggttgtctgctccgcaatgggagacaccacggatgaacttctagaacttgcagcggcagtgaatcccgttccgccagctcgtgaaatggatatgctcctgactgctggtgagcgtatttctaacgctctcgtcgccatggctattgagtcccttggcgcagaagcccaatctttcacgggctctcaggctggtgtgctcaccaccgagcgccacggaaacgcacgcattgttgatgtcactccaggtcgtgtgcgtgaagcactcgatgagggcaagatctgcattgttgctggtttccagggtgttaataaagaaacccgcgatgtcaccacgttgggtcgtggtggttctgacaccactgcagttgcgttggcagctgctttgaacgctgatgtgtgtgagatttactcggacgttgacggtgtgtataccgctgacccgcgcatcgttcctaatgcacagaagctggaaaagctcagcttcgaagaaatgctggaacttgctgctgttggctccaagattttggtgctgcgcagtgttgaatacgctcgtgcattcaatgtgccacttcgcgtacgctcgtcttatagtaatgatcccggcactttgattgccggctctatggaggatattcctgtggaagaagcagtccttaccggtgtcgcaaccgacaagtccgaagccaaagtaaccgttctgggtatttccgataagccaggcgaggctgcgaaggttttccgtgcgttggctgatgcagaaatcaacattgacatggttctgcagaacgtctcttctgtagaagacggcaccaccgacatcaccttcacctgccctcgttccgacggccgccgcgcgatggagatcttgaagaagcttcaggttcagggcaactggaccaatgtgctttacgacgaccaggtcggcaaagtctccctcgtgggtgctggcatgaagtctcacccaggtgttaccgcagagttcatggaagctctgcgcgatgtcaacgtgaacatcgaattgatttccacctctgagattcgtatttccgtgctgatccgtgaagatgatctggatgctgctgcacgtgcattgcatgagcagttccagctgggcggcgaagacgaagccgtcgtttatgcaggcaccggacgc

SEQ ID NO: 282 - DNA, 1053 bp, Corynebacterium glutamicum
atgcaatgcacgtgcagcagcatccagatcatcttcacggatcagcacggaaatacgaatctcagaggtggaaatcaattcgatgttcacgttgacatcgcgcagagcttccatgaactctgcggtaacacctgggtgagacttcatgccagcacccacgagggagactttgccgacctggtcgtcgtaaagcacattggtccagttgccctgaacctgaagcttcttcaagatctccatcgcgcggcggccgtcggaacgagggcaggtgaaggtgatgtcggtggtgccgtcttctacagaagagacgttctgcagaaccatgtcaatgttgatttctgcatcagccaacgcacggaaaaccttcgcagcctcgcctggcttatcggaaatacccagaacggttactttggcttcggacttgtcggttgcgacaccggtaaggactgcttcttccacaggaatatcctccatagagccggcaatcaaagtgccgggatcattactataagacgagcgtacgcgaagtggcacattgaatgcacgagcgtattcaacactgcgcagcaccaaaatcttggagccaacagcagcaagttccagcatttcttcgaagctgagcttttccagcttctgtgcattaggaacgatgcgcgggtcagcggtatacacaccgtcaacgtccgagtaaatctcacacacatcagcgttcaaagcagctgccaacgcaactgcagtggtgtcagaaccaccacgacccaacgtggtgacatcgcgggtttctttattaacaccctggaaaccagcaacaatgcagatcttgccctcatcgagtgcttcacgcacacgacctggagtgacatcaacaatgcgtgcgtttccgtggcgctcggtggtgagcacaccagcctgagagcccgtgaaagattgggcttctgcgccaagggactcaatagccatggcgacgagagcgttagaaatacgctcaccagcagtcaggagcatatccatttcacgagctggcggaacgggattcactgccgctgcaagttc

SEQ ID NO: 283 - DNA, 1434 bp, Corynebacterium glutamicum
atgggggtcgagcttgtgaagtggaattttccacaagttttaagtttctttagcaggggaaacactgctgatagcactagcgataaagaacatgaaaatgcaacggagctagcggccgaagctttagcggatgtcatttttcagtggaaaaactgggtctaccgacgcgttgatagtgtgcatccatccgaaggagctcgagggagactcagacactccatggattgcgaacctccacctgacccacggcttgcgtacaacgaagttgaacgccgttataacgatattaatgacgtaaagggacaactaatggtcccgctagcgttcattgaaaaaggcccgatgcgtcatcttgatgtctggagaaatgatgggacgagcattcctgtccttggttcggaagaaactggtgaactaatggtggctgtcctcatgctgtttttgaagaaaaatggcatcgagcgaacatctgaacttgaagatgcgatgcgtgcccttgtgatatcaagagaaaagggaaacctagcaaaagcaacgaacctaattgaaagtggggtgtgggagggcaaaacattatgggatagtaatgatcctgcagtgagatttgatgtgggaacaaaagacttgcttttgaatctatctactgattttttgttgatcggtttgttgcccgcggaaacttctggaatcaggcaagttttaaaattttcatatcactgggtggttgaattacctgacagagggcttcttagatcattgtggggtagcgtgtgtgtcgcatttcgagcagctccaatggaaattgaattaccaacacatatgcccacggatgcgaaatcgtaccatcttgaattccacacaccgcctgagttagatactcaagagttatcgcttccagttgattccaagaataagggccatcgggtcggctatccaactgactctagtaggacacctatcgcccatgtgcactcgcatttttccgagataatgaccacaaatgcaaaagtaaaattggaggttcccaaaaggggaatttgggttactgcacttttatcgaatgcactaacagccggaatttttatcctagccttgttgctacccaatgcaactgatgctttgcgtagtgttggaggaaatgcagcggccttgatgcttgcagcgccggcagtatttgtaagctttctcatctttcctaaagaacatatttttgtatcttccatgcttaatccgcttcgtatcgtcgtaggaatatgcgcactactgctctttatgatggcaggaagtcttgtgggtgggttggagcgaccatttcttattcttctgtggtcatttggagctgggttttcattgctagttgttagcgcactagtactaggtccactcctaggaaagttttttgagaggttgcacctgcgccctagtactaagaac

SEQ ID NO: 284 - DNA, 579 bp, Corynebacterium glutamicum
gtgaagtcaaaagagcgtaacgacgcccacgtcaccgagctggccctagccgccggccgtggcgaccgcgcagctctcaccgatttcatccgggaaacccaagacgatgtctggcgtctcctcgcccaccttggcggccacgaaatcgccgacgatctaacccaagaaacttatctgcgggtcatgagcgccctcccccgcttcgcagcgcgctcctcggcgcgcacctggctactatcgctagcccggcgcgtctgggtcgacaacatccgacacgacatggcacgcccccgcaaatccatcgtcgaatacgaagacaccggtgccaccgacgcgagcaacgcaggcatctggtccgagtggatcgacgtgcgcacgcttatcgacgccctcccacccgaacgccgcgaagccctcatcctcacccaagtgttgggctacacctacgaagaagccgcaaaaatcgccgacgtccgagtcggaacaatccgttcccgcgtagcccgcgccagagcggacctcattgctgcaacagctaccggtgattcctcagccgaagatggcaaatccgcccaaggt

SEQ ID NO: 285 - DNA, 1506 bp, Corynebacterium glutamicum
atgcgtccaaagctttctggaaacactacccgccacaacggagcaccagttccatctgagaacatctccgcaaccgcaggcccacagggtccaaacgttctcaatgacattcacctcattgaaaagctcgcacactttaaccgcgagaacgttccagagcgtatccctcacgcaaagggccacggcgctttcggtgagctgcacatcaccgaggacgtatccgaatacaccaaggcagacctgttccagcctggtaaggtcaccccgctggctgttcgcttctctactgttgctggtgagcagggctccccagatacctggcgcgacgtccacggcttcgctcttcgcttctacaccgaagagggcaactacgacatcgtgggtaacaacaccccaaccttcttccttcgtgacggcatgaagttcccggacttcatccactcacagaagcgtctcaacaagaacggtctgcgcgatgcagacatgcagtgggatttctggacccgcgcacctgaatctgcacaccaggtgacctacctgatgggtgaccgcggtacccctaagacctcccgccaccaggacggcttcggctcccacaccttccagtggattaacgctgaaggtaagccagtttgggttaagtaccacttcaagacccgccagggctgggattgcttcaccgatgcagaagcagcaaaggttgcaggcgagaacgctgactaccagcgcgaagacctctacaacgctattgaaaacggcgacttcccaatctgggacgtcaaggttcagatcatgcctttcgaggatgcagagaactaccgctggaacccattcgacctgaccaagacctggtcccagaaggattacccactgatcccagtcggttacttcatcctgaaccgcaacccacgcaacttcttcgctcagatcgagcagcttgcactggatccaggcaacatcgttcctggcgtcggcctgtccccagaccgcatgctccaggcacgtatcttcgcatacgctgaccagcagcgttaccgcatcggcgctaactaccgcgacctgccagtgaaccgtccaatcaacgaggtcaacacctacagccgcgaaggttccatgcagtacatcttcgacgctgagggcgagccttcctacagccctaaccgctacgacaagggcgcaggctacctggataacggtacggattcctcctccaaccacacctcctacggccaggctgatgacatctacgtcaacccagacccacacggcaccgacctggttcgtgctgcttacgtcaagcaccaggatgatgacgacttcatccagccaggcatcctataccgcgaggtcctggatgagggcgagaaggagcgattggcagacaacatctccaacgcaatgcagggcatctctgaggcaaccgagccacgcgtctacgactactggaacaacgttgatgagaacctcggcgctcgcgtcaaggagctttacctccagaagaaggct

SEQ ID NO: 286 - DNA, 342 bp, Corynebacterium glutamicum
atgagggcctatccaccaatggtggataggccctcattcgactttgaagctattgagaggaaattagctagacagcagatccgcaattcccaaggtcactgcagtggaaccaatggcggtcgagccgagtccaacggcaaagaaaccagcggtgctctgaattgctccttcaacctgcgcagcctgagcagcaggcaggaagctcaacagatcggtggcttcttgtggaagctggatcccagagctgaggttggaggaaccagcagtcgagccagcttcctgtgcgctagcgactccagtgccaccagccagggcggcggtagcgattgcaattgctgcgat

SEQ ID NO: 287 - DNA, 291 bp, Corynebacterium glutamicum
atgcgtatgaaatcaatcgcagcaattgcaatcgctaccgccgccctggctggtggcactggagtcgctagcgcacaggaagctggctcgactgctggttcctccaacctcagctctgggatccagcttccacaagaagccaccgatctgttgagcttcctgcctgctgctcaggctgcgcaggttgaaggagcaattcagagcaccgctggtttctttgccgttggactcggctcgaccgccattggttccactgcagtgaccttgggaattgcggatctgctgtctagc

SEQ ID NO: 288 - DNA, 462 bp, Corynebacterium glutamicum
gtgcaatatatgaagctagattccattgatcgcgcaattattgcggagcttagcgcgaatgcgcgcatctcaaatctcgcactggctgacaaggtgcatctcactccgggaccttgcttgaggagggtgcagcgtttggaagccgaaggaatcattttgggctacagcgcggacattcaccctgcggtgatgaatcgtggatttgaggtgaccgtggatgtcactctcagcaacttcgaccgctccactgtagacaattttgaaagctccgttgcgcagcatgatgaagtactggagttgcacaggctttttggttcgccagattattttgtccgcatcggcgttgctgatttggaggcgtatgagcaatttttatccagtcacattcaaaccgtgccaggaattgcaaagatctcatcacgttttgctatgaaagtggtgaaaccagctcgcccccaggtg

SEQ ID NO: 289 - DNA, 753 bp, Corynebacterium glutamicum
gtgcaaaaaacgcaagagattcattcaagcctggaggtgtcgccatccaaggcagccctggaaccagatgataaaggttatcggcgctacgaaatcgcgcaaggtctaaaaacctcccttgctgcaggtttgggcatgtacccgattggtattgcgtttggtctcttggttattcaatacggctacgaatggtgggcagccccactgttttccggcctgattttcgcgggctccaccgaaatgctggtcatcgccctcgttgtgggcgcagcgcccctgggcgccatcgcgctcaccacattgctggtgaacttccgccacgtattctatgcgttttcattcccgctgcatgtggtcaaaaaccccattgcccgtttctattcggttttcgcgcttatcgacgaagcctacgcagtcactgcggccaggcccgcaggctggtcggcgtggcgacttatctcaatgcaaatagcgtttcactcctactgggtattcggcggtctcaccggagtggcgatcgcagagttgattccttttgaaattaagggcctcgagttcgccctttgctctctctttgtcacgctgactttggattcctgccgaacgaaaaagcagatcccttctctgctgctcgcaggtttgagcttcaccattgctcttgtggtaattccaggtcaggccctatttgcggcgctgctgatcttcttgggtctgttgaccatccggtacttcttcttgggaaaggctgctaaa

SEQ ID NO: 290 - DNA, 324 bp, Corynebacterium glutamicum
atgacaactgatttctcctgtattctccttgttgtcgcagtatgtgcagtcattacttttgcgctccgggcggttccgttcttaatccttaagcccctacgtgaatcacaatttgtgggcaaaatggcgatgtggatgccagcaggaatccttgccattttgaccgcatcaacgtttcgcagcaatgcgatagatctgaagactctaacctttggtctcattgccgttgcgattacagtggtggcgcatcttcttggcggtcgacgcaccttgttgagcgttggcgctggcaccatcgtttttgttggactggtgaatcttttc

SEQ ID NO: 291 - DNA, 315 bp, Corynebacterium glutamicum
atgcaatattttttaggagtcccaatgcgtttcaagtcagttgcagctatcgcactttccaccgcaatgatcaggggtggaaccgcaagcgttgctaatgctcagcaggttagccctagttccacgattgagatccctcaagaattcgtccacaccgtgcagaacttcgtgccaggtatgacttacggcgatgcagggtccgctatccagagcaccgctggttctgtggcactgaacagtaccgctggaatcatccttccaatcgttcttccattccttggtctgggagctgttggttctgcagcgctgtctgct

SEQ ID NO: 292 - DNA, 345 bp, Corynebacterium glutamicum
atgaccgcacccatccacctaccgctcattaactccgcagagtgttgctcactggcagcagaaccactcagcgtggacgatgccgaacgctacgccgagattttcaaagtgctcggtgagccagttcgtttaagaatcctgtcccatcttgcagcagaaggttgcacccccactacggtcaacgaactcaccgaaatcatgggattaagtcaacccaccatctcccaccacctaaaaaagatgactgacgctggtctattggtaagaatccccgaaggacgaaccgtctttcatcaggtccagccagaaacgttcaccaacctgcgcacaatcctgcaaatcgga

SEQ ID NO: 293 - DNA, 1080 bp, Corynebacterium glutamicum
atgacccttactaaagagcattcgacacctcgagcggctggctcaatgtcgtttcttgaccgctggttagctgcctggattttcttggctatggctgctgggttgttaatcggcaaggtctttccaggaattggggcgcttttgagcgcggtggaaattggtggaatttccattccaattgctatcggtttgatcgtcatgatgtatccacctttggccaaggtgcgctacgacaaaactaaagaaatcagcacagaccgcgctctcatggtggtgtcgattatgttgaactggatcgttggaccagcacttatgtttagcctggcgtggctgtttcttccagatcaaccagagcttcgcactgggctaattatcgtgggccttgcgcgctgtatcgcgatggttttggtatggagtgatctcgcttgtggtgaccgggaagcaactgctgtgctggttgcaatcaactcggtgttccagatccttatgttcggtgtgcttggttggttttacctgcagattcttccctcgtggctgggattagacaccacgtcggtgactttctctgtggtatcaatcgtgacttccgttctcgtgttcttgggcataccacttgtagctggagttttatctcgcgtcattggtgaaaaaacaaagggacggcgctggtacgaggacacgttcctgcctaagatttcacccttggcgctgattggcttgctatacacaattgttctgctgttttcgttgcagggggatgaaatcacagcgcagccttggacagtagctcgtcttgcattgccgctgctgatgtactttgtgggcatgtttttcatttccctggtggtatccaaactgtccgggttaacttatgagcgagctgcttccgtgtcttttactgcagcaggaaacaactttgaattagcgattgcggtatcgatcggaacctttggtgcgacatcaccgcaggcattagctggaacgatcggccctttgattgaagtcccagtattagtcggattggtttatgtcatgttgtggcttggaccaaaaatctttaaaaaggagaatgcaggatca

SEQ ID NO: 294 - DNA, 387 bp, Corynebacterium glutamicum
atgaaatcagttttgtttgtgtgcgtcggtaatggcggaaaatcacagatggcggcggcgctggcacagaagtatgcatcagattcagtagagatccattctgctggaaccaagcctgcacaggggctaaaccaattgtctgtggaatccatcgctgaggtgggcgctgatatgtcgcaaggaattcccaaagcgatcgatccggagctgctgcgcactgtcgatcgtgtggttattttgggcgatgacgcacaggtagatatgcctgaatctgcacagggcgctcttgagcgttggtcaattgaggaaccggatgctcaaggtatggaacgtatgcgtattgtgcgggatcagatcgataaccgagtccaagctttgctagcggga

SEQ ID NO: 295 - DNA, 318 bp, Corynebacterium glutamicum
atgaccattccagagatcatcgtctccatcctcgtgatcctcgcaggcctgttttctctaggtactgcaatcgctttgtggcgcgcaccggatccgctcacccgagccaacctgcttggcaccaccgtgggtgtctccataccgctgctcatcattgcgctgctgattcacacctggtccgtcgacggatttaaccccaacaatttcatccgagcgatcatcgccatcatcggcgtctgggtcatcggttccgttggttcctactacatgggacgcgccatctatggtgtgaccgtagtggataacagacgatccaaa

SEQ ID NO: 296 - DNA, 270 bp, Corynebacterium glutamicum
atgactgcttttggaattgtcaccacagttggcatctgcatgtttgcgttctccctcttatctgccctggtccttattctgcgcaccaaagatttcctcacccgcgtggtgctttccgacatggttttctactctatgatcgcgatctacctcatctgggtgctcaacaacccaacctcaatcgcctttgagattgctcttctcgcagcagtcctcggcggcgtacttccaaccctgtccatggctcgcatcatttcgaagggacgcagg

SEQ ID NO: 297 - DNA, 453 bp, Corynebacterium glutamicum
atgcttaacgccctgaaattcatcccatggctgatcggccagattttcctctctggcttcagcgtgatcaccgctgcggtaaaaaaggacaccggcttcaaccccgttgttatccgctacccacttcgagtgaccacggacttccagatcgcagccctgtcaacgtgcatcaccgcgactccttccaccctgtcccttggcctacgcgaaccccgcaagcccggcgaccccaccattttgctgatccaagcagtgtttggttccgatccagtagaagtttttgaatccatcgccgatatggaacaacgcctcgtcccttcggtcgcttcaattgaccacggcgtcccaggccaaggcccttacaaggagatccgccccagcgatgctgagtggccaagtcgcgagatcgctgacaccgcccaaaacaccgtcagccaagacaagagggagttt

SEQ ID NO: 298 - DNA, 1530 bp, Corynebacterium glutamicum
atggccatggatgttctccttcctattttcgttgcagttccccttgctgcctctgccattgcggtgcttctgccgtggcgtctcatccgcgatattttgcacatcatcgtgcctttcgcgggtatttttgctggcatctggttgtttgcacacaccgctgaacacggcccgattgctcacaacgtgggcctttatgtcggtggcgtggcaatcccctttgctgccgatacgttcagcgccatcatgttgatcaccacctcgatcgttgcggtggctgccaactggtttgccaccatcgtcggtgaaacccgcgcgcgtttctatccagcgctcacattgatgctgatcacgggcgtcaacggtgctctgctgactgccgatctgttcaacttctttgtgttcatcgaagtgatgctgctgccttcctatggtttgatcgccatgaccggaacgtgggcgcgcctagcctctggacgaatcttcgtactagtcaatctctctgcctccacattgctggttgcaggtgtgggaatcgtctacggtgtcataggctcagtcaacatcgcagctctgcaagatgtcgtagagggcaaccccctggttgccagcgcaatgggcatcgtggttattgccatcgcggttaaagccggtgtattcccagtgcacacatggctgccacgcacctatcctggtacatcagcagctgtgatggggttgttctccggtttgcacaccaaagtcgcggtatacatgctctatcgcatttgggtccacatttttgacatggatcccacgtggaattggctgattgtcgcattcatggtgatatccatgctggtcggtggcttcgctggacttgctgaaaactccatccgtcgcgtccttgcctaccaaatggtcaacggcatgccatttattctcatcatgatggcgtttacctctgacgatccacagcgcgcacttgccgctggtctgttgtacaccctgcaccacatgatcaccatcgccgcattggtgctcacttccggcgcaatcgaagaaacctacggcaccggtatgttgtccaagctgtctggccttgcacgccgcgaacccgtcgtcgcagcagtgttcgctgcaggtgccttctctgttgtcggtttcccaccgttttccggtatgtggggcaaagcgctcatcctgctcgagatcgcccgcgtcggcaatattgcagcatggatcgcaatcgccgccatcatcatcgccagcctcggcgcactgctctcgatgatccgcgtgtggcgtgaagtcttctggggtggcgcaatgcaccagcgcggcgtctcgccgcagctgcgcatcagcccagcaaaaatcgccccagcgctcagcctgatcattttatcggtaggcatgttcatcttcgcgggcccgcttatcgacgcgaccctcaccgccaccgacggcctcttgaacaccgatgcataccaacaggctgtgctcggtgaaaatgccatcggagtgccaagccctagctaccagggaggaaac

SEQ ID NO: 299 - DNA, 381 bp, Corynebacterium glutamicum
atgattctcgcactgacagtcgcgatacttttcggtggaggtgtctacctcattcagcaacgcggaatggtgcgcatcgtcttcggcatgtcactgatcggccacgcagcgaacctgaccatcctgtacgccggtgtgcccacgtggcgcggcgaagccttccccgacaggaccccgcttaccgacgccgccgatccactcccccaggccttcgtcctcaccgccatcgtcatcgcgatggccaccacaaccatcatgttggccttggcagcactgggacgcagcgacgacacccggtccatcgaaccagatgacgatcaatcgcctttgactactagcgctcgttcagtcaccaacccaacagatcaggaggataaagct

SEQ ID NO: 300 - DNA, 2886 bp, Corynebacterium glutamicum
ttgctatttgttgtggcgcttgctgtgatctcagtatttttggcgccaatttcggtcaaggtgattgatcgaaaagctggatggcctttggctgtaatctttgcagtcgccgcatattttttggtgcgtgaggctggtccaattttggatggtcaggcgctgacctgggatatcacgtgggtgagggatattctcggctcgggtgtcgacgtcaagtttgccttgcgcgctgatgcgttgagtttgttctttgcactgttggcgctggttatcggcgctgtggtgtttgtgtattcggcggaatatttgccgcggaagaagggcaacacgagtttttacaccatcatgacggcgtttaccgctgccattttgctgctcgtgcttgccgatgatgtctttgtgttgttcgtcggctgggaactggtctcgcttgcgtcattcatgttgattgcgcgttcgggttcttctggtgaatctggttcgatccgcacgttgattttgacgtttttcggcggcctcacgctgcttactgcggtggcgattgctgcgacccaagctggcaccaccagcctcgatggtattttgcactctgatttctgggcggagaagccagtgctcacgggtgttattgcggtgctgattgcaatgtccgcgttcactaagtccgcacagttcccgttccacttctggctgcctgaggcgatggctgcggccaccccagtgtcggcgttcctgcacgctgcggccgtggtcaaggcgggtatttacctgttgctgcgctttagcattgtgttccatgatgttgcggtctggaattggttgctgattatcgtcggcatgggtacggccatcatgtcggcgtatttcgcggtgcagaagaccgatctgaagaagctcacggcatattccacggtgtcgcatttgggttggatcgtagcgaccatcggcgtgggcactcctttcgcgctcggcgctgccattgtgcacacgctcagccacgcgctgtttaagtcctcgttgttcatgctcattggcgtgattgatcaccagactggcacgcgcgatattcgtcgcctcggtttcctggtcaagaagatgccgttcacgtttgtgtctgtattaataggtgcgttgtcgatggcatcggttccgccgttgctcggcttcgtgtccaaagaaggcatgatcacagcgttcatggacgcccccatcggcaactcctatgttgtattactgctggtcggcgcagcaatcggcgcggtcctaaccttcacatactccgcgaaactcgtgctcggcgcattcgtcgacggcccacgcgacatgtcacacgtcaaggaagcccccgtctccctctggcttccggccgccctgcctggacttatgtctctgccactagtcctagtactttcgcttttcgacgcccccgtctccgccgcagccacctccgccgcgggggaagcggcgcacatgcacctggcattgtggcacggcatcaacaccccactgttgatttccttgggtgtgctggtggccggaatccttggtgtgctgttccgcaaagagctgtggaaaatcgccgagaccagccctttccccatcgccacaggcaacgacatcctatcgatgctggtttaccgagccaacttgctgggtaaattcttcggtcgcatggctgattcgatgagcccacgcaggcacttggtcagcctcatcgtgctgctctgggcgctggctgcttttgccaccattcacccctcggttcagcttgcaccaaagcaaccgggaattgatcgttggatcgacctcattccgcttgccatcatcgcgctatctgtcttcggcctgctcaccacccgaaaccgcctcagcgcagccgtgcttgtgggtaccgttggtgtgggtgtttccttccagatgctacttctgggcgctcccgatgttgcacttacccagttcctggtagaaggcctcgtcgtggtaatcatcatgatggttgtccggcaccagcctgccaacttcaagcgcatcaagcccagcagaaggcgcagcaccgttcttgtcgccgtccttgctgccttcgccgcattcatggcggtgtggggattgcttggccgtcacgaacgttctgagctggccatgtggtacctcaaccaaggtccagagatcacctctggcgccaacgtggtgaacaccatcctcgtggaattccgtgcactggatacgttgggcgagctctccgtgcttggcatggcagctgtcgtcatcggtgcgatggtggcttccatgcctcgtcatccgtttgccaagggcacccaccctcgcccctttggccaatcacagttgaactccattccgctgcgcatgctgcttaaggtgctggttccagcgctatgcttcttgagcttcatggtgttcatgcgtggacacaatgatccgggaggcggtttcatcgcagccctaattgccggtggcgcgctgatgctcctgtacctgtccaaggccaaagatggccgcattttccgcccgaatgttcctttcattctcactggtgcgggcatcttgatggcagtgttctcgggcgtactgggactcacccacggttctttcctgtacgccatccacttcaacttcgtaggccagcactggaccacctcgatgatcttcgacctcggcgtgtacctggccgtgttgggcatggtgtccatggcaatcaacggcctgggcggatacctgcgcccaggtaccgacattgcagatctggactacgcccgccgaagtggcccactgccagcaacgccaacggttgaacccgaaccagaaggcgatgaagactggcccgaacccatcaaccccgcaggcgataacaaagaggaggcaaaccga

SEQ ID NO: 301 - DNA, 1485 bp, Corynebacterium glutamicum
ttgcacactatgtctgccgctgcttctcgatcaagaaacatcttgactgccctcctgctattggtcccgctcatcgcaggtaccatctacgcctccgccatgggcttggacgtctcccgcgcatggtcctcagcagatgaagtaacgggggcacctgcagcctccgtagccaccaacaaccaggagcttatcgaagcccgtcgcgccgccggagaagccggcgcccaagcggggttcctcacctcaggaactgaagagctaaccagcggaacacaagagcttatcgacggcgcagccccactcgaagaaggcgtctcagccgcggctgacggtgcagcgcaactccacgatggcctcatccaactccaggccggcactggacaaatgggaaccggcgccaccgaaattgccgacggcgtccaaaacgcagtcgaacaacttggcggtcttgtcgttgtacagcagcaactcttaggcgccctcaacgaagcagacaaacaactcgcctcgagcaaaatccccgaagccgaagacctgcgcaaacaaatcaccgaagtccgaggacacctcgaaaacttcggcatctccgtagaaatgaccgaccaactcgatcaactacgttccggcacccgcgacctggctaaccaactcgcagtccccggctacggattccacgatggtatttacagcgccaccaatggagcagccgaattatctgcaggtttgcaagagctagaagcaggcgttgggactgccgtcgaaggcttcaccgcactcgatgaaggtgcaaaccgattagactccatggccaccctcaacgaagaaaaaacctccgcagtccaacgagccctcccggtaccccaagtacccgccggcacaatcgaaggcaccgcagacgaagaacgcaccagcgcactagcgcccatgtacgccttcttaatttcagcattggtcatgctggccggtgcagcacttggatgggcaacactaaaaaacaagtggctgatggcctttgctgtcattggtgtcactgcaatcggtggcattatcttgttcaccgtagctttgggcatatccattggagctttgtttggagccttaggaattttgcttcttgccactgttgttgccggtattctctcccggattttgcttgacgtgttgggaactaccggggctattgtggtttctgttctgggatgggtagcccaagctgcagtaattggccatgtatggagtgttaccgctgtatccgatatcgcacttgtttggcgagtcgtcgcaggcatgatgccactgcattatccaacctttgcagtgacctccattggtaatggcggatcagctgcagctatctggatgtctgttgctgtcttgttggcaatgggagcgatcggagctgttgcgcttcggaagccaaaggcggttgcggttgaggttgaagaagctgttgatgctgatgcagaccaagcagcctcggaatcc

SEQ ID NO: 302 - DNA, 603 bp, Corynebacterium glutamicum
atgcctgcgacgactcgccaaacaagtgcgatatcggatacagcggtaacactccatacatggccaattactgcagcttgggctacccatcccagaacagaaaccacaatagccccggtagttcccaacacgtcaagcaaaatccgggagagaataccggcaacaacagtggcaagaagcaaaattcctaaggctccaaacaaagctccaatggatatgcccaaagctacggtgaacaagataatgccaccgattgcagtgacaccaatgacagcaaaggccatcagccacttgttttttagtgttgcccatccaagtgctgcaccggccagcatgaccaatgctgaaattaagaaggcgtacatgggcgctagtgcgctggtgcgttcttcgtctgcggtgccttcgattgtgccggcgggtacttggggtaccgggagggctcgttggactgcggaggttttttcttcgttgagggtggccatggagtctaatcggtttgcaccttcatcgagtgcggtgaagccttcgacggcagtcccaacgcctgcttctagctcttgcaaacctgcagataattcggctgctccattggtggcgctg

SEQ ID NO: 303 - DNA, 864 bp, Corynebacterium glutamicum
atggaaccgaaaaaacctgtcacatataaagaacttgcccacgaatattcaagaagaacgtttaacaaactcttcaccaaaattactggcttcgtctatctaaaaaacgatctaatcaacgatcccaacttagtgacccaagcactgctcaaaagatgcccagaaggagtacttcgcggatatgcagcattaaagcaacgtggctatcagcttttagacgatcagtggatgccaatcatcagtgtttccggagatctaaacaggagggactgctcacgaggtgaaattctcaggcggattgaaccagaaaacaccctgctcagtggcaacattaggttcgttaatgatgttcaagcgatccaagacgtcttcgacctgcattctctcaacgactttgaagaccaagtagctctcatcgatcatctcatcaggcagcgccccgaattattccaagaactcatacaagagccaaaacttaagaaacacactcaatacgccaatccttttgctgaatctccgcaagaatcacgacttcgggtcagacttcattcactgggttaccacggcttcatcccacagattcatgttgaatacgacggtcaatcctattttctagatctcgcagatccgctgtggcaggttgccctcgaatacaacggcggatggcactacacctctgagcagcgagagaaagattctcatcggaagaatgctctgaaaagtgcgggatgggatgtcctagaagtgacatcaaaaactctgcagaatccgaattcctggaacaacctgatacaacagatcaatagctctctccgccgaaagcaggctcagcgacgccgaaggttacccatgcaaacggtgggc

SEQ ID NO: 304 - DNA, 666 bp, Corynebacterium glutamicum
atgagcaagatcctgctcgctgaagatgacgccggcatcgcagatttcatcgttcgtggcctcatccgcgaaggcttcgaatgcgaggtcaccgaatccggcgccgaagctttcgcccgcgcacattccggcgatttcgatctcatggttttagacctcggcctcccccacatggacggcacggatgtcctagagcaattaagaaatctgcaggtcacgctacctatcattgtgctcacggcacgcaccaacatcgaggaccgcctccgcaccctcgagggcggcgccgacgattacatgcccaaaccattccaattcgcagaattactggcccgcatcaaactccgcctcgccaaacacactcctcaggaaacgccgaccgatgcgcgcgtgctacgaaacggcgatttggagctcgatcttcgtacccagcgtgtgctcatcgacggctcctggcacgacctttcccgccgcgaagtcgatctgctcgaaaccctcatgcgacacccagggcaaatcctctcccgagtccaactcctccgactggtgtgggacatggattgggaccccggctcaaacgtggtggacgtatatatccgcgcgttgaggaagaaaatcggtgcccatcgggtcgaaaccatccgaggatctggctaccggctgcgc

SEQ ID NO: 305 - DNA, 1467 bp, Corynebacterium glutamicum
atggctaaatcaactcctttgattgcatcgctacgctggcgaattgtcctgtggatgacagcggttgttttcttgaccctagccagcgttgtgatcattacccgttcggtgctgctttcagaggtaaccaacaccgcgaactcggcagttgagcaggaaattgaggagtttcgtcgctttgcagccgaaggaattgatccaacaactgcgcagccttttgagtcaggtcatcgcctgatggaggtttacctgtcgaggcagattccggatgaaaatgaagccattgtcggcattttccccggagagctcattcaggttgattactcccagctcagtggcgcccatccgcttcctttggaacactccgatccgttgatttcggaaatccgacagaccacgctgaattctggagttttcagcgatcttgaacgcggaaccactcactggggaaaggtgaatttccaaactgcttccggtgaggccgatggtgagttcgttgtcgcattcttcgctgataatcttaaagaccaggtcaacggccagatccagattcttattttgatcggcacagggggtttgattgcctcaattctgattgcttggttgattgcgggccagatcattgccccgatccgcaaattgagttccgtgtccgcaaagatcagtaattcggatctcacctggcgcgtccctgtggagggtcgtgatgagattgcgcagctggccaggacttttaatgccatgttggatcgcatcgaaatcgcgtataacgatcagcgccagttcgttgatgatgccggccacgagctgcgcaccccgatcacagtggtgcgtggccagttagagcttctcgccaccaccccgccggaggaacaagcgcggtcgattgagctggccaccactgagttggatcgaatgtcgcgaatggtcaatgatctgctcaccctcgcagtcgccgattctggcaccttcatccacgcccaccccacggatgtcacggatttaacaatcgatatcgaagacaaagcccgcaccatcagcgaccgaattttgcttgtcgacgccgccgagggcctcgtcagcctcgacgagcagcgggtcaccgaggcagtgctggagttgttcggcaatgcgttgcgctacagcgatgatgtggtggagttgggttcagatttcagggggtctggccccgaccgcatttttcgcatttgggttcgtgacaaaggaaacggtgttgatatggatgaacaagaagccctgttcgatcgcttctccagaggctcccaaaaaaattcacggcgtcccggtggcgctggcctgggattatccattgtcaaggcgatcggcgaagcccacggcggccgagctttcgtcaattccacaccaggtctaggatccattttcggcctggaaatccccgcaccagaacaatcaaaggaatacacccatgagcaagatcctgctcgc

SEQ ID NO: 306 - DNA, 603 bp, Corynebacterium glutamicum
gtgagttgggtggaaacactcatgacagcatcggtgttttatccggtgctgtcagttgtggtgctcatcgactgcattttgccgcttatccccagtgagactgttcttgctttggcaggggcgtggtcaggagctcggggaactccaaacttgtggttggttatttcagtagcaacgttggccgcgatcattggtgacaacctgtgttatttctttggcacgcggttgatcaatatggtgaacaggattccgggagaatcgaggcgcggaaaagcgctggagtgggcgcggaagaaccttaatgaacgggatgtttcgacaatcattatcgcccgctttattccgtgggctaggtggtttgtcaccatcattttgggatctgtgggatattcctggtcgaggtttatcgtgtgggattccattggagcgctaatttgggcaacccaggcaactttgttgggttatgtgggcggatggcttttccaagaacaaccgttgatcggcctggttgcaggcgcagctttgggaatcttcttcgggttctttttgcagtggctcaacaaaatgtgggagaggcgtcgtctggcgaaagtggctgcagaa

SEQ ID NO: 307 - DNA, 561 bp, Corynebacterium glutamicum
gtgtttccacccaactcaccaactgatcattcaatgggaatccctctcattaaaaagagccttaatgagccgatattaatgatcaatcctggcaatttcttgatgattccgccccaaaccgcaacctcgcgcacttggagtgaaaattctcatcttcatttcatcttggtgcctaacaatggaatacagattgagttgatcaaaggagaacccccaatgaaatcactcccccgtttcgccccactgattacgattctggctctgctcgtactcgttgccatcggaggatctgcactggcaaataatcgtgctacccctaatgtggaaagtgaacccgccacggtcaaccagcgttccactcccacaacttccgcgtatgagccccctgctacagaatctccggaagaaccaaccacacaaattcaagaatccccagtacaacccccagttcctgcccccgctcaaattcctcaagccccacaagttccactcaattatcagtactatgacgatgactgggacgacgacgatgatgacttcgacgacgactgggacgacgac

SEQ ID NO: 308 - DNA, 915 bp, Corynebacterium glutamicum
gtgaataaggtgtcaactatcgctaaaacactcactttttcaagtgcagccctactcggagctggtatcgccaccgctgcatggggatactcagagctcaaaaaattcgagctcaaaacagtagaactgccaattttgaagcctggaacgctccgtggaaagaaggaattccgccttctccacatctctgatctccacatgatcccaggccaagaaaccaaaaaagcatgggtctccgcactcgattcactaagccccgatttggtgatcaacaccggtgacaaccttagcgatgaaaaagcagtccccgacgtcctccgcgcactcggcccactgatgaaccgccccggcgcgttcgtcttcggaaccaacgattactgggcaccccgccccgtcaatcctttcggctacctcttcggtaaaaaacgcgaagtgagccacatcgacctcccctggcgagccatgcgagctgctttcatcgaacacggatggcaagacgccaaccaaaagcgactcgaattccaagtaggttccgtccgcctcgccatctcaggtgttgatgacccccaccatgacctcgacgactacacagagatcgcaggggcaccaaacgtggacgctgatctgtccatagcgttgcttcacgcaccagaacctcgagtcctcgctcagttcgaagccgacggctaccagctttccctctccggccacacccacggcggtcagctttgtcttccgggcagcaagccaattgtcaccaactgtggaatcgaccgcaaacgcgccaccggcctcaacaaatttggcgacatgtggatgcacgtttccaacggcctcggcacctcaaaattcgtcccattccgcatcttctgccgacccagcgccaccctaataaagatcactgaacaggcactt

SEQ ID NO: 309 - DNA, 453 bp, Corynebacterium glutamicum
atgagtgaactaaaagacaaaatccgcgcagatctgaccaccgctatgaaggcccgcgacaaggacaccactggtaccttgcgcatgctgctttccgcattgacccaggaagaaacatcgggaaccaagcacgaactcaatgatgaagaagtgttgaaggtgattgctcgtgagattaagaagcgtcgcgagtccgctgaggtgtacaccgaaaatggtcgtcaggaattggctgacgttgagcttaaagaggctgccattttggagggctaccagcctgagcagcttgatgatgatcagctgaacgcgctgatcgatgaggctatcgctgaagtcggcggcgaggccgatatgaagaagatgggccagatcatgaaggctgctaccgctaaggctgctggccgtgcagatggaaaacgactctccaccgcagtgaagagccgtttgagcaac

SEQ ID NO: 310 - DNA, 2385 bp, Corynebacterium glutamicum
gtgtccaccacgaattctctgacaaagctcgttgcatctacagtcgccgctggcgtccttggtgcgctcgcacttgtgcctttcgctagtctttctggcgttgcggttgcgcgtaccaatgacacgatgcagaccaacctttcagatctgacggatggtcgcgggccgggcgtcacgacgattactgattccactgaccagccgattgcttatatttatgcgcagcggcggtttgaggttgggggtgatcagatttctacgtcgatgaaggatgcgatcgtttcgattgaggatcgcaggttctatgagcatgatggtgtggatttgcagggctttggtcgtgcaatcctgacgaacctggctgcgggtggcgtggagcagggtgcttcgacgattaaccagcagtatgtgaagaacttcttgctgttggtggaagctgatgatgaggcggagcaggctgctgctgtggaaacctccatccctcgtaagctccgtgagatgaagatggcgtctgatttggaaaagacgttgtcgaaggatgagattctgactcgttatctcaacattgttccttttggtaatggtgcttatggtgttgaggctgcggcgcggacgtatttcggtacgtcggctgccgagttaaccattccacagtctgcgatgctcgcgggcattgtgcagtcttcgtcttatctcaatccatacaccaatcacgatgctgtgtttgagcgtcgtaatactgttttgggcgctatggctgatgctggcgcgatttccccagacgaggcttcggctttccagcaggaacctttgggtgtcctggaaaccccgcaaggcttatccaatggttgtatcggcgctggcgatcgtggtttcttctgcgattacgctctgcaatatctttctgagcagggaatcacccaagatatgctggcgaaggactcctacaccatcaaattgactttggatccagatgttcaggatgcagcgcacaatgcggtgtcctcccacgttgatccaaccaccccaggtgtcgctgaagttgtgaacgtcattgagcctggcgagaactcccgcgatattttggctattacttcttcccgcaactacggccttgacctggatgctggtgaaacgatgctgcctcaggcaacgtcccgtgtgggtaatggtgccggttccattttcaagatctttaccgccgctgcagccattcagcagggcgctggcctagacaccatgttggatgttccttctcgatatgaggtcaagggcatgggctccggcggtgccgcgaactgtcccgcaaatacttactgcgtggaaaacgcaggatcctacgcgcctcgcatgactctgcaggacgctctcgcgcagtcccccaacactgcattcgttgaaatgatcgagcaggttggcgtggacaccgttgtggatctttcagtaaagctgggcctgcgaagctacaccgatgaaggttccttcgacggcgaaagctcaatcgcggactacatgaaggacaacaacctcggttcttacactcttggacctaccgctgttaaccctcttgaattgtccaatgttgctgcaaccattgcatccggtggcatgtggtgcgaacccaatcccatcgccagcgtccatgaccgtgaaggcaacgaagtctacattgaccgccctgcatgtgagcgcgccatcgatgccgaaacggcttcagctttggccgtcggcatgagcaaggatacggtcagcggaactgcggcctctgcagccagcatgtacggatggtccttgccaaccgcagcgaagaccggtaccaccgagtccaaccagtcctcagcatttatgggcttcaacagcaactttgccgcagctccatacatctacaatgacggcacctccaccaccccactgtgcagcggccccgtccgccagtgcagcagcggtaacctcttcggcggtaacgaaccagctcaaacatggtttaacatggcaagcaacgtccccgcagcttcgcaaggaacactgccatccagcagcgattcattccgcctcggcacttccggcgaactcctcaaccaggttgtcggccaaagcgaagcctccgctcgacgcaccctcgaagccaaaggctacaaggtcaccacgcgttcagtctccggcgccggcagcgcgcgcggcaccgtagtcagcgcaacccctcagggtgcagtgcttatcgacggtggaaccgtcattttggacatctccgacggcacaagccctgcccccgctgccaccaacaatgatgacagcgacgatggagacacccctgctccatcaacaaacaaccgcggaacaaccattgaagacgccatcaatgacgccatcaaccagttcttccgc

SEQ ID NO: 311 - DNA, 339 bp, Corynebacterium glutamicum
gtgattccagagcagcgcaacaaccccttttatagggacagcgccacaattgcttcctcggaccacacagagcgtggtgagtgggtcactcaggcaaagtgtcgaaatggcgacccagatgcattgtttgttcgtggtgcagcgcaacgccgagcagcagcaatttgccgccactgccctgtagccatgcagtgctgcgccgatgccttagataacaaggtggaattcggagtctggggaggcctgaccgagcgccagcgccgtgcattgcttcgaaagaagccgcacattactaactgggctgaatatttggctcaggggggcgagatcgccggggtt

SEQ ID NO: 312 - DNA, 192 bp, Corynebacterium glutamicum
gtggtcggcttttttgattcagggcgcaccccaggcgcaccccaggcgcaccccagcgcaccacaggcgcaccccagcgcaccacaggcgcaccagcccagcacaagagccaacgcaagtgtcaggcacgccagcaaaggggctagcaagaagcacgcccccgaagccttagaaatgcgttccccggtagga

SEQ ID NO: 313 - DNA, 153 bp, Corynebacterium glutamicum
atgactaaatgggaatacgcaactgtgcctttgattacgcatgcaactaagcagatcctcgatacttggggtgaggacggctgggagttggtctcggtcatgcctggtatgaaccctgagaacctcgttgcttacatgaagcgtgaggtggct

SEQ ID NO: 314 - DNA, 459 bp, Corynebacterium glutamicum
atggcttctaattccgaacgccttgcagagctgggcatttctcttccttccgttgcagcgcctgttgctgcgtatgttcctgcgattcagaccggtaaccaggtgtggacttctggtcagctgcctttcgttgatggtcagcttccggccaccggcaaggttggcgctgaggtttccgctgaggatgcggagaagttggctcgtgcggctgcgctaaacgctcttgctgcgattgatgcgcttgttggcattgataaggtcactcgcgttttgaagattgttggtttcgtggcgtctgctgatgatttcagtggtcagcctgctgtcgtcaacggtgcttccaatttgatgggtgaggttttcggcgaggctggggcgcatgcgcgttctgctgtgggcgtggcggagttgccgctcaactcgcctgtcgaggtcgaggttatcgtcgagatcgcgcag

SEQ ID NO: 315 - DNA, 1353 bp, Corynebacterium glutamicum
atgactacatcttccacagcttcgccgatcgctgaattacaaaacctcagcccgaagcaaagaaaatcagaatcccggcgcgcgattatatccagctacttgggctccacgatcgagttctatgacttcctgttatatgccgcagcctccgcgacggtattccccgcagtgttctttaccaatctcgatccgctggctggaaccattgccgcctacggaaccttcgccgcaggttatttagctaggccacttggtggagcaatcttcggacacttcggtgaccgtcttggacgcaagaagatgcttgtgttgtccatgctcatcatgggtgtggcatccacatgcatcggccttgtcccaagcgctgaaatgatcggaagcatgggcgcggtaatcctgatcatgctgcgcatctgccaaggcatcgctgtcggtggcgaatggggcggagctgccctcatggcgctcgagcactcagattccaagaagcgcggattcgccgcctccttcaccaacgctggtgcaccaaccggcgctgcactgggaaccttcgcgctcggtaccgcatctgctgttctcacccaggagcaattcctttcatggggttggcgcatcccattcctgctctctttcgttctgctgattgtcggcttggttatccgcgcgaaagttagcgaatcaccactgttcgcagctgcagcggccgccgaaaaagccaagccaaccgaacgtaaagtccccctcttgcaggttcttcgccgaccaaaggcactgatcttgaccatgcttggcggcgcatcaggattcggacttcaagttctcttgtccaccttctccatcagctacgcaacacaatccggcatcgaaagatccagcgtcctctacgccttcgcagtcgcctcagtgttctctgtcttctttgtgatcctcttcggtcgcgtatccgacctcttcggacgccgacccgtcatgatcatcgcgctcgtactgttcgtggcctacctgccggcattcttccggatgctcacctcagacaactggttcatcctgctctcggcattcaccatcgcgctcgcactccacgccatgctttacggcccactagcagcgtttatctccgaacaattcggaacctccgcgcgctacacaggcgcatccctgggttaccagttggccacgctcatcggtgcaggattcaccccaaccatcctggctagcctctacgcgggaccaggcggcggaacctctgtcaccccagtcatcgtcttcctcgcaacgatgtccctagtgtccatcatcgccatcgcaatcaccagagaatcaaaagaccacgatctttctacttacgaacac

SEQ ID NO: 316 - DNA, 609 bp, Corynebacterium glutamicum
atggcgatatctccggagtggtaccagccattttgtagtgcgctggcggtgtcttctggtcggttccagtatccggtcatcacatgtggtccgcggatgagaacttcgccggcctctccggtggggacttcttcgccggttttcgggtccactagtttgatgtcggtgaagaagtgggctcgacctgcggttccaaggtgtgtgcttgtgtctgttgcctcgaggatacaggcgcccggtgcggtttctgtcatgccgaagccttggacaatttttacgtcgcgtccttgccagattcgcagcgcacgttcgctaaggggagagccgcccaccatgatggcgcgaagggaagaaaggtcgcgttcggcaaatgatgggtggttggacaacatgtcgatcatcgctggcaccatgaaggattcggataccttggagcgttcgatttcgtcgaggacgtgctctgcccggaattcgcggtggatgatcacctttccgcccttcatcatcaccgggatggtggtcatgttgaggcccgcgatgtggaataacggcgcagtggataaaagtaccgcgccttgttcaatttcctggctgagcagggcattgaag

SEQ ID NO: 317 - DNA, 1536 bp, Corynebacterium glutamicum
atgaaagtgaacctcggaataggaagctacccacgacgcagggcaactgttcgaccagagtccactgcaatcgaattcgaaggcaccagcatcacctacggagaattcagcaaacgagtcaatcggcttggacatgctcttctagacctcggcgttgcgcaccaagatcgagtagcttatgtcggattcaaccaccctgccctgctagaagtgttcttttcaacgaacctcattggggcaacacccgtgcttgttaaccctcgcctatcggcaaacgaaatcgattacatcatccaagacagcggtgcgagcatcgtgttttacggaatcgacctcatcgagcacgccacttacctccaagaactccatccagagatcatcatggtggccgttgaaggcgatgagggtccaggtttgcgtcgaaaagcgcttattgaagcggcgagcgacgccgacatcgacctagaagtcagcgatgatgacatcgcgctgctcatgtacacctccggaaccactggccgcccaaagggcgccatgttatcccaccgaaacctcttctttaactacttcaatgccctgctcagccaggaaattgaacaaggcgcggtacttttatccactgcgccgttattccacatcgcgggcctcaacatgaccaccatcccggtgatgatgaagggcggaaaggtgatcatccaccgcgaattccgggcagagcacgtcctcgacgaaatcgaacgctccaaggtatccgaatccttcatggtgccagcgatgatcgacatgttgtccaaccacccatcatttgccgaacgcgacctttcttcccttcgcgccatcatggtgggcggctctccccttagcgaacgtgcgctgcgaatctggcaaggacgcgacgtaaaaattgtccaaggcttcggcatgacagaaaccgcaccgggcgcctgtatcctcgaggcaacagacacaagcacacaccttggaaccgcaggtcgagcccacttcttcaccgacatcaaactagtggacccgaaaaccggcgaagaagtccccaccggagaggccggcgaagttctcatccgcggaccacatgtgatgaccggatactggaaccgaccagaagacaccgccagcgcactacaaaatggctggtaccactccggagatatcgccatcaaagatgaagacggctactacaccatcaaagaccgcatcaaagacatgtacatctccggcggcgaaaacatttaccccgcagaagtcgaacaagcactccaggaactggaagcagtccttgatgccgcagtcatcggagtccccgatgaacgatggggcgaaactggcatcgcctttgtctccatccgagaaagctacctgaccaacccaccaaccggaccggaactacgagaactactaggcagtgtcctagccagatacaaacttccacgagaaatccacatcatcgaagaactcccccgcaacgccacaggcaaaatccaaaagaacatcctgcgagacttcaccatccccgtttca

SEQ ID NO: 318 - DNA, 525 bp, Corynebacterium glutamicum
atgcatgttcaaatgattgaagatcgaaactatttttcagccagttcacatggagccactatgaccaccagcaaccccaccgccgagatcattggcggaccagaacgattcctcgaggccgaattgtcccagcagattcaattcctcactgcccgcgcacgagccaagggatccgccaaaggaaacgaagccttagtcgacctcggacttaaagttcgccaatactccacactgtccctagcggccagcggattaaaaccaacccaacgagaattgggagcatttctcgacctagacccaagtcagattgttgccttggtcgatttcctagaaaagcgcggattagtggcccgggaagttgacccccgggataggcgctcgaagatcatcatcgccaccgaaaaaggtctggaaattcacgacgaagccaccaaacgcctcctcatcgccgagggtgaatctctaaaaaacctcacctccgacgagcaagaacaactaagggaactgctgctcaaaatcgccttt

SEQ ID NO: 319 - DNA, 933 bp, Corynebacterium glutamicum
atgtctctcaatggaaaagtcgccatcgttaccggatctggtgcaggacttggtcgttccttcgctcaggagcttgcccgtcagggtgcatctgtcatcgtcaatgacgtaaaccaggcagccgcagatgagactgtcgcagcaatcaccgaagccggcggcaaagccgccgccgttatcgcccccgttggaccctctgaaagcgccgcattgctggtgcgggaggccgtcgacaagttcggttctttggacattcttgtcacaaacgcgggcatccttcgtgataggtccctgctgaagatgacggacgatgatttcgatgcagtcattaacgtgcacctcaagggcactttcacctgtgttcgcgaggcatttggatacttcaaggagaatggaatcgcggggcgcatcgtcacgattggttctcccaccgggcagcgcggcaacttcggacagagcaattacgctgcagctaaggcgggcattgtgggtatggttcgcacgtgggcgctggagatgaagcgcgcaggtgtcaccattaacgcgatcattccggaagcagccaccgatatgaccaagacggtgccatatttccagaaggctgtagaggccgatgagcgtggcgaggccatgccagcattcttccgcgagaccctaggttttggcactcctcaggatgttgcgggacttgtggccttcctttcctctgatgaggcagcgaatatttctggacaggccatcggtgcaggcggcgaccgcatgcaggtgtggaagcacccagagccagcagttactgaatttaacccaggtggctggacctatgaagcactgcaggaacgtggcaagaacattattgagggcaacctgcagtccgtcggtgtcgttttccctgaactgccggcagagcttcagccacaaatcccagtcaaggca

SEQ ID NO: 320 - DNA, 942 bp, Corynebacterium glutamicum
atgagcaacaacgtagtgaaatatgagtgcgcggtcgacgccgacaacattgtcgcagtcgatatgcatgtgcacttggaagtcgacagctgcggacacaaatcgatgccggcagacatcatggcggcatcctcgaagtactttaagaccgcggaacgaactccctcagcagatgccattgctgatatttatagggaacacaagatggcggcggtggttttcaccatcgatgcgcggacccaaatggggcatctgccgaactcgattgatgatttggtggcaagctgtgcccgcaacaatgacgtgctgatcccttttggcagtgtggatcctcgtaccggcgaggacgcgctggtggaagctcgccgacaggtggaagaactcggggtgcgaggcttcaaattccatccatcggttcaaggattcgacccatccgcgccagagttctacccactgtgggaattgctcgaaagttttggattgccatgcgtgttccataccggacaaaacggcatgggtgcaggtcttccaggtggtcgaggcattaagctgcgcttctccaacccaatgttgcttgatgatgttgcggcggacttcccgaacctgaccatcatcatggcgcacccttctgttccttggcaggatgaggctaactcgattgccacccacaaggccaatgtgttcattgatctttccggctggtcgccgaagtatttcccagagtctttggtcagacagtccaataacgtgctatccaagaaggtgctgtttggcacggacttcccgctgattaccccagagaaatggcttgcggctttcgcgaatctgccactgaaggatgaggttcgtccgggaatcctcaaagacaatgcggtgaaggtacttggcctagccgctagcactgagcgcggatctcaagcagaaaaggtcgtgcaacatgcg

SEQ ID NO: 321 - DNA, 1194 bp, Corynebacterium glutamicum
atgcgtgatcccattcaaggtgctgttattccttctgatctttttggtttcgcagaagttctcaccgaagccgaacgcgcagttcttctggaaacccgcagggtgcttgaggaagaggtgaagccttatattaatgaggcctgggataaggcagtcttccccgatgagatcgtgcagcccctccaagatctgcaattgcttgatccgcctgcacttcgggaagcaggggagtcggttcgagacattttcactggtttccgcaattttgaactcgcgcgctgtgacatcaatgttggtacctattacaacgcatctgctggtctcttccgaacggcctgcatggttggtggctccccggagcaggcgcagcgattggatgcgcagatcaaatctggtgaggtcaagggcgtttttgcactgacggaacctgatcatggctctgatatcgcaggtggtctggcaaccacggccactaaggacgcagacaccggcgagtggattatcaatggtgaaaaacggtggatcggtggtgcttccactgctgatttgatcgctaccttcgccagggatacagccgataaccaggtgaaatgcttcctcgtggcacctcaggcagagggcgtgtccatggagattattgatcgcaaagcctcactgcgcatcatgcaaaatgcacacattacctataacaatgtccgggtgtctggggatgcgcggctgcacaacatcaattctttcaaggatgtttcggaatgcctgcgccgtatgcgttccgatgtggcgtggatggcggtcggtgcgcaggcaggtgcctatgaagcagccgtgaagtatgtgcgcagcagggaacagtttggccgtccgatcgcggggttccagttgattcaggaaaagctcgcgctcatgctgggcaatctcacggcgtcgctgggcatgatggtcaaactcaccgatcagcagcaggcgggaattttcaaagaggaaaactccgcgctggcgaaaatgtttacctcgctcaaacttcgggagaccgctagttgggcgcgggaaatctgcggaggcaacggcatcattttggacaacgatgttgcccggttccatgccgatgcagaagccgtctattcatatgaaggcacccacgaaatcaatgcactcatcgttggtcgcgccatcacgggcgtcagcgcttttatc

SEQ ID NO: 322 - DNA, 471 bp, Corynebacterium glutamicum
atgactacttccaccaccccaaacaccatcgtttctttcgaagacgcaccaaccctcaccggccaggacctgggcttttcgcagtggcgcactgtcacccaggagatggtgaacaccttcgcggacgcaactgatgatcagcagtggattcacactgatcctgagcgcgccaaggacggtccttttggtggcgcaattgcccacggtttcctcaccttgtccatgatcattccgttctggggcgagcttctcgatgtcaccggcgtgaccaccaaggtgaactatggcctggataaggtgcgtttcacctctcccgtcaaggtcggttcccgcatccgcatgggcgctgtggtccgtgagatctctgaggtgaagggcaatggcctgcacctggtcgccgatggcactattgagatcgaagggcaggagcgcccggccgtcgtagctaccttcctcacccgcttctacgct

SEQ ID NO: 323 - DNA, 843 bp, Corynebacterium glutamicum
gtgactaagcttgagcgcatggagcatcctgcttacagccaattgcggccggttaccccgtccgcatctgttgttttgtgccctaatcccggttacagctcgctggaaggcactaattcttgggttatccgggcaccagaagacccccggagcattgtcatcgatccaggtcctgaagatgagggccaccttaacgtcttgcattccaaggctgaggaggtgggtttgattcttctgacccaccgtcactatgatcatgctgacggcgcacagcgtttccgtcagctgaccaatgcacctgtgcgtgcgatggacccttcgtactgtgctggtgcggaggagattcatgatggtgagatcatcacgatcgacggtgtcaccccacagattgaggtggtggccacacctggtcatacccgtgattctgtgtcttatttcatctggagtggagtccctcatgagtccactttggagggcatcgtttctggcgacaccattgcgggtcgtcacaccacgatgatttcagagaccgacggcgatttgggtgagtacctgaattctttggccattttggaggagcgcggcaaggatattccgctgcttccaggacatggtccagatggacaggacgtgtcctccttcgcgcgtaagtacattgagcgtcgtgagctgcgtctgaaccagatccgtgaggtatgggagacccgtggccgtgacgtgtccatgaaggatctcatcgacgccatctacgatgatgttgatccagttctgcgtggtgcagccgagcagtccactcatgtggctattcgttacctgcaggctcaggaagcttccgcctcaaac

SEQ ID NO: 324 - DNA, 1173 bp, Corynebacterium glutamicum
gtgacgacccgcaatggtgtcgccagaaacgatgccctccaaagtggactcatgagggactccactccagatgaaataagacacagaatcacgggtatgaccaggtgtggccaccacctcaatctgtggggtgacaccgtcgatcgtgatgatctcaccatcatgaatctcctccgcaccagcacagtacgaagggtccatcgcacgcacaggtgcattggtcagctgacggaaacgctgtgcgccgtcagcatgatcatagtgacggtgggtcagaagaatcaaacccacctcctcagccttggaatgcaagacgttaaggtggccctcatcttcaggacctggatcgatgacaatgctccgggggtcttctggtgcccggataacccaagaattagtgccttccagcgagctgtaaccgggattagggcacaaaacaacagatgcggacggggtaaccggccgcaattggctgtaagcaggatgctccatgcgctcaagcttagtcacaataagtcatttcgtagaactggggagaaaaatagcagcgcacccctaacattgaagggatgcgccggatgggtttttgcgtcgagaagcaagcttttaagcgtagaagcgggtgaggaaggtagctacgacggccgggcgctcctgcccttcgatctcaatagtgccatcggcgaccaggtgcaggccattgcccttcacctcagagatctcacggaccacagcgcccatgcggatgcgggaaccgaccttgacgggagaggtgaaacgcaccttatccaggccatagttcaccttggtggtcacgccggtgacatcgagaagctcgccccagaacggaatgatcatggacaaggtgaggaaaccgtgggcaattgcgccaccaaaaggaccgtccttggcgcgctcaggatcagtgtgaatccactgctgatcatcagttgcgtccgcgaaggtgttcaccatctcctgggtgacagtgcgccactgcgaaaagcccaggtcctggccggtgagggttggtgcgtcttcgaaagaaacgatggtgtttggggtggtggaagtagtcatgatgttctccttaaaagtgtgttagataaaagcgctgacgcccgtgatggcgcgaccaacgatgagtgcattgatttcgtgggtgccttcata

SEQ ID NO: 325 - DNA, 705 bp, Corynebacterium glutamicum
atgctcggtgtccacaatgaggacggacttgccctcgaggcgaatccagccacggtgtgcgaacgttgcaagagccttattcacagtttcacgggaagcaccgacgagctgtgcgatttcttcctgagtgaggtcgtggttcacgcgcagcgcgccagcttcttgggtgccgaagcggttagccagctgcagaagggtcttagcaacgcggcctgggacgtcggtgaagatgaggtcagccagggaagcgttggtgcgacgcagacgacgagccagaacgcgcaggagctgctcagcgatagctgggtggtcagctacccagttgcgcagcatgtcagagttcatggttgctgcatgaacttcggtgacacacactgcagaggaggtgcgtgggcctgggtcgaagatggagagctcaccgaacatgtcggaaggacccatgatggtcagcaggttttcgcggccgtccggtgcgtggcgcgcaagcttcactttgccggaggtgatgatgtaaaggcggtcacctggctcgccctcgtcgaagatggttgctccgcgtgggaagcgaacggtctccatatcctggatgaggttattgactgccgttgggtcaacgccttgaaaaattccggcgcgcgacaggatctcctgtacaccttccactgcttttctccttcatctgcacacatcttgtttgagtccgga

SEQ ID NO: 326 - DNA, 681 bp, Corynebacterium glutamicum
gtggaaggtgtacaggagatcctgtcgcgcgccggaatttttcaaggcgttgacccaacggcagtcaataacctcatccaggatatggagaccgttcgcttcccacgcggagcaaccatcttcgacgagggcgagccaggtgaccgcctttacatcatcacctccggcaaagtgaagcttgcgcgccacgcaccggacggccgcgaaaacctgctgaccatcatgggtccttccgacatgttcggtgagctctccatcttcgacccaggcccacgcacctcctctgcagtgtgtgtcaccgaagttcatgcagcaaccatgaactctgacatgctgcgcaactgggtagctgaccacccagctatcgctgagcagctcctgcgcgttctggctcgtcgtctgcgtcgcaccaacgcttccctggctgacctcatcttcaccgacgtcccaggccgcgttgctaagacccttctgcagctggctaaccgcttcggcacccaagaagctggcgcgctgcgcgtgaaccacgacctcactcaggaagaaatcgcacagctcgtcggtgcttcccgtgaaactgtgaataaggctcttgcaacgttcgcacaccgtggctggattcgcctcgagggcaagtccgtcctcattgtggacaccgagcatttggcacgtcgcgctcga

SEQ ID NO: 327 - DNA, 192 bp, Corynebacterium glutamicum
atgactcccatgacaggtttgcttgtggtgatcatcccgctcttgctgatgctttttgcatttgcgatggagcgaatcgagtcttctttcctgcactccaacgctccgcagaacactgaggtaaagttagcaaaggacgctatcggtgcagaaaacttaaatgacggtgacgtgcaggaagcatcagctgcc

SEQ ID NO: 328 - DNA, 780 bp, Corynebacterium glutamicum
atgggttccattactccgcagaagcggcctcgcgtggggtctcacatcgcgaacaagggtcaagagactgatatcgggcgaaaacgccgagctcgacgcatcaatcgcacactcaccgtggcatatccggatgcgcactgcgaattagatttcaccaatccgctagaactcacggtcgccaccattttgtccgcccagtgcacggacgttcgcgtgaaccaggtgacgcccgcgttgttcaagcgctatccgacggccacagattacgccaacgccgatcgcacggaattggaggagttcatccgtccgacaggcttttaccgcaacaaggccacttctttaatcggcctgggtgaggcactaatttcgcttcacgacggccaggtccccggtacccttgagcagctagttgagctgccgggggtcgggcggaaaaccgccaacgtggtgctgggaaatgctttcggtgttccgggaatcacggtggatacacactttggcaggttggtgcgtcgcctgaagctcactgatgaagaagatcccgtcaaggtggaaaaagtgatgaacgaactcatcgaaaagcctgagtggaccatgttttcacataggctgatcttccacggacgtaggatatgtcatagtcgacgcgccgcctgtggagcctgcatgctggcagctgattgcccatcctttggtttggaggggccgtcagatccatttgaggcgcaaaaactcattaaaagtgatgatagggagcacctgctgaaaatggcaggaatg

SEQ ID NO: 329 - DNA, 558 bp, Corynebacterium glutamicum
atgacaagcagtgcaaagtggtccatcgttggagttgtcgccatcctggctgtgatcgttgcgttaatcccgcagcttgtgggtggagaaagcgcagaggaagcgcagggggagacgtcgacaagcaaaattacgacgcgtcctgactgcgtggcctctggcgcggcgggtgtggatctgccctgcttgggcggcgccaacggcgtcggcaacgagctggccaccgtggtgaatctgtgggcgtggtggtgcgaaccgtgccgcgcggagctgccgatttttgatgaattcgccaccacccaccccgaactcaacgtcattggcgtgcatgcagaccaaaacgcagccaacggcgccgcactccttgaggatctgggcgtgaatcttgcaagctaccaagacgattccaacctgttcgcaggcacccttgggctgccgggcgtcgtgccgatcaccatcgtggtttctccagacggcaatgtagtggacaccttcccgcagcctttcgaaaccatcgatgacctcgaaaccgctgtggcaggggcgctgcagaatgcg

SEQ ID NO: 330 - DNA, 669 bp, Corynebacterium glutamicum
gtgtggatgcaccgactcttagaccgcatccacaccggccgcatggccaacccgctggacggtgcggaaacgctcggcgacacagactccgaaaagcgcgctgccgtgctcatgctattttctggctcggaaacctcctttgacctgcccaatgacgcctccgtgctgctgacgcaccgcaccccgacgatgcgttcccatgcaggtcagattgcctttcccggtggccgaatcgaccccaccgatactaacgccgtggactgcgccttccgcgaggcctgggaagaaaccgggctggatcgccgcaccgcaaccccattagcccagctcaacgaggtgcacatccgtgccaccggataccccgtctacccaatccttggacactggcacaccccatcacccgtcgccgtggccagcccacacgaaaccgacgaagttttcgacgccccactctacgacctcatcgaccccaaaaaccgcctcatggtcggctggcgcgaatggcacggaccagcgtttcgaatcaacgactacatcatctggggattcaccggcggactactctccgcgatcctcgacaccgccggctgggccaccgaatgggacaccgaccgcatcttcgacctggaaaatacattgtcaacatctcgcaacaatgagcgtatgcgt

SEQ ID NO: 331 - DNA, 1191 bp, Corynebacterium glutamicum
ttgagccccagcctggtcgtcgatgccgtcatcgtcctcgttatggcattcgccctgtggggtggttggcgtcaaggcgccttcacctcgctgctgtccaccgtcggcgtcgtttctggcctggtagttggcgcagcagcagctccatttgtcatgggtctcaccgattccaccgcgcttcgcttcctcctggcgatcggcaccgtggtgctgctggttggtttgggaaatctcatcggcgcccacttgggtgctgcgattagagacaacatcaaattccgaagttccaggaccttagattctgggctcggcgccattttccaagtattggccaccttgatcgtggtgtggctcgtcgcaattcccctggccacaggcctccccggaactgtcgccagcggaattagagactcccgcatcctgggctttgtagacaaatacaccccgcaaggcctagataccctgccctccaaaatcgctgcgatgctcagcgaatccggcctcccaccactgatttcccccttcaccggcggatcctcggtggaagtggacgcccccgaaatcaacgtcaccaacgttgacctagtcgaagcaatgcgcccgtccgtcatccacgtgatgggtgacgcccaagaatgcagccgccgactcatgggttctggctttgtggcatcccccgactacgttgtgaccaacgcccacgttgttgcaggtacctccaccgtcagcctggataccatgatcggaacccgctccgcagaggtagtgttctacgacccgaacctggacatcgcagtcctttacagccctgacctcggcttggatccactgccgtgggcatccactccgctagacactggcgatgaagcaatcgtcatgggattcccacagtccggacctttcaacgcctccccagccagggtccgcgaacgcatcatgatcaccggcagcaacatttacgccaacggccagcacgaacgcgaagcctattcagtccgcggatccatccaatctggaaactccggcggcccaatgaccaacgaaatgggtgaagtggttggtgttgtcttcggcgcagcgatcgacggctccgataccggttacgttctcactgccgaagaggtacaggagcggatcggcgacatcaccgcgctgactcagcctgtcgatacgatgcagtgcgcggtttct

SEQ ID NO: 332 - DNA, 993 bp, Corynebacterium glutamicum
atggccttttttagcttttcgacgtctcccctcacccgcctcatccccggcagccgctccaaagccacaggcgccaaacggcgcctgagcagcacaatcgcgtcgattgaacgctcccccggcatcattgccctagacggaccgttcacccacgatcacgtctccgtacgtggcattcgcctccatttagcagaggcaggctcccccaccaaacccctggttcttctgatccacggggctttcggcggttggtacgactaccgcgaagtcatcggcccactcgcagatgccggcttccacgtcgccgccatcgatctacgcggctacggcatgtccgacaaacccccaacaggctacgacctccgccacgcagccggagaactcagcagcgttatcgcagctctcggccacgatgacgcacttcttgtcggctccgacaccggcgccagcatcgcctgggctatcgcttccatgtaccccgaacgggtccgcggcctaatttccctcggcgcgatccacccccttgacatgcgacgcgccatccgacgaaaaccccacctacacgtctctgacctcagccgacttgctccttttcggttgccctcattcctgcataacctcttccacttcggaatcaccagcgaagctcgacgtgagatcgtcaacaacacgtcctcgtcctaccagcgcagcaacgcattcacagagacagtgctcctccgcaaaaaagcactatcgatcgaccacaccatcaccccgatcatccgcaccaaccgctacctcgttgggtcgatccccagcaaaacagtctccgcaccggtgtggctgctcagaaccaacactcgacgctgggaacatctagccaatactgcgcgcactcgaacgacagggccattcaccaccatcgcgatccccggcggctacgaactcccctacctcgagaacccttccgaatttgcagcaaccatcgcagagttcgcgcgcaccacgttt

SEQ ID NO: 333 - DNA, 549 bp, Corynebacterium glutamicum
gtgagcaacaaagacggcctttttactgacggtaacagcacgtttgcacctaaggtggattcaattcccctcagcgatgtggataccagcgttagcggtgaagcctccatcggcacgctgatctccaacgcaacctcccaaatgtccagccttttccgcgcagaagttgagctggcgaagactgaactcgcaggcgaagccaagaaagctgccatcggcggcggcgcattcagcgttgctggcgtaatcgcactgtacagctccttcttctttttcttcttcgtcgcagcactgctgagcgagtggattaagccttgggcagcattcctcatcgtgttcctcttcatgctggtcatcgccgcagctctcgcactgttcggctggcgcaaggtgaagaagatgggcgctccgaagaacaccatccaatcggtcaaccaactgaagaacctggtcccaggtcaggcatccgagaagctggagaaggccaacaagcgtggcctctacacctccgcgtccttccacagccccggcgccatcactggcgaccac

SEQ ID NO: 334 - DNA, 966 bp, Corynebacterium glutamicum
atgacacttcccgcacgccttctacattcccaatgcgcaaccccagcacgtcacttcaatctcattggtaactttagtttctttctcagtcttggaaagttgccaaaaagcgctaaactatgcggtgtgaagcacccagatcccgcccaaaaagtagagggcaccactgcgaccacccccacaaaggtggctgcttttttcgatctggacaagaccatcatcgccatgagttccacctacgcctacggccgtgagttcatgaacagcgggctcatctcccctgtcgaagccctgcaattaagcctcgcgcaagcaacgtacatgttcgccggccacaccagtgaacaaatggacaacacccgcgaccaactcaccgccatgatccgcggctgggaagtccaacaggtgcgctcgatcgcggaggaaaccatgcattcggtggtcactcccaccatctacgcagaggcccgcgaactgatcgagcaccaccaggagctcggccacgatgtcatcatcatttccgcctctgtgaaagaactggtggaacccatcgcccgcgaactgggtgtacataaaactgtcaccaccgtgcttgaagcccacgacggtatgtacaccggtgaagtgctgttttactgcaaaggcgacgctaaagcgcagtccatcctggatctcgccgaggcgaacaattacgacctttccttaagcttcgcctactccgattccttcacggacctgcccatgttggaagctgtcggcaacccggccgccgtcaaccccgaccgcgcgctgaagaaaatcgcccttgaacaggggtggaaaatcttaagcttcaaaaaccctgaaccgctgttccaaatgcccagcacccgcgacgtcggcatcggaaccggagttgttgccggcatcgcagctgttacagcaggtagtatctggtggatgaaacgcgcacggcgcggatcggcc

SEQ ID NO: 335 - DNA, 1023 bp, Corynebacterium glutamicum
gtggaagatccggtcctgcacccagaggccatgcacgtagctgcagccactggtcggccggttattgaaacaacaaatttgatggacatctccaggcattttcaccgcacatcggcagtgctcattgatgcgtcgatggcctctcaattatcacctgggaaacgccgcgacagggtgtttcttctcgattctgatccagggccctctgattggaaaacggcgatgaaaatccacgctgagcaagccatgttgcttcccgctcaggcaggggagttgctcagcgctttaggcagagatgacaaacaactgccggtggcttcgggccatgtcatcggtgttgccggggtggtgggaggaacaggcgcgagcacgtttgctgcggcgctcgcaaagcggcgtgcggagtcagtcaccactgtgcttatcgacgccgacccttcctctggcggcatcgacctgttgctaggaatcgaagatgtgcccggcgcgcggtggcctgatgtggggttgcgtcgcggaactgtccaggctgctgatgtgttgaaagcgctgccgagcactcctgatgaggtcgtggtgttgtctacggcgcggtctaatattctggatccttttgcattatccgagtctgatgtttcggcggcgattgattgtttcttaagcgccgataggtcggtggatgtggtggtggatctgcctcatgcgagagtgcatccagatattgcggagcgcttatcccacctggtgttagtcatccctgcagaggtccgagcggtggctgctgccagggctcggtgtctggaattacaacaattgcatgtatccatcacgtgcgtgttgaggcatcgcgggtggtcaggtttggatgttgcagaagtggaagagattttaggtgcggatattaccgcggaggttggctcgatccagcggctggctaagtccgtggagatgcatgggctgaccggttctttgccgagggttttaagctcagcatgcgacgcggtcctcggggaggtggcggca

SEQ ID NO: 336 - DNA, 1023 bp, Corynebacterium glutamicum
gtgatcagtaacgaggacatcgtgatggtgttgcgtcgactgcgcagtgattctgtgggcgtgggaccgttggaatctctgcttgcgcttcctggcgtgacggatgtgttggttaatgcccatgacagcgtgtggattgatcgcggtcagggcgtggagaaagtcgacatggatctgggctcagaggaggcggtgcgtcgccttgccacccggttggcgttgacctgtggcagacgcttagatgatgcgcagcctttcgctgatggccgaatcaccagggacgacggcagcgtgttgcgcattcacgcggtgttggcacccttggcggaatccggcacgtgcatcagtgtgcgagtactgcgtcaagcacggctgagccttgatgatcttatccaaagcggcacggtgcctgaggacatcgcgcctgcgctccggaacatcatcaatcaacggcgctcgttccttgttgtcggtggcaccggcacagggaaaaccacattgctgtccgcgatgctcaccgaagttcccgctgatcaacgaatcatctgcatcgaggacaccgcagagcttcatcccggccatccaagcaccatcaacttggtgtctcgccaagcaaacgtcgagggcgccggcgccgtgagcatggcggatttgttgaaacaatcgctgcgcatgaggcctgaccggattgtcgtcggagagattcgcggtgcggaagtcgtggatcttttggctgcgatgaataccggacacgacggcggtgctggcaccattcacgcgaactccatctctgaagttcccgcgcgcatggaagctcttgcggcgaccggcggattggaccgcatggcattgcattctcaactcgcggccgcagtggacattgtgctggtcatgaaacacaccccttttggccgcaggctagctcaactcggggtgctccgcggaaatcctgtgaccacgcaggtggtgtgggatttggaccacggcatgcacgaagggagcgaagaggcatggtttatgccc

SEQ ID NO: 337 - DNA, 615 bp, Corynebacterium glutamicum
atgcaatgccatgcggtccaatccgccggtcgccgcaagagcttccatgcgcgcgggaacttcagagatggagttcgcgtgaatggtgccagcaccgccgtcgtgtccggtattcatcgcagccaaaagatccacgacttccgcaccgcgaatctctccgacgacaatccggtcaggcctcatgcgcagcgattgtttcaacaaatccgccatgctcacggcgccggcgccctcgacgtttgcttggcgagacaccaagttgatggtgcttggatggccgggatgaagctctgcggtgtcctcgatgcagatgattcgttgatcagcgggaacttcggtgagcatcgcggacagcaatgtggttttccctgtgccggtgccaccgacaacaaggaacgagcgccgttgattgatgatgttccggagcgcaggcgcgatgtcctcaggcaccgtgccgctttggataagatcatcaaggctcagccgtgcttgacgcagtactcgcacactgatgcacgtgccggattccgccaagggtgccaacaccgcgtgaatgcgcaacacgctgccgtcgtccctggtgattcggccatcagcgaaaggctgcgcatcatc

SEQ ID NO: 338 - DNA, 816 bp, Corynebacterium glutamicum
gtgggatttggaccacggcatgcacgaagggagcgaagaggcatggtttatgccctaggccttcttagcgtggcggtgttgatctctggttcaaggggccccggcgcgcgtaccaggccaccaacacctgggaatggcgtccatctattcgccctaattgcactattttgcctggccacagtgctatttatcgtcgttgacgcctacacgatgatcgccggcatcatcatcgccacaactctattctggtatctccgccagacacacgccgcagcccaacgcaccaaacaatccctccaattagccagcttcttaagcctctgcgcaggcaatttacgcgccggggtcaccatggtcgacgccatggactacgcgctcgacaacaccacgccggacaaattcttaagccccacgttgcagaccgcagccaggcaggcgcgctcgggcggcagcgggccgcgagtgcttatcgacgcctccctccccgatcttcaacgcctcggccatttgtgggaaacatcagaacgacacggcatcccgctggtcgccctcattgatcaaatgaggtcccggatttcatcgaagcaacgccacggcgaatccacccgagctgcactccaaggaccgcaagcaaccgcagtgatccttaccgtgttgccactagcaggaatgctcatgggcacagccatgggagcaaacccccttgggctactcaccggtggtgggatcggtgggttcctgcttgtcatcggtgtgggcctcgatgctgcagggtttgtgctcacccacaaaattctccagagcgcgagcccctca

SEQ ID NO: 339 - DNA, 546 bp, Corynebacterium glutamicum
gtggccatgttcctcggttcacccaaccctggagttcgcggtggattgataagccccaaatccggtaaaagcctgcgtatccgagctggcccaaaaaagctgggcaacgctgacccagtggatgtctctgcagatatcgaactgttttcagcgtgtttggatgcgggtttaaacacacgtgatgcagcgcaggtggtggctcatgttgcagccattacgcaccgcgaactgtggacacatgtggtggcattgctatcgattggagtgagtgcccctcaagcattcgccctgatggcaggagttgatgggctggatgaactagccaatttagccaccgtgtcgcacaggtcgggcagtgcattaagtgatgggtgcaggaacatttccacctcgttgttggcctctgctggtgacaagcgcaccgccgcagcagaacgcgcaggagtgttcatcgccctgccacttgctctgtgtttcctccccgcattcatgattgtcgggcttgcaccagtggtgctcagcttgggtacgcaacttatcaatttc

SEQ ID NO: 340 - DNA, 198 bp, Corynebacterium glutamicum
atgtccaacaatctcgaactacttcgacttcgcactcgcgccattcttgctcaagacgatggcctcaccaccgttgaatacgccttgggaactttagctgccgcagctttggccgctgttttatacatggtggtcaacagcgacgccgtgtcctcggcgttcgaatcaattatcagcgatgccttgagcgcacgaccg

SEQ ID NO: 341 - DNA, 318 bp, Corynebacterium glutamicum
atgagaacaaaacagcagcgtgaaccaccggaactgtgcagcgacgatggctctgtcagtatcgaagcagctctcgcattgtcatcgctggtgatcgtgtgcgggttgatcattgcagcaatggccaccttggcggcgtatcttgcagctgttgatgctgccggcgctgctgccagggcgcatgccattggggagagcttcgaaccggcacgaggacacgtcgatatgcatgaagcagggggaatgctcaccgcaacagccactatcccggcaccgattgggcaggtgagcgcgagtgcggtgttcccggtggaaaac

SEQ ID NO: 342 - DNA, 414 bp, Corynebacterium glutamicum
gtggctgttgcggtgagcattccccctgcttcatgcatatcgacgtgtcctcgtgccggttcgaagctctccccaatggcatgcgccctggcagcagcgccggcagcatcaacagctgcaagatacgccgccaaggtggccattgctgcaatgatcaacccgcacacgatcaccagcgatgacaatgcgagagctgcttcgatactgacagagccatcgtcgctgcacagttccggtggttcacgctgctgttttgttctcatcggttacggtcgtgcgctcaaggcatcgctgataattgattcgaacgccgaggacacggcgtcgctgttgaccaccatgtataaaacagcggccaaagctgcggcagctaaagttcccaaggcgtattcaacggtggtgaggccatcgtct

SEQ ID NO: 343 - DNA, 345 bp, Corynebacterium glutamicum
gtgcggtgttcccggtggaaaactagctgtgcaaatgacgaaggctacatgaccatcgccagcgctggtgtcgcctccatcctcattagcctgctggtggtgctggcctggcaggcgggaaacctcgtggccagggaacaagcacaggtagcggccgatgtttcagctgttgccggagcctacgcctttgcccgcggggaactacccgacgctgcctgcgccaccgcgaaacacacagccgaagcaaacaacgcacaactagaaaactgcgcaacagaaggggaggatctcacgctcaccgtcaccgttcgtggacaagaagcccacgcaaaagcaggaccttta

SEQ ID NO: 344 - DNA, 2355 bp, Corynebacterium glutamicum
atgaggcccagctttggtgaagagctggccgcaatcgtttccaaacgttactccgaatcgacgctcactcatatggtgacgttgcccgcatcgaaagctaaatacgtcgattggccgagttgggtacctgctagcctgcgcgatgcgttggtgaatcgtggtatcaataagctcttttcccaccaggagcagaccgcacatctggcgtggaatggccagcatgtggtggttgccaccggtacatcttcgggaaaatctttgggttatcagctgcccattttgtcagcgctcggcacggatcctaccgcctgtgcgttgtatctaactcccaccaaggctttgggatctgatcagctaacctccacgtccacgttgctgcgcgacattccggatttccacccgattaatccggcgccctacgatggcgataccccctccgaggcgcggtccggcatccgcgatttgagtcgttttgtgttcaccaatccggatatggtgcatgcgtcgatgctggcgaatcatccccgctgggccaggttgttgcgccatttgaagttcatcgtgattgatgaatgccatgcctaccgtggtgtgtttggcgcgaacgtgtcgatggtgcttcgtcgtctactgcgcatcgccgcgttttatggatcccacccgacggtcattttggcgtccgcgaccagctccgatccggaaattcatgcttccagattgttgggcgcgccggttaaagcagtgacggaagatggcgccccgacgggtgaacgcaccgttttgctgtgggagcccggtttcatcgaaggcgccgagggcgagaacggcgcgccggtgcgtcgcgcagccagcaccgaagcagcaaacattatggccacgctcatttccgagggtgcacgcacgttgacgttcgtccgttcacgtcgacaagcagaaatcgttgccctgcgcgcgcaggaagagctcagcacgctgggccgccccgatttcgcccggcgcgtcgcgtcctaccgggcggggtacttggcggaggaccgccgtaggttggagagattgcttgacgacggcaccctcctcggtgttgcttccaccaatgcgcttgaactgggcattgatgtcggtggactggatgctgtggtcacggctggttttccaggaactgtggcgtcgttttggcagcaggcggggcgagctggtcggcgtgggcagggttcgttggtggtgcttgttgctcgtgatgagccgatggatacgtatttggtgcatcatccggcagccctgttggagaagccggttgaggctgcggtgtttgatccgacgaatccgcatgttattcggggtcatgtttattgcgctgcggtggaaaagcctctgacagaggcggaggtcgcggcgtttggtgcccaaaaggtggtggagaagctcgagattgaagggctgttgcgcaagcgtccgcgtggctggtttgcggtggaaaagcccatgtcagaggatccggatgagctgagtcctgattcggcacaccagcaggtgagtttgcgtggtgggtctggttcggagttcatgattgttgatatcactgacggccggttgttaggcaccatcgattccgcgaaggcgatgtcgcagactcatcccggcgcggtgtatctccaccagggtgaatcctttgtcattgatgagttggatttggaggagaatctggcactggccaggcctgagctgcctgattacaccacctatgccagaagtgacacggacatcaggattacctctgccccgttggaggacgaggtttttgatgctggtggtggtttgtgggtcgccaacgtagaggtgcaggtcaccgaccgtgtgactggctatgtcacccgccttagtgatggcaccacgttggatgcgactccgttgtatcttcctcctcaaattcttcagactcgtgcggtggcgtacacgattgatccgttggcgttggaagcgatgggcattcccgccgctgatattcccggtgctcttcacgcagcggagcatgcggcgattggtatgttgccgctgcttgcgacgtgtgatcgttgggatatcggcggcgtatccacggcacttcatgcggatacgggctaccccactgtgtttgtctatgacggtatggacggcggagctggttttgcggatactggttttcgacgtttcgcccagtggattgaggccacatttgaggtcgtccgcagctgtagctgtgaatctgggtgcccgagctgtgtgcagtccccgaaatgcggcaatggaaacaatccgttggataaggcaggtgccatcaagttactgggtgcgatggtgaccttgttgggaacctca

SEQ ID NO: 345 - DNA, 201 bp, Corynebacterium glutamicum
atggcacagggcactgttaagtggttcaacccagagaagggcttcggcttcatcgctccttccgacggatccgctgacgttttcgtccactactccgagatcgagggcaacggcttccgtaccctcgaggagaaccagctcgtcgagttcgaaatcggcgagggcgctaagggccttcaggctcaggctgttcgtgcaatc

SEQ ID NO: 346 - DNA, 225 bp, Corynebacterium glutamicum
atgcaattagattgcacgaacagcctgagcctgaaggcccttagcgccctcgccgatttcgaactcgacgagctggttctcctcgagggtacggaagccgttgccctcgatctcggagtagtggacgaaaacgtcagcggatccgtcggaaggagcgatgaagccgaagcccttctctgggttgaaccacttaacagtgccctgtgccatttgtcttacctttac

SEQ ID NO: 347 - DNA, 2988 bp, Corynebacterium glutamicum
gtggcagataccgcaggcaccacaggatcgaaaaagaagtacttggtgatcgtcgagtcggcgaccaaggctaaaaagattcagccttaccttggcaacgactacatcgtcgaggcctccgttggtcatattcgtgatctgccacgtggcgctgctgacatccctgcaaagtacaagaaggagccttgggctcgtcttggtgtggacaccgatcgcggtttcgcgccgctttatgtggtgagccccgataaaaagaagaaggtcgctgacctcaaggcgaagctcaagctcgttgatgagttgctgctggcaacagaccccgaccgtgagggcgaggcgattgcgtggcatttgcttgaggtgttgaagccgactgttcctgtgcgtcgcatggtgttcaatgagatcacgaagcctgccattttggctgcggcggaaaacactcgtgagctggatgagaacctggtggatgcgcaggaaactcgtcgtattctggaccgtttgtacggctatgaagtctctcctgtgctgtggaaaaaggtcatgccgaggttgtcggcgggccgtgtgcagtcggtggcaacccgtgtgattgttgagcgggagcgcgagcgcatggcgttcgtgtcggcggattattgggatctgtcggcggagtttaatgcgcgtgaaaacggcaaggcggattcggataacccgtcgtcgtttactgcgcgtttgtccacgattgatggaaaccgtgttgctcaaggccgtgattttaatgatcggggagagctgacctcggaggctgtcgtcgtcgataagcagcgtgctgaggcgttagccgaggctttggaaggccaggaaatggccgtcgttggggtcgaggaaaagccgtacacccgtcgcccttatgcgccgtttatgacctctacgctgcagcaagagtctggccgcaagctgcattacacttctgagcgcacgatgcgtattgcgcagcgcttgtatgaaaacggccatatcacttatatgcgtactgactcgacctcgttgtcggagcagggcatgaaggctgcgcgcgatcaggcgttggagctgtacggtgcggaatatgtttcgccgagcccacgtacctatgaccgcaaggtgaagaactcccaggaggcccacgaggcgattcgcccagctggtgaaacttttgcgaccccgggccagctgcatggccagttggatgcggaagaatttaagctctatgagctgatttggcagcgcactgtggcctcccagatggccgatgccaagggcacgtccatgaaggtcaccatcggtggcaccgcgaagaccggcgagaagactgagttcaacgcgaccggccgcacgctgactttccctggcttcctgcgcgcttacgtggaaaccacccgcaccgccgatggccgcgacgtagctgacaacgccgaaaagcgtctgccactgctgtctgagggcgatctgctcaaggttttgagcatcgaagccgatggtcacagcaccaatccacctgcgcgctacacagaggcgtcgctggtgaagaagatggaagatctgggcatcggccgtccttccacttatgcatcgatcattaagacgattcaggatcgaggctacgtttattcgcgtggcaatgcgctggtgccgtcctgggtcgcgttcgccgtggtcggattgcttgaagccaacttcacctcgctggtggattacgatttcacctcctccatggaagatgagctggacaacatcgccgcaggtcgcgagggccgcacggagtggctcaacggtttctacttcggcgatgccgaagcggatcagtccatggctgaatcagttgcccgccagggcggtttgaaggcgcttgtcgacgcgaacctggagcacatcgacgcgcgttcagtaaactcactcaagcttttcgacgacgccgaaggccgtgccgtgaacgttcgagtcggacgctacggtccgtacatcgagcgcatcgtgggcaccaccgcggaaggcgagccagaatttcagcgcgccaacctacctgaggaaaccacgcctgatgagctgaccctcgaggtcgctgagaagctcttcgctaccccacaaggtggacgtgaactgggcattaacccagcaaacggtcgcatggtggtggctaaggaaggccgctttggtccatacgtgatcgagcaggtcacggactcagagcgcgctggcgccgaagcccaagcagaagaagtcgttgcagcggaacgaaaagctgaagacgaacaacgtgccaccgatggaatgcgacccaagaactgggaaaccaagactgccgcaaaccagaaggaaaagcgcatcaaccagctggttgaggaaaacctcaagccagcgaccgcatccctgttcagcggcatggaacctgcaaccgtgaccctggaagaagccctcaagctgctgtccctgccacgcgaagtaggtgtcgatccttccgacaacgaagtgatcaccgctcaaaacggacgatacggcccttatctgaagaagggtagcgactcccgttccctcaacagcgaagagcagatcttcaccgtcactttggatgaggctcgccgcatctacgccgaaccaaagcgtcgtggacgcgccgctgctcagccaccactgaagcaacttggcgacaatgacgtttccggcaaaccaatgaccgtcaaggacggacgtttcggcccatacgtcaccgacggcaccaccaacgcgtcactgcgcaagggcgatgttccagagtccctgaccgatgcgcgtgccaacgagttactttccgagcgtcgtgccaaggaagcagcagatggcggagctcctgcgaagaagacgtccactaaaaagactgcagccaagaagaccacggctaaaaagacaacagctaagaaaaccgtgaggaaggctccgccgaaaaccaccaaaaacgtggtgaaggccggcgctaagaagaagtcc

SEQ ID NO: 348 - DNA, 711 bp, Corynebacterium glutamicum
atgctgaacgggttcgtgaccaaaacacgccaaggtgcatctgcgctggtgaaagccgtgtcgaaatcagggtccgaacccgagcgggccgccttcgtggcagcggctggtgcacatgtgtgcgccagcctaatgggggtttccaaagtaaagactctgagcaaacccaccctcatgccacttcttgcaggtagggtgctgcgttcttcctgtggttctttagaaaagggtctcgggttagttggccttgccagtggttgggtaggggatctagtgctgatgaagccggattcactgcctaaaggtgcggctggttttgccttcaatcacgccgcgtacatcgcattgttgctgcgcaggggagctaggccaagtgcggtgcgtgcaggaatccgggcagttcctctcctgggtgccgcaggttttgcagctatccgtgaacccaaaatgctccccatcgttcttggatacggaggcctgttagctaccacttccatgctggccgatgactctaaacttcacgattcttccaacctcgcgagctttggaatgggccacggtggcaacttattcttgatctctgatgcggtactttttgcccgtgagctcttccttgaggatggcactgttgctgcacaattcgcagatggagcagtgatgggaacgtatacaattgctcaacttttgctagtagatgggttgttttcggac

SEQ ID NO: 349 - DNA, 1041 bp, Corynebacterium glutamicum
gtgcgtccggttgctgcgtctgccctggcgcgtcgatttgaggattccacgctggaaccacctgtgagccagcgcttgcgtatgacgtggttgctgacgttgggcattccagtgatgggaattctgctgcttatttggggctactcgcagggcattttcggctctgatgcctccggaattatgcctgccatcgcagcgctcgcgtttgcatcgttggtcacgggttacctgggcaaccggcttgtggtgtcctctgtggtggatccgattcgggaacttcaggaggccatcaacagggttcgtcgtggtgaaaacgatgtgcaggttgatatttatgatggctctgagatcggtgtgcttcaggctggcttcaatgagatgatgcgtggcctgcgtgaacgtcagcgcgtccgtgaccttttcggtcgctacgtgggcgctgaagtggccaagcgtgcgctggaggaacgccccactctgggtggcgaggaccgtaaggttgccgtgttgtttgtcgatgtcatcggctccactacctttgccgtcaaccacactcctgaagaggttgtggaggcgctcaatgagttcttcgagcacgtcgtggaggttgtgcaccgcaacaagggtgttatcaacaagttccagggtgacgcggcgttggcgattttcggcgctcccctgcccctgtctgatgccaccggtcatgcgcttgcggctgcccgtgagctccgcgcagagctgaaagatctccagctcaaggccggaattggtgtggctgctggccatgtcgttgctggtcatatcggcggtcacgcgaggtttgagtacactgtgatcggcgacgcggtgaaccaggctgcgcgcctgacggagatcgcgaaaacgaccccaggccgcaccgtcaccaacgcttccacgctgcgtgaggccaacgaggcggagcaggctcgctggacgctcatgaagtccgtggagctgcgcggacgtagccagatgacgcagattgcgcggcctattcggccgacgttggcggataggtcc

SEQ ID NO: 350 - DNA, 1257 bp, Corynebacterium glutamicum
gtgactaattcgagtgtgtttgacagtctcgccggctccaaaacagtgtccaagacgcttttcgacgcggcctccagcgcgcgtgcccttgtccgcgcccgaaccacagaacgtgcccgcgcccgggcagaacaccaaaaccctgcaatgatccacgactccggctttgcccagtcatggctgtttacaggccctcccggatcgggacgttctgtggcagccaaggttttcgccgctacgctcgtatgttcgaatccggatgttgtgggctgtggacaatgcgaggattgccgcgccgccatgggaggcagccaccccgatattgaacacatcgtcccgcagcaattgtctatcggtgttgatgcagctagagaggtcatcaaagccgcagcggtcagtcctgttgcaggaaactggcgagtcgtcatcttcgaaaacgccgaccgactcaccatgcaagccgccaacgccttgctgaaaaccgtggaggaaccaaccgaaagcaccgtgatgattctgtgcgcacccaccacagacccccgcgacattgcgatcaccctccgctcccgctgcaggcacctctacattcccaccccctccatcgcggaagtcgcacgaatcctcgtagctgaaggcaacgtcagccaagcggatgcagaattagcggcggctgcctcaggcgctcacatcggcagggctcgatacttagcgcacaacaacgccgcccaacgcagacgcgccagcatcctcaacctggccgaattaatcttccacggtgatgtcgccttccgctccgtaaacaccttggtcaaaatggtggaaaccgaagccaaagacagcaacaaagaaaaagaagaagccgaactcgaagccgtaagaatctcactcggcatgggggccaaaggcaaaggtgtccacaaagcagtacgtggaggagcgggagatttcaaagcactcgaagaccaacaaaaactccgacgcacccgattcctccgcgacagcctcgacctcgcactcgtcgacctagccggcatctaccgcgatgccatcatcatttcctcccaagcccaagtcggactcacacaccccgatatggaaggcctctcccaagaactcgcaacaaaagtaagccaagaaggactcctggcatgcctcgacgcgatctccaaatgccgcgaatccttcggcttcaatgtacgacccatcgtggccatggacgccctggtaggacgcctgcgcaaagcctacaaagtgtcc

SEQ ID NO: 351 - DNA, 162 bp, Corynebacterium glutamicum
atgggtgggcggaggccgcgcaattttcgggttttactgcctggattccatttacgatggaacatttttgaagaatacctcgttgaatctagtgcaagttccagcgaaaaccttccaaaactgaccaagtttaagaagattcgctaccctatgaatcagttg

SEQ ID NO: 352 - DNA, 444 bp, Corynebacterium glutamicum
atgaagatcagaagtgcacgtgaaatcgcggagtggttcgttgcctggggagatgaactcgatgctgaagtctcccctttgaaattgcagaagctcctttattactcccagggtgagcatatagctgcaacagggcgaaaacttttctcggataagattctggcgtggcagcacggacctgtcactccgggcgtttattcagatacaaaatcatacggccgaaacccaattgatcctgatgagtttgtgtcagatgaatttaactgggatgactactcagatgtgtcagatgagcttgtaaccgtatggcgaaaatacggcatctattcggcgtgggcactgagggaaaaaactcacagtgaatcgccgtggctcgatgcctgggcacaagggcaaaatattgaaattacagatgctgcgctgaaagatttcttcttggtgcat

SEQ ID NO: 353 - DNA, 561 bp, Corynebacterium glutamicum
atgaaaactgcttctgatccgattgactggaatccgcagcgcatcgctgtttctggcgtgagtggtgtgggaaaaacgacgttgtgcaagcaaatcgctgcactttcaggattccctcgggtggagttggacagcctttatcatggggaaaattgggtgccgcgtgagactttcgttgcagaggtacaggatttcatcaaaggtccacagtgggtgatggagttgcagtatcggcaggttcgtccactcattgtggagcgggcggatacggtgctgtggttggattattcgacaccgaggcagatgtttcggttgattaagcgaactattccgagaagtttgtttaagacaaagctgtttaatgacaatatcgagccgcctctgtggacgatttttaaggatcctgaccatattgtgcggtggggttggcagactaggaactcgttgaagaaggtcacgccaaccttcgagggacggtttgctccgctgacagtggtgcgcctgagcagcccaaaagagacaaagcgctggttgagggcatatggggaaagcgtgaaactc

SEQ ID NO: 354 - DNA, 882 bp, Corynebacterium glutamicum
atggcagaaagttttatagaggtctcggcggggcatgcggatcggcggatagataagtttttgcgggcacagctaaagggcgtgcccgcgtcgttgattttccgtcaaatgcgtaaaggcgacattcgggtgaatggtcgtaaagtggatccgaattaccggttgcaagaaggcgaccgaattcgaatgtggcagatggatttgctggcagatttgccgccaccggtcgtcgataagcatatttttaaggctgtcgcagacagcgtgctttttgaggacgccgaattactggtgatcaataagccagctggaattcctgtgcacggtggcacggggcacggcggtggcgtgattgaggcgctgcggcagaagtttccgcaggaacgcgacctggaattggtgcatcgtttggatcgggacacctcaggtttgttgctggtttctaaaacgacatctgtgttgcgcgagttgcaggaaattttgcgagaccgcgaagaggagatttttcgggggtatttactcaaggtcgagggggcttggcctggcgatttgcgacaaattgatgtgccgttgaagcggacggagacaactgttgtgccacattcggatggtttgcgggcgcggacgtattttgaggttgtaaagcgtttgccgggtgcgaccttggtgaaggcgcagttggcgaccgggcggaaacatcagattcgggtccatgcgcagtatgcgggtcaccctattgttggcgatccacgatacgggtcgcgtgggggcagagctgcgacgatgcatttgcatgcggcggaattggtggcgcctcgtggggcggggaagcgtcagaaattcactgcaccgttgccgaaggagtggggtatgggacgggtc

SEQ ID NO: 355 - DNA, 1644 bp, Corynebacterium glutamicum
atgtctcaagagcggcctcaaatcggctcccgcctctctcgtgtcattgaacaagacggcctacaattccgcgatctcgacggcgacggcgtacttgcaccttatgaagattggcgtctaaccccagcagagcgtgccgctgacctggtgaaacgtatgaatgtggaagaaaaagcgggcctgatgatcatcggttcgcactaccccggatactcgcctttggcgccggagagtgaaggcaaagacgcggaaaagtgcgagcctttgctgaaccctgtcgatatgtggcgtgaggataacccgatcacgggtgttcctttcaccgagcctgtgctggcaacttcttccactgaaaatgccattaacctgcgcaatcagcgttacttaattgttcgtgacaacctgccagctcgtgggcttgctacttggaccaatgctgttcaggaagtcgcggagcgatcccgtttgggtattcctgttgcgtttgcgtcgaatcctcgtaaccacgtcgcgctcgttgcgcagttcggtgtgaacgagtccgcgggtgtgttctctgagtggcctggcgagctgggtcttgctgcgcttcgcgatgctgaactgatggagactttcggtaccgaggctgctaaagaatggcgtgccggtggtgtgcacaagctgtacggttacatggctgacctcgcttctgagcctcgttggtcccgcttcaacggtacttttggtgaggatccggagttgatctctgattacatcgctgctgttgtgcgtggtttgcagggccctgagctgtccaagaattccgtgtcgaccaccattaagcacttcccaggtggcggcgtgcgcctcgacggccacgatcctcacttccactggggtcagaccaatgagtacccaaccgaagatgcgctgggcaagtaccatctgcctcctttccaggcagctatcgacgctggctgcgcctcgatcatgccttactacgcacggccaatgaacaactccgccaaccagctcgatcagcagctgtggcaaaacccgaccacgcagttcgaagaggttgcgtttgcctacaaccgcaccttcattcaggatttgcttcgcgacgccatgggccaccgtgggtacgtcaactccgactccggcgtcatcgacgccatgatgtggggcgtggaggaactcagcgagccagaacgcttcgccgcagcagtgcgtgcaggcaccgacattttctccgacatggctaacccacgtcgactgctcgaagcagttgctgagggacaccttgatgagtcagagctgaatcagccagtccagcgactcctggaggaaatcttccagcttggtctgtttgagaacccatatgtctctgaagatgaagcagaaaagatcattggtgcgccagaggtttctgcattgggcaacaaagcacagcttgattccgtcaccttgctgcgtaacaaccccatccgtgctgccactggatcctgcagcaagcctgaagatctacccattggttactggccgtaccaagatcgacgaggttcaactacagctggaagcagccattcgcgcagaactcccaggggtaaccttggtgtcttccgagtcagaagcagatcttgcaatcgtgtgggctcgccc

SEQ ID NO: 356 - DNA, 1989 bp, Corynebacterium glutamicum
ttgaacaagacggcctacaattccgcgatctcgacggcgacggcgtacttgcaccttatgaagattggcgtctaaccccagcagagcgtgccgctgacctggtgaaacgtatgaatgtggaagaaaaagcgggcctgatgatcatcggttcgcactaccccggatactcgcctttggcgccggagagtgaaggcaaagacgcggaaaagtgcgagcctttgctgaaccctgtcgatatgtggcgtgaggataacccgatcacgggtgttcctttcaccgagcctgtgctggcaacttcttccactgaaaatgccattaacctgcgcaatcagcgttacttaattgttcgtgacaacctgccagctcgtgggcttgctacttggaccaatgctgttcaggaagtcgcggagcgatcccgtttgggtattcctgttgcgtttgcgtcgaatcctcgtaaccacgtcgcgctcgttgcgcagttcggtgtgaacgagtccgcgggtgtgttctctgagtggcctggcgagctgggtcttgctgcgcttcgcgatgctgaactgatggagactttcggtaccgaggctgctaaagaatggcgtgccggtggtgtgcacaagctgtacggttacatggctgacctcgcttctgagcctcgttggtcccgcttcaacggtacttttggtgaggatccggagttgatctctgattacatcgctgctgttgtgcgtggtttgcagggccctgagctgtccaagaattccgtgtcgaccaccattaagcacttcccaggtggcggcgtgcgcctcgacggccacgatcctcacttccactggggtcagaccaatgagtacccaaccgaagatgcgctgggcaagtaccatctgcctcctttccaggcagctatcgacgctggctgcgcctcgatcatgccttactacgcacggccaatgaacaactccgccaaccagctcgatcagcagctgtggcaaaacccgaccacgcagttcgaagaggttgcgtttgcctacaaccgcaccttcattcaggatttgcttcgcgacgccatgggccaccgtgggtacgtcaactccgactccggcgtcatcgacgccatgatgtggggcgtggaggaactcagcgagccagaacgcttcgccgcagcagtgcgtgcaggcaccgacattttctccgacatggctaacccacgtcgactgctcgaagcagttgctgagggacaccttgatgagtcagagctgaatcagccagtccagcgactcctggaggaaatcttccagcttggtctgtttgagaacccatatgtctctgaagatgaagcagaaaagatcattggtgcgccagaggtttctgcattgggcaacaaagcacagcttgattccgtcaccttgctgcgtaacaaccccatccgtgctgccactggatcctgcagcaagcctgaagatctacccattggttactggccgtaccaagatcgacgaggttcaactacagctggaagcagccattcgcgcagaactcccaggggtaaccttggtgtcttccgagtcagaagcagatcttgcaatcgtgtgggctcgccctgaaattgcactgtttgaagatgacctcgaaggtgtttccctctctgttgaccctcgtgccaatggtgtcgatgtggaacgcgttcaggctgtggaagctgcagtcccaaccatcttggctgtgaacttcaccaacccttgggtgctgtctgagatcgagcctggtgccgctgccgtggtgggcacttttgagatcaagccagagttccttctcaaggctttgactggtcaagagggaggaccaaagggcaagctgccattgactgttcctgcttccatgcaggcgattgctgattcccctcgcgatatcccaggcaagttcctcgatgagtcttacacctacgtggactccgcagggatggcctacaagtacggtcacggacttaatttc

SEQ ID NO: 357 - DNA, 1104 bp, Corynebacterium glutamicum
atgagcactgtagtgcctggaattgtcgcactgtccaagggtgcaccggtagaaaaagtaaacgttgttgtccctgatccaggtgctaacgatgtcatcgtcaagattcaggcctgcggtgtgtgccacaccgacttggcctaccgcgatggcgatatttcagatgagttcccttacctcctcggccacgaggcagcaggcattgttgaggaggtaggcgagtccgtcacccacgttgaggtcggcgatttcgtcatcttgaactggcgtgcagtgtgcggcgagtgccgtgcatgtaagaagggcgagccaaagtactgctttaacacccacaacgcctctaagaagatgaccctggaagacggcaccgagctgtccccagcactgggtattggcgcgttcttggaaaagaccctggtccacgaaggccagtgcaccaaggttaaccctgaggaagatccagcagcagctggccttctgggttgtggcatcatggcaggccttggcgctgcggtgaacaccggtgatattaagcgtggcgagtccgtagcagtcttcggccttggtggcgtgggcatggcagctattgctggcgccaagattgctggcgcttccaagatcattgctgttgatatcgatgagaagaagctggagtgggcgaaggaattcggcgcaacccacaccattaattcctctggtcttggtggcgaaggtgatgcctctgaggtcgtggcaaaggttcgtgagctcaccgatggtttcggcaccgatgtctccatcgatgcggtaggcatcatgccgacctggcagcaggcgttttactcccgtgaccatgcaggccgcatggtgatggtgggcgttccaaacctgacgtctcgcgtagatgttcctgcgattgatttttacggtcgcggtggatccgtgcgccctgcatggtacggcgactgcctgcctgagcgtgatttcccaacttatgtggatctgcacctgcagggtcgtttcccactggataagtttgtttctgagcgtattggtcttgatgatgttgaagaggctttcaacaccatgaaggctggcgacgtgctgcgttctgtggtggagatc

SEQ ID NO: 358 - DNA, 621 bp, Corynebacterium glutamicum
atgatgcctaccgcatcgatggagacatcggtgccgaaaccatcggtgagctcacgaacctttgccacgacctcagaggcatcaccttcgccaccaagaccagaggaattaatggtgtgggttgcgccgaattccttcgcccactccagcttcttctcatcgatatcaacagcaatgatcttggaagcgccagcaatcttggcgccagcaatagctgccatgcccacgccaccaaggccgaagactgctacggactcgccacgcttaatatcaccggtgttcaccgcagcgccaaggcctgccatgatgccacaacccagaaggccagctgctgctggatcttcctcagggttaaccttggtgcactggccttcgtggaccagggtcttttccaagaacgcgccaatacccagtgctggggacagctcggtgccgtcttccagggtcatcttcttagaggcgttgtgggtgttaaagcagtactttggctcgcccttcttacatgcacggcactcgccgcacactgcacgccagttcaagatgacgaaatcgccgacctcaacgtgggtgacggactcgcctacctcctcaacaatgcctgctgcctcgtggccgaggagg

SEQ ID NO: 359 - DNA, 537 bp, Corynebacterium glutamicum
gtgggaaatgatgatgaggttttcatcatcgatgcggcacacactgcagcacccatcatcgaggctgtcggtggacgtgctgtgaagggcattttgtgcacccacgcacacaatgaccacatcactgtcgcaccagagctatccaaggaatttgatgcaccaatcttcgtgcacccaggtgaccaaatgctgtgggaggaaacccacggaaacctgacccacgaggatttggcagatcagcagaagttccaaatcgctggaactgaactgatcgtgcttaatacccctggacactcacctggatccagctgcttctacctccctgaagcaaacgagctcttctctggagacactttgttccagggtgggccgggagcaactggccgtaagtacagctcctttgacaccatcattgagtccctcaagacctcaattttggatctaccagcggaaaccaccgtgcgcactggccatggtgatcacaccagtgtgggggctgaggctccacacttggaggaatggattaaacgcgggcac

SEQ ID NO: 360 - DNA, 669 bp, Corynebacterium glutamicum
atggatcttaaacttggtggccaagtcatacttgttgttggcggtgcaggaactattggttctgaagttgtaaaactcttaactgaagaaggcgcaaccgcggtagcggcgtcgagaagcacgcccttatctattgacgcttcggatgaagcgtccgtccgtgcgggcattgatcaggtgatcgcagaacatggtcgcctggatgggctggttgtttcttctgcacccgctgcgcaaacgctcagcgcggagacagcagatgatccggacactgtgttggctgctattgaaggcaaagccatcacgtttatgaaggctgcaaccgtggcgctcgagaagatgcgtgaggctggacatgggcgcatcgttgcactttccggcatgaactcatacaaaacattgagtactactgcgtcggcgcgaaatgctgcgctgaatgtcgtggtgaaaaatttggcggatcgtcacgcgggcaccggaattacagtaaatgcgattagcccgggattcgtggtagctgagccagacgctgaggtaaaccgcgcaaatggtgacaccacggtggaggaggtcgcggaggcgatcgcgtttttgttgtcgccgcgcaccgcatcaatttctggagagattatttcggtgggacataaggcgaagggcatcatccttcct

SEQ ID NO: 361 - DNA, 1230 bp, Corynebacterium glutamicum
atgggggtgtccgcgcttaacatgtctgacatggtggcgaacaaacgggcacagcgtaaagtctggctagcggtagctttatcggtctttacggtcgcgtggggtggcaatgaattcactcccttgctggtgttttaccgaggtgaagggttctttagcaacctgttcatcgaccttttgctggtgttttatgccatcggagtagcggtaggtttgctggcagctggtcctttatctgaccgctatggccgacgtgccgtcatgttgcctgcgccattgatcgcgatcttgggttccgcgttgattgcctcgggtgaagaaaccgccatcctgattgccattggtcgagtgctgtcgggaatttcggtgggcatggtgatgacagcgggaggttcctggattaaggagctttcatcgtcgcggtttgagccaggggtgaaaaccagtgctggtgcaaaacgcgcatcgatgtctttgaccggtggttttgcgctcggcccagcgcttgctggtgtgatggcacagtggctgccactacctggacagttggcatatgttttgcacattattctcactctgattttgttcccgttgcttattacagcgccggaaactcgtcaatcagcgcacctgaaaactaagggatcattctggtcagatgtgcttgtgccatctgcactagacaagcgattcttgtttgtggttgctccaattggaccgtgggttttcggtgcggccttcactgcctacgcagttttgccgtcgcagctgcgtgacatggtttctgcacccgttgcgtattctgcgctgatcgctttggttaccttaggttctggatttggtatccaacaattcggtcctcaaatcatgggcacctctaaaactcgcgggccgattttggccatgttcgtcacagtcatcggcatgatcggcgcggtgatcgtggtgatgaaccctcatccatggtgggcgctagttgtctgcatggccctcggtctgtcttatggcctgtgtatgttcatggggttggcggaaactcaaaacattgctccacctattgatatggcaggcctgacgggtattttctactgcctgacgtacgtaggtatggtctttccagccttgatgacctggttgaatcaatggctcagttacccgttcatgctgggctttggtgcggtgatggcaactatttgtctgatcattgtgagttttagtgcacgccgattc

SEQ ID NO: 362 - DNA, 933 bp, Corynebacterium glutamicum
atgcgcacagtagttaccggcggtgccggcttcatcggatcccatctcgttgaccttttgatcaaggaaggccacgaggtcgttgtgatcgataacctctcccgcggacgcctggagaatctctccgatgcggaagccaccggaaaactcacctttgtggaagccgatcttctcgacgttgatttcaacgagtttctaggaacccacaagcctgaggttattttccacctggcagcgcaaatcgatgtgcgccactctgttgtagatcctcttcacgacgccgaaaccaacattttgtccaccatccgcatcgctgacgctgcccgccagcacggtgttcgcaaggttgtctttacctcctcaggcggttccatttacggtgagccttcggaattcccagttgatgaaaccgtgccagtggatccacattccccttatgcggcatccaaggtgtccggtgaaatttacctgaacaccttccgccacctgtacggcttagactgttctcacatcgcaccggcaaatgtttacggcccacgccaagatccacacggtgaagcaggagttgtggccattttcgcgctgcgacttctgggaggcctggacaccaaggtattcggcgacggcggaaacacccgcgactacgtctacgtcggtgacgtagttcgtgctttctacctggcttctggggaaatcggtgggggagagcgcttcaacattggcacctctgtggaaacctctgaccgccagctgcacaccctcgtggccactgcggcaggttccaaagatgatcctgaatatgcacctgcacgtctcggcgatgtgccacgcagtgcactcagcttcggcaaggccaaagaggtgcttggttgggagcctgaggtgaacatcgaacaaggtgtggccaagactgtggagtacttccgcactcac

SEQ ID NO: 363 - DNA, 375 bp, Corynebacterium glutamicum
atgacgcagaccaccacccaaatcatcatccagatactgcttctcctggcaaccgcagcactggcactatatttcctccgaaaccgccgcaaagcccgcgccaaagcatgggtgaaaatcggcttcgtagtattcattttcgccgcagtatgggcagtgctccgccccgatgacctcacccaactagccaactttgtgggcgtggaccgcggcaccgacctaatgctttacgccctggttgtggcatttatgttcaccacgctgtccagttatgtgcgtttccgtgaacaagagctgcgttattccaagctggcccgcgctgtcgctttgcaaaatgtggtgctgccggaggattcccagggttctgaccccgct

SEQ ID NO: 364 - DNA, 759 bp, Corynebacterium glutamicum
gtggcacctaacaggaaaatcagccatcatgcactaggctctattcctatcatggatgcatcaaaaaacagcgactttaaagacacctggctagtcgtaccttgttataacgaggcaacagttatccgggaagttttagagaacgcactcaaaacattccctaatattgttgcggtcaacgatggctccccggacaactccgcggaagaaatccatgcggccggcgcacacctggtcaaccaccccgtgaacctcggacaaggtgccgcgatccaaaccggcatcgaatacgcccgcaagcaacccggtgcaaaatactttgtaactttcgacgccgacggccaacaccaagtgaaagacgttatccgcatggtggagcgactgcgtgccgaggacgtggacattatcgtcggcacgcgttttggacgcccacgccaagccgatgaccaggtgccactaatcaagcgccttgtgctgcgcaccgtggtcctgctgtcaccgaaaacccgccgacttgggctcaccgacgcccacaacggcctgcgcgtattcaaccaaaaagtggcgcaggaaatgaacatccgcatgaacggcatgtcgcatgcatccgaaatcgtcgaccaaatcgatgaacgcggctggcgcatttcagaagaacccgtagacatcctctacaccgaatactccatgagcaaggggcaatccctgctcaacggcgtaaacatcctggccgacggcttcctagcgaggagactccca

SEQ ID NO: 365 - DNA, 1029 bp, Corynebacterium glutamicum
ttgattgtcatgaaatccattgatcttgagcagctggcgggcacgcaatcgcgcacgtatcaatcgcgaaagatcaccgatgagatggtcgcccggccggtgcatgtggcgatcgcgttgtgggaagtgccgtgggagtcggcaaaatccggcaagattgagggttgggtcattgccgtggattcgccgcgtgggcggtttgtgcgcagcgggcagaccaaaaatggcgacgccgtcaaccggactgtgtcgatgctgaaatcagcgttgaaaggggtccgcgggaaggcgtggattgtaactgggcgtcgacaagcagctttacgcgcagccctggtgcgcgaaaactacctggtcaccggaagcttcgccgagcaaaatagggccggcgtgaaggcgtcggcgatctcgcgccgcgccgaacaatccgcgctctacaaggcgaaaaaaatcggcgaattcgccgagcgcgccccacgcgtcaaagagcggcaagaggcacattggtggccacggttgtcacgcacgcaaggcaccgcaggcgttttacgcttagcgacggacgcctctaccgatggggtcttccgcggcgccatgtgcttcgtagcctcaaacggcgactacctcctggagacccaagacaccaccgcaagctccgacgaattagaactcgaaagcatcacccacgccctgatctacctcaaaaccatcggcgcgacccaagccatcatcgaatccgacagcaaagccgcacttgaagccatcgacttcatcctcaacaaccgaccgcgccggggcaggtggcgcggcatcaccgcatgcgcccgcaaccggttccgggatgcctgggaagcgcttatcgacgactgcgttgtggaattatcccgcgtactagggcacgccggggatccactgaaccaagcagccgaccaaatcgcatacatgggcatgcgcgccgtaatttttgaacaaaaatccgcacaccccacattgctcaaaggaattgacaaggcgcttcgcaaggccgag

SEQ ID NO: 366 - DNA, 1035 bp, Corynebacterium glutamicum
atgagcaacaaacgcatcggtgtagtgatcgtttcctacggacacgaacaagatgttgccaacctggtagacacatttgcagatcagctgaaaactggtgaccgcgtagttgtcgtggacaaccgcaaaccttgggtgttaaaagacgccgtgggggagcgcctggaaaaacacggcgcagagatcatcaaccacgacaacggtggtttcgccgctggctgcaacgtgggcgcagcgcacatcgtggatgacgttgacctgctgttcttcctcaaccccgacacagtgatcgacgatcccaccctgttcaattcgctgagacgcgtcgatgaacagtgggcagcattcatgccgtacctgctgcttcctgacagcaccattaactccgcaggcaacgccctgcatatttccggactgtcgtgggtgactggtctggatgaaaaaccagttgaaggctcatctgaagttaccgatatttccattgcctctggcgcctgccttgccgtgcgcgtggactggtggaaacgcctcggtggcatggaagaactgtatttcatgtaccacgaagacactgacttctccgcccgcttgctgctggccggcggtcgaattggtctcctgcattccgcgtatgtcacccaccattacgactacgccaagggtgactacaagtggatttacatcgaacgaaaccgacacgttttgctgctcagcgtgctgccgcttccattgctgttcgtgctgatcccgcagatcctcggtgtgaacctgggactgtgggcgattgccgcaaaggaaaagagggtcggactcaaggtgaagtcccttcgcctcctgatccgcgatctaccagcgattttcaaactgcgtaggagcacgcaggagcttgccgaactcacaccatcgcaatatctggcaaaaatggaatggcgcctagacaatcccaacctaggcaacattggatccaacaagattgttgcgactggatataagacctattacaagttgtgtatgagtatcctgaaattgctcgct

SEQ ID NO: 367 - DNA, 2082 bp, Corynebacterium glutamicum
atgaagaggctttcccgtgcagccctcgcagtggtcgccaccaccgcagttagcttcagcgcactcgcagttccagctttcgcagacgaagcaagcaatgttgagctcaacatcctcggtgtcaccgacttccacggacacatcgagcagaaggctgttaaagatgataagggagtaatcaccggttactcagaaatgggtgccagtggcgttgcctgctacgtcgacgctgaacgcgcggacaacccaaacacccgcttcatcaccgttggtgacaacattggtggatccccattcgtgtcctccatcctgaaggatgagccaaccttgcaagccctcagcgccatcggtgttgacgcatccgcactgggcaatcacgaattcgaccagggctactcagacctggtgaaccgcgtttccctcgacggctccggcagcgcaaagttcccatacctcggcgcaaacgttgaaggtggcaccccagcacctgcaaagtctgaaatcatcgagatggacggcgtcaagatcgcttacgtcggcgcagtaaccgaggagaccgcaaccttggtctccccagcaggcatcgaaggcatcaccttcaccggcgacatcgacgctatcaacgcagaagcagatcgcgtcattgaggcaggcgaagcagacgtagtcatcgcattgatccacgctgaagccgctccaaccgatctattctccaacaacgttgacgttgtattctccggacacacccacttcgactacgttgctgaaggcgaagcacgtggcgacaagcagccactcgttgtcatccagggccacgaatacggcaaggtcatctccgacgtggagatctcctacgaccgcgaagcaggcaagatcaccaacattgaggcgaagaatgtctctgctactgacgttgtggaaaactgtgagactccaaacacagcagtcgacgcaatcgttgcagctgctgttgaggccgctgaagaagcaggtaatgaagttgttgcaaccattgacaacggcttctaccgtggggcggatgaagagggtacgaccggctccaaccgtggtgttgagtcttccctgagcaacctcatcgcagaagctggactgtgggcagtcaacgacgcgaccatcctgaacgctgacatcggcatcatgaacgcaggcggcgtgcgtgcggacctcgaagcaggcgaagttaccttcgcagatgcatacgcaacccagaacttctccaacacctacggcgtacgtgaagtgtctggtgcgcagttcaaagaagcactggaacagcagtggaaggaaaccggcgaccgcccacgtctggcattgggactgtccagcaacgtccagtactcctacgacgagacccgcgaatacggcgaccgcatcacccacatcaccttcaacggtgagccaatggatatgaaggagacctaccgcgtcacaggatcatccttcctgctcgcaggtggcgactccttcactgcattcgctgaaggcggcccaatcgctgaaaccggcatggttgacattgacctgttcaacaactacatcgcagctcacccagatgcaccaattcgtgcaaatcagagctcagtaggcatcgccctttccggcccggcagttgcagaagacggaactttggtccctggtgaagagctgaccgtcgatctttcttccctctcctacaccggacctgaagctaagccaaccaccgttgaggtgaccgttggtactgagaagaagactgcggacgtcgataacaccatcgttcctcagtttgacagcaccggcaaggcaactgtcaccctgactgttcctgagggagctacctctgtcaagatcgcaactgacaatggcactacctttgaactgccagtaaccgtaaacggtgaaggcaacaatgatgacgatgatgataaggagcagcagtcctccggatcctccgacgccggttcccttgtagcagttctcggtgttcttggagcactcggtggcctggtggcgttcttcctgaactctgcgcagggcgcaccattcttggctcagcttcaggctatgtttgcgcagttcatg

SEQ ID NO: 368 - DNA, 162 bp, Corynebacterium glutamicum
atggatgctcaaggggcacgcagtaagcttgagaatcgtgttgttcgagtaaatcgagaaaccggaatgtacacctcatatgaagatgctgcgtgggtcatgcttgaaagtgcgacaactgacaaatacgaccgccagttagtcagtgttgcgacaaatgtc

SEQ ID NO: 369 - DNA, 351 bp, Corynebacterium glutamicum
atggaaacccccatcgatccccacatttacagcttgatgcaagaccgaaaagtagtgcgcaagaaaatagctctcatactgggaatttacatcatcgcagtcgccctactagcctacgcaatcagctttatctttgacgacggcacacgagctgtgcttggactcatacttgtagtcgcagctttcattgcaggaggtataaaatttaaagaattcatgaaaatagtagacaaatccaaccgtctcactgcggacattaaaacagcccaaaatagtaccgcttggaaagccttacaaaaacaacaagaagaacaacagagacttatcgctgaaatattccccgaacaacag

SEQ ID NO: 370 - DNA, 1059 bp, Corynebacterium glutamicum
gtgagtatctcagtaaaagcactacaaaagtccggcccagaagcacctttcgaggtcaagatcattgaacgccgtgacccacgcgcagatgatgtggttattgatatcaaagctgcgggcatctgccacagcgatatccacaccatccgcaacgaatggggcgaggcgcacttcccgctcaccgtcggccacgaaatcgcaggcgttgtctctgcggttggatccgatgtaaccaaatggaaagtcggcgaccgcgtgggcgtcggctgcctcgttaactcctgcggcgaatgcgaacagtgcgtcgcaggatttgaaaacaactgccttcgcggaaacgtcggaacctacaactctaacgacgtcgacggcaccatcacccaaggcggctacgctgaaaaggtagtggtcaacgaacgtttcctgtgcagcatcccagaggaacttaacttcgatgtcgcagcaccactgctgtgcgcaggcatcaccacctactccccaatcgctcgctggaacgttaaagaaggcgacaaagtagcagtcatgggcctcggcggactcggacacatgggtgtccagatcgctgcagccaagggtgctgaggttaccgttctgtcccgttccctgcgcaaggcagaacttgccaaggaactcggcgcagctcgcacgcttgcgacttctgatgaggatttcttcaccgaacacgccggtgaattcgacttcatcctcaacaccattagcgcatccatcccagtcgacaagtacctgagccttctcaagccacacggtgtcatggctgttgtcggtctgccaccagagaagcagccactgagcttcggtgcgctcatcggcggcggaaaagtcctcaccggatccaacattggcggcatccctgaaacccaggaaatgctcgacttctgtgcaaaacacggcctcggtgcgatgatcgaaactgtcggcgtcaacgatgttgatgcagcctacgaccgtgttgttgccggcgacgttcagttccgcgttgtcattgatactgcttcgtttgctgaggttgaggcggtt

SEQ ID NO: 371 - DNA, 855 bp, Corynebacterium glutamicum
gtgaaaggcatcatcctcgcaggtggctccggcacccggctctaccccatcaccaagggcatctccaagcaactgatgccgatttacgacaaacccatggtctactacccactgaccacgctcattcaggccggcatcaaagacatcctgattatcaccacccctgaagacagcgcctcctttgaacgcttgcttggcgacggctcctcctggggcatcaacctcacctacgccgtccaaccctcccccgacggactagcccaagcattcatcatcggcgaggaattcatcggtgacgacgacgtcgcgttggtgcttggcgataacatcttcgacggcgcacaacttggccacgcactaaagcagtgctccaaccccgacggtggcattgtctttgcttatgaggtctccgatcctgagcgttatggcgtggtggaatttgatgctgctaataaggcggtgtctattgaagaaaagcccaccgcgccaaaatccaactttgccgtggtaggactatatttctacgacaatcgcgtggtggacatcgccaagtcaatcaagccttcctcgcgtggcgaactggaaatcacctccgttaacgatgcctacctccagcaaggtgctttaactgtgcagcgcctggaccgtggcgatgtctggttagataccggcacaatcgattccatgtccgaggcgtcttcctatgttgaggtcctgcaaaaacgtaccggcaacatcatcggatcccccgaagtcgctgcgtaccgcgaaggtttcatcacagctgaagaactcacagtgcttggtgaggaactgaagaaatcaggctacggaaactacctgctgagagctttg

SEQ ID NO: 372 - DNA, 1359 bp, Corynebacterium glutamicum
atggaatacggtaaacaactcacctcccacaccaccgacatcgaaggcctactggttttcgatttccccgtccacggcgacaaccgcggctggttcaaggaaaattggcagcgcaccaagatgaccaacctggggctgcccgattttggccccgtccaaaacaacatgagtttcaacgccaccgccggcacgactcgcggcatgcacgctgagccgtgggataaatttgtgtccgtcgcggtgggttccgttttcggagcttgggtggatctgcgcgcgggctcgagcacgtacggtaacgtcgtaacgcaaaaaattacccctgacgtgggagtttacgtcccgcgtggtgtggcaaacggcttccaggcgctcgaggacggcacgctgtacacctacctcgtcaacgatcattggtcccccgacgcgcattacgccaacgtcaacctcaacatgatcgactggccgctgcccatcaccgagatctccgaaaaagataaaaaacatccagcgcttatcgacgccacccccctgcccgcccgcaaggttctcgtggtcggcgccggcggacaactgggaaccgcgctacgcgcgcagttcccagacgcggaatttgtcacgcgccaagaactcgatatcacctcagatctcaccgaggctcgcgcgtggaaacaatactccaccatcataaacgccgccgcctacactgccgttgaccaggcagaacacgaccgcgcagcagcgtgggacatcaacgcagcggcagtggctaacctcgcgaccatcgcgcgcgacaacaacctcaccctcgtgcacgtgtcctcagattatgtcttcgacggtgcggccgaatcctacgatgaaaacgcaccgttttccccactcggcgtgtacggccaatccaaagcagccggcgacatcgcagccaccaccgcaccgcgccactacattgtgcgcaccagctgggtgattggcgatggcaataattttgtccgcaccatgaaatccctcgacgaacgcggcatcgcaccatcagtagttgatgatcaaatcggccgcctatccttcaccgaagacatcgcagccggcatcgcgcaccttttggaagtgggtgcagcatatggcacctacaacctcaccaacaccggcgaacccgcaagctgggccgatgttgcccgcgcagtattttccgaccccaccaaagttaccggcgtgagcaccgccgagtacttcgccaacaaagacgcagcgccccgcccactgaactccgttttggatctcggcaaaatcgaagccaccggatttagcgcaccgacctggcagacccgcctcaacgactacctcaaggaactctcaaag

SEQ ID NO: 373 - DNA, 1131 bp, Corynebacterium glutamicum
ttgctaccggattccctaatgaacagccggagcaccctggtcgtttgcagaataggcgcatcgacaacagctactaactctgccagctcgcccggacgaactaaggtagacggcatgacttctttgcttgtgaccggaggtgccggatttatcggcgccaacttcgtccgccaaaccgtagagcagcaccctgaatacacccacatcacggtgctggataaactcacctacgcaggaaacgccgacaatctcaaaggcctccccgacagcaaagtaaccctcatcgaaggcgatatctgcgatgctgaattagtcgactccctggtcaaagaccacgacatcacagtccacttcgcagcagaatcccacaacgacaactccctcaacgacccctccccgtttgttcacactaacctcatcggcacctttgtcctgctagaagcagtccgcaagcacaacaaacgcttccaccacatctccaccgatgaagtcttcggcgatctagagctggatgatccaaaccgcttcactgaaaccaccgcctacaagccatcgtctccatattctgcaaccaaggcagggtctgatcacttggtacacgcatggatccgctccttcggaatccaggcaaccatgtctaactgctccaacaattacggtccctaccagcacattgaaaagttcatcccccgccagatcaccaatattctggccggcctgacaccaaaactttatggaaccggcgagcaggtccgcgactggatccacgtcgatgatcacaatgacgccgtccacctgatcctgagtaagggcaagatcggcgaaacctacatcatcggcgccgacaacgatcatgtgaataacaagcaggtcatcgagcttatttgtgaactcatgggcctcgacaaaaacgcatacgagcacgtcgcagaccgccccggccacgatatgcgttacgccatggattccaccaagctgcgcaccgagctcggctgggcacctaaatacaccgacgttgattccggcatgcgcaaaggcctagagcagaccatcgattggtaccgcgaaaacgaggcctggtggcgccctgccaagaacaacgtcgaagctacctacgctaagcagggacaa

SEQ ID NO: 374 - DNA, 579 bp, Corynebacterium glutamicum
atgtcactttcagtcgtcgaggcgattaccaaccgccgcgccacccgcaaatacaccgatgaagctcctacccctgagctgatcgacaaaatcgttgaccttgccctggaggcacccagtgcgttcaatgcgcagcaacgtgaaattgttgtgattactgatcccgcacagaagcagaagctttacgaggcctcccatcagaaacaattcctcaccgcacctgtaactttcattgcggttgcccgcgtggaaaacgagcctgaggatttggaagagattcttggtacggaaagggctgaacgtgtcgcgggattcatcaacggtcgcagcattcagcaggcacgcgaagcaacgttgagggatgccagcctcgcggcggcttttctaattctggctgcccaggcggagggtttgagtaccagcccgactactggttgggatgaggaaaaagtgaaggaagcaatcggtctcggcgggcgtgaggatcgtgcaatcgcccttgttattgctaccggattccctaatgaacagccggagcaccctggtcgtttgcagaataggcgcatcgacaacagctac

SEQ ID NO: 375 - DNA, 945 bp, Corynebacterium glutamicum
atgcatttttgtctcctgcctctggccaaacctgccaaagttgtggccccgctcctcggcgtcgcactccttctaagctcctgttcttcaacatcttccgatgaatcaatccaacctgaagttgccagcactggatattcagtggagcacgcaatgggcaccaccgaaatccctgaaaccccaacgcgtgtggtcgtcattgattccccacacctcgacgcacttttggctttgggaattactccagtcggagctacggaatctggatccgaaaatggtttccccgcctacttggctgacgagctaaaagacaccgaatctgttgggctgacatctgagccaaatttggaaaagatcgccgcactggatccggatttgatcattggcgcaaaggtccgccacgaggctatttatgatcagctttcagacatcgcaccaaccgtgatgtccgaaggttccggcacaaactggaatgaacaggcagaaatcactgcggcagcagtaaacaagtctgatgagatggacaaactgatctcagacttggacacccgtgccacagagcttggtgaagagatcggtgctgacggacaaaccgcttcaatggttcgattccgcacggacaacttcaggctctatggtcccgagaccttctctggttcagttctggaacaagttggatttgacctgggggaacgtgattggaatgagtactccatgatggagctatcctcagaaaactttgggcagatcgatggagaccttattttctacaccatcccaggatcccctgaagcaaccacttatccaaagatttccgaactgtgggttgattcaccagcagttcggcaaggtagaacttacgagtttgaagacgaaacctggatggtcggcatcggtgtattaggtgccaatgaaatcttggatgacctggaagaaactctgagc

SEQ ID NO: 376 - DNA, 639 bp, Corynebacterium glutamicum
gtgcttccaaacaggctattccttaggctcttcgcgctaatcgcactgatcggtgtagtaactggcggtattttgctgctaattaactcgcaaaacggtgagcagacatcatcttcaactcgcacaacagtcaatgactccatggtcatcagagctctccagcgcgaagaagaaatcgtccttctcagcgccggagcacttggaatccatgagaaaaccgttgaacgtacaattcgtggaaaacgtattcctggcacgcaaaagaccgtgcacgtccaatacagctacaccggaaaactcggaatcgatgcctcagatgttgaaatcaaatccgcaggtgacaataagctttccatcactatccctgagttcatcttcatcggatacgacgatctaaagtttaagaccatagccgaagatgacggttggatcagtttcagcactgacgatatcgatactgcagaagtagtttctgagatcatgagccaagagaacttcgtcgagcaagtaaccactaaccgggaaatgttggaagatcaagcggttgatttctacaacgacctgctccacgaattcaccgagaaactcgatacagatcgatacgaagacaccaagattgagctcgaattcgagtttgag

SEQ ID NO: 377 - DNA, 1308 bp, Corynebacterium glutamicum
gtggcagtcctggcttcgcgatctggagttgccggagtttccttctggtggtttggactagtgcgctatctgacgctggccacaatcatcgcaggtctctccgggttcgtcgtcatcatcatcgctgcctgggcccttggtgattccagccaactttccgaagaattcaccgcctactggggtctgttctttgcaggaaccggagtgctgactgggttgacgcaggagacgacccgcgcggtgacggccggttctcgtggtggttctcgtggtgggcgtgctggttctgttgttggatttaggccgtttttgtttagcttcgtggttgcggcgatagtgctcgtggtgcttggcgcttcggcgccgctgtggatcggccagcttttaagtaatttgcaaggtgttggtgttgggctacttgctgtaggtcttgctagctacgcgatccaagcgacaatctccggcattttgtccggctgccaattgtggaaagagtatgcctcgctgatttctttggacaccggcgtgcgcatggttttagctgttgccgcctggttgctgggttatcaattgctggcgttcttgatcatcaccgttgtgggatcaatatcctggctggtcatcgtgctgtgcttcggttcggtgcgttccgttttgggatcggttgctgatgtttcacggggcgttttcatccgacaggctctgcttgcgatggcagcatccggcgccacggcagtgctgattactggtttcccgaccctgctgaaattcacgaacccttcagcggttgcaggaggggtttcgatggccgctgtttcctacgccgtcatcctgacccgcgctcccctgctggttccgctgcagcaattccaatcggcgatcatcgttcgttttgtcaaaggtacgtccggtccattgaaaactttggcgggtccgttggcaattgtgtgggcagtcggacttgttggagctggtcttgcatggttagttggcccatggatcctggacgttgtactccaaaaggaactcttcgcggtccctggctggctactcgcgatgctcaccttaggcgccaccaccaccgcttcattgatggtgtccggctgcgcggcgatcgcctttgaacgtcacgggatctatctcaccggatgggttgttgccactgttgttgccgtcggattcttgctgggaccttttgatttgggcgtcgctgctggccttgcgctcattgttggcccactctgcggtttgctggtacacatgggagcgtttgttggtggggatcggaatcgggttttgactgcggga

SEQ ID NO: 378 - DNA, 1380 bp, Corynebacterium glutamicum
atgattatgcgaaggctgcgctccaccccggtccctggtacacgcgattcctacacaggaattgatttcaacttaggcttccacatccgacgctacgagcttgatctcacctaccgcgtagcacccaacctgctcatgggcaccgcaacgctgcacatggataattaccgtgcgctcgacgcgctgaccctggacctcggcggcagcctgcgcgtggaaaaagtcaccgccaaaggcaccgccggcacccacatccaagtcgcgcgcttccgccacgccggccgcaaactgcgcatcaccttccgcaaccaaatcccggttgaccaggaattttcactcaccatccgctaccgcggcaacccgcgccccctgcgcagcgaatggggcatgatcggctgggaagagctcgacaacggcgccctcgtcgccgcccagccaaacggcgcgccgagctggttcccctgcgacgacacgcccgacgagaaggcgcttttcgacgtccacttccacaccgacaacggatacgccgccattatcaccggtgatttaatctcaaaacacgtcagtggcagcatgaccacctggcactaccaatcccgcgaacccatggccacctacctcgcagccgtccacgtcggagaatacgacactgtatccctgggcgtttcggaatcgggcgttgtggtggaggcgtatgtgcctgtgggggatgcggccttgcgggctcggattttggaggactttgccaaacaagtcgacatgttagacgcctacgaaaaactcttcggcccctacccattccgcagctaccgcgtagtcatcaccgaagacgaactcgaaatcccactcgaagcccaaggcctctccagcttcggagccaaccacgccaccggcgaaggaacctgggaacgactcatcgcccacgaactctcccaccagtggtttggcaactcactcggcctcgcccaatggaacgacatctggctcaacgaaggcttcgcctgttacgcggaatggctctggtttgaggcagctggagttaagtcggctgcggaaagtgcgttggaattctatcgaggcctggaggcgctgccgaaggatattttgctggccaaccccggcgcgaaggatatgttcgacgaccgcgtctacaagcgcggcgctctgactgtccatgcattgcgggaattgcttggcgatgatgcattcttcaaagctgtgcgctcctacgttgccgaaggccgacacggactcgttgaaccccgcgacctgaaacgacacctctacgcagtctccacagaccacgcagctttagatgcagtgtggcagtcctggcttcgcgatctggagttgccggagtttccttctggtggtttggac

SEQ ID NO: 379 - DNA, 2118 bp, Corynebacterium glutamicum
ttgaaaacggccggtactactcggttcacgtttacgtcggctgatccaattggaggcgccctcggaagccgccttaaaaaacctgccggtcaaaagatcactaacctgaacttcatgactgattacacgttcctcgaagacattgacaccccggaagcgctcgcgtgggcggaaaaatggtcgggggaaagcgtcgaaaagctaaaaagcccagccaaggacgccctggaagccaggctgctggctgcgttggacaccgatgatcgcattgcctacgtgagccggcgcggtgagaagctgtacaacttttggcgggacgcgcagcatccgcgtggagtgtggcgcacgaccacgttggagtcgtatgaaagtgaccagccggagtgggacgtgctcattgatgtggatgcgttggcggaggatgagggcgaaaactgggtatggaagggcgcggttgtgcgctcgccggagtttgatcgggcgttggtgaagttctcgcggggcggggctgatgcgacggtgattagggagtttgatctggccacggctgctttcgtggatgattcgccgtttgaattggaggaggcgaagtccgatgtcacgtgggttgatctggatacgttgctggtgggcacggataccggcgaggggtcactgacggattctgggtacccggcgcgggtgctcacgtggaagcgtgggactccgcttgagcaggcggagttgttctttgaggggtcgcgtcaggatgtggcgactcatgcgtggcgggattcaacacctggttttgagcggacgtttgtgtcaaggtcgttggatttctataattcggagacgtcgctggaaaccgagggtggcctggtcaagcttgatgtgccgaccgattgcgatgtcattgtgaagaagcagtggatttttgtgagtcctcggacggatttcgctgggattccagcaggtggcttgggagtgctgctgttaaaggagttccttgagggcgggcgcgattttcagcctgtgtttacgcctactgagtcgacgtcgctgcagggattggccacgacaaagaatttcctggttttaacgctccttaataatgtctccacagaaatcgtcacagtgccgctcaatgatccgacaacggagcatgaacacattgacctcccagagcatgtcaccgcgcatgtggttgctacctccccgttggatggcgatgaaatttgggtgcaggcagcgagtttcaccgaagcgccaacgttgctgcgtgcggagctgcctggtgcgcttgaggctgtgaagaaggcgccgttgcagtttgaaaatgctggtcaggagactcgtcagcattgggcaacctcggcggatggaacgaagattccgtactttattacaggagccttcgaggaggaaccacaaaacaccctggtccacgcctacggcggcttcgaggtttcccttaccccaagccactccccgacccgcggcatcgcatggttggaaaagggctactactttgtggaagccaacctgcgtggtggcggtgaattcggtccggaatggcattcgcaggcaaccaagctgaaccgcatgaaggtgtgggaggatcaccgcgcggtgctcgccgaccttgtggagcgcggctacgcaacgccggagcagattgcgattcgtggcggatccaacggtggtttgctgacaagtggcgcgttaactcagtacccagaagcattcggtgcggcagttgtgcaggtgccgttggctgatatgttgcgctatcacacctggtcagcgggtgcttcgtggatggcggagtacggcaaccctgacgatccggaggaacgggcggtgattgagcagtactcgccggtgcaggcggtggtgggcgtcgagaagcgaatttatccacccgcattggtgacgacctcaacccgggacgaccgcgtccaccccgcgcacgcgcgcctttttgctcaagctttgcttgatgcgggccaggccgtggattactacgaaaacaccgagggcggccatgccggcgcggcggataacaagcagaccgcgtttgtggaatcgctgatctacacctggatcgagaagactttggatcagcagggtagcatt

SEQ ID NO: 380 - DNA, 573 bp, Corynebacterium glutamicum
ttgacagctcgtgcaaagatgattggcatgcgtaaaaccctcatcaccatgctcgcgaccaccgcgatcgccttttccgccatctcaccagtgcaggcgcaaaccgtggacacagacactgacgcctccgtgtcatctgagctgagcagcggcacaagctcaggaagttcagaggattccgaagattctgacatctccaaccgggacatcatcttcggcatcgcagctatcgctgcagtcggcggacttatcgcaagtggtgtgcactgggcagtacaacagcgcatgatcccaaatcccctcccaggaatcattccaaatccccctgcactggcacctcaggcgcctgccccagcacctgctcccgctcctgcccctcaggcagtcgcgccccaggttgtcgctccccaggttgtcgcgcctgctccagccccagtacagaccaaccgcacctacaaaaactgcaccgaagtatggaacgtcctgggaaggtccatccgccaaagcgatccaggctacggcacacacctcgaccgcgaccgcgacggcatcggctgcgaatcacgccctagg

SEQ ID NO: 381 - DNA, 1092 bp, Corynebacterium glutamicum
gtggctgaaataaccaccccattaatggaaaaaattcgctcacccgcagtccaatcagatgcactgcaggtttttaaatcagcacttgctgcgacagtcacgtggtggatttcggttaacctccttaactcccaactaccctttttagctccctgggtagcgttaatgacgatgcaattcaccgtctaccacacctttatcagtggaattcagactgcaattgcttctgtcatcggagttggactttcctttgtcataggcacttacttagacgtcagtgtgtggacttttggccttgcaatggtcataggattaataggtgcacgagtaccaaagctccgcgcggaaggaataggtattgctactacatccatttttcttcttgcctccgggtttgatgatcaacaaccccttctatacgaccgtattttagagatcctgctcggcgtggctgttgccatagccatcaacctcatcatctttcctcccttacgcgaccaggaggcaaacatggtggtaggaaacttagatcggaggatgggtgaggttttacaaaaaatggccgatgagcttgcagaaaagtggaatatcgacaatgcagatgagtggctggaagaaattaattctattaacaatgacctagaaaaagcgtggcactccgtgcggttcgctcgcgaaagccgtcgagttaatcctcgtaaaatccgcatccaagagggccgcccccagcctacggaaacaagttatgaatcaaacctcaccagcattgatgaagggatcgctcatttacgccaccttgcccgtactcttcgtgataccccgattatagattccgactgggatccagtattccagcaacagtgggtatcccttatgcacgatgccggagctttgctcgcagatccgaatcaggaaatagatcctatccgcgaccggctctctaaactttcaagtgagatgagtgaggatcaacaattaacttcaaagaagtggcctatctatggttctctcctcaccagtttgtttcacctttctgcgcttgccgatgatgctctgaccaccagaaaaacggaagataaagagcataatagt

SEQ ID NO: 382 - DNA, 1095 bp, Corynebacterium glutamicum
atgaagcttcttcgccgcatcgctgcaccagccatcgcgctgggaattgcgatgtccaccattgtcacgccatccaccgcaggcgctgccgaagtaaccccagcagacgttgctggcgatactgcactatccaccatctccgatagtgctcctgcagatgaagcctctgcacctcgctggcgcgcacacgtcaacgcagcagacgagcgcgtcaaagaaatgtgggcatactccccttccatggaccgcaatgtgccactggtagttataactgccgatgagtccgcaggtcctcgtcctgtgatttaccttcttaacggtggcgacggtggcgaaggtgccgctaactgggttatgcagactgacgttctggatttctacctagaaaagaacgttaacgttgttattccaatggaaggcaagttttcctactacaccgactgggtagaagagaatgcgtccctcggtggcaagcaaatgtgggaaaccttcctggtgaaggaacttccaggaccattggaagaaaagctcaacactgacggtcagcgtgcaattgctggcatgtccatgtccgcaactacttccctactcttcccacaacacttcccaggcttctacgacgcagcagcatccttctcaggatgcgcagcaacctcaagcctgctcccatgggaatacctcaaactcacccttgaccgcggcaacgcaaccccagaacaaatgtggggaccacgtggtggcgaatacaacatctacaacgacgcactgatcaactccgacaaactacgcggaaccgaactatacgtctccaacgcatccggccttgctggtgaatgggaatccgtcgacagcccacgcttcgaaggactcaaccaacaagttcagtccatcgcaatggcagaaactgtggtaaccggcggcatcatcgaagctgcaaccaacaagtgcacccacgacctcaaggcaaaacttgactccgccggcatcccagccgactggaacctccgcccaaccggcacccactcatggggctggtggcaagatgacctccgcggatcttggaccaccttcgctcgtgcgtttgagctagaggcc

SEQ ID NO: 383 - DNA, 1434 bp, Corynebacterium glutamicum
atggaattaagggaatacgcgacaatcctgatgaagaattgggtgttgatcgttatcgcatccattcttggaattgcagcgggcgctggtttttcccttctagctacaccggagtatcagtcacgtactcagttgtatgtatcggtgcggtcgggggctgggacaacctctgacatggttcagggtgctaacttttcgcgtcagattgtgaatagttatgttgatgtcattaagacgggtgttgttctagagccggttgttgatgagcttggtctggagttgacggctaaccagttgagttctcatatcagtgcggcttctcctgctgatactgcgttgatcaacatcactgcttctagtccttctcctcagcaggcggctgagatcgccaatgcagtgggggagagtttcaagaatgtgattcagactgaattggaaccagactccggcgatggcatgagcccgattaacctgactactactcaggtggctctggaaccatcttctccggtcagtcctaatgtgatgatgaatatcctcctcggcctacttgtaggtcttgcaataggtgttggtattgcagtgcttcgcgcggctttggatactcgtattcattccttgcgcgatattgaagaggttactgataagccacttttgggcggaatcattgcggattctgaagttgagaagcacccgttgatcattaagcacaagccgcatagtcctattgcggagtcctttcgtgcgttacgtactaacctgcagttccttaacgtcggcggctcatcttcagtatttgttatctcctctgctaatcctggtgagggtaagtcaaccacttctgtaaacctagctttggcgcttgcagaggccggctcccgtgtagcgctgatcgaagctgatcttcgcttgccacgagtgagcaagtacctcggagttgagggcaacgcaggtctgactgacattctcattggcaaggccgaggttaatgatgtgttgcagcgttggggtaggactcagttgtactatctcccggcagggcgcattccgccgaacccgagtgagttgcttggttcagctgagatggaaaaggtcattgcggagcttgaggaaagctttgattatgtgatcatcgatgcccctccggcgttggcggttaccgatgctgcagttattggtcatggcaaggctggcatcctgattgcggtctccgcaggttctacaaagaagcctgagttggaagctacgctgtccacgcttgagaatgcggatgccaatgttgttggcgttgtcgctacgatgctcccgcctaagtctgtggctggttatggctacggaaattacggctacggcgacacctccaaaatcaatgcccctaagcccgacaacaccgaactaaccaccaccgatgcttccaaggccaacaatgagcaa

SEQ ID NO: 384 - DNA, 603 bp, Corynebacterium glutamicum
atgagcaatagcttcactattctcactgtctgtactggaaacatttgccgctccccgttagctaagcagctacttgaacttgagcttccgggggcagatataatccgcgttgattccgccggtgttcaggcgatggttgattcgcctatgccggagcaatctttagaaatcgcacgtaaacagggcatagaaaaccctgaggagcaccgagctaagcagattactgaggagcttgtaaaccaatctgatctgattcttgcgatggatcgggggcatcgaaaatccattgtccagctaagcccgcgtgcaacccgtaaggttttcactgttgttgatcttgccaggttaattgaggcaacaactgatgctgatctgcaggaagagctcaatctggcaggggattccgtgatcgataggctgcatgcgacagttgaggctgctcgtcttagccgcagtgaattgaatcctctggataacctcgcagatgaagatattgttgacccgtacggaaagagtcaatcggtttatgaggcatcggcgagtcagctaattccagctattcgtttgattgcttcttatttgaacaaagcactggagtctgcg

SEQ ID NO: 385 - DNA, 984 bp, Corynebacterium glutamicum
atggcgaggaagtatcgggtgggtcaacgccaacgtggttggtctatatggttaagcattcttgttattgtcgtgcttttggttggggctggagcgctttcggtttttgcccttaaaagcgtaaaagaaaacgataaaaacgaaggcttttcgacgactaaagctgcctccgtagagcaaataagctctgaaacttccgaagaaagccccgaggaagcaccggcagagatttcagagtcggaagaaatctctgctgagcaggcctcgttgccactcgtggcgccacagcggcagattgcacaatttgaaaatctagctgtgcgatcccaagttggtacgtgcactgatcctggaacactcgaaatctccactgatggtggacaagcttggtccacatcagcgtcatttacagcaaccacggcgacacaagtgcttcgcttgattccggtgagcacttcaaacatctttgttgttgcactgaatgctgattgcgagccacggatttacggaacaactgatcaaggtgcaacgtggcaacaaccagtttcagcagtaggaacctggtacttagatccttctaacccaacgcagctaacggctcccggtggggctaaagcaattagctgtgaggcaatctcgatcgccccaagaactgacagcaacgttgatgtgctgtgtgcagatggatcgctgacttccacctctgatggaggagcaagctggtcagagcccgttgcgggtgctggtgtatttaatgtcgcgcactcaaatggtgattggttgctgatcgctcaagaccctgatcaatgcacaggaatccaactaagtgacactcttcctgttgctgagggagctacatgcgtgcatgctgaactcggtgaatccgatgccggacagatcgcagcaactcaatttggagattcagttttagcctgggttggcgaaacccaatttatttcaaaagatggtggacaaacatggcaa

SEQ ID NO: 386 - DNA, 1812 bp, Corynebacterium glutamicum
atggcaataagcattggtaaagcaggacagaacttaaaagggtcagtgcctatcggaaaagtcctttttctcattgatgcccttgcctggatttctgcactatttatcggtgtggttttgcggtatgaattcaatctgagttctatcaactggagtgcgtttgcatggttcgggcttgctgcagttattttgcagtttgttctcggactttctctccatctttaccgcaagggattacgtcaccttttcggtagcttcgaagatacactaaacgtttctatctcggtcattgttgtcggtgttgtcctttggatcgcctcactatttgttggtcagcgttgggaaatctcacgcggtgtcatgctgctagttatcccgcttgctctcgtattcgtattggcagtgcgttatctcgcgcgtatgcgagttgagcgtcttcgtcgtccggctgcggattccacaccagcattgattcttggtggtggatacatcggtaccaacctgatccagtggatgatgtccgatcctaagtcgcctttccgcccagtcggcgttattgatgataaccctgaattagcatggcaacgcgtacgtggtgtgccggttcttggcaagtttgatgatatcgcccaagttgcatcagacactggcgcagaacttcttatcgttgctattggtgatgccgactctgcacttttaaggcgtgtccaagataccgctaataaaaatggtctttcagtaaaggtaatgccggctattgaccgcgtcgtttctaagggcgttcgtggaaacgatttgcgtgatctctctattgaagatttgcttggacgtcaacctgttgaaaccaatgtttcagaaattactggctatctaacaggtaagcgtgttcttgttaccggtgcaggtgggtcaattggttcccagctatgtacggaaattgccaaatacggacctgctgagcttatgatgcttgatcgcgatgagactggtttgcagcaggttctgattaacgttgctggtaacggtttgttggatacggatgctgtggttcttgcggatatccgcgaagcagacgcgatgaaagagatttttctcaagcgtaaaccagaagttgtcttccatgcagcagcattaaagcacttgccaatgctggagcagtatccagatgagggctggaaaacaaacgttctaggaactcttaacgttcttgctgccgcagaagctgttggtgttgagactttcgtcaatatttccaccgataaggcagctaatccaaccagcgtcttagggcactcaaagcgagtcgctgaaaagctgactgcctggtatggacagaattccaccagcaagtacctatcggttcgatttggaaacgtcattggtagccgtggatcgatgctcccgactttcaccaggctaatcatggaagataaaccgctaacagtgacgcacccggatgtcactaggttcttcatgacaattcctgaagcttgccaattggtcctgcaagccggtggtattggacgttccggcgaggttctcatccttgacatgggtgagcctgtaagcatccttgaaattgcacagcgcatgatcgcaatgtccggtaaagatattgacatcgtgttcaccggccttcgcgagggcgaaaagatgcacgaagagctggttggtgatggtgaaaccgaagatcgtccattccactcaaagatttcgcatgcacatgcagaaagcctcgctcctaataatctcgatagagatcgatttatgcaacgtgctggaaaactagcttcaacagattcggagatcatc

SEQ ID NO: 387 - DNA, 942 bp, Corynebacterium glutamicum
atgatctccgaatctgttgaagctagttttccagcacgttgcataaatcgatctctatcgagattattaggagcgaggctttctgcatgtgcatgcgaaatctttgagtggaatggacgatcttcggtttcaccatcaccaaccagctcttcgtgcatcttttcgccctcgcgaaggccggtgaacacgatgtcaatatctttaccggacattgcgatcatgcgctgtgcaatttcaaggatgcttacaggctcacccatgtcaaggatgagaacctcgccggaacgtccaataccaccggcttgcaggaccaattggcaagcttcaggaattgtcatgaagaacctagtgacatccgggtgcgtcactgttagcggtttatcttccatgattagcctggtgaaagtcgggagcatcgatccacggctaccaatgacgtttccaaatcgaaccgataggtacttgctggtggaattctgtccataccaggcagtcagcttttcagcgactcgctttgagtgccctaagacgctggttggattagctgccttatcggtggaaatattgacgaaagtctcaacaccaacagcttctgcggcagcaagaacgttaagagttcctagaacgtttgttttccagccctcatctggatactgctccagcattggcaagtgctttaatgctgctgcatggaagacaacttctggtttacgcttgagaaaaatctctttcatcgcgtctgcttcgcggatatccgcaagaaccacagcatccgtatccaacaaaccgttaccagcaacgttaatcagaacctgctgcaaaccagtctcatcgcgatcaagcatcataagctcagcaggtccgtatttggcaatttccgtacatagctgggaaccaattgacccacctgcaccggtaacaagaacacgcttacctgttaga

SEQ ID NO: 388 - DNA, 1155 bp, Corynebacterium glutamicum
atgactaatgaacgaatttttctatcatcgccagatgtaacacagttagaggaagacgcattggtacgcgcaatccgatcaggatggattgcaccgcttggtccagaagttgatgcgtttgagcaagaacttgctgagtattgtggccgcaaatatgttgttgcactttcatcgggtactgcagccctccacttaggtctattagcactaggcgttggagaaggagacttggttcttacatcatcaatgacttttgcagcgaccaccaacgcaattgtttatacgggtgctgagccaattttcgtggactgcgatgaatctggaaatatggatccagatcttttagaaaaagcctttgctgagctaaagagtgaaggaaaggaagtaaaggctgtagtacctgtcgatctacttggcaaagttgttcagcacgagaagattaaaaagattgctgatgaatacggggcagtagtgctttctgatgccgctgaatccttgggcgccattcgcaatggaaagtctgctgcagcatatggagtggcggcagcggtttccttcaacggaaacaaaattatgactaccagcggtggtggagctttgttaactgatgacaaggatattgcagacaacgtccgctatcttgcgacacaagctcgccaacctgtagttcattacgaacacaccgatgttgggtataactatcgcctttcaaatatcctcgctgcactgggacgagctcaactttcccgactcgacaagatgattgagcgtcgacgtcaacaccgtgcgttctatcgagaattgtttgcaggtgtttctggagtagagatctttggcgagccatcaggggtcgatggtggcgacactattgataatttctggctcacttctattcttattgataaagaagttgcgggatttagctctgaagatcttcgatcagttctaaatcaggcgaatattgagtctcgtcccttgtggaaaccaatgcatctccagccagtatttaagaagtatcgtagcttcaccaatgaagaaggacagaggctatttgattcagggctttctctcccaagcggttcagtacttgataatgcgtcaatgaatcgtgttgagactacaattggccagtttttggagagtcagcatgcgatc

SEQ ID NO: 389 - DNA, 612 bp, Corynebacterium glutamicum
atgcgatctaagtacaaaaactatggcgtagtaaaacgtgcgattgatattggggttagtggcgtagggctgattatctctgcgccgattcagctggcaatagcagcagttgtattgagagctcatggtcgtccgattctatttcgtcaaccacgacctgggaaagacggtgtggtatttgagatgattaagtttcgaaccatgcttgaaccagatgaaaaacatgtaactgatgaacagcgtctaactaaagttggaaagcttctgcgggaaacgagtttagatgagttacctacactctggaatgtatttaaaggtgatatgagccttgtagggcctcgacctttgcttgttagctatctggaacattactcttctgaacaagctcgacgccatgaagttcgtcctgggattactggtttggctcaggtgaatggccgtaatcaaactacttgggatgaacgacttaagttggatgtcgaatatgtggatcgctgtagtttgaaactagatttcaaaatattaatcgccactgtaaaaacagttctttctaaaaagggcattagtaatgaaggtcatgtcacgatgccatccttcattgaagaaagaaaa

SEQ ID NO: 390 - DNA, 1161 bp, Corynebacterium glutamicum
atgatactaagaaataggtcacgttgtagatcttctagagagaatgtgattctctttggggctacgacagacatgtcaaatattttttatgaagggatcctgcagaatctaattcaagatgggtgggatgtgcaccttgtttcaaatccaggcccagttgggaagaaattactgaatggtaaagctcatactatcgagatgtctagagagatttcaataggtaccgatgttaaatcattatttaattgggtgctattgcttaggaaaattcgtccaagagtgctgatagttggaactccgaaagcttcattgctgggagtcgtggcagcacgaattgctcgagtgccacgaattgtctatgtggcacatgggctgcgctctgaaactgttttaggcttaaaaaagaagattctagtgtttttggaatatttgacccagttgtttgcacatcaaactttggctgtaagtcattctctgaagaaagcaattgaagatgcgcaccctcgttttaaaggaagagtgcaagtcttaggttatggcagtatgaatggagttgagcttgatcgctttagagttccatcccttgaagagaaattatctgctcgtaatgctttaaacctgcctagtaaatctgtcattgttggttttgtcggcagaataaataaagataagggaggagatcttctcgctgctcttacaaaacatgaggcttttacccgattgcgactgcatctcttaattattggtgaattggaagacgatgacttgcgagaagcattcattaaattagttaatgaagggcaggttacgattacaggatggattgatttccctgaagaaccattagctgcagttgatgttttgcttcacccaactcagcgagaaggtttaggtatgtctttgctggaagctcaggctatgggagtgcctgtattgacgaatgctgtgactggaacagttgatgcagtaacaagtggagaaggtggcttttttgccgatgacgattctgttgagtcctgggtttctaagattgatttattagtttccgatcctaagttaagagaccggatgggacgtgctggtcgccagtttgtgtcagctcgtttcaatcgtgatgatgtcgcagctcgtttcagtcatttcgtggaacaattcaaaaaa

SEQ ID NO: 391 - DNA, 1491 bp, Corynebacterium glutamicum
atggcaaatactagagatgaagctactgaagtacctgaagatggctctttgaggaagggcgcagctcggggatccgctatcactttagtagggcagattacgagaattttgattcagttactcagcgtaatcttactagctagattaattcctcctgcagattttggtttatacgctatggtccttgcagtttcaggcgtggctcagatctttctcgatctagggttttctatggcggccctgagatcacgtgatctaactaagcaacaacattcaaatctattttggattaatacttccgctggttttcttctatttattattattttttcacttgcgattcctttagcaactttctatggagatgatcgattaataagggttacacagtggatatctattgtgtacctgttggggggaatcactgctcagtttagggtccatttaaatcgtcacctgcgatttggagctttatctcttgcagatgttttagcaccgttggtagctctcgtagtggccgtaattatggcaatgaagggttatggagttcaagctcttgtggttcaaacaatattgaactacttagttatgctggttttggttgtcgtgatggcccggtgggttccgagttttcctcgtaagactcccggtatgaagccattgcttacttttggtatgggacttggcgcgactagattcttatcttatttaactcaaaatattgatagtattattattggccgggtgatggggccagttcagctcgggttttatgatcgtgcatttaggctggcagtcgcacctgttgtgcaaattagtttcccattcacacgtgtagcaataccatttttagttcgtgtaatggatgatggaaaaaagtatgttgccgcactacgtgaagctcaaatggtcggcatctatggaactgctagttttcttttggtttttggcggtatggctacaccaattgtgaccttaatttttggtcctgattgggtagaagcgggacttctgatgacaattctatgcataggtgcaatattccgtacattgcaacaggttgctacttgggtatttatgtcaaaaggactgtccggggcattgctgaagctaaatcttgtcatgcaaccggtgatcgtattgttaatcatcggtggtgctcgatggggcacggttggtgttgcatgggcagggactctgggatactttctgttttggttggtctcaatagcttgggcaagttatgccactaatttaaatttgtggagtttagtcacaaatcctctagagattatcggtaaatttagccttcctgcggggcttattacttttgcgatttcgtcaaattcatccctttcgctattaacacagttcttggcatctattggtggtgcattgatttggtttgtattcatttattgcatctcaaagaagattaaaaaagatattcgccgactagttggaatcggaatgctagttttaaagaggcgt

SEQ ID NO: 392 - DNA, 1314 bp, Corynebacterium glutamicum
atgtatgcagaaattaatggcggttttattccagagggcaccgtgcgggtaagcggcgcaaaaaactctgctactagacttctcgcggcggcactgctaaccgatgaggtggtgcatcttggtaatttcccaaccaagcttgtggatgttgaacataaaattcgctttattgaagagcttggcggaaaagtgcatgtcgaccatgatgagcaaattttagtagttgatgctaaggatcttgcagcgcgagaaatgactactgatgaactgaatattccgattcgaactacttatctcctagcagcagcgcagattgggcgtggggaaattgctcgagttccttttcctggggggtgtgctattggaggaggtcctgctggcggacgaggatatgatcttcatcttatggtctgggaacagctaggttgtaaaattcttgaaaaagatgatcacattgaagtaactgcaccccagggctttatcgggggagttattgactttcctatttctactgtgggaggcactgaaaacgcgttactatgcgcaagtattgcttcaggggatactaaaattgccaatgcttatattacccctgagataactgatcttattgaacttctgcgacgtatgggtgcggagatcactgtctacggtaccagccgtattcatgtaaagggtcgagcaggtcttttgcagggcgcatatatggacgtaatgccggatcgtattgaggcattgacgtggatcgtgtatggaattatttcaggcggaaggattaccgtcgaaggtgttccatttagctcgatggaagttccttttatccaccttgagaaggctggagtggatcttttccgtaattcaagttccgtatatattacaccagaatgcttgccttcaggctcagttcagccatttgagctagcgtgtggaactcaccccggagtaatttcggacatgcaggcactttttgttcttttaggattaaaaggtgcaggaacttcacgcgtctatgactatcgatacccagaaagaattgcatttgttgaggaattgacaaatctagtttcgggcgacaaattaagtgcagaggctggcaagatcactatccagggagatgctactttccggccaggatatgcgaactcaactgatctacgtggttctatggctgttgttttagcggcgctttgcgctgatggaaagtccacgattaataacgtccatatggcgttacgtgggtacaacgagttggataaaaaacttcgtttacttggtgcggatttaactatcagagaaggcgaagttccttcacct

SEQ ID NO: 393 - DNA, 1005 bp, Corynebacterium glutamicum
ttgaatgattttaagaaagtctccgaaagtcttgagaccgcattgcgtaatgagttcgactttcggttcgctaccgaagtctcattgaaggagatatcgcgttggaggatcggaggtcctgcagctgtatttgctgagcctagttctattaatgagatctgtgctcttcttgcattcatgaaaaatcgtccggaaccagtagtagttgttggcggtacttccaatattctttttgattcagatggctttggtggcttagttataaagttgggtgaaaattttagcaactttataattgaaggcagccgtattcgtgctcaagctggtgcttcggtacctcaactagtgcgtgctgttgcgaccgaggggctggaaggaatagttcatgcgggcggaatacctggaactgtaggtggcttagttgttatgaatggcggaacccagcgtcgtggaatcggtgagcatgtcactaaagtattagtaacagatgctgaaggcagtatccgagaactgaacgcaaatgaattgcagtttacgtatagaaactccgtacttaagaactctgaaactactgtattagaagtcgaacttcttctgaagccaggaaatgctggagaattgttggccgaattggaaacgattctagatcaacgttctcaaaagtttcctgaggatcttccaaactgtggatcgacattcctttcagatcccgctatgtacagtattgttggtcctcctggtaaggccatagaagatgcaggattaaagggacttagacgcggttctgcagaaatttccatgcaacatgcgaattttatagtcaatcatggggatgcatctgatgatgacatcttgtggttgatctctgctgttcgaaaggaagtttatagcagaactggttttgtaatggattgtgaagttttatatctgtcatattctggtgattttcgccctgctcatgaagtggcggacgagcaatggcccgatatagatttagtaaggaac

SEQ ID NO: 394 - DNA, 1035 bp, Corynebacterium glutamicum
atgccaaaagtaagtgtggttactggtttttataaccgctgtgagcatttagaacgaaccattgagtctattcttaaccaaacttatagcgattttgaattaattgtttttgatgatgcatcgacagatggaacagcttcacgattgttagagttaaaagaaaaatatgatgatccgcgtttccgatttatcattcatgaagagaataaaggtttcgtaaaagggttatcagaagcaatttctggagctaaagggcagtatattgcagtccagggatcaggcgatgtatctcttcctcgccgtttagagcttcaggtagagtttctagacgcgaatccttcggtaggtgctgtgggtggtgctatctataatattcaagaagatacgggaacacgcaacccacagagatttgaaaagccaattgctacattcgatgatttattgacatctaatccgttcactcacggagaagtgatgtatcgcttagacctttataagagtataggtgggtatcgaagtggctttacttttgctcaagatcgtgatttatggttgaggatggcgaaaaaagcagatctgggtatcattccagattttctttatcaccgttacacacttttagatggtgtctctttcgtcccggataaaactatacgtcagcgatgcttttcagaagctgcggtgcgactggcattaatgccagaagaggaaggagctttagcctactctaggctggaagctgaagggcctactgccgtagttcctatcgctgatagagctgttcagaaatttgtccctaaagcggctattcgcttatgtctatatggtgctccggaaactggtttacacatggctcgagactatatccagaaccctctgcgccgtaccatagttgtagttttgatcagcatctattcgtctagattaattaagcctcttcaagatattctatataagtctatttttaagggggtctcgatttctaaacctattaagagttcactcgtgaagtttacaagaagaattcaagggaag

SEQ ID NO: 395 - DNA, 150 bp, Corynebacterium glutamicum
atgagtgtgtctgccacggctaaagcactgaagatcggctgggaactagtcaaccaggttgcactcgatgcttgccgacagctcatttacaacgacccgcgccaccttgaagtcgatgaacatgtatggaagtatactcgaaagccaggt

SEQ ID NO: 396 - DNA, 135 bp, Corynebacterium glutamicum
ttgacctggaagaattatttcacgcagtggcagaaacgaggactcgtcatgttgtgggccaccgatgatgactacgtggctttagatctgacgtggttgttctatcaagacatgattgcggcgtatgggaatccg

SEQ ID NO: 397 - DNA, 327 bp, Corynebacterium glutamicum
gtggttgttctatcaagacatgattgcggcgtatgggaatccgtagaaatcagaggaaaagaagctgatgagaaggggatcaacagcctgcgcaaaggcctaccagcgagaatggacgagcttgcccaactggggcacaccttgtggcgtcggcgtaagaacgtgttggcgtccttcaatatcggtgcatccaacggacctgtcgaggccatcaacggcagacttgagcacctgcgcgggatcaccttggggttcaggaacctcaaccactacatcttgcggtgcttgatccaagccggacaactgcagaggaagatcaatgtactc

SEQ ID NO: 398 - DNA, 276 bp, Corynebacterium glutamicum
gtgacctcgacgacttcatcaacgatgatctttgccaactcttcggatttagagtacattgatcttcctctgcagttgtccggcttggatcaagcaccgcaagatgtagtggttgaggttcctgaaccccaaggtgatcccgcgcaggtgctcaagtctgccgttgatggcctcgacaggtccgttggatgcaccgatattgaaggacgccaacacgttcttacgccgacgccacaaggtgtgccccagttgggcaagctcgtccattctcgctgg

SEQ ID NO: 399 - DNA, 1170 bp, Corynebacterium glutamicum
ttgatcgttgtagggatttattatttcaatggagaaatgcacttttggcaaggtctcctaattatcgggttctctttcatccctgcttggctaagttatcatttcattgagaatccaatgcgtaattggtcagcaatcaaggctgacgcaagaaaagcagtggcctttggagttattttgatgacggtatcggcgactgctgggatcctcctctttttatctccaaatagaagccaagctgcgccaccccaatttagtttgaccccgtatgatccaaccgctgtaaataaggagtcggaaaaagaagcagcaaagaatctgtttggcgctgaggcgttgacagtggatccggatgccggtgaggttgttgatcgagtagataatttttatccgacgactgctaaggcaaaacgagattacccaagtaactatgcagcgggttgtcaccaagaagtcaatgagactagtcctgagtcatgtgtttatggtgataaaaattctgatttttctgtagcacttgtcggtgactcccacgctggtcattggcttcctgccttggaaccaattgctgaagcacaggggtggagattggaagtttatacaaagtcacagtgtccactcataagcactgcgatcaaacttggtgaaactttttatgcagaatgctatgagtggaatgaaaaattacttgctaagctaactggaccttctgcaccaaatcatgtgattgtaagtagccaacgttacgcttctgcaaatccgttaatcgatagtgtcgcgacgggaaccgtttccgaaggatatgaaatggcatggaattcattaaaagatgcaggtgtttctatttctgtacttcttgatactcctcggccgcaaattgatatcccagaatgtgtagcatcaaaccgcgataatctctcagaatgttcagttcaccggagcgttgcgcttgggactgaagctcatcctcagcaaaaaactgcagctcaaaatatagacgtgcctgtattggatttgagtaattggatttgtccggaagaatattgctccgctgttatcggaaatgttttggtatacagggattcacatcatttgaccgctacgtatgctcgtagtctctctagcgcattatggaatgagttggttgcctcaaatggtgagccttttaag

SEQ ID NO: 400 - DNA, 993 bp, Corynebacterium glutamicum
atgactacatcgacggcaactgctaaacaacaagcttcgaaaagtcatttccgtcccgacattcaaggactgcgagccgtcgcggtacttttagtattgatatttcatgctggcgatggctccgtgctttccggaggttttacgggtgttgatattttctttgtaatttctggctacttgattactggacacttgatcaggtcttgtctagaaaagggaaaaattagtttaattaacttttatgcgggccggattaggagaattctgccagcagccacagccgttttggtattcacggccctaattacgattttagtgttgcctgatacccggtggatgcttatcggtgctgagatcattgcaagttcagtgtatttggtaaactggctttttgcctcaaatacgaattatttgaatgcagaagctgctgccagtccagttcagcattattggaccttatctgtggaggagcagttctatatcctctggccagcgctacttattgggttgttgtatttcagtcggcatcgttttacactggactcagaggaaactagtggcacgaaactaaacaaagttcgttggctgcagcgttatatcgctttagcagctgtacttataacgttagtttctctttgcttttccatttatttttcatacaccaatccggcacccgcatatttcattacctcgacacgcctgtgggagcttggaataggcgcgattctcgcctctttttcattccaattagaacgaatttcagctccgataggatatgcgcttggtgtaatgggattagcaagcatcgtagcagctggagtgacttttgattctcagacagtttttcccggctatgccgcgctggtgccaacattaggtgcagcagctgtaattattggtggcatgggaggtcgtgcggaaaaaggtgtaggtgtacttctaaaagttaaacctatgcgttggatcggagatctttcctattcgctttatcta

SEQ ID NO: 401 - DNA, 231 bp, Corynebacterium glutamicum
gtgctgtgggtatcggtgcggataattcgctggcttcagtcgtttaatgccgcattcaagcgggaagttccgcgcaggattccaagacgtttgcgaaccagttggtgtgccgtcgggaggtatttgaagtggtgtaccaggtacaacacgagtcttaggcaatcctggtgtggtcatctcacacctgcgatgtatgagattcggggttctgctatcctgaaatctgcttct

SEQ ID NO: 402 - DNA, 1161 bp, Corynebacterium glutamicum
atgaaaattgccgtcgcagggctcggatatgttgggctttcaaatgcagctctcctctctaaaaatcataaagttgttgcagttgacattgatgaagaacgagtgaaactagttcaagaatttcgttcgccaattgtcgatagcgatctcgaagaatatctgtccactaagcctcaaaacttaactgccacaacggacgccgaagccgcttacaaaggcgcagattttattgttattgcaacgccaactaattacgacccagagtcaaacttttttgatacttccagcgttgagtccgtaattgagatagtccttaaggtttctcctggatccacaatcgtaattaaatcgactatccctgttggttttacatcggaactacgcattaagcatccagaagcttcgattattttttcacctgagttcctgcgtgaaggccgagcattctacgacaatctctacccatccagagttgtcgttggtgatcgcagtcctctgggggaagaatttgcgactctgttagctgagggggcaaaagaaaagcctccgattctacttacggactcaactgaggcagaggcgattaaattattttctaatacatatcttgcactgcgagttgcttttttcaacgaactggatacttatgcgtctgttcgaagcttggatactaagcagattattgaaggggtagggctcgatccacgtattggatctcattacaataatccttcatttggatatggcggatattgtcttccgaaagatacgaaacagcttctcgccaactataaggatgtcccgcagaatctaatctctgcagtagtccaagcaaataagactcgtaaggactttattgcagaggatatcctcagtaaatcacctactgtagttggaatttaccgccttgtaatgaagtctggatcagataactttcgttcttcttctattcaaggagtcatgaaacgaattaaggccaagggaatcgaaattgtagtatttgaaccgaatctcggagaagaaactttctacaattcgaagatccttaatgacatcgaagagtttaaggattactgcgacatcattattgcaaatcgtccaaccgatgagctttctgatgtaccagaaaaagtttatacacgtgatattttccagcgtgac

SEQ ID NO: 403 - DNA, 273 bp, Corynebacterium glutamicum
gtggtaacgatcgtgaagcacttgagtggacatcatgaagcagtacccaccccagcatcaatcagtaagaaacgctttaacgccaggtggctttcaaccgcatacgctgtattcggctatgtcgtaccggttttctgcgcagcgggtgtgctctatcgcgacgttgtgcacaaggtcgtgatagagcacaccacatacgcggaatcgcagtaccgcttgttaagaattgtggggtttaaagaaagcgcggatcaatttcggtcaagtgctttc

SEQ ID NO: 404 - DNA, 1209 bp, Corynebacterium glutamicum
gtgcttcgtgagcctttagctgtcggaagtctaattttccttgcgacaatcctcatactctcgctaccaagctttgtagcgggtctcatagttggcgtatggcattccctccccggaattgcaccatctctagcaggctttgcgttaactatcggtgtccttgttctatgcctgcttatattaattttccgaaagaagaagtttcctgatgctagtatttttaccaagtactcaggttttctttcactgattcctgccattttcatcatcgaatggataaataatgaaagcgcatcagaaactcgaacattactcggcgccattgttactggcttccttttcttagtaaccagttctttccgagataatattccgcatattatttggggtttttcaaccggagtatcaatctacggagtaggagaattattacgaattgctggtggcggagctttgcatttgaaagccggagcatttggtgccaatcctattttcgcttctcagttcttaggcctagcaattttcggggtttggcttctacatataaccaaacgaagcactccgaaatttacccttttcgttagttccatccttctagtttgtttactaagtgcactatcatgggggccgattattgctcttgcagttgctttcctatacgcaaacactacaaaatcttctacacaccgcttgcaagattatagagttcgaaatcgaattatagtctggggccccttgctagtaggacccgtaattatactttccagagacgccataaaatcattttattacagtgaagactctgtagcgcgtctccatatttggcaagaatttatcgacctagctctaaccagcccgctgaccggagttggaatggaaaaagtgcatagtttttattcgattagtagctcggataaattcctgtcaccacataatctatttcttgaaatgtgggtagcatatggtgctctccctatattcatcctgtttgcaaccttgatttatctctttcgaaaaatcaattatctcggacgagccagtctaatattcttagtgatttgttcctcggtatcaggcagtctggccgtcagttttaacttttggataggtttaaccttagtggtcattattggatcctcttcactagcttccactaaccaaaatgcccattcttcaaaatcaagaaaagttaataaacaaccagcaaag

SEQ ID NO: 405 - DNA, 822 bp, Corynebacterium glutamicum
atgactagttccgctccattaataagtgtagtaatcccaacaatcgcttatgacgaatattgcagtcaatctattaaatcggtttgcgaacaaaactatgaaaactggcaaatagtcctagttctggacggggcgcccattaaggatgttccccaatgggtaaaagaacatgaacgcattaaaattgtcgagcaaaaaattagacaaggtacccccacgagcttaaacaatggaatcaaagcgtctgatggacagctaattgcacgactagattcagacgatctcgctgctcccagccgcttatccaagcaagaggaatttctcaggaaccatccatacattatttgcgttgcaacaaaaacaaagcacattaatgaacatgggaaaatctttggacaatcagctgaccttccaacttcccaggacatcagacaaatcctgttagtgaagaacccaatcattcactcctcagttatgtaccgcaaacaagttgttgaacagatcgggggatactctctggagatgactcgatcccaggactatgagctattccttaggctctccaaaattggagcaatcggataccttgacgaaagccttagctcataccgcattcatggtggccagcacagcaggaaaacctccccatttaagaaatatacctggatcatactaaaacgaaggatggaacttgcttcgttcttaaagcggtcaccagttcgacaaatattcttaaattttatatggtatggcgctcaagttactcgatacttggggttgcgtaaagcaggattcatgacgggatacaccccggaccgcatc

SEQ ID NO: 406 - DNA, 645 bp, Corynebacterium glutamicum
atggttgctcaaaactcagtcgtagtgataggtgcatctggattcggtagggagagtctagacgttctcgaagcaatgaaggaagccggacattcgttagagataattggagtagttgatgacaatcctgctgcaatcaatttgcagcgtcttgcggagcgaaaaatcgaatatctaggaactttaaaagaatggattgagggatctcccaagtcgtgtaagtatgtgcttgcgattggaaacccaacgattcgccataagctttctgctcttttagacaagtctggtttcgatgcatttacggcggtgcatccctctgcagtgataggaagccaagtagtgtttgggtctggggctgttgtatgttctggggccgtgatttcgaccaatgtaaggcttggtgtgcatgtgcatatcaacccaaatgtgacaatcgggcatgattcaattcttgaagactatgtttcgataaatccggctgcaacaatttcgggtgaagtcctgatcatggaagaaactcttattggagctgcggctacagtattgcaaggactgactatcgggaataggtcgttagtgggtgcatcttcgtgcgtcactaaggatatttctgcagggaaggtagttaagggtattcctgcgcgc

SEQ ID NO: 407 - DNA, 195 bp, Corynebacterium glutamicum
gtgcatccgggtgcggttggttttccatacttaattttagagtggaagaaaatgaaaaacacccacatccgggcccaaatgggcacagaaatgcaggtgttttatgtacggtctaagcaccgtgctgttttagaacaagccgatgctgtgggaaagattactgaatgcggaggatccagcatgcaggccgtaacc

SEQ ID NO: 408 - DNA, 1407 bp, Corynebacterium glutamicum
gtgactgaacattatgacgtagtagtactcggagccggccccggtggctatgtctccgccatccgtgcagcgcagcttggcaagaaggttgctgtaattgagaagcagtactggggtggtgtttgcctaaacgtgggctgcattccttccaagtctctgatcaaaaacgctgaagttgcccatacctttacccatgagaagaagaccttcggcatcaatggcgaagtgaccttcaactatgaggatgctcacaagcgttcccgtggcgtttccgacaagatcgttggaggcgttcattacttgatgaagaagaacaagatcatcgaaattcatggtcttggaaacttcaaggatgctaagactcttgaggtcaccgacggtaaggatgctggcaagaccatcacctttgatgactgcatcatcgcaaccggttcggtagtcaacaccctccgtggcgttgacttctcagagaacgttgtgtcttttgaagagcagattcttaaccctgttgcgccaaagaagatggtcattgttggtgcaggcgcaattggaatggaattcgcctacgttcttggtaactacggtgtagatgtaaccgtcatcgagttcatggatcgtgtgcttccaaatgaagatgctgaagtctccaaggttattgcaaaggcctacaagaagatgggcgttaagcttcttcctggccatgcaaccactgctgttcgggacaacggtgactttgtcgaggttgattaccagaagaagggctctgacaagacagagactcttactgttgatcgagtcatggtttccgttggtttccgtccacgcgttgagggatttggtcttgaaaacactggcgttaagctcaccgagcgtggcgcaatcgagatcgatgattacatgcgtaccaacgtcgatggcatttacgccatcggtgacgtgaccgccaagcttcagcttgctcacgtcgcagaagcacagggcattgttgccgcagagactattgctggtgcagaaactcagactcttggtgattacatgatgatgccacgtgcaaccttctgcaacccacaggtttcttcctttggttacaccgaagagcaggccaaggagaagtggccagatcgtgagatcaaggttgcttccttcccattctctgcaaacggtaaagcagttggcctggcagaaactgatggtttcgcaaagatcgttgctgatgcagaattcggtgagctgctcggtgcacacctggttggagcaaatgcatcagagctcatcaatgaattggtgcttgctcagaactgggatctcaccactgaagagatctctcgtagcgtccatattcacccaacgctatctgaggcagttaaggaagctgcacacggtatctctggacacatgatcaacttc

SEQ ID NO: 409 - DNA, 921 bp, Corynebacterium glutamicum
atgagtttgccaatagctcagcatcaaaatgctgtaaaaactgtcgtggtaccagctgcaggaatgggaacacggttccttcctgcaacgaagacaattccaaaggagcttcttcctgtagttgataccccgggtattgaacttgttgccaaagaggctgctgatcttggtgcaactcggttagcaattatcactgctccgaacaaagacggaattcttaaacacttcgaggagttccctgagcttgaggcaactcttgaggctcgcggtaagactgatcaactgaataaagttcgagcagctcgagaattgattgcaacagttccagtggttcaagaaaagccattggggcttggtcacgctgttggccttgctgagtctgtgctcgatgatgatgaagatgttgtggctgtcatgctgccagacgatttggtgctgccatttggtgtgaccgagagaatggcagaagttcgcgctaagtttggcggatctgttcttgcagcaattgaggtggctgaagatgaagtctcaaattacggagtatttaagctcggtgaactcgatgcagagtccgaaagtgaaggcattaggcgtgttgtaggaatggttgaaaagcctgcgcctgaagatgcaccatcaaggtttgccgcaacgggccgttatctacttgatcgagctatttttgatgcactgcgtcgaattgagcctggtgctggtggagaactgcaattaacagatgccatcgcattattgatcgaagaaggccatccggtacacattgtggttcatgaaggaaagcgccatgaccttggtaatccagctgggtacattcctgctgttgtgtacttcggacttcgtcatgcagagtacggttccaagattcaccgtgcggtgaaggaaatactcgctgagtttgaatct

SEQ ID NO: 410 - DNA, 498 bp, Corynebacterium glutamicum
atggctaagaaagtagacacctcgaacgctacccccgctctagcccttcttacggagaggcagattccttttgagctggatgttcatgatgtagatccaaaatcatcaaagggctttgcattggatgcctctgaagtaatgggtgtggagccggaagtggtgtttaaaacgctcatggcagatattgatggtgaacacgtggtcgcgattgttccagccagcagaacgttgaatctcaagcagttggctaaggctggaaaaggtaagcatgcaaacatgatggatcgcagccgtgcacaggtagttacggggtatgtccctggtggaatctcaccgatagggcagaagaacaagcaccgcgtgtttttggatgagtctgcaattctccaggagcgaatctacgtcagcgcagggcgacgcgggtggtccctgattatcgccccggatgatgttcttctggctaccgatggtgtttacgcggatattgctgatcattca

SEQ ID NO: 411 - DNA, 1422 bp, Corynebacterium glutamicum
atgggaaagacatatgtggggtccaggctgcgccaactgcgccgcgaaagagacctgagccaggcatccttagcagcaacccttggcttatctgcaagttatgtaaatcagattgagcacgacgtacgcccgctcaccgtaccggtgttattgcgcatcaccgaggcgttcggcgtagacgcaacgtttttctcccgcgacgatgactcccgcctgctcgccgaggtccaagacgtcatgctggaccgggagatcaatcctgcgaacgtggagctgcaagagctttcggagatggtgtacaaccacccccaactagcgcgcgcgatggtggaaatgcaccagcgttaccgaaacgtgcgcgataagttctccatcgcagtggataatcgcaccaacacgcctgaggaacgccgtcccatcgcggaggccgtgagcatgccgcacgaagaggtccgcgatttcatttacgcccgccaaaactacttcgatgcccttgaccgccgcgccgaagccatcgccgcgcaactgggctggcagccgtacgattcccgcgccatggaagattcgatcgcccgccgcctgcaaatggatcacgatgtcaccatcacctcctccaaagaggaatccggcacgctgcaccacttcgaccccgagacgcgtctgctgacaatccacgcacgcctcaaccccgggcaacgcgccttccgcatggccaccgaactcggctacctagaagccaacgacctcatcgaaggtatcgttgacgacggcatctggtccacccccgaagcccgcaccctagccatccgcggtgtggcctcctacttcgccgccgccgtgatgctgccctacaaaatcttccactccgaggccgaaaaatccggctacgacatcgagtacctaggccaactctttggcgtgggctatgagacaaccgcccaccgcttgtccaccctgcagcgccccaacctgcgcggcatcccctttaccttcgtgcgcgtcgaccgcgccggcaacatgtccaaacgccaatccgccaccggcttccacttcacccactacggcggcacctgccccctgtggaacgtgtttgaaaccttcaccaaccccggccaagtgctccgccaattcgcgcaaatgcccgacggacgcaactacctgtggatctcacgcaccgtgcgacaccacgaagcccggttcggcgaagtagacaaaatgttcgccatcggcctgggctgcgaagcgcgccacgccgaccgcactgtgtactcccgcggtttcaacctccaggacctctccaccgccacccccatcgggtccggctgccgagtgtgcacccgcgagaactgcgcgcagcgcgcattcccatccgtccacggccgcatcaacatcgacgcgcacgaatccactatcgcgccgtac

SEQ ID NO: 412 - DNA, 771 bp, Corynebacterium glutamicum
atgactgttagaaatcccgaccgtgaggcaatccgtcacggaaaaattacgacggaggcgctgcgtgagcgtcccgcatacccgacctgggcaatgaagctgaccatggccatcactggcctaatgtttggtggcttcgttcttgttcacatgatcggaaacctgaaaatcttcatgccggactacgcagccgattctgcgcatccgggtgaagcacaagtagatgtctacggcgagttcctgcgtgagatcggatccccgatcctcccacacggctcagtcctctggatcctacgtattatcctgctggtcgcattggttctgcacatctactgtgcattcgcattgaccggccgttctcaccagtcccgcggaaagttccgccgtaccaacctcgttggcggcttcaactccttcgcgacccgctccatgctggtgaccggaatcgttctccttgcgttcattatcttccacatcctcgacctgaccatgggtgttgctccagcagccccaacctcattcgagcacggcgaagtatacgcaaacatggtggcttcctttagccgctggcctgtagcaatttggtacatcattgccaacctggtcctgttcgtccacctgtcacacggcatctggcttgcagtctctgacctgggaatcaccggacgccgctggagggcaatcctcctcgcagttgcgtacatcgttcctgcactggtcctgatcggcaacatcaccattccgttcgccatcgctgttggctggattgcg

SEQ ID NO: 413 - DNA, 1875 bp, Corynebacterium glutamicum
atgaacctggtctccccactgaaccgacgcaagttccgtgtcctcgtcgttggcaccggcctgtccggtggtgctgcagcagcagccctcggcgaactcggatacgacgtcaaggcgttcacctaccacgacgcacctcgccgtgcgcactccattgctgcacagggtggcgttaactccgcccgcggcaagaaggtagacaacgacggcgcataccgccacgtcaaggacaccgtcaagggcggcgactaccgtggtcgcgagtccgactgctggcgtctcgccgtcgagtccgtccgcgtcatcgaccacatgaacgccatcggtgcaccattcgcccgcgaatacggtggcgccttggcaacccgttccttcggtggtgtgcaggtctcccgtacctactacacccgtggacaaaccggacagcagctgcagctctccaccgcatccgcactacagcgccagatccacctcggctccgtagaaatcttcacccataacgaaatggttgacgtcattgtcaccgaacgtaacggtgaaaagcgctgcgaaggcctgatcatgcgcaacctgatcaccggcgagctcaccgcacacaccggccatgccgttatcctggcaaccggtggctacggcaacgtgtaccacatgtccaccctggccaagaactccaacgcctcggccatcatgcgtgcatacgaagccggcgcatacttcgcgtccccatcgttcatccagttccacccaaccggcctgcctgtgaactccacctggcagtccaagaccattctgatgtccgagtcgctgcgtaacgacggccgcatctggtcccctaaggaaccgaacgataaccgcgatccaaacaccatccctgaggatgagcgcgactacttcctggagcgccgctacccagcattcggtaacctcgtcccacgtgacgttgcttcccgtgcgatctcccagcagatcaatgctggtctcggtgttggacctctgaacaacgctgcatacctggacttccgcgacgccaccgagcgcctcggacaggacaccatccgcgagcgttactccaacctcttcaccatgtacgaagaggcaattggcgaggacccatactccagcccaatgcgtattgcaccgacctgccacttcaccatgggtggcctctggactgacttcaacgaaatgacgtcactcccaggtctgttctgcgcaggcgaagcatcctggacctaccacggtgcaaaccgtctgggcgcaaactccctgctctccgcttccgtcgatggctggttcaccctgccattcaccatccctaactacctcggcccattgcttggctccgagcgtctgtcagaggatgcaccagaagcacaggcagcgattgcgcgtgcacaggctcgcattgaccgcctcatgggcaaccgcccagagtgggtcggtgacaacgttcacggacctgagtactaccaccgccagcttggcgatatcctgtacttctcctgtggcgtttcccgaaacgtagaagacctccaggatggcatcaacaagatccgtgccctccgcgatgacttctggaagaacatgcgcatcaccggcagcaccgatgagatgaaccaggttctcgaatacgcagcacgcgtagccgactacatcgacctcggcgaactcatgtgtgtcgacgccctcgaccgcgacgagtcctgtggcgctcacttccgcgacgaccacctctccgaagatggcgaagcagaacgtgacgacgaaaactggtgcttcgtctccgcatgggaaccaggcgagaacggaaccttcgtccgccacgcagaaccactgttcttcgaatccgtcccactgcagacaaggaactacaag

SEQ ID NO: 414 - DNA, 837 bp, Corynebacterium glutamicum
atgggaaccaggcgagaacggaaccttcgtccgccacgcagaaccactgttcttcgaatccgtcccactgcagacaaggaactacaagtaatgaaacttacacttgagatctggcgtcaagcaggcccaactgcggaaggcaagttcgaaaccgtccaggttgacgacgccgtcgcgcagatgtccatcctggagctgcttgaccacgtaaacaacaagttcatcgaagaaggcaaagaaccattcgcgttcgcctctgactgccgcgaaggcatttgtggtacctgtggtctcctcgtgaacggtcgccctcacggcgccgaccagaacaagcctgcctgtgcgcagcgcctggtcagctacaaggaaggcgacaccctcaagatcgaaccactgcgttccgccgcatacccagtgatcaaggacatggtcgtcgaccgctccgcactggaccgtgtcatggaacagggtggctacgtgaccatcaacgcaggtaccgcacctgacgctgataccctccacgtcaaccacgaaaccgcagaactcgcacttgaccacgcagcctgcatcggctgtggcgcatgtgttgctgcctgccctaacggcgcagcacacctgttcaccggcgcaaagcttgttcacctctccctcctcccactgggtaaggaagagcgcggactgcgtgcacgtaagatggttgatgaaatggaaaccaacttcggacactgctccctctacggcgagtgcgcagatgtctgccccgcaggcatcccactgaccgctgtggcagctgtcaccaaggaacgtgcgcgtgcagctttccgaggcaaagacgac

SEQ ID NO: 415 - DNA, 336 bp, Corynebacterium glutamicum
gtgaacaccatgtcctccgcgaaaaagaaacccgcaccggagcgtatgcactacatcaagggctatgtacctgtggcgtatagctctccacactcatccctcgagcgcagcgcaacctggttgggcatgggattcctcctcactgctctggcaggcgttggcgcagtcctcttcgcagtcggcgcaaacagcgttggccagcagcaggaacactgggtcctctacagcatcatcggtgttgtattcgccgttgtctgcacagttttgggcaccgtcctgatcatcaagggccgagcaccttacaaccgttacgtcaaggaaaccggccgtacgcag

SEQ ID NO: 416 - DNA, 261 bp, Corynebacterium glutamicum
ttgactagcacctccaacaacaccctttcttccatttatgtgggggagagggtgttgttttgtttttgcttggagttccctggagccttcatcgacagcccccaagccctcgaaaacgccgaaagcaacccactgtggagccaactccccgcagtcaaaaacggtcaactctgtaccacggaaaacctcaccccatggatcctcaccggaccagcagcagctgagattgtgacctctgacctcgaggcatgtttcgctgct

SEQ ID NO: 417 - DNA, 630 bp, Corynebacterium glutamicum
atgacaagtttgcacgaactactccgccgagaattcgaacttgcgtatcctatatctccaagcatccttctgcacgacccaatttccaccaatcttccatgtctcctaagcagcgaaacatgcctcgaggtcagaggtcacaatctcagctgctgctggtccggtgaggatccatggggtgaggttttccgtggtacagagttgaccgtttttgactgcggggagttggctccacagtgggttgctttcggcgttttcgagggcttgggggctgtcgatgaaggctccagggaactccaagcaaaaacaaaacaacaccctctcccccacataaatggaagaaagggtgttgttggaggtgctagtcaaagaacctgcatacagaaactactgcgtacggccggtttccttgacgtaacggttgtaaggtgctcggcccttgatgatcaggacggtgcccaaaactgtgcagacaacggcgaatacaacaccgatgatgctgtagaggacccagtgttcctgctgctggccaacgctgtttgcgccgactgcgaagaggactgcgccaacgcctgccagagcagtgaggaggaatcccatgcccaaccaggttgcgctgcgctcgaggga

SEQ ID NO: 418 - DNA, 96 bp, Corynebacterium glutamicum
atgttggcctctgtgctcgccggggtcaacgtctacggatcggaaaatttcgtaggcctgggttctggatacgggggatttttcggcggcggttgt

SEQ ID NO: 419 - DNA, 339 bp, Corynebacterium glutamicum
ttggctgaagcagccaggatgcgtggggagcatagtagcgtcatccagcggacgtcttcggcggcaagtatttggtgggtgccgcgctgcgtccagctgcggatgagcagtgactttcttaatgccgtggcggcgtcggcgttttccgagcgggtgtctagcgcaacgagtgcggaaccgcgttgttgggcctggctggcgagcatgtgttttgccacgtcgacggcattgcgctcggacttaaaattcaacgccgcagatggtgcaagcagctgtgaaatgaggcgtagggcgcggacgcgttccagagaaagtgcaggcataacccctaaaataccc

SEQ ID NO: 420 - DNA, 975 bp, Corynebacterium glutamicum
atgcctgcactttctctggaacgcgtccgcgccctacgcctcatttcacagctgcttgcaccatctgcggcgttgaattttaagtccgagcgcaatgccgtcgacgtggcaaaacacatgctcgccagccaggcccaacaacgcggttccgcactcgttgcgctagacacccgctcggaaaacgccgacgccgccacggcattaagaaagtcactgctcatccgcagctggacgcagcgcggcacccaccaaatacttgccgccgaagacgtccgctggatgacgctactatgctccccacgcatcctggctgcttcagccaagcgccgctccagcctttcgcttgatagcgccgcagtccagcgcgcccgcgacgcactaacaaccgccgccgaaaaatcccccgtatccagaacccaggcctacgaaattttccgatccgtagacgttgaccccggcgagcacagaggccaacatttactccggcatttcggtggcgaaggtgacatcgtacaaggcccgcccatcggaacggaagattcctttgtgcttctcgattccatctgccccctttccctagcacttaacggcgacgaagcgctcacagagatgacccgtcgctacttccactcccgtggtgctgccactgtgaaagatctggtgtggtggaccggactgactgtgcgtgatgtaaagaaaggcatcgctgccgtgtcttcggatggactgattcactctgttgaaggcccgaatggtgaagaaatgtggatccctacctgggcagatgatgtcacagacgcagaggtttctgatgcactagcgttggaactaaccctccccgcctttgatgaatacctactttcctacaccgaccgcagccacgtcatggatcccgagcaccttttcagcatcggtcccggcaaaaacggtgtgttcaaacccttcaaagtagttcagggtgaggcactgccggtt

SEQ ID NO: 421 - DNA, 1251 bp, Corynebacterium glutamicum
atggaagcgcagcggcgtaaagagttgcgcaagcacaaggccattgccactggcctgttgatttttgctgccgctgtatattttctttgccgtttcgtggagacccgtccgggtgaaactgcagcgtgggtaggttttgtgcgcgctgcggcagaggccggaatgattggcgggttggccgactggttcgcggtcaccgcgctgttccgtcatccattgtggctgcctattccgcacactgcgattatcccgcgcaagaaagaccagttaggtgaggccttaagcgggtttgtgggggataacttcctaaatgcccagctcattacggaaaaagtctctcaggcgcggatcccagagcgcgccggggagtggctcgcccagccggaaaacggggagaaagtttcgcgcgaagtcggcaaattgaccgctaatattgtgcgcgcaatcgatccgtcagatgctgaagcggtgattaaatctgcggtgatcgacaagcttgcggaacccacctggggcccaccagctgggcggttgctggaacaactcctcgccgaaggcaaagccgaaccagttgtccaggaactcgcgcagtggctgcacaaaaaggcgttgggctccgagccgctgattgatcgcctgctcaacgagcgccgcccgatttgggcgccgaaattcactgcgcagctggtcagcggcaaagtctatgacgaggtcataaaattcactgaagccgtcgctgccgatcctaaccacgaggcccgcaaatcgctgcgccgattccttaataaattggcgcaagacctgcagcatgacccaggcatgattattaaagttgaagaaatcaaacgcgacatcatgggctccggcgccatcgcgcaagccgcgccaaccatctgggcgtcagcctccgagtcgctcattgaatccgcagaagatgagtcatcaattctgcgtcgcaaaattgccgaagcagctaccagctggggtcaaagattgcttgtcgacgactccctccggcattcactcgacacccggattaccggcgccgctgctttcctcgccgacaattacgcccccgaagtcaccggcattatctccgaaaccattgaacgatgggacgctgaagaagcttcagagaaaatcgaactcatggtgggcaaagacctccaatacatccgccttaatggcacaattgtaggtgcattagcaggactggccatttacgctatttcccatatcctcttcggagct

SEQ ID NO: 422 - DNA, 420 bp, Corynebacterium glutamicum
atgtccgatgcaaaagacgattccatcttgtccaagtggagcaatgcagcttccgagctcagcggtgccgtcagtggagtagcgaagaagctccgtgaagaactctctgagaaggaaaccttcagcaagcttaaaaccgaagccagcgaagccgtcgatcaagcaaagtccggctcctacctagatgccggtaaggaattcgcccgcgacgccggatccatcatcaaagatgcagccaaaaccgtcaaaggtgccgtcagtgattccgataaaaacgacgtgaaatccgccttcggtaacgccgtggaagcttcccgcgacaagttcgatgacaccctcgaaaagcgcaaggctaagaaggattccccagaaccaggcgatgacgatatcatcgatggagaagtaattcctccgcagaat

SEQ ID NO: 423 - DNA, 303 bp, Corynebacterium glutamicum
atggatatttccatgctcaacgtaataacgagctacaccatttgggccatttttgccatcatcggcatctgcggattcgttggtgccttcttggcagccaccaccagagaagatgcctttgaggttgctgatcgccaaaagaaaatggtgtgggtagcaatccttatcgcatccggatttgtcctcaccgcgctaggtccatcgattccgatcctgccatgggtcgccatcatcatgatcggcctgtactggtttgatgttcgcccgcaaatcaagagcatccttgaaggtgccggcggctgg

SEQ ID NO: 424 - DNA, 678 bp, Corynebacterium glutamicum
gtgcaagtttacactaggtttacttcagtggatattgaagagcagccctcgttaagagaaatcaagcgccaaatgaccctggaagcgatagaagataacgcaaccaggctcattctggagcgtggcttcgacaatgtcacaatcgaagacatctgcgcagaggcagggatatccaagcgcacattctttaactacgtggagtccaaagagtctgtggccatcgggcacacagccaagctcccaacggatgaagaacgtgaagcattcctggctacgcgtcatgaaaatattatcgatactgtatttgacctggtaatcaacctctttggcaaccacgacaactccaagtctggagttgcaggcgacattatgcgtcgacgcaaagagatccgggtgaagcatccagaactggcagtgcaacatttcgccaggttccaccaagcacgcgaagggctagaacacctaattgttgagtacttcgaaaaatggccaggctcccaacatctagatgagcctgcagatcgagaagcaatcgccatagttggcctgctgatctcggtcatgcttcaaggttctcgtgaatggcacgacatgccacaaggcacgcaagctgatttccaagcctgctgtcgcaaagcaattaaaaatacttttcttcttagaggtggattttcagaa

SEQ ID NO: 425 - DNA, 204 bp, Corynebacterium glutamicum
gtgaatggcacgacatgccacaaggcacgcaagctgatttccaagcctgctgtcgcaaagcaattaaaaatacttttcttcttagaggtggattttcagaatgacatcacaggtcaagccggacgacgaacgtccggtaacaacaatttcaaaaagtggtgcaccttcggcccacacctcagcaccatatggtgcagcagcaac

SEQ ID NO: 426 - DNA, 1647 bp, Corynebacterium glutamicum
atgacatcacaggtcaagccggacgacgaacgtccggtaacaacaatttcaaaaagtggtgcaccttcggcccacacctcagcaccatatggtgcagcagcaactgaagaagctgtcgaggaaaaaaccaaaggtcgcgttggatttatcatcgcagccctcatgttggcgatgcttcttagctccttgggtcagaccattttcggttctgccctgccaacgattgttggtgagcttggcggcgttaaccacatgacctgggtgattaccgccttcctcttgggccagaccatttcattgcctattttcggcaagttgggtgaccagtttggtcgcaaatacctcttcatgtttgccatcgcactgttcgtggtgggttccatcatcggtgctttggctcagaacatgaccaccttgattgtggctcgtgcactgcagggtatcgccggtggtggcttgatgattctttctcaggcaattaccgctgatgtcaccaccgcccgtgagcgtgcaaagtacatgggcatcatgggttccgttttcggactgtcctccatccttggcccattgcttggtggctggttcactgacggtccaggctggcgttggggtctgtggttgaacgttccaatcggcatcatcgcactggttgctatcgctgtgctgctgaaacttccagctcgtgaacgtggcaaggtctccgttgactggttgggaagcatcttcatggctatcgccaccaccgcatttgtcctcgcagtgacctggggtggcaatgaatatgagtgggcatcaccaatgatcatcggtttgttcatcacgacattggtcgctgcgatagtgttcgttttcgtcgaaaagcgtgctgttgacccactggtccccatgggccttttctcgaaccgcaacttcgtgctcaccgccgtcgccggtatcggcgtaggcctgtttatgatgggcaccatcgcgtacatgcctacctacctgcagatggttcatggtctgaacccaacgcaagctggtctgatgctgatcccaatgatgatcggcctgattggtacatccactgtggtgggcaacatcgtgtccaagactggcaagtacaagtggtacccattcatcggcatgctcatcatggtccttgccctagtactgctatcgacgctgacaccttcggcaagcttggctctcattggactgtacttcttcgtcttcggattcggcctgggctgtgcaatgcagattttggttctcatcgtgcagaactccttcccaatcaccatggttggcaccgcgaccggttccaacaacttcttccgccaaatcggtggagcagtaggttccgcactgatcggtggcctgtttatctccaacctgtccgaccgattcaccgaaaacgtccccgcagcagtggcttccatgggtgaagaaggcgcacaatacgcctcagcaatgtccgatttctccggtgcatccaacctcactccacaccttgttgaatcacttccacaagcactccgtgaagcaattcaactttcttacaacgacgccctgacaccaatcttcttggcgctcaccccgatcgcagtagtcgccgcgatcctcctctttttcatccgtgaagatcacctcaaggaaacgcacgaa

SEQ ID NO: 427 - DNA, 1632 bp, Corynebacterium glutamicum
atgacacacgaaacttccgtccccggacctgccgacgcgcaggtcgcaggagatacgaagctgcgcaaaggccgcgcgaagaaggaaaaaactccttcatcaatgacgcctgaacaacaaaagaaagtctggtgggtcctcagcgcgctgatggtcgccatgatgatggcctcccttgaccagatgattttcggcacagccctgccaacaatcgtcggtgaactcggcggcgttgaccacatgatgtgggtcatcaccgcatacctacttgccgaaaccatcatgctgccgatctacggaaagctcggcgacctggttggacgtaaaggtctcttcatcggagccctcggcatcttcctgatcggctccgtcatcggcgggcttgcaggaaatatgacctggttgatcgtcggccgtgccgtacagggcatcggtggcggtggactgatgatcctctcgcaggcaatcatcgcggacgttgttccagcacgtgaacgtggccgctacatgggtgtcatgggtggagtcttcggactctctgcagttcttggcccactactcggtggctggttcaccgaaggaccaggctggcgctgggcattctggatgaacatcccactgggaatcatcgccatcggtgtcgccatttacttcctggacattccaaagaagagcgtcaagttccgctgggattacctgggcactttcttcatgatcgttgccgcaaccagcctgatcctgttcaccacctggggtggatcccagtacgagtggtctgatccaatcatcattggactgatcatcaccaccatcgttgccgctgcactgctggttgttgtggaactgcgcgcaaaagatccattggttccaatgtccttcttccaaaaccgcaacttcacgctcaccaccattgcaggcctgatcctgggtatcgcaatgttcggcatcatcggctaccttccgacctacctccagatggtccacggaatcaacgccaccgaagccggctacatgctgatcccaatgatggtcggcatgatgggtacctccatctggactggtatccgcatctccaacacaggaaagtacaaactcttcccaccaatcggcatggtggttaccttcgtggcactgatcttctttgcccgaatggaagtgtccaccaccctgtggcagatcggaatctacctcttcgtcctcggcgtcggcctgggtctagccatgcaggttctggtcctgatcgttcagaacaccctgccaaccgcggtggtcggatccgcaaccgctgtgaacaacttcttccgtcaaatcggttcctcactcggatccgcgctggtcggtggcatgttcgttggcaacttgggaaccctcatggaagaaagaatgccagcagccatggcacaactttcaccagaagaacaagccgccatggcagcccaaggcggactggactccaacgaattgacgccggcaatcgtcaatcaattgccaaccgcgctccacgatgcgttcgccggttcctacaacgacgcactcatcccagtgttctacgtgatgatgccactgatcggcatcgcgctgcttctcttgctgtttattaagcaagaaaaactacgcgaaaccaccacagac

SEQ ID NO: 428 - DNA, 912 bp, Corynebacterium glutamicum
atgaccccgagttctcctgaagttcgtaatcgtccgagcgctgcgcctgaagagcgtcagtttgtgctcacttttggctgccctgactccactggaattgtggcgaagttgtcgtcgttcctagctgagcgtgggggttggattactgaggctggatatttcacggatcctgattcgaattggttctttactcgtcaggcgattcgcgctgagtcgattgataccacgattgagcagttgcgggaggagttcgctccgcttgcggaggagttcggcccgagggctaagtggagtttcactgacactgcgcaggtgaagaaggctgtgttgttggtgtctaaggagggccactgcttgcacgatttgttaggtcgtgtggctgagaatgattatccgatggaagttgttgcggttgtgggtaaccatgagaacttgcgttatattgcggagaaccataatgttccgtttttccatgtgccgtttcctaaggatgcggttggtaagcggaaggcgtttgaccaggtcgctgagattgtgaatggttatgatccggatgcgattgttttggctcgttttatgcagattttgccgccggatttgtgtgagatgtgggctggtcgtgtgttgaatattcatcacagtttcttgccgtcgtttatgggtgcgcgcccgtatcatcaggcgtatagccgtggtgtgaagttgattggtgcgacctgccattatgcgactggggatctggatgatggtccgatcattgagcaggatgttattcgtgtgacgcataaggatacgccgactgagatgcagcgtttgggccgcgatgcggagaagcaggtgctggctcgcggtttgcgtttccacttggaggaccgggtgctggtttacggtaaccgcacggttgtctttgat

SEQ ID NO: 429 - DNA, 666 bp, Corynebacterium glutamicum
atgacgatttcccgctccaccatggcccaaatccttgactacaccctcctcggaccagaagtaaccaactccgaactggccgcatttatagattccgcaattgagctgggagtcggcacgatctgtgtccccaacagcatggtcaacctaactgcaaaagcccaagaagctggaattcgagtggccaccgtcgcaggattcccgcacggcaaaacccccgcgttggtgaaagccgccgaagcgcgccttgccgtacagtccggagcttccgaagtagatgttgttttggatattgcggtagtgaaagagggagatgccaataggttgctgcaggaaattgtggcaatcagggaggctgttccatctcctgtggtgctgaaattcatcctcgaaacagctgttgtgagtgatgaagcaattgtgactgcagtgaatgcgttgattgctgctggtgctgacttcgctaaaacttccacgggattccacccagcgggaggggcaactgttgaggctgttcgggtgatggcttcggcttctcggggaagggttggaattaaggctgccggtggggtgaaaacttgggaagatgcggtggcgtttgttgaagcaggggctactcgcattggaacttctaatgcgggagccattttggagggtgcgccggag

SEQ ID NO: 430 - DNA, 150 bp, Corynebacterium glutamicum
ttgcatcccaaggcctctaaagcgggaaaatccaccacagatctcaacattcctgcaggttgtggtggatttttgcattgccccgaagcccgacccccgaatcgaacttcgaaccctcttaaccgccctcaattacccatcagtcccgat

SEQ ID NO: 431 - DNA, 897 bp, Corynebacterium glutamicum
atgcaaggctatttttcagcccctttcaccccaccccaggagtctgtgagttccctgatcaactactcaccacaacgagcagcctcgcagcagaatcggtctgatttttgcatcccaaggcctctaaagcgggaaaatccaccacagatctcaacattcctgcaggttgtggtggatttttgcattgccccgaagcccgacccccgaatcgaacttcgaaccctcttaaccgccctcaattacccatcagtcccgattagaacgccaaactactccggcgcaccctccaaaatggctcccgcattagaagttccaatgcgagtagcccctgcttcaacaaacgccaccgcatcttcccaagttttcaccccaccggcagccttaattccaacccttccccgagaagccgaagccatcacccgaacagcctcaacagttgcccctcccgctgggtggaatcccgtggaagttttagcgaagtcagcaccagcagcaatcaacgcattcactgcagtcacaattgcttcatcactcacaacagctgtttcgaggatgaatttcagcaccacaggagatggaacagcctccctgattgccacaatttcctgcagcaacctattggcatctccctctttcactaccgcaatatccaaaacaacatctacttcggaagctccggactgtacggcaaggcgcgcttcggcggctttcaccaacgcgggggttttgccgtgcgggaatcctgcgacggtggccactcgaattccagcttcttgggcttttgcagttaggttgaccatgctgttggggacacagatcgtgccgactcccagctcaattgcggaatctataaatgcggccagttcggagttggttacttctggtccgaggagggtg

SEQ ID NO: 432 - DNA, 867 bp, Corynebacterium glutamicum
atgaagccaattagatttgaagatgtccagcatgaaatgaatagaagacagttctctgcaaagtacacaagagtagtgggaacgttttggattaagaaggaatatgcggaaaatccggttgtggtggcagatgcgctattgcggagatttcccaacggtgtaatcaggggattcactgcactgattgtgagaggatactccctgttggatgaacctcgaacggcggaaattagcgtcccgaggggagcgagccatgtgactgtccttttgggaaaagtcgtgcgccacaaaatgccagaggtgcatgtggtgaaggggaggcgctgcgtgagtgttgcccaggcgctgttggatgagtttcccgcgatggttctggaacagcaggtggcattggtagaccatttggtgaggcagaatgaggatctgtacaagcagctgcagcaggtgaaagcgctaaaggaagtgatgcggctggtgaatccgatggcggagtcgaggccggaatcgatgctcagggtgaggcttcgtcgtgaggggatttgggggtttgagccgcagattccggtggagtgtgatggggtgacgaggtttgtggatttgggaaacccgaagcttcggatagcgctcgagtatcagggggctgtgcattttgaggatgcggagaagaggtcgcaggatagtcggcgggtgaatgagttgagggctgcggggtgggtggtgatagaagtaacctggcctgatcttgcggatcaggccaggtgggggaggttgcttactgagttaaggaagcagatcgggcgggcagaggaggaaaggaaaatgaggaggacaccgattccaatgccaccggatccgtttaggccttac

SEQ ID NO: 433 - DNA, 300 bp, Corynebacterium glutamicum
atgtccaacagcgaatgccacacccacggttacatcgaagaaaagcagcgttacctcgcacgcctcaaaagaatcgaaggccaaacccgaggcattcaccgcatgatcgacgaggaacaatactgcatcgacatcctcacgcagatctccgcagtgaactccgcactcaaaaacgtggcgttcggcctcctcgacgatcacctcgctcactgtgtcaaagaagcagctgacctcggcggcgacgaactcgacgcaaaactcaaagaagtttccgacgccatcgcccgcttcagtaaggcc

SEQ ID NO: 434 - DNA, 600 bp, Corynebacterium glutamicum
atggcggtgacgtcggtgacggacatggtgccggtggtgacggtgccggttttgtcgaggacgatggtgtcgacttttttggtggattcgaggatttcagggcccttgatcaacagaccgagttgcgcgccgcggccggttccgaccagaagtgcggttggggttgccaggccgagggcacaagggcaggcgataatgaggacggcgactgctgcggtgaatgctggggcgaggccggcgtcggtgaagacgaggtgcgcgatcagcgtcgcaatagcaattacgatgacaacgggaacgaaaacctgcgagatttggtcaacaagacgctggacaggggcctttttggactgtgcgtccgtgaccagtttagccatttgcgacagggtggtgtcggcgccgatgcgggttactttcaccatgaggcggccggaagtgttcagcgttgcgccggtaactttggagcccttggtgacttcaacggggatggattcgccggtgagcatggattcgtcgactgcggaggaaccttcgacgacttcaccgtcggtggcgattttctcgccggggcgggtgatgaaaacgtcgccgagtttaagc

SEQ ID NO: 435 - DNA, 2265 bp, Corynebacterium glutamicum
atggctcagacacccgccaaaatcccggcggcactgaatttcattgacgtcgacctcggcgttaccggcatgacctgcacttcttgctccgcccgcgtcgagcgcaaactgaacaagctcgacggcgttgaagcaaccgtcaactacgcgacggaatccgcacaggtcagctacgacccctcaaaggtcagccctgaacagctgattaagactgttgaggacaccggctacggtgctttcacgatggcttccgcagctgccgaatcagaagaggacaacgctccagctgacagcggccagtcccgcatcgacgcagctcgcgaccacgaagcagccgacctgaaacaccgcgtgatcgtctctgcactgttgtcagttcctgtggttttggtcagcatgatcccggcgctgcaattcaacaactggcagtgggccgtactcactttggtcaccccgattttcttctggggcggttcaccgttccacaaggcaacgtgggcaaacctgaagcacggttccttcaccatggacaccctggtttcactcggcacgtccgctgcttacctgtggtccctgtgggctttgttcattggaaatgctggtcaccctggcatgaagatggagatgcacctgctgccgtcggcctccacgatggatgagatttacctcgaaaccgtcgcggtcgttattacgttcctgctgcttggacgctggtttgagacaaaagctaagggccaatcttcggaagctctgcgcaagctgctggacatgggcgccaaagatgcagtcgtcttacgtgacggcgccgaagtccgcgttcctgtgaatcagcttaaactcggcgacgttttcatcacccgccccggcgagaaaatcgccaccgacggtgaagtcgtcgaaggttcctccgcagtcgacgaatccatgctcaccggcgaatccatccccgttgaagtcaccaagggctccaaagttaccggcgcaacgctgaacacttccggccgcctcatggtgaaagtaacccgcatcggcgccgacaccaccctgtcgcaaatggctaaactggtcacggacgcacagtccaaaaaggcccctgtccagcgtcttgttgaccaaatctcgcaggttttcgttcccgttgtcatcgtaattgctattgcgacgctgatcgcgcacctcgtcttcaccgacgccggcctcgccccagcattcaccgcagcagtcgccgtcctcattatcgcctgcccttgtgccctcggcctggcaaccccaaccgcacttctggtcggaaccggccgcggcgcgcaactcggtctgttgatcaagggccctgaaatcctcgaatccaccaaaaaagtcgacaccatcgtcctcgacaaaaccggcaccgtcaccaccggcaccatgtccgtcaccgacgtcaccgccatcaactacagcgaaaccgaaatcctcgaattcgctgcagccgtcgagtccgcctccgaacaccccatcgcccaggcaatcgccaaggccgccgaacacgagcaagtcaccgacttccaaaacaccgcaggtcagggagtcaccggtgtagtccgcggacacgaggtccgcgtgggcaggccttcaagcacgcttatcgacgccctcctccaccccttccaacacgcccaaaaaatcggcggaacccccgtagtcgtcacgattgacggcgtagattccggaataatcacggtccgcgacaccgtcaaagacacctccgccgaagcaatccgcggactcaaggaactgggactcaccccaatcctactcaccggagacaatgaaggcgcagctaaatccgtagccgctgaagtcggcatcgaccaagtcatcgccaacgtcctcccccacgaaaaagtccaaaacgtagaagccctccaagcacaaggcaaaaacgttgcgatggtcggcgacggcgtcaacgatgccgcagctcttgcccaagctgacctcggactcgccatgggagccggcaccgacgtagccatcgaagcctccgacatcaccctcatgaacaacgacctccgatccgcagtcgacgccatccgactgtcccgtaaaaccctcggcaccatcaagggaaaccttttctgggctttcgcctacaatgttgcactaatcccagtagcggcgatcggactcctcaacccaatgcttgccggcattgcgatggccttcagttcagttttcgtcgtctccaattccttgcgtctgcgaggattcaaagcaaggagcaac

SEQ ID NO: 436 - DNA, 450 bp, Corynebacterium glutamicum
atgacttttcaaaatgcagctttccccaatctctatccggacgtagatccattaacgcccattcccatcactttcggtgaacgtcttgcggcatgtgttgctgcaggtaccatcgctttcggcgcggcaagtggggacctacttattacaggagtgggtctcgttttggtcttgtttgccaccttcgtgccggcgtcgaaaacggcgaggaggattcgtcgagaagcgcgcgccaggtttccacaggaaggctggattgatgaggaaatcacacgcaataatcgaacatccatttttgtgccgctaatttggttcctgatcgcggcgattagtttcgcgatatacaggttcgtcgacgccacatggggctcgattatcgcggcagtaattgcaatgaccctcacgtggtttacgccaggcatgttcccgcgaagggttgacccatacccc

SEQ ID NO: 437 - DNA, 1863 bp, Corynebacterium glutamicum
ttgcggaaaaggacactgctgttcatgaaacttgcacctcgtatgcggatgaggagccccaaaactttcgcggccctcgcctcacttgctttagtcataggtctcggccaggtaccgatcgcccaagctcaaaccgagtatcgaaccgcctccgacggttccctgaactggggatttaggcaatcgttccgcaattacatccaaaccggcgtggccaaaggttccatcacgcttggcgacggcgcatccgacaacggtggcaacttcgcattcaccccacgcaccaacggcaccaccgtgaccagcgattcccaaggcaccgtggaattcaacggctccgtgcacttcctcggacaccaggcagaggacaaatggatcctggacaccaccatgtctgacatcaaaatggtgttcaacggatcctccgcgcagctagttgtggatttggttgcccgcgaattcaagggcaccacctacgatgacatcggcgaatacatcatctccgacgacatcgtgcttgccgacgtctccctcaactccgccgccgacttctcccaagattccatcgacctgtccggcaccaccgacctcaccgcagctggcgcccaagctttcggaggattctacgaaaccggcgaagccctcgacccgaccggcggcagcctgaccatttcctccaccaccaccgcgccatcgaccagcacgacctccacctctgcctcaacttccggtggaaccgccgactgttcctccggcgcattgggtgttgtcaccaccggaaccaacgacggcatgctgggcaccatccaggaagtaaacaacaccttcgcgatttggaacaacctcatcgtcaacaccgagcgcatgttctgcaacattgataccctcaaggcgcgcttcgacacggatgattccagcgattcagcgacctctgcgacttctgggactactgcgtccaccggcaccaccgctgcaactaccgcgggaaccacgggtaccactggaactgccagcaccgcttccggaacttccggaacttccggaacctccggcaccgcagcaactgtcgctggcaccaccccaactgacaatggcgtttgcaccgcttccggatctttgggcgtgacccaagcatctgcgcagtggggtgtgaaggcgtccttccagaactacattcgcggatcgatcgccaacggtagctggactctcaacggcgttggttttgataatcagcagttccaattctctggaaattccggagcagtcgacgcggaaaacaagaccggcagcatcaatttccctggttccatccacttcacgggtcacggcggaatcttggacatgcagatcgcaaacattgagatcagcttcaacggcaactccggcgagctgattgcggatgtcgtttcctctgacatggatggaaattccaccaactacggtcgcactgtcgtgggcaccctgaacttctctgcgttgaatgtttctgcaacggaagcttccggttccgcttcggtgtccctgtcacagtcgggttcgcaggcgttcgctgatttctacaccccaggcacccagttggatccgatcagtttcagcgcaactttgggcggcgacgccagctgcgccaccggatccacctcgaccacaggcgctgctgccaccgcgaacactgacaacaccgaaggtgttgccggcgaggaatccaccacccccgctaaccaaaacagccagttccaaatccgccaggccgctgcagattccaccggactggataccaccaccacaatgttgctcatcctcgcggcgttcgttgtcgcaggtggctccatgactcgcttcaccgtcggcaacccgactggaaaa

SEQ ID NO: 438 - DNA, 1077 bp, Corynebacterium glutamicum
atgaataacgcttttcgacgcacccttacatccgtagtcctcgccgctagcttggccttaacggcctgcgcaagctgggattcacctacggcatcttccaatggtgatctgattgaggagatccaggcaagctccacctcaacagatccgcgcaccttcacaggcttgagcatcgtggaagatatcggcgatgtggttcccgtaaccgacaacgcctcaccagctctgccagtttctttgaccgacgctgatggcaacgacgtggtggtggaggacgtgtcccgcatcctcccactggatctctacggaacctattccaaaaccatcgctggcctgggactcgtggacaatattgtgggtcgtactgttagttccaccgagcctgcattggcggacactgaggtggtcaccactggcggacacaccctcaatgctgaagcgatccttaatttacatccgactttggtgatcatcgaccactcgatcggcccacgcgaagtcatcgatcagatccgcgcagctggtgtcgccacggtgatcatgtcgccgcagcgttccattgcctcaattggcgacgacatccgcgacatcgcctccgtcgttggacttcctgaagaaggggagaagctcgcggaacgttccgttgctgaagtcgaagaggccagcacggttgtcgatgaactcaccccagaagatcccctcaaaatggtattcctctatgcccgcggaactggtggagtgttcttcattttgggcgatgcctatggtggacgcgatctcattgaaggcctgggcggcgtcgacatggctgctgaaaagggcatcatggatctggcaccagccaacgcggaagcacttgccgaactaaatccagacgtcttcgtgatgatgtcggaaggactagtctcgacaggaggtatcgacggtcttatggaacgccccggcattgctcagacaaccgccggacaaaaccaacgagtactggcgcttcccgatggtcaatcattggcctttggtgcccaaactggcgagttgttgctccgcgcatcccgcgaactgtatgtgcagggcggcgag

SEQ ID NO: 439 - DNA, 1068 bp, Corynebacterium glutamicum
gtgaaggaggttgacgtcgaaaagcaaaaagctggccgggtgcctggtgctatagctaagcgtcggaccgtgcggattgtgctgtttgtcgcgctgggcgcgatcgtgattgcggcgtcgctgtggtcgattctggtcggccaatacaccatcccgattcgcgatctacctgcgattttagcctccggtccgaccggtgcgcagacgatggcggaacaagtcgtgtggcaaatccgcatgccgcgcatcgtgctgggactgctcgtgggtgccgctttgggcgtggccggcgcgctgttgcaggcggtgttttccaacccgctggcggaaccgtcgatcatcggcgtgacctccggcgcgggcgtgggtgctgctgcggtgatcgtgtttaacctgacatttttgggcacatccaccgtcgcagtcggcgcgtttattaccgcggtgatcaccacgattttggtatatcagctggccagaagccgtggacgtgtgcaagtgatcaacctgatcctcacaggcatcgccattaatgcagtatccggcgcgctgacctcgttcttcatctacatcgcgccgacgagctcccgcgaagaaattattttctggcagatgggttccctcaacggctcgcaatgggcgcacgtcaacgtggtgtttgtgatcgtgacaatcggcctcgtcgccgcatttggcctgggcaaacagctcgatgtgctggcgctcggcgaaagcgccgccggacacgtcggcctcaacgtgaagaaactgcgcatcatcgcgatcgccgtatccaccctcctcactgccggtgccgtcgcatacgcgggactaatcagcttcgttggcctgatcatcccgcacctgcttcgcacagtcaccggacctgccaacaaaatcctcgtaccagcctccgcactgggcggcgcagcactgatcagcgtctctgacatcctcgccagaacgctcatcccatacgctgacctgccgatcggcattttcacagcgctggtcggcggcccaacattcttcataatgttgcgccgaatgatgaaaaagggcgtgcac

SEQ ID NO: 440 - DNA, 813 bp, Corynebacterium glutamicum
atggccattgtttccctcgacaacgtcaccgtatccattgaaggaaaaaagcttctcgacgccgtctccctcaaggcctaccccggggaagtgttgggactcatcggcccaaacggtgccggaaaatccactctgctgagtgtcctttcaggcgatcggcttcccgattcaggcgaagtcaacgtcggtggcttagatcccgcaacagcagcggcatccgatatggccagggtgcgagcagtcatgcttcaagatgtcagcgtggcattttccttcctcgtgtgggacgtcgtagaaatgggcaggcggccgtggcagaaggcgtcaacccccgaagaggatcatgaaatcatcgaagcagcgcttgccgccacctcggtatcgcaccttgccgaacgtgaaatcaccacactgtcaggcggcgagcgggcacgcgttgccttgtcccgtgtccttgctcagcaaacccccattgtgctgttggacgaaccaacagccgcgatggatatcagccaccaagaacaaactctgggcacagcgcgagcactggcagccgccggggcagcagtgattgtggtccttcatgatctcaatgcggccgctgcatattgcgacagcattgtgtgtctcagtgatggtcgagtgattgcctccggttctgttgatcaggtgtattccacggaaacgctgtcccgtgtttacggttggcctatcagggtcgatcatagtggaaaatatgttcgagtggagccggaccgttctgaggcgaatttaccctccgtactacaggtgaaaaatacggtttcaccagct

SEQ ID NO: 441 - DNA, 957 bp, Corynebacterium glutamicum
atgaacaagcttgccacccgtgcgctcgttgctctcacgggatccgccatcgccatgaccggcctcaccgtagtctcggctaatgcagccgagaaaaccggcaaatgccgcgttgtcaccaccacaggaaccgccgactggtcagtgcgtgaatcattcaacaactaccttgaaggtccaattgcaaacggtgcagcatacaaataccacggtggcatcgaggtccgtgacggtgtagaaaccaccggcacgaagtcagctcgcgagttcacctggccagtacttggcagcgaagaaggagccgtcaaacttggcggtggcgttcactggaccggacacaatcactactccggcgacgacgagtcccaggcgccagacaacttcatccttgatctcgacttctccaacccaaccgtcaaattcgatggcaacgagggcaccctgcttgtcgacttcaagtcccgtgagttcgttgataccaagaccgtcgctgacttcctcaccggaactcaggcagagttggctaccatcactttcgatgagccaatcgacctgacccaggagaacgtcaccgtcaccggccagaccaagctgactgcaactggtgtcgatgtcatgggcaccttctacccagaaggtgaagcacttgcgccaatcactttgaacctcaccaacgaagttgtatgcgacgagcctgaaacccccgttgagcctgaggttcctgtagagcctgagactccagtagatccggaaacctcggtcgacccagagactccagtagatccggaaacctcggtcgacccagaaaagcctggcgatgacaacaaggatgacggaagcaacagcagcagcaacggcgatatcctcggaatcttgggcatcctcgcagcgcttggtggcgttggtgcacttgtgtacaacttcctggtagctagcggattccttgcagcgtttaag

SEQ ID NO: 442 - DNA, 837 bp, Corynebacterium glutamicum
atgaatcgttttcctagtgccttattagcagcctctgtcgcgggggctgcgttggccattccagcgacctctgcacatgcagcagaatctatttgtacattcaccggcgatgttgggtggaatgtgcgcgattctttcaacagttatcttttgggaaacatcgcaaatggtagtgcttataaatataagggcgggttggacgttcgtgacggcgtccagaccgacggtaacggcaaaactccagcactgacctggccagttgattcggtgacgtcttcgaagatttccacttccggaggcgcgcactggaccggacacaacctgtaccccggtgatgacctcgcggaagtccctaacaatttcacgttggatcttgatttttccaacatcactgtggagctgagtggttctacaggtcggttgttggtggattacacatctcgggaatacatcaacacccacacgttgggtgagtttcaaactggtgaacaggctgagcttgccacgattacttttgccaaagctccagacctcacctctaattcagtcaacgtgactggcgatgtggcattgactgctgatggtgtggaagttttcggtggtttctacacggcaggggaggagttggcgccaatcacgctgaatctcactgcagatgagggatgtggatcgacccccgagccggaggacccagaaaccccttctgcatcgtcttctgatgtcagcagcagttccttcggggatacgattactcaggtgttgtcgattggttcgatggtgggcatggctggtttgttgttcacgatcgtgaattacttcatccaaagcttcgcccca

SEQ ID NO: 443 - DNA, 810 bp, Corynebacterium glutamicum
gtgggcgtggctaaatcaaagaaatctgctttacctaaagtcctgctcaccatcgtggtgatcctgctcctgctcgtgctggtagcagaattcgggctgcgcttcatgatcggaaaacaactgaaagatgagttccaagctcaggcttcctcacaaggaatctctgcaactgaagagccctccatcagcttcggcgcatccccactcctgttaggcatcgctcggggaagcatcaatgaagtcacaatcgacacccccgactccgtatccatcactaaccaagacggtgtcccctccatcagtggcacaccagagtcaactatccaactccaagggcttgatatcggtgaccgcgacaacccagtcgcagaccacctcaccttaaccacattggcaaccgacgatttcatcctggcaaccatccaacagcagatggccgaagcaaccggcgggaacagcacctcccaaggattcgcagaacagcttatccaggaactcatcaaagtcaccgacattacttccgatgcagctaatcaaaccatcgaagttgaattcaccgacggcgccgcccgagcctcactgcaccccatcgtaacgaacggccaactcggctttgagatcgtagattcccaactcttcggattcggcctccccgatgaaatctcccaaatgctcaccgacgcactgcaatcatcaatcaatgaagtagccggtggcctgcaaatccaaagcctcgaagttgtcgacgctggcatcaacgtcaccctgaccggagacaacatcaacatccagaccctagaagccgcacag

SEQ ID NO: 444 - DNA, 813 bp, Corynebacterium glutamicum
atggctgatcacgcccacaatctgcgcgcctctttccgcaagggtgcaaacggaaagcagaagccaatcggcgtgatcacccgcggcaccaccggtgtgaaccgcctacggcgcttcgatcggtggtgctttcatcatcccaaaatacgttcgcttctcgacgccacttccctggcgttagatgtcgggtacggcgccagccacacaaccaccgtcgaatggggacgttggctccaccgcctccaacccgacatggatgtcatcggcctagaaatcaaccccgaacgagtcctcgaaccccaaaacggcgtgtcctttgaactcggcggattcgaacttgccggctacaccccacaactcgtgcgcgccttcaacgtgctgcgccaatacgacgtggaccaagtcgaagccgcatgggaaaccgtcacctccagacttgccccaggcggactgtttttcgaaggcacctgcgatgaaatcggcaaacgctgcacctggatcacacttaactcagacggcccacaagaactcacccttgcatgggatccttggggaatctccaccccctccgatgtggccgaacgactgcccaaaatgctcatccaccgcaacattcctggtgaaaagattcacgcactgctagcagccgctgatttagcctgggactactgcgccggctgggaaccccacggaccgcgcgtgcgctgggaaaaagcccgcgagatgctcatcgaccaaggttggcccatcgcagtgtccaggcgacgcgtgggcgatagcctgctgactgtaccgtgggaaacggtggcgcct

SEQ ID NO: 445 - DNA, 501 bp, Corynebacterium glutamicum
atggcaacgcgtacagaaaacaccattacgatcaatcagcccgtcggcaaggtgcaccaagcactgaccaccgaagcctactgggcatacatcgcagagaacctctcccccgaagctggcgaggtcaacgagttcaccgcagctgacggtggcgcaaccgcaaccctttttgaggtcctcccactcgaggtcctcccagaggcagttcgcgcaatgatcagccaggcactgaaggtcaagcgagtcctcacggttcctgcactgaccaacaacgccacaaccgtcgagtacaacgctgacgtcaagggcacccctgttgatttcaagggcaccatcgccatcaacggcgacgacgcagcaaccaccttcgactacagcaacgaagtgtccgtgaacatcccattcatgggccctgcaatcgagcctaaggttgccgacgcactcggcgagctcttcgcaaacgaaggcgctctgaccgaaaagtggatctccgagaacctc

SEQ ID NO: 446 - DNA, 1101 bp, Corynebacterium glutamicum
ttggattcatcgctagcccaggaaatcgccgcgatcgacggcgtcgaactcgattcggaagtcactttcgccgatctgacgaccctccgcatcggcggaaaaccccgcagcgccgtacgttgccagaccacggaggcgctggtcagcgccataaaattgcttgacgacgcctccctccccctcctcatcgtcggcggcgggtccaatctcgtcgtggccgacggcgatctggatgttattgccgtcatcatcgaaaccgacgacgtctccatcaacctcaccgacggtctcctcaccgccgatgcaggcgctgtttgggacgatgttgtccacctttcggtggatgccggcctcggtggaattgaatgcctctccggaatccccggctccgccggcgccaccccagtccaaaacgtgggcgcctacggcacggaagtttccgatgtactcacccgcgtccagcttctcgaccgcaccacccaccaagtctcctgggtcgacgcctccgaactcgacctctcttaccgatactccaatctcaaattcaccaaccgcgcagtcgtcttggcgatcgaactccagctcctcaccgacggattgtccgcgccgctacgttttggtgaattgggacgtcgattagcgatctccgaggccgaaccccacccacgtcgccccgtccgcatggtccgcgacgccgtcctagaactccgccgcgccaaaggcatggtcgtggaacacaccgaccacgacacctggtccgccggatccttcttcaccaacccaatcgtcgacccagcccttgccgacgcagtctttgaaaaagtcggcgaacccaccatgccccgcttcccagccggcgatggcaaagaaaaactctccgcagcctggctcatcgaacgcgccggcttcaaaaagggacaccccggcgcaggcgcaaaagcctccctgagcaccaaacacaccctcgcactcaccaaccgtggcgacgcccgcgcctccgacctcgtcgcattagccaaagaaatccgcgacggagtcctcgaaaccttcggcgtcaccctcgtcccagaacccgtctggattggaatcagcatcgatgac

SEQ ID NO: 447 - DNA, 651 bp, Corynebacterium glutamicum
ttggaatcagcatcgatgactgaattttccgacgtccctggcaccgccgccccactgcacagggcgttggaaaatgccggatactccactttagaatccctcgacggtgttccctacaagacgttgattgccctgcatggtgtcggaaaaactggcctcggcaggatccaggcagcattgttggaacgtggcctttccctgggggaagaaacaaaaggcgccaccatcaccccaggtcacaccggtaaagtggcctcagatatcaaaactcacatcacttccgtggatcccgtcgcatacgtcgatggtctagaggggcgtcgggttgctcacgggcaccaattgctatcgatcttcggtcgcgtcaccggcgcggaacccaaaatgtggggaccctccatgatcggatacggctcagtccactacgtttcccacaccggaagggaaggcgattggtttcagtgtggtttcagcccggcgaagtccaaaatctgcctgtatggcctgaaggattcgcctcgcggtgaggaattgctgcagaaacttggaaaatacaccgaaggccgcggatgcgtgtacatcaataaaccggaagacatcgatttggatgttttagaggccatgatcagcgagtcatgggccggccaaggc

SEQ ID NO: 448 - DNA, 735 bp, Corynebacterium glutamicum
atgctgcctggatcctgccgaggccagtttttccgacaccatgcagggcaatcaacgtcttgtagggaacaccgtcgagggattctaaagtggagtatccggcattttccaacgccctgtgcagtggggcggcggtgccagggacgtcggaaaattcagtcatcgatgctgattccaatccagacgggttctgggacgagggtgacgccgaaggtttcgaggactccgtcgcggatttctttggctaatgcgacgaggtcggaggcgcgggcgtcgccacggttggtgagtgcgagggtgtgtttggtgctcagggaggcttttgcgcctgcgccggggtgtccctttttgaagccggcgcgttcgatgagccaggctgcggagagtttttctttgccatcgccggctgggaagcggggcatggtgggttcgccgactttttcaaagactgcgtcggcaagggctgggtcgacgattgggttggtgaagaaggatccggcggaccaggtgtcgtggtcggtgtgttccacgaccatgcctttggcgcggcggagttctaggacggcgtcgcggaccatgcggacggggcgacgtgggtggggttcggcctcggagatcgctaatcgacgtcccaattcaccaaaacgtagcggcgcggacaatccgtcggtgaggagctggagttcgatcgccaagacgactgcgcggttggtgaatttgagattggagtatcgg

SEQ ID NO: 449 - DNA, 174 bp, Corynebacterium glutamicum
gtggatttgtggtggatttttgcgtcttcgctatctgaaaccgcgaggatccaccacagattcgagttttcctttgaaacgtggttgatccttgccctggaatctttcaggaatcacatcagtcccactggttacaaagtggaaacccctcagaatcgcttctggggggtgaac

SEQ ID NO: 450 - DNA, 1704 bp, Corynebacterium glutamicum
atgtcagcatacgaaaccaaagaatggctccagcactacccagagtggacgccacactcgctggaatatggcgacaccaccctgctggacgtttacgacaacaacctggccatcaacgcagacaagccagccacctactttttcggtcgttcacaaacctacggtgaactggacaaagaagtccgcaaaactgccgctggcctgcgcgcactaggtgtccgccccggcgatcacgtagcgattatcctccccaactgcccacagcacatcgcagctttctacgcagtgctgaaactcggcgcagtagtcattgagcacaacccgctctacaccgcccacgaactgctcgaacccttcaaagaccacggtgcccgcgttgccatcgtctgggacaaagcctcccccaccgtcgaacagctacgtggacagacccagttggaaaccatcgtgtcggtcaacatgatcaacgcgatgccaccactccagcgcctagcacttcggctcccaatccctgcactgcgcaagagccgcgaatccctctccggcgcagcccccaacaccgttccttttgaaaccctgaccagcgcagcaatgggcggcgacggcgacgacgtagtttcagaacccaccgtgaccaaagaatccgtcgcgctgatcctctacacctccggcaccaccggacgccccaagggtgcccagctcacccacggaaacctgttctccaatctcctccaaggaaagcactgggttccaggtctcggagacaaaccagaacgcatgcttgcagccctaccaatgttccacgcatacggtctgaccatggtcggcacactgtccgtgttcatcggtggcgaaatggtgctacttcccaccccacgcatcgacctgatcatgaacgtaatgaaaaagcacaccccaacctggctaccaggcgtgcccaccctttacgaaaaaatcgtcgacgcctccgaaaaagaaggaatccccatcaagggagtccgcaacgccttctccggtgcatccacactctcccagcgcaccgttgaacgctgggaaaagcacaccggcggacgcctcgtcgaaggctacggcctcaccgaaacctcccccatcatcgtgggtaaccccatgagcgatcaccgacgccaaggctacgtaggaatccccttccccgacaccatcgtgcgcatcgcaaacccagaaaacctcgacgaaaccatgcccgacggcagcgaaggcgaagtcctagtcaagggcccacaggtgttcaagggttacctcaaccaggaagaagccaccaagaacagcttccacggcgagtggtaccgcaccggcgacgtcggagtgatggaagaagacgggttcatccgcctagttgctcgcatcaaggaagtcatcatcactggcggtttcaacgtgtacccagctgaggttgaagaagtcctcgcagagcacccagacattgaagattccgcagtcgttggtatcccgcgtgaagacggctccgaaaacgtcgttgctgccatcactttggtggaaggtgcagcgctggatccggatggcctgaaggaattcgcccgcaagaacctcacccgctacaaggttccgcgcactttctaccactttgaggagatgccgcgggatcagatgggcaagattaggcgtcgtgaagtgcaggcggagttgttgaagaagctcggcaag

SEQ ID NO: 451 - DNA, 1254 bp, Corynebacterium glutamicum
atgcgcgtagctatgatttccatgcacacctctccattgcagcagcccggaactggtgattcaggcggcatgaacgtctacattctttcgaccgcgactgagctagcgaaacagggtatcgaggtcgatatttacactcgtgccacgaggccttctcagggtgagatcgtgagagtagctgagaatttgcgggtcattaatatcgctgcggggccgtatgaggggctttccaaagaggagcttcctactcagttggcggcgtttaccggcggaatgttgtcgtttacgcgccgggagaaggttacttatgatctgatccattctcactattggctgtctggtcaggtggggtggttgctgcgcgatttgtggcggattccccttattcatacggcacacactttggcggcggtgaagaattcttatcgggatgattcggacactccggagtcggaggcgcgtcgcatttgtgagcagcagctggtggataacgctgacgtgttggcggtgaacactcaggaggagatgcaggatttgatgcatcactacgatgcggatccggatcggatttctgtggtgtcaccgggtgcggacgtggaactttatagccctggaaatgatcgcgcgacggaacgttcccgtcgtgagctgggcattccgctgcacacaaaggtagtggcttttgtgggtcggttgcagccgtttaagggcccgcaggtgctgatcaaggcggttgcggcgttgtttgatcgcgatccggaccgaaatctgcgcgtcattatttgtggcggcccttctggtccgaatgcgacaccggatacctataggcatatggcagaggaactgggcgtcgaaaagcgaattcgctttttggacccgcgcccgccgagcgagctagtggccgtgtatcgggcggcggacatcgtggccgtgccaagttttaatgagtccttcggactcgtcgccatggaggcgcaagccagcggcacaccggtcattgcggcccgggttggcggcctgcccatcgcagtcgcggaaggggagacgggattgcttgtcgacggccactccccgcatgcctgggccgacgccttagccacactcttggacgatgacgaaacgcgcatcagaatgggtgaagacgccgtcgaacacgccagaacattctcctgggcggccaccgccgcacagctatcgtcgctgtacaacgacgctattgccaacgaaaatgtcgacggtgaaacgcatcacggc

SEQ ID NO: 452 - DNA, 744 bp, Corynebacterium glutamicum
atgactaacggaaaattgattcttcttcgtcacggtcagagcgaatggaacgcatccaaccagttcactggatgggtcgacgtcaatctgaccgaacagggtgaggctgaggccaagcgcggaggcgaactcctcgtcgaggcaggcgtcctcccaggcgttgtatacacctccttgctgcgtcgcgcgatccgcactgcaaacatcgcactgaacgctgcagaccgccactggatcccagtgatccgcgactggcgcctcaacgagcgtcactacggcgcactgcagggccttgacaaggctgcaaccaaggaaaaatacggcgacgaccagttcatggaatggcgccgctcctacgacaccccaccaccagagctcgcggatgacgcagagtactcccaggcaaatgaccctcgttacgcggacctcgacgtagttccacgcaccgaatgcctcaaggacgttgtggttcgttttgttccttacttcgaggaagaaatcctgccacgcgcaaagaagggcgaaaccgtcctcatcgcagcacacggcaactccctgcgtgcgctggttaagcaccttgacggcatctccgatgctgatatcgcagagctcaacatcccaaccggcatcccactggtctacgaaatcgccgaagacggttccgtagtaaacccaggcggcacctacctcgatcctgaggcagcagcagccggcgcagcagcagtagcaaaccagggtaataag

SEQ ID NO: 453 - DNA, 1239 bp, Corynebacterium glutamicum
gtgagcactcttcttgctttcgtattgggcgtggtcctcatgggcctcgccctacctgcgtatacgaaaattaaagatcggatgcgtcgccacaagtccgcggtcaccctgtccgaaaaccaggtcaccacggtggggcaggtcctccacctggcgattcaaggctccccaacgggaatcacggttgtcgatcgcaccggcgacgtcatcttatccaacggccgcgcccacgaattgggcatcgtccacgaaagatccgtcgacggcaacgtttggcgcgtcgcccaggaagccttccaagaccaagaaacccactcactcgacgtccacccagaccgcaatccgcggcgcccgggtagtcgcatcaccgcagtgcaggcagtggtcaagcctttaacgcttatcgacgatcgtttcgtgatcatctatgcctccgacgaatccgaaaacgtgcgcatggaatcggcacgccgagacttcgtcgcaaacgtctcccacgaactgaaaacccccgtcggcggcatggcactcctcgcggaagccctcatggaatcctccgacgacccagaacaagtcgaatacttcggatccaggctccaccgcgaagcccaccgcatggccgacatgatcaacgaactgatctccctttccaaacttcagggcgccgaacgactccctgatatggaacccgtccaggctgacgacatcatcagcgaagccatcgaacgcacccaactcgccgccgacaacgccaacatcgaaatcattcgcggcgaccgcaccggcgtttgggtagaagccgatcgatccctgctggtcacagccctggcgaacctgatcagcaatgcaatcaactactcaccaaaatcagtccccgtctccgtttcacaaagcatccgaaacgacgtggtcatgatccgagtaaccgaccgtggcattggcatcgcacccgaagaccaaggccgagttttcgaaagattcttccgcgtcgacaaagcccgctcccgccaaaccggcggaactggccttggcctcgcgatagtcaaacatgtcatggctaaccatggcggtagtattagtttgtggtcacgtcctggaacaggctccacatttacacttgaactccctgtataccacccagagtccaaggaaccggcaggatctaagcagggacctagtttggattcacctattcgtacgactgcgtccaaagcatctgggcgccgaaaggaaaaatca

SEQ ID NO: 454 - DNA, 696 bp, Corynebacterium glutamicum
atgacgagaatcctgatcgttgaagatgaggaatcgttagcagatcctttggcctttcttcttcgcaaagaaggttttgacaccatcatcgccggtgatggcccaaccgcacttgtggagttcagtcgcaacgaaatcgacatcgtcctcttagacctcatgctcccaggcatgtctggcaccgacgtatgcaaagaactccgcagcgtatccactgttcccgtcatcatggtcaccgcccgcgactccgagatcgacaaagttgttggcctcgaactcggcgccgatgattatgtaaccaagccatattcttcccgcgaactcatcgcccgcatccgcgctgtcctgcgccgacgcggagttactgaaaccgaagccgaagaattaccacttgacgatcaaatcctcgaaggcggccgcgtccgcatggacgtcgattcccacaccgtcaccgtcggtggcgaaccagtgagcatgccactgaaggaattcgaccttctggagtacctcctccgaaacgccggccgagtcctcacccgcggacagctcatcgaccgaatttggggcgcagattacgtcggcgacaccaaaaccctcgacgttcatgtcaaaaggttgcgttccaagatcgaagaagagccatctcgccctcgttacctcgtgaccgtgcgtggattgggctacaaattcgagctg

SEQ ID NO: 455 - DNA, 879 bp, Corynebacterium glutamicum
atggacaacaataattcctacctctggccagtaacctacgacgaagtctcccatgaattaaccaagtggaagttctacaaacacttcaccaaaatctcaggatcggtgtatttaaagaacgatctgatcgatgatcctgttttagtcacccaagcactcataaagagatgccctcaaggagtgctgaggggatatgcggcattgaatcgaagaggatatcaactattcgacgacccttggatgcccataattagcatttcgggtgagcctcgcacgagaaaaacaaccaacgtcggaaaaatcattcgtcgcgaaacccctgaaaatctaaggcgtagtggggaattcacgctcgtgagtgattcccaagcacttttggatgtgtttagtttgcacgggctcgatagttttgagcatcaggtggcgttgatcgatcatctgattaggcagtgtccggatttgaaggatgagatcaaaaaggttcctgaactgcggaaacatgcggaatttacggatgagtttgcggagtcgccaccggagtcgagattgcgggtgcgtcttcatatgcaggggtaccggaattttatgccgcaggttcgtgtggaattggaggggaggaggttttatttggatttggcggatccggtgtggggtgtcgcgttggaatataacggtgggtggcattacaccgctgagcagaggtcgaaggatgcgtttcggaagaatgctctgaagaatgcggggtgggatgtttttgaggtgacttctaagacgttgcagagtcagcaggcgtgggattatttctttcagcaggtcagggtggcgattcagcggaagtatgcggatcgtaagaggaggttgccgatgcagactgttagt

SEQ ID NO: 456 - DNA, 2586 bp, Corynebacterium glutamicum
gtggcgaataaactccgcatggcattaacagtgctttcggttgtgctaggaaccgcatttttgtgtggctccctcctcctcacacattcccttgaaagaacattttcctccatcgttgatgccggcgtggagggcgttgacgtgggcgttatcgcgcaacaaaacaaccccgacggcgtacctttctccgtcatcgccgaaattgagcagtatccggaagtccgcgccgtcaacatcatcggcgacggccccggcatgccctccggcaccaccatgaccggccaatccgcgctgatcctcaccgactccgacggcaatcccctgcaagcaggcagctccggcacgcacccgctagccatttatccgcagggcgagtgggtctcgcccgagccaacgcttatcgacggccacttccccacaaaacccgacgaggtagtagtcaacgcttcggccgccaaacgtggcgggctctccctcggtgatcacctaacgatcgtcacacccaccgaacgcatcgacgccaccctgtctggaaccttcgaatcaaacaccgacgtcgcaggctgggtcggagtcggattcaccccacagcgctacgtcgaactgttcaccaacggcaccgacgccagccaaatcaccatcgcagtcaacgacggcgccgaccccatggcagtccgcaaccgcatcggcaaaaaccaccgcgacctcctgcccctgctgcccgagcaaatcatcgaccaaaccaccggcgacaccgcccgccaactggagttcatgacctacgtgctcctggcattcgccgcgatcgcactgattgttggctcgttcatcattgccaacaccttcgcgatgatcgtcgcccaacgcaccggcgaattcgccctcctccgttccattggtgtctccacgttccaaatcggattctccgtgattatggaagcagtattcgtcggacttatcggcggtttcatcggcatcgcagttggcttcggagtggtcaatgcacttgtccaagtgctcaaccaattcggcgacaccctctcctccatcgacatcacctacaacgccggatccttcatcttccctgtcctcttcgccgtcactgccaccgtactaagctccatatcgcctgctcaccgcgccggtaacctcccaccagtccaagcattcgaatcctccgatgcacgcagcgacgccctcggaaggatccgcttcctcgtcgccgccgtcatgctcacccttggaatcagcctgacgatcgcaggtgccgtggtatccgccatcaacggagatgaattcaaaacagaaacacgcctcgcattcatcggcgctggacttctcttagtgttcttctcactctccctgtccggtcccgcactgatggtggcgacctctcagactcttggcgtggcgataatgtcgccgttccgagccgtcggcaagctcgcacaacgcaacaccctgcgcaatccgcgacgctccgcaaccaccgcactggccgtcactttgagcgttggcctcgtcgcctgcgttggagtcatcggcgccaccacccgcgccagcgtcttcgggtccatggaatccaccatcaaatccccatatgtcctcgacagcatcggtggcaccatgatccctggacaacccgccggcggttcaaggtcactgtccatgtccgcagccgtcgcacaggaaatcgcacaaacccgcggagtcggcaaagtgggcaccctcatgaccggcagcgtccaagtcaacggatgggacaacgaaaacaccacaattttcgacggcgacctctctcagttcctcgacctcgcagtccgctccggcgacgccttcgacgacgaaacccccggcgtcatgatctccaccacctacgccgaccaatccgacctcgaagtaggcgacaccgtcaccgtcaacccctacggatccgacgacggcatccgcgtccccatcaccggcatctacgcagaaaccaacctcgtcggacacctcatggtcaacgcagccgccaccaaccgagtcctcacctccgcggacacctaccaccggtcccaaatcttcgtcaacggcgacggctccaccaccaacgaagaactccgcgacatcctcgtcgacgccgtagcccccttcctcatcgtccaagtgaaatccaaagatgaattccgcggaagcctcggcacccaaatcaaccaattgctcggcatcatctacggactgctcgccctggcagtgatcatcgcagtcctgggaatcgtcaacacactgttcctctccatcagcgaacgcacccgcgaaatcggaatcctccgcgccaccggcgtccaacgaggacaaatccgccgcatgattaccctcgaatccgtcatcctctccatccacggcgcaatccacggactcctcctaggtacatttatcggctgggcaatcgtcagttgtctccgcacccgaggcatggcacccgtcgaattcccctggacccaaatcggattaatgctcatctccgcaatcatcatcggaggcatagcagccctcatcccagccaaccgagcctcccgaatctcccctttggaagcaatcaac

SEQ ID NO: 457 - DNA, 903 bp, Corynebacterium glutamicum
gtgaatcggtcaaattcttcttcggtatttttaggtttccccgagtcttcgccagcggcggcatcgattcgtgctggggaggaactccctcttgatttcccacgtgaatggtatgaattcacggatccaactgatattgagcatgtatttagcatcgatttaacgtggcttgagtctaattggaattgcacctttggtacccccgattgtttaggtattgattccgaaaacgccgacgtgggttgttgcggccacggtgcattcttagcagatgagacagatcgagatcagctttatgatgccgttgctcagatgcccgctaagtattggcagctacgccccgcctccacggactcgtttttagcatccgatgacggcaccgacattgagccgtggctgacatgggatgaattagatgatgaagacggcaatcccgagcccgctttgaagacaactgtggtcaacggcgcctgtatttttgccaacagggcgggttgggaaacaggcgcggggtgtgcgctgcatcagtggggcgtgaacgcaaatgaggatctaaccgtcgtcaagcctgaagtttgttggcagctcccgctgcgccgcctggaggcctgggaagagcgccccgacgggcaagaaatcttgcgcaccacaattactgaatacaaccggcgcggctggggcaacggcggcgaggatttcgactggtactgcaccacctctccgcgctgccacaccaatgccgaacccatgtggaaaacacaggaaacagaactccgtgcactcatgggaccaaactcctacgaggtgttacgtaaatatttggaagcacgatcagccatcccagcacatttgcgagcccagcacccagcttctgcgagtaacaataatgagactcctcgcggt

SEQ ID NO: 458 - DNA, 927 bp, Corynebacterium glutamicum
gtgagattaggtgtattagatgtgggcagcaatactgtccacctagttgcagtagacgcgcgtcccggtggacaccccaccccgatgagcaattggcgtaccccactgcgccttgttgagcttcttgatgactccggggcgatctccgaaaagggcatcaacaaactcacctcagcagtcggggaagcagcagacctagcgaaaacgctcggctgcgctgaactgatgccatttgctacatcggcagtccgctccgccaccaacagcgaggcagtgctcgaccacgtggagaaggaaaccggcgtccgcctgtccatcctttccggtgaagacgaagcacgccaaactttcctcgcagttcgacgttggtatggatggtccgcagggcgcataactaacctcgacatcggtggcggctccctggaactatcctccggaaccgacgaatccccagacctcgcgttctcactggatctgggtgcgggccgcttgacccacaactggttcgacaccgatccaccggcacgtaagaaaatcaacctcctgcgcgattatatcgatgcggaacttgcagaacccgcccgccagatgcgcaccctagggcccgcgcgcctggcagtgggaacatccaaaactttccgcaccctggcacgactgactggtgctgcgccctcatccgcaggaccacacgtcacccgaaccctcaccgcgccgggtctgcgccagctgatcgcatttatctcacgaatgactgcggcggaccgcgctgagctggaaggtatcagctcggatcggtcacatcagatcgtggcaggtgcgctagttgcggaagctgcgatgcgtgcgttggatattgacaaggtagaaatttgtccgtgggcacttcgtgaaggtgtgatcctcaccaggatcgacaaaggactcgag

SEQ ID NO: 459 - DNA, 813 bp, Corynebacterium glutamicum
ttggcgaaaatgagtgaagagaaactcacagtcgctgagctgatggcgcgtgccgcgaaagagggacgctccaccgatgctccccgacgacgcaggcgccgcagcatcgaagacggtggcgtatccgttgctgagctgaccggctccattcctgccgttaaggaaaagcccgcggagtccaagcactccagcgtgcccatcgatgcaccagcagaacctgaggttgttgaggcccccaagcctgagcccgccgaagaagtagaagtggcttcggtggagggcgacgtcgataagcaggaaacccctgagcgtccggcgccgagcaacgaagaaaccatggtgctgcgcatcgtggatgaaaaagatccaattagcttgacgacgggcgcgttccccgtggttccggcagttgccgccaagccggcgcccgtagtgcgcgcggagaaggacgccgatgtggagactgccgtaaaggcagatttcgcagaggtggaagtcgataacactgacaccacgcagatggctgtggtggaagaagttgacgaggagccagagcaagaaaacaaaatgtccgtattcgcgatcatcatgatggcgatcgtcggagttgttctcggtgtcgttgtattcctcggctttgaaatgctgtgggagcgcctgaacaagtggatcgtcgctgttctggcagtcggcgtgaccttgggaatggtgggcatcatccacgctttgcgcacctcacgtgatggtttcagcatggttctcgcaggaatcgtgggcctggtcatgacgttcgggccgctggcaatcgtcatg

SEQ ID NO: 460 - DNA, 810 bp, Corynebacterium glutamicum
atgacaacaattgctgtaatcggcggcggacaaatcggcgaggctttagtctcaggtttgatcgcggccaacatgaatccacaaaatattcgcgtcaccaaccgttcggaagagcgcggccaagagctgcgtgaccgctacggcatcctcaacatgacggataattcccaagccgcagacgaagccgacgtggtgttcctgtgcgtgaagccgaaatttatcgtcgaagtgctctccgaaatcaccggcactttggataacaactccgcacaaagtgttgtggtcagcatggccgcaggcatcagcatcgctgccatggaagaaagcgcctctgcggggctccccgtcgtgcgcgtcatgccgaacactccaatgctcgtgggcaagggcatgtcgactgtcaccaaaggccgctacgttgacgcggaacagttggaacaagtcaaggacttgttgagcaccgttggagacgtcctcgaagtcgcggaatcagacatcgacgcagtcaccgcgatgtccggatcctcccctgcatacctgttccttgtgaccgaagcgctcattgaggcaggagttaatctaggcctgccccgcgcgaccgctaaaaagctcgctgtggcctcattcgaaggtgctgcaaccatgatgaaggaaaccggcaaagaaccctcagaattgcgcgcaggcgtttcctcacccgcaggcaccaccgtcgcagccatccgagaactcgaagaaagcggaatccgaggcgctttctaccgcgcagcccaagcttgcgccgaccgatctgaagaactcggaaagcgc

SEQ ID NO: 461 - DNA, 1122 bp, Corynebacterium glutamicum
ttggtgacgcgaatattttgtggattcatgttggccgcgatcaaacctgagactaaagcctcgccgatttgtccgccgccgattacagcaattgttgtcatggttcccacactgccactaaccacccctgttttgcagcagcgggggcccaaaacgacaaattacatgacgattgccagcggcccgaacgtcatgaccaggcccacgattcctgcgagaaccatgctgaaaccatcacgtgaggtgcgcaaagcgtggatgatgcccaccattcccaaggtcacgccgactgccagaacagcgacgatccacttgttcaggcgctcccacagcatttcaaagccgaggaatacaacgacaccgagaacaactccgacgatcgccatcatgatgatcgcgaatacggacattttgttttcttgctctggctcctcgtcaacttcttccaccacagccatctgcgtggtgtcagtgttatcgacttccacctctgcgaaatctgcctttacggcagtctccacatcggcgtccttctccgcgcgcactacgggcgccggcttggcggcaactgccggaaccacggggaacgcgcccgtcgtcaagctaattggatctttttcatccacgatgcgcagcaccatggtttcttcgttgctcggcgccggacgctcaggggtttcctgcttatcgacgtcgccctccaccgaagccacttctacttcttcggcgggctcaggcttgggggcctcaacaacctcaggttctgctggtgcatcgatgggcacgctggagtgcttggactccgcgggcttttccttaacggcaggaatggagccggtcagctcagcaacggatacgccaccgtcttcgatgctgcggcgcctgcgtcgtcggggagcatcggtggagcgtccctctttcgcggcacgcgccatcagctcagcgactgtgagtttctcttcactcattttcgccaactcctttccgggtaaatgttactcgagtcctttgtcgatcctggtgaggatcacaccttcacgaagtgcccacggacaaatttctaccttgtcaatatccaacgcacgcatcgcagcttccgcaactagcgcacctgccacgatc

SEQ ID NO: 462 - DNA, 198 bp, Corynebacterium glutamicum
atgatatatatggctagagaagataacggaaccttcctgacagtcgccgaggtcgcagaaatcatgcgcgtctccaaaatgactgtctaccgattggttcactccggagaactcccggcagttcgcgtgggacgatcatttcgtgtccacgagaaagctgtcaacgagtacctggactcctccttctacgaggctggc

SEQ ID NO: 463 - DNA, 219 bp, Corynebacterium glutamicum
gtgcgctggcacgatttttccatcttacctttaagactattgagcaccaaaaacacctcaaaaacacctcaacaaaaccccaaaatcatcatgccgggcgaacaaacagaaaaacctctctacgtcactttcggaggtgttatccgggagttacgtggagaggtttttgctgttgtggagtctagccagcctcgtagaaggaggagtccaggtactcgt

SEQ ID NO: 464 - DNA, 99 bp, Corynebacterium glutamicum
atgggttctgtcatcaagaagcgccgcaagcgcatgtccaagaagaagcaccgcaagatgctgcgccgtactcgtgtccagcgtagaaaattgggcaag

SEQ ID NO: 465 - DNA, 192 bp, Corynebacterium glutamicum
ttgagcttcaaactagcaccgcctttcggggcggtgcttttttgtgtcttgggtggggtgcgttggggattttttatgggttctttgtgggttcgggggtctcaaactccccgggaaagcgattcgggtgctggggttttggaaaacgtgcgtattgaaccaaggagcacttctctggacgagcttttggtc

SEQ ID NO: 466 - DNA, 618 bp, Corynebacterium glutamicum
atggatgcgagtgctgcgactgcgtgtcttttgccgggtccgtggaggatgtcgccgacgagtcggccggtgaatactccatcttttgcttctgcgactgtgccgatcgctccggtgaagccgaggcgttgtgccaggatttgggcgagttggacgggggttgcggagacgagccagacttggtggccggcggcgatgtgcatgtcggcgagttgtttggtgccgggccacattttgtcggccatgcgttggtcgacgatttcttcgcagaggtcaactagttcttggacggggcggcctttgatgaattcgagggcttgttcgcggccgcgggagacgtcttcggcgttttcggagccggtgagtttgaatttcacttgtttccacaccacggggaggatttctttgatggtgaagaatttcttccggaagagtccttgggcgaaaacgatgagggaggagccttggatgagggtgttgtcgacgtcgaaaaatgctgcggctccgacatcttgggggacatcgggatcggggatgctgacgtggatggcgccggcagattcgatggcgccggcgacggcgtcgacacctgcgttgaattcgttgagctccatgccg

SEQ ID NO: 467 - DNA, 1065 bp, Corynebacterium glutamicum
atgagctctgaaggaagaaaccacaactgggactacgccgccatcggcaccccagaggatttcctcgccagctggagcgcatcccgcggaaatctacgacgctttttcgaagaccacgcagccgcccccataaacgatgccgcccagcgccaagcaggtgaagccgcagcaacccaagccgtcgcagcgatctacggcatggagctcaacgaattcaacgcaggtgtcgacgccgtcgccggcgccatcgaatctgccggcgccatccacgtcagcatccccgatcccgatgtcccccaagatgtcggagccgcagcatttttcgacgtcgacaacaccctcatccaaggctcctccctcatcgttttcgcccaaggactcttccggaagaaattcttcaccatcaaagaaatcctccccgtggtgtggaaacaagtgaaattcaaactcaccggctccgaaaacgccgaagacgtctcccgcggccgcgaacaagccctcgaattcatcaaaggccgccccgtccaagaactagttgacctctgcgaagaaatcgtcgaccaacgcatggccgacaaaatgtggcccggcaccaaacaactcgccgacatgcacatcgccgccggccaccaagtctggctcgtctccgcaacccccgtccaactcgcccaaatcctggcacaacgcctcggcttcaccggagcgatcggcacagtcgcagaagcaaaagatggagtattcaccggccgactcgtcggcgacatcctccacggacccggcaaaagacacgcagtcgcagcactcgcatccatcgaacaactcgacctcacccgatgcaccgcctactccgactccatcaacgacctccccatgctctccatggtcggcaccgccgtcgcagtaaaccccgactccaaactccgcaaagaagccgaaacccgaggctgggacgtccgcgatttccgaagcatccgcaaagccacccgcgaatacggaatccccgccctggtcaccgccgcattcagtgtcgccggctggagactacgccgccgatggagaaaacaa

SEQ ID NO: 468 - DNA, 246 bp, Corynebacterium glutamicum
gtgggcgcaaccatgggccattcggtggagatcattgttcgggacaattgtggctcgtgtgttcgggtgaaagcccagattttgccgattgttgaggctgccggaattaaactcactgagcgaaatgttgatcaagatgcgagccttaaactggaattcggtgatcgcgtgccagtcattttggtagatgatgaagagttcgcatgttgggaagtggataacgacgagttagccaatgctttgttg

SEQ ID NO: 469 - DNA, 258 bp, Corynebacterium glutamicum
gtgagtttaattccggcagcctcaacaatcggcaaaatctgggctttcacccgaacacacgagccacaattgtcccgaacaatgatctccaccgaatggcccatggttgcgcccactccctcacatttcactacccttcgcgagcgtatccgccccgaaagctttaccatggatacgatactcaatggagatatccattatcggtttggcgtctgtgcgctcatgaaccaggaaggtttttgtttgtctcatgagctc

SEQ ID NO: 470 - DNA, 1389 bp, Corynebacterium glutamicum
gtgagtgtactcatcgtagggatgtcgcacaggtctgcgcctgtgtcgcttcttgaacgtctgagcatggatgattcagtacgtggtgaaacaactcaagcactcctgggtagggcgtctttaagcgaggccctcattgtctctacgtgtaaccgcctggaggtctacaccgtcactagcagtttccatactggtgttaatgatgtggtggaggttctccatgaggcaagtggcgtagatattgaaactttgcgcggatatctttatgtccgttacgccgatgctgctgctgaacacatgttggtggtgacttccgggttggattccatggtgttgggtgagcagcagatcattggtcaggtgcgcactgcgtaccaagcagctaatgaatatggttctgtcggtcctgctttgcattcacttacccagaccgcgctgcataccggcaagcgcgtgcattcggagactgctattgatgatgctggtgcatcgatggtgtctttcgctgtggatcgcgcgttggtgcagatgggtcttgattcggaggcagaagccccactatctggcaagacagccttggtgttgggcgctggcgcgatgagttctcttgcagccactcaccttggtcgcgctggaatttccaacttgatcatggccaaccgcactctggaacgtgccgaaaggcttgcggagcattccctagaagccggagttcctgcagaggttgtggaatacgatcagcgagcttccgcctacaatcgcgttgacctggtagtttccgccacgggagcggatgatttcaccgtgaagcctgaggatattccagaaggtgcttcgttgatgttggtggatttgtccatgccacgagacatcgatgatgcttgtgcggatctgccgggcgttgatttggtgaacatcgaacgcctgcacaaggcctcccgtgagggtggatcgggcatggcgccaagcgaggaagaagctttggcgattgttcgggaagagttggattctttcacctctgagcagcgcattcgcgatatcgttccagctgtgtccgcgttgcgcaggcaggccgcgtcggtgggaagcgatgaattggatcgactccgccaacgtgcccccgggatttccgaggtggaatggggggaagtggagaaaacagtgagacgggtcgtcgataagcttcttcatgaacccactgtgcgcgtcaaggaactggcggcccggtccggcagcatctcttatgattcagctctgcaagagctgttcggtttggagtcgctggcgagcaccgcagcaccggcaaccacgtccgtcaacgcgtcagaactgccggatgcgggtatcgtcgcattcgtgaacgcaccttctgccacacaaacgagggag

SEQ ID NO: 471 - DNA, 906 bp, Corynebacterium glutamicum
atgaccttaaaaattggtacccgaggatccaaacttgccaccacccaagctggcaccatccgcgaccagctgaaacactacggacgcgacgctgaactgcacatcgtgaccacccctggtgatgtcaacatgtccccagtcgagcgtatcggcgtcggcgtgttcacccaggcgctgcgcgatgtgttgcattccggtgaatgcgatgtggctgtgcactccatgaaggatctgccgaccgccaccgatcctcgattccacctggtcgtgccaactcgtgcggactcgcgcgaggcccttatcgcccgcgacggcctgactctggctgagcttccagaaggcgcaaaggtgggaacttccgctcctcgacgcatctcccagctcaaggcaatccgccctgacctggagattctcccactgcgcggaaacattgacacccgcatgggcaaggtcacctccggtgaactcgatgctgtgatgctcgcctacgcaggcctcacccgcgtcggcatgcaggaccgcgcaacggaagttttcgacgccgacatcatcatgcccgcccccgcacagggcgcacttgcgatcgaatgccgcgccgacgacactgaaaccgtccgcgcgctcaacatgctgatgcacgccgacacgtttgtttccgcggttgcagaacgcaccgtgctcaaccgcctcgaagctggctgtaccgcgcctgtcgcagcgcacgccaccttggacggctactccggcgacaccatgactctcaccgccggcgtctacgcacttgacggctctgaccagctggtattctccgccgaaggtgacggcgcccgcccagaagagctcggcgagctcgttgcacaacagcttatcgacgccggagccgccaatttgctcggcgaccgcagc

SEQ ID NO: 472 - DNA, 372 bp, Corynebacterium glutamicum
ttgatcgttgtggctgagttgagaatcaataatcgtatcgtgactgttcatttgtcatggtgggagaagttgagtgctaggcgtagccatttgaggattcctcggaaagcaatccggaacattcaggttgtagacaatgtcatcagttcagttgaccgtcccattaagcgcactggtcgtttgcgtattccgggggtctttgtggctggcactcatgcgtatgtcaatgaaactctttcggaaaatgagttcagcatgtgccgaaagaatgaacctggtttggtcattgagctggagaacatcagcatcgatcgcattgtcatttccacaccagatgcccaccgctatgcggatgagctcatggcggctgtt

SEQ ID NO: 473 - DNA, 882 bp, Corynebacterium glutamicum
atgcacctcaatcagctcgaatttttcatcgcagtagcccaacacggacagatcaaccgcgccgccgaagaactcctcatttcccaacccgctctcagccgacagatctccgcacttgaaaaatccgtcggagctccactcttcgaacgccattcccgcggtgtctccctcacaaaggccggagaaatcctccacgaagaagccctccgaacgcttagcaggatgcaatcggtagtcgatgaaatccaatccggtgagcacctcatcaccagcatcaacatcggagttccccctggaatccccatcgactggttgcgctgccaactcatcgatttaggccccgagacccgcatttcactgatcgaatcccccaccgatgatcagctaaaacttcttaaacaacgcgaactcgacatcgccctttgtcgacgccaaagcgaggcctttgccaccacacttgtccacgaacaagaactgggaatcgtcgtccgaaaaaactccgaactgcaccaaaaagtcgcaggaaaagacaacgccacactcttcgatcttgaagggcttcgagtcctcgcacactcccgcggtgaagtaagaattcaggaagaaatcctcaaaaacgccatgctcgccgcaggagttaatgccacgtggatcttccgaaaatttgggcaatatagctcactgatcgcagaccttgtccaggccgatgtcgcactcacaacagaggaatccgcccgcaccaacttccccagctggcaatgggtccccatcgaaggcgaagacgcctccggaaatgaccttgttgttcgcacctggatcacctggaacccccaacccacccccgcggtgaaggccctgatccagaaatttattgacggaaac

SEQ ID NO: 474 - DNA, 1401 bp, Corynebacterium glutamicum
atgagcgaacaacttcagggtgtaactcactccgaatcaactccgggcaagacgcccaagcgagcagcactatccagctggatcggctcagctctcgaatactacgacttcgctgtttacggaaccgctgcagcgctggttcttaaccacctcttcttcccagctgatacttcaccaggcatcgcaattttggctgcgatgggtaccgtgggtgttgcttatgtggttcgccctcttggtgcgctgatcatgggtccattaggtgaccgttacggacgtaaatttgtcctcatgctgtgcctcttcctgattggagcatccactttcgcagttggctgcttgccaacatttgatcaggtcggttacttggctccggcactgttggtgctgtgccgtgtgatccagggactgtctgcatccggtgagcagtccagtgcgatttccgtttctttggagcacgccgatgagcgtcaccgcgcatttactgctagctggactcttcacggaacccagttcggtaccttgctggcaaccggagtatttatcccattcaccttgttcctgagtgaagatgctctaatgtcatggggttggcgcgttccgttctggctgtccgctgctgttgttttggttgctttcctcatccgtcgtggactggaagagccaccagcattccgtgaaaacaaggaagcagttgcaggcgcagcatctccactggcgatgaccttgcgttaccacaaggcggcggttgctcgcgttgctattgctgcgatgatcaactccgtgaacattgtgtttactgtgtgggcactgtcgttcgccaccaacattgttggcctggatcgttcaactgttttgctggttccagttgttgcgaacttggttgcactgattgcgattcctttgtccggcatgctggctgaccgcattggtcgccgaccagtgttcatcatgggtgccattggtggtggcctggccatgaacggttacctgggagctatctactccggcaattggaccatgatcttcttcatgggcgtgttgatgtctggtctgctgtactccatgggtaatgccgtgtggccagcgttctacgcagaaatgttcccaacctctgtgcgtgtcaccggcttggctcttggaactcagattggtttcgcagtctctggtggtttcgtcccagttatcgcatccgcgcttgctggtgatcagggtgaccagtggatgaaggtgtccatcttcgttggtgttgtttgtgtgatttctgcactggttgccatgaccgctaaggaaaccaaggctctgactctggatgagatcgatgctctgcacactgctggtggtgaggccgcagacctggcagccgcaagcaaagcctccgaggcccaactcgcggctcag

SEQ ID NO: 475 - DNA, 1854 bp, Corynebacterium glutamicum
atgcgtacatccattgccactgtttgtttgtccggaactcttgctgaaaagctgcgcgcagctgcagatgctggatttgatggtgtggaaatcttcgagcaggacttggtggtttccccgcattcggcagagcagattcgtcagcgggctcaggatttgggattaaccctggatctgttccagccgtttcgagatttcgaaggtgtggaagaagagcagtttctgaagaatctgcaccgcttggaagagaagttcaagctgatgaacaggcttggcattgagatgatcttgttgtgttccaatgtgggcaccgcgaccatcaatgatgatgaccttttcgtggagcagttgcatcgtgcagcagatttggctgagaagtacaacgtcaagattgcttatgaagcgttggcgtggggcaagtttgtcaatgattttgagcatgcgcatgcacttgtggagaaggtgaatcacaaggcgctgggaacctgcttggatacgttccatattctttcccgtggttgggaaaccgacgaggtggagaacatccctgcggagaagatcttctttgttcagttagcggatgcgccgaagctgagcatggacattttgtcctggtcgcgtcaccaccgtgttttccctggtgaaggcgatttcgatctggtgaaattcatggttcatctggccaagacgggttatgatggcccgatttctttggagatcttcaacgattccttccgcaaggccgaggttggtcgcaccgcgattgatgggttgcgttctttgcgttggttggaagatcagacctggcatgcgctaaatgctgaggatcgtccaagcgctcttgaactgcgtgcacttcctgaggtcgcggaacctgagggtgttgatttcattgagatcgccactggacgtttgggtgagaccattcgggttcttcatcaattgggtttccgcttgggtggtcatcactgcagtaagcaggattaccaggtatggacccagggcgatgtgcgcattgtggtgtgtgatcgtggggtcaccggggctccaaccacgatctctgcgatgggctttgacacccccgatccagaagctgctcatgcccgtgcggaattgctgcgggctcagacaattgatcgtccccacatcgagggcgaagttgacctaaaaggtgtgtacgcaccggatggggtggagctgtttttcgcggggccgagccccgatggaatgcccgagtggctgccggaattcggcgtcgaaaagcaagaagctggtctcattgaagccatcgaccacgtcaatttcgcccagccgtggcaacattttgatgaggcagtgctgttttacaccgcgctgatggcgttggagactgtgcgtgaggatgagttcccgagcccaattggtttggtgcgcaatcaggtgatgcgttcgccgaatgatgcggtgcggttgctgctcagcgtggcgccggaggacggtgagcagggagatttcctcaacgcggcctacccggagcacattgcgttggccacggcggacatcgtggcggtggctgaacgtgcgcgcaaacgaggcctggatttcttgcccgtcccagagaattactacgacgatgtgcaggcgcgttttgatttgccgcaggaattcttggacacactcaaggaaaaccacctgctttacgaccgcgacgagaacggcgaattcctccacttttacacccgcacgttgggcacgctgttcttcgaagtggtggaacgccgcggcggttttgcaggttggggcgaaacaaacgctccggtgcggttggcggcgcagtatcgtgaggtgcgggacctcgagcggggaatcccaaac

SEQ ID NO: 476 - DNA, 849 bp, Corynebacterium glutamicum
atgaacgacagtattctcctcggcctaatcggccagggcctcgacctatcgcgcacccccgcaatgcacgaggcggaaggcctcgcgcagggacgtgcgacggtgtacaggcgcatcgacacgcttgggtcgcgtgcttccgggcaagatttaaagacgcttctcgacgccgccctctaccttggcttcaacggcctgaacatcactcacccgtacaaacaagcagtattacccctgcttgacgaagtctccgaacaagccacccaactcggcgcagtgaatactgtcgttatcgacgccaccggccacaccaccggccacaacaccgacgtctccggatttggccgcggaatggaagaaggcctccccaacgccaagctcgattccgtcgtgcaggtcggcgccggcggcgtaggaaacgcagtggcatacgccctggtcacccacggtgtgcagaaacttcaggtcgctgacctcgacacttcccgcgcgcaggcactggcagatgtcatcaacaacgcagtcggccgtgaagccgtcgtgggagtagacgcccgcggcatcgaagacgtcatcgccgccgccgacggagtagtcaacgcaacccccatgggaatgccagcacaccccggcaccgcctttgatgtcagctgcctcaccaaggatcactgggttggcgacgtcgtgtacatgcccatcgaaactgaacttctcaaagccgcccgtgccctcggctgcgaaaccctcgacggaacccgcatggcaatccaccaagccgtcgatgccttccgactgttcaccggcctcgaacccgacgtctcccgcatgcgggaaactttcctgtccctc

SEQ ID NO: 477 - DNA, 273 bp, Corynebacterium glutamicum
atgtttggcagaaaagacgtaaatctcagtgctttggaagctcgtgttgctgctcttgaacgcagactagctgagcaagatcggatcattgctcagctagggggtgattcttcgattccgctgtcgttgcaaagaccacaatcagggttacatcctgacgttgtggcgctcctgcagcagggtaagaagatcgcggcgatcaaacgtcaccgtgaacttaccggggcagggttgaaggaagcgaaggaaacggtcgaagcgtcgaggttttac

SEQ ID NO: 478 - DNA, 1050 bp, Corynebacterium glutamicum
gtgtcatcgatcaaattgcgcgatttaagcgtgagcttccgcgacggaaccttcgggctgcaagatatcaatttgaaaattgagccggaagaatttgtggtgctcatcgggccgtcggggtccggtaaaaccaccatgttgcgcaccatcgcggggtttgtggagccaagttccggcagtgtgctcatcggcggcgaagacatgacgcatgtcccgccggagcgccgtcgcatgggcatggtgtttcagcagcatgcggtgtggccgcatatgtcggtcgccaagaatgtgggatacccgctggcgcgaagtggtcagaagggggcgtcgataagcaaacgcgtggagcgcacgctcgcgctggtggggcttgaggggttcggcagtcgcagaccggccagcctgtctggtggtcaacgtcagcgggtggcgcttgcgcgcgccatcatcgccgaccccaccgtgctgcttctcgacgaggccctctccgccctcgacgaaccgctgcgagacgctttacgacgcgaactcgtatctttgacccggcgcgaaggcctcactactgtgcacgtgacgcatgaccgcgccgaagcgatctccatcgctgaccgcatcgtcgtactcggcaacggtcgaatccaacaggtagccacccctactgagctcctttccgcccccgctactgccgatgttgcccgattcatcgtcgacgccaccgtcctgaatggaattgttcgaaatggcagagtgatgtgtcctgatctcgatacttcttgggatctagacgcagtacaggcgattgatgacattttcgacggcgacctcgtcgacatcgcgatcccaccccactccgttgacatcggccccgctcatcaccccgattacattttcgcggagatcacctcggtgctgttccaggtcacgtcctattccgtgaccgcgaaaacccagagcggacacagtttccgaatgtccatcacttgctccctccccgaaatcggcgaaaccatcgggctcagcatcgacaacccgatggtctaccgcgcggat

SEQ ID NO: 479 - DNA, 615 bp, Corynebacterium glutamicum
atggctgatcggagtgctcatcacccgaacccagcatttcgccaacgtaccgttgacactcactgtgctgcttcccaccgcactgccgggcatgatcatcggcgtcggctggctcattttgggcagatacaccggaatttacaacacaccttgggtgattttgggtgcatatgtgtgtgcttttaccgcgctggttgtccaagctgtacgcggaccactcagtcaagcacccgaagcaatcgaagaagccgcacgaatcagcggcgcaggcagattacgatccatcatggacaccaccggagcgatggcaattcccgcagctttcgccggcgcagtgctggttgcggtaactgcggttcgagagttaaccgtgtccattttgctcatcgcgccgggcaccaccaccctgggtgtgcaggtgttcaatttgcagcaggcgggaaattacaatcaggcatcggcgttgtcgttgatgtttgcgattatcggtatcgtggcgctcgcgttgacggtgcgcagccagaaggagttttaggtgtcatcgatcaaattgcgcgatttaagcgtgagcttccgcgacggaaccttcgggctgcaagatatcaatttgaaaat

SEQ ID NO: 480 - DNA, 1644 bp, Corynebacterium glutamicum
atgcagttatctccttcaaatacgtcgacgcagcgctttcacatctctgcgttgacgtctttgtctttcatgcgtctgggtgtgtggctgattgtcgcggggttgtttatcactccgttggcgctggtggtgggcttggcgttgggaggcaatcagtttcctgctctgtgggattccggattgggcaaagccctatggaattccgcctatacaacagtgctttctgcggtgggcgcgaccattatcggcacgatcatggctctcacgctggaccgaactgatgttttcgggcgcaccgcgttgcggttatttttgttatccccgctgttgatccctccgtttattggggctattgcgtggttgcagctgttcgggaagaaccagggcatcaaccggtttttcggcacggaagtgtgggatatttacggcgctgatggtgtgacatttttgttgattgtgcactcctatcccactgtgtacatcattgtttcggcagctctgaggcaacttcctagtgatttggagcaagctgcacggatcgcgggggcggatacttttacggtgttgcgcaccatcacactcccactgctcaaacctgcattgttgtcggcgtttactcttaccacagtggcgaacctcgccgactttggcattccagctctgttgggatcgccagcgcgttttgaaaccttagccaccatgatttatcgcttcatggaatccggcaccgtgagcaatccattgcaggtggtatccaccattggcatcgtgttgttgttcctgggaatcgcagcagtaaccgcggattatctggtgtctttgtacgcggcatcaaagttgcaagacgcaggaacaccgcatcgctttactctcaacaaatcacgaatcccagtcagcgtgatcacgtggatcatcgcgttgatcatcaccgccgccccgctgctgggtctggcatacagagcattactgcctgccccaggtgtgccgttcaacctagacaacatcacgctcaacaactttgaagcagcactgagcaatccacgagtaatcgaaggattcagcaactccctcatgttatccctgggtgcagccctaatctgtggggtgctgggatggctgatcggagtgctcatcacccgaacccagcatttcgccaacgtaccgttgacactcactgtgctgcttcccaccgcactgccgggcatgatcatcggcgtcggctggctcattttgggcagatacaccggaatttacaacacaccttgggtgattttgggtgcatatgtgtgtgcttttaccgcgctggttgtccaagctgtacgcggaccactcagtcaagcacccgaagcaatcgaagaagccgcacgaatcagcggcgcaggcagattacgatccatcatggacaccaccggagcgatggcaattcccgcagctttcgccggcgcagtgctggttgcggtaactgcggttcgagagttaaccgtgtccattttgctcatcgcgccgggcaccaccaccctgggtgtgcaggtgttcaatttgcagcaggcgggaaattacaatcaggcatcggcgttgtcgttgatgtttgcgattatcggtatcgtggcgctcgcgttgacggtgcgcagccagaaggagttt

SEQ ID NO: 481 - DNA, 1113 bp, Corynebacterium glutamicum
ttggaagaactcaacagcagccgccttatcagcggttacaacctccaggtcaggggtcatgagctcgatgtcagccaactcgggggtgccctctggagttccgacatcttcacgcactggcaggtatgcctgctcaactgcgatttcctggccttcaacagacagcaggaagttgatgtagcgctcggctgcttccttcttttcagaatcagcgaacacacctgcaggctcagtgatgtaaggagaaccctccgatgcgtagatggtgtcgattggagatccagcagcagccaagtcgcgcaccaagtagtccaccacgatgcccactgggtggccaccgccagcgatctcctgggaggttgggccgttggactgagcgatcattggttggttttcacccaaggcggtgatccaggcttcgccaagcgcagggtcgttcttccacacagaagcattgaaggctgcagcaccagacacagctggatccggcatgaccagttggcctgcatacttaggatcagtcagatcagcccaagacgtaggaagctcagcctgatcaacaacttcagtgttgtatgcaatcacggttgggatgatgcgggtgcctacataaaagttctcagcatccagagcctcttcaatgatgtcggaagtctcaacatcttccagctctgcaaggtcgccctgtgctgcataagtttcaaaggttgcagcatccgcagcccacaacacatcagcctcgatagaaccggatgccttttcagcttcaatgcgagcagtcagatcgccagtaccagcgcggtacacctcaacctcaatatctgggttggcttccatgaacgccttgttgatctcatcgaccttttcctcaggctcagaggtgtagacggtgatggttactttttcaccggctgcatcggatgcgttagcggaagagcttgcagtggtggtctctgcggtggaaacgtcctcagaaggttcagagcaagccacgaggagagcagcggaagcgccgagtgcaaaaacagtaacggcagtgcgcttcaaagggtgcttcgaagacatgaaaataaggcccttcttgaaattttaaggagtgtttgggggaggaaa

SEQ ID NO: 482 - DNA, 1059 bp, Corynebacterium glutamicum
ttgaagcgcactgccgttactgtttttgcactcggcgcttccgctgctctcctcgtggcttgctctgaaccttctgaggacgtttccaccgcagagaccaccactgcaagctcttccgctaacgcatccgatgcagccggtgaaaaagtaaccatcaccgtctacacctctgagcctgaggaaaaggtcgatgagatcaacaaggcgttcatggaagccaacccagatattgaggttgaggtgtaccgcgctggtactggcgatctgactgctcgcattgaagctgaaaaggcatccggttctatcgaggctgatgtgttgtgggctgcggatgctgcaacctttgaaacttatgcagcacagggcgaccttgcagagctggaagatgttgagacttccgacatcattgaagaggctctggatgctgagaacttttatgtaggcacccgcatcatcccaaccgtgattgcatacaacactgaagttgttgatcaggctgagcttcctacgtcttgggctgatctgactgatcctaagtatgcaggccaactggtcatgccggatccagctgtgtctggtgctgcagccttcaatgcttctgtgtggaagaacgaccctgcgcttggcgaagcctggatcaccgccttgggtgaaaaccaaccaatgatcgctcagtccaacggcccaacctcccaggagatcgctggcggtggccacccagtgggcatcgtggtggactacttggtgcgcgacttggctgctgctggatctccaatcgacaccatctacgcatcggagggttctccttacatcactgagcctgcaggtgtgttcgctgattctgaaaagaaggaagcagccgagcgctacatcaacttcctgctgtctgttgaaggccaggaaatcgcagttgagcaggcatacctgccagtgcgtgaagatgtcggaactccagagggcacccccgagttggctgacatcgagctcatgacccctgacctggaggttgtaaccgctgataaggcggctgctgttgagttcttccaaaacgcaatgaac

SEQ ID NO: 483 - DNA, 1770 bp, Corynebacterium glutamicum
atggctgaaactaccgggatcgagaccaaccaggtttccgaaaccatcggggttgaatcgctcacgcacggaaacttacgtcctgtttcatcttttgagggacagcatgagggacaaacggaagagttacttccaggcaaagtcatttttgttggggccggtcccggtaaccctgatcttcttacagttcgtgcccgtgaagttctgggcaacgcggttcgtgcgattactgatgaacaagtactaagcggcgttcgagcttttgtcgccactgaaattcctgtgccggaagataagcttcaggctgcggaagatgagtacgagcgcatctgcattgaagcgaaggagaacggtgcacgccgtaagcctcctcgtccagcaccaccaaccgctgcagagatcacggaagtttctgaggcgactccagctcagattgttgagcttgtgcaggatgctctttcttatggtggagatgttattcgtcttgtcaccggcaacccattgagcagcgatgccacactggctgagatctctgcagtttccgaggctggcctggagttccaggtggttccaggtatgtctttgcctgcaacggttcctgcatttgcgggaattgcgttgggttctacctacaccgaaactgatgtcaacggtcaaaacttggactgggatcagttggctagcgcacctcagcctttggtgctgcaggcccgcgtggatgacctttcccgtattgcacaggaactaaaggcccgcaatatgtctttggaaactcctgtttctgtcaccgctaacggcaccacccgtttgcagcgcacctatgacaccactttaggtctgttgcacaagcttgatgctgaactaagcggacctttggttgttaccttgggcaagggtgtggatgatcgctccaagtactcttggtgggaaaaccgcgctctgtacggttggcgtgtgctggtgcctcgcgctcgggagcaagcggcatccatgtccgcacgtctgagcagccacggcgctatcccgcaggaagtccctaccatttctgtcgaaccaccgcgcaacccagcgcaaatggaacgcgccatcaagggcatcgtcgaaggacgctaccagtgggttgtcctcaccagcgtcaacgcagtgaaggcagtctgggagaaaatcaccgaattcggcctcgattcacgttccttcgcgggcgtccgcatcgccgcagtcggtgaaaaaaccgccgctgagatccgcgcgctcggcatcacgccggagcttctgcctgcacgtaccaggcaaaatgcgcaagggcttgtcgacgtgttccccgaatatttcgaagaactcgatccagtcggccgtgtcctcttgccgcgcgcagatatcgcaaccgacgtgcttgtcgacggcctgacccaccttggttgggaagtcgaagacgtggtggcttaccgcaccgtccgcgcagcaccaccaagcgctgatatccgagatatgatcaagaccggcggatttgatgcagttgccttcacctcttcgtcgaccgtgaagaacctcgttggtatcgcgggtaaaccacacccacgcaccatcgtcgcgtgcatcggacccatgactgcagcgaccgctgaagaactgggactgcgcgttgatgtcatgccagagatcgccgaagtaccagaactgatcgacgctcttgcggaacacgtggcggatctgcgcgctaagggcgagctgccgccgccgaggaagaaacgcaggcgtcgaaaagcgtct

SEQ ID NO: 484 - DNA, 426 bp, Corynebacterium glutamicum
gtgttgtccatggacatccagcagctagacgccgaaacaacagcatggaaagacagcctcctgcgcgccgcacaggaggctggttttcattttgagccaccgaaactcttcgaggattttgagaccatggtggagcagtacaagcaggcagctgcgagcgacccggacattgatgtcactgatattcagcaaatgtggggcatcgtggtgggggagtacctgcgcgaaaaaatgggcatggaatgggtcgtcatcaccgatgactacggcactgacctcgcgattctagccacggcacccaacggggaccacgtatattcctgccccatcatcgtggtgggcaagcgcttttcacccgactatgaacctggtcagctggagtttttctgcaatcaattcatggtgacgtcgctcgctcaactgcag

SEQ ID NO: 485 - DNA, 1017 bp, Corynebacterium glutamicum
atgagcacttcttctgattactcccacgcactaattcgtcgtccgcgccgacttcgcgccaaccctgcgatgcgggaactagtcgcggaaaccgcattgcgcccggcggatcttattctgccaatgttctttgcggatggaatcactgaggcacgtgagatctcctccatgccgggcgtttatcagcacactgaagattcgctgctgcgtgccgcccatgaggctttagatgctggtgttcgttgcgttgatctgttcggtgttccagtggatgcggacaaggacttcaatggttcccaggcatggtctgaaaccggtgtgttgaaccgtgcactttcatcgctgcgtaaggaattcggcgatgacctgctgattatggccgatacttgccttgatgagttcacggatcatggtcactgcggcgtagttaccgaggaccgccatggaaacgcaatcgtggacaacgatgccactttgccgctgtaccagcagatggctgttgctcaggctcgtgccggtgcacatattgtgagcccttccggaatgatggacggccagatcgctgctattcgtgcagcgttggatgaggaaggctaccaggacgtcgccatcatggcgtattccgctaagtatgcatcagcattcttcggacctttccgcgaagcagtgggatcctccctccaaggcgatcgacgtacctaccagcaagatcctgcgaacctgcgtgagtctctccttgaggcagagctagatatcgcagaaggagcggacttcattatggtcaagcctgcactgccataccttgatgtgctgacccgcatcgctgatacctcacctgtcccagtggctgcctaccaagtttctggtgagtacgcgatgatccaagcagcaggccgcaacggttgggttgaccttgatgcagtgatgatggaatctttgacctccatcaagcgtgccggtgcaaaccaaatcctcacgtactttgccgttgacgctgcccgcgcactgcgaaacgct

SEQ ID NO: 486 - DNA, 582 bp, Corynebacterium glutamicum
atgagcatgcttcccaatctcacaccgaagaaatctgccccgccttcatcttctgcttctgcgaaaaatgctggagaaaagaaggaagacaccgtcaagctcctgattcagatgtgggctgtgatgatcggtttggagctgctgcaccagatcttaaacgtggtgatgagctttacggacccgactgcgctgcggactgttgccaaagaacaagcagcagcacaggggctttccgatggcattgttaacgccacagtcatcgcagcaatcttggtcatgggattcttcaacctcattgtgattgccattttgtcctggatggtggtgatggtgaaaaaccgttccaaacgcctaccgacggcattcttgctgctcaccatcttcagtttcttctttatcctaagagtcttgatgctgtttttcgcctcacctggtgggactgatgttccaatggcactatttgctatcgacggttgtgtacaaatcctcgtcggagtgagcgccggtgtggcatatgcgctctcgcgcactgagcagcctgtcaaaatgctcaccgactacgcaccagaagacgctaaacgg

SEQ ID NO: 487 - DNA, 510 bp, Corynebacterium glutamicum
atgccaagcatgttcccatcacccgcaactggcggagatgacatcaaccgacgccccctgaatgaaccaaacgcagatgcaaccaccatccccactgcactaaaagtggtgttctggatgctgtttgccactgcagcgttcatgatttttacaggcctggtgatgtacaccgccggatacacgggacctgatgatgtggatgagagctacaaagccgttgtggtgaacaaccaggagttcatcggtggcatcaatgcctttgctggcgtcgtgattgctgcacttacttcacaactgccaaagggcggcaagaatccgcgccgtcttttgttggccatcatgttgttggtattgctgacagatctgttgtcttttgccacccgcgctggaggcttcgcactcgcaatcatcgcagtcttgttggctttggaagcactcttgatgttccgcccagcagtcaatgatcacattgaccgaaatcatatggctcgtgtaatgaatcgcgagaag

SEQ ID NO: 488 - DNA, 2544 bp, Corynebacterium glutamicum
ttgaaccgagccaccgcctcagaagaagaggaagatttaagctcaagcattaaggtttctttggcctttgagctcgaggggttaagcaatgcaccatcgttgatggtggtggaaaaagccctagagaagatccccggtgtatccgcggatctgatttacccttcacaaactgcatggattacagcaactgatcgggtacatcccgaaaccctcattgaggtgtttgagcagttcggcatcaaagcacacctttctaattcatcgctgctgcgcaggcatcaacagctcagcgcggaagtaaatagggaagcacgccttgatcgttaccgctcccgaatggatgccaagcgaatctcgcctcgtgtgcgaaggcataaccgacaagaaatggtacatgcggtacgcgctcgtgaaagtggttggattaaacgcaggaatcacaccacctcgcagcatgaagacccaatgtcgggcgatgtgctgttcaccgcccgcgcactgattacacctaagcgtttgtgggtgtcgttgccgtttgcgctcatcgtattggcgttatcgttgaatccttcgtggcagtttgattattggcagtggttgtccgctgtgttggctattcctgtggtggtgtggggtgcctggccgtttcaccgcgctgcagcaggcggtattcgtcgaggaatttccgctcttgatgcgaccagctcaatcgctattgctgctgcatacgcgtggtctatcgccatgctgttgtttgaaaccccaggaggtaaatcctggcggtcatatccgtcctggttcgcttttgaccacggcacgttgacccaaaacgagatttattttgatgtggcctgcggaatcaccgtgttgcttcttgccggacggctgctgacaaggcgtcgaagccaatccagtttgttagcggaacttggtcgcctccaaatcgatccacagcgcattgtcactgtggtgcgtaaacaccgattgaagcgcgtagtccaggaactgaacattccagtgcaggaagtccgtgtcaatgacgatgtgaaagttccacctaataccacgatccctgtggatggcactgtcatcggtggcggttcgcggatcgcagctagcatcatcatgggacaagaccagcgtgatgtaaaagtaaatgacaaagttttcgccggcagcctcaacctcgaatccgaaatcaaggttcgtgttattcgcactggtcaccgcacccgcatcgccgcggtacataggtgggttaaagaagcgacgttgaaggaaaaccgccacaatagggcagcgatccgttcggccggtaaccttgtgcccatcacgttcacccttgctgtggtggacttctgtctgtgggcactgatctctggaaacatcaacgctgcatttaccactaccttggctgtccttgcgtgcgtggctccggtggccttagcgttgtctgctccacttgccacgaggaattccatcgaagctgcagcacgacacggtattttggtccgctctggtgaaattttccgagttctcgatgatgtggatactgccgtatttaatcgtgtgggcacactaaccgatggcgaaatgacagtggaaaccgtcacagcagacaaaggcgaggacccagaactagtgctgcgtgtcgccggggcgttggccatggaatcccaccacgcgatttccaaagcactggtgaaagcatcccgtgaagctcgtgataccggcgccggtggtgaagatgtcccacactggattgaagtaggcaacgtggaaatcaccgaagccggctcattccaagcaaccatcgagctgccactgatcaaaccatctggcgaaaaaatcatgcgcaccacagaagcactcctgtggcgaccacgatccatgacagaagtccgtgagcacttaagcccccgactagtggcagcagcaacctcaggtggcgcaccactgatcgtgcgatggaaaggcaaagaccgcggagttatcactctaagtgaccacgtgagatcagattcctccgatgcgattattgcgattgaagaacaaggcatcgagaccatgatgctttcacgtgatacttacccggtggcacgtcgatacgcagacagcttaggcatcacccacgtcttggccggcatcgcgccgggcaagaaagcccaggtcgtccgtgcagtccacacccgcggatccactgtcgcgatgatcggcgatgaatcagtaatggactgtttgaaagtcgctgacgtgggtgtactgatgggcgtcgatcgtccctcagatctgcgtgatgattccgatgacccggcagctgacgttgtggtcatgcgcgaagaggtcatgagcgtgccgacgctgtttaaactggctcgacgctacgccaagttggtcaatggcaatattgctctggcctggatctataacggtgttgccatggtgcttgcagtgtctggcttgctgcatccaatggctgcgaccgtggctatgctggcgtcttcgctgcttattgaatggcgctcgggcagggcgcgcaagtac

SEQ ID NO: 489 - DNA, 843 bp, Corynebacterium glutamicum
atggtctcgatgccttgttcttcaatcgcaataatcgcatcggaggaatctgatctcacgtggtcacttagagtgataactccgcggtctttgcctttccatcgcacgatcagtggtgcgccacctgaggttgctgctgccactagtcgggggcttaagtgctcacggacttctgtcatggatcgtggtcgccacaggagtgcttctgtggtgcgcatgattttttcgccagatggtttgatcagtggcagctcgatggttgcttggaatgagccggcttcggtgatttccacgttgcctacttcaatccagtgtgggacatcttcaccaccggcgccggtatcacgagcttcacgggatgctttcaccagtgctttggaaatcgcgtggtgggattccatggccaacgccccggcgacacgcagcactagttctgggtcctcgcctttgtctgctgtgacggtttccactgtcatttcgccatcggttagtgtgcccacacgattaaatacggcagtatccacatcatcgagaactcggaaaatttcaccagagcggaccaaaataccgtgtcgtgctgcagcttcgatggaattcctcgtggcaagtggagcagacaacgctaaggccaccggagccacgcacgcaaggacagccaaggtagtggtaaatgcagcgttgatgtttccagagatcagtgcccacagacagaagtccaccacagcaagggtgaacgtgatgggcacaaggttaccggccgaacggatcgctgccctattgtggcggttttccttcaacgtcgcttctttaacccacctatgtaccgcggcgatgcgggtgcgg

SEQ ID NO: 490 - DNA, 1074 bp, Corynebacterium glutamicum
atgtctgctcttactattccagctgcgcgtcgcacgctaaataacgcgcccattattgatgccgctaatggcaagaccccgactcgcactccggtgtggtttatgcgccaggcgggtaggtcgttgcctgagtacaagaaggtccgtgagggaatcagcatgttggattcctgtttcatgccggagttgttggcggagattactttgcagccggttcgtcgtcatgatgtggatgctgcgattttgttctctgacattgtggtgccgttgcgtgctgcgggtgttggtgtggaaatcgtggcgggtcgtggacctgtgttggatgcgccggtgcggagccgtggggatgtgttgaatcttcctattttggagggcaacgttccggaggtggagcagggtattggcatcattttggatgagttgtctgattctcaggcgttgattggttttgctggtgcgccgtttacgttggcgagttacttggttgagggtggtccttccaagaatcatgagaagaccaaagcaatgatgcatggtgatcctgagacgtggcatgcgttgatggctcgtttggtgccgacgattgtgaattctttgaagtcgcagatcgatgcgggtatcgatgcggtgcagttgtttgattcgtgggctgggttcctcactgagcgtgattacaccgagttcgtgttgccgtattccactgagattttggaggaagtgggcaagtaccagctgcctcgtattcactttggtgtgggtactggtgagttgcttggtgcgatgagcaaggctggctcagaggtcatgggtgtggattggcgggtgccgttggataaggctgcggagcgtattgctgcggtatcaggtcctaaggtgttgcagggtaacctcgatcctgcgttgttgtttgcgggtcgcgcacctttgactaaggaaattgagcgcatcaaggcagaggctcagactgctgttgatgcaggtcatgcaacgggccatatctttaaccttggtcatggtgtgcttcctaatacggtggcggaagatattactgaagccgtctccatcattcattct

SEQ ID NO: 491 - DNA, 1344 bp, Corynebacterium glutamicum
atgcgttttgccatcatcggtgcaggccttgcgggtctgactgctgcatatgagatccataaagctgatcccactgcccaaatcgatgtgttggaagcaggcgaacgcattggcggcaagctttttacggtgccgtttgcttccggacctaccgatattggagcggaggcgtttttagctgcgcgttccgatgcggtggagttttttactgagcttgggttggctgattctttggtcagcccgtctgctgcgaagtctcagtatttcgcgggcggtgcgctgcatgcgttccccgcaggtggagtgatgggtattccaagcaatccaccagcaggcgcgcaagacaccgcttttgattggactcctggccaagacatttctgttggcgccttagtgcgccgtcagtatggcgatgagatcgtcgatactgtggtgtcttcgctgcttggtggcgtttattcctccaccgctgatgatctgggtgtgcgcgcttccgtgccggcacttgctgcagcccttgatcagctggctgaggccggcgagccggtgactctgtcagctgcggtcaaggccgtggaagctcagcgggaagccgcaaaaacaacttcagaaacccgccccgttttccagaccttcaagggcggatacgcggagctgtacgaagcgttggcagagcaatgcggtgcagatattcacttggatagtttcgtttccgccatcaccaaagatggtgaaggttttgccatcaagggcggtggcgaaggcacctacgacaaggtgattttggcggttcccgctccaaccgccgctgtgctgctccgcgacttggcaccggccgcagcgccacatttgcgcgcaattaagttggcttcttcagcagtcgtcggcatgcgtttcgattccagcgagggcctgcccgacaactccggcgtcctggtcgctgttaatgagccgggcatcacggcgaaggccttcacgttctcctcaaagaagtggcctcacctggaggctcgcgggggcgcgctcgtgcgcgcgtcgttcggcaggctaggcgatgaggcgtcggcacgcatggacgaggatttgcttgtcgacgccgccctcgacgatctcctcaccataaccgggttcgacggccgggctgccggactgggtgaaattttcgtgcagcgctggttcggtgggctcccagcctatggagttgatcacattgctaccgtttcggctgcgcgtgcagagatcgcagccgtgcctggcgtggaagcaattggcgcgtgggctgggggagtgggagttcccgcagttatcgcagatgcccaggcagcagtacacaggttgctggga

SEQ ID NO: 492 - DNA, 1311 bp, Corynebacterium glutamicum
atgacgcacatgacatcgtccaatacggctcgatccgcagagtggtttgaaaaggctcagaagctcacccctggtggtgtgaattctcctgttcgcgctttcggttcagttggcggacaagcccgtttcatcgaaaaagctcacggttcaacgctgatcgatgtggacggaaatgaatacgttgacctggtctgttcttggggccccatgctgatgggtcacgctcacccagcagtggtcgaggctgtgcagaaggccgtcgtggatggtctttctttcggcgctcccaccatcggtgaggttgagttggcccaagatatcgtcaagcgcacttctgtggaggaagtccgcctggtcaactccggcactgaggccaccatgtcggcggttcgtctggcgcgcggttacactcagcgttccaagattttgaagtttgagggctgctaccacggccacgtcgatgcgctgctcgcatctgctggttctggtgtcgcaactttcgctctgcctgattccccaggcatcaccggcgctcagacttctgacactattgttgttccttacaacgacattgaagccgtgcgcaacgcttttgcggagtacccaggcgagatcgcctgcatcatcgcagaggcagccggtggcaacatgggcaccgtcgctccaaaggacaactttaacgacaagcttctcgcgatcgctcacgctgacggcgcgctgctgatcctcgatgaagtcatgaccggcttccgcacctcttaccgtggctggttcggcgtagacaaggttgccgctgacctggtcaccttcggcaaggtcgtctccggcggcctacctgccgcagcgtttggcggcaaggctgaaatcatgaacatgctggccccacagggccccgtctaccaagcaggcacactgtccggcaacccggttgcggtcgcagctggtcgggcatcgcttaagcttgccgacgaatccctctacacaaccatcaacgccaacgcagatcgtctccacggtttgatctctgatgccttaacccacgaaggcgtagcccaccacattcagcgtgcctcaaacatgctgtctatccgttttgcagaaggtgagggccacaacttctctgatatgaaggcagccgacatcttccgcttcgcaccgttcttccacactttgctggacaacggcgtctacgcaccaccaagcgttttcgaaacctggtttgtgtcttccgctctcacggacgatgatttctccaagatcgagcaggcactcaagcccgccgcacgtgcagcagcagaagcgaaggcatca

SEQ ID NO: 493 - DNA, 606 bp, Corynebacterium glutamicum
atgacgcaaaccattgtccatctagttcgccacggcgaagtccacaacccagagaaaatcctgtacggacgcatgcccggatacaggttgtcttcccgtggacgcagccaagccgcccgcactgcagcttcttttgaaggccacgatgtcacctacattgcggcctccccattgcagcgtgtgcaggaaacctccgaaccgttcatcaaggtcacaggcctagaactgatcaccgacgaggatcttctggaagcaggcaaccgtttcgaaggcctgcgcaccaaaggttggcgttcccagttgtggaaccccgtgcgttggcctttgatgtacaaccccacgcttcccagctggggcgaacactacaccgacattttggaaagaatgatggcggctgtggaacgagctcgggtggcagcggaaggacacgaagcaatcctggtgacccaccagttgccgatcgtgtgcgtgcaacgccacgcccgcggacaaagcctgtcccataacccagcgaccaggcaatgcgacctcgcctcagtgacatccttggtgttccaagacgatcaaattgtcggcgtgcattacaacgaaccagctcaggagatt

SEQ ID NO: 494 - DNA, 621 bp, Corynebacterium glutamicum
gtgcgtttgaccaaactagcagcaacaatcggctgcgtgacactcagcggacttgcgctagtagcctgcagcagtgacagtaccgctggtactgacgctgttgctgtcggcggaaccttccaattccactccccggatggaaagatggaaattttctacgacgaggctgaccgtcaacaactccccgacattggtggagattccctcatggaagagggcacacagatcaacctgtctgatttcgaaaaccaagttgtcatcctcaatgcgtgggggcagtggtgtgcaccgtgccgctccgaatccgatgatctccagattatccatgaggaactccaagctgccggaaacggcgacacccctggtggcaccgtgttgggtatcaatgtgcgtgattactcccgcgacatcgcccaagactttgtcaccgacaacggccttgattacccaagcatttacgatccaccatttatgacagcagcatccctcggtggtgttcccgcatcggtgatcccaaccaccatcgtgctggataaacagcaccgccccgcagcagtgttcttgcgcgaagtcacctccaaagatgtgttggatgttgcgttgccattggtagatgaggcc

SEQ ID NO: 495 - DNA, 792 bp, Corynebacterium glutamicum
gtggtagcccaaagcatcggccagcagtttgctgacgtcgcagcttccgggccactgttccttggcatccttgccgcagcgctcgcaggtctggtgtcttttgccagcccgtgtgttgtgccgttggtgccaggatatatttcctacctcgccggcgtggtcggtggggaagtggaatacagcgcgcagggcaccaaggtgaaaaccaagcgtttcgccgtgggtggcgcagccatgctgttcatcctgggattcaccgtggtgttcgtgctggctacggtcagtgtgtttggtgccatcagcgtgctcaccctaaacgccgacaccctcatgcgtatcggcggcgtggtgaccatcatcatgggtatcgtgttcatgggcttcattccaggcctgcagcgcgatacccgcatggcaccaaagcgttggaccacctggttgggtgcgccccttcttggcggagtgttcgctctcggttggaccccttgtttgggccccaccctggctgcgatcatctccatttctgcaggtactgaaggcatgaccgctgcgcgtggcgtgatcttaattgtgggttactgcctcggactggggctgccgttcctgctgatcgcgttgggctccagcaaggcactcaccggagtcgagtggttgcgcaagcattcccgcaccctgcaaattatcggcggtgtgtttttgatcttggtcggagtagcgttgctctctggctcatgggcaatttttatcaactgggtccgtcagtggaccgttgaatacggcgcaacactgctc

SEQ ID NO: 496 - DNA, 1623 bp, Corynebacterium glutamicum
atgctcaaaacagtcaagctgtatgcacggaaagcgtggaactggctcaccagcatgcgcacagcactggcgttgctgtttcttctggcgatcgctgccatccctggcgcattgctcccgcagcgttccctcaatgaatcaaacgtcattgaatacattgagaacaatggaaagctcgctgagttctacgacaagattcagcttttcgacgtcttctcctccacgtggtttaccgccatctatgtgctgctcctgatctctttggtcggctgtattctccctcgaagctgggaacactacaaagccatgcgcgcacctgtggtgcgggcgccaaggaacctcgaacgtttggctcacaacggcgaggggctcgtcgaaaagcgtgaagaagaggtagaaaaagacgcccgtaaactcctcaaaggctggaaaatcaccgaatattccgccgaggaagaccgcgcgggagtgcgctccattgccgctgaaaagggctacacgcgcgaactcttcaacctgattttccacctgggcatcgtgggcatgattgtgaccgcaggcctgggacgactgttttactacgaaggccacgtcatcgtcgtgaccgacggcgagcaaaaccaacagaactccgtgttctgcaacactgccaccgccaactacgactccttccgcgccggcgccaacttcgacggcaccgggctgaccaccttctgctttgaagcgcacgatttctccgccgactacctcgccaacggccaggccgagatgttccgctcgaatatttcctacgcagtcggcgacgacatccaaaacgacccagaaacctgggaagactacgaacttcgcgtcaaccacccactgcgcatcgaaggcgaccgcgtctaccttcagggccacggcttcgccccaacattcaccgtgacctggccaaatggcgagacccgcacccagaccgtgcagtggcgcccagacgacccgaccttcttcctgtcctcaggcgtggtccgtttcgatccacccgccggcatgtacccagacctttacgagcgccgccaaaaccagttggccatccagggacttttcgcaccgaccgcggaatgggaaggcgacaacaacgaactgctgacctcctcctacccggcgatgcgtgacccagccgtggcgatcgatatttaccgcggcgacaatggcctcgataccggcatcggacagtcattgttcagcctggactctagtctcatgcacagcggcgtgctgcaaaaaattgagcgcgtcaacctccaaatcggcgacaccgtcaccctggatgatggcaccaccgtctccttcgacggcgcgtcagaatttgccaactaccagatcagccgcgaccccacacaaaactgggtgctggtcaccaccgtgatttcgctggtctccctggttggatccctgatgatccgacgccgccgcatttgggtgcgtttctatccacaagaaaacggaaccacccgcgtggaaaccggcggacttgcccgcaccgaccgcgcaggctggggtggcgaatacgagaaattccaccgcgaactgctgggtctgaaggaggaagatgaagacgaagagtacttcgaccacgacgac

SEQ ID NO: 497 - DNA, 1011 bp, Corynebacterium glutamicum
atgttgcccgtcaaccaaacgtatgcgcagttctcagacactgccttcgtatcggcatacatcatctacgttctggcactcatcctctccctcgtctactacgtaaaacaacaaggcattatcgacgcccgccgcgagcaaacccgcgtcagcgaactcgttggtgcaggcggcagcgctgatgttgatactgacctgcctgatgacatcgccgacggtgtcctcgccgacgaagaccttgcaaaacgcgaagaaaccgcacgcaaactagccaacatgacccaatctctcatgtggctcggcgtcatggtgcacctcgtatccgtcgtgatgcgcgcgctgtctgccagccgattccccttcggcaacctgtatgaatacatcctcatggtcaccctcttcgccatgatcggagccgtactcatcctgcagcgcccacaattccgcgtggtatggccatggatcctcaccccaatgctggcactgctcttctacggtggcacccagctgtactccgacgcagcaccagtcgttccagcactgcagtccttctggttcccgatccacgtttcctccgtctccatcggcgcatccatcggtatcgtctccggtattgcatccctgctgtacctactgcgcatgtggcaaccaaagggtaaagaaaagggcttcttcggcgcagtagcaaaaccactcccatccggaaaaaccctggataacctggcatacaagaccgcgatctggactgtcccaatcttcggcctgggcatcatcttgggtgccatctgggcagaagcagcctggggtcgtttctggggatgggatcctaaggaaacagtctccttcatcacctgggttctctacgctggttacctccacgcacgtgcaactgctggttggcgcaacaccaacgctgcatggatcaacatcctggcgctggtcacgatgatttttaatctgttcttcatcaacatggtcgtatctggtctgcactcttacgccggactgaac

SEQ ID NO: 498 - DNA, 801 bp, Corynebacterium glutamicum
ttgagcctgacggaaggggagatcattcccatccaaacaaagctcggccactggcgtgacgtgcgggattccgaagatctgccattccaagtaatcgcatcgcgcaccagcgtgaccattatggaaaacaccctggaatggaccaacagccgccttgagcgtggcgaagagttcaccgagctcgacatttatgctcactacttggaagagttggaagattacgccctccaattcaccttcgatgtcgagccctacttcaccaacctgcactcctccaacagaatgctcttccctggacctcctgtggatttcccgatcaacgcagaaacccgatgcattcagctcgacgccggtgttgcagtaaagaaggacggcgtggtgctgggtacctcagatatggcgaggtccctgcctcgaaccgccgctggccaagaagcctatgagtacttcttcaaggtggttcgtgaaggcatcatcgggcagctgcgcccgggcgtgatctgcgctgacgtgcacgaagcaacccttgattacctaagcccgcagctacctcgcatgattgacatcggaatgctgggtgccgacaccgatttcaacaccatctaccgcaagcgcaatgttggccacctcatgggcaagcaggaatcctttgccaatgagcttcgccctggatacaagcacattcttcaccacggctcctatggtgccgcggagatcccttggcgctacaacggtgtagccattggtaccgaggatctgtggtacatcggcgcagacaagacctacattttgagccagcgc

SEQ ID NO: 499 - DNA, 471 bp, Corynebacterium glutamicum
gtgacagaaattgcagaaaaccttcagcgcttgggtattgaattacctgatctaccagcaccgcagtattcctacgtaccgttcaaccgccaaggaaacaccctctatgtatcggggcagatttcacgaaccgcagcgggagacatcctcgccggacgagttggcgaagacgcaacattagaagaaggaatccacgccgcagaggtagccaccatcaatctgctggccagaatccaccaatccatcggtttagacaatgtggcccaaattctgaaactgaatgtgtgggtcaatagctccgatgactttattcagcagcctcaagtggccgacggtgcatcccagctccttgaggcagtgttgggtgaggccggaaaacatgcacgcacagcactacccacaaatactctcccccagggagcactagtggaattggatgctgtcgttgcggtcaccgaggccgccgaagtt

SEQ ID NO: 500 - DNA, 357 bp, Corynebacterium glutamicum
atgacctccgttatcccatccagcgcagacagtgccacagagcagcgcttcgcgccgctaaaatccgtacccagcaggatcacggacatcgccgaagaggccagcgatttctacaaggcactcggtgacaccacccgcctagaaatcttgtacctgattttcactacaaaaagctcgcgggtgagcgcgaatgccctggcacacacactcaatatttccgcccccacggtgacccaccatatgaaaaagctcatcgcagctaatttggtcaaccgtgaacaatgcggaaagtgggcgtatttcagcattaattccgctcatattgatacggttgctgaaattttcgcccacgcgtcc

SEQ ID NO: 501 - DNA, 300 bp, Corynebacterium glutamicum
gtgggtaggcttttgctgattattttggttatcgtcgcaatcgtcttgctgtggaaggccttcaagccatctacatggaagcgtaacgcggagatcaatcagggccaggcacctcgtgcagtgaaaggccccgacgatgatgaagaattcttgtggaatattgaaaagaatcgcttcaaacagcgtcgcgccgacgaggctgcccaattagaagaggaagaacgtctcaaacgggccagggaacgctacgcaaagcctgaaagctcagaagaaggtccagagaagcccactgaggattct

SEQ ID NO: 502 - DNA, 333 bp, Corynebacterium glutamicum
gtgagtgagtccaatacccccaatctccagacacaccaagcgccggaattaaacccggaactacaaaaagctgcccggaaaaacgtgctgatttacggtctggcacgtttgcttctgttcgtcgtgctgaccttgattattcatagcctggctctgctgattagtgcgcctgtgccactcgttatgtctgcgatgctggctctgattgtggcgttcccattgtccatgctggtgttcagcaaactgcgcatgaatgccacccaggctgtttcccagtgggatgcacagcgcaaggcccacaaggaatgggttcgaagcgagctggcggaccgc

SEQ ID NO: 503 - DNA, 894 bp, Corynebacterium glutamicum
atgtctcacacggaaccccagccgaattctgtaactttgtccgattggattcaaggcgcacgcccgcgtacctgggcaaatgcgttcgcgcctgtcattgccggttcaggtgtcgccgcttttcatgatggttttgtgtggtggaaggccttgctggcgcttgtcgtggcgtgggctttgatcatcggtgtgaattacgccaatgattactctgatggcattcgtggcaccgatgaagaccgcaccggtcctctgcgactcactggttctgggttggctgagccgaagaaagtgaaagctgcggcgtttatttctttcggtatcgcaggtgtcgccggcaccgcgctgagcctgttgagcgcgtggtggctgatcctcatcggcatcctgtgtgtgctgggcgcgtggttctacaccggcggtaaaaatccttatggttaccgcgggctcggcgagattgctgtgttcatcttcttcggcctcgtcgcggtcatgggaacgcagttcacccaaaccggttccgtcagctgggccggtttggccgccgcagttggcgtggggtcgatgtctgctggcgtgaacttggccaacaatattcgcgatattccaaccgatagcaagaccggaaaaattaccctcgcggtccgcctgggcgatgcgggtgctcgtaagctgttcctcgcgctgatttccacgccgttcatcatgtccatctgcctggcgtttgtcgcctggccagcgctgatcgcgatcatcgttttcccgctggcactgaaagccgcagggccgatccgcaacaacgccaccggcaaggatctcatccccgtcatcggctcaacagggcgcgccatggcgttgtgggccgtgctcacgggcctggcattagcgtttagc

SEQ ID NO: 504 - DNA, 864 bp, Corynebacterium glutamicum
atgtgggttggttatgcggttcgacagatcgccagtgtttttcttactcttttgcgcatgctgccactagcagcgcgaaatcgagttgccaggggacgcatcccggaaaccggcgatgtggtgatctcattgaccacccatgggaagcgaattaactacgttcacttcaccatcgaatcgatcgcacgcggccatgtgaaagcaccaattgtgctgtggttggacaaaccagactttgatgcgccgtggcctgccaccattaagcgacttgtcgcccgcggtctgcaagtacggtgcagcgacggcttctacggcccccacaccaaatactggaaccaattccgagaaatccacggcaccggcgtgcgtgtcgccaccgtcgacgatgacatgatctaccccgagtggttcctgcagcgcttgctttttattggcgacctgcgcatggatgcggttgtcgcctaccgggcgcacagaattgagcttcgcgacgaccgaatgctcccgtacgttaaatggagtgccgcagacacctcaaaagcgtcattcctgcactttgccacgggagtgtcaggcgttttgtaccccgtgaccttcattgattatgtggtctcccagggcgatgtattccttgagaactgcaagcgcgccgatgacgtatggctgcatgcctgcgcactgcgctctgatcaccctattcgccaggtctacgctcagccccgacacttcgctgtcgtgcccaccacccaagtgggagcactagttgttggcaacaccctcatgggtggaaatgatgagcagatcgccaaagtgtacaccgatgaagatgtggcaaaactagttgcagccagcaagaatgaagac

SEQ ID NO: 505 - DNA, 1323 bp, Corynebacterium glutamicum
ttgcgcacgtctcctccggcatctttgtcaccaacaatggttgggaactcaccggcgcaatcggcgctggcgcgctgcttctcatcgcagttggcgcaggtgcatggagcatcgacggggttctggcaaaacgcaaggcctaaatctagcgccacaactccgaattctgaaccatcggcactagaatctcggaatatgaatactcgcgtcctcgaagcactacctgttgatcttgcagatcccaccgcaattctgggagatctcgaggacgcaatctctgggaagaaaactttcctccccatccctgtacaagataaaacccgtgcacagttgctgcgcgattctcaacgagttggcctcgccatcgatccttcgatcgctttggtgatggccacttctggttctacaggtaccccgaagggcgctcagctcactccgttgaatttggtgagttccgccgatgctacgcatcagtttttaggtggcgaaggccagtggttgcttgccatgccagcacaccacattgcaggcatgcaggtgcttcttcgaagcctcattgctggagttgagccactagctattgatctcagcacaggttttcacattgacgctttcgcaggcgccgcggcagaactgaaaaataccggcgaccgcgtctatacatccttgactccaatgcagttacttaaagcaatggactccttgcaaggcattgaagccctgaaactttttgatgtcattcttgttggcggtgctgcattgtctaagcaggcccgaatttctgcggagcagctagacatcaacattgtcaccacctacggctcctcagagacttcaggtggctgcgtttatgatggcaagcccattcccggcgcgaaagtccgtatttcggatgagcgcattgagttgggtggcccgatgattgcgcagggctacagaaatgcacctgaacatccggatttcgccaacgagggttggtttaccacctctgattcaggtgaactccacgacgggattctcaccgtgactggtcgcgtggataccgtcattgattccggtggattgaagttgcacccagaggtactggaacgtgccatcgcagatattaaaggtgtcaccgcggcgtgtgttgtgggtattcccgatccccgattaggccaagcaattgtggccgcgtactccggatcgatcagtccgtctgaagttattgaaggcctcgacgatctacctcgttggcagcttcccaaacggctgaagcatctggaatctttgcccagcattggtcctggaaaagctgatcgacgtgctatcgcgaagctgttt

SEQ ID NO: 506 - DNA, 411 bp, Corynebacterium glutamicum
gtgaccatgtcaactaccagggaaattgcattcctcatcgcacgtatcctcttgggcgtcatcctcatcgcccacggctgggacaagttcgccatcacaggacttgaaggcgtcaccggcttcttcgattcactcggcatcccagcagccggcatcgccgcaatagctgctgcagtcgtcgagctcctaggaggaatccttatcatcctaggagtatttacccgcatcgttgccgccttcgttgccatagacatgctcttcgcagcactgtttgcgcacgtctcctccggcatctttgtcaccaacaatggttgggaactcaccggcgcaatcggcgctggcgcgctgcttctcatcgcagttggcgcaggtgcatggagcatcgacggggttctggcaaaacgcaaggcc

SEQ ID NO: 507 - DNA, 1560 bp, Corynebacterium glutamicum
atgatcaccgcaaccgcactgcatgggtgttcactgattgatggcgagtgggtcgctggaaaaaatggtgagattacaggattcgatccgcgcaccaatgcgagtctgaacccttcctactctttagcaaacagcgcacagctgcgcgccgccacaacatcggcgaagcgagcttttgaaagctaccgactcactactccagaggttagagcagatttcctggattccatcgctgacaacatcgatgcgctatccggcgagatcgtgcaacgggcgagcctggagacaggtttgggaactacccgactcacaggcgaagtagcccgcaccagcaaccagctccgcctgtttgcagaaaccgtgagaagcggacagttccaccgagtacgcattgaacgaggaccgcggattgatcttcgccagcgtcaggttccgttgggaccagtcgcggtattcggggcaagcaacttccccgtcgctttctctactgctggtggcgatacagcatcagcgttggctgcaggctgccctgtggtttttaaggcgcataatgcgcaccctggaacagctgagctcgtcgggcaagcggtgcggggagccgtcgaaaagcatgagtttgatgctggtgtgtttaaccttgtctacggccgtggcgtggaaattggccaggagctggctgcggatccgaatatcacggcaatcggttttaccggttcacgccagggtggtttggcactgtcacagactgcgtttagccgcccagttcccgttccagtctttgcagaaatgagtgccaccaaccctgtgttcgtcttccccggcgcgctggcggatttggatgcatcgagttccttggctgaggcgtttaccgcttccgtcaccggcagttccgggcaattgtgcaccaagcctggcctcgttttcatcccgcgcggtgttgttggtgatgcttttgtggcgctcgtagcagccaaatttaaagaaaccacgggtcaaacgatgctcacgcaaggcatcgctcaggcatggcagcgcggagtcgacaaccttgcagcacagccaagtgtaaaaatcctcgcccaaggcacccccggagatggagagaacgcgccgggcccggtggtgtttgaaagtgatgtgcaggcgttgctaaataatgtggtgttgcaggaagaaatcttcggtgcggcatcgctggtggtgcgttatgattccccggatcaactccaccaagtagccaattcactcgagggacaattaacagccacgatccacgcatcccaggatgatttccaggaagtctcgaaacttatccccctcttggaggatctcgcgggccgtgttctttacggcggctggccaacgggtgtggaagttgggcacacggttatccatggaggcccttatccggcgacctcaaatgcgcagtcgacaagtgttggaaccctggcaatcgagagatttatgcgcccggtttcttatcaaactttcccggctgagctgcttccagatccagtttctgaggcgaataaatgggctgtacctcgggaaatagaccgt

SEQ ID NO: 508 - DNA, 948 bp, Corynebacterium glutamicum
atggcacgcttttcaccacaagatctcgcagaccacctcaaggatggactgctctctttcccggccaccgctttccaagatgacctcgaagtagatgaagctgcttatgtcgagcacattgaatggcagtccagctacccagtcgccggcctcttcgcagctggcggtactggcgaaggattcagccttaccgttgaggaaaaccaccgtgtcactcaacttgcagttcaggcgtccagcccggaagttcccgtgttggggtctgctactggctcaactaagtctgccatcgcaaacgcacagggcgcagaggcagcaggcgctgaaggtgtcctcctgcttcctccctacctcaccgaatgcgacgcagaaggcctgtacaaccatgcagccgcagtctgtgaatccacttctcttggtgtcatcgtgtacaaccgtgccaatgccatctactccccagaggttatcgctcgactctctgagcgctaccccaacttcattggatttaaagatggcaccggaaacatcgagcacctagcaaagatcaccacgctatgcggagatcgcctgttctacctcggtggacttcccaccgctgagacctttgcactaccactgcttcagatgggcatgagcacctactcctctgcaatgttcaacttcattccagatttcgcactgagcttctacgccgatgttcgtgcgcaggacagcgcagcagtaaagcagaagctgagcgattttgtgctcccctacttggatatccgcgatcgcgcacaaggctacggtgtctccattgttaagggcggactcaaggctgttggccgcaacgctggcggcgttcgcccaccactgcgtaacctttccgagcaagatatcgcggacctgtcggatttgcttgccacctctggcgcaggttcctaccgccttccagttgaggtgaaagca

SEQ ID NO: 509 - DNA, 879 bp, Corynebacterium glutamicum
ttgttcactcttgaacagttgcggtgttttgtcgccgtcgccaatcatcttcatttcggaaaagctgctgcagagctatccatgacgcagccgccgttgagtcgtcagattcaaaagctggagaagatcgtcggtgcaaccctgcttgatcgtgacaaccgcaaggtggaactgaccactgcgggtttcgcatttttgaaggatgctcgcctcattctcaattccaccgagaaggcggctgagcgcgcacgattggctagctctggcatgtggggacagctcaatattggatacaccgctgcagcgggtttttccattctgggcccgacgttgaatcagttgcatgagaagatgccgggggtcagtgtcgatctttttgagatggtctccaccgagcagatcgccgccttggaatctgggctactggatcttggcattggccgattgagctcgccagttgagggtcttcaaactcgacgtctccaggcagattccttggttcttgcagctccgaaggggcatccacttcttgatcagaatcgaccactgttgcggaagcatctgactggggttccttttctgcagcactctcccaccaaggcgaagtacctctacgacatcgttgttagaaacttcacgatcaatgatgcgcaggtgcaacatacgctgagccagatcaccacgatggttagtctggtggcctctggactgggtgttgcgctggttccggagtctgcgaaaaaactcaattacagcggtgttgagtatcgccatttttatgatctacctgttggtttagcggagctgcaggctatttattccacctcgaatgataatcctgcggtgcggaaattcatcaaaaacattgacgataccttt

SEQ ID NO: 510 - DNA, 315 bp, Corynebacterium glutamicum
atgagccacaacgacagcccaaactttgctcgccgagcgctcaattggctccgccaaggttatccaaccggtgttccgcggcacgatactttcgctctgttttacgttttggagcgcgaacttactgaggaagatctcaatgagctcgcagagcttctcatcgcggaaggtgagaacaatgggctgcacgataatcccattacgcgtgaaaaaatcggcaagctgatcacgcatgttcacagtcagccacctgaggatgaagacatcgatcgaattcagaaaaagctgcaggctgagggcttccccacccgcaat

SEQ ID NO: 511 - DNA, 444 bp, Corynebacterium glutamicum
gtgctggggatcgatgatatggaaatgggaatcaaacaacttggccatgatttagttttccttaggtgcttcaggcagacgggagacaaacttctcacggttaaccacaccgcgctggtgggtgccggtgctgatggtggcgaactcatcagctgcagtgatgttgaaggtaactgcacgacggttgatctctgtcacctcaacatcgatggtgaccgtggatccaggaaccgttggagctgcgtgggagaagttcacatgagtgcccagcgagatttcaccgtcgtccaaatggggacgcagaagttccatgcaggcccactcgatgatgccgaccatatatccagtggccaggacatctggcatggtttcaaattctgctgcttcgggaagcagatgcggaactgtgcggtttgctggcactatgtaggtcatttggtgggt

SEQ ID NO: 512 - DNA, 750 bp, Corynebacterium glutamicum
atggccaagttgtttgattcccatttccatatcatcgatccccagcacccactgatcgaaaacaacggctacctccccgagcctttcaccgtggaggattacactgcgcgtgttgaaggcctcgaagttgctggcggagcgattgtttccggttctttccaggctttcgaccagggctacctcaaagatgctctcgcagtgcttggcccaggctatgtcggtgtcactcagatccccgcagatacctctgatcaggagattcttgatctggacaaagctggcgtgaaggctgtgcgtttaaacttgaagcgcggtggttcggcaggtcttgacgatctcgagaccttggcacgccgagtccacgacctagccggttggcacaccgaactctatgtggatgctcgcgaactagacgagttggaatcaaccttggcctccctccctgctgtcagcattgatcacttagggctccaccgcgatggacttcccgcacttcttcgcttggtagaaaatggcattaaagtcaaagcaaccggattcggacgggtagaactagatccaactgaagtcatccaggcaatcatggctgtcgatcccactgctttgatgatcggaactgatcttccatccacccgcactaagcgacctttcgaagacgctgacctagatttgatcgctgaaacggttggcgaagatcatgtcgacaacgtcttctggaacaacgctgcagcgttctacctcggagaccag

SEQ ID NO: 513 - DNA, 417 bp, Corynebacterium glutamicum
atgaaagagacactgaccaccggtttaacccaccaaatgacctacatagtgccagcaaaccgcacagttccgcatctgcttcccgaagcagcagaatttgaaaccatgccagatgtcctggccactggatatatggtcggcatcatcgagtgggcctgcatggaacttctgcgtccccatttggacgacggtgaaatctcgctgggcactcatgtgaacttctcccacgcagctccaacggttcctggatccacggtcaccatcgatgttgaggtgacagagatcaaccgtcgtgcagttaccttcaacatcactgcagctgatgagttcgccaccatcagcaccggcacccaccagcgcggtgtggttaaccgtgagaagtttgtctcccgtctgcctgaagcacctaaggaaaac

SEQ ID NO: 514 - DNA, 378 bp, Corynebacterium glutamicum
atggtgatggcgtgtactcgacaagcggagagaaaatcctctccgaagccactcggctgttctacgccgaaggactctgcgcgatctgagtcgaccgggtcgtggctgaatccggcctggtcgccgcagttctttaacgccgtagtgataccagaaaatgggacatcaccgaatacctggattcgccacacgctcaccgagctttccgctcaagatggcctggcgaacccagcaaagtgcgggtcattcttttcattgcttatcgacggcgccagcgtccgtgccatcaccaccggcgagatcactggcatcgtggacgcaaaacaaacagcaacagaaattattaacatccgacgcaacgcttcaggagagtcctca

SEQ ID NO: 515 - DNA, 261 bp, Corynebacterium glutamicum
atgaacttcgctactattttcggaagcatctttgaggtcaccctcgtgggcattttgctcggcgcaggccttccagccctttttgcattaggaatccgctttgctcacagcccttcttccaacggcaccaacgctcttggaaaaattgcttcaaccatctgctttgccatcattgcggttgctatcatcgctggcattctctgggtcaccaaagcaacgatctaccagtactctggtttcgacattttcggcactgaaggc

SEQ ID NO: 516 - DNA, 1275 bp, Corynebacterium glutamicum
gtgaccgagctgattattttattgattgttatcgtgacggcgctcgccttcgatttcacaaacggattccacgacaccggcaatgcgatggccacatccattgccacaggcgctctaaaacctaaagtcgccgtggcactatccgcctcactgaaccttgttggcgcattcctctctgtagaagttgcgacaactgttgccaaaggcgttgttgacctcgaccaattcgacctaagcaatgcctgggattcccaccagctcctgcttgtcgtcttcgccggcctcattggcgccatcgtctggaaccttctgacctggctgctaggcattccttccagctcctctcacgcacttttcggtggcctcattggcgccgcaattgcttcactcggtttcggcggagtggtgtgggaaggtgtcttgtccaagatgatcatcccagcattggctgcaccagttgttgcaggtctcgtggccgccatcggcactttcgccgtgtacagcatcacaaaggcagttggagacaacgagaagaaccgttacttccgctggggtcagatcggctccgcttccttggtttccctggcacacggcaccaacgatgcccagaagaccatgggcgttatcttcctttccctggttgccaccggtcacctgggaactgacgctgacatcccattctgggtcaaggctacatgtgcattggcaatcgcaatcggtacctacttgggtggttggcgcgttatccgcacactgggcaaaggcttggttgagattgattcccctcagggcatggcagcagaaacttcttctgcagcaatcattttgacttcttcccacttcggtatggcactgtccaccactcacgttgctactggctccatcatgggtaccggcattggacgtaaaggggcgaaggttcgttggtccgtcgcaggacgcatggcaatggcctgggttatcaccctccctgcctccgcgatcgttggcgttttctgctggtgggtagctcacggaattggtcttatcagctcagacctcctcggagtcctcgttgcattcgccattctggtcattctgtctggctacatttacgcccgttcccgtcgcgtgcctgttgatccaagcaacgtcaacgctgactggaatgaagaatcaaacagcgtggaacctgcaacaccttccgccccggctgcttctgagattacagaagctcctgccgctccagccgctcaagccgttcaagatctcaacaacgagaatgaggtaaccaag

SEQ ID NO: 517 - DNA, 222 bp, Corynebacterium glutamicum
gtggctcaaaataaaaaggacatcgaacatatcgtcgcactacaagggcgtggacaagcctcaaagattcgtatagtacacatccggggcggagatgaacctttactctggattccagatattttcttaggagaaattaactctaactatcttggaaatgatctctactggaaacaattgcaagacagagttgttctcaattcattaaccccggaatcacta

SEQ ID NO: 518 - DNA, 306 bp, Corynebacterium glutamicum
gtggaatcgcagctagttgcctatatagacgaatcatcagccatgcgatcccaaaaccgccaagattacatggtgtgcgcggctattattgattctgtcaactcggacgcgatacgcactgaactcataccgttacgccttccaggtcagattaagctgcattggacagacgagcgtgagagtcgtcgcagaacgatagtcaagacattatccacccttgattccatgcaagctgtagttactcatcgcagcgagataagtaaagacagaacgctaccgaaggaaatgcctcgaaaatatgtattt

SEQ ID NO: 519 - DNA, 957 bp, Corynebacterium glutamicum
atgagcaactacagcaccgacaacccttttgatcccacccaatgggccaccgttccaggttttgaagaattcaccgacatcacctaccaccgccacgtgggcaccacccgcgccgatggcatcgtgcgcatcgccttcgaccgccccgaagttcgcaatgctttccgcccccacaccgtcgacgagctttaccaagccctcgaccacgcgcgccgcaccccagatgttggaaccatcctgctcaccggcaacggccccagcgaaaaagacggtggctgggcgttctgctccggcggcgaccaacgcatccgcggccgctccggctaccaatacgccaccgaacacgcgcgcgacgatgccaccgctgatgtctccacggtagatattgcccgcaccaaagttgaaggcggacgcctccacattttggaagtccaacgcctcatccgcaccatgcctaaagttgtcatcgcagtagtcaacggctgggcagccggcggtgggcactccctccatgtcgtttgcgacctcaccatcgcttcccgccaagaagcacgcttcaagcaaaccgacgctgacgtgggatccttcgacgctggctacggctccgcctacctagcgaaaatggtcggacagaaaaacgcccgcgaaatcttcttcctcggacgcacctacgacgccgaacgcatgcaacaaatgggcgcagtcaacatcgtggccgaccacggcgacctagaaaaagaagccatccaagcagcccgcgaaatcaacaccaaatcccccaccgcgcaacgcatgctgaaattcgccttcaatctcaccgacgatggcctcatgggacaacaagtcttcgccggcgaagccacccgcctggcctacatgacggatgaagccgtagagggtaaggaagcattcctagaaaagcgcgaacccaactggaatgaattcccttactactac

SEQ ID NO: 520 - DNA, 603 bp, Corynebacterium glutamicum
atgcgcttactgctgacctcctttggccatgatcatattcgggattttgtacgcggtaccgtggcgtatatccctgatgcgaccaggctttttgctgatagtcccgaggctgctccttttatggagacggagcgaaatatgctgcgcgagcacggcttgagcattcgtgagctgccgatttccacgtcgactccggaggaagtggatcgggtgcttggtgaggttgatggggtgtatgtggcgggcggtgagacttttgatctgatgtggctgctgcgttccacaggcaatgatgaggtgttgattaagcatgttcgcgctggtctaccgtatattggaacgagcgccggcgcggtaattgcaggtccttcgattgaaccgatcagctttttggatagccccgatgtcgcgccgaatttaagcgactattcaggtctaggcctgtgcgagcatgtcgtggtgccccatgctggtggcacgatcccgcaatttcccatcgatgtgtttgcggaaaccgtgcgcacctacggcgccgaattcccgctggtcctgcttaaagatggacaggcactgcttatcgacgaccacggcgtccacctaatt

SEQ ID NO: 521 - DNA, 309 bp, Corynebacterium glutamicum
atgtgcgccattttaaggcaagatggggccatgaattcgcttttcgacgtctccccacactggtcctccgccaacgccaagctcaccgcacatttcaacaccggaaaattctccactggcatgaaatttgtcaacctcattgccgactccgcagaagaagccaaccaccaccccgatatccttctcacctatggttttgtggaaatcaccctcaccagccacgatgtgggtgagataaccgaccgtgatgtcgccctagcaaaagtcatcgacgcccacgccaagaccttggccatttcggcagaggct

SEQ ID NO: 522 - DNA, 1014 bp, Corynebacterium glutamicum
atgagcaccccaactgttgatgagattctagagcgcgcccacgtggtgtcgctgccgatgcgtgtgaagtttcgtggcgtcaccaccagggaggctttgctgattgaaggccctgctggttggggagagttcgcgcccttccttgagtatgacccgcaagaatcggccagttggctaaagtccggcattgaagcagcgtgggagggttttccggcgccgttgcgtgatcgcgtggaagtcaatgccaccatcccagctgttccggccgatcaagtggcagaagttttggaccgtttcccaggctgtcgcaccatcaaagtaaaggtcgcggaaccaggccagaccttggctgatgacatcgcgcgagttgccgctgcccgtgaggcacgccccggcgcgatcatccgtgttgatgccaattgtgggtggagtgtggagcaggcggtggaggcggctcaggcgttggcgccgttggattatttagagcagccgtgtgccaccgtggaggaactggcggaagtgcgcatgacggtgcagcggcgcggactttttgtgcgcgttgcagcggatgaatcgatcagaaaatctgatgatccttatcgggtggcggatctgcgtgctgcggatgtggctgtggtgaaggttgctcctttgggtggtgtgaaaagggtacttgaggtggtgcaacatttgcgggcgcgcacgatggacatcactgtagcaagtgcgttggacacggttgtggggatgaatgctgggttggctgcggtggcggcgttgccgaagttggatgatgacgatctcattgatgtgccaccagcggcggcgggtcttgcgacttcgcagttgttcctggaggatgtcgcgaccccgcacgcaatcactgatgggttcatggaaacgcgtgtaattgccccggaaatggatcgtttggaaacgcttgctgccagcaaagataggcgtgattggtggtttgagcgcgtgcgtgaatcgtatccgtacctggagacgatc

SEQ ID NO: 523 - DNA, 1629 bp, Corynebacterium glutamicum
atgtccagcacgccagctcaagatcttgcccgcgccgttattgattccctcgcaccacacgtcactgacgtggtgttatgcccaggatccaggaactcaccgttgtcgcttgagttgctggcgcggcaggatctgcgtgtccatgtgcgtatcgacgagcgcagcgcctcatttttggcgctgtccctagcgcgtacccaggcccggccggtggctgtggtgatgacctccggcacggctgtagctaactgcctgcctgctgttgctgaagctgcgcatgcccatatcccgttgattgtgctctctgctgaccgtcctgcacatttggtgggaacgggggcgagccaaacgattaaccagaccggtatttttggtgatcttgcaccgacggtcggtatcactgagctggatcaggtagcgcagattgctgaaagccttgctcagggggcttcccagattccgcgtcatttcaatcttgcacttgatgttcctttggttgctcctgaactgccagagcttcatggtgaggcagttggagcatcatggacgcatcgctggatcaaccacggtgaggtgaccgtggacctgggggagcacaccctcgtgattgccggtgatgaagcatgggaagtggaagggctggaagatgtgcccaccatcgctgaacctactgcaccaaagccttataatccggtgcacccactggctgctgaaatcttgctgaaggagcaggtctccgcggaaggctatgtggtaaacaccaggcctgatcatgtgatcgtggtgggacaccccacgctgcaccgcggagtgttgaagttgatgtcagatcctggcattaaattaactgtgctttcacgcaccgatatcatcactgatcccggccgccatgccgatcaggtgggcagcacagtgaaagtcaccggcacccaggaaaagcagtggctaaagatctgttcggcagcatcagaacttgcggccgatggtgtgcgtgacgtcctggacaaccaagaattcggtttcaccggcctccatgttgccgcagccgtggcggataccttaggcaccggcgatactctctttgctgcagcatccaactcaatccgtgacctctccctggtgggtatgccttttgatggcgtggataccttctccccacgaggtgtcgcaggcattgatggttctgttgctcaagcaatcggcacttcacttgctgtgcagtcccgccaccccgatgaaatccgcgcgccacgcactgtggcccttctgggcgatctgtcgttccttcacgatattggcggactgctcatcggccctgatgaaccacgcccagaaaacctcaccatcgtggtctccaacgacaacggtggcggaatcttcgaactcctagaaaccggcgcagatggtctccgccccaacttcgagcgtgctttcggtaccccacacgacgcgtccatcgcggatctctgcgcaggctacggcattgaacaccaagtggtagacaacctccaagacctcatcatcgcgctagttgataccaccgaagtatccggattcaccattattgaagcttcgaccgtccgagatacccgccgtgcacaacagcaagctctcatggacacggtgcac

SEQ ID NO: 524 - DNA, 441 bp, Corynebacterium glutamicum
atggagtggtaccaagtgcgccgacgggcccgacaactgctcattgtcctttttatagcagcgatgctcggagcagcctccatggtgatcgggccattccttaacgaccgcactatcgaaggcaactccgggcgcgccttggcacaagtaaccaacgtcggcagctaccgcacaacggtggatttccaagatgaaaacggcatctatcactcaccagccaccggcctgttgttccccacgggactgggcgaggggcaacgcgtgtgggtgaactacgccaaatcagatccagacctggtcaaagtagaaggccgcaagtggacactgtccatcatcccagcgcttagtgtcgcagctgtcgccaccgctacctggtcagtactatggctgggagtgggcagattcggaagacgatccgacgacgccaacgaaaccacagtg

SEQ ID NO: 525 - DNA, 1239 bp, Corynebacterium glutamicum
gtggagataataaggcccatgcgggtagcaattgttgcagagtcgttccttccaaatgtcaacggagtcaccaactcggtgctccgggtgttggagcatttgaaagccaacggacacgacgcgctcgtcatcgcgccgggtgcccgggattttgaagaagaaatcggccactacctgggctttgaaattgtgcgcgtccccaccgttcgggtcccactgattgattcactgcccatcggtgttcctctgccctcagttacctctgtgctgcgcgagtacaacccagacatcattcacctggcatccccatttgtgctcggtggagcggcagcattcgcagcaaggcagctgcgcatcccagcaattgctatctatcaaactgatgtcgcagggttctcccagcgctaccacctggcaccgttggccactgcaagctgggaatggatcaagacggtccacaacatgtgccagcgcacccttgctccctcatccatgagcattgacgagctgcgtgaccacggaattaatgatattttccactgggctcggggcgtggactccaagcgtttccaccctggaaagcgttccgtagcgctacgtaagtcttgggatccaagtggagcaaagaagatcgttggtttcgttgggcgccttgcatccgaaaagggcgtggagtgccttgctggattatccggacgctcagacatccaattggtcatcgtcggtgatggcccagaggccaagtacctgcaggaaatgatgccggatgcgatcttcacaggagctctcggcggcgaggaactagccaccacctacgcatcactcgatctgtttgtgcacccaggtgagtttgaaaccttctgccaggcgatccaggaagcccaagcatcaggtgtgcccaccattggcccacgcgcaggtggtcccattgatttgatcaacgaaggcgtcaacggcctgcttcttgatgttgtagatttcaaggaaaccctccccgctgcagccgaatggattttggacgattcccgccactccgaaatgtgcgcagctgcttgggaaggtgtgaaagacaagacctgggaagctttgtgcacccagcttctccagcactacgcggatgtaatcgcattgtcacagcgcatcccactgacattctttggccctagcgctgaagtagcaaagcttccactgtgggttgctcgcgcgctgggtgttcgcacccgcatcagcatcgaggct

SEQ ID NO: 526 - DNA, 1359 bp, Corynebacterium glutamicum
ttgagcaatagacaccttcagctcatcgccatcggcggagcgatcggtacgggtctgttcatggggtccggcaagacgatctccgttgcggggccatcagtaattttggtgtacgccattattggtttcatgcttttcttcgtcatgcgtgccatgggagagctgctgctcgccaatttgaattacaaatctttgcgcgatgcggtctctgatattttgggtcctggcgcaggttttgtcaccggctggacatattggttctgctggattgccacaggcatggcggacatcgtggcgatcactggatacacccaatactggtggcctgagatcccattgtggcttccaggtgtgctcaccattgcgttgctgtttgccctgaacttggctgcggtacgactgttcggtgagatggagttttggttcgccatcatcaaaatcgtggctatcgtgtccttgatcgtcgtgggacttttcatggtggtcacagcctttgaatcacctaatggcaccaccgcgcagttcaacaacctcattgagcatggcggatttttccccaacggcatcaccggtttcttggctggtttccagatcgctatctttgcgttcgtcgggattgaacttgccggcactgcagctgcagagactgagaatcccaccaagacgcttcctcgggcaatcaactccattcccatccgcatcgtggtgttctatgttttggcgttggctgtcatcatgatggtcaccccatgggatcaggtccgtgctgacaacagcccattcgtgcagatgttcgcgctggcaggaatcccagcggcggcaggcatcattaactttgtggtcatcacttctgcagcgtcgtctgccaacagtggtattttctccacctcccgcatgttgtatggattgtctttggaaggcgcagctccgaaacggtggagccggttgtccaagaacttggtgccagccaggggattgactttttctgtgatttgcctcattccagcggtgggtttgctgtacgctggcggcactgtcatcgaggcattcacactgatcaccacggtttcttcggtgttgttcatggtggtgtggtcctacattttggtggcttatatcgtctaccgccgcaacagcccggaattacacaaaaagtcgattttcaaaatgcctggcggcgtggtcatggcagttgtggtgttggtgttcttcgcagcgatgttggtggtgctgtccctggagccggatacccgtgcagcgctcatcgcgacgccagtgtggttcatcattttgggtatcggttggttgtccatcggtggagctaagggcgctaagcatcgcagccaaataacctcccac

SEQ ID NO: 527 - DNA, 690 bp, Corynebacterium glutamicum
gtggctaaagcagatttagacaaggaccccttcgacgtagcgtcaatgttcgatgacgtcggaaagaactacgatctcaccaataccgtgctttcttttggtcaggaccgtgtgtggcgaaagcgcactaggcagcgcctggacctcaagccaggggagaaggtgcttgatctagctgcaggaacagccgtttccaccgtggagttggcaaaatccggcgcgttttgtgtggcgtgtgatttctcccagggcatgctcgccgcaggtaaagaccgcgatgtgtccaaggttgtgggcgatggcatgcagttgccgtttgcagacaacagctttgatgctgtgaccatttcttatggtctgcgcaatattcacgatttccgcgctggcctgaaagaaatggcccgcgtgactaaacctggtggacgcctcaccgtggcggagttctccacccccgtgatccctgtgttcggcaccgtgtacaaggagtacctcatgcgcctgctgccccaggcggcgcgcgcagtatcgtccaacccggaggcctacatttacctggctgattccatccgcgcatggcctagccaggcggaactagcacgggagatcaaccagaatggttggtcagattgcggttggcagaacctgaccttcggcatcgtcgcgctgcactcggcgattaaaccagagaac

SEQ ID NO: 528 - DNA, 669 bp, Corynebacterium glutamicum
atgtggccataccaaggtcaaatcgcgcttggggttttccacaagcgtgtcgacggccatcgccgcggtttccaggccatagtcgatgccttcgccgttcagcgggttcacacacgcggcggaatcgccgatcagcatccagttcgcgccagccacattcgacaccgcgccgcccataggcagcagggcagaggcgacgtcgtgctcgggcccgagttgccatgctttacgacgctgacccgcatagaagctcaacaatttcttcgtattgatcttcgctggtctcgtatccgtcgagagcgcgccacaacccaaattcaccgtgccgttgcccagcgggaaaatccacccatatcctggctgcaccacaccatcttcatcgcgcagttccacatgggagtgaatccacggttcatcagacagcggagtttcacaataagcacgagccgcaatgccatacacctcatcgcgttgccactgcctacccagtttcttaccgaaaggggagcggacaccatcggcaataatcacatgcttcgccttgacggttttctcttgccctgcgtgattaatcacaacgccttccaagaaattccccctcaaaatggggtcttgggcgctcgcgttctcccacgtggttacttcctcatgagattttgccaagcggaa

SEQ ID NO: 529 - DNA, 1272 bp, Corynebacterium glutamicum
atggggtttgtgtctacaacttttgatgtgttgatcatcggcgcgggcccctcaggtgccagcgccgccgtccatgcggccaggactgggcttcaaacattgcttatcgacgcctcctccttcccgcgggataaaacgtgtggcgatggccttactccccgtgcgattcaccagctagaacttctaggtgttgctgatcaggttaccggggattatttcaacaagggcttgaaactgcatggttttggtggctctgttgaggcgccgtggccggagacatatttcacgaataagggttccgcgatgtcgcggatggagttcgatgatttgttattccgcttggcaaaatctcatgaggaagtaaccacgtgggagaacgcgagcgcccaagaccccattttgagggggaatttcttggaaggcgttgtgattaatcacgcagggcaagagaaaaccgtcaaggcgaagcatgtgattattgccgatggtgtccgctcccctttcggtaagaaactgggtaggcagtggcaacgcgatgaggtgtatggcattgcggctcgtgcttattgtgaaactccgctgtctgatgaaccgtggattcactcccatgtggaactgcgcgatgaagatggtgtggtgcagccaggatatgggtggattttcccgctgggcaacggcacggtgaatttgggttgtggcgcgctctcgacggatacgagaccagcgaagatcaatacgaagaaattgttgagcttctatgcgggtcagcgtcgtaaagcatggcaactcgggcccgagcacgacgtcgcctctgccctgctgcctatgggcggcgcggtgtcgaatgtggctggcgcgaactggatgctgatcggcgattccgccgcgtgtgtgaacccgctgaacggcgaaggcatcgactatggcctggaaaccgcggcgatggccgtcgacacgcttgtggaaaaccccaagcgcgatttgaccttggtatggccacataggttgcgcgacgcgtacggcgagaccttcatgttggcgcgcacggctgctcgactgctgacgtacccgcagtttttgccgatggctgggccgctcgcattccgcgggccgctgcaaaaggccatcatgccggcggctgcgcgtttgatgggcaacctgatcacagaggaggataaagacctgctcgccaggggttggcaggccgccggatccgcgattagttgggcgcggaagggctcccctctgtgggactcgactagttctctggtt

SEQ ID NO: 530 - DNA, 1050 bp, Corynebacterium glutamicum
atgagtagcggccgaaccgttccaacccgttcccacgggctcggaaaagaaggtgtatccaccacaggagcatctcaggtcgagtttggtgatcccgagctaacggccaggatcaatgacgccatggtgcaggtagaagaactcctgcacactgaactatcgtccggggaagacttcctcgtcgatatcgtcatgcacctaacacgagccggcggcaaacgattccgccccatgtttgcactgctggcctccgagttcggtgaaaaaccactctccgaaaacgtcatcaaagccgccgttgtcgtagagatcacccacctggccaccctgtaccacgacgatgtcatggacgaggcatccatgcgccgcggcgtcccaagtgctaacgcgcgatgggacaactccgtagccatcctcgcaggcgacatcctcctagcacatgcatcaggtctgatgagtcagctgggtaccgacacagtcgcccactttgccgaaacattcggcgaactagtcaccggccaaatgcgcgaaacagtcgggccacgcgacaccgacccgatcgagcactacaccaacgtaatccgtgaaaaaactggtgtcctcatcgcctccgcaggctatttgggagccatgcacgcaggcgccgcacctgaacacatcgacgccctgaagaacttcggcgcagccgtcggcatgatcttccaaatcgtcgacgacatcatcgacatcttctcggaaacccacgaatccggaaaaacgcccggcaccgacctccgcgaaggtgtattcaccctcccagtgctctacgcactccgtgaagacacccccgtcggcgcagaactccgcgacatcctcaccggccctctagaagacgacgagaccgtcaaccacgtcctcgagctcctctcccaatccggcggacgccaagcagccctcgacgaggtctaccgctacatggacatcgccaacgcagaactcgaccgcctcccagacagcaccgtcaaggaagccctccgcaaccttgcaaccttcacagtcaagcgcgtcgga

SEQ ID NO: 531 - DNA, 333 bp, Corynebacterium glutamicum
gtgagcgacgagcagaattctggcgtaggcggaacgtctcgcccaacgggtaaacgccagctgtcgggtgcttccactacctctacctcttcttatgaggctaagcaggtatctacacagaagaagtcatccggttcggattctaagcctggcggcggtgttatttcttttctgcctgaggttgtgggagaagtccgtaaggttatttggcctactgcgcgccagatggtcacgtacacccttgtcgttttgggattcttgattgttttgaccgctttggtgtctggtgtggatttcctagctggtcttggagttgagaagattctgactccg

SEQ ID NO: 532 - DNA, 954 bp, Corynebacterium glutamicum
atgagcgatgagaacattaacgagtttgagcaggacgaggatctgaacttcggcgcgagctttagtgatgaattcgcagatgacgatttcgatgcagaagcagacgtagaagcagatgctgctgcagaggcctctgccctggaagctgagcaggatctggaagaagagaccctagatgctccagaagaagccgcagaagaagctcctgctgctgcagagtccgaagctccagtagaagaggacgaagaggctgacagccttgctcaggcggctgctgcacttggtgacaccgatgagcaggacgcggatgcagagtacaaggctcgtctgcgtaagttcactcgtgagctgaagaagcagcctggtgtttggtacatcattcagtgctactccggctacgagaacaaggtgaaggcgaaccttgacatgcgtgctcagacccttgaggttgaggatgacatctttgaggttgttgttcctatcgagcaggtcactgagatccgtgatggtaagcgcaagctggttaagcgtaagttgctgccgggctacgttttggtccgcatggacatgaatgaccgcgtgtggtctgttgttcgcgatacacctggtgtgaccagctttgtgggtaacgagggcaatgcaactcctgtgaagcaccgcgatgttgcgaagttcttgatgcctcaggagcaggctgttgtcaccggtgaggctgctgctgcggctgccgagggtgagcaggttgtggctatgcctaccgataccaagaagcctcaggttgctgtggacttcactgttggtgaggctgtgaccattctgactggtgctttcgcttctgtttctgcaacgatttcttctatcgatcctgagctgcagaagctggaagttttggtgtccatctttggtcgtgaaactcctgttgatctcagcttcgaccaggttgagaaggttagc

SEQ ID NO: 533 - DNA, 435 bp, Corynebacterium glutamicum
atggctcctaagaagaagaagaaggtcactggcctcatcaagctccagatccaggcaggacaggcaaaccctgctcctccagttggcccagcacttggtgctcacggcgtcaacatcatggaattctgcaaggcttacaacgctgcgactgaaaaccagcgcggcaacgttgttcctgttgagatcaccgtttacgaagaccgttcattcgacttcaagctgaagactcctccagctgcaaagcttcttctgaaggctgctggcctgcagaagggctccggcgttcctcacacccagaaggtcggcaaggtttccatggctcaggttcgtgagatcgctgagaccaagaaggaagacctgaacgctcgcgatatcgacgctgctgcgaagatcatcgctggtaccgctcgttccatgggcatcaccgtcgaaggc

SEQ ID NO: 534 - DNA, 708 bp, Corynebacterium glutamicum
atgagcaagaactctaaggcgtaccgcgaggccgctgagaagatcgacgctggtcgcatctactccccactcgaggctgcaaacctggtcaaggagacctcctccaagaactacgacgcttccatcgacgtagctatccgcctgggcgttgacccacgtaaggctgatcagcttgttcgtggcaccgtctccctgcctaacggcaccggtaagaccgttcgcgttgctgtgttcgcacagggcgagaaggctactgaggctgaggctgctggcgctgacttcgttggcaccgacgagctcgttgagaagatccagggtggctggaccgacttcgacgttgctattgcaacccctgatcagatggctaagatcggccgtatcgctcgtgtcttgggcccacgtggtctgatgcctaaccctaagaccggcaccgtcaccaacgatgtcgctaaggctatcgaagaggtcaagggcggcaagatttccttccgcgttgacaaggcttccaacctgcacgctgcaattggtaaggcttccttcgatgcgaagaagctggctgagaactacggcgctctcctcgacgagatcatccgtatcaagccttcttccgctaagggcatctacgtcaagcgcgtgaccctgtcttccaccaccggtcctggtgttgaggttgacactcacgtcaccaagaactacgcagaagaggca

SEQ ID NO: 535 - DNA, 1512 bp, Corynebacterium glutamicum
atggaaaccccaacccaagacatggatgtccgctggttatacacccaaagccagctcaaactccgcgaaattctccccacaaacaaaaccttcgatgtcatccaaatcagcgaactcgttgaccccaccgacttcatcagccccaacagcgtggtcttatccgttggcatcgccttcgcagaaacgcccgacgggcttcgcgattgggcacaccgactcgccgacgcaggggtcatcgcgatcgggttcggctccggcctcaccttcccacaggttccgcaggcgcttatcgacgcctccctccaccttggcctcggcctctttgaagtcccccgtgaaattccatttatctcgatcacctccagcgtgcgtgatgagcaaacccgccgtgccggccgcctgcaacaagaactcctcctggaacaggaacggcttaactccatcgccatctccggtggcatcgaagccctgtgccgtgctgccgccgactatttgggtggtgcagtagccatcgtggacagcgacggccgcgtggcttgctctattaccaccgatgacctagacgcactcccccaagctgtctcgcgccttaacggatccagtcaagcactcacggatgccaccaactttggattcatccaccgtatgacccggtacggcgaccgccaccacgtgctctcagtccttatgcccacccgccccagcgaacaacaccgcgcactgatcagacactgcgcaggccttgccgatattttgcttcaacgccccgaagccatgcgcgaccgagaaatcgaagtgcgctcacttgccatgtcactacttctgggtcgaagcgacgacctagccaccattcaccgcgtgttcgctgacatcactgatgcttccggaaatatccgccccatcctcatcaccggcaacacaccccaatcagtacgaaaagcactctccagtgtcgccaccgcactgtacaaacaggaacgagcactagctcatctacgcctcgccgaatccaccgaactcctcttccttcgcggaagccgcagcgtgcacaacatcgtgcaactttttggtactgccgcaagcggagttcgcctctgcattggtctgcccacccgagcggaaaacatcgataagaaactcatccgcgaactcactgccaccgcaaaaaccctacaacttggaacccacgccgaaccccgtgacggcaccttgctgtggctccaaaaccccgagctgcgcaaaatccttaagatccgatcccgcgacacctacgaccgtctcctcgaccacgaccgcaccaacaacaccgagctcgcccccaccttggtgtcttttactcagcacagcggacatataggcgacaccgccaaagaactgggcatccaccgccacaccgtgcgcacccgcatgatccgcattgaagagatctgcgaaatcgacctcaatgatccactgaccagagcggagctgctcttagtgatcgcaacgaaggagggagacgtcgaaaagcaa

SEQ ID NO: 536 - DNA, 1344 bp, Corynebacterium glutamicum
gtggaagatctctcataccgcatcccgcagtcgcgcaccgtggccgagcaggtgccagggccgaagtcgaaagcgctggatgagcgtcgacaagcagcagtagcacgagcacttgcaccgggtctgcctggatacgtggtggacgcagacggtggcatcttggctgacgcggacggcaaccgtttcatcgacctggcctccggcatcgccgtgaccacggtcggcggatccaacgcggccgtcgcgaaagccgtcggcgccgcagctgcccgcttcacccacacctgcttcatggtctcaccttatgaaacttacgtggccatggcggagagactcaacgccttgactccaggcgatcacgacaagaagagcgcgctgtttaactctggcgccgaagccgtggaaaacgccgtcaaggtggcacgcgcctacaccggcaagggcgcggtcgtggtgttcgacaacgcgtaccacggacggaccaacctcaccatggcgatgaccgcgaagaaccgcccatacaagtccggattcggaccactagccgcagacgtctaccgtgcaccaatgtcttacccactgcgcgacggactgtccggcccggaagccgcagagcgcgcgatctccgtgatcgaatcccaggtcggagccgaaaacctcgcctgcgtggtcattgaaccgatccagggcgaaggcggattcatcgtccccgcaccaggattcctcgcagccatttccacctggtgccgcgagaacgacgtggtgttcatcgccgatgaaatccaatctggcttcctgcgcaccggcgactggttcgccagcgacgcagaaggtgtgatccccgacgtcatcaccaccgcaaaaggcatcgccggcggcatgccactatccgcagtgaccggccgcgcagaaatcatggacgcacccggccccggcgcgctcggcggaacctacggcggaaaccccgttgcttgcgccgcggcacttgcagccattgaagtgatggaacaagccgaccttaagacccgcgcgcaagaaatcgagaccatcatccgcgatgaattcgcgcagctgagtgccttcccggaggtcgccgaaatccgcggccgcggagcaatgatggccattgagcttatcgacgctaccggccgcccgaacgcagctttaaccgccgcagtggctgcgcgcgcaaaagctgaaggtgtgctgctgctgacttgcggcaccgatggcaacgtcatccgcctgctgccaccactggtcattgcagaggacactctccgtgatggtcttcaggtgttagtcgcagccctagagcgcgaaaccgcgcaccagaaggtgggc

SEQ ID NO: 537 - DNA, 1359 bp, Corynebacterium glutamicum
gtgtctttgaccttcccagtaatcaaccccagcgatggctccaccatcaccgagctagaaaaccacgattccacccagtggatgtccgcgctctctgatgcagttgcagctggtccttcatgggctgcgaaaactccccgcgaaagatccgtggtactcaccgcaatcttcgaagcactgaccgaacgcgcccaagaacttgcagagatcatccacctggaagctggaaaatccgttgcagaagctcttggtgaagtcgcttatggtgcagaatacttccgttggtttgcggaagaagcagtgcgcctgcccggccgctacggacagtcaccttccggaatcggtcacatcgccgtcacccgcgcacccgtgggaccagtgctggcgatcaccccatggaatttccccatcgccatggccacccgcaaaatcgccccagccctggccgctggttgccccgtgttggtgaaacctgcttccgaaaccccactgaccatggtcaaagtgggggagatcatcgcctccgtctttgatacctttaatatcccgcagggcttggtctcaatcatcaccaccactcgagatgcagagctatcggcagaactcatggctgatcctcgcttggctaaagtcaccttcactggatcaaccaacgtgggacgcatcctggtccgccaatccgcggaccgactgctgcgcacctccatggaactcggcggaaatgcagcttttgttatcgacgaagccgcagacctcgacgaagccgtatccggtgccatcgccgcaaaactccgcaacgccggccaagtatgcatcgcagctaaccgtttcttggttcatgaatcccgcgctgccgaattcacctcaaagctggcgacagccatgcagaacactcccattgggccggtgatttctgcccgccaacgcgaccggatcgcagcactagtggatgaagccatcaccgacggcgcccgcctcatcatcggtggggaggtccccgacggctccggcttcttctatccagccaccatcttggccgatgtccctgcacagtcacggattgtgcatgaggaaatcttcggacctgtggccaccattgccactttcaccgacttggccgaaggcgttgcacaagcaaattccaccgaattcggcctcgcagcctacggattcagcaacaatgtgaaagcaacacagtacatggcggaacacttggaagccggaatggtcggaatcaacagaggcgccatctctgacccagcagcaccttttggcggcatcggacaatccggcttcggcagagaaggcggaaccgaaggaatcgaagaatatctctccgtgcgttacctcgctttgccg

SEQ ID NO: 538 - DNA, 468 bp, Corynebacterium glutamicum
atgcatacttggccggcgttgcggagttttgcggcgatggcaccggatacggcttcgtcgaggtctgcggcttcgtcgataacaaaagctgcatttccgccgagttccatggaggtgcgcagcagtcggtccgcggattggcggaccaggatgcgtcccacgttggttgatccagtgaaggtgactttagccaagcgaggatcagccatgagttctgccgatagctctgcatctcgagtggtggtgatgattgagaccaagccctgcgggatattaaaggtatcaaagacggaggcgatgatctcccccactttgaccatggtcagtggggtttcggaagcaggtttcaccaacacggggcaaccagcggccagggctggggcgattttgcgggtggccatggcgatggggaaattccatggggtgatcgccagcactggtcccacgggtgcgcgggtgacggcgatg

SEQ ID NO: 539 - DNA, 1191 bp, Corynebacterium glutamicum
gtgtcctctgctaagaagaagtacctcagcgttgcccaaggcgttgcccttatctacggaaccaacatcggcgccggtgtgctcagcctcccatacgctgcccgcaacggtggtttcctcgccctggttgttgccctgctcattgcgggaacactgaccaccatctccatgctctacatcgccgaagtatccctgcgcaccaagaagccactgcagctttccggcctggcagaaaaatacctggggcagtggggccgctggctggtgttcattgccattgtggtcaacagcgtgggtgcactgattgcctacgcatcaggatccggcattttgataggcaacctcaccggcctgccaccaatcgtgggcacccttggattctttgttttaggcaccttgatcatgtggaaaggcctgcacacggcaagcttcgtggaggcattgatcaccactggcatggcaacgatcatcatcgtgctgtgtggatggacagtgcttggccctggaatttccgcagacaacctgatcgtgttccacccattcttcatcgttccgatcatgaacctcgcggtctttaccttccttgcccaatatgtggttccagaaatcgcacgaggagttaaccctgccaccccgaaggcagtgccacgcgcgatcatcatcggcatggtcgcaactggtgtcaccctggcagctgtaccattcgcggcactagggcttctgggcacaggcgtcagtgaagttgtcaccatctcctggggcgaagcactcgccccagtggcctattacatggccaatgccttcgcactattggccatgttcacttcattcatcgccattggattcaccgcgatgcgcaacgtactagatattggccactggccacaacacggatggcagcgatccgttgctgtcggactaactgttcttccaccactggcaatttcacttgcgggattaggcggattcgtggcagcactgagctacgccggaggatttgccggagcaatcatgtccatcatccccgtgctgttgctgcgcaactcccgcaagagtggtgaccaagaaccagtgtggaaagccacctggcaagcgcaccccatcttccagatcctgttgattgtggtgtactccctggcgtttgtgtactcggttctcgcgatcgtcggattaatgcctgcgggttgggca

SEQ ID NO: 540 - DNA, 1950 bp, Corynebacterium glutamicum
atgctggtcagggacatttttatgggtgataatggggttatgaataaaaaacttaataccccaaatccctggatgttattcatccgctcatttgatggcatcatcactgtcgcagcccttgttgccatcgcaatacatctcattttatggctggctctagatctagatggccttgctaaaaactggcctttaatagccatcgttatcgtaggtggcattccgttgatgtgggatgtgctgaaatcagccattaaaactcgcggtggcgcggatactttagcagcagtctccatcattacttctgtgttgttaggggagtggttggttgccgcgatcatcgtgctcatgctctctggtggtgaagcgctagaagaggcagcatcacggcgagccagtggcaccttggacgcacttgcccggcgcgcaccaagtacagctcaccgcctgttgggtgcaaccattcttgatggaaccgaagagatcgccgtggaagagatcacggttggtgatttagtggcggtgctcccgcatgaactttgtcccgtggatggtgaaatcgtggcaggccacggcaccatggatgagtcttatctcacgggtgagccctatgtggtgagtaaatctaaaggttcgcaagcaatgtcgggtgcagtcaatggtgatactccgctgacgattgttgccacaaagcttgcccatgattccagatacgcccaaattgttggtgtactccatgaagcagaaaacaaccgcccagaaatgcgcaggatggctgaccgtcttggcgcgtggtatacggtgattgcacttgccctcggtggtcttggctggattgtctccggcgacccagtgaggttcttggctgttgtcgttgtcgccaccccatgtccattgctcattgcagtgccagtggcgatcatcggtgcgatttctcttgcggctcgtcggggcatcatcgtgaagaaccctggaatgctggaaaacgcttcaggagtaaagacagtgatgttcgataagactggaacgctcacctatggcaggccagtgattactgatatccacactgctcccggagttgaggaagatacagtcctagctttggctgcttcagtagagcgctactccagacacccgttggctgacgcgattcgtgagggcgcaaaagccagggaacttcatctgcctgatgtagtggaagtatcggaacgtccaggacagggactaaccggcacggtgggcgagcacctggttcgaataaccaataggcgcagcacactagaaattgatccagacagcaagaactacattccggtgacaagttccggcatggaatctgtggtgcttgttgatgataaatatgcagcactcattcgcctccgggatgaacctcgtgcatctgccagtgagttcatcgcgcacttgcccaagaagcacaaagtggacaagctcatgattatctctggtgatcgcgcatctgaggttcgttaccttgcggacaaggttggcattgatgaggtacacgcagaggcctcaccggaagacaagctgaacattgttaatcggcataatgagcacggcgccaccatgttcttaggtgatggaatcaacgatgcgccagccatggccgttgccaccgttggtgtcgcgatgggagcagactccgatgtcacgtccgaagcagcagatgctgtgattttggattcttccctggaacgtctcgacgatctgctccacatcagtgcacggatgcgtcgaatagcgttgcaatctgcgggcggtggcatggcgttgagtgtcataggaatgatcctcgcggtatttggattcttgacgccactgatgggtgcgatcttccaagaggtcattgacgtgctggctatcctcaattccgctcgggtcgcactgccacgcggagcgattagtgattttgatacgcaagaaaaagtttct

SEQ ID NO: 541 - DNA, 1413 bp, Corynebacterium glutamicum
gtgacatttcgaggcggaaacactggcgcaaagcacgcggtcgttgttggttctggccccaatgggttgaccacggcggcggtgctggccaaagcaggttggcaagtagatgtgtatgaggcggcgccaacccctggaggggcggcgcgctcagaaagcgttctgggggaggggactatcagcgatttgggtgccgcagggcatcctttcggggtggcaagcccagcttttcactatttgggtctggaagatcacggcctggaatgggcgtattctccctttgcgatggcccacccgttagattatggcagggccggactgctggaaacgtcactcccagagaccgccaaaaagcttggacctgatgcacgtcgttggaagaatttgcaccagggcttaaccaaaaacattgataaacacttggccaatctattagggccggtgctgaaatggccagcacatccgattcggatggcaaagtttggcccatttgcgttgctgcccgcgaaacgtctagccagtgccgcttttgaaacagaagaagcccgatccctgtttatcggttcggcgatgcactcggtgactccaccacacaagccgatgaccgcatcacttggattgctttttggcgctctggggatgtcgcgaggatggccggttgcagttgggggaagcggacggatcgtcgatgctctggtcaatgtcataaaccatcacggtggcaccattcactgcgattcacagattgattccctctcacaattccgcgacaccgatgccattattctgaaccaaaccccctcacaggtgctgaaactcaaaggaactgaccttaatgcagggcttccgcaacgcatgagcacctggaaacacggaccaagttcctacaaagtggactacctcctcgacggaccaattccctggagcaatccccaggtaggccaggccacaaccgtccatgtgggcggaagctctgaggaaatcgctttcgcagaagcagaagtcgcagcggggcggatgcccgaacgcccgtttatcattttgtgccaacaacaagtggcggatccttcacgcgcccgggaggggcgccacgtcgtgtgggcctacgcgcatgtgccgcggggtttcgtcgataagcgagctgctttattaatcactgcgcagattgaacgcttcgcccccggtttccgtgatcgcatcgtgcattcagtggataccaacgcggaggatttagaggcgtggaaccccaatcttgttggcggagacatcaccgcagggtccgcgctgcttcggcgaatgccgaccaaaatcggcgagaaaacgtacatggcatccgcctccaacgcgccgggcgggggagtccacggaatgcccggctggtgggcagcgcaagccgttttagcagatcacagg

SEQ ID NO: 542 - DNA, 603 bp, Corynebacterium glutamicum
atggagcccaccgtaaaagccagcgcgcgccacaccatccacgtcaccgccgacacctggcgcatccgcctgagtgcctcagcccactcacaccccaacgacgcgtacgcgcgccgggctacggcaatttccgccataggcagcgtgcttatcgacgtccccctccaaggcgaacgcatctctgaatccactgcatacgacggccaaatcaacgccgactggaacgcagaagtcaccggcaccgatgtgaacatcgcacgcgacatcatctcccggctcgcagcggtgccagacgttcaagtcgacggcccgttgtggtccttgagtgacagtttggctgcagaggctgctgtggaggcattgcaaggtgctgccgacactgcgcggaacaccgcgaccgccatcgcagaatccctcggcgggcagctaggtgcacttctctacgcaacaaccgacacccacagctccacaccgataccagcacgcgcagaaatgatggcagcaaaagcctccataccaccgcgcacactcgacctagaactcgccccctctgacatcgaagtcaccaaagaaatcgccgtgacctttgaattccttgcaggc

SEQ ID NO: 543 - DNA, 513 bp, Corynebacterium glutamicum
atggcaaacccaagaaacgaagcagctctggcagagctcaaggcacgtttcgctgagaccgacaccgtcgttctcaccgagtaccgtggcctgaccgtggctcagaccaccgaactgcgtaaggcactgggcttcgatgtccagtactccgtcgccaagaacacccttgttaagatcgccgctaacgaagctggcgtcgagggccttgatgatctcctgaccggtccaaccgctgttgccttcatcaagggcgaagcagttgacaccgctaaggtgctgaagaaattcggcgaagaaaacaaggcattcgtagtcaagggtggctacatggatggcaacgcgctgaccgctgaacaggtcaacgcaatcgccgagctggacaaccgtgagaccactctcgcgaagcttgccggcgccatgaagggcagcttggcaaaggccgcaggcctgttcaacgctcctgcttcccaggtcgcacgcctcgccgttgcgctccaggacaagaaggacgca

SEQ ID NO: 544 - DNA, 384 bp, Corynebacterium glutamicum
atggctaagctcaccaaagacgagctcatcgaggctttcaaggaaatgaccctcatcgagctctccgagttcgttaaggaattcgaagaggtcttcgacgtaaccgcagctgctccagttgcagttgctgctgcaggcgctgcaggcggcgaagctgctgctgcagaagagaaggacgagttcgacgtcgttctcgaagacgcaggcgcaaagaagatcggcgtcatcaaggctgtccgcgagctcgtctccggcctgggcctgaaggaagcaaaggagctcgttgagggcgcacctaaggctatcctcgagggcgcaaacaaggacgacgctgaggctgcaaaggctaagctcgaagaggctggcgcaaaggtcacccttaag

SEQ ID NO: 545 - DNA, 138 bp, Corynebacterium glutamicum
ttgagaaaccgctaccgtgaaatcgaacttaagacaccgccgaccccaacaaaccccaaaacccaacccaaacccaccccagacagcacaaaaccccacccctggatcgagtccagggtgtggggttttgaaaaggtg

SEQ ID NO: 546 - DNA, 972 bp, Corynebacterium glutamicum
atgctgcctaaatcccggattttctccgcaatcttgctcggaattggtgtggcacttgtggtctggggtctggtggctccgcgctttgtgcacgctgatggccgtttgcctcttgatttggaggcgacgacgtacgttctccatgactctgacgctcagaccactattaattctgatccgttggccggtgtggtgactacgccggtgactcgtcagttgcattttgaggtgatggatccggcgagtgctgatgatgccactattcgtattggtgattcgatgttgcgtggtaatcctgatactcagggttttgagcaggaacggctcctgtcagcgactgtgtcgagtttccgcattgatcgcacctctggtgaggttttgtccgatattgcgctgactaatcagttggcgagccctacggtgcagtattcggtggatggcatttggttgaagttcccaactgacgcgcaggagaccacttacaacgtggtggatccggtgctgaggtctgcgctgccggcggattttgtggagtccacggagatcgatggccgtgaggtgctgcattaccgtcaggtgattgataacgtgaatgtggcggagtatttcgcggatgccaacaacaccaccacgttgactaaagaggatggcggtaccacgacgggctatttttatcacaatgtgactcgtgatttttgggtggatcagcgtaccggtttggttgtcgatctagctgaaaatattgatgatttttacggcgaccgcagcggccagaagtacgaacagaaattgcttttcgacgcctccctcgacgatgcagctgtctctaagctggttgcacaggccgaaagcatccctgatggagatgtgagcaaaatcgcaaataccgtaggtattgtgatcggtgcggtattggctctcgtgggcctggccgggtgttttggggcgtttgggaagaaacgtcgagaagct

SEQ ID NO: 547 - DNA, 3495 bp, Corynebacterium glutamicum
gtgctggaaggacccatcttggcagtctcccgccagaccaagtcagtcgtcgatattcccggtgcaccgcagcgttattctttcgcgaaggtgtccgcacccattgaggtgcccgggctactagatcttcaactggattcttactcctggctgattggtacgcctgagtggcgtgctcgtcagaaggaagaattcggcgagggagcccgcgtaaccagcggccttgagaacattctcgaggagctctccccaatccaggattactctggaaacatgtccctgagcctttcggagccacgcttcgaagacgtcaagaacaccattgacgaggcgaaagaaaaggacatcaactacgcggcgccactgtatgtgaccgcggagttcgtcaacaacaccaccggtgaaatcaagtctcagactgtcttcatcggcgatttcccaatgatgacggacaagggaacgttcatcatcaacggaaccgaacgcgttgtggtcagccagctcgtccgctccccgggcgtgtactttgaccagaccatcgataagtcaactgagcgtccactgcacgccgtgaaggttattccttcccgtggtgcttggcttgagtttgacgtcgataagcgcgattcggttggtgttcgtattgaccgcaagcgtcgccagccagtcaccgtactgctgaaggctcttggctggaccactgagcagatcaccgagcgtttcggtttctctgaaatcatgatgtccaccctcgagtccgatggtgtagcaaacaccgatgaggcattgctggagatctaccgcaagcagcgtccaggcgagcagcctacccgcgaccttgcgcagtccctcctggacaacagcttcttccgtgcaaagcgctacgacctggctcgcgttggtcgttacaagatcaaccgcaagctcggccttggtggcgaccacgatggtttgatgactcttactgaagaggacatcgcaaccaccatcgagtacctggtgcgtctgcacgcaggtgagcgcgtcatgacttctccaaatggtgaagagatcccagtcgagaccgatgacatcgaccactttggtaaccgtcgtctgcgtaccgttggcgaactgatccagaaccaggtccgtgtcggcctgtcccgcatggagcgcgttgttcgtgagcgtatgaccacccaggatgcggagtccattactcctacttccttgatcaacgttcgtcctgtctctgcagctatccgtgagttcttcggaacttcccagctgtctcagttcatggaccagaacaactccctgtctggtttgactcacaagcgtcgtctgtcggctctgggcccgggtggtctgtcccgtgagcgcgccggcatcgaggttcgagacgttcacccatctcactacggccgtatgtgcccaattgagactccggaaggtccaaacattggcctgatcggttccttggcttcctatgctcgagtgaacccattcggtttcattgagaccccataccgtcgcatcatcgacggcaagctgaccgaccagattgactaccttaccgctgatgaggaagaccgcttcgttgttgcgcaggcaaacacgcactacgacgaagagggcaacatcaccgatgagaccgtcactgttcgtctgaaggacggcgacatcgccatggttggccgcaacgcggttgattacatggacgtttcccctcgtcagatggtttctgttggtaccgcgatgattccattcctggagcacgacgatgctaaccgtgcactgatgggcgcgaacatgcagaagcaggctgtgccactgattcgtgccgaggctcctttcgtgggcaccggtatggagcagcgcgcagcatacgacgccggcgacctggttattaccccagtcgcaggtgtggtggaaaacgtttcagctgacttcatcaccatcatggctgatgacggcaagcgcgaaacctacctgctgcgtaagttccagcgcaccaaccagggcaccagctacaaccagaagcctttggttaacttgggcgagcgcgttgaagctggccaggttattgctgatggtccaggtaccttcaatggtgaaatgtcccttggccgtaaccttctggttgcgttcatgccttgggaaggccacaactacgaggatgcgatcatcctcaaccagaacatcgttgagcaggacatcttgacctcgatccacatcgaggagcacgagatcgatgcccgcgacactaagcttggcgccgaagaaatcacccgcgacatccctaatgtgtctgaagaagtcctcaaggacctcgacgaccgcggtattgtccgcatcggtgctgatgttcgtgacggcgacatcctggtcggtaaggtcacccctaagggcgagaccgagctcaccccggaagagcgcttgctgcgcgcaatcttcggtgagaaggcccgcgaagttcgcgatacctccatgaaggtgcctcacggtgagaccggcaaggtcatcggcgtgcgtcacttctcccgcgaggacgacgacgatctggctcctggcgtcaacgagatgatccgtatctacgttgctcagaagcgtaagatccaggacggcgataagctcgctggccgccacggtaacaagggtgttgtcggtaaaattttgcctcaggaagatatgccattccttccagacggcactcctgttgacatcatcttgaacacccacggtgttccacgtcgtatgaacattggtcaggttcttgagacccaccttggctggctggcatctgctggttggtccgtggatcctgaagatcctgagaacgctgagctcgtcaagactctgcctgcagacctcctcgaggttcctgctggttccttgactgcaactcctgtgttcgacggtgcgtcaaacgaagagctcgcaggcctgctcgctaattcacgtccaaaccgcgacggcgacgtcatggttaacgcggatggtaaagcaacgcttatcgacggtcgctccggtgagccttacccgtacccggtttccatcggctacatgtacatgctgaagctgcaccacctcgttgacgagaagatccacgcacgttccactggtccttactccatgattacccagcagccactgggtggtaaagcacagttcggtggacagcgtttcggcgaaatggaggtgtgggcaatgcaggcatacggcgctgcctacacacttcaggagctgctgaccatcaagtctgatgacgtggttggccgtgtcaaggtctacgaagcaattgtgaagggcgagaacatcccggatccaggtattcctgagtccttcaaggttctcctcaaggagctccagtccttgtgcctgaacgtggaggttctctccgcagacggcactccaatggagctcgcgggtgacgacgacgacttcgatcaggcaggcgcctcacttggcatcaacctgtcccgtgacgagcgttccgacgccgacaccgca

SEQ ID NO: 548 - DNA, 3999 bp, Corynebacterium glutamicum
gtgctcgacgtaaacgtcttcgatgagctccgcatcggcctggccaccgccgacgacatccgccgttggtccaagggtgaggtcaagaagccggagaccatcaactaccgaaccctcaagcctgagaaggacggtctgttctgcgagcgtatcttcggtccaactcgcgactgggagtgcgcctgcggtaagtacaagcgtgtccgctacaagggcatcatctgtgaacgctgtggcgttgaggtcaccaagtccaaggtgcgccgtgagcgcatgggacacattgagctcgctgcaccagtaacccacatttggtacttcaagggcgttccatcacgcctcggctaccttttggaccttgctccaaaggacctggacctcatcatctacttcggtgcgaacatcatcaccagcgtggacgaagaggctcgccacagcgaccagaccactcttgaggcagaaatgcttctggagaagaaggacgttgaggcagacgcagagtctgacattgctgagcgtgctgaaaagctcgaagaggatcttgctgaacttgaggcagctggcgctaaggccgacgctcgccgcaaggttcaggctgctgccgataaggaaatgcagcacatccgtgagcgtgcacagcgcgaaatcgatcgtctcgatgaggtctggcagaccttcatcaagcttgctccaaagcagatgatccgcgatgagaagctctacgatgaactgatcgaccgctacgaggattacttcaccggtggtatgggtgcagagtccattgaggctttgatccagaacttcgaccttgatgctgaggctgaagagctgcgcgacatcatcaacaatggcaagggccagaagaagatgcgtgcactgaagcgcctgaaggttgttgcagccttccagcgttccggcaacgatcctgccggcatggttttgaacgcgatcccagtgatcccaccagagcttcgcccaatggttcagcttgacggtggtcgcttcgctacctccgacttgaacgacctttaccgtcgtgtgatcaaccgcaacaaccgtctgaagcgcatgattgagctcggtgcacctgagatcatcgtgaacaacgagaagcgcatgctgcaggaatctgtggacgcgctgttcgacaacggtcgtcgtggtcgcccagttaccggaccgggtaaccgtccgctgaagtctctgtctgacttgctcaagggcaagcaaggccgtttccgtcagaaccttctgggtaagcgtgttgactactctggtcgttccgtaattatcgttggtcctcagctgcgcctccacgaatgtggtctgcctaagctgatggctctcgagctcttcaagcctttcgtcatgaagcgcttggtggagaacgagtacgcacagaacatcaagtctgcaaagcgcatggttgagcgtcagcgccctgaggtgtgggacgtcctcgaagaggccatctctgagcacccagtgatgctgaaccgtgcaccaaccctgcaccgcttgggcattcaggctttcgagcctgtccttgttgagggtaaggctattcagctgcacccacttgcttgtgaagctttcaacgccgacttcgatggtgaccagatggcagttcacctgccgctgtccgctgaagctcaggctgaggctcgcgtgctgatgcttgcatccaacaacattttgtccccagcttccggtaagcctttggctatgcctcgtctggatatggtgaccggtctgtactacctgactctggagaagtcttccgaggagttcggtggacagggcgcttaccagcctgcagatgaaaacggtcctgaaaagggcgtgtattcctcactggcagaagcaatcatggcttatgaccgtggtgtacttggcctgcaggccccagttcgcatccgtttgaaccacctgcgcccaccagctgaggtagaagcagagcagttcccagatggatggaaccagggcgagacttggttggctcacaccaccttgggtcgcgttatgttcaacgagatcctgccttggaactacccataccttgagggcgttatggtccgtaagggtggcggctccgacaagatcatgcttggcgacgtagtcaatgacctcgctgctaagtacccaatgatcaccgtggctcagaccatggacaagatgaaggatgctggcttctactggtcaacccgttccggtgtgaccatcgctatgtctgacgttttggttcttcctaacaaggaagaaatgctggaccgctacgaggaatctgcacgccagatcgaagttaagtacaaccgcggtaagctcaccggccgtgagcgctacgaccgtctggtcgagctgtggaaggacgcaactgacgaggttggacaggctgtcgaggatctgtacccagacgacaacccaattccaatgatcgtgaagtctggtgctgccggtaacatgcgtcagatctggacccttgctggtatgaagggcatggttgtgaactcgaagggtgactacatcacccgcccgatcaagacttccttccgtgaaggcttgaccgttctcgagtacttcaacaactcccacggttcccgtaagggcctggccgataccgcgctgcgtaccgctgactccggttacctgacccgtcgtcttgttgacgtcgctcaggacgtcatcgtgcgtgttgaggactgtggcacccgccagggtgttcgcgttcctgtcgctgctgaggttctggatgcaactggtgctgtcaccggctacacccgccatgacctgatcgagacttctgtctccggtcgtgttctggctggcgatgcaaccaacgctgcaggcgaggttgtgcttgctgctggtaccgacctgaccgagctcaacattgaccttctggtcgaggctggcatcaaggacgtcaaggttcgttccgtacttacctgccagaccccaaccggtgtttgtgctaagtgctacggcaagtccatggcttccggccagcaggttgatatcggagaggctgtcggtattgttgctgcacagtccattggtgagcctggtacccagctgaccatgcgtaccttccaccagggtggtgtcggtggcgatattaccggcggtctgcctcgtgttcaggagctgtttgaggcacgtgttcctaagaactgtgcaccaattgcttctgttgaaggtgttatccaccttgaggatgaaggcaacttctacactctgaccatcgttcctgacgatggctccgacaacgttgtctacgagaagctgtccaagcgacagggtcttgcatccactcgcgtggctatggagtccaacgctggtgcgttcattgagcgcaccttgaccgaaggtgaccgcgtcaccgttggtcagcgtctgctccgtggtgcagctgatccacacgacgtgctcgagatcctcggtcgccgtggtgtggagcagcacctcatcgatgaggtgcaggctgtttaccgtgcacagggtgtggccatccacgacaagcacatcgaaatcatcattcgtcagatgctgcgtcgcggtaccgtcattgagtccggttccaccgagttccttcctggttctttggttgacctctctgaggcgaagctggctaactctgaggcaatcggtgcgggcggtcagcctgcagagctgcgttctgagatcatgggtatcaccaaggcctctctcgcaactgagtcttggctgtctgcagcgtccttccaggagaccactcgtgtcctgactgatgctgctatcaacaagcgctccgataagctcatcggcctgaaggagaacgtgatcatcggtaagctgatcccagctggtactggtatttcccgttaccgcaacatctccatcaagccaaccgaggctgctcgcaacgccgcatactcgatcccaacttatggtgagtcgatttacggtgacgatggattcggtgagttcaccggcgcatccgtcccattggatgaggctttc

SEQ ID NO: 549 - DNA, 582 bp, Corynebacterium glutamicum
atggcgggtgtagccggtgacagcaccagttgcatccagaacctcagcagcgacaggaacgcgaacaccctggcgggtgccacagtcctcaacacgcacgatgacgtcctgagcgacgtcaacaagacgacgggtcaggtaaccggagtcagcggtacgcagcgcggtatcggccaggcccttacgggaaccgtgggagttgttgaagtactcgagaacggtcaagccttcacggaaggaagtcttgatcgggcgggtgatgtagtcacccttcgagttcacaaccatgcccttcataccagcaagggtccagatctgacgcatgttaccggcagcaccagacttcacgatcattggaattgggttgtcgtctgggtacagatcctcgacagcctgtccaacctcgtcagttgcgtccttccacagctcgaccagacggtcgtagcgctcacggccggtgagcttaccgcggttgtacttaacttcgatctggcgtgcagattcctcgtagcggtccagcatttcttccttgttaggaagaaccaaaacgtcagacatagcgatggtcacaccggaacgggt

SEQ ID NO: 550 - DNA, 180 bp, Corynebacterium glutamicum
atgtggaaactatctattggcatcgcagttggtgccatcttgttcggtttaggtctgtggggaacccactttgaagacaccgtcatctcgatcgcaggatgggtcggaacgttcgcgtcgtttgcggtgtggttctgggtcatttggtgggcagcggtaggaaatacaaaaagcccactc

SEQ ID NO: 551 - DNA, 780 bp, Corynebacterium glutamicum
atggatgagctgctcaaacaggaagtcaaggatttcctcaccaccaggcgtgcacggattacgccggccgctgcgggactagaaacgcagccgtggagtgatcgtcgggtgccggggcttcggcgggaagaagtcgcggatctggcgggcatttctttggagtattacatccggtttgagcgcggaaatctcaagggtgcatcgcctgaaatattgcaatcgttggctaaggctctccaactgagcccaattgagcgcgaacaccttcacaatttggcttatcgcgccgaccatccgcgcaacctacctagtgcagagaccccaacggcacccctccaggacatcgttgatgcggtcacagataaaccggcgtggatccgcaacgagcagatggatattttggctacaaatcggctctgcgcggaactttacgccccgattttcaaggatctgcccgatcggcccaacactgcgcggcattgctttatcggcgcaacagcctccgagttctgggtggaccgggatcagttcagtgcggagttcgctgccaaactacgcctcgagtacgcccggcgccccagcgtgccaggtttaaaggagcttatcgacgagctccatcagaaaagttctgttttccgcgataattgggcgtctgctgatgttttgtcattcggctctggcatcaaacgtttcaggcacccaacactgggggagcgggtctatgaatacgagacgtttaatctcaatagtgcaccggggtatgtgttgagcatttacttt

SEQ ID NO: 552 - DNA, 798 bp, Corynebacterium glutamicum
ttgagtgcgaggtgccgtcaattcccaactacaagagtgggactcagccgttcacattatcagctagccgcagaaaacaccaaatcccttgttagaatggttcccatgactgttcctcaaggaaacgaaccagcaaagaagctcgccactgaccttaaccgaaaccaagtcgtggatgaactttctgcagctgtttcccgaggtcaactcactttggaggaatttgaagatcgctcctccaaagcatggaatgcccgccacttagacactcttgtagagctgatctctgatgtgaacgacaatccctacactctgcttggtcagcaatttcccggcgcctcctatgcgccggcggcctacgagaccactcccccagcgatgcccaatgtgtcagatcctgtaaatattgtccgcaacaggattaccggcaacccgaatggctccaaaatgtcggtctcgtttatgggtggcaccgtgcgcaaaggtggatggcatgtgcctaatgttcacacatccttcgccatgatgggcggcaatcagatcgatttgcgcgacgccttcctggaaagcgaccgcattcagatcaacgcctacacattcatgggtggcatcgagattattgttcccgagggtgtttttgtcatttgtgatggcatgggcattttcggcggcttcgaacagtctgtggacaaggccggtgcactcaatcccgcgcgcctgccaagcaacgcgcccacggtccacatcaaaggcctggcgttcatgggcggagtcagcgtagtcaccaagaaaaacatt

SEQ ID NO: 553 - DNA, 366 bp, Corynebacterium glutamicum
atgccaactattcagcagctggtccgtaagggccgccacgataagtccgccaaggtggctaccgcggcactgaagggttcccctcagcgtcgtggcgtatgcacccgtgtgtacaccaccacccctaagaagcctaactctgctcttcgtaaggtcgctcgtgtgcgccttacctccggcatcgaggtttccgcttacatccctggtgagggccacaacctgcaggagcactccatggtgctcgttcgcggtggtcgtgttaaggacctcccaggtgtccgttacaagatcgtccgtggcgcactggatacccagggtgttaaggaccgcaagcaggctcgttcccgctacggcgcgaagagggga

SEQ ID NO: 554 - DNA, 465 bp, Corynebacterium glutamicum
atgcgtaaatcagcagctcctaagcgtccagtagttcaggaccctgtatacaagtccgagctcgttacccagctcgtaaacaagatcctcatcggtggcaagaagtccaccgcagagcgcatcgtctacggtgcactcgagatctgccgtgagaagaccggcaccgatccagtaggaaccctcgagaaggctctcggcaacgtgcgtccagacctcgaagttcgttcccgccgtgttggtggcgctacctaccaggtgccagtggatgttcgcccagagcgcgcaaacaccctcgcactgcgttggttggtaaccttcacccgtcagcgtcgtgagaacaccatgatcgagcgtcttgcaaacgaacttctggatgcagccaacggccttggcgcttccgtgaagcgtcgcgaagacacccacaagatggcagaggccaaccgcgccttcgctcactaccgctgg

SEQ ID NO: 555 - DNA, 2115 bp, Corynebacterium glutamicum
gtgcttaaggatctaaacaaggtccgcaacatcggcatcatggcgcacatcgatgctggtaagaccacgaccaccgaacgcatcctcttctacaccggcatcaaccgtaaggtcggtgagacccacgacggtggcgcaaccaccgactggatggagcaggagaaggaacgcggcatcaccattacctccgccgcggttacctgtttctgggataacaaccaggtcaacatcattgacacccctggccacgttgacttcaccgttgaggttgagcgttccctccgcgtgcttgacggcgcagttgctgtgttcgacggcaaggaaggcgttgagccacagtctgagcaggtttggcgtcaggctaccaagtacgacgttccacgtatctgcttcgtgaacaagatggacaagctcggtgctgacttctacttcaccgttggcaccatcgaggaccgcctgggtgcaaagccattggttatgcagctcccaatcggtgctgaggacaacttcgacggcgtcatcgaccttcttgaaatgaaggcactgacctggcgtggagttaccccaattggtaccgaagctaccgttgaggagatcccagcagagctcgcagaccgcgcagctgagtaccgtgagaagcttctcgagaccgttgcagagtccgacgaagagctcatggagaagtacttcggtggcgaagagctcagcatcgctgagatcaaggcagctatccgtaagatggttgttaactctgagatctaccctgtttactgtggcaccgcctacaagaacaagggcatccagccactgctcgacgcagtcgttgacttcctgccttccccactggatctcggcgagaccaagggcactgacgttaaggatcctgagaaggttctgacccgtaagccttccgacgaagagccactgtctgcacttgcattcaagattgcagctcacccattcttcggtaagctgaccttcgttcgtctgtactccggcaaggttgagccaggcgagcaggttcttaactccaccaagaacaagaaggaacgcattggtaagctgttccagatgcacgccaacaaggaaaaccctgttgaggttgcacacgctggtaacatctacgcgttcatcggcctgaaggacaccaccaccggtgacaccctctgtgacgcaaacgctccaatcattcttgagtccatggacttcccggatccagttatccaggttgctattgagcctaagaccaagtctgaccaggagaagctcggcgtagctatccagaagcttgctgaagaagacccaaccttcaccgttcacttggacgatgagtccggccagaccgtcattggcggcatgggcgagctgcacctcgatgttcttgttgaccgcatgaagcgcgagttcaaggttgaggcaaacatcggtgacccacaggttgcttaccgtgagaccatccgtaagcctgttgagtccctcagctacacccacaagaagcagactggtggttccggtcagttcgctaaggtcatcatcaccattgagccttacgcacctgaggcagacgagcttgaagagggcgagtccgcaatctacaagttcgagaacgctgtcaccggtggtcgtgttccacgtgaatacatcccatccgttgacgctggtatccaggacgcaatgcagtacggcttcctggctggctacccactggttaacgtcaaggcaacccttgaagatggcgcttaccacgacgttgactcctctgaaatggccttcaagctcgccggttcccaggcgttcaaggaagctgttgcaaaggcaaagccagtcctcctcgagccaatcatgtccgttgaaatcaccactcctgaggagtacatgggtgaagtcatcggtgacgtgaactcccgccgtggccagatcgcttccatggatgaccgtgcaggcgccaagctggttaaggctaaggttccactgtctcagatgttcggttacgtcggtgaccttcgctctaagacccagggtcgtgcaaactactccatggtcttcgattcctacgctgaggtcccagccaacgttgccgcagatgttattgctgagcgcaacggcaccgcttcc

SEQ ID NO: 556 - DNA, 2160 bp, Corynebacterium glutamicum
gtggggcgtcgaaaagcaaattgcttttcgacgttttccttcggatctaaacgatctttaggaagcggtgccgttgcgctcagcaataacatctgcggcaacgttggctgggacctcagcgtaggaatcgaagaccatggagtagtttgcacgaccctgggtcttagagcgaaggtcaccgacgtaaccgaacatctgagacagtggaaccttagccttaaccagcttggcgcctgcacggtcatccatggaagcgatctggccacggcgggagttcacgtcaccgatgacttcacccatgtactcctcaggagtggtgatttcaacggacatgattggctcgaggaggactggctttgcctttgcaacagcttccttgaacgcctgggaaccggcgagcttgaaggccatttcagaggagtcaacgtcgtggtaagcgccatcttcaagggttgccttgacgttaaccagtgggtagccagccaggaagccgtactgcattgcgtcctggataccagcgtcaacggatgggatgtattcacgtggaacacgaccaccggtgacagcgttctcgaacttgtagattgcggactcgccctcttcaagctcgtctgcctcaggtgcgtaaggctcaatggtgatgatgaccttagcgaactgaccggaaccaccagtctgcttcttgtgggtgtagctgagggactcaacaggcttacggatggtctcacggtaagcaacctgtgggtcaccgatgtttgcctcaaccttgaactcgcgcttcatgcggtcaacaagaacatcgaggtgcagctcgcccatgccgccaatgacggtctggccggactcatcgtccaagtgaacggtgaaggttgggtcttcttcagcaagcttctggatagctacgccgagcttctcctggtcagacttggtcttaggctcaatagcaacctggataactggatccgggaagtccatggactcaagaatgattggagcgtttgcgtcacagagggtgtcaccggtggtggtgtccttcaggccgatgaacgcgtagatgttaccagcgtgtgcaacctcaacagggttttccttgttggcgtgcatctggaacagcttaccaatgcgttccttcttgttcttggtggagttaagaacctgctcgcctggctcaaccttgccggagtacagacgaacgaaggtcagcttaccgaagaatgggtgagctgcaatcttgaatgcaagtgcagacagtggctcttcgtcggaaggcttacgggtcagaaccttctcaggatccttaacgtcagtgcccttggtctcgccgagatccagtggggaaggcaggaagtcaacgactgcgtcgagcagtggctggatgcccttgttcttgtaggcggtgccacagtaaacagggtagatctcagagttaacaaccatcttacggatagctgccttgatctcagcgatgctgagctcttcgccaccgaagtacttctccatgagctcttcgtcggactctgcaacggtctcgagaagcttctcacggtactcagctgcgcggtctgcgagctctgctgggatctcctcaacggtagcttcggtaccaattggggtaactccacgccaggtcagtgccttcatttcaagaaggtcgatgacgccgtcgaagttgtcctcagcaccgattgggagctgcataaccaatggctttgcacccaggcggtcctcgatggtgccaacggtgaagtagaagtcagcaccgagcttgtccatcttgttcacgaagcagatacgtggaacgtcgtacttggtagcctgacgccaaacctgctcagactgtggctcaacgccttccttgccgtcgaacacagcaactgcgccgtcaagcacgcggagggaacgctcaacctcaacggtgaagtcaacgtggccaggggtgtcaatgatgttgacctggttgttatcccagaaacaggtaaccgcggcggaggtaatggtgatgccgcgttccttctcctgctccatccagtcggtggttgcgccaccgtcgtgggtctcaccgaccttacggttgatgccggtgtagaagaggatgcgttcggtggtcgtggtcttaccagcatcgatgtgcgccatgatgccgatgttgcggaccttgtt

SEQ ID NO: 557 - DNA, 144 bp, Corynebacterium glutamicum
atgctgttgaaagccgatttcaagatatctaacaagccgctaccccacttaccctacgcgcctactgacacgctaaaacgcgcggggtggggcgtcgaaaagcaaattgcttttcgacgttttccttcggatctaaacgatctt

SEQ ID NO: 558 - DNA, 228 bp, Corynebacterium glutamicum
atgccgatgatgtcaacatcatcgttcacgttcagggtaccgcgctcaacacgaccggtaacaacggtgccacgaccggtgatggtgaagatgtcctcgataggcatgaggaatggcttgtcggtctcacgaactgggtcagggatgttgtcatcgcaagcctgcatgagctcaaggatctgcttgccccacttctcgtcgccctcaagagccttcagagcggagatg

SEQ ID NO: 559 - DNA, 153 bp, Corynebacterium glutamicum
atgactgagatcgcccctaacaaattgagcgcaaggtaccgaaaccgtgaaatcgaacctaagacgccgactagacaaaccaactccgaaaccaaccctagaaacgacaaaacagcgaccccagaggatatttcctctgggatcgctgtcagt

SEQ ID NO: 560 - DNA, 729 bp, Corynebacterium glutamicum
atgaaagatccatctagaattcccccagttgtggctcagttacagaaagtgtgggaggctcagccagatttagcgttgccgacacttttggggattttgggtaaccgtggcattgggtggggaagtactgatgaggatctggtcgaggcgctaaacacgatgtatacggagaacccgggcgagattcgtgggggttctagacttgcagatcctcaaagggaagttccggggcgttttcttgtggagactgaatctccggcttatcggattacagtggatccgtttcggatcagtgtacggagaatcgccaagggtccgcaccgacctttgcaacctggggtgtgggagtttcaggagattcgtcggtgtcggtcaggtgagcctttgttgattactgatgtggagggcattgatcatcggctgggtgtggttgttcggattacgctgctgaatgattctcctgctccaacgacgaaaagcctagacaaggtccgacgccgtgaagtgggggacaaggtgttttacttgcactttgagagcggggatactgctttgttgaatcatggtttagagatctaccaggcgtctaggcgcaccttggagcagcacagtgtgaaatgggatcaactcattactgctactccgggacaacttttgaagctgaaggaaaccggcagtgggaaaatccttgagcttggggtgttagagaagatcattccgttggagggg

SEQ ID NO: 561 - DNA, 792 bp, Corynebacterium glutamicum
atgaataaccgcctgaccatggaagacgtcaccatggcgtatgacaaccgcgtcatcgccgaacacctcaacgtcaccatccccgacaacaccttcaccgccatcatcggccccaacggctgcggcaaatccaccctgctccgcggtttctcccgcgtgctcaatccgcagcacggcaaagtgcttctcgacggtcggcaactcgattcattcaagcctaaagagatcgcccgagaactaggcctgctgccacagacctccatcgccccagaaggcatccgggtttacgatctcatcgcgcgcgggcgcgctccctaccaaagcctcatacaacaatggcgcacctccgacgaagacgccgtcgcgcaagcgctcgcctccacgaatctcaccgaacttgcagctcgcctcgtcgatgaactctccggtggccagcgccaacgagtgtgggtggccatgttgctcgcccagcaaacaccgatcatgcttctcgacgagcccaccaccttcctcgacatcgcccaccaatacgaactcttggaattgctgcgcgcattcaacgaggccgggaaaactgtggtcactgtgcttcacgatctcaaccaagccgcccgctacgccgaccacctcatcgtgatgaaagatgggcacgtacatgccacgggcacaccggaggaagtcttaactgccgagatggttcaaggagtttttggcctgccctgcatcatctccccagaccccgtcacaggaacccccaccgtcgttcccctcagtcggtctcgcgcaggagct

SEQ ID NO: 562 - DNA, 1035 bp, Corynebacterium glutamicum
gtgcagaggcgccggttctctttccgcatcccagcccgcctcatggtggttagccttatccttttcgccatcgcgctatgcagcgccacatgggctatcacgatgggcgattacccactgtctttggggcaggtgattaatgcacttgctggcaccggcgagaaattccagttgttggtggtgcgggaatggcgtctacctgtagccattgctgctgttgtcttcggcgcgctgcttggcataggtggagcgattttccagtcgattactcgaaacccgttgggttcacctgacgtgattggtttcgatgcaggttcttacacggcggtggttcttgtcattttggtcctcggcaacactcactactggagcatcgctttcgctgccatcgtcggtggcattgttaccgcctttgccgtgtatgtcctggcgtggcgtaaaggtgtgcaaggtttccgcttgatcatcgtgggcatcggtgtctcggccatgctcagttccgttaacgcgtatctaatcacccgcgccgatgtggaagacgccatggttgtgggcttctggagtgccggttccatcaaccgcattacctggcaatctctgctcccctctctggtgatcgctgctgtcatcatcgtggccgccattgtgctggcaaggtcactgcgtttcatggaaatgggcgatgacgtagccaccaccctcggtgtgaaaacaaactccacccgcttggcactcatcgttgtcggcgttgctacctccgcgttggttacagcagctgccggaccgatctccttcatcgcgttggttgccccacagctggcacgtcgcctcactaaaacccctggtgtcagcctggttgctgccgctgcaatgggttccgcactgctcagctgcgctcacctcctttccctgattatcagctccttctaccgcaccatcccggttggcctgttgactgtatccatcggtggttgctacatgatctggcttctgctgcgcgaaacccgccgccaataccgcaccggcaccatccga

SEQ ID NO: 563 - DNA, 1035 bp, Corynebacterium glutamicum
gtggcggtagagaagcagaaggagacgtcgataagcaaaaacctcggcaggcgccgagcgctgggcattctcggaatcgtcgtggcactgggtgcgcttattgttttaagtattgctgtgggtgcgaacccactttcttttagctccgtatggcagggttttaccgcacacgacagctctgaggcgtcgattatcgtgtggtcaatgcgtattccgcgcacgctggtgggcatcgtgactggcgctgcttttggtgtggcgggtgctttaattcaagcgctgacgcgcaacccgcttgccgatcccggaattttgggagttaacgcgggtgcaggtttcgcagtgaccgtaggtgtcggatttttcggactcagcagcgtgacgggctacatctggttcgcattcctgggcgctgccgccgctaccctgctggtgtatttcattggtgcgagcaccagcggcagcgttaatcctgttgctctggtcctcgccggcgttgctctggccgccgtgcttggtggcgtcacgagcttcctcacactgattgatcctgagacttttgaaagcatccgcaattggaatcttggttctgttgcacgcaccgacctcagcgacaccatgaccgtattgccattcctggcagtcggactggccatcgcgctcctgctgtcgggagcactgaactccattgcgcttggcgatgaccttgctgcatccctgggcaccaaagtgatgcgcacccgcgtgctcggcatcatttcagtcaccttgttggccggcggcgcgaccgcccttactggtggtatcggcttcgtaggccttatggttccccacgttgtgcgctgggtagttggccccgatcaacgatggatcatcaccttcagcgccctgtgcgcccctgttcttgtactcggcgcagacattttgggacgcatcatcgcccgccccggcgaaattgaagtaggcattgttaccgcagtcatcggcgcacctgtcctgatcgcactagttcgacggaggaaagccagtggtctt

SEQ ID NO: 564 - DNA, 516 bp, Corynebacterium glutamicum
ttggggatcttaaaggcgacttcacgtgcgctgacttctcgtgctcaatttcacaccacacgacatcactggaaaaacctgacatcgccggctgatatatatggaaatatcaactccacccacgttgcgggtacgcgcgtgatgaatggtatcggcggctcgggcgatttcacgcgtaacgcctttgcttccacatttatctctccctcggcagccaaagttgatgcgatttccgcgattgtgcctttcgcgtcccatatcgatcacacggaacatgatgcgatggttgtcattactgaatatggctacgcagacctgcgcgggctatcgccaaaacaacgagtccccaaaatgattgccatcgcccacccggactatcgaccactgctggaagcatactttgaccgggcgctgaacagtgctgattcctatcagcacaccctgcatgatctgcgcaccgccttcgatttccataatcgcttgaactcacaaggaaccatgaaaatcgaaaaagca

SEQ ID NO: 565 - DNA, 303 bp, Corynebacterium glutamicum
gtggcgggacaaaagatccgcattaggctcaaggcctacgaccacgaagcgattgatgcgtctgcacgcaagatcgttgagacggtcacccgtacgggtgcccgagtcgttggaccggtgcctttgcctaccgaaaagaacgtatacgccgttattcgttctccacataagtacaaggactctcgcgagcacttcgagatgcgcactcacaagcgcctgatcgacatcctcgacccgacgccgaagactgttgatgcccttatgcgcatcgaccttccggccagcgtcgacgtgaacattcag

SEQ ID NO: 566 - DNA, 654 bp, Corynebacterium glutamicum
atgagtgaaaacgagatcaagggcattctgggcaccaagctcggcatgactcagatcttcgacgaggagaaccgcgttattccggttaccgtcgttgaagcgggtccatgcgtagtttcccagattcgcaccgttgagaccgatggctacaacgccatccagatcgcctacggcgaaatcgacccacgcaaggtgaaccagccattgactggtcacttcaagaaagcaggcgttaccccccgccgccacgtcaccgagattcgtatggacgatgtctccggttacgaggttggacaggacgttaccgttgaaatcttcaacgacatcaagttcgttgacgtcaccggtaccaccaagggtaagggctacgccggcgctatgaagcgccatggcttcgctggccagggtgccggccacggtaaccaggctgcacaccgccgcgtaggtggcattggtgcagctgctaccccaggtcgcatcttcaagggcaagcgtatggctggccgcatgggtaatgaccgcgtcaccacccagaacctcaaggttcagaagattgacgccgatgccaacatcatccttatcaagggcgcaatccctggtaaccgtggtggcatcgttaccgttaagaccgcagtgaagggcggtgcacacgca

SEQ ID NO: 567 - DNA, 687 bp, Corynebacterium glutamicum
gtgtgcaccgcccttcactgcggtcttaacggtaacgatgccaccacggttaccagggattgcgcccttgataaggatgatgttggcatcggcgtcaatcttctgaaccttgaggttctgggtggtgacgcggtcattacccatgcggccagccatacgcttgcccttgaagatgcgacctggggtagcagctgcaccaatgccacctacgcggcggtgtgcagcctggttaccgtggccggcaccctggccagcgaagccatggcgcttcatagcgccggcgtagcccttacccttggtggtaccggtgacgtcaacgaacttgatgtcgttgaagatttcaacggtaacgtcctgtccaacctcgtaaccggagacatcgtccatacgaatctcggtgacgtggcggcggggggtaacgcctgctttcttgaagtgaccagtcaatggctggttcaccttgcgtgggtcgatttcgccgtaggcgatctggatggcgttgtagccatcggtctcaacggtgcgaatctgggaaactacgcatggacccgcttcaacgacggtaaccggaataacgcggttctcctcgtcgaagatctgagtcatgccgagcttggtgcccagaatgcccttgatctcgttttcactcattatttattctccgctgccaaaaattccgtcgatcac

SEQ ID NO: 568 - DNA, 654 bp, Corynebacterium glutamicum
atgacgaatctgaagctggatgttcagaccgctgatggaaacatcaacggatctgtagaactccctgcagagatttttgaccgtgaggtctccgtcgcactgctgcaccaggttgtcaacgcacagcttgcagcagctcgacagggcacccactccaccaagacccgtggcgaagtacgtggcggtggccgtaagccattccgtcagaagggaaccggtcgcgctcgtcagggctcgatccgcgcacctcacttcaccggtggtggcatctcccacggccctaagccacgcgactactctcagcgcacccctaagaagatgatcaaggctgcactttacggtgcactgtctgatcgtgcacgcaatgcacgtatccacgtcgtctccgaattggtgcctggccagaccccttcgaccaagtctgcaaaggctttcatcgagcgtctgaccgagcgtaagtccgtgctgctcgtagtgagccgtgaggatatcaacgcccagaagagtgctaacaacctgcctggcgtccacatcctggccgctgatcagctgaacacctacgacgttctcaagtctgacgacgttgtgttctccgttgaggctctccacaccttcatcaaccgcgcttccggtgcggcacaggaggagcagaac

SEQ ID NO: 569 - DNA, 303 bp, Corynebacterium glutamicum
atggctactatcgccaacccacgcgacatcatcatcgcaccggtcgtttctgagaagtcctacggcctcatggagcagaacgtttacacgttcttcgtctccactgacgctaacaagactcagatcaagattgccatcgaagagatcttcggcgtcaaggttgcatctgtgaacaccgttaaccgtgcaggtaagcgcaagcgctcccgcaccggcttcggtactcgcaaggctaccaagcgcgcttatgtgactcttcgcgaaggcagcgactccatcgacatcttcaacggctccgtcgct

SEQ ID NO: 570 - DNA, 327 bp, Corynebacterium glutamicum
gtgtccttttctatcgacgtcttaagcgacggagccgttgaagatgtcgatggagtcgctgccttcgcgaagagtcacataagcgcgcttggtagccttgcgagtaccgaagccggtgcgggagcgcttgcgcttacctgcacggttaacggtgttcacagatgcaaccttgacgccgaagatctcttcgatggcaatcttgatctgagtcttgttagcgtcagtggagacgaagaacgtgtaaacgttctgctccatgaggccgtaggacttctcagaaacgaccggtgcgatgatgatgtcgcgtgggttggcgatagtagccat

SEQ ID NO: 571 - DNA, 840 bp, Corynebacterium glutamicum
atggctattcgtaagtacaagccgacaaccccgggtcgccgcgcaagctccgtttccatgttcacggagatcacccgttcgacccctgagaagtcacttctccgcccactgagcaagaccggcggacgtaactctcacggccacatcaccacccgtcaccgcggtggtggacacaagcgccgctaccgcgtcatcgacttccgtcgtaacgacaaggatggcgtattggcgaaggtcgctcacatcgagtacgacccaaaccgtaccgctaacattgcactgcttcactacttcgatggcgagaagcgttacatcctcgcaccgaagggcctgacccagggcaccgttatcgagtccggcgctgcagccgacatcaaggttggtaacaacctgccactgcgtaacatcccgactggtaccaccatccacaacgtggagttgaagccaggcgcaggtgcaaagctggcacgttccgctggagcttccatccagcttcttggtaaggaaggctcctacgcagttctgcgtatgccatcctccgagatccgacgcgtagacatccgctgccgcgcgactgttggtgaggtcggcaacgccgagcagatcaacattcgttggggtaaagctggtcgtatgcgttggaagggctggcgcccaaccgtccgtggtgtcgttatgaacccggtcgaccacccacacggtggtggtgaaggtaagacttctggtggtcgccacccagtctccccatggggacagaaggaaggccgcacccgcaagcctaagcgttacagcgatgacatgatcgttcgtcgccgtcgtgctaacaagaacaagaagcgc

SEQ ID NO: 572 - DNA, 276 bp, Corynebacterium glutamicum
atgccacgcagccttaaaaagggtcctttcgtcgatgagcacctcctcaacaaggtagatgctcagaacgaaaagggaaccaagcaggtcatcaagacctggtcccgccgttccaccattctccccgatttcatcggtcacacctttgctgtccatgatggacgcaagcatgtgccagttttcgtggacgatgccatggttggccacaagctgggcgaattcgcccctaccaagaccttcaagggtcacgtcaaggacgacaagaagggacgtcga

SEQ ID NO: 573 - DNA, 285 bp, Corynebacterium glutamicum
gtgacccttgaaggtcttggtaggggcgaattcgcccagcttgtggccaaccatggcatcgtccacgaaaactggcacatgcttgcgtccatcatggacagcaaaggtgtgaccgatgaaatcggggagaatggtggaacggcgggaccaggtcttgatgacctgcttggttcccttttcgttctgagcatctaccttgttgaggaggtgctcatcgacgaaaggaccctttttaaggctgcgtggcattcttcgttacctcctcttagcgcttcttgttcttgt

SEQ ID NO: 574 - DNA, 360 bp, Corynebacterium glutamicum
atgagtgacaacatcacctccgcaagcgcgactgctcgcttcgtccgcgtcagcccaatgaaggcacgtcgcgtcattgatcttgttcgcggcaagaccgtcgttgaagcactgtcaatcctgaagtatgcgccacaggcagcatctgagcctgtagcaaaggttgttgcatctgcagcagctaacgctgagaacaacttcggcctggatccacgcaccctggttatctccgaggcttacgccaacgaaggtccaaccatgaagcgcttccagccacgtgctcagggacgcgcattccagatccgtaagcgcagcagccacatcaccgtggtcgttgagagccagaaggaaggagccaac

SEQ ID NO: 575 - DNA, 744 bp, Corynebacterium glutamicum
gtgggccagaagatccatccacacggcctccgtttgggcatcacttccgactggaagtcccattggtacgccgacaagtcttacgctgactacgtcgcagaagacatcaagattcgcgaattcctgtccaagggcctcgaccgtgccggcatcgccgacgtcgtcatcgagcgcacccgcgaccgcgttcgcgtagacatccacaccgctcgcccaggcatcgtcattggtcgtcgtggcgctgaggctgaccgcatccgccgtgagctcgagaagctcaccggcaagcaggttgccctcaacatcctcgaggtcaagaacgtcgatgctaacgctaagctggtggcacagtccatcgctgagcagctgaccaaccgcgtggcattccgtcgcgcaatgcgcaaggctatccagtctgcaatgcgtcagccacaggttaagggcatcaaggtcgtgtgctccggtcgtctcggcggtgccgagatgtcccgcaccgagcgctaccacgaaggtcgcgttccactgcacacccttcgcgcagaaatcgattacggcacctacgaggctcacaccactttcggacgcatcggcgtcaaggtgtggatctacaagggtgacgtcgttggtggacgtcgcgagagcgagatcaatgcacccgcagagcgtcgcggccgcggcgaccgcaacgcacgtccgcgtcgtggtggccagcgtcgtcagcgtgctgagcagaagcaggagggc

SEQ ID NO: 576 - DNA, 414 bp, Corynebacterium glutamicum
atgcttattcctaagcgcgttaagtaccgtcgccagcaccgtcctacccgtagtggtatctccaagggcggcaaccgcgtcactttcggtgagtacggcatccaggctctcgagcctgcctacatcaccaaccgtcagattgaatctgcacgtattgcaatcaaccgccacgtcaagcgtggtggcaaggtttggatcaacatcttcccagaccgcccactgacccagaagccactcggcgttcgtatgggttccggtaagggccctgtggagaagtgggttgcaaacatcaagccgggccgtatcctcttcgagatgagctacccggacgaagctactgctctcgaggctctgcgccgcgctggccagaagcttccatgcaaggtccgtatcgtcaagagggaggatcagctc

SEQ ID NO: 577 - DNA, 228 bp, Corynebacterium glutamicum
atggctatcggtaccccagcacacgagttccgtgagctcaacgaggaagaactggttacccgcctcaacgaggctaaggaagaactgttcaaccttcgcttccagcttgccaccggccagctgaccaacaaccgccgcctgcgcaccgtcaagcgcgacatcgcccgcatctacaccgttattcgcgagcgtgagctgggcttgtctgtggttccgggagctgaggct

SEQ ID NO: 578 - DNA, 276 bp, Corynebacterium glutamicum
atgagtgaggcaaacgtgaacaaccaggaaaagagcacccgcaaggtccgcactggctacgtggtttctgacaagatgcagaagaccatcgttgtcgaggtcgaagaccgcaagcagcacgctctctacggcaagatccttcgctccgcgaagaaggtcaaggctcatgatgaggagcagatcgccggaatcggtgacttggttcgcatcgaagagacccgcccattgtccaaggacaagaactaccgtctgatcgagatcgtcgaaaaggctaag

SEQ ID NO: 579 - DNA, 294 bp, Corynebacterium glutamicum
atgacgcccaaactacttagccttttcgacgatctcgatcagacggtagttcttgtccttggacaatgggcgggtctcttcgatgcgaaccaagtcaccgattccggcgatctgctcctcatcatgagccttgaccttcttcgcggagcgaaggatcttgccgtagagagcgtgctgcttgcggtcttcgacctcgacaacgatggtcttctgcatcttgtcagaaaccacgtagccagtgcggaccttgcgggtgctcttttcctggttgttcacgtttgcctcactcatgat

SEQ ID NO: 580 - DNA, 318 bp, Corynebacterium glutamicum
ttgatacgttggtggttaaatctccatgccccttctattaggaacattcggatggctcatgaaaaccaaaaaactgtttcaatttttgcatggcttagcgttctagttgtcgcaatcctcggatatgtcctgtggctcgtcccgatttcctggtacggcatccgtgagtggatctacccgatcattgccgttccactcattggatatgcattgtttaccgctttcaagtccaagagttgggtcttgggtatctgcgcaatcctcgccctgctgtcccccaccatttggctgacagctggattcttcgtcttcggcttc

SEQ ID NO: 581 - DNA, 696 bp, Corynebacterium glutamicum
atgtccctacgcaagaatctcgccctcggaagcagcacagtactactcacagccgtgctaagcgggtgtgtttcccttgatgagcgctccactgatacatccacggagaatgtcaccacggtaactgccacactcacttccaccgccgcagcagaacccaccactagaacgactgtgcaaagtgctacagaagcctccactactgcaccagtgcaatgcaatttggatccccgtacctcggattttgggccatatcttgcacaatctcgcaccccggttggtgagctagctggatctgcagattccgtcgtgcaggttcctgactggttctatcacttccaaatgggcgacaacggctacgattcctgttccaagctcagctatgtggttctcaacggttccaatggagacgccgaacgttctactggaacgggtgctgcgatcgccgacgtggtggtgctgtttatcgacggccatatggttgctcgtcctgctccttttgaaatgaagaccgtggaatccgtcaccagagtgtcagattcagaaatccaagttgtttacggacatgccggccgatctactgccgaaggtgttacggactatttcacctttaacttcttcgttgacaacggcgttctttcaggacgcggcgatctcccagaacacatcgatactcacatgcgtctatatctgctg

SEQ ID NO: 582 - DNA, 366 bp, Corynebacterium glutamicum
gtgattcagcaggaatcgcgtctgaaggtcgccgacaacactggtgcacgtgaaattctgtgcatccgcgttctcggtggatccacccgacgttttgctggcattggtgacgtcatcgtcgccactgtcaaggaagcaaccccaggcggcaacgtaaagtctggcgaaatcgtcaaggctgttatcgttcgcaccaagaaggagacccgtcgtgcagacggttcttacatctccttcgatgagaacgctgccgtcatcatcaagaacgacaacgagccacgtggcacccgtatcttcggaccagttgctcgtgaacttcgtgagaagaagttcatgaagatcgtttctctcgcaccggaggtgatt

SEQ ID NO: 583 - DNA, 312 bp, Corynebacterium glutamicum
atgaaggtccacaagggcgatatggttctggtcatctcaggtccagacaagggtgctaagggacaggtcatcgcggctttccctaagaccgaaaaggttctcgtcgaaggcgttaaccgcatcaagaagcacgtagctaactccgcaccagagcgtggcgcagagtccggcggaatcgtgacccaggaagctccgatccatgtctctaacgtcatggtcatcgactccgacggaaacccaactcgcgttggctaccgtttcgatgaaaacggcaagaaggtccgcgtttctcgtcgcaatgggaaggatatc

SEQ ID NO: 584 - DNA, 573 bp, Corynebacterium glutamicum
atgactgagaattacatccctcgtctgaagacccgttaccaggacgaaatccgcaccaagcttcagggcgagttcgagttcgaaaacgtcatgcagatcccaggcgtcaccaagattgtcgtcaacatgggtgtcggcgacgcagctcgtgactccaagctcatcaacggcgctatcgaggacctcaccgcaatcaccggtcagaagccacagcttcgccgtgcgaagaagtccatcgctaacttcaagctccgtgaaggcatgccaatcggcgcaaaggttaccctgcgcggcgaccgcatgtgggagttcctggaccgtctgctgaccgtggcactgccacgtatccgcgacttccgtggactttccgaccagcagttcgacggccacggtaactacaccttcggcctcaccgagcagaccatgttctacgaaatcgacgtcgacaagatcgaccgtcctcgtggtatggacatcaccgttgttaccaccgctgtaaccgacgatgaaggtcgctccctgctccgcgagctcggcttcccattcaagggtgaagacggcaaccgccagcag

SEQ ID NO: 585 - DNA, 1032 bp, Corynebacterium glutamicum
atgtctacgcagtgggtaactttcagaggaaaattacccaaccaaaacaaaggaactttcatgaacgtgcaacgcaaactgctggcgatcgtaggggctttcatggcagggtctttagccttgggaacaccaactgcacaggcccaaagcattggcagcagtgcctcacagagaactgaagtcttacgtgggctgacctcatctgccggaataccagatgccacagcgccggaaggcggggcaaaagtcgtggtctttggagattcacatgcatcaggaaccaatgcaccatttgatgtggatgaacgcggctgcctcaaggggaaccaatcgtggcctgatcaattgcaagcacaacaaggattgcagcagggggagctcattgacctttcctgcaacggcgcctccatcaactcgacgggtttccacttttccgatgaagttcggcatgcagaagcactaggggccattggaccaaataccgagaacatcttcatccaatttggcaagaatgatcagtggggacactcaccaatcaatttgcgctattccgtgatcaactgcctttttgatgcggccaacggatgcggtgagaaagctgtagcggctggaaccatgcaggatccctcctcggtcaccggcgaaaactatgctcagcggatgaaacctgtcatcgactacctcaagtactacgctccaaatgcgcagatcacgttgctgggataccaggaatacaccccacgaagcggaagcgagatttgtgtccgcgtgggaggtacggaactaaggaaaccagacgccaccaacctggtgtcctatatgaacaatcttgagtcggccatttttgaagcctctgagattcttgacgtccagcatgccaatctccgtgaggccactgcaggacacagcagctgctcagctgaaccgtgggtcaacggagtgctggatatgcgggtaaacgctgtaggaggcacctggcacccatctccaaagggagatgaagtgaccgcgggcctcctcggaaccttgatg

SEQ ID NO: 586 - DNA, 807 bp, Corynebacterium glutamicum
atgactctttcccttcctccaattggtttcggcaccgttcatcttgatggcgcacctggcgttgaagccatcgctactgccattgatgctggttaccgcctcatcgacaccgcgtacaactatgaaaatgaaggtaccgtgggcaaggctgtccgcgagtcgggtgtcccccgcgaggaattgattgttaccagtaagctccctggccgcttccatgctcgcgatctaggacgcgtccgcattgaggaaagtctataccgcctcaacttagattacatcgatctcctcttgattcactggcctaatcccagcaaggatctctacgtcgaggcgtgggaaacgctgattgaagtccgcgatgctggcctggtcaagcacatcggagtgtctaacttccttccaaatcacattgatcgcctgcgccgcgaaaccggtgaactgccggccgttaaccagatcgagttgcacccctatttcccgcaggtggagcaggtagatttccacgatgagctgggcatcattaccgaggcctggagcccgctcagcaacggtcgcggactcgtcgaagagccattgctcaaggaaatcggcgagcgctacggggtcggcagcggcgaaatcgccctcgcttggcatcacgccaggggaatcgttccgattccacgctccaccaacccggccaggcagcgcagcaacttggaggcggtaaagatttcgcttatcgacgaagacgtccaggcgattaccgctttggcgcgcaaaaacggccggatcaaagatcaagatccagccgtctatgaagaattc

SEQ ID NO: 587 - DNA, 492 bp, Corynebacterium glutamicum
atgccagaacaggtagaacagccgaatcaagcacgcgaagagctggagaggattttcccgcagtggttcgtgtcagctgcagagaacagggatatgtctgtcggtcaggcaatgaagttctccccgaaaaggtggctgttccctgatttcagtttcagttatgacgaccaagatttcgtcatgccattgatcatcaattttgattcattaatcaacgatcttctcgcccaccagccgggtgctttccactatccgggggtcactttatcgtttccaaacaactgggaagacctctcgcacaaacaaatccaagactgtctgtggaatgcccttgaagagtggttttacttcctagagatctacacctggtcggctgtagatcagcgaaagtatgagcatggtcaagtacctggagacctgcgtatcggctgcctttttgaattcttttcctcctcgaggcctaaccttcaattccttaccgatccccttccc

SEQ ID NO: 588 - DNA, 915 bp, Corynebacterium glutamicum
atgggtcggattacccaaaacttgcaggtcccacgcgttgtgtccactgacgagcaagtttttgttaacactcgtccggatactgttgcggtggaggagcctctagaaattcgggttaatggcactgcgcttaccaccactatgcgcacgcccggccatgatattgagttggtgcatggcctcctcttgtcagaaggtctgatcacggatgcttctgaggtttttaccgcccgctattgtgcaggagctgttggcccagataatcaaaatacgtacaacgtcttagaacttgatgtcatccccaaagacaatccggcccgggatcccgtccagaatccctcccataatcccgaaggcagccaacacgaagcactccacatcccaactttccaaccggtacgcgaactaaacctcgtggcagcccaacgcaatgtgctgactacgtctgcttgtggtgtttgtggcacgacgtctattgagcagttgatgaacaagaagggctggcccattacgccgattacaccggatcctcggatgattgtgtcgttgccagataagttgaagtcgaagcagaagattttcgacaaaactggtggggttcatgctgctggtttggccacgcttgatggtgagatgttgattattcgagaggatgtcggtcggcataacgcagctgacaaagttataggaaacatgctgatggcgggaaagctccccttggaaaacactattttggtgatgagttctagggcgtcttttgagcttgtccaaaaggctgccatggctggaatttcgggtgtaatcgctgttggtgctgcaacatcgctggcaatcgaggcggcgcaggattcaggtattttccttgctggttttgttcggggcaacaagtttaaccactatgcgggcgagctcgga

SEQ ID NO: 589 - DNA, 336 bp, Corynebacterium glutamicum
ttgcagccatcatcagaaacgagtttcactgtggacaccaccccaagcaaaaacaacgaagccgagaagatgcagaaaatgtatcaatggctcgacactgtgtgcacagagctggatattgatccagacattctcgcagaggttgtcccccacctgttgaatctcacgcgtgatgttgcgcatggcccttctcgaccagcggcaccaatgacgtctttccttcttggtttagctgctggccgttctggaacaagcactgatgattgggccgagtccacgttggttaatgctctgcatcttcaagaaatcatcgctaaaaattacccggaggctaaa

SEQ ID NO: 590 - DNA, 2133 bp, Corynebacterium glutamicum
ttgctcaccatgaataaaccaggcggcatcgactgtcctggttgtgcttggcctgagccttccactgccaaccttggtgtggttgagttctgcgagaacggtgccaaggcggtcgccgaggaaacaacacctgatcgtgccggcaaagagttctgggcagagcattctatttatgatctgcgggaaaagaccgatcactggctgggaaagcgtggccgaatcaccgagcccatgttttatgatcgttcttctggcgatgatcactaccgccctatttcttgggatcgtgcatttgcgatcattgcgtcgaagctccgcgagatcgagccagatgaagcggtgttttacacctctggtcgagcacccaatgagccggcttatatgctgcagcttctagcccgccgacttggcacaaataatcttccagactgtggaaacatgtgccacgagtccaccggtactgccttgggtgagaccttgggtttgggcaagggatccgtggtgatggaggatttctacaacactgatttgttgatttccgtgggacaaaacccgggcaccaaccacccacgtgcgttgacggctttcaaagaattgaaggaaaacggtggcaagattctggcgctgaaccccatgccagagaccggtctgatgaaattccgtgagccccaatcagtcaagggcgcgttgagcatttcagacaaacttgctgatgaatacttgcagatccgtcttgatggagaccgcgcattcttccaggcgctcaacaaggaactcatccgtagagatgccctagatcatgcattcttggataaattctgttcaggtgtggatgaaaccatcgagcacctcaaatcactcgatgatgaggttctgctcaagggatgcggtctgacggcagcggagatcaacaaggccgctgacatggtggaaaagtctgacaccgtggtggtgtcatggactctcggggtcacccagcataagaacgctgtgtacaccatccgtgaaatggtgaacttcctgctgcttactggaaatattggtaagcctggcgcaggcactgccccgcttcgtgggcactcaaacgtccagggtgatcgaaccatgggtatttgggagaaaatgccggaggcattccttgctgctcttgaaaacgagtttggtttcgatgtgccccgcaagcacggcttcgacacggtaaattccctgcgagccatgcgcgaaggcaagaccaagttctttctctccctcggtggcaaccttgttcgagtgtcctcagatacgtctgttgtcgaaaagggcatggaatccaatgagctgacggtgcatctgtcgaccaagcccaatggttcacaagcatggcctggtgagcagtcacttatccttccggtgattgctcgaacagataaggatgtccaaaagtcaggcgtccagcgtgtgacagttgaggattctgccggcgctgttcacgcatccactggtaaacgaaccgccaacaaggatctgaatttgaagtccgaatgcgacatcattggaaccatcggtaagcagaccttcggtgatgccttctggcagccgatgattgataactacgatgtggtccgcgatcacatcgaggccaccattcctgggttccacgatttcaaccgtcgcatcgacaaccccggtggattcctcctccccaacggacctcgtgagcgcatcttcaacacatccaatggcaaggcccaattgacggttaatgaaaccaatgtgattgagctacccaaggactatttgcttatgaacacggtacgttcacatgatcaatacaactccacgatttacggtctggatgaccgctaccgcggtgttcgcaatggtcgccgcgtagtgttcgtcaatcctcaagattgtaagcaacgtggtctcaaggatggagacatcgtcgatatcgtctctgtctttgatgatggcgaacgccgagcaccgaatttccgagtggtggaatatgacaccgcgagggactgcgtcaccacgtatttccctgaggccaacgtattggttccattggattcagtagctgaaaaatccaacactccagtgtccaagtcagttgtggttcgccttgaagcaacaggacgtactgcttct

SEQ ID NO: 591 - DNA, 756 bp, Corynebacterium glutamicum
ttgtcgtggactacgaaaagcttgcatcttcaaattctgcgcacaaagtgttctaagacgacgtctgcccatcggcgctctaatgcacattacagcgtttacagaattgaaaatgaaaggttcaaagccttgaccattacttttagccgcgttgctctgaccaccctggcagtcaccgcaaccactttgtccctgagcactgctgcgaatgcacagtcttccttgttggataagactcttgatgcccgtcagtgcatcgatgcagacaacgtctgggtctcagttgactatggtgcagattccgaaaaagaaccagagggcgcatgtgccaccgagttcactgatggtgttgtagctcttgaatctgctgggttcaaactgacctttgacgaatctgaaatgggcaaatacatgaccggtatcaacggagttgttcctgattgggttgaaactggaacttactggagttactactctggtgaagtcgcagatgattacagcgtggactacacctactacgaggttggtgcatctaattctgaacctgaaggtggaactgttgaggcttgggttgttggcaccggcgaggaaacaccagcactcgagactcttcctgaaactccagcagcaaccggatcttctgaagacggcggctggattgcagtcatcgcaggtcttctcgcactgatcggtggtggagttgcagctttgtaccagggcttgatcactatcccaggtctggttctgcctaagttt

SEQ ID NO: 592 - DNA, 804 bp, Corynebacterium glutamicum
atgatcaacgccatcacactcaagcccaaaaccttcctcaccttaagcttccttgcggttttgagcatcgtgattttcttctggccgctgatcgtcaacccggaatccttcctgtccgacaaagcccaagcgcccctctacatcgcgatcgtcattcccctcgtgctggccgctgtcatcgccgaaatcagtgaaaacggattcgacgttaaagccgtagccatgctcggcgtcctcaccgccatggttgccgtagtccgaccattcggtgccggcgcagcaggctttgaagcagtcttctttgtcctcatcctcggcggacgagccttcggacccggcttcggattcatcctcggcaacaccggactgttcgcatccgcgctgctcaccgcaggaatcggaccgtggctcccctaccaaatgctcgcagccgcctgggtcagcttcggcgccggcctactcccccaagtacgcggcaaaaaggaaatgctcatcatcgtcctatacgccatcgtctcttcactcggctacggaaccatgatgaacatgagcttctggccctacgccatcggtgtcaccagcgggctttccttcacacccggcgcgcccgtcctggaaaacctccacaccttcatgctgttctgcctcaccacatccatgggttgggatctcggccgcgccttcttcacctcagtgctattactgctcacagccaaacccgttttaggtgctttacgacgcgccagccgccgcgccgctttcggcgtcgagcgtgacttcggggaggccggggtgcctcgggtc

SEQ ID NO: 593 - DNA, 1662 bp, Corynebacterium glutamicum
gtgctggaactggaaagcgtcgctgcctcgtattatgacgatgagcgcacgctggcggcgccgcagatcagcgacgtgaatctgacgctttttgaaggcgaaatcctgctggttgtggggcgcaccggctccggcaaatcgacgctgctgaacgcgatgtccggcgcgatgccgcatgcgaccggcggccgacttgatgggcgcgtgcgcgtggtcggccgggatacgcgtgatttcccaccacgcatgctttccgacgtggtcggcgtcgttgggcaagatccggcggcaagttttatcaccaacacggttgaagaagaacttgcctacagcatggagcaattagggctcccacctgcggtcatgcgcaagcgcgtagaggaaacccttgatcttttaggcatcgcggagctgcgatacgtgccattggcggaactatctggtggtgagcagcagcgcgtggcgattggcgcggtgctgaccactcgccccgcgctgattatcttggatgaaccaaccagcgctttggaccctaatggtgccgaggatgtgctggcaaccgtaaccaagctggctcatgacttggcgatgaccgtagtgcttgctgaacaccgcatcgagcgcgtactgcagtacgtggaccgcgtggcgcatgtgggcgctgatgggcacgtcactgttgggacgccggaagaaatcatggctgattctgatgtggcaccacccattgtggaattaggacgctgggctggctgggctcccctaccgctatcgatccgcgatgcacgcgcacactccgctgacatgcgcaaacgcctgtatcagcgtggtttagtggtgaacaaattacacaaccacgctgtccagccacttttgatcgccgaagatatcatggttgatttccccgaaatccgtgccgttgacggcgtgaacttgaatctcaactccggtgaaattaccgtgctcatgggccgaaacggctgcggaaaatcatccctgctgtgggctttacaaggttcagggactagaaatcagggctcggtgcaggtgcttgatgaggccgcgggattttcgtggacagaccccaaaactttaaagcccgccaagcggcgcaatcttgtgtccatggttccgcaaacaccgaccgatattttgtatgaatcaaccgtgcatgcagagctcgcacgctctgataaagatgccgcagcacccgccggcaccacgcgggaaatcctggattcactggtcccgaatatcccggaccatctccacccacgtgatctatcagaaggccaaaagctctccctcgcgctgtccatccaactcgccgcaaaaccccgcgtggtatttttcgacgaacccacccgcggcctagactacgacggcaagaaatccctcgcccgctccttccaacaactcgcagacgacggccacgccattttggtggtcacccacgacgtggaattctctgcactgtgcgccgaccgagtgttgtttatggcctctggaaagatcatctccgatggcacagccgtagaaatcctccccgcatcaccggcttacgccccacaagtcgcaaaaatcaccgccggcatccaagaggaatcacactggctcacagtctcggccgtgaaagctgcgctagggcatggtgaaatctca

SEQ ID NO: 594 - DNA, 1146 bp, Corynebacterium glutamicum
gtgaaatggattgagcgatatgtgctgtcccggcggatggttcatccctgggcgtggtgggtgtgggcgttgggtattgctggttgtgccagcatgaccaacaatccttatattttggcgctcacttttgccacgttgtgttttgtggtgtttaaccgtcgtgggtcatcgccgtggtcgcgtgctttcccgatctatttgatgatcgcgggttggctcgtggtgtaccggttggtcatgcacattgtggtgggagcaaaaattggcaccattgaactgtttcggatcccgccggtgcagttgccggaatgggctgcgggtatccacgtgtttggcacggtgtatctcgagggtctgatcatcgcgacgacgcaaggcttaacgcttggaacgatgatcgtggcggtgggtgctgcgaactctttggcggatcccaagaagctgctcaaatcgttgcctggcgcattgggcgaactgggaactgcggtggtcatcggtatttccattgcacctcagatggctgagtcggcgttccgcattaatcgtgcacgaaccttgcgtggtgatgatgccaaaggtgttcgtggtttcgcgcggattttgatgccggttttccaggacactttggataggtctttggccctggctaattccatggatgcccgtggttatggcaggcaggctcatgtatccaaattccaacagcgtgtgacctctatttttggtgcattcggaatactcggcgtgaccgttggtctgtttgtggtcttagatgcatcatcaccgatgttcgttgccgttccggtgtttattaccggcgtgggcttcttgatcatttcgttggtcgttgcttcacatagaaaaacatccaccacttttgatcagttgccttggggtgctgcggaatggcttgtgtgcatcacaggtgtgattccgctgctcatggctgcgctgacacgataccttgatccaggttccatgatcaccacctgggttcctttgcatatgccagacaccgttccgttgctcgttgtggcaggacttgttgtggcgacgatgccaggattcttgacgccccgcttgccgaagaacaaagtgagggtcaagcgtcgaaaagcaataaatagcccagaaagggccgaagtt

SEQ ID NO: 595 - DNA, 1074 bp, Corynebacterium glutamicum
gtgatgtctcgaacctcaacttttcacctgtcgctgaagtcttttgcagctgcagtcgcactatggattgttcttgccatatcgccatgggttccttctgcgcacgccttgaccacgccttgtgaagacgaccaagtgacagtgatggttgagggcaacaccatcggctgtgctgacgccggcggaaatggctatcaaacgcttcttgatgccggatttgatgtggaaaccaccgttcagtttccagaattcttgtgccgaatcaatgatttcccaggtcctgatgtggacgattgcatgaccgcatcacctgctgaagcttattggtcttattggcatgctcccctcggcggagatgaatgggaatacagcaaccttggagctttcctctactaccccaaacccggcactgttgaagcgtggtattggggagatactgatcgtcccggcgcgatcccggtgagtaaatctcaggcggagttggggttagactccgcggatccggattacaaaattgattttgatccaaatgatttcatcaccacaaccccaacctccgagtcccctatcgccgatttagggggtgacgaagagcccactgaaactactgaagctcctatcgcaggggctggagctggttcggcaagaggacaagcagctgaacccactgctgaggtaaaccctgagaaccctaatgaggtattggtgtatcaggattctgaaggaaactcgattactaaaggtcagtacgagaacttggttgctgcagcagccgctaagaccactgctgctgtccaagccccagctggggctggtgaagcaaatagccaaccgcaggcaacagcggtggcagaagctcctgaagttgatccgatgaccacgcaggttcttatggcgcctgcgggccaagatggagacgtcatggctgagggttcgacgcagcagacgtacgccacaggcacggtggattcttctgctcagggatggatcattggactcacactggctgtcatttccttggtttcagcgtctgctgtggcggcgtgggcgattcgtcgttcagaggtccagggt

SEQ ID NO: 596 - DNA, 1182 bp, Corynebacterium glutamicum
atggctcatctacgtgggaagagaaccattcgctggtctgctgcaaccgtggctttagcaaccggtgtttccctgttggctccacaggtcgttgctgcacaggatgcatcatcggatattcaattagctacccaattcatcgaaaaagaatttgcaacgaatggcctcatccctgggcctgtaggtactccagatattgggctcaatcaggatctgttgctgtccctaaatgcgcttgcccctgattctccagagatcgacgctgcatatgctgcaattgctccggagctcgagggctatgtctcagtttctgactacatcttcagcgatcgtctagccaagaccgtagctttccaagatgccctcggcgtcagagatgctgattttatcgcgcaacttgtcagcgctgttcaagaaaacggtcagatcaaaaacttagataatggtgaagccacaactgcaattaataacttcagccaggcctggggcgttctagctctgcaccgcgtcggtgaaaccgaagcagccgagcgcgcaacagaattccttaaaactcaagtgtgctccgacggtggtgtccaattagcctcagcaatcgaacctacatgcaaaaccacggattccgatgtcactgcaatggctgcacaggctttgactctggcaaatggtgcgcaggatccaaccacacaagccactctcgattacctcgtcaccacgatggatgagaccggtggtgtcaaaaatacttggaccggtgtgaattccaactccacgggaattgtcggatccgcttttgctcttgcgggcgatgaggaaaactacctcaaggctcgtgaatacctggcatctgttcaatttggcgaagatgcagacccatcgattcagggtggctttgctttcaccgtgaaggctaaggaaaccaacactgcgattagcgatcagattcgacgcgcaactggccaagcagcattaggttttgcaggcggtaactacgccaacgataaactgatcaccattgcgaacccagtagatccaactccagatccagaaattccaactcccccagctgattcagagggatccaccggtggaattggcggcgctggaattatcatcgccatcttggccatccttgccgccatcgctggtgtcatgggaccaatgatggctaacctgcagttt

SEQ ID NO: 597 - DNA, 468 bp, Corynebacterium glutamicum
ttggaagaattcggatcaggccccatccacggctcgggttatttcgagaactatcttcccatcgactattccgaagcaggatttcaccactacctcaaggagcgcactgacgcggccgatccttcggttccaccaccggaaggttttgtgcactgcagctatttctggatcgttgatgatgacgatgttcttgtcggattcttagctttaaggcacgagctgaaccaacatctcctggaagtcgcgggccacattggttacggcgtgcgcccgtctgcgcgtcgaaaaggtgctgcaaccgcagcgctgaaactcggtgttcatgaagctcaggccttgggcatcgacaaggttttgctgtgcgtcgcaggagataacgaagcgtccaggaacgtcatcgaaaagtgcggtggagtttatgaatccacgatccgtggaatgcgacgctattggatagccacagattct

SEQ ID NO: 598 - DNA, 396 bp, Corynebacterium glutamicum
atgacaatgactgatccaatcgccgacatgctgtcgcgcgtgcgcaatgctagcaatgcgcaccacgacaccgtgtccatgccatcctccaagatcaaggcaaacatcgccgagatcttgaagcaggaaggctacatcgctaactacaccgttgaggatgcaaaggtcggcaagaccctgtccctcgagctgaagtacagcaacacccgtgagcgctccatcgctggtctgcgccgcgtttccaagcctggtctgcgtgtatacgctaagtccaccaatctgccacaggttctgggcggccttggcgtggctatcatttccacgtcacagggcctcctgaccgaccgtcaggctaccgagaagggcgtaggcggagaagtcctcgcctacgtctgg

SEQ ID NO: 599 - DNA, 534 bp, Corynebacterium glutamicum
atgtcacgtatcggaaaagaaccgatcaccatcccatccggtgtcgaaaccaagattgacggacagctcgttgaggttaagggtcctaagggcaccctgaacgttaacgttccagagccaatctccgttgcagtggaagacggcaagattgtcgtcacccgcccggatgatcaccgcactaaccgttccctccacggtctctcccgctccctggttaacaacctggttgtcggcgtcaccgagggctacaccatcaagatggaaatcttcggtgtcggttaccgtgtcgcgctgaagggcaaggaccttgagttctccctcggctactcacacccagttctgattgaagcttctgaaggcatcactttcgcagttgatggcaacaccaagctttcagtttctggcatcgacaagcagaaggttggacaggtcgcagcagtgatccgccgcctgcgtaaggacgatccttacaagggtaagggcatccgctacgagggtgagcagatccgccgcaaggtcggaaagacgggtaag

SEQ ID NO: 600 - DNA, 402 bp, Corynebacterium glutamicum
atgagcaacactgaaaacaagcagaagcgcgtttccgttggcaaggacatcgcgactcgtcgtcgcgttgcccgtgcacgccgccacttccgcatccgcaagaacctgcgtggcaccccagaggctccacgtttggttgtccaccgctcttctcgccacatgcacgttcagatcatcgatgacgttgcaggccacaccctggctgcagcttcttccatcgaggctgaggttcgcgcaactgagggcgacaagaaggctaagggcgcaaaggtcggtcagctgatcgccgagcgcgctaaggctgctggtatcgagcaggtcgtcttcgaccgcgctggttacaagtaccacggccgcgttgcagctctcgctgacgccgctcgtgaaggtggtctgaaattc

SEQ ID NO: 601 - DNA, 633 bp, Corynebacterium glutamicum
atgccgggacgtgaacggcgtgacggcggacgctccgccgacgacaacaagcaaaacgatcgcaacgagcgtcgtggcggaggccgccgcgatgaccgtcgcaatcagcagcaggacgagcgctcacagtacatcgagcgtgtagtcaccatcaaccgtgtgtccaaggtcgtcaagggtggtcgtcgcttcagcttcaccgcacttgtcatcgttggcgacggcaagggaatggtcggtgtcggttacggcaaggccaaggaagttcctgccgcaatccagaagggtgcagaagaggctcgtaagaacttcttccgcgtcccaatggtcaacggcaccatcacccacccagttcagggcgaaaaggcagccggcatcgttatgctgaagccagctgctccaggtaccggtgttatcgccggtggcgcagcacgtccagttcttgagtgcgcaggtatccaagacatcctgtccaagtcccttggttctgacaacgctatcaacgtcgtccacgcaactgtggatggcctgaagcagctggtccgccctgaagaggttgcagcccgccgtggcaagaccatcgaagaggtcgcaccagcacgtattctgcgtgcacgcgcaggtcaggaggcg

SEQ ID NO: 602 - DNA, 183 bp, Corynebacterium glutamicum
atggcgctgaagattactcagatcaaaggcactgtgggcaccaagcccaagcatcgcgaaaatcttcgttccctcggtctgaagcgaatccgccacaccgtgatccgccccgataccccagaggtacgtggcatgatcctggcagttcgccacctgatcgtcgtcgaagaagtggcgggggag

SEQ ID NO: 603 - DNA, 444 bp, Corynebacterium glutamicum
atgagcgaaccaattaagctccacgatttgcgcccagcagcgggctcaaacaaagctaagacccgcgttggtcgaggcgaagcatccaagggtaagactgcaggtcgcggtaccaagggtaccaaggcacgcaagcaggtttctgcagcattcgaaggtggccagatgccactgcagatgcgtcttcctaagctgaagggcttcaagaaccctaacaaggttgactaccaggtagttaacattgcagatctcgcagagaagttcccacagggcggcgacgtcagcattgctgacatcgttgcagcaggacttgtccgcaagaacgaactggttaaggttcttggcaacggcgacatcagcgtcaagctgaacgtcaccgctaacaagttctccggctctgccaaggaaaagatcgaagccgctggcggctccgcaaccgtggca

SEQ ID NO: 604 - DNA, 729 bp, Corynebacterium glutamicum
gtggagcttaattggttcgctcattgttacctactcccccgccacttcttcgacgacgatcaggtggcgaactgccaggatcatgccacgtacctctggggtatcggggcggatcacggtgtggcggattcgcttcagaccgagggaacgaagattttcgcgatgcttgggcttggtgcccacagtgcctttgatctgagtaatcttcagcgccatttcttacgcctcctgacctgcgcgtgcacgcagaatacgtgctggtgcgacctcttcgatggtcttgccacggcgggctgcaacctcttcagggcggaccagctgcttcaggccatccacagttgcgtggacgacgttgatagcgttgtcagaaccaagggacttggacaggatgtcttggatacctgcgcactcaagaactggacgtgctgcgccaccggcgataacaccggtacctggagcagctggcttcagcataacgatgccggctgccttttcgccctgaactgggtgggtgatggtgccgttgaccattgggacgcggaagaagttcttacgagcctcttctgcacccttctggattgcggcaggaacttccttggccttgccgtaaccgacaccgaccattcccttgccgtcgccaacgatgacaagtgcggtgaagctgaagcgacgaccacccttgacgaccttggacacacggttgatggtgactacacgctcgatgtactg

SEQ ID NO: 605 - DNA, 321 bp, Corynebacterium glutamicum
ttggaaagttccaattctcaggcacagggacgtgcggacagaattctcgattcagccttgaaagaaggcgcttcaatagttgttgatggccgtacagctcgagaatttcagatggacatcgaagtcggaatggttggcattaacgtgccaatcccagtcccaattggcgctttctcatttggaggttggaaagactcactattcggagacacacacatgtatggatctgagtctttcaacttctatacccgaagcaaggtggttaccactcgctggcctcttccaaatgaatcacagattgagcttggcttccccacccac

SEQ ID NO: 606 - DNA, 363 bp, Corynebacterium glutamicum
gtgcaacatcccccggtacccggtaaatcgattcttgctttttacgcagtagttcttgtcgcgctttgtttgtggttcaagattggttctattccagacatagtggtaattggctttatccttgcactttccttcgcttcggccatcattaccgcagcactcactcaaaaatctccccaatgggttcttctgaccgtaggacttgttggcctgatcattgtgggaatttgcatctatctctggatcaccgttcccgagggaattctcgatgtcgccgtcctccttgtggcttcaggagcagtcatcgccgaatcttccctacttattagccgaatgtggcccaggcgccgtcaagctactagt

SEQ ID NO: 607 - DNA, 456 bp, Corynebacterium glutamicum
atgtctgcatcaggaaggataatcgcggaagattttccgcctagctctaaagtcactggtcggagtagttctccgcaggcggcagcgatcttctttccaacaggcgttgatccggtaaacgctaccttgtctactccggggtggcggacaagggcatcaccgaaacgccctgaaccggtgagtaggttgactacgcctgctggcactccggcggcttcgatggcttcgatgatgaaacggatcgacagtggggtgggggaggctggtttgatgatgacggtacagccggcaagaagtgctggtgccagtttgatgactacaaggttgatcgggaaattccatggggcgatgagtgcgcagacaccgatgggatctttatccacgatggattcggcgctaccggcaggaaatgggcggatgtcttcgccgtctaaccaaggcgcgagagtggcaaag

SEQ ID NO: 608 - DNA, 1491 bp, Corynebacterium glutamicum
atgaatgctgcaaccaggcgtgcttctctgcaactcccctatacccatgtcgatgatttctacatcaacggttcctgggttaaagcagaaggaacacaacgcaaccccgtagttgatcctgcggtcggtcaagaatggggatctgttccagaagcaaccgcatctgaattggactctgcggtgggagctgcacgtacagcgctaaagtcgtggagtgcacttacaggtgcggaacgaacaggctacctcctgaaaatcgcgacggaaattgaatcccgttctgaagctctagcacttactaatacccgcgaaaatggttcccccatttccgagacccgtggagctgcgtccaatgcagcaggaattttccgttactttgccactctcgcgccttggttagacggcgaagacatccgcccatttcctgccggtagcgccgaatccatcgtggataaagatcccatcggtgtctgcgcactcatcgccccatggaatttcccgatcaaccttgtagtcatcaaactggcaccagcacttcttgccggctgtaccgtcatcatcaaaccagcctcccccaccccactgtcgatccgtttcatcatcgaagccatcgaagccgccggagtgccagcaggcgtagtcaacctactcaccggttcagggcgtttcggtgatgcccttgtccgccaccccggagtagacaaggtagcgtttaccggatcaacgcctgttggaaagaagatcgctgccgcctgcggagaactactccgaccagtgactttagagctaggcggaaaatcttccgcgattatccttcctgatgcagacatgtcagtactctcgacgcggttgattcgatcctgtatgcgcaacactggacaaacctgctacatcagtacccggattattgcccctagctcacgctatgcggaagtcgtacaaacagtggcaagcactatcgctgcaggtagacaaggtgacccctatgatgaagaaacggtttttgggccagttgccagcgcctctcagtactcaaccgtcatgtcttacattgactccgcacgagaggaaggtgcacgagtggttgcaggtggaacccggtcaatcagcctttctgaaggtttagaatcaggcgagtttatccaaccaaccgtgtttgccgatgtcacccccgacatgcggatatcacgcgaagaaatcttcggccctgttatttccatcctaaagtacgacgatacaaacggtgtttccgaagcaatcgcactagccaacaacacgaaattcggtctcggtggcttggtatttggtgcggatgaggaacaagcactagaagtcgcccgtcaagtggattctggttccgtaggcatcaacttcttcggttccaaccattccgccccatttggaggacgccacgaatccggtatgggagtggaatacggcatcgaaggcctcagtgcttacctgacatacaagagtattcaccgaaccatt

SEQ ID NO: 609 - DNA, 735 bp, Corynebacterium glutamicum
atgactcgcagtaatttacccgcttgggagcaagcagaccccagcgtccacgcctctgatccccgcgccatcacttttgcggaggattttgggattcgtcccatcccggccgtaggtccaattgataccaccgctatctgtgcaacaccttcaaatggatttgagcaattatggaaagccattgagccggaaacccgcacccgcgccaacgacattcatcttcccatcgtcgtggcgtacgctgaacgtctctgcgacgcttacccactggcagatagagaattggttctcgtagccgcaatcctccacgacacgggctgggcacatgtcgatgagagccgaatcatctccgaaggattctccggaaactggcgcaaagcagcaatccgcttcgaacacgaaacagaaggctgcactgtggcccgccgagtgcttccatccctcggatatactgtcgattttgtcgagcatgtctgcgacatcatcgacggacacgacacccgccaagtggcctactcactagaagacgctcttgttcgcgattgcgaccgactctggcgtttcgaccgcgccgggatcacggcttctagctcatggttcgggatgccagtctcagattatgtcgaccgcctgcacagggaaatcctcccagaattaatcaccgaagctgcacaccagatggctactgcagacctcaatcgtgcaaaggccctgttaagaacggatgcgatccga

SEQ ID NO: 610 - DNA, 306 bp, Corynebacterium glutamicum
atgattcaacctcacacttgcgtttctggcgtggtcaacgaaagatccatgccttcggtgaccttgatttggcaagacaaacgggagcaatcctcacggtccacggcagcaccccacagcatttcatcttccatctcctccattgggggaagcgcatcatactgtgcagggtcaacaaacacatggcaggttgcacacgataaggaaccgccgcattcagcaacaattccaggcactccgtttcggactgcggtctccattactgaatcaccaacagtcgcctcgatggtgcgggttttgccagca

SEQ ID NO: 611 - DNA, 1266 bp, Corynebacterium glutamicum
atgaatacttcagctgaaactggaatcttgatcatcggtgcaaaccaatcgggtgtgcagctggcgatttccctgcgggccacgggtttcaccgaatcgatcacgcttctaggcgaggaggatcaccgcccctaccagcgtcccgccttgtccaaggagttcctccaggacaagatcgacaaagagcgtctgattttccgttccaatgagtattgggaagaaaataatattcgcctggtcaagggcgtgcgcatcgaacgcattgaaaagaacgacgacggatcaggggtcgcctacggcgccggacaagaattcgcttttcgacgtctcgctctagcggttggtgcccgccctcgccacctcgacctcccgggcgccaccttggagggtgtcacctacctgcgcaacgcggacgacgccttggcgctcaaagcgatgattggttctgtcaccgatgccgttgtagtcggtggtgggttcatcggattggaagctgcgtgttcgcttcatgacctcggcaaaaatgtcaccgtcctggaatatggtccgcgtctgattggccgagcggtgggtgaagaaaccgcagcattcttcctcgaacaacaccgttcccgtggcgtaaatatcgtgcttgatgcccgcatgaaacagtttgtgggcaaggatggaaagctcagcggcattgagctagaagatggcacagtaattcctgcccaactagtcattgtgggcatcggtgtcattccgaacacagaacttgccgctgttctgggcttagacatcaacaacggcatcgtggtggataaacatgccgtcgcgtcagatggcaccaccattgcgattggcgatgtcgccaacattcccaatccaatccctggttcccccgctgatgaacgcatccgactagaaagcgtcaataacgccatcgagcacgcaaagatcgctgcatactcactcgtcggccagcccgaagcctacgccggaatcccctggttctggtccaaccaaggcgatctcaaactacaaattgcaggacttacccttggttatgacagcacagtaatccgacaggatcccgagaaaaagaagttctctgtcctttattaccgtggcgacaacatcatcgccgccgattgcgtcaacgctccactggatttcatggctgtgcgcagtgcactttccaggaaccaaaatatccccgccgaccttgctgcagatatttcgcagccgctgaaaaaactagccgttgacctggaggttacccga

SEQ ID NO: 612 - DNA, 318 bp, Corynebacterium glutamicum
atgtctactattcatttcattgatcatgctggcaaaacccgcaccatcgaggcgactgttggtgattcagtaatggagaccgcagtccgaaacggagtgcctggaattgttgctgaatgcggcggttccttatcgtgtgcaacctgccatgtgtttgttgaccctgcacagtatgatgcgcttcccccaatggaggagatggaagatgaaatgctgtggggtgctgccgtggaccgtgaggattgctcccgtttgtcttgccaaatcaaggtcaccgaaggcatggatctttcgttgaccacgccagaaacgcaagtg

SEQ ID NO: 613 - DNA, 744 bp, Corynebacterium glutamicum
atgcctagtccacgcactgttcttatcactggtgccgctggcggtttgggtcgggcattcgctgaaggtttcgcagcccaaggagaccgtatcgcggtggcggatatcaatctggatggggcgcaagagaccgttgacaagctgaaagcattgggcgcagatgccgcagcctttgaagttgatgtcacgtctttggagtccaccgaggccctagccgccggtgccgctgagtttggcggtggccgaattgatgtccttattaataacgcagcgatatatgcgacagtgactcgttcaccgtttgaggatattgaccctgcggagtgggatttggtcatgggagtcaatctcaaaggcccgtggttggtgacgcgttctgtgagtccgtttttgtccgataatgcccgtgtggtcaatctttccagcgcgactgtgttttcaggatctgcacactgggcgcactacgtggcatccaaaggtggggtcattgctttaaccagggtgcttgctaaagagctgggtggtcgtgggatcacggtcaatgcggttgcgcctgggtttacgctgactgaagccagcttgggactcatggatagcgcggaaacgtacggtgtcgatcgcggatccatcaagcgcgcaagccaaccgaaagacatcgtcggcaccaccatgtttcttgcatccccagaagccgaatacatcactgggcaaacactcatcgttgatggtggccgacagttcatc

SEQ ID NO: 614 - DNA, 213 bp, Corynebacterium glutamicum
atggtggtggatgcagcgccagttccagtaacagccggcaagccgtattcgcggcacacgatcgcagcatggctcatcatgccaccaatatcagtgactgttgccttgattttgccaaagattgggccccaagaaggtgctgttacaggggcaacgaggatttcatcctgctggatttctgaaaggtcatctgcgctgagaattactcgagcg

SEQ ID NO: 615 - DNA, 1740 bp, Corynebacterium glutamicum
gtgttcaagccttttgaaactatcggtggtgaattcgctgtaaagtgcctcggccaatacaacgctcggcatttgatgatcccgaatgccaatggcatcgagttccgcgtgcatctgggatacctctatatgtcccctattccagtgcctgaagatcagattgcggaacgcgtccccatgttccaggaacgcatcacgcactacttccaaaactgggagccaatgctggcaaattggaaggagcgagtattaggaaccatcaatgagctggaatctctagaattcaagccactgcctgactacgtgcctatcgatgatattgtctccggaaaagccaaagacggcaccgaagtactcatggaaaacttcgatcggctcattcagctcgcctaccaaaactggcaataccactttgagttcctcaacttgggttacatcgcttacctagatttcttcaatttctgcaaggaagtcttcccagatatccctgatcaatcaatttcgatgatggttcagggcgtggatatggagctgttccgccccgatgatgaactaaagattctggcacagctagcggtcgaccttggcctgcaaactcactttgccaacccggatgatccgcaagctaccttggctgctatcgcaaaggcagaaggcggcgcgacatggatagcgcgctgggaagaagcacaagatccgtggttcaacttcaccgtcggtaatggcttctacggtcacgataaatactggatcgagcacctggaacttccactggggtacatcgcggattacatccgccgcctagatgaaggccaaaccatctcccgcccgaaagatgaactcatcgcagaaaaggaacgcgtggtggaagaataccgcgaccttttggatggagaacaactcgcgcagtttgatgctaaatgcggcctcgctgctactgcatacccctatgtggaaaaccataacttctacatcgagcactggaccatgtcagtattttggcgcaaagtacgcgaactttcccgcactctccagggctacggtttctgggagaacgaggatgacatgttgtacctcaaccgcactgaagtccgcgatgtcctcttcgacctggctactgcgtggggtgtcggcgcacccggtggtccaattggcacgatcatttggccggaagaaattgagcgaagaaaagcaattgtcaccgctttgaaaactgcccgaccagcgccagctcttaacactcctccagagtccatcaccgaacctttcacccgcatgctctggggaatcaccaccgaacaggtgcaatcatggttgggcaatgacgaggatgccgaagaaggaacccttaaaggcatggctgcatcccctggtgtggtggaaggctacgctcgagtaattctcagcgcagatgacctttcagaaatccagcaggatgaaatcctcgttgcccctgtaacagcaccttcttggggcccaatctttggcaaaatcaaggcaacagtcactgatattggtggcatgatgagccatgctgcgatcgtgtgccgcgaatacggcttgccggctgttactggaactggcgctgcatccaccaccatcaaaaccggcgattacctcaaggtcgatggaaccaagggcaaggttgtcattgttgatccagatgcgccacgcatcgaaggacccggcgcgcacagccatgcgcactcagtagcagcacatggggtggatacacatgcc

SEQ ID NO: 616 - DNA, 1080 bp, Corynebacterium glutamicum
ttgaacatcccgtttgtccagcgcttcgatgaaggcctggatcctgttctagaagtactcggtggcaagggcgcttcactagtcaccatgacagatgctggaatgcccgttccacctggatttgtggtcactactgccagctttgatgaattcatccgtgaagcaggggttgctgaacacatcgataaattcctaaacgatctcgatgcagaagatgttaaggaagtggatcgagtttctgcgatcatccgcgatgagctgtgcagtcttgacgttccagagaatgctcgtttcgcagtgcaccaggcttatcgcgatctcatggaacgatgcggtggcgacgtcccggttgctgtccggtcatcggccactgccgaagatctgcccgatgcttccttcgcagggcaacaggacacctatctgtggcaagtcggtttgagcgctgtcactgaacacatccgtaaatgctgggcttcgctgttcacttcccgtgccattatctaccgtctgaaaaacaacatccccaatgagggcctctccatggcggtagttgttcaaaaaatggtcaactctcgtgtcgcaggcgtggcaatcactatgaatccttccaacggcgaccgctcgaagatcaccatcgattcctcatggggtgttggtgaaatggtggtctcaggtgaagtgacaccagacaatatcttgctggacaagatcacgctgcaggttgtctccgaacacattggaagcaaacacgctgaactcatccccgatgccaccagtggaagcctcgtggaaaagcccgttgatgaagaacgcgcaaaccgccgcagtctgactgatgaggaaatgctcgctgtggcacaaatggctaagcgtgcagaaaaacactacaagtgcccacaagatatcgaatgggcgctggacgctgatctgccagatggagaaaaccttctgttattgcaatcccgcccggaaactatccactccaacggtgtgaagaaggaaaccccaactccgcaggctgccaaaaccataggcaccttcgatttcagctcaatcaccgtcgcaatgaccggcacgaag

SEQ ID NO: 617 - DNA, 1290 bp, Corynebacterium glutamicum
atgacaatgacttcccagacttcccaacaatccacctcaaccggtggatgcccattcgggcacacatcagagtccaccagccatcacggctaccagcctttcgatatgcacaacccgtttcctgcatataaagaactccgtcaggaagagccagtgatgttcgatgagcgcatcggctactgggtggtaaccaaatatgacgacatcaaaaccacctttgatgactgggaaacattctcctctgaaaatgcacaagccccagtccgcaagcgtggacctcaggcaacccaaatcatgaccgatggcggcttcactgcatactccggattatcagctcgtattccaccagagcacacccgcatccgcgcaatcgcacaaaaggccttcacgccacgccgctataaagcactcgaaccagatatccgagcaatggtgattgatcgtgtggagaaaatgttggcgaatgatcaacacgtcggcgatatggtgtcagatcttgcctacgacattccaaccatcacgatcctgacgctgatcggtgcagatatttccatggtggacacctacaagcggtggtcagattcccgtgcggccatgacctggggcgatcttagtgatgaagagcagatcccacacgcacacaatttggttgagtactggcaggaatgccaacgcatggtagctgatgcacatgcacacggtggcgacaacctcaccgctgatctagtgcgagcacagcaagagggtcaagaaatcaccgatcatgagattgcttctttgctgtactccctgctttttgcggggcacgaaacaaccaccacgttgatctccaattgtttccgagttctcctcgatcatccagagcagtggcaagccattctagagaatccaaaactgattcctgcggcagtggatgaggtcttgcggtactccggctcgatcgtggggtggcgtcgaaaagcattaaaagacaccgagatcggcggcgttgccattaaggaaggcgatggtgttctgctgctcatgggttccgcgaaccgcgatgaagctcgctttgaaaatggcgaggaattcgatatcagccgcgctaatgcgcgcgagcacctgtcttttggtttcggcatccactattgcctaggaaacatgctggccaaacttcaagccaagatctgtctcgaggaagtcaccaggcttgttccttccctgcacttggttgcggacaaagctatcgggttccgggagaacctctccttccgcgtccccacttctgttcccgtgacttggaacgct

SEQ ID NO: 618 - DNA, 804 bp, Corynebacterium glutamicum
atggcgggaggaaatcgcgaacctggacgtacagtcacctccaaggtgatcgccgtactgggagcttttgaacacaccatgcgtccacttggtgtcactgaaatcgctgagctggcagacctcccaccaagtaccacccaccgtctcgtttctgaattaaccgaaggcggactactcagcaagaaatctgatgggcgctaccaattgggcttacgtatctgggaactcgcccaaaatacaggacggcagttacgcgacactgcacgcccgttcatccaagagctctactcacttacttccgagactgcgcagctagtggtccgcgataaagatgaagcacttttgattgaccgagcctacggcacgaagaaaattccacgctcggctcgagtcggtggtcgactacctctgaactccactgcggttggcaagattctccttgcgtttgatgagccatgggtaaaacagtcctatctcaagctgccactcaacgcctccaccccaaagacaattgtgaatcccgacgtcttggctgcgcagctgaaacaaattcactcgcaaggctttgccatcacacatgacgagcaacgaatcggcggcgcatcgatcgccgtaccggtctggcatacaggaaaactgggagcagcactggggttggtggttcccaccgcacaggctgcaaatcttgagcgctatctcccgatccttcaggcgacaagtcagagaattacaaaagcaaccgcgctcattcctttggacacacttttggcttcacacaaaaatgcagaacgaaaaggcgatacc

SEQ ID NO: 619 - DNA, 543 bp, Corynebacterium glutamicum
atgcgactcgtactcctcggacctcccggtgctggtaagggcacccaggctgcaattctctctgagaagcttggcattcctcacatttctactggcgatcttttccgcgccaacattggcgaaggtacccctctgggtatcgaggccaagcagtacatcgacgctggcaagctggttccaaccgacgtgactgcacgtatggttgcttcccgccttgctgagtccgatgctgcagaaggcttccttttggatggtttcccacgcaccgttgagcaggctgacatcttggctaacctgctttccgaagctggccagaccctcgatggtgttgttaactaccaggtttctgaagacgtcgtcgtggagcgcatgctgtcccgtggtcgcgctgatgacaacgaagagaccatccgcacccgtctcggtgtctaccgcgacgagactgctcctctgatcgatcactacggtgacaagatcatcaacattgaggctgaaggcgaagtcgaagagatcaacgctcgtaccctcaaggcactgggcaaa

SEQ ID NO: 620 - DNA, 612 bp, Corynebacterium glutamicum
ttgctatctacctatcatcgtagattcagcagcactagagaagaaatcttatttgcccagtgccttgagggtacgagcgttgatctcttcgacttcgccttcagcctcaatgttgatgatcttgtcaccgtagtgatcgatcagaggagcagtctcgtcgcggtagacaccgagacgggtgcggatggtctcttcgttgtcatcagcgcgaccacgggacagcatgcgctccacgacgacgtcttcagaaacctggtagttaacaacaccatcgagggtctggccagcttcggaaagcaggttagccaagatgtcagcctgctcaacggtgcgtgggaaaccatccaaaaggaagccttctgcagcatcggactcagcaaggcgggaagcaaccatacgtgcagtcacgtcggttggaaccagcttgccagcgtcgatgtactgcttggcctcgatacccagaggggtaccttcgccaatgttggcgcggaaaagatcgccagtagaaatgtgaggaatgccaagcttctcagagagaattgcagcctgggtgcccttaccagcaccgggaggtccgaggagtacgagtcgcattattttagaagtccttcg

SEQ ID NO: 621 - DNA, 792 bp, Corynebacterium glutamicum
atgggtttccgttccaagaagaaggttattgcggcaaagaccgccgctgagctggacgcgatgcaggcggcgggtgagatcgtcggcaaggctttgcaggctgtgcgcgctgaggctaaagctggcatgagcacgtgggatctggatcagatcgcggagcaggttatccgcgatgctggcgccgttcctacattcctgggttaccagggttttccggcatcagtgtgcgcttcggtcaatgaggtgattgttcacggcattccatccaaggagaccatcttggaggaaggcgatctggtgtccatcgactgcggcgcaacctttgatggttgggtcggcgattccgcgtggagcttcggcatcggcgagctggacgaggacgtccagggtctcaacttggctaccgagtgggtcctcatggaaggcatgaaggccatggttccaggcaaccgtttgaccgatgtctcccacgctctcgaggtcgcaacccgcaaggctgagtccaagttcggcgtcgcgctcggcatcgtcgatggctacggcggacacggcattggccgccacatgcacgaggagccatacttggctaatgagggcaaggccggcaagggccctgtgattcaggagggctccgtgctcgccattgagcctatgctcaccctcggcaccgaagattccgcagtgctggaagatgattggactgtcgtgactctcgacggttcatgggcatcacactgggagcacaccgttgcagccaccaagggcggcccgcgcatcctcacgccgcgttat

SEQ ID NO: 622 - DNA, 828 bp, Corynebacterium glutamicum
gtgccgccaggggaggaggcgataaaacttttttacctttcgaatatcaaaatcataaaacagccttatatacttcaacgtatggcgaagaattctcgaatccgatacagcgcgtcaatcaagcgtgccgcagctgcaatcctcaccgcagctgctacctcagtcgcgttgatcgctgtgccagcaactgcttcagcacaggacctcgcaaccggcagctcccagatccagactgatgctcgtgaaggtgcgtgggcaacccgcaacaccatccaagaccaacttgcctccattgggccagcagccctcccagtccgcgcagcggtagacaatgccatcaacggcatgttcccaggacttgttgatgaaaaggttgcagcagagcaggaagctgcacgcgcagaagctgagcgcgaagcagcagctgcacgtgaagcagaagcagcccgcgtagccgcagaagaagccgcacgctttgaccgcggctcttgcccagcaatcgctgatgtctgcgtggacattgatggtggacgtacctggctgcaggaaaacggtcaggtcacctacggtgcagtcccagtttcctccggcggagttggccaggaaacccctcgcggaacgttctacatcaaccgcaaggtcaaggatgaaatctcttacgagttcggtaacgccccaatgccgtacgccatgtacttcacctacaacggccacgcattccaccagggcaatgttgcgactacttccgctggttgtgttcgcctaaacactcaagatgccatctactacttcaacaacgttggcatcggcgacatggtgtacatctac

SEQ ID NO: 623 - DNA, 216 bp, Corynebacterium glutamicum
atggctaaggaaggcgctattgaagttgagggtcgcattgtcgaacctctgccgaatgcaatgttccgagtcgagctcgacaacggacacaaggtactcgcccacatcagtggaaagatgcgccagcactacatccgtatccttcctgaggaccgcgtcgttgtagagctgtcgccctatgatctgactcgtggacgaatcgtttaccgctacaag

SEQ ID NO: 624 - DNA, 366 bp, Corynebacterium glutamicum
atggcacgtctagctggtgttgacctcccacgcaacaagcgtatggaagtcgctctcacctacatctacggaatcggcccagcccgttccaagcagcttctcgaggagaccggaatctccccagacctgcgcaccgacaacctcactgatgagcagatcgctgctcttcgtgacgttattgaaggcacctggaaggtcgagggtgacctccgccgccaggtacaagctgacatccgtcgcaagatcgaaatcggctgctaccagggtattcgccaccgccgtggcctgcctgttcgtggtcagcgcaccaagaccaatgcgcgtactcgtaagggtcctaagaagacgatcgccggaaagaagaag

SEQ ID NO: 625 - DNA, 402 bp, Corynebacterium glutamicum
atgcctcctaaagcacgcactaacgcgcgccgcacaggccgtcgcgttgtaaaaaagaacgttgctaacggcaacgcttacatcaagtccacctttaacaacaccatcgtttcgatcactgataccaacggtgctgtaatctcttgggcttcctctgggcacgtcggattcaagggctcacgtaagtccactccgttcgctgctcagatggctgcagagaacgctgcccgcaaggcaatggatcacggcatgaagaaggttgacgttttcgtcaagggcccaggatcaggccgcgagactgcaatccgttcccttcaggctgcaggcctggagatcggttcaatctccgacgtgaccccacagccacacaacggctgccgtccaccaaagcgtcgtcgcgtt

SEQ ID NO: 626 - DNA, 603 bp, Corynebacterium glutamicum
atggctcgttataccggcccagcaacccgtaaatcccgtcgtctgcgcgtcgaccttgttggtggagacatggcgtttgagcgccgtccttaccctccaggacaggcaggccgtgcacgcatcaaggagtccgagtacctgctgcagctccaggagaagcagaaggctcgtttcatctacggcgtcatggaaaagcagttccgtcgttactacgccgaggctaaccgtcgcgcaggcaagaccggtgagaacctggtcgtcctgctcgagtcccgcctcgacaacgtcgtgtaccgcgcaggtctggcaaacacccgtcgccaggctcgtcagcttgtttcccacggtcacttcaccgtgaacggcaaggcaatcgacgttccatctttccgcgtttctcagtacgacatcatcaatgttcgtgagaagtcccagaagatgaactggttcgaagaggctcaggacaacctggccgacgcagtcgtcccagcttggctccaggtcgttcctgagaaccttcgtatcctcgtgcaccagctcccagagcgcgcacagatcgatatcccactgcaagagcagctcatcgtcgagttctactcgaag

SEQ ID NO: 627 - DNA, 1014 bp, Corynebacterium glutamicum
atgctcatttcacagcgcccaaccatcaccgaggaatttgttaataacgcacgttcccggtttgtcatcgagccactggagccaggttttggctacaccctcggtaactccctgcgccgtaccctgctgtcctccattcctggagcagcagtaaccagcgtcaagattgacggtgtactccacgagttcaccaccatcagcggtgttaaggaagatgtctctgacatcatcttgaacatcaagggattggttttgtcttctgattccgatgagccagttgttatgcagctggtcaaggaaggcccaggagttgtaactgcaggtgacattcagccaccagcaggcgtggagatccacaacccggatctgcacattgcaaccctgaacgagaccgccaagattgagatcgagctcatcgtcgagcgtggacgtggctacgttcccgcaactgttactgcaaccggtggagagatcggccgcattccggtcgatcagatctactccccagtactgaaggtcagctacaaggttgaagctactcgtgttgagcagcgcaccgactttgacaagctggtcatcgacgttgagaccaagaactctattaccgcacgtgacgccctggcgtcggcaggtaagaccctggttgagctgttcggcctcgcacgcgagctgaacatcgcagccgagggcatcgagatcggaccatctcctcaggagaccgagtacatcgctgcctacagcatgccaatcgaggatctggacttctctgtccgttcctacaactgcctcaagcgcgaagacatccacaccgtgggtgaactcgcagagcgcgctgagtccgatttgctggatatccgcaacttcggacagaagtcgatcaacgaggtaaagatcaagcttgctggcctgggtctgaccctgaaggatgctcctgaagacttcgatccttcaactcttgaaggttatgacgccgaaactggtggctacatcgatgtcgaggcggaagattccgag

SEQ ID NO: 628 - DNA, 156 bp, Corynebacterium glutamicum
gtgatggttgggcgctgtgaaatgagcattgaactctccttgagtgacgaccgctatttgacgtcggtaaaggtttctaaaaccatgaaggatgtttggaaaatcgaaagattcctgtgcacccggggcagccgggtaagcaaaaactacttcgag

SEQ ID NO: 629 - DNA, 489 bp, Corynebacterium glutamicum
atgcctacccctaagaagggcgcccgcctcggcggatccgcaagccaccagaagaagatcctctctaacctggctgcatctctgttcgagcatggcgcaatcaagaccaccgatgctaaggcaaaggctctgcgtccatacgctgagaagctgatcaccaaggctaagtccggttccgttgcagatcgtcgtaacgttctcgcactggttcctaacaaggaaatcgtggcttacctgttcaacgaacttgctcctaagttcgagaaccgtccaggtggttacacccgcatcatcaagctggagaaccgtaagggcgacaacgctcctatgtcccagatctccctcgttctcgaggagaccgtctccgcagaagcatcccgcgcaacccgcgcatctgcttccaagaaggctgctgaagaggctgagaccgaagaggtagtcgaggctccagctgaggagaccgcaaccgaagaggctgcagaagagaag

SEQ ID NO: 630 - DNA, 867 bp, Corynebacterium glutamicum
gtgcgaatccggctggatctagcgtatgacggcacggattttcatggctgggcgaagcaggggaccagcgatctacgcaccgtgcaaaaagtgttggaagacaatttgagcatggtgctgcgtgagactgttgaattgactgtggccgggcgaaccgatgcgggggtgcatgcggcgggccaggtggcgcactttgatattccggcacacgctttagagcagcgcagtattgatggcgatccaagcaagttggttcggcgcttgggtcggttgctgcccgatgatattcgggtgcatggcgtacgttttgccgagcccgggtttgatgcgcgattttccgcgatgcgcaggcactacgtttatcgcattacgacgcatcccgccggcgcgctgcctacgcgccgccacgacacggcgcagtggccaaaacctgtcgaactagagcggatgcaattagccgccgatgcactgctggggctgcatgattttgtggcgttttgcaaagctaagccacatgcgacgacggtgcgtgaactacaaaaatttgcgtggaaagacgtctccactgacatcgaaccgcaggtgtatgaagcacacgtggtggccgatgctttttgctggtcgatggtgcgctcgctggtcggctcctgcatggccgtgggcgaaggacgccgcggatcagggtttactgcagaattgcttgatgcaagcgaacgcagccccatggttccagtagcacctgcgaaaggtttgagcttggttggcgtggattatccttccgctgataagttacaggaaagagcgctggaaacccgagctgttcgcgagtttccggacgcgtccgcgagcctaaaactagatgatgag

SEQ ID NO: 631 - DNA, 2397 bp, Corynebacterium glutamicum
atgctgacgacactatggattgcggtgttggtatttaccgttccaggattggtcgtctcgtgggtttctggccttaaagtgccctgggctatcgcagcctccatcccagccaccttcggtatttacggcctgtccgcctggttgctgggcttgtgggagatgcgttttgatctccattctgtagttatttccacattggttttcgctgcggttgctttggtatggcgcttgttttttgtcggtggttggcttgtacgtcggcgtaaagcacgtatccgcaggcagacgctcgcggatgaagagcgggcagaaaatgctgaggtatctgcaggggagcctgccgaatcgagcacaaacgaagcagccgaatctgaatctgaaacctcggagcgtcgcggaatctggcgcgtgatctttgattacatgcgcgacggtggcatcttggatcaccgttggctgctgcctgccgcaggtgctatcactggtgcgtggctgatcattgatcgtgccgttgatctgctcttgagcaccgagcatggtttgggcgatatcgtccaaggctgggatgtccattggcatgcttcgactgtccgttttatagatgagaccggcattgcgtcatccacgatgatggggcagctgcgcaatattgaaacgcagcaagatctgttctacccaagcgcatggcatgctggtgcatgggtgctgtcggatgtcggaaatctgacgattgttgaagccaccaacctcactggcattgtgctgtccggattgttgctgccgttagctgttgcactgattgcatggcggatgatcaacaatcgtggactgaccgcgcagattggtgcgggctttgctggactgatcaccattgcctctccggtactgttctgggttggtaactacgtgggtgcgtggccttatgttgctgcgatcggtgcttcaggtgtggtgcttgcgctgtttatgtccactccgtctgtgccggtaagaatctttgccgcagcattggcgttcatgggtatgttccagctgcatccagccccatccaccatcgtgatcatggtgttgctgctgtggtggctgctcaaactcgtggtggttccaagccagaaagtgaagggctggaaggcgggcatcggtatccgtttgaaggatgtcggcatcctggccatcacgggcatcatcggtgtgctcttcatgctgcctcaggtgatttcaggttccgaacaaaccgaagatgtgctgtcatattctgctgaggaacaagtcacccgcagcgagtcctggttggtgtctattttcatggagacccgccatgttgatttcttcggaaatattgacatcgtcccagtgctggtattcgcagcaatcggtggcgtggttgctttggtgtggcgcggaaacttgtgggcgccggtgttttacttcgccagcgttgcgttgaccgctaactcgctgaagccttttgaagagccgtggggtgattggctcaacatcgtgggcggtctgcattactccacaggacaccgtttgatcatgcctgtcgccatgttcacttttgctgccgcaggtatcggcgctgccgcagtgatccgtttgatctgcttgggaccaataaagaagttcaccactgtttccggtgttgtttctgtggtgatggctcttgttgtggctgtgccattgcagacttgggcgaaggattttgtagaggaaggatccgaaaccacaatccttgcgccacacaatgatgaacgtatggtgagcaacaacgacttggctgcctgggactggttaatccaacagccaggtggagctgacatgaacatcatgggtgaccccgcagatggtaacggctggatgtatgcctacaacggcttgcactccgtggcccgccactatgcatggccagcagcaggcgaaggctctgccaccgcgatgctgttctggtggcctcaacttctaggtgtgggcaccgatgaaaacccagatcaagtcaacgatgtggatcaggctgctcgtgatctcaacgtcggctacttcatgatcagtccgtggacgttctgggatttccagatccccaacttccgccagatcgatctgctgtggcaaaccccaggcgtgacaccggtgtacaagaagggcgactcggtgatcttcgcagtcaacgatatgttcactgacgccgaactggatcagatgcgtgcacctggtaattctccagaaccactgccagagcttcctaccttgggcgagcttgggttggctgaaactgaagacgaggtagatcagacttattaccatcgtccaacggttcctgctggtgtgaactcagagatgccttcagccgaaactctgtatgcaccggatccaacgaagccgcatacggtccctaac

SEQ ID NO: 632 - DNA, 456 bp, Corynebacterium glutamicum
atgtggaaagacttaaccgaaccgctgcccgaagcttgcgctgagggcttagagatccgggtggttaaatctcccgaagagctggcagattacgctgcagttctttctgcgaattggaatccacccgccgaaactgtgcagcgtttctataccgaagcagctgaatacgcactgagaaagaactcgcccgcactttatctggtgggttatgcgggcaaccgcgcagtgtgttctgcggaagcattcatacacgcgagcgtagttggaatctacaatatctccacccttgagcacaaacgccggcgtggctacggcggagccatcaccttagccacgttgcataccgcacgtaacgcagggtgtgacaccgccgtgttgcaagcttccgaagatggtgagcccgtttatcgcaaactaggattcaccgactgcggtcgatttactgaatactctttg

SEQ ID NO: 633 - DNA, 303 bp, Corynebacterium glutamicum
atgaaggacctcggtaaattacaacgcgcaatcgaagagaacttagcggagcatttctgccatctccaccggcatcttgcatccgcaacaatcacgcacaccgatggcctgctcatcgcagacagtagcctcgacgatgacacgttcaacattattgcgggcgcacgctttacccctgagattgcagctgcgcggattgctgaaaccaccgcttttgtagaacatgcactccgtccgttttcctggtgggtcggccccgcatccagccctagaaatatcggagagctgctcgttgaggcccaa

SEQ ID NO: 634 - DNA, 1257 bp, Corynebacterium glutamicum
atggctgaaggcatgttgatgcccacgacatcggcgcaggtgtcggggcataaatttctggtgcggcgcatcgaacatgggttggtgatgggcgatgtgcgcatgattcatgatccacttggtaggcgccggcgggcgttggtgtttggggtggtggcgtgcgtgatgttggcggtgggatcattggcgttggctatttttcgacccgcgaaggatccggccgatgcgccgttgatccgctctgaatccggcgcgctctttgtgcagctggatgggtcggtgcatccggtggctaatgtggcctcggctcggttgattgtgggggagccggtggatccggtgaacgccagcgatgcgatcatcgcgggcatgccgcgcggagtgccggtgggggttcctgatgcgccggggcttttcagcagcaccgaagaacccgagcaagattggtttgtgtgccaggatgtcggcactggggatctacacattacggttcctaggggcggactagggcccaccctgattgcggaaggaaatgggtggctgggggcgtcgaaaagcgaaaccggcgaggtcacctggaacctgattaccgcggacgggcgccgcgaactgccggcgtggggcagcgaacatgggcgcattatgcgccgccacctggggatttccgaggacaccccgcgcgtatacctgaccactgagctgctcaacgcgatccccgagcacgacgcggtccgcttcccagccccgctgcccgagcttgtcgacgcctccacccgcaactggttacggctcgacggggcgctcgccgaaatcacgccgctacagcgcgggttgcttatcgacgccggttccggtgttttccccgaccccaccgcgcttcttggtgtgcatgaagaaacagccaacaccttgacgctgcccgagcaaacagtttcttggcaagatctggacggtggttttgcctgcgcggatggtgaaggccagatcggtttcctggaaactctggaatcgggggtggcgctatctggtgattccagggcgaaaagtttcagcacaaacgctggtggggcagtgggcgtggacagtggctttggctactatgtggtctctgattttgggctgatgcaccctgtttctactggtgaatcgatggttgccctaggaatcactgacgtgcaggtcgtgccgtggagcgtgctgcgattgttgccgcagggaagtgaattagcaaaagagacagcgctcgcgcccacctat

SEQ ID NO: 635 - DNA, 1545 bp, Corynebacterium glutamicum
atgagcggattagttgacccggatagtacttttttaaagaccatcggaaaactgagcaacagcttgtccattggtcgtggagtagatcaaaaagaggtaatccccaaaggctggaacgcccattgggaggcaattacaaagcttaagagaagctttgacgcgattcctgctggggagcgggtgcgtttagctaagaaaacctccaacctgttccgtggacgctccgatgcaggtcacggcctagatgtggcagcgcttgggggagtgattgccattgatccggtcaatgccaccgccgatgtacagggcatgtgcacgtatgaagacctggtagatgccactttaagttatggtctgatgccgttggttgtgcctcaactgaaaaccatcacgcttggtggcgcagtgaccggaatgggcgtggaatccacatccttccgcaacggtttgccacacgaatcagtgctggagatggatatttttaccggcactggtgagatcgtgacttgctcgcccacagaaaatgtcgacctttacagaggttttcccaactcttatggttcgctgggatacgcggtgcggctaaaaattgagctggaaccagtgcaagattacgtccagctgcgccacgtgcgcttcaacgatttagagtctttgaccaaagcgattgaggaagtcgcgtcttctctggagtttgataaccaacccgtcgattaccttgacggcgtggtgttttcacccacggaagcctacttagttcttggcacgcaaacctcacaacctggccccaccagcgattacaccagggatttaagctactaccgctccctgcaacacccagagggcatcacctatgaccgcctgacaatccgcgattacatctggcgctgggacaccgactggttctggtgttcacgcgcattcggcacccaaaaccccgtggtgcgcaaactctggcccagggatctgctgcgctcgagtttctattggaagatcatcggctgggatcgaaaatactccatcgctgatcgcctggaagagcgcaaaggccgcccggctagggaacgggtggtccaagacgtggaagttacgattgataaactgccagaatttttgaaatggttctttgaaagcagcgacatcgagccgctgtggctgtgcccgatcaagcttcgggaggtaccaggtagttcggttggtgctggagaaattttgagctccgctgaagcaatcgactccggtgctgctgaacacccttggccgctgtatcccttgaagaaggacgtgctgtgggtcaacatcggattctggtcctcagtgccggttgatctgatgggctccgatgcaccagagggagcatttaacagagaaatcgaacgcgtcatggcagagctaggcggacataaatcgctgtactccgaagcgttctacaccagggaagactttgaaaaactttatggcggaaccatcccggcgctgctaaaaaagcagtgggatccccacagccgattccccggtttgtatgaaaagacagtaaaaggcgcc

SEQ ID NO: 636 - DNA, 1353 bp, Corynebacterium glutamicum
ttgtggccacattttaaaaaaatgcacaagaagagaaagcaaagcattatgagtaacgccgtagcgcaggacctcatgaccatcgccgacatcgtcgaggccacgaccactgcacccatcccattccacatcactgccttcgatggaagcttcactggccctgaagatgctccctaccagctgtttgttgccaacacggatgcagtatcctacatcgcaacagcgccaggagatttgggtttggcacgtgcctacctcatgggagacctcatcgtggaaggtgagcatcccggccatccttatgggatctttgatgcgttgaaggagttctaccgctgcttcaaacgcccagatgcatccaccaccttgcagatcatgtggactctgcggaaaatgaatgccttaaaattccaggaaattccaccaatggaacaagcccctgcatggcgtaaagcactgatcaacgggctagcatccaggcactcgaaatcccgcgacaagaaagccattagctaccactacgacgtgggcaatgagttctactccctgtttttagatgattccatgacctatacctgcgcgtattatccaacgccagaatcaagtttggaagaagcccaagaaaacaaataccgcctcatctttgaaaaactgcgtctgaaagaaggcgatcgcctcctagacgtgggatgcggttggggaggcatggtccgctacgccgccaaacacggtgtgaaagccatcggagttacgctgtctgaacagcaatatgagtggggtcaagcagagatcaaacgccaaggtttggaagacctcgcggaaattcgcttcatggattaccgcgatgttccagaaactggattcgatgcgatctcagcaatcggcatcattgaacacatcggtgtgaacaactatcccgactactttgaattgctcagcagcaaactcaaaacaggcggactgatgctcaaccacagcatcacctacccagacaaccgcccccgccacgcaggtgcatttattgatcgctacattttccccgacggtgaactcactggctctggcaccctgatcaagcacatgcaggacaacggtttcgaagtgctgcacgaagaaaacctccgctttgattaccaacgcaccctgcacgcgtggtgcgaaaacctcaaagaaaattgggaggaagcagttgaactcgccggtgaacccactgcacgactctttggcctgtacatggcaggttcggaatggggatttgcccacaacatcgtccagctgcaccaagtactgggtgtgaaactcgatgagcagggaagtcgcggagaagttcctgaaagaatgtggtggactatc

SEQ ID NO: 637 - DNA, 426 bp, Corynebacterium glutamicum
atgggcacgatgcgagaaatggtcagtgaccgcattgaccgactacaagaagcacacgcgcgatcaaagcagaagaagttcggcttcttagttcggccaggcaccctgatccttggatggttggtcacgatcatcggtctgatcaccattccacttcccggccaaggctggctgaccaccttcattggtgtgggcattttgtctctggagcttaaatgggcgaagaacctcctggcctggggagtgcatcagtatgatcgcttcttcacctggtacggcaagaaatcattccgcttccgcatggcgatgttggcactgatgattctgctgatttgggtggtgttcatcgtgacattttggttgatgtggcacgccggaactatcccgtgggcagatgagttcttcacctggcttgggttgagccgc

SEQ ID NO: 638 - DNA, 1359 bp, Corynebacterium glutamicum
ttgtgtggcttgaaaggttggaatcactgtgtcttgcagctagtctgccactcgcactgcatttgctggatgtatttggaatgctgcgcggtcttgatattggattcggtggataagatgcgcagactcatcgcggttagcttggccgctctgtttatgttggcttccactccagcgacgagggcacaggaagtagaagctctcgcttgccccgaggtagcgatcgccgatccttcctccgcagttttagatgaacacctttcgcagtcattatcccaagctcaccaactagcaactggcgccggtgtgatggtggcagtcatcgacaccggagtatccctgcatccacgtctgccccacttaattcccggcggtgatttcgtgggcgcccaccaaagccccgatgtgccaggtgaacttatcgattgcgacggccacggcaccatcgtcgccggaatcatcgcctcccaaggaaaccccggcaccggctggccatatgacggcagctccgatccttatatcggtgtcgccccagattccggaatcatctccattaaacaaaccagctcatatgtgcgtactcgtgaagattccaacgtcggaacgctgagcaccctggcggaatccatccaccgagctctcgattccggtgcccacgtgatcaatatttccgtggtgtcctgtttgccccaatcacccgacgaggccgcatcgttccagcctctgacggatgctcttaacagagcagaacttcaaggggtgatagtggtggcagcagcaggaaacctcgggcaggattgtccagttggatctaccgtttatcctgcacattcagacactgtgctctctgtgtcggcacgttttgattctcacacgcttgcagaatattccatgcctggcaaccaacaaatcctctctgcaccaagccacattcaggctggtctatcaccgcgtggcgacggcttcgccagccacatgatcaccaccgctggcgaaagccccttcgagggcaccagttttgccgctccagttgtcagcgccacagctgcactgcttcgccagcattttccctttgccacaccctatgaaattcgtgcacgaatcttcaacagcatcgaccctgcaagaggcgctattgatccctacctggcacttactcaagaaatctatcccaccactcccctggttcatgagatcgcactaagtgttcccacgccgccggatgattctccacgggagcggggcatcctagttaccgcaatcattgttgggttgctcgcagtgttagctgtgctgatgggactacgccgaattcatcatcactcggcctttcaaaaagctagctcaagtgttatcact

SEQ ID NO: 639 - DNA, 1371 bp, Corynebacterium glutamicum
ttggcaatcgataatgcgctgcgcgtgagcatccgcatagatctcaccgttggcgatgcgcccgctgctgtggctgatgtggcgctacctgcaggttcgagtctggcggacattttggatgaaattttagaactcaccgatgcaccccggatttccaggccgtgggtggctcacactgctgcgggaagtcccattgattgcgggattccgcttgcagaaacacaagtggaacaaggcagcgtggtggtcctttcacccgaaagggacttggaagcccccgtgttgcgtgatgtcgccgaagcgttggtggagttttcttccacgaaccgcgccgggcacctcgtggaattgatgactttcgcggggctcatcggggctgccgtgttaatgacaagtcctgctgcctccggaattattgtgcccggccgcatgggaatcttcgtcgcaatctgcgctctactgcttctgtggctcccacccgcgcacaccccgatccttcgaaacgtcctgccgattaccctgatcttgggcgcaggcggagcggtatcagtgctggttgcaggcacttctgggacttctcccggcgcgcttacctggacgattttcgctggcgcgtgcactattcttgccagttcgctgctggttcatgtggtgtatcgtccagcaattcttctggtggcaacactgtccacattggggctcggtctcttagtccttgcagcaaccaccactctgtggaagctcaaagctaccgaagatttcagcggtccagcagcgatcacggtcaccgcttccaccatcaccatgtgcttcgccccgaaaatcgcagcatcgctagcaggcctgcgcgtcccatcgcttcccaccgccggcgaagatctctccgtcagcgacctcaccatgactgatcccgagaaaagaataaaaacaacaaagacgcttttcgacgcccagatccttggccttggcgttttgagcgggcctttggcgttgttgtcggttaccccgggcacctggacaaccaccgtttttagtttatgcatcgcggtggcttcgctgcttcacgctaatcgtcatcaagcaccaattcccacgtggacattgatggggttatctgcccttggtttcatttccatggcgttatccgcaagccgatcaggttcactaattgcactgatcggttctgtggttatcatcgctgtgctggtcagcgtggcattgtggatcagtacagtccccacgctggaacccaccaccattgtgtggcttgaaaggttggaatcactgtgtcttgcagctagtctgccactcgcactgcatttgctggatgtatttggaatgctgcgcggtcttgatattggattcggtgga

SEQ ID NO: 640 - DNA, 3567 bp, Corynebacterium glutamicum
gtgacgtggccagaacgcgatccggcgccaccgctgccaacggagccgctgatcgctgaagctgtgccacaagcggtacgtccagcgccgaaaccactgctcaaagtattgatgcctgtgatcatggtggccatggtggccatggtgctggcgatggtggcgctgatgatccttaccagtgggcagttaaatcctatggtcttgatttttccaatgatgatgggtatgagcgtcctgatgatgttcgccccacctgaaggtgacgatactgatgaggttcggcgcacctatttacgtcacctgggtgcattgcgggcgaaagcgacagatcacgcggcgatgcagcgcaggcatgaatggcacaggcatcctgatccagcaaccttgtggtccacgttggggactcggcggatgtgggagcgcacccaagatgatcaagattgtttggaaatccgttttggtttgggcgtgaccaggcttgatccggctattaacgtgagtgattcgggtgcgccggaggatcttgatccggtatgtgcggtgtcgttgcgtcacaccattcgggatgtggggtcggtgcagagcatgccggtgtcggttcagttgcaggcgtttcgattcattgggctcaacggtgcgggcgcacatgatctggcgcgggcgctggttgtgcagttgttgtaccaccacggaccggaggtggtgggtatcaaagcgatcggggagtcgggttgggagtggctgaaatgggtaccgcacacccgcgatccggagaaggcagcctttcggattttgctggtggattccgtgttgaccaacggcaccgaaagcttcattgatgacccccaatggaccacgatcatcaacgttggcgcgcagaccagcaccgcattgggccagctggcagaggatgaagggctgctgttgcacgtcgataagcgtctgcatgtggctaccgcgcacggcgcggaggagctgggcacgccggatgcggttagcgctgagcttgcggaggtttttggccgccgtttgactgcttttcgacgcacaaccacagcacacgcggcgagctctggtgaattgctgtcccttttggggattgatgacgtggagcatttaactccagaaaccttatggatgaacaagcgcacgcagcctaaaactcgtttggcggtgcccttgggtttgaacgcgtccggtcggccgatggtactggatctgaaggaatcggcgcacggcggaatgggaccacatgggctgtgcatcggcgctactggcagcggaaaatccgaacttttaagaacacttgttctaggtttgacgatcacccattcgcctgaggaattgaatctggtgttggtggattttaaaggtggcgccacctttttgggcttcgagcagctgcctcacacgtccgcggtgatcaccaacttggaggaagagtccgtgctggtggagcgcatgcatgatgcgatttcgggtgagatgaaccgcaggcaagaagcccttcggcaggcaggtggctgcgccaatgtggatgaatacaaccagcgtgatggtgtgaaaccgatgcccgcgctgctcattgtgatcgatgaattctcggagttgcttggccaacatcccgatttcgcagacctattcgtcgccgtcggacgcttgggccgttccttacacatccatttgttgctcgctagccaacgtctggaagaggggcggttgcgcggattggattcccacttgtcctaccggatcggcttaaaaaccttttccgcatccgaatcgcgccaggtattaggcatcactgacgcatatcaattacccagccaacccggcgcaggtttcctcaaatccgacgtcgacaccgtcacccgcttccaagcaagttatgtatccggccccatcatgcgtcgccatcacctcgcaccaacgcagtcccgggtgcgcctttttaccagctgggaggaacccaaagaggaggtgattgtcgagcaaagcaccgagacgcttatcgacgccgtggttgcgcgcgccatcagcgccgcgaagttgcgggggttaagcgctcatcgcatctggttgccaccgttgccggcagaagtttcgattggtgctttggctgatgatgtcggtgagctaagcgccgtgatcgggatgatcgatagaccctatcaacagcgacaagatccattgctgattgatttttctctcaacggtggaagcggacactgggctatttgtggtgggccccaaaccggaaagtccacggcattgcgcagcatcgtgatctccatggcagcaacgcatagcacagaaaacatccgcttttacgtgctggatttatctggaacctccctggaaaatctctcccggctgcctcatgttgcaggcgtggcaggacgcaaagatccagagaaagtccgccgagttgtcgatgaagtacgaggcctgatcaaccaccctgaacaacgccacaccttccttattgtggacggctggcacaccatcacccaagaattcgacgagcttttcgacgccttcgtagacatcgccgccaacggccttgcctcgcgggtgcatttagttttaagcactcaacgctggagttccatccgccccgcggtccgcgatctggtgactggcagaatcgaattgaaactcggcgaagccatggattcggtgattgatcgtaaagctcagcttcggatcccgtcgaaacctgggcgtggcctcaacctggataaagaacacatccttattgctcatgcgtctggccaagacatcgcccaggtatgcgtcatggccgatgggcaaggatggcagcaggtcccacaattaagcgtgctgcctgcgcatatcctgcttcacgagcttgagctttctgcgacacctggcatcccgattgcacggggaggtgctgaactatccacgctgacgtgggatccagaatccagccgccaccttctagcttttggttctcaaggttgtggcaaatcctcgctgatccgcacgattgtcacgggtctgacaattgtggggcgggagaaagcacgcttggtatttttcgaccttcgacgcacccacctaggcctggtccccgaagacatgttggctgcttattgtgctacttccacagcagtccacaacaccatcaaagacatggtggctacgctatccgccagacttccaggacctgatatcaccgcccaagaactccgcgatcgttcctggtggcaggggcccgacatttatttagttatcgatgattatgatttgctccccgccggcaccctgcacccgctgcgcgagatcatcccgcatgcaagagacgtaggcctgcacatcgtgctcacccgcaaagccggtggcgcctcgcgtgcgctctacgatccggtcatgtccgagatcaaggaccaatcaccgcacgtcgtgcttttcgacgccgaccgcgacgaaggcgctatcctaggcatcaaacccacagcacaaccaccaggacgtgccacgatgtccatccgtggtgaaaacatcggtgttgcacagatggcacgcataggtgatgactca

SEQ ID NO: 641 - DNA, 822 bp, Corynebacterium glutamicum
atgctccacgtcatcaatccccaaaagggacagcaattcaccagagctcgccgcgtgtgctgtggttgtgcgtcgaaaagcagtcaaacggcggccaaaaacctccgcaagctcagcgctaaccgcatccggcgtgcccagctcctccgcgccgtgcgcggtagccacatgcagacgcttatcgacgtgcaacagcagcccttcatcctctgccagctggcccaatgcggtgctggtctgcgcgccaacgttgatgatcgtggtccattgggggtcatcaatgaagctttcggtgccgttggtcaacacggaatccaccagcaaaatccgaaaggctgccttctccggatcgcgggtgtgcggtacccatttcagccactcccaacccgactccccgatcgctttgatacccaccacctccggtccgtggtggtacaacaactgcacaaccagcgcccgcgccagatcatgtgcgcccgcaccgttgagcccaatgaatcgaaacgcctgcaactgaaccgacaccggcatgctctgcaccgaccccacatcccgaatggtgtgacgcaacgacaccgcacataccggatcaagatcctccggcgcacccgaatcactcacgttaatagccggatcaagcctggtcacgcccaaaccaaaacggatttccaaacaatcttgatcatcttgggtgcgctcccacatccgccgagtccccaacgtggaccacaaggttgctggatcaggatgcctgtgccattcatgcctgcgctgcatcgccgcgtgatctgtcgctttcgcccgcaatgcacccaggtgacg

SEQ ID NO: 642 - DNA, 663 bp, Corynebacterium glutamicum
atgcacagcccatgtggtcccattccgccgtgcgccgattccttcagatccagtaccatcggccgaccggacgcgttcaaacccaagggcaccgccaaacgagttttaggctgcgtgcgcttgttcatccataaggtttctggagttaaatgctccacgtcatcaatccccaaaagggacagcaattcaccagagctcgccgcgtgtgctgtggttgtgcgtcgaaaagcagtcaaacggcggccaaaaacctccgcaagctcagcgctaaccgcatccggcgtgcccagctcctccgcgccgtgcgcggtagccacatgcagacgcttatcgacgtgcaacagcagcccttcatcctctgccagctggcccaatgcggtgctggtctgcgcgccaacgttgatgatcgtggtccattgggggtcatcaatgaagctttcggtgccgttggtcaacacggaatccaccagcaaaatccgaaaggctgccttctccggatcgcgggtgtgcggtacccatttcagccactcccaacccgactccccgatcgctttgatacccaccacctccggtccgtggtggtacaacaactgcacaaccagcgcccgcgccagatcatgtgcgcccgcaccgttgagcccaatgaatcgaaacgcctgcaac

SEQ ID NO: 643 - DNA, 900 bp, Corynebacterium glutamicum
atgagcacccaaacaatcaccatcacagtcctagaaaccgccaccatctttgacggccctgaaaccatctaccgctatgacctggctgccgaaggcatccttgatggatgggctcactctgctgtgctggatcaagtgaaacaaatagcaggtgaaaactggccgactgttgagatcgtggtggatggcaccgacaacgtagtcaatgcactcacctccatgtttgcttccaaaggcgtgacctgcggtggggttggagtagaagcacctcccgttgcggaggaaccaccgaaaattaaacggcccacgagtggaaaacaagtccgccagttctacggcatcaagccactacacctgttgttggtcagcatattggttggttctattgctggtatttgggtgatttcgggtttcactgggccagtggactcacggccggtagataaggtggcggagatttcaacgcagggggagacgtcgataagcaatcaaccccaaccccagcccaccgtgctcgtgaccgaggacctgcttattgaggcgccatttggttttgaaatgcgaagcgacgaacagtcgcgctacctggaaggccccgacccgaatctgcgcatccacgtgggcgtcgatccgctgcacggcgcggacgccgcgctggttgccgaagagctgcgccgcctgatcaccgaggatccttcgctggaggaaattcccgcaggggagtggggcgagaaaaccaccatcgactaccgcgaaacacccggcgatggctctcatgtgctgtgggtgacctggtttgacaccgaccgacaactcaacgttgggtgccatagcaaagccgccgaaacccttgttcacaaggcacaatgccgaaatgtgattgagcatctgacgctgaaa

SEQ ID NO: 644 - DNA, 324 bp, Corynebacterium glutamicum
atgtcaaatcttttcaggacagaatccgatgtgatgctcgcgacggcgagccaggtagacgacattaacgatcaagttcagggcgaactgagccgacttcgcggagttgttgattccgtacgcggcagctgggccggccaagcacaggtcagcttcgactccctgatgaaccgctggaactcatcagcacgccaactgcaggaagcactggcgtccatctctgacaacatccgccacaacgcgcgcagcttcgaaaacactgaagccgacaactcccaggcattcaacgctgtcggtgctggcgacggcgctggactcccactg

SEQ ID NO: 645 - DNA, 288 bp, Corynebacterium glutamicum
atggacatgatccgctatgaattcggtgccatccaaggtgccgcaaccgacatcaactccacctcaggtcgaatcaactctctacttgatggcctgaaatctcaactgcagccgatggtagccagctgggagggcgaatccagcgaagcatacagcgaggcgcagctgaagtgggaccgcgcagcagcagaactcaacaccatccttgccaccatctccaacaccgttgcccaaggcgctgaacgtatgtctgatgtgaaccgccgcgcagcagcaagctggggtgca

SEQ ID NO: 646 - DNA, 441 bp, Corynebacterium glutamicum
gtgtctacttaccacccgaagagcggtgacatcacccgtaagtggtacgtcatcgacgccactgacgtggttctgggtcgcctggcaacccacgccgctgacctacttcgcggcaagggcaagcctttgtacgcacctaacgttgactgcggcgaccacgtaatcgtgatcaacgctgacaaggttgcagttacctccaacaagcgcgagcgcgaaatgcgttaccgccactccggttaccctggtggcctgaagtccatgaccctgggtcgttccctggatctgcacccagagcgcaccatcgaggattccatcgtcggcatgatgccacacaacaagctcactgctgcttccgcaaagaagctgcacgttttctccggctccgagcacccatacgctgctcagaagcctgaggcctacgagatcaagaaggtggcccag

SEQ ID NO: 647 - DNA, 546 bp, Corynebacterium glutamicum
atgtcagagcctatccagaacgagaacgtagagagcaacgtcgcagacgctgctgacatcgctgcagcaaccgctgcaaccgaggagttcaccaacaccatcggcgatgcaattgctactgcttccgaagaagagaccatcgaggctgcaccagtagtactcgacggcccaatccagaccgttggtcgccgtaagcgcgccatcgttcgcgtccgccttgtagctggctccggcgagttcaagtgcaacggtcgcaccctggaagagtacttccctaacaagctgcaccagcagctgatcaaggctcctttggtcctcctggaccgcgagaaccagttcgacatcgttgcaaccctgaagggtggtggcccaaccggacaggctggcgcattccgcctcgcaattgcacgtgcactgaacgcatacaacccagcagagcgcggcgagctgaagaaggctggcttcctcactcgtgacgctcgtgcagttgagcgtaagaaggctggtctgcacaaggcacgtcgtgcacctcagtactccaagcgt

SEQ ID NO: 648 - DNA, 1341 bp, Corynebacterium glutamicum
atgactcgactatttggaactgatggcgtccgcggactagccaatgaagtactcaccgcacctttggccttgaagctgggggccgctgcagctcacgtacttaccgcagagaaacgggtagatggacgtcgcccggttgcgatcgttggtagggatcctcgagtctctggagagatgctcgcggcagcactttcagcaggcatggccagccagggtgttgatgtcattcgtgttggtgtcatcccaacccctgctgttgcattcctcaccgatgattatggcgctgacatgggcgtgatgatttctgcatcccacaacccaatgccggacaacggaatcaagttcttctctgcaggtggacacaagcttccagaccatgtggaagacgagattgagcgtgttatggacagcttgccagcagaaggcccaacagggcatggagttggccgtgtcatcgaagaagcaaccgatgcacaggaccgttacctagagcacctgaaggaagctgttcctacgtcacttgaaggcatcaagattgttgtggatgcagccaatggtgcggcaagtgttgtagctccaacggcttatgaggctgcgggtgcaactgtaattgctattcataacaagccagactcatacaacatcaacatggactgcggttccacccacattgatcaggtgcaggcggcagtcctgaagcacggtgctgaccttggactcgcgcatgacggtgatgctgaccgttgtttggctgtggacaaggatggcaaccttgttgatggtgaccaaatcatggcgctgttagccattgcgatgaaagaaaacggcgagctgcgcaagaacaccctcgtgggcactgtcatgagcaacctgggattgaagattgctatggatgaagccggaattacactgcgtaccaccaaggtaggagaccgctacgtgctggaagacctcaatgcaggtggattcagcctgggcggcgagcaatctggccacattgttcttccagatcatggcaccactggcgatggaactttgactggtctttccatcatggcgcgcatggctgaaaccggaaagtccttgggcgagttggcacaagctatgacggtgctgccacaggttctgatcaatgtgccagtttcggataagtccaccatcgtgagccacccaagcgttgtggctgcgatcgcggaagcagaagctgagttgggcgccaccggtcgcgttcttcttcgtgcttctggcaccgaagagcttttccgcgtgatggttgaggctggagacaaggaacaagctcgtcgtatcgcgggacgtcttgctgcagtggttgcagaagtc

SEQ ID NO: 649 - DNA, 303 bp, Corynebacterium glutamicum
gtgtctggattcgaacttaaaattggggaatctttagcgacactgcgcgggcttctgggggaaaccgcgcagcaacacagcattcaccggcaacgcgtgccttactattcaccttcggcctctggccgaggatttagcgcgcacggcgtggccttggcggacatgtttgaggggctgcacaggggcgtcgagaagcgtatcgacgcttttacccaaacaacccaagccgccgaggaagaagttaaacgattcgacaataccgacaaagtttttggtgccggatttgatgggattgatccgaag

SEQ ID NO: 650 - DNA, 1509 bp, Corynebacterium glutamicum
gtgaatgatcctttagccggctacggagcagtgatctccgcactacaaggcgccagtggtgggatgtatcgcggaccggcgaaatccgaaggccagttgcgcgagatgtaccaaaccatcgaagggctagacaccagctcgttgcgcgaagctgccgaagcagcagtgggcggaacgaacgaagccagaatacaagggtgggtcggcccgctcttgaaattcttcgggacggttggcgggggaatgatcgccacggagatagctgaacgggcagtcgattggttcaaaaaccgtaatgatgtggaagaagtcagcgaagccgctgataaagccgccgatgcgatcgactccactgtcacagagtccgaccagggcatgatgcacattatccagcagctcttggacattgtgtctacgttgacgcagattcttggcagcatggatcgggggaaatttcctcaagaattccgggactgtgtccaaactggagctgatcttattgaccaggcaggggacatgcttgaaggattgtgcgctgatcgagatgatgcgatttcacagtgtttctccgcgttgaccgatcatggaaaacaagtttgtgaaactgagccaaagccgttgtgtagtgcagcttctgggggttcatctggtggagcgacttcttcggctgcggcctcttcaggtggttcaagctcgagcactgctagctctgggagttctggcggatcgagcagtgctgcggatagttcgacgtcgaccaatgctgaatccagtgttgaaaaggaaaagaccacacctgctgccgttgagaaacctgacgagaaaccagtggagaagccggttgaaaagacgccagaaaagccggtagaaaaacctgtcgagaagcaagagtgtgaagaaaagcctgaccctgacccggaaaaatgcaaaacagagccggtcgagtgtgagccaacaccgaaacctgaaacagagcctgaaccaaaaccgacacccacgcccacacccggaacaccaacaccaatacctgagctagagactgaggattgtgaacctggcaaggagacgggcacagactcagaatctgaatcggaagagtgcgcccccgagctcaatgacgttccagaagagtcggatctgattgggcaactcatcaagggagcaatcggtattgggattgttgttgtaggcgttgggctgttggtgaatttcctggagcagtgcgtccctgtgattgaagaagtacctgtgccggagcccgagcctatacctgaacccgctccgcagcctgagccaacttcagtgaaaccaccagagtctgaactagataaggtggctgagcctgcgccgaagccaattccacaagctaattacactgctgctgcagcaactaactattccgctcccgcgcacgctcccgttgtcccaattacgccggcagcacctgaagttccggcagcaccagaagtgcctgcaccggcggttaatcttcacaaggccggcgggtgg

SEQ ID NO: 651 - DNA, 573 bp, Corynebacterium glutamicum
ttgatgagttgcccaatcagatccgactcttctggaacgtcattgagctcgggggcgcactcttccgattcagattctgagtctgtgcccgtctccttgccaggttcacaatcctcagtctctagctcaggtattggtgttggtgttccgggtgtgggcgtgggtgtcggttttggttcaggctctgtttcaggtttcggtgttggctcacactcgaccggctctgttttgcatttttccgggtcagggtcaggcttttcttcacactcttgcttctcgacaggtttttctaccggcttttctggcgtcttttcaaccggcttctccactggtttctcgtcaggtttctcaacggcagcaggtgtggtcttttccttttcaacactggattcagcattggtcgacgtcgaactatccgcagcactgctcgatccgccagaactcccagagctagcagtgctcgagcttgaaccacctgaagaggccgcagccgaagaagtcgctccaccagatgaacccccagaagctgcactacacaacggctttggctcagtttcacaaacttgttttcca

SEQ ID NO: 652 - DNA, 234 bp, Corynebacterium glutamicum
gtggtagcggtggagtatgcggaatttctccagcagtttcgggagcgcacagctaagcggatggaagagttcgaaaaggcgatcgcttcgactcaacgaaagcttgatgatgtggcggaagaggtggaaaagaagaaacagcctgttgtggttgagtctctggaaaaaccgattcggatggcaaggcgacaacagagaggtcgggggcctgtgaaatcggtactgcgggaagcc

SEQ ID NO: 653 - DNA, 855 bp, Corynebacterium glutamicum
gtggctgagaatctgaacaaacacctgtccaaactgtccaagcgcggaccgcaccgcgtgctggtaggcgatatgaactacgccggcatcccgggcaaaatctacaccccagcagaaggcgacggcatcccaggtgtagctttcggccacgactggatgaaatccatcaagtactaccaccaaactttgcgacacctcgcgtcctggggcatcgctgttgccgccccagacaccgaaaatggcttcatgccagaccacaaaggtttcgcctctgacctcgaatcctccattcagattctcggcggcgtaaaactcggctccggaaacgtcaccgtcaacccagcctgcctcggtgtagtaggccacggcatgggtgctggggctgcagtactatccgcagcaaaccgcgacctcgtgcgcgcagtcggagcaatctacccagcgaaaacctccccctcagcaatcgacgccgccttcgctgtcaaagccccaggcctagtcatcggatcctccagcctcggcctctttgaatccggcgagccagcaaaactcgcagccaactgggccggcgatgtctgctaccgcgaatcagaaaaaggcaaccaacagggcttctctgaagacaccatgttcaaacttgtcgcaggaatcggcagcccacaaaccggagctcaagaaaccgtccgcggcctcctcaccggattccttctccaccaacttgccggagaaaagaaatacaaagcattctccgaaccagacgctgaagctaagaaagttgtctcctacttcggccaggagctgcaggaacatgccttccctaaggacacgtccccattcgcgttccttaacgagaag

SEQ ID NO: 654 - DNA, 1083 bp, Corynebacterium glutamicum
atgaacttgctgaccaccaaaattgacctggatgccatcgcccataacacgagggtgcttaaacaaatggcgggtccggcgaagctgatggcggtggtgaaggcgaatgcatataaccatggcgtagagaaggtcgctccggttattgctgctcatggtgcggatgcgtttggtgtggcaactcttgcggaggctatgcagttgcgtgatatcggcatcagccaagaggttttgtgttggatttggacaccggagcaggatttccgcgccgccattgatcgcaatattgatttggctgttatttctcccgcgcatgccaaagccttgatcgaaactgatgcggagcatattcgggtgtccatcaagattgattctgggttgcatcgttcgggtgtggatgagcaggagtgggagggcgtgttcagcgcgttggctgctgccccgcacattgaggtcacgggcatgttcacgcacttggcgtgcgcggatgagccagagaatccggaaactgatcgccaaattattgcttttcgacgcgcccttgcgctcgcccgcaagcacgggcttgagtgcccggtcaaccacgtatgcaactcacctgcattcttgactcgatctgatttacacatggagatggtccgaccgggtttggccttttatgggttggaacccgtggcgggactggagcatggtttgaagccggcgatgacgtgggaggcgaaggtgagcgtcgtaaagcaaattgaagctggacaaggcacttcctatggcctgacctggcgcgctgaggatcgcggctttgtggctgtggtgcctgcgggctatgccgatggcatgccgcggcatgcccaggggaaattctccgtcacgattgatggcctggactatccgcaggttgggcgcgtatgcatggatcagttcgttatttctttgggcgacaatccacacggcgtggaagctggggcgaaggccgtgatattcggtgagaatgggcatgacgcaactgattttgcggagcgtttagacaccattaactatgaggtagtgtgccgaccaaccggccgaactgtccgcgcatatgtt

SEQ ID NO: 655 - DNA, 495 bp, Corynebacterium glutamicum
atgaaatctgagtttccggtatccggcacgaggcgttttgagcatgccgcagatacccaaaattttggggaagaattaggcaggcatctagaagctggcgatgtggtgattttggacggcccgctgggtgctggaaaaaccacatttactcaaggtatcgctcgtggattgcaggtgaaggggcgggtgacatcgccgacgtttgtgatcgcgagggaacaccgctcggaaatcggtgggccagatctgatccacatggatgcctaccgattgctgggcgaagacagcgaggatgctgatccgatcggtgcgctggactctttggatttggataccgatttggacttggctgtggttgttgcggaatggggcggtggcttggtggagcagatcgctgactcgtatcttttgattaccattgatcgagagaccgctgtgcaggaagacccggaatctgaggctcgaattttccattgggaatggcgcgaaggccgc

SEQ ID NO: 656 - DNA, 1599 bp, Corynebacterium glutamicum
gtgcttgatttcttagctgcgaacccgctgattgcgctggtggttattttggccgttggtttagcaattggtcagattagggtctttggcctttctttaggtgccgccgcggtgctgtttgtggccctggtggtttcaactgcaaataccgacatcgtcatccccatgattgtttatcagctgggcttggcgatgttcgtttatgtcatcggtttgtccgccggaccagcatttttcagtgagttcgctaaaaagggctggaagctcaccatctttatgctcctgctgctggcaacactgattggtttggcgtgggtgcttattaagtcactggggcttgatgcagcgatcggtaccggtatgttcaccggcgcgctgacctcgactcccggtatggcagcggtcgtggaattgattgaaggaatcgatccaagccttgccagtgaacctgttattggttattccttggcatatccgggagccgtgctgggatccattgtggtggccgcggttggagcgaaactgctcaaagtaaatcaccgggaagatgctcgaaaagaaggcatgatcaccgcaccgctggtgtggaagggtgtgcagctcaaacctggaatcacaggcagggtgggagatcttccacgccttgcaggtgaaagtatcatcgcaacccgcattgtggatgatccacatacacaccgcctcgcggatccagatctgccgattactgaaggcatggaactgttgatcaacggcactgaagaagccgtggatcgggcaattaaggcgttgggtgaagaacgcgaaaccaaaattgaggacacagagctgatctacacccgcctgacggtatctagccctgaggttgcaggtagaaccgttgctgagcttgatactgtagctcacggattcatgattgcccgtatccgccagggcgattctgaggtagtgcctaaacctgacaccgtgatcaactactctgaccgcatccgcgtggtggttgctcctggtcgtgtggctgaagtgcgacgattcttaggggactctgaaaagtcccttgctgatgttaatctgctgcctttagccatcggattatctcttggcctgttgttgggcgcgatcccgattcctcttccaggcggcaccacgatgtcccttggctttggtggcggcccgattattgccggcctgattttgggagcactcaagcacacaggaccgctgacgtggcagatgccgttccacgccaaccgcacgatctccaccttgggcctggcgctgtttttggctggtgtgggtacctctgcaggtgcaggatttagagctgcgcttaccgattcctcctccttgatctacatggccggtggcttggtgatcaccttggcctctgcgctgctgtgtgctgtgatcggcatgtgggtactcaggttgaggtgggatgaagccatgggtgttgccgctggcaccaccacaaatcctgcaattatttcctatctgaatgggcaaaccggaacggatcttgccaacaggggatatgccactgtgtaccccacggcgatgatcggtaaaatcctcggcgcgcagatattgttcttgctgctc

SEQ ID NO: 657 - DNA, 1239 bp, Corynebacterium glutamicum
atgactaaaacacttggttcccttcagctggaagaaatcacgctgaccctccctctgactgaagatgtggccgatgaacgcaccattgatgtgttcgcacgcattgccacacgcgtcggtggggaagaccttccatatttagtattcctgcagggtgggcctggcaatgaagctccacgtccaagccttaatcccctcaaccccaattggttgggcgtggccttggaggaataccgcgtggtcatgttggatcaacgtggcaccggccgttccaccccagtgggtaatgatattttggaaaaacccacagcagaagtagtggagtacttatcccacctgcgcgcagatggcattgtgcgagatgctgaagccctgcgtaagcatttgggtgtgaatcagtggaaccttttaggccagtccttcggaggtttcaccaccctgcattacttgtcccggcacgccgattccttggacaacgtgtttattaccggcggtctcagcgctattgatcgcccagcagaagacgtgtatgccaactgttacaaccgcatgcgccgaaactctgaggaattctaccgtcgcttcccgcaattacgggaaactttccgagggttggttaatcgtgctcgcgccggggagattgtgcttcccaccggcgaagttgtgtcagaaaccaggctgcgatcccttggtcacttgttgggtagcaatgacggctggtttgatctgtacaacctgctggaattagatcccacctccaacgcttttgtccatgacctggcaggacttttgcctttcggcaaccgcaacccaatttattacgtgctccatgagtcctcttacgccgacggtgtggtgacaaattgggcagcagagcgtgtgcttccagaggatttccgcgaggatccaacactgctcaccggtgagcacgtgttccaggagtggacagacaccgtgccgtcgctcaagccgtggaaggacgttgccctggcattggctcagcaggaatggcccaagctttatgatgcgaaggcattggaaaactcacaggccaagggcgctgcagcagtgtatgccaatgacgttttcgtcccagtggattactctctggaaaccgcacaacacctgcccggtgtgcagctgtttatcaccagccagcatgaacacaatggacttcgtgccagctcaggcgcagtactgaagcaccttttcgatctggcccacggccgagaggtacgc

SEQ ID NO: 658 - DNA, 675 bp, Corynebacterium glutamicum
gtgttagtactagccctagacacctcaacccctgacctgatcgtcggcgtcgtcgactccgacaccggaaacacccgcgccgaaaccatcatcgaggacacccgcgcacacaacgagcagctcacgcccaccgtccagaagacgcttctcgacgccaacttgagcttttcagatatcgacgcgatcgtcgtgggttgcggcccgggaccgttcactggacttcgagtaggcatggtgtccggcgcagcgttcggtgatgccctgggaatccctgtctatggagtctgctcactcgacgcgatcgctcacaatattggtgcacgcaacatcccgcacgcattagttgccactgatgcgcgccgccgtgaaatctactgggcaacctaccgctccggcgaacgtgatcagggaccagatgtcatcgcaccagcaaacatccagatcagcggcgctgtagacaccatttcgattcctgagcacctggtggaaaaactcccagaagaactccagaatgtcaccatgcatagcggcaaacctgcccccgcaagcttggtggcagtggctgatttcagtgtggaaccacaaccattggttcctctttacctgcgccgcccagatgccaaagaaccaaaaccaaaacctaaatctgcagccatccccgaggtggatctttca

SEQ ID NO: 659 - DNA, 507 bp, Corynebacterium glutamicum
atgagtgaacaattcgagctacgggaactccgcagggaagacgcggggcgctgcgccgacctggagcaaatcctgttcccaggtgataacccctggccacgtgatgtctttgccgtggagttttcccaccccaccaatttctacatcggcgctttcgacgaaggatacttggtggcgtacgcaggtcttgccatgatgggacctgcggatgatccagagtttgaaatccacaccattggtgtcgatccggaattccaaagaaaaggcttgggacgcgtactcatggatcaaatgatgcatgcagcggacagccacgacggtccagttttcttggaagtccgcaccgacaacgtacccgcgatttccatgtacgaggctttcggctttaaaaccttggccgtgcgcaaaaactactaccggccatccggagctgacgcctacaccatgcaacgcccacgcttgagcgatcgcaaagatcaacagacagacacagaggggacacccagc

SEQ ID NO: 660 - DNA, 1032 bp, Corynebacterium glutamicum
atgatcgttttgggaattgaaagctcctgcgatgaaacaggcgtaggcgtagtcaaacttgacggcgaaggaaacctagagatcctcgccgactcagtggcctcctccatgcaagaacatgcccgctttggtggcgtcgtgccagaaatcgcctcccgggcgcacctggaatctatggtccccgtgatgcgtgaagcgttgaggcaggcgggcgtcgacaggccagatgctgtggctgcaaccgtgggccctggtttggcgggcgcgctgctcgttggagccagcgctgcgaaggcgtatgccgctgcgtggggagttccgttttacgcggtcaaccacctgggcggacacgtcgccgtggccaatctggaaggtgaaactcttccacacgcggtggctttgctggtttccggcggacacactcaattgttggaagtcgacgcggtgggattacccatgaaggaattgggatccaccctcgacgatgccgctggcgaagcctatgacaaagtctcaaggctgttgggattgggctacccaggcggccccatcattgataaattggcgcgccggggtaatccagaggccattgctttcccccgcggattgatgaaaaagtcggattctcggcatgatttcagcttttccggtttgaaaacctccgttgcccgctacgtggaagctgcggaaagaaacggtgaagttatttccgtggaggacgtctgcgcatcattccaagaagcggtgtgtgatgtgttgacgtttaaggccgtgcgtgcgtgccgcgatgtcggtgcgaaggtgctgctgttgggtggaggagtggctgccaactctcgtctgcgggagcttgctcaagaacgttgcgataaagccgacatcgaactccgggttcctcgtttcaatttgtgcaccgataatggtgtcatgattgcagcgttggcggctcaaagaatccacgaaggtgcccaagaatcaccaatttcggtcggaactgatccttctttgtccgttgagaccccacaggtgttt

SEQ ID NO: 661 - DNA, 1722 bp, Corynebacterium glutamicum
atgaaaccagtcttctccgttgaccaaatccgacgcgcagaaaacaccctttttgagcttcaggcagatccggatgagctgatgatctccgcggcatcggcggtggccgatgtcgcgttggcaatggtggacggccccgctccagcggtctccagtgaggagtcaatcctgctgctggtcggccccggtggcaacggtggcgacgccttgtatgcaggcgcgttccttgcagaagaaggccaccacgttgatgctttgctgttgggaaacggcaaagtccatcaatcagcattggcatattatgagtctttgggcgggcagatcatttccgattttccccctcactacctctaccgcctggtgattgatggtttgtttggcatcggtggtcggggagggctcaccccagagctggccagtttggtggagtctttttccgcttcaggtatccccattttggcgattgatgtgccgtctggcgtgcatgccgatagtggtgaactgccgcccggcgtgatggtgacggtggaaggatttgataatgatgcaccgatggcgcgtcagaaaattccggcacacattgacgctgatgtcacgatcacgtttggcggtttgagacgcgcccacgcggtcagtcctgcgtgtggtgaagtgctctgtgctgatatcaacatcgctggtggcggcggaaaatcgctgtccgctgagttgagtcaggtgcaggcagaagacgcgaccccgcagatgtttgcctccaaggcgtatcaacggaaagattcgctttttgagcgcgcgaatctcaaagctacggcgccacatatccataggatcggccagcactttaccgtgttgaacatggagcctggcccggatcatgataaatacagtggcggaattgtcggcattgttgcaggtagtggcacctatccaggtgctgctgtgctgtcggtgaaggcggctgtcagggccacaagcgccatggttcgatacgttggccctgcgttaaattttgtcatccagtcgctgccggaggtcgtcgcaacgcaatcacttgccaccgccggccgcgtgcaagcgtgggtgcacggccccggacgcgggctggaggctgagcaatcagccgagcttgcggagcttttgagccggcctgagcctgtgcttatcgacgccgacagcctctcattactccagctctcagcggagcttcggcaggcgttgcgcgagcgaaaagcaccaacggtgctcactccgcacaagggcgaatttgaacgcatcgcagcagaattacgctctgaaggcgtcgagattccccaagcggacaaagatcccattggtgctgcgcaagcgttagctaaagaatttgattgttgcgtactgctcaaggggaaatacaccgtcattgcagctcacgactttgtgcatgcgatcaacgctgggcattcctggttggctacacctggctctggcgatgtgttgtcaggtcttgtcggtgcacacttggctcaaagctacgcagaattaaaccgcttgccggagtttttccccgatgtgaccttgtctgattcggcgatttacacccagattgcacctgctgcgaccatccacgcggttgctgctgggttggccgcacgaaccgaatttgggtttgcgccgacctccgcaagtttgatcgctgatgccatccctgcagcgaccgccaaggtggatttgaagcgaattgtc

SEQ ID NO: 662 - DNA, 429 bp, Corynebacterium glutamicum
ttgagaggcatgacctacggatttcttgtcaacacagatctcacccaccgcgcgattgactttgatttagaaaacgctgcgaagttcctcggcggtgccgatgatggccgcgtcgctgtcgctttccaagaggatggcaccttgtacgccgctctctacagcgccagcgcaaaagatgagggtgccgcagcaaacccagtagcatcccttggccgcaacgccgctgctaccggtgatggctccttcttctctgatccgaccactgcaatctgtggccctgtgatcttcgtgggggccgaaggcgaagacatcacgttggatgaaattgagcgaattaaggacggcattcgcgccgctcgtaactaccgcgatgattatccagaggaattcaacctgtggcgcaacgctgtatataacctgcgtacggct

SEQ ID NO: 663 - DNA, 453 bp, Corynebacterium glutamicum
gtgtgtcaaacaacctatttggcactctacccccgagagtgccagcactcaactgttgagggtgctaaaaattcacatggcagccaaactttaagccgtacgcaggttatatacagcgttgcgccacaggttgaattcctctggataatcatcgcggtagttacgagcggcgcgaatgccgtccttaattcgctcaatttcatccaacgtgatgtcttcgccttcggcccccacgaagatcacagggccacagattgcagtggtcggatcagagaagaaggagccatcaccggtagcagcggcgttgcggccaagggatgctactgggtttgctgcggcaccctcatcttttgcgctggcgctgtagagagcggcgtacaaggtgccatcctcttggaaagcgacagcgacgcggccatcatcggcaccgccgaggaacttcgcagcgttttc

SEQ ID NO: 664 - DNA, 297 bp, Corynebacterium glutamicum
gtggcaaacgtcaacatcaagccgcttgaggacaagatcctcgttcagatcaacgaagcagagaccaccaccgcttccggcctggtcattccagattccgctaaggaaaagccacaagaggcaaccgttatcgcagttggcccaggccgcttcgatgacaagggtaaccgcatcccactggacatcaaggaagatgacgttgtgatcttctcccgttacggcggcaccgagatcaagttcggtggcgtggagtacttgcttctctccgctcgtgacatcctcgcaatcgtcgagaag

SEQ ID NO: 665 - DNA, 1614 bp, Corynebacterium glutamicum
atggcaaagctcattgcttttgaccaggacgcccgcgaaggcattctccggggcgttgacgctctggcaaacgctgtcaaggtaaccctcggcccacgcggccgtaacgtggttcttgataaggcattcggcggacctctggtcaccaacgacggtgtcaccattgcccgcgacatcgaccttgaggatccttttgagaacctcggtgcgcagctggtgaagtccgttgctgttaagaccaacgacatcgctggtgacggcaccacgactgcaactctgcttgctcaggcactcattgctgaaggcctgcgcaacgttgctgctggcgcaaacccaatggagctcaacaagggtatttctgcagctgcagaaaagaccttggaagagttgaaggcacgcgcaaccgaggtgtctgacaccaaggaaatcgcaaacgtcgctaccgtttcatcccgcgatgaagttgtcggcgagatcgttgctgcagcgatggaaaaggttggcaaggacggtgtcgtcaccgttgaggagtcccagtccatcgagactgctctcgaggtcaccgaaggtatttctttcgacaagggctacctttccccttatttcatcaacgacaacgacactcagcaggctgtcctggacaaccctgcagtgctgcttgttcgcaacaagatttcttccctcccagacttcctcccattgctggagaaggttgtggagtccaaccgtcctttgctgatcatcgcagaagacgtcgagggcgagcctttgcagaccctggttgtgaactccatccgcaagaccatcaaggtcgttgcagtgaagtccccttacttcggtgaccgacgcaaggcgttcatggatgacctggctattgtcaccaaggcaactgtcgtggatccagaagtgggcatcaacctcaacgaagctggcgaagaagttttcggtaccgcacgccgcatcaccgtttccaaggacgaaaccatcatcgttgatggtgcaggttccgcagaagacgttgaagcacgtcgcggccagatccgtcgcgaaatcgccaacaccgattccacctgggatcgcgaaaaggcagaagagcgtttggctaagctctccggtggtattgctgtcatccgcgttggtgcagcaactgaaaccgaagtcaacgaccgcaagctgcgtgtcgaagatgccatcaacgctgctcgcgcagcagcacaagaaggcgttatcgctggtggcggttccgctttggttcagatcgctgagactctgaaggcttacgccgaagagttcgaaggcgaccagaaggtcggcgttcgcgcactggctactgctttgggcaagccagcgtactggatcgcctccaacgcaggtcttgacggctctgttgttgttgcacgcactgctgctctgccaaacggcgagggcttcaacgctgcaactttggaatacggaaacctgatcaacgacggtgtcatcgacccagtcaaggtcacccattccgcagtagtgaatgcaacctctgttgcacgcatggttctgaccactgaggcttctgttgttgagaagcctgcagaagaagcagccgatgcacatgcaggacatcatcaccac

SEQ ID NO: 666 - DNA, 255 bp, Corynebacterium glutamicum
atggactgggactcctcaacggtgacgacaccgtccttgccaaccttttccatcgctgcagcaacgatctcgccgacaacttcatcgcgggatgaaacggtagcgacgtttgcgatttccttggtgtcagacacctcggttgcgcgtgccttcaactcttccaaggtcttttctgcagctgcagaaatacccttgttgagctccattgggtttgcgccagcagcaacgttgcgcaggccttcagcaatgagtgcc

SEQ ID NO: 667 - DNA, 1158 bp, Corynebacterium glutamicum
atgatgtcctgcatgtgcatcggctgcttcttctgcaggcttctcaacaacagaagcctcagtggtcagaaccatgcgtgcaacagaggttgcattcactactgcggaatgggtgaccttgactgggtcgatgacaccgtcgttgatcaggtttccgtattccaaagttgcagcgttgaagccctcgccgtttggcagagcagcagtgcgtgcaacaacaacagagccgtcaagacctgcgttggaggcgatccagtacgctggcttgcccaaagcagtagccagtgcgcgaacgccgaccttctggtcgccttcgaactcttcggcgtaagccttcagagtctcagcgatctgaaccaaagcggaaccgccaccagcgataacgccttcttgtgctgctgcgcgagcagcgttgatggcatcttcgacacgcagcttgcggtcgttgacttcggtttcagttgctgcaccaacgcggatgacagcaataccaccggagagcttagccaaacgctcttctgccttttcgcgatcccaggtggaatcggtgttggcgatttcgcgacggatctggccgcgacgtgcttcaacgtcttctgcggaacctgcaccatcaacgatgatggtttcgtccttggaaacggtgatgcggcgtgcggtaccgaaaacttcttcgccagcttcgttgaggttgatgcccacttctggatccacgacagttgccttggtgacaatagccaggtcatccatgaacgccttgcgtcggtcaccgaagtaaggggacttcactgcaacgaccttgatggtcttgcggatggagttcacaaccagggtctgcaaaggctcgccctcgacgtcttctgcgatgatcagcaaaggacggttggactccacaaccttctccagcaatgggaggaagtctgggagggaagaaatcttgttgcgaacaagcagcactgcagggttgtccaggacagcctgctgagtgtcgttgtcgttgatgaaataaggggaaaggtagcccttgtcgaaagaaataccttcggtgacctcgagagcagtctcgatggactgggactcctcaacggtgacgacaccgtccttgccaaccttttccatcgctgcagcaacgatctcgccgacaacttcatcgcggga

SEQ ID NO: 668 - DNA, 297 bp, Corynebacterium glutamicum
atgacattgcctcaccagcttcccgggccaaatgcagacttctgggactggcagttgcacggaacgtgccgcggcgagacctccgacgtgttctatcacccggacggcgagcgcggtcgtgctcgccagcgtcgggagctgcgcgcaaaggccatctgtgcagcatgcccagtattggaatcctgccgcaagcatgcactagctgtagcagagccttatggagtatggggcggactttcagagtccgaacgactggttatccttcgcaacaacgagcgcaagcaaccagtagcagtt

SEQ ID NO: 669 - DNA, 564 bp, Corynebacterium glutamicum
ttggctgatactgagcgcgagctcgctgacctggtaccgcaggcaacggcgggcgatcgtcgggcattgcaaagaataatggagattattcaccccattgttttgcgttatgctcgcgctcgtattggaggtggacgccagccaacggcagaagacgttgctcaagaaatctgcctggcggtagccacctccattaggaactttgtcgaccagggtaggccgttcatggcgtttgtctacggcattgcatctaacaaggtcgcagatgctcacagggcgatgtcgagggataaatcgactcctattgaggaagtcccagaaacttcaccagatacttttacccccgaagactttgcgctggtcagcgatggaagtaacagagttagggaacttctcgatctactgagtgaaaaggcacgcgacattcttatcttgagagttatcgttggtctttccgcagaagaaactgcagagatggtgggcagcaccccaggtgctgtacgagttgcccaacacagggcactcacgacacttcgaagcacacttgagcagcaggagaacaag

SEQ ID NO: 670 - DNA, 1026 bp, Corynebacterium glutamicum
atgactcgacgtctacatggtggtgagcaggatggccaggaacacgttaaaggacagctaaagcagctgttcgacgacgacgcgttcttgactgacctgtcccgcggcgttgatccctcagagggcgatgacgccctcgctggcctcctcctcgatttaacaaaggaagctcaggagccgccggcaacaatgccggattggtctactttgctccctggaattttggatcaggatcaggatttgccagtggaatccacttcggacaccacggttatgcaggcatcaaaccctgcaacccaagaattcgcacctgtttctatttctgatacccccaacactgcaactaattcagctgatgcagatgagtccgcaactgttgttccacttgcagcacgccgtgagaagcgtgccaagagcggatcaagcggggttcattcactggatgcttcggcaacccagcgcaaatctcacccattccttagcggtttggtgggtgctgcagctgcaactctagtcatcgcaggcggtggagcagcagtgtacaacgctgatgaaaactccccgttgtatggcatgaatcagcagctgtttggcaatcaagattctccaagcgtggtggagcttgcctccacgctggaagaagttgatagtcgtacagctagtggcgatgtggaaggggcacgtgctctactcgagcaggctcgagcaatgctggatggcatggcacctcctcgaaaggcgccgtcggaggcaacccgaacggttgaatctgaaccaggtactcagacgttgactgcaacggttactgaatccgcaagtccggaaccaccggtcacggaaactcaaactgttacctccaccgaggtacagacagtgacaaccactgcggttgctccaccggtctggactcctaatccagagccaacaaccacagctgccccgacttctacgccttcaactggtggcggtgagggaaccggcaatgatggtgactctggacttgtgccacctcagactcctggaaac

SEQ ID NO: 671 - DNA, 378 bp, Corynebacterium glutamicum
gtgaactttgatgcgatgatgccccgcgacccgtttgccgatgatcccaatgacccggcatcgtttattaccgacgatgacccttatgatcatcccgaaccgctttctgaagaagagcgaatccacgtgagccaagaccttcgcctcgtgatggaatttaaaaaagttttaggtccccgaggaatcgaaggcgtgttcttcatgtgcgaagactgcgaagagttccactactacgactgggacatcatggcagcaaacatgcgcgccaccttggctggggaactcagccccgtgcatgaaccaagtgcgcaacccaatattgatgcctatgtgccgtgggactactgcattggttacctagacggacttgaagccaaa

SEQ ID NO: 672 - DNA, 1518 bp, Corynebacterium glutamicum
atgacaacccagagccgagtttctaccggaggagacaacccaaacaaggttgcccttgttggattaacctttgatgacgtacttttgcttccagatgcgtcggacgttgttccttcagaggtagatacctcgacgcagttaacacgtaatattcgccttaacacccctattctttctgccgcaatggatactgtcaccgaggctcgcatggctatcggcatggcacgccatggcggcattggtgttttgcaccgcaacctgtctattcaagagcaggcagaaaacgttgagctggtgaagcgttctgagtctggaatggtcactgatcctgttacctgtactcctgacatgagcatccaagaagtggatgatctgtgtgcacgcttccgcatttccggtctgcctgttgttgatgaggccggaaagttggttggtatttgcaccaaccgcgatatgcgttttgaaagcgacatgaaccgtcgtgtcgctgaagttatgaccccaatgcctttggttgttgctgaagagggcgtcaccaaggagcaggctcttgctttgctgtctgcaaacaaggtggagaagcttcctatcatcgcaaaggacggcaagcttgtcggtctgatcacggtgaaggacttcgttaagactgagcagcacccgaacgcatccaaggatgcatcaggtcgtctgctggttgcggctggcatcggcacgggcgaggagtcattccagcgagctggtgcgcttgccgacgccggcgtcgacattttggtcgtagactctgcacacgcccatagccgtggagttttggacatggtgtcccgcgtgaagaagtcgttccccaaggtcgatatcgttggcggcaacttggcgacccgcgaggctgcgcaggccatgattgaagctggcgcagacgctatcaaggtgggtattggcccaggttctatttgcaccactcgcgttgtcgcaggtgtcggtgcacctcagatcactgcgatcatggaggcagctgttccagctcacaaggctggcgttcctatcatcgccgatggcggcatgcagttctctggtgatatcgctaaggctttggctgctggcgctaactccgtgatgctgggctccatgctggctggtaccgctgaggctcctggtgagaccatcaccatcaacggcaagcagtacaagcgttaccgcggcatgggctccatgggcgctatgcagggccgtggacttagtggtgagaagcgttcctactccaaggaccgttacttccagtctgacgttaagagcgaagacaagctcgttccagaaggcatcgaaggtcgcgtgcctttccgcggtcccatcggagacatcattcaccagcaggtcggtggacttcgtgcagcaatgggctacaccggttcctccaccattgaagagctgcacaacgctcgtttcgtgcagatcaccagcgcgggtctgaaggaatcccacccgcaccacatccagcagactgtggaagctcctaactaccac

SEQ ID NO: 673 - DNA, 627 bp, Corynebacterium glutamicum
atggcctgcgcagcctcgcgggtcgccaagttgccgccaacgatatcgaccttggggaacgacttcttcacgcgggacaccatgtccaaaactccacggctatgggcgtgtgcagagtctacgaccaaaatgtcgacgccggcgtcggcaagcgcaccagctcgctggaatgactcctcgcccgtgccgatgccagccgcaaccagcagacgacctgatgcatccttggatgcgttcgggtgctgctcagtcttaacgaagtccttcaccgtgatcagaccgacaagcttgccgtcctttgcgatgataggaagcttctccaccttgtttgcagacagcaaagcaagagcctgctccttggtgacgccctcttcagcaacaaccaaaggcattggggtcataacttcagcgacacgacggttcatgtcgctttcaaaacgcatatcgcggttggtgcaaataccaaccaactttccggcctcatcaacaacaggcagaccggaaatgcggaagcgtgcacacagatcatccacttcttggatgctcatgtcaggagtacaggtaacaggatcagtgaccattccagactcagaacgcttcaccagctcaacgttttctgcctgctct

SEQ ID NO: 674 - DNA, 1122 bp, Corynebacterium glutamicum
atgcgtgaccacgttgaaatcggtatcggccgtgaggcacgacgcacctacagcttggacgatatttctgtcgtttctagccgccgcacccgttcatccaaagatgtcgacaccacttggcatattgacgcctacaagtttgatctgccgttcatgaatcacccaagtgatgcattggcaagccctgagtttgtcattgaaatgggcaagcagggtggccttggcgtgatcaacgctgagggtctgtggggtcgccatgctgatctcgatgaggcgatcgcaaaggtgattgctgcgtatgaggaaggcgaccaggctgcagccactcgcactcttcaggagctgcacgcagcgccactggatactgagctgctgagtgagcgcattgcgcaggttcgtgattccggtgagatcgttgctgtgcgcgtgtctccacaaaatgttcgtgagatcgcaccaatcgtcatcaaggcaggtgctgatctgctggttatccagggcaccctgatctctgcagagcacgtcaacaccggtggagaggccctgaacctaaaggaattcatcggttctttggatgttcctgtcatcgctggtggcgtgaacgattacaccaccgcgttgcacatgatgcgtaccggtgctgtgggcatcatcgtcggtggcggcgagaacaccaacagcctagcattgggcatggaggtatccatggccactgcgattgctgatgtcgctgcggcacgtcgtgattacctggatgagaccggtggacgttacgtgcacatcattgcagatggaagcattgaaaactccggtgatgtagtcaaggctattgcctgtggcgcagatgctgtggtgctgggttcaccgttggctcgcgctgaagaagctgctggaaagggctacttctggccagcagtggcagcgcaccctcgtttcccacgcggtgtggttactgagtccgtggacttggatgaggcagcaccaagcttggagcagattctgcatggtccgtctacgatgccgtggggtgtggaaaacttcgaaggtggattaaagcgtgcgctggctaagtgtggctacaccgatttgaagagcttccaaaaggtaagcctgcacgttaac

SEQ ID NO: 675 - DNA, 921 bp, Corynebacterium glutamicum
ttggcaataatcaagggcatgaataaacagtccgctgcagtgttgatggtgatgggttccgccctatccctgcaatttggtgctgccattggaacgcagcttttccccctcaacggcccctgggctgtcacctctttaaggctgttcatcgcaggcttgatcatgtgcctggtgatccgcccgcgacttcgttcctggactaaaaaacaatggatcgccgtgctgctgttgggattatctcttggcggaatgaacagcctgttttacgcatccatcgaactcatcccgctgggtaccgccgtgaccattgagttcctcggccccctgattttctccgcggtgttagcccgcacgctgaaaaacggattgtgcgtggctttagcgtttctcggcatggcactactgggtatcgattccctcagcggcgaaacccttgacccactcggcgtcattttcgcagccgtcgcaggaatcttctgggtgtgctacatcctggcatcaaagaaaatcggccaactcatccccggaacaagcggcctggccgtcgcactgattatcggcgcagtggcagtatttccactgggtgctacacacatgggcccgattttccagaccccaaccctactcatcctggcgcttggcacagcacttctcgggtcgcttatcccctattcgctggaattatcggcactgcgccgactccccgcccccattttcagtattctgctcagcctcgaaccggcattcgccgccgccgtcggctggatcctgcttgatcaaacccccaccgcgctcaagtgggccgcgatcatccttgtcatcgcggccagcatcggcgtcacgtgggagcctaaaaagatgcttgtcgacgcgcccctccactcaaaatgcaacgcgaagaggcgagtacacacacctagt

SEQ ID NO: 676 - DNA, 909 bp, Corynebacterium glutamicum
gtgctcaatctcaaccgcttacacatcctgcaggaattccaccgcctgggaacgattacagcagtggcggaatccatgaactacagccgctctgccatctcccaacaaatggcgctgctggaaaaagaaattggtgtgaaactctttgaaaaaagcggccgaaacctctacttcacagaacaaggcgaagtgttggcctcagaaacacatgcgatcatggcagcagtcgaccatgcccgcgcagccgttctagattcgctgtctgaagtgtccggaacgctgaaagtcacctccttccaatccctgctgttcacccttgccccgaaagccatcgcgcgcctgaccgagaaatacccacacctgcaagtagaaatctcccaactagaagtcaccgcagcgctcgaagaactccgcgcccgccgcgtcgacgtcgcactcggcgaggaataccccgtggaagtcccccttgttgaggccagcattcaccgcgaagtcctcttcgaagaccccatgctgctcgtcaccccagcaagcggcccatactctggcctcaccctgccagaactccgcgacatccccatcgccatcgatccacccgaccttcccgcgggcgaatgggtccataggctctgccggcgcgccgggtttgagccccgcgtgacctttgaaaccagcgatcccatgctccaagcacacctcgtgcgtagcggcttggccgtgacattttcccccacactgctcaccccgatgctggaaagcgtgcacatccagccgctgcccggcaaccccacgcgcacgctctacaccgcggtcagggaagggcgccaggggcatccagccattaaagcttttcgacgagccctcgcccatgtggccaaagaatcttatttggaggctcgtctagtagag

SEQ ID NO: 677 - DNA, 1569 bp, Corynebacterium glutamicum
gtgagccttcagacaaatcatcgcccagtactcgtcgttgacttcggcgcacagtacgcgcagctgatcgcacgtcgtgtgcgtgaggccggcatctactccgaagtcatcccgcacaccgccaccgcagacgatgtgcgcgctaaaaatgcagcagccctcgtcctttccggtggcccatcctccgtgtatgccgagggagcaccatcccttgacgctgagattcttgatctcggattgccagtatttggcatttgctacggcttccaagccatgacccacgcgcttggtggcaccgttgccaacaccggtaagcgcgaatacggacgcaccgacatcaacgttgccggtggcgtcctccacgaaggcctcgaagcctgccacaaggtgtggatgagccacggcgacgccgtctctgaagccccagaaggtttcgtagtcaccgcgtcctccgaaggtgcgcctgtcgcagctttcgaaaacaaggaacgcaaaatggctggcgtgcagtaccacccagaggtattgcactcaccacacggccaggcagttctgacccgcttcctcactgagatcgcaggtctagagcagaactggaccgcagcaaacatcgctgaagaactcatcgaaaaggtccgcgagcagatcggcgaagatggccgcgctatttgtggcctatccggtggtgtggactccgctgttgccggtgctttggtgcagcgcgccattggtgaccgtttgacctgtgtctttgttgaccacggtctgctgcgtgccggtgagcgcgagcaggtggaaaaagacttcgtcgcagcaaccggcgccaagctggttaccgttgatgagcgccaggcattcctatccaagctggccggagttaccgaaccagaagcaaagcgcaaggctatcggcgctgagttcatccgctccttcgagcgcgcagttgccggtgtgctggaagaagctccagaaggttccaccgtggacttcctggttcagggcaccctgtacccagacgtcgtggaatccggtggtggatctggtaccgcaaacatcaagagccaccacaacgtcggtggactgccagacgatgtggaattcaagcttgttgagccactgcgtgacctcttcaaagacgaagtccgtgccgttggccgtgaacttggcctgcctgaggaaatcgttggccgccagccattcccaggaccaggacttggtatccgcatcatcggtgaagtcaccgaagatcgcctagaaaccctccgccacgctgacctgatcgcccgcaccgagctcaccgaagccggacttgacggcgtgatctggcagtgcccagtagtcctcctggcagatgtccgctctgttggtgttcaaggcgatggccgcacctacggacacccaatcgtgctgcgcccagtgtcttccgaagacgcaatgaccgccgactggacccgcctgccatacgaggttctggagaagatctccacccgcatcaccaacgaagttccagatgtgaaccgcgtggtgctggacgtaacctccaagccaccaggaaccatcgaatgggag

SEQ ID NO: 678 - DNA, 663 bp, Corynebacterium glutamicum
atgaactcagcgccgatagccttgcgctttgcttctggttcggtaactccggccagcttggataggaatgcctggcgctcatcaacggtaaccagcttggcgccggttgctgcgacgaagtctttttccacctgctcgcgctcaccggcacgcagcagaccgtggtcaacaaagacacaggtcaaacggtcaccaatggcgcgctgcaccaaagcaccggcaacagcggagtccacaccaccggataggccacaaatagcgcggccatcttcgccgatctgctcgcggaccttttcgatgagttcttcagcgatgtttgctgcggtccagttctgctctagacctgcgatctcagtgaggaagcgggtcagaactgcctggccgtgtggtgagtgcaatacctctgggtggtactgcacgccagccattttgcgttccttgttttcgaaagctgcgacaggcgcaccttcggaggacgcggtgactacgaaaccttctggggcttcagagacggcgtcgccgtggctcatccacaccttgtggcaggcttcgaggccttcgtggaggacgccaccggcaacgttgatgtcggtgcgtccgtattcgcgcttaccggtgttggcaacggtgccaccaagcgcgtgggtcatggcttggaagccg

SEQ ID NO: 679 - DNA, 441 bp, Corynebacterium glutamicum
atgagcgaaatcctagaaacctattgggcaccccactttggaaaaaccgaagaagccacagcactcgtttcatacctggcacaagcttccggcgatcccattgaggttcacaccctgttcggggatttaggtttagacggactctctggaaactacaccgacactgagattgacggctacggcgacgcattcctgctggttgcagcgctatccgtgttgatggctgaaaacaaagcaacaggtggcgtgaatctgggtgagcttgggggagctgataaatcgatccggctgcatgttgaatccaaggagaacacccaaatcaacaccgcattgaagtattttgcgctctccccagaagaccacgcagcagcagatcgcttcgatgaggatgacctgtctgagcttgccaacttgagtgaagagctgcgcggacagctggac

SEQ ID NO: 680 - DNA, 189 bp, Corynebacterium glutamicum
gtggaatttttgattgtttttgcaaaaccagacaggcgtgccaaaggtcctcaaaaatctgaatctttggcacgtgtgtttggttatggggacttggaaccagacaggcgtgccaaaacttcaagcaaaaggaagttcttggcacgcgtgtctggttttgctaaatcgactactcacatagggtcgggc

SEQ ID NO: 681 - DNA, 1176 bp, Corynebacterium glutamicum
atgagtacttttcaggagccccaccacaaccagggattcatcccttttgcccaacctggttatgaagctccaacaccacaccttgcaactggtacttttcagcaaatgtggcagacccgccccgcacgcatccctgccaagcaaggtggtcacgccaaagtagctggtgtctgtgaaggcattggtgtgcgttatcaaatcgacccggtgctcattcgtctatttttcgtggtcactggtgtcttcggcgccggtgtcgcagcctatctcattgcatggctgtgcatgccccgctactccgttccggtctcccccatcgaagctctctggaccccgggccacaccaaagaccgcaaccacggctggtggctggtcatcgcgttctttatgttctcaggtgttttatcctccggcgctggaggaatatccggcccagcagcagccattacttacctttgccttttagccatgtggtgggcgttgcataagaaacaaccacttccaccccgcggactactcaccactgaattcactgtttctgaggatgccaccatgaaaaacgaagatctctacccacgaccccaaccagatctaagcactatcacccccgttgagggctactatgcacccttcgcgcaacaaacccccgaagcgcctcattgggatccacttgcccaaaaccaatacaacacctgggatgtacaagtccctccacaaaagcctcagaaaaagcgccatgtgtggccatggattgtcggcggtgtagttggtaccggagttgtcatgagcgccctcgcaggcctgtttatttcaaatatcgatcccatctactttgaagacgaccctggaatcggcgatgtcaatctcatccccaccaacgatgaactcctcagcagctacacctctggtgtgggcgaaatgaacctagatttcagcaacctcacccaacttgatcaggaacaaaacgttcaaatcacctcaggtatcggtgaagtcatggtgaccctgcctgatgacgtgccagtaagcttgagttgctccgccggtgtgggcacagcgcgctgtgatgttggagacctcgccgcccacaatgctgatttggaaggtccgatgttgaatctggttgtaaattctggaatcggcgatgtgaaggtggagttcgctgatcagaatgac

SEQ ID NO: 682 - DNA, 1140 bp, Corynebacterium glutamicum
gtgcctttatatcccacgtttacccggtcaagagatggtcgggttgttgcgggtgtcgcatcggggctggcaaagcatcttaatgtgtcggtgttttgggttcgtgcgctgctgatttttgcggcgttgctgagcggtgcgggtctttttgcgtatgccttgatttggatttttacgcgcattgagaaaaaggggagtggggaggcgtcgacaagcaagcgctgggtgtcgtggtgcctggtgctgctcgctatcggtggtgctgcggcgtcggtgatgctgagcaccggcttcgcggtgggcacgttggtgcccatcggcgtggtcggtgtgggcctgttgatggtgtggctggcgtatgaccgcggggtggaatccggcccgaatctgctgattattgccaccggcggtgtgttgatgctggtggcgatcgtgctgatcgtgatgaattggaacacccaggacggcttcgtcatggcgctggtggccgtggtgctcacgctggtgggtgtggctgcgctgggcgttccgctgtgggtgcggatgtgggatcagctgggcgaggagcgcgcggaaaaagccgcagctgctgagcgcgcagatattgcttcccgcctgcatgattcggtactgcagaccttggcgctgattcaaaagcgtgccgacgaccccgccgaagtcgcccgcctggcccgcgggcaggaacgcgagctgcgtcaatggctgtttgattcccaagataaaacacctcaaacaaccggcactgtctttactgcgttggagcgcgcctgcggtgaagtcgaggatatttacgctctgcgtatcgtgcctgtgaccgtgggaaccgatgaagcgctgactgagaaaacgcaggcagcggtgatggcagtccgcgaagcactcgtgaacgtggccaagcatgccggcgtggaaaccgccgatgtgtacgccgaaattatgctcggcgaactgaacattttcgtccgcgaccgcggtgcaggattcgaccccgacaacatccccgacgggcaccacgggctcgccgaatccgtccaaggccgcgtcgaacgagccggcggaaaagtacgcatcaaatctgaaatcggcgaaggcaccgaagtggcaatcaccatggatgtg

SEQ ID NO: 683 - DNA, 690 bp, Corynebacterium glutamicum
atggttgatgtgtttttggtcgatgaccactccgtgtttcgctccggcgtcaaagcagaactaggcaacgccgtcacagtagtcggcgaagcagggacggtggccgacgccgtagccggcatcaaggcaagcaaaccagaggtagtgcttctcgacgtccacatgcccgacggcggcggcctcgcagtgctccagcagatcaacgactccgatgtggacaccattttcttggcactcagtgtctctgatgctgcggaagatgtcatcgccatcatccgtggcggtgccaggggatacgtgaccaaatcaatctccggtgaagaactcatcgaagccatcaaccgcgtgaaatccggcgacgcattcttctcaccacgcctggcaggcttcgtcctcgacgccttcgccgcccccgattccgcagctggcgcaggcattgtcgacgcacccgaaaaagacgccgccgtagaatccggaaaaatcctcgacgacccagttgtcgacgccctcacccgccgcgaactcgaagtcctccgcctactagcccgcggctacacctacaaagaaatcggcaaagaactgttcatttccgtcaaaaccgtggaaacccacgcctcaaacattctgcggaaaacccaacaatccaaccgccacgcgttgacccggtgggctcactcgagggatcttgac

SEQ ID NO: 684 - DNA, 324 bp, Corynebacterium glutamicum
atggcggctaaaaagagtggcgctggttctcggggtggggctgggaggtcagcttcggctgataaacagatcgatcaaagccaagcgaaattcaccttccaacccacccgaacactgctgttcagtgttattttcaccgtcttggtgatgtggcaatccggtttctcatactggtacgcgatccctattttgttcttcatctgggcgattttcatcctcggccacagcttctacaactgggcaaacctcaagttgatcgaaatggggcgccgcaacaaacaggtcctagaagaacaagaaaagcagaaaaagaagaggggcttc

SEQ ID NO: 685 - DNA, 489 bp, Corynebacterium glutamicum
gtgcactcctgcagcatgggttttgggaaggcgatactcttagaaattatggatccgatgaacagctacaacaccatgaagtcccacgtcaccccaattccaacgccggtgagcgtgcggctgagtagctcggtattagtaggtgctgccatcgcttcattaaccactgatctagccccggccgtaaagttttctgtcactggagttggtctggcactcgcgctgctcatcgcttttgcgcatccttaccgtggggagatgaggatgtaccgcttccaaaacaatatttcaccagtccccaccattggccaggtgatgccactatttttcacatggctggcgctgatgcttgcaccgattatttcaggagcgccattgtgggcaacgattctagtgttcctggcagctaccggctggatgtatttaacgttcccccacgtggatggcagccggaagctggcgttcgctgaaggcccccgccgaaacacc

SEQ ID NO: 686 - DNA, 963 bp, Corynebacterium glutamicum
atgtctaaacgctcccgtgctttcgccacagcattaatcgccttgggcctagggctatcttcctgctctactacggaagataccgctatatcggagacgacagtgtctagtgttgcaacgaaaacaacctcgactctgcctgaaatgaactccgcagtatcagcagacggcgtgacgatcactatcgattctgccttcacgacagactctgtagaaatggaatccctagacagaccttctggcgacatccaacccgagatgtctagagaagacggaatctttgtcgtagtcgaaaccactataaagaacgagagtggagcagatatggacatcacctgtgcatccactggttcaactgtctatgcagaaatctccactaatcaagaggccgtataccaaccaatacgcgatttattcctcatcccaggaaacccggaatgcaaccataatctaggatccggtttcgacgcaccaatgacttgggtatttcaaatccctaaagatgccactgcggagcgatttggattcacacatagtgagctcggtgatgggaaactaacttggattgcactcaatgatttgagtaattcggagccagctactgaatcaactatgcgagacgaagcagcaatcgatccgagcacccctcagcaaactccagtacaggaaactgtgatctcacaaaacaccattgaaactcctgtagcccctgctcctgcggtacctgcttatggcgcttcttgccctgtctcgatgctccagcagccaagtcaagctgcagatggttcagctttggtctgcatttatgcaggaacccccaacccaatctgggtctacggcccagaacctctcggagtcgggactgctacaccgggtggggcatgcgaaggatacgaggccggtgggcaagatgcttctggaaatataatgatgtgctcaggcggacaatgggtctatgggcca

SEQ ID NO: 687 - DNA, 825 bp, Corynebacterium glutamicum
ttgcacaccgttgaaaatgagtgtttactggaactcatgagtggaacaggtgttcgaaagttgtggggagatggcactccggtgtcgctccctgacctttcaggattaagtagagcggagcgcattgatgcgttgcgttcacgcatgtccaccatgggtgctgcggtgccaaagtttgagccgtcggtggaagaaagtgctgaacaaaagcaggattctctcgccgaaaaacaggacatagttgcagttccttccgctttttctgatcttttccctggggatggtttgccgcgtcgtgcggttactcaattggttgaacagccacttgtggtggtggacttcctggctcatattactgcccagggtggacacgctgcggtgattgggtggaaggatttagcctacgccggggtgattgattccggaggtgtgtgcgagaacatcattgctattccaaatcctggtacggagccactgaatgtggcagcggtgctgtgtgaggggttggatgtggtcgtgtacaaaggcccggagatttccctgtcgccaaccagagcgaggccgttgctgggaaagctgaggcaggggactgctgccttggtgatggttggcacgaaagtaagctcaccggcgctgtcggtggatgcagagatcactgattatgttggcattggtgcaggtagtgggcgtattcgtggcgttgagatgcaggtgcgggctgtgtcgaaaactcacggtgtgcgcagcggaaaagtcctgatcagtaggcctcaggatgcagcattgcttgagcctgaacagccaacaacgttgcgggcggtccca

SEQ ID NO: 688 - DNA, 1590 bp, Corynebacterium glutamicum
atgacgcgggtgatggcattgtggtttccggattggcctgtgcaggcggttcatttggatgaagatgctcccgcgcacaataaacctgtggcgattgctgcgcattaccgcatccaggtgtgtggcgtggctgcgcgcaagcgtggggtgcgtcgtgggatgaaggttcggcaggcgcaggctgtgtgccctgagctggaggttgttgacgcggatgcagatcgtgatgcccggatgtttgagggcatcgtggcatcgctcggtgaggttgcctccagcgtcgaggtgcttcgtccgggtctggtcgcggtcgatgcgggagctgccgcgcgctattacggttcagaggacatcgctgctcagatgcttatcgacgccgccctgcgccaaggcatcgacgttttcgccggggttgcggatgagatcacgacggccgtcatcgcggcgagggcgaatggtgggactgtggtgaagagggaggcgtcgagaagctttttacagcagcaacccctgggcgtgctggcggccgaggaagcgctgggttgtgaggcggaggtggtgcgcgcgctggcggatctgggcatgcgcacgcttggtgagctggcggaactgccggtagaagccgtggcgacgcgtttcggcaacgctggtctgcggtgtcacaacattgcgcgtgccaggcacgatcgtaaggtcgcgccaccgatcacgcatgcagattgggaggtttcgcatgtgccggaggagcctattttgcgtgtcgacgccgcctcgtttgttgcgcgcaaccttgcctcgcgcctgcatcaactgctgagcaaaggtggcgtggtgtgccaattgctcaaggtcacagccgatttcagtactggtgatacggtgagcagaatttggcgtaccggtgaacctttaacggaacaggcaactgcggatcgggtgcgttggcagttggatgggtggttgactgcgcgcggtgtgcattccgatgatccgaatgagcacgatgggattacggcgttgtggcttattcctttggaatgtgtgccaccggatatggccagcggcggattgtgggataccgggcgcagccagcagcatgtggccagacaagtcattgagcgtgtgcaatcaagcttgggcgtggatgcggtgctgcagcctgttccggctggtggtcggggagtagaagaacgcattcattttgttccctatggtgaaaaacgtgatgctatccgcaatccagcggggtcgtggccagggaaaataccaggtccgctgcctgctcggttgggcggtgggatcaaccacccggcctcgcaagtgaccatgattgatacagaagggcagcgtatttacgtcaccgcagaggcattgctcagctcgtcgccgtatgccttgtcctgggggccggcccgctatttgatcactggctgggctgggccatggccggtggatgatcgatggtgggagaaaaacggcacaaaatatgcccgcctccaagtggtgggacgggcagtatctgaagaaaggcagctcagtgcgtggctgttgatgtggaaagacaacaagtggcggattgaggccacatat

SEQ ID NO: 689 - DNA, 660 bp, Corynebacterium glutamicum
gtgacccagggttacggtgtgtgcatgattgtgcagccaacttctcattcaaagcatcgtgcccgcctgaagactctagcgattgtcggcgctagcgcgttgactcttgcgggttgtggaacctccaattccaccaccaacgatgcttcttctgtaacccaaactatgtccgcaactgcggatggcgcacagttgtccaacgaagcttccaccggcccaaccgcattgggcgaagccgatgtagcaatgaagactctccgacctgatgcgcctgcacagctcatggtcaccgatgttcggattggctctcacagtggctttgaccgcgtggtatttgatctcactggcaccggaactcctggttggttcattgattacacctccaatcccacccagcagggcagcggaaacaccatcaacttcacgggcgatacagcgctgaacgtaaatattgacggtactgtttatcctttcgatttgggccttgaggatccagagatcggcaccgtggatggctccggcagcattgtcacccaggtcgtcagcgcaggtacttttgagggacgctcccagttcgtcatcggcctcaacggcaagcaccgctactcggtcactgagttgcaggatccgcaccgtctcgttgtggatgttttagcgcag

SEQ ID NO: 690 - DNA, 861 bp, Corynebacterium glutamicum
atgactcttcgctgttctgacgtcaatgttgaacccctgccgggaacggcaaaaacaggttctgggtttgttctccttgaacatgctggctcgtggagccgtgatgttttagacggcggaacatttgatcctgagttgactgatcaattgaagaggcacctgaaagcttccggaatgggtctgcaattaattaggaagccgggaagggagggtcgaaacgtcgaaaagcataatctttttctcgtttttgctgaggcctcaattattgagcacctggtggtggacgcgccggctgatgttttggatcttgatttaagcgggccgggcaaaaacaatgcgcagcgcatggatgatccgatgctgctgatttgtacgcattcgaagcgcgatgtgtgctgcgcgatcaaggggcgtccgctggcagctgccgtggagccacaatttgggccgctgcatgtgtgggaggcttcgcacaccaagggccaccgttttgcgccatcgatgctgctcatgccgtggaattactcttatggcctacttgatgaggccgaaaccgtgcagcttttccaaggcgcgttggacaacaaactcttcctgccgggcaaccgtggccgaggaaccttagatgctcgtggccaggttgcagaaattgccgtggcggaagctttcggcgaggcggttgctcctgcgagtttgcaggttgaattcgaagatgattctgttttggttactcatcccgatgggcgcacgtgggttgtggagcttgaacgcatcgaggtcgacggcgtggtgtcctcgtgtggtgatcagccgaaaactggaaaagcgtgggtggctaggcaagttacagaactgatcgga

SEQ ID NO: 691 - DNA, 861 bp, Corynebacterium glutamicum
atgatggaaaaaataagactaattctattgtcatctcgccccattagctggatcaataccgcctacccctttggtctggcctacctattaaatgcaggagagattgactggctgttttggctaggcatcgtattttttcttatcccgtataacatcgccatgtatggtatcaacgatgtttttgattacgaatctgatatgcgtaatccccgcaaaggcggcgtcgagggggccgtgctaccgaaaagttcccacagcacactgttatgggcctcggctatctcaacaattcctttcctagttattcttttcatatttggcacctggatgtcgtctttatggctgacactctcagtgctagcagtgattgcttattcagcaccgaaattgcgttttaaagaacgcccctttatcgatgctctaacatcttctactcacttcacttcacctgcattaatcggtgcaacgatcactggaacatctccttcagcagcgatgtggatagcactgggatcctttttcttgtggggcatggccagtcagatccttggagcagtacaggatgttaatgcagaccgggaagctaatctgagctcaattgccactgtaattggggcgcgtggagccattcggctttcagtagtactttatttactagctgctgtgttagtcactactttgcctaatccggcgtggatcatcgggattgcgattctaacttacgtatttaatgccgcacgattttggaacattacagatgccagttgtgaacaggctaatcgcagttggaaagttttcctgtggctgaactactttgttggtgctgtgataacgatactgctaatagcaattcatcagata

SEQ ID NO: 692 - DNA, 390 bp, Corynebacterium glutamicum
atgacttatatttttataagcattccttttttagcaatagccatggtcctatttgtcttaaagctgcagtctggaacacctaaacttttaccaatcaccgctgtcagtgcccttaccctatgttccctaactatcatatttgataacctcatggtttgggctgatctctttggatatggcgatacccagcaccttggcatttggctcggtttaatccccctagaggatcttttctatccgctcttcgcagtacttctgattcctgccctatggttgcctggaaatatgtttaaacgcaggaaaaaacgtccacaccattccttacccaccatcgccaatggaagcatcactactagatccaccaccacgcaatctgagccagaaaagccg

SEQ ID NO: 693 - DNA, 396 bp, Corynebacterium glutamicum
atggcctttatttatctaggtactctcctagttctcattgggtgcatggctttgtgcgaccaccgttggaagctagcgttcttccgccatccgttacgagcaattctttcggtaggtgctgcatatattggatttcttttatgggatatatttggcattattactggcactttttatcgcggagactcagcgtttatgtccggtattaaccttgcaccccatatgcccattgaagaactttttttcttattcttcctctgctacatcaccctcaaccttacctcggcagcagcattatggcttaaagcaccactgcctaaaaaacccggtaaaaagtctcccctcacaccacagcgcgatactttccaaccaactaccactcccgaggttgaacca

SEQ ID NO: 694 - DNA, 1644 bp, Corynebacterium glutamicum
atgaaggtctcgactaaaactccacgctcctcaggtaccgccgtagtcataggcgcaggtgttgctggtttagccacttctgcacttttagcacgtgatggctggcaagtaactgttttggaaaaaaatactgatgtcggtggccgagctggatcgcttgaaatatcaggctttcctggctttcgatgggataccggaccttcttggtacctcatgcccgaggcctttgaccatttcttcgcactttttggtgcatgtacttctgattatctcgatttggtagaattaacgcctggttatcgagttttttctggcacacatgacgctgtcgatgtccccactgggcgtgaagaagcaattgcgctattcgaatccatcgaacccggcgcgggtgcaaaactaggaaattatcttgatagcgcggcagacgcctatgacattgccattgatagattcctttataataatttctccacgttaggcccgctgcttcaccgggatgtactgacccgagctggccgactgttttctctactgacccgttctttacaaaagtacgtaaatagtcaattcagtagcccggtgttgcgccagatcctaacctatccagcagtcttcctgtcttcccgacccactactaccccatcgatgtaccacttgatgagtcataccgatttggtgcagggagtgaaataccctataggtggttttactgcagtggttaacgctctgcatcagttagcgctggaaaacggggttgagtttcaactcgattctgaggtcatttccatcaacactgcttcatcgaggggcaacacaagcgccacaggtgtgagcttgcttcacaacagaaaagtgcaaaatctagatgcggatcttgtggtttcagcaggcgacctacaccatacagaaaataatctgcttccccgggaacttcgaacctatcccgaacgatattggtccaatcgcaatcctggaattggagcggtattaatcctcctgggcgtaaaaggagagttaccccagctcgaccatcacaaccttttcttcagtgaagattggacagatgattttgctgtagttttcgacgggcctcaacttacccgcccccacaatgcatcaaattccatttatgtctccaagccttcaacgtccgaagacggcgttgcacctgctggatacgaaaacctttttgttttaattccgaccaaggcctctagcagcatcggccacggtgatgcgtatatgcagtcggcttcagcatccgtggaaacaatcgcgtcacatgcaatcaatcaaattgctacgcaagccggcatccctgacctcactgaccgaattgtggtcaaacgcaccattggccctgcggattttgagcaccgctaccattcatgggtaggcagtgcgctgggtccagcacataccctcagacagtccgctttcttaagagggcgcaatagctcccgcaaggtcaataacctcttctattccggtgccaccaccgtcccgggtgtaggaatacccatgtgtttaatttctgccgagaatattattaagcgtttacatgccgataccagtgcaggaccactgcccgaaccattgccgcctaaaacgacaccatctcaaaagacctcatacgatcat

SEQ ID NO: 695 - DNA, 912 bp, Corynebacterium glutamicum
atgacacaccaaaattcgcctctcttccttaaaagtgcactgagactttacaatcgggcctcattcaaggcttcacataaagtgatcgaagaatattcgacgagcttcagtctgtctacgtggttgctatccccacgcatacgaaatgacatacgaaatctctatgcagtagttcgtatcgccgatgagattgtcgacggcactgcacatgccgctggttgctcaactgccaaaatcgaagagattctcgatgcctatgaaattgcggttcttgcagcaccacaacaacgcttcaacacagatcttgttttacaagcttatggtgaaactgcccgacgctgtgatttcgaacaagagcatgtaatagccttctttgcatcaatgcgtaaggacctcaaagctaatacacacgacccagatagcttcacaacgtatgtctatggctccgcggaagttataggcctgctttgtctcagcgttttcaaccaaggtagaacgattagcaaaaaacggctagagattatgcaaaacggagcccgctcattgggagcggcattccagaaaattaactttctccgtgacttggcagaagatcagcaaaatttgggccgattttatttccccaaaaccagccaaggaactcttactaaagaacaaaaagaagatctcatcgctgatatccgtcaagacctagcaattgcccacgatgcatttccagaaataccagtgcaggctcgcatcggagtgatctctgcttatttgctctttcaaaaactcactgaccgaattgaggctactcctaccgccgatttattgcgggagcgaatcagagttccacttcatatcaaactctctacactcgctagagccacgatgaaaggtctatctatgagcatctacagaaagaattcg

SEQ ID NO: 696 - DNA, 2190 bp, Corynebacterium glutamicum
atgtctactagcatcacaacagagaacaagaagaaatctggtcctcctcgcttgatgagaatctttctgcccgccttgctaattttagtttggcttgtaggagctggagtcggcggtccttattttggcaaggttagtgaggtctcctccaacagccagaccacatatctgccagaatctgccgatgccactcaagtacaggaacagttgggagattttactgattctgaatccatcccagccattgtcgtaatggtcagcgatgaacccttaacacagcaagacatcacacaactcaatgaagttgttgctgggctttcagaattagacatagtttccgatgaagtctcccctgctattccatccgaggacggcagagctgtccaagtgtttgtccccctcaatccatcagcggagctgacggaaagcgtcgagaagctctctgagaccttgacccagcaaacgccggactatgtgagcacctatgtgaccggaccggctgggtttaccgctgatctcagcgcagctttcgcgggtattgatgggctactcctagcagtcgccttggctgccgtccttgtcattcttgtcatcgtctatcgctccttcattctgcccatcgccgtgcttgccaccagtttgtttgcgctgactgtagctctattggtggtgtggtggctagctaagtgggacatcctgctgctttcgggtcagactcaaggcatcctcttcattctggtcattggcgccgccaccgactactcattgctatacgttgctcgtttccgtgaagagttacgcgttcaacaagataaagggatagccacagggaaagccatccgggcatcggtggaacccattcttgcctcgggcagcactgttattgcgggcctcctttgtttgctatttagtgatttgaaatctaactccacgctaggtccagtagcttcggtgggcattatttttgcaatgctttctgctcttactctgctaccagccctgctgtttgtattcggtcgggtggccttttggcccaagcgaccaaaatacgaacctgaaaaagcccgtgcgaaaaacgacatccccgccagcgggatctggtcaaaagtggctgatttagtggagcagcatcctcgtgcaatctgggtatctacacttattgtgcttctcttgggtgcggctttcgttcccacactaaaagcggacggtgtgtcccaatccgacctagttctgggttcctctgaagcacgtgatggccagcaggctttaggcgaacacttccccggtggatccggcagtcctgcttatattatcgttgatgaaacacaggcagcacaggctgctgacgtagtccttaacaacgacaatttcgagactgtaactgtaactagtgctgactccccctctggctcagccccaatcaccgctgacggtattgtgccgttaggttctggtacagctccaggcccggtagttgtagaagggcaagtccttttacaagcaacacttgtcgaagcaccagattccgaagaagctcaaaaagctattcgcagtatccgccaaacttttgcagatgaaaatatatcagcggtagtaggcggtgtcactgcaacttccgtagacactaacgatgcctccatccatgaccgcaacctgatcatcccaattgtattgctggtcattttggttattctcatgctgttgctgcggtctattgtcgcaccactcctgctagtagtcaccaccgtggtgtcttttgctactgctttaggcgtggctgctttacttttcaatcacgttttcagtttcccaggagcagaccccgcagtacctctctacggatttgtatttttagtagccttgggcatcgactacaacattttcttagtcacccgaatccgtgaagaaaccaaaacccacggcacaagacttggaattcttcgaggcctgacagtaaccggcggagtaattacctcagctggagtagttctcgccgcaacgttcgcagcactctatgtcatcccaattctattcctggcacaaattgccttcattgtcgcttttggagttcttattgataccctgctcgttcgcgccttcttggtgcctgctttgttctacgacatcggaccgaaaatctggtggccgtcaaaattgtccaatcagaaataccagaagcagcctcagcta

SEQ ID NO: 697 - DNA, 1146 bp, Corynebacterium glutamicum
ttgcgagataactggccgtgtgatactcgaatggacaatggcatgacaatcaccacagaacattcaactcatcctgatcttgatttcaatgatgagatttatcgggaactaaaccgcatctgcgcttcgctatctcaacagtgcagcacatatcaaccagagttccgtacctgcctagatgctgctttccaagctttgcgaggtggcaagttaatccgccctcgaatgctactggggctatacaacacgcttgtagacgatgacattgaggtcaaactcaacaccgttttacaggtagcagtggctttagaactactgcatttttcccttttggttcatgacgatgttattgacggagacctctatcgccgaggcaaacttaattttattgggcagattctcatgcatcgcacacctgaaagttttgcacaaatccagcgcgatccagagcatctagattgggcacaatctaatggactgcttatgggaaatctttttcttgctgccacccatcaaatcttcgcgcgccttgaccttccacatcaccaacgggttcgacttttagatttactcaaccacacgataaatgacactattgtgggtgagtttcttgatgtgggattaagcagcaaagccatcagccccaatatggacattgctctagaaatgagtcggctaaaaacagccacatacacttttgaacttccaatgagagcagcggcaattctcgcggaactacctcaggagattgaaacaaagataggtgagataggcacaaacttgggcatcgcttatcaattgcaggacgattacttatctacttttggtgacgcagccgaacacggcaaagatgccttttctgaccttcgagaaggaaaagaaactacaattatcgccttcgctcgagatactgctaaatggactgatattcaagacaacttcggctccgcagatctgagcacctctcaggcagagcgaattcaacatcttctcatacagtgtggagcaaagaatcactccttgaatgccatctccgaccacttaaatatctgccgttcgatgatcaaaacactaagcccccaggtagatcccaaggctcaaaatttattacttaaacaagttgagcaactagccagccgcaaatct

SEQ ID NO: 698 - DNA, 585 bp, Corynebacterium glutamicum
atgctgaatatgcaggaaccagataaaatccatccggcagaacctacacttcgtaatatttatgacgttaaaactagtgatcccaaaagtgaattagttgatcgttctggcatgtcggaagaagacattgcgcaaattgggcggctaatgaaatcgttggccagtcttcgcgatgtggaacgtagtattggtgaagcctcggcacgttatatggagctaagtgcccctgatatgcgagctttgcactatttgattgtggcgggcaatgcgggcgaagtggtgactccaggaatgcttggagctcaccttaagctttccccggcatctgtaacaaagacgcttaataggctagaaaaaggtgggcatattgttcgtaatgtgcaccccgtcgaccgcagggctttcgccctcatggtcactgatgccactcgtggagaggcgatgcggacgcttggtaagcatcaggcgcgtcgttttgatgctgctaaacgattaactccacaagagcgtgaagtggttatccgattccttcaggatatggcacaggagttatcccttaataatgcaccatggctcaacacggag

SEQ ID NO: 699 - DNA, 648 bp, Corynebacterium glutamicum
atgcgcatttcaagcaaacttgtcaccacagcactactcgcagccatttcacttttcgggatatccacggcacaagcccaagacatttttgacggcggacgacttgcaggtggctcctcgcaggtatctaacctaagttcggttcctgaaaacctagcgctgcccgaaattgaaaatagcattgacctagaacgctacaaaggcaagtggtatcaagtcgcagcaattccccaaccattctctttacagtgctcacatgacgttaccgctgattacggcgtgatcgactcggacacaatctctgtaacaaataagtgtggcactttctttgggccttcagttattgaaggcagcgctaaagtagtttccaatgcttcattaaaggttagcttcccaggtattccatttcagagtgaagacaatcaagcaaactaccgcgtgacctatatcgaagatgattattcactagcaatcgtcggcagcccaagccggtcctcaggatttatactatcccgcacgccacagctcagtagtgaccaatggtctcacgttcggaacattacagaggacagtgggtggtggccatgcgcattcattacagtcccagcgacaggtggcttaaacaccgccactccgctctgcacactt

SEQ ID NO: 700 - DNA, 1425 bp, Corynebacterium glutamicum
ttgattactgagttacttgctgccggtttccaagttcgggccacctcgaggaaaaaaacaagtcttcagcgctttgactggtacgaggacgtcgaggcagtggaagcggatctgactgacgcgactgagttagatacgttatttaaggatgtagacgttgtttactatctagtgcattccatgggaggtaagaatgttgattttgaagagcaagagcaacgcactgctgaaaatgtaattcaagctgctgatcaagccgggataaaacagattgtctacctttccggcttacacccgcgtaatcgaaaaatagaagaactatctaagcacatgcgctcacgggaaaaggtcgcccagattttgctggcaggccagacaccagctttaattttaagggctgccacaattattggttccggctctgcatcatttgaaataatccgtcatctcacggagcgtttgcctagaatgatagcgcctcagtggattactaatcagattgagcctttagcaatacgggatgttttgcattacctaatctcggcggctgatttaaaggatccagtcaaccgctcctgcgatattgggtgtggaaagtcgtatgaatttgcggatctattgcgtatctatgccgatgttcggggactgaaacgtcatgtaaattccgtacctctcaatttgcccatggacaagctatccggtctttggattagtctagtgacacctgttccatttcaattgtctttccctttagctcaatcaatggctgaggatgccgtcactgaagagcacagcattaaagatattatttcagatccacccgatggttttattgagtatcgggaagcagtggagctggcattagctgcagaatttgatcgtggagttccaacgtcatgggatcgaagctggactgtacaacaaccgtgggctggccagcctaccgatccagagtgggcgggcaaagctgtatatgaagacgtccgcacagaagatactgatctccgagcagcgcaggtctggccgatcattgaaggtttgggtggcgtgaacggctggtattctgcaccactgctatggcgattgcggggtatcgctgacagactcatcggcggtccaggtttgggcggacggcgggatccccgtcatttgaaacttggggatcgcattgattggtggcgggttactgagatcgatccaccacatagattagtgctcaccgcagagatgaaagtagatggtggcgcttggctgatcctggaagttgcggacaaggaaaatggcggatgtacttatacccagcgcgcaatatttgagccgaagggtttgcccggttatctctattggtgggttgtttcaccgttccatgcgattatttttccttatatgcgttcgaatattttaaaagctgcgcgtaaactcact

SEQ ID NO: 701 - DNA, 1404 bp, Corynebacterium glutamicum
atgaatgatccacaacgctctcccacccttctatggttccgcgatgacctccgactaagtgataatgctgccttaaaatgggctgctgatcatggccccgttattggactcttcattgatgaaacgatcaatcgcagcattggggccgcagcacgatggtggcgagaacaaagccttaatgctttagcccaagatctttctttttacggagtacctttactacgacgtaccggtaatccgcttgaaatactgccgaaaatagtctctgagatggaagtcaaagccgtcacatggaatcgacgctatcatcaaccgttatgtgaagtggatgccactctcaaaaagaatctccgtgataaagggattgaagtgcatagccacccaggttttttactcactgaaccctgggaagtcagtaccgctaccggaactccctacaaggtatttacccctttttctaaagccgcatgggaagtagccagagtacatgcatatgaaactgttaaaaacaatgtgcctgtcccctctcacctaacaggaccagaggatgtagagctgcccatcctagaaatggagcaacctttttggtcaacaacgttagttaaggagtgtgctcccggtgaaaaaaatgcttcggaaaaactctttgattttttggaacatctacaggactacccgcaagctcgagacagcttagcccgatccgctacaagtaaattatctgctcatctaaggtttggtgagatcagcatccaccgcgtgtgggcagagactgcagcaatagactctgaaggaactgagttatttcttaaagaacttctctggagagattttgcgtggcatcgactttatgccctgccacacatggacacgcaaaacgttcgtatgcaatttaatcgtttcggatggtcctgggatccgagtgaaaaagataaacttaacactccatccacccctcttatccccaccaaagctgaccaattccatgaggatttagcagcatggcgtgcaggaaaaacaggaattccgctggtcgatgcaggcatgcgagaattatgggccaccgggtcaatgcacaatcgcgtcagaatggtagtagctagttttttaaccaagaatctccagatccattggcgtcatggcgaagaatggttttgggaaactctcgtagatgctgatccagcttctaatgctttcaactggcaatgggctgcgggtagcggagatgacgcttcgccttatttccgtatttttaatccggtcacccaagcgaaaaaatttgatccagatgaaacttatattcgtcgctgggtacccgaatatggaacaccatcatatccggatcccatcgtcgatctgaaagaatcccgtcaaattgctttagacgcctactctgcgattaag

SEQ ID NO: 702 - DNA, 753 bp, Corynebacterium glutamicum
atgacaacctcaatccaacgcagaatcagtatcgtaattccatgtctaaatgatgcagtacttctagaacagtgcttaagctcaattgttgcgcagactcttcaacctgaggaagtcatcgtcgtggacaacggtagcactgataactcagttgaagtggcaaatcggatgggggctcgcgtggttcatgagccacttcaaggcatcacttgggctagtgcagctggatataattctgcgcgtggagacctaattgtccgtttcgacgcagattgtgtgattcctcctgatcatctaagccaagtcaatgccatttggaaccgtacagaggagacgcctggccgtactatagttgcgctaacaggtaccggcagttttgatattcctggccgtatgggagagtggttggctctatgctatctaggcgcctaccgatggtctacgaaacaagcactaggacactatccgatttttggttcgaactccgtaattagcaggcaatggtgggaggatgtaaaagaccaaattacgttatcagaaacttttgtgcatgaggatatgtacttttccttctttgtccgcccacatgagacggtctggttcgaaaaaaatttaaaactcatcatgcatccacgtgctttgatgggagtcaggcagtcctttatccgattggtacgaggattttatactattaaaattgcttggaaaagagaaccagtccatcagcggctggaatctagaagagattggacc

SEQ ID NO: 703 - DNA, 2415 bp, Corynebacterium glutamicum
atgttcaggcttgctttcgctcaacttcggcgacgaggtgggcgctatttttcattgtttttcgcgattttcgcttcggttgcattgactgttagcgccactgcgttgacaaattctttggtgtccagtgttaatgatctttttgccaagccgtatgaaaacgctgatcttgtggtcacggtgtctgcgaaaaacgaagattcctttgcagcttttgagcaacaattagctacgacacctggtgttgaagctctggcttttgatcaaaattttgcagcctctgtaaagcaatcagacgggatttacgccagtacttcagtccagtcaatttcggaaggcccactgcagtggcggccaatcctagaaggccgattgccccaaggacctggtgagattgcagtaacaacggccccgggtgcgcctgaagttggtgagcacgtatccattcgcctgtcccaaaacactgaggacactgaggttcttgtggttggcgtggtggagccagcggcgcaggaaactttaggtggcgcaccgttcgttgtggcgtctcctgatgcgctgatggagtggaattcttccggtgtgcggggtgaattccgagtggcaacttccgatcctgcctcgctagaggctgcaagctttagcgacgctacggtggtggttgcttcggcggaggggcacgtcgataagcttgctgattcttatttgggccagcgagatcgctatttcttgctgctcgcagcgtttgtggcagtggctgctgccgtggcgtttttggtggtcttttctgcatattcggtgctcactggtgagcgagttcgcgagttcgggctgattcgttcagtgggcgcatcgacgccgcagattttggggtcagtgatttttgaagccggcatcctcggtgtggtggctgctggttttggtgcgcccgccggattgatggcggcgcgtttgttggcggataatgccgcacgttttggcattcgtgtgcccattgatgtgattgatctgccaagtagcacgatgtggctcatcgctggcgtcggcgtggtgatgtccgtgattgcggcattaccggcagtgttcagtgtgtgcagaaaatccgcagtggaatcactgagtacgcctgctatttcgaggacttccccctggttcggtgcattatggttgctgctcgcgggcattgtgggcgccggcggaatgtgggcgtatgaggcaacctcggactaccgcggcatgcgttcagtggctttatccatcgccggttcaggcgctttggtgtgtgcgttgttgattgccacggcggtgctcgtgccctggttattgcacgtattctccaggattgtgggcggcaccgtcccaacacttcagttgggattggcgtttgcagcaaagcagaaatctcgttcggcggcgctgatcgctgtgattcttgctggttctgcattaagctccgctgttctgcatggccaggcacatatcggcacgcatttggtggccgtggctaaaggcatgggcggcacagacatgatggttacagcgcttgatggggaaatccccgccggaatgctggaggaaatctctagcatcgacggcgtgaaaactgccatcgcgccagccaccaccgctgtggaattggaagattccggcaatttctctgtgctcatgctcgctgaagaagacggagcctccgtgatgcgcgcaggcgatactggtgcaccagctggtggccttgttttgggcagaaactctcctgaccaggatgcttacccggccggccaggctgcaaacatcattgtcgcggataccccaacgcaggcggaaatcttccacagcgacaactacttctccatgatcgacccagcactcgccaccggccccagcaccacacgcaacgtactgatcctgctcgacggcgactccaaccaggcccccgacaacgccacggcgcaggcggtacgcaagaccatttcgcttttcgacggacgatactccatcaccgagggtttctccgcccgccaaaacacttttgaactggtttcccgcatcaccaccatgtccacactgcttgccatcgtggccttagcgatcgctgccgttggcctgatcaacacagtggcactcaccatttctgagcgtgcccgcgatcgttatttgctgcgcaccattggactgacctcaactggtcagattctggtgatggctattgaaatgatcgcgctctcattgccggctgccattgttggtgcagtttcgggaggattcttaggcagattcgttgccagttctgccaccaacaccgctgcgacggcaccacttcaagtagacattctcggcggaacggttctcgcgatggtcgcaggatctgtactgtgcgcgctcatcgtgctggcgaacaaacgacgtcgggtggtt

SEQ ID NO: 704 - DNA, 717 bp, Corynebacterium glutamicum
ttgaaccctgccacagataacgctccgccggtcctttcagcccaagatctcatgatgatctatggaaaaggatcaacagaagttcgggctctcgatggcatttctgtacagattcagtccgacaaatggacctccatcatggggcaatcaggctctggcaaaacaactctgttgcagtgcctttccggattggcgcagccaacctcaggcagagtgacactgaacaaaaacaacatcacgttgagctccctgtcagaaaataagcgtgccaagctgcgtcgcacgcacatcagcatggtgtttcaggatttcaacttggtgcctattttgtcggtgaaggacaatattttgctgccgttgcgtcttgcgcatcgcagggtggataagcagtggtttgaacacatcaccagtgtgttgaagattgataatcgtatgcgccatttgcctggggagctgtctggcggtcagcaacaacgcgccgcgattgcccgggcgttgatgtctaggcccgatattgtcattgcggatgagccaacaggaagtttggattccgtcaccagcgatgcagtgttgaatttgttccgcagcattgttgatgattttgggcagtcacttgtgtttgtcacccacgataaagatgctgctcaccgtggtgacgtgttgatcacaatgcgtgatggcaagatcatcgatacggcagatttgcgggtggggcgt

SEQ ID NO: 705 - DNA, 153 bp, Corynebacterium glutamicum
ttggctgtccaagaagatcatgcgccgctaaacctcttgcatagaaaaacccgtgatatctacctcgaagtaggcatcgcgggtttttctatgcccaaatgcccatatagtgttgatgcgttagtccacccacgcagctacgccccaaaggaa

SEQ ID NO: 706 - DNA, 666 bp, Corynebacterium glutamicum
atgatcctcgcagctgactggaaccggctaggacccaccttccaaacagccatcattgacaccctgttgatggtcatcatcaccatggtggtggctggcttactgggtcttgtcgtcggcctgctgctttacaccacccgcgctggtggaatcttgaagaacaaggtcatctacaccattttgaatgtgctggtgaactttgttcgacccatcccattcattattttgatcgccgccatcaagccactaacggtcgccgtcatgggcacctccatcggccgagatgccggcatcttcgtcatggttgtcgcagcgattttctctgtggctcgaatcgtggagcaaaacttggtctccattgatcctggtgtcatcgaggcagctcgctccatgggtgcgtccccgatgcgcatcatcgccaccgtgatcattccagaagcacttggaccattggttctgggttacaccttcctgttcatcgcgatcgtcgatatgtccgcaatggtcggctacatcggtggcggtggtcttggtgacttcgccattgtttacggctaccgcgccttcgacaacgaagttatgtacgttgccgtcctggttatcgtcatcatcgtgcaggcagcccagcttctgggcaattggctgtccaagaagatcatgcgccgc

SEQ ID NO: 707 - DNA, 846 bp, Corynebacterium glutamicum
atggctaagcagatcttccgattccacttggtctggggtgttacgcagcgcggtggccacgaacttttgagcaacctgtgtttgtggattggagaacacctcgtagacgctgccgtattccacaactttgccggattccatcacagcaaccttgtctgcgatggaacgcacaacttccatttcgtgggtgatcacaacgatggtgatgcccagttcgcggtttaccttgcgcagcagctccagaacttcatgggtggtttctgggtccaaagcggaggtggcttcgtcggcaagcaaaagcgttggattggtggccagtgcacgggcaatgccgacgcgctgcttctggccgcccgacagctgctcggggtagtttttgcctttgtcgcccaggccgacgaactcgagcatttcttgcacgcgagctttacgagctgccttgtccatcttggcaacttccagcgggtactccacatttccagccgcagtacgcgactggaacaggttgaactgctggaaaatcatgccgatattactgcgcagtttacgcagcttagactcgggcattccgacgatgtcggtgccgttgagcagcaacgaaccgctcgtgggggagtcaaggccattgatgaggcggacaagagtggacttgccggcgccagagtaaccgatgatgccgattacctcaccgggttctacggtgagagtgacattatcaagcgcggtggttttagcagatttattgttgctaaagactttggttatgccgcggaactcaacgcgagtgccctgggtgctgggttgctgcgcggagtattcctctggcgtcggtgtggacgcggtgtg

SEQ ID NO: 708 - DNA, 1080 bp, Corynebacterium glutamicum
gtgtcacacaccgcgtccacaccgacgccagaggaatactccgcgcagcaacccagcacccagggcactcgcgttgagttccgcggcataaccaaagtctttagcaacaataaatctgctaaaaccaccgcgcttgataatgtcactctcaccgtagaacccggtgaggtaatcggcatcatcggttactctggcgccggcaagtccactcttgtccgcctcatcaatggccttgactcccccacgagcggttcgttgctgctcaacggcaccgacatcgtcggaatgcccgagtctaagctgcgtaaactgcgcagtaatatcggcatgattttccagcagttcaacctgttccagtcgcgtactgcggctggaaatgtggagtacccgctggaagttgccaagatggacaaggcagctcgtaaagctcgcgtgcaagaaatgctcgagttcgtcggcctgggcgacaaaggcaaaaactaccccgagcagctgtcgggcggccagaagcagcgcgtcggcattgcccgtgcactggccaccaatccaacgcttttgcttgccgacgaagccacctccgctttggacccagaaaccacccatgaagttctggagctgctgcgcaaggtaaaccgcgaactgggcatcaccatcgttgtgatcacccacgaaatggaagttgtgcgttccatcgcagacaaggttgctgtgatggaatccggcaaagttgtggaatacggcagcgtctacgaggtgttctccaatccacaaacacaggttgctcaaaagttcgtggccaccgcgctgcgtaacaccccagaccaagtggaatcggaagatctgcttagccatgagggacgtctgttcaccattgatctgactgaaacgtccggcttctttgcagcaaccgctcgtgctgccgaacaaggtgcttttgtcaacatcgttcacggtggcgtgaccaccttgcaacgccaatcatttggcaaaatgactgttcgactcaccggcaacaccgctgcgattgaagagttctatcaaaccttgaccaagaccacgaccatcaaggagatcacccga

SEQ ID NO: 709 - DNA, 897 bp, Corynebacterium glutamicum
atgaaacttcgtcgcatcacaaccaccgccatcgctggcctcttcgccgcaaccgcacttgttgcctgtggctccgattccgatggaagcagcaccactgttgctgaaggcaccgaaggcgtgaccatccgcatcggcaccaccgacgctgcgaaggaagcatggaccgtattcgaagacaaggcagctgaagagggcatcaccctcgacatcgttcctttctctgactactccaccccaaatgaggctcttgcccaggatcagctggacgttaacctcttccagcacctgaagttcctggctgagtacaacgtcggctccggcgcagacctcaccccagttggctccagcgaaatcgtgccactggcactattctggaaggaccacgactccatcgacggcattgacggcgagtccgttgccatccctaacgatccttccaaccagggccgcgccatcaacgttctcgttcaggcaggtctggtcaccctgaagaccccaggtctggtcaccccagctccagtcgatatcgacgaggcagcttccaaggtttccgtcatcccagtcgacgcagctcaggcaccaaccgcttaccaggagggtcgcccagcgatcatcaacaactccttccttgaccgcgcaggcatcgatccaaacctcgcggtcttcgaagatgatcctgagtctgaagaagcagagccatacatcaacgtcttcgtcaccaaggctgaggacaaggacgatgccaacatcgcccgcctcgttgagctgtggcacgacccagaggttctggctgcagtagaccgcgactctgagggcacctccgtcccagttgatcgtccaggagctgaccttcaggaaatccttgatcgccttgaggctgatcaggaaaacgca

SEQ ID NO: 710 - DNA, 3012 bp, Corynebacterium glutamicum
atgcagggggaagcgtcggttccttttgccgagctgcatgccaccagcagttataactttctcactggcgcatcggatccgtctgatgtggttgtgcaggccaaaaagttaggacttgttgctctatcagtcatggatagggatggtttttatggtgcagtgagatttgcggaagctgccgcggaagctggaatgcataccgtttatggtgcggagctgagtctgcaagaaggcgtgttgacagtcttgtgtaaaaatccggaaggctacaaaaagctcagtcacctgatcagtgacgcgaaaatggcaacgggagaaaagggggaagttcgctatccgccgctgccaatggttgctgaacatgctgcaggggattgggtggtccttgcaggttttcagtggttggacaaaatcgactatgtgatcgattgctttaaaccggaaaatattgtgctggaattcggttcaaccatgacaccggaagacgccgaccgcaatgaatacctcagaagaacgcaagccaaattccagcttcgaggcatcctaagcaccaacccagaatccgctgcccgggggagcgtgcggcttgccggcgccaagcaggcactagcccgcaagatgccgcttgccgacgccgaaagcgagctacatcccatgggcactacctggatgcgcagcggggatacattgttaaaagcacaccctgattacgcggatctcattgcaaccacggtggaattagctgctgaatgtgctttcaccctagatttggtggccccgaatctgcccaagtgggatacccctggtgaacacacggaaatgtcctggcttgcgcacctggtttccactcggattgatacccgctatgtggggcgctccgcagacatcaaagcacgagctgccacacaaattgactatgaattaggcgttattgaaaagctgggttttccaggctatttcctcgtcgttaatgatctggtggagttttgtcgcgattccaatattttgtgccaaggcagaggttccgcggcgaactcggcggtgtgctttgtcctaggcatcaccaacgcggagccgatctctgctggattgttgtttgaacggtttttatctcctgaccgggatggtccaccagatattgacattgatattgaatccggcaggcgcgaagaagtaatccaatacgtgtatgaaaaatacggaagggataacgcagctcaagtagccaatgtcattacctaccgaacaaaaggcgcgatgcgtgatgctgcccgtgcactgggttacccgcaaggtgctgccgatgcctgggctaaaggaacctcggaaccacccgatgatgtgctggaattagctgcgcaatttaaagggcaaccacggcatttgggtattcactccggtggcatggtcatttgcgatcgccccatcgccgatgtggtgccagtggaatgggctcggatggataaccgctcggttgtgcaatgggataaagatgactgtgccacggcaggcttggtcaaattcgaccttttgggattgggcatgttggaagccatccatcacatgctggatctggtggcagaacaccgaggtaaaaagatcaatttgtgggaactagatctggcggaaccggaggtctatgacatgttgtgcaaggcagatgccgtgggtgtgttccaggtggaatcacgtgcgcagttatccacgctgcctcgactcaagccccgcaccttctttgacctggtcgtggaggtagctctgattcgtccaggtcccatccaaggcggatcggtgcacccgtatttgcggcgccgtgctggtgaagaggccatcacttatgaccaccccgtgttggaaaagtctttgggtaaaaccttaggaatcccactgtttcaggaacagctcatgcaggtagctgttgatgctgcaggttttagtggtggggaagcggattccttgcgcagagcgatggggtcgaaacgctcacctgaacgcatggctgcgttgcgctcgcggtttttccaagggctgaaagataccaatgggattgtgggggagaccgccgagaaactgtggaacaaaattgtggcctttgctgcctacggttttccggaatcgcattcgcagtcgtttgcgtccttggtgtatttctccgcgtggtttaaataccactacccggctgaattctgcgtgggattattgcgggcacaacccatgggtttctattcaccacagtctttgatcagtgatgccagacgccacggcgtgagtatcctgccgatcacggtcaatgattccggtgtggaggccgatgctccgaatggtgcgattcgattggggctcaacctggtgaaaggccttggccacgatgccgcgcaaagaatagaggacaacgccccgtttgattccattccggatttatcgcgccgggctgatcttaatgttgctcaagttgaggcattggcgcgagcgggagcggtggactgcttgggggtcggacgtcgacaagcattatggcaagcgggcgtcgcagcgaccgaaaaacctggaatgctgcctggcctttcggtgattgaagctccggcgttgccggggatgagcgcctttgagctgatggcgaccaatatttccgccacgggagtcaccgcggattatcagccgatggcgttgattcgggagcggatggaggagctggggatcgtgccggcggatcggctattggaggtggaagatggcacgcggctgcggatcgctggcattgtcacgcaccggcagcgcccgcaaactgcgtcggggctgacatttttagggatggaggatgagaccgggctgatgaatgtgatggtgtccgttgggttgtggcagcggcagcgcgtgctggccagaaatgccaaggcgttgattattcgagggattgtgcagaatgcgcaaggggtggcgacagttgtcgctgaccggttggaaccgttggacatgggggagtttctcagccgtggctcacgagattttcga

SEQ ID NO: 711 - DNA, 447 bp, Corynebacterium glutamicum
atgaatccagtgtcaccaaaactgaccacggccaggtacctcacccgcattccatggctgctgatcagcgcgattgtgtttggggtgcttggagtttttgtgtcttcgtggttttacgccggtgtgatcgtagttgccgtcattcttatctggcagctgtggctgatcccgcagcaggtcaagcgactgggatggctggaaacctccgatgagctgctgatcaccaagggaaaactgtggcacaccttcacggttgttccctatggccgcatccagtttgttgatgtcaccgcaggtcccctcgagcgcgcgtttggcatgaaacaagtgcaattgcataccgcgtcggcgtcctctgactccaccattcaaggcctgcctgtcgcggaagccgatgccttacgtgagcgactggctattaaggcccgggagaggatgagcggacta

SEQ ID NO: 712 - DNA, 1413 bp, Corynebacterium glutamicum
atgagcagccttgaagggtttcgaaaagtccaccgcgccaccccattccttcgcatctggaccatcatcgtcgcagttctcgcggcattcgcattcaattccggcgcatccgttttaagtttcatctggggtgtcgtcaccggcgaatacggattcgcagtgctgccgattctattgaccgtcggtggcgccgtcattgtggtggcactggcctggattatcaccggaatttggtggaaagccgtcggattccgcatcaccaatgaagaggtgcagctgcaacgcggagtgatcagcaaagacctccgcaccgcccgatttgaccgtatccaagccgttgacctggtggaatcattcatcgcccgtatcttccgactggcagaagtccgcatcgaaaccgccggcggcagcgactccgccatcagcattggctttttaagaaaaagcgaggccgaggccctaaaaagggagcttctcgacgcctcccagcactcagtcgccaccaccccagccggagttccggctgagcctggggtaggggagaccgttgtagttgagagcgcgggcgatgttctggttccacaaatccccgtgcaacgcaccctcgccagcaccgccttatcactagcaaccatcatcaccgcgatcggtattgtgattttgctcttcgttcctttcggagtgagcattgccgtgccgttctttgtaggcatggtgccagcggtctggaacttgatcgataagtcgtggcaattcaccgcaacacagcgcaacgatgtcctgcatgtcagctatggacttgccaaccgccgcaaacaatcaatcccactgggacgcatccacgcagtgaaactaaaacagccattgctgtggcgactggttggctggtggaccgtgaccgtgactgtagttggctacggcgacaccacccaaggcggaacctccaaaatcttgcccgtgggttccaaagaactcgcactaaaagtccttgaagcggtggggccactaaacagcgccgacatcgccgaatctgcagacccatcacatatgagcagaccccagtacacaccaccagttgctgcacgcctgctcacaccagtcgatcggacccgccaaggcgtcacgttgattggtgtggctggtgcccctggtgcggtggtcgtgcatgaaggcagattcatgccacgtatgtctgtgattgatacctcccacatccaagaactcacccttaaacacgggccgatccaaagaatactgggactctccaccgttgtgtttaacctggtccaagggccagtgggaatggccgcatcggatctcagtgcagctgatggaaaagaacttctcaacattctccgcaacagaaaactacccgcactggaatcagctccgctgggacaaaacagcctggac

SEQ ID NO: 713 - DNA, 738 bp, Corynebacterium glutamicum
atgcctacaaagaacggcacggcaatgctcactccgaaaggaacgaagagcaaaatcacaataccgatcgcggtgatgatggttgctagtgataaggcggtgctggcgagggtgcgttgcacggggatttgtggaaccagaacatcgcccgcgctctcaactacaacggtctcccctaccccaggctcagccggaactccggctggggtggtggcgactgagtgctgggaggcgtcgagaagctccctttttagggcctcggcctcgctttttcttaaaaagccaatgctgatggcggagtcgctgccgccggcggtttcgatgcggacttctgccagtcggaagatacgggcgatgaatgattccaccaggtcaacggcttggatacggtcaaatcgggcggtgcggaggtctttgctgatcactccgcgttgcagctgcacctcttcattggtgatgcggaatccgacggctttccaccaaattccggtgataatccaggccagtgccaccacaatgacggcgccaccgacggtcaatagaatcggcagcactgcgaatccgtattcgccggtgacgacaccccagatgaaacttaaaacggatgcgccggaattgaatgcgaatgccgcgagaactgcgacgatgatggtccagatgcgaaggaatggggtggcgcggtggacttttcgaaacccttcaaggctgctcatagtccgctcatcctctcccgggcct

SEQ ID NO: 714 - DNA, 669 bp, Corynebacterium glutamicum
atgcacatctcagatcttcccgataggtcccaggactacctgaagacaatctgggacatcacagaactccttgatgatcaaccagcagcactcggcgatatcgccgaaaaaatgaaccagaaaactcctaccgcctccgaagcaatcaaaaagctggcggcaaggggcctggtcaaccatgaaaaatatgctggtgtcaccctcactgaacagggcaaaacgctagccatcgacatggtgcgacgccaccgcctgctggaaaccttcctccacgatgttttgggatacacctgggacgaagtccacgccgatgcagacctgttggaacatgcagcctctgatcagctcatcgaacgcatcgatgctcacttgggtcgtccacgcaaagatccccacggcgatcccataccaactgccgaaggcgttattgaagagtctccccgaaccaccctcgaggcagttcagccaggggagactgtcacgatttccagggtcaaagacattgatcctgaattgctgcgctacctcgcgcaatacaacgtctcaccaggatgccggatcaccgttgcgtccggcccactagctggcatggtgcatgtcgttgtagaaggcaccgacaccagcttccccctggccgaaacgcaactgccattaattacagtgcaggac

SEQ ID NO: 715 - DNA, 798 bp, Corynebacterium glutamicum
gtggttatggggccaacccacgctatgagcggtgcagccgtggggcttgctgttgctcaaattctcccagcagaatggggtggggttaccaccgccacggaggcttttatttatgcgggtttagcggcgggtgcagcgctgctcccggaccttgattcaccgcaggccacggtgtcgcgttcttttggtccgattacccaagtgatttcgcgttttacagagaatatttgccaaactttcgtcaatgtcaccaggggcaggaaagacaaacactgcaacaacgggcaccgcacgttgacacatacggtgtggagcgctgctgccacaggcgctggtgccacagcgctaattggcgcctatggaaaacctgcggtgattggtttgctgtttttcttcctcgggctcgccattagaggtctcatgcctgaatggtcaaagaacgcagattggcttttagttactggagcttccgctgcattagcagtgggagtatggaattatgctcccgaaagttcattcggcattgtgttaggctccgccattacagttggaagcctgacccacttggctggcgatatggccactaaggccggtatcccagcatttgccccggtcattccgctgaagggcaaacgctggtggaacctcaaattgcctaagtttttaagcattcgtgccaacggtcctgccgataagttcttactgttcgtattctcggtggcggtcatcattcagattggtttggtctcatcgggaaatatgagcaccattatgatgaatctgcttagtcctgcactg

SEQ ID NO: 716 - DNA, 138 bp, Corynebacterium glutamicum
gtgcatcaactactttcacaactaaaaattcaaaacttaagtgagttcaagaataaaccaaagggtggacacttattcgaacgggtgcttgatttaggcaacttgagcaaaattctgccatttcgcctcaaatcgggc

SEQ ID NO: 717 - DNA, 774 bp, Corynebacterium glutamicum
atgagcgaacgtcagctggaaaagtcaattgagcacgccgtcgagttagcccgcgaagcccgaaacatcgaagtttttaccggagccggaatgagcgccgactccgggttggaaacgtatcgtgatgataaaaccgggctgtggagcaacgtagatccacaagcgatggcaagtatcgatgcatggcgcaaagatccagagccaatgtgggcgtggtatcgctggcgcgccggggtggcagctagggcagaacccaacgcggggcatcaagctatttcctactgggaggggagtgacaccgtcgaacacgttcacatcaccacccagaacattgacaacctgcacgagcgagctggctctagcgatgtgacacatcttcatggcagcttgtttgaatacaggtgctctgattgtgcgactccatgggaagacgataaaaactatccgcaagaacccattgcacgccttgctcctccacaatgtgaaaagtgcggagggctgattagaccaggtgtggtgtggtttggtgagaacctgcccgtagaagagtgggatattgcagagcaacgcatcgcagaagccgatctcatgatcattgtgggtacctccgggattgttcatcctgcagcagcactcccgcaattagcccaacaacgcggcgttcccatcgtggagatctccccaacgcgcaccgaacttagccggatcgcagacttcacctggatgtccaccgcagcccaagcgctaccagcgttgatgcgaggtttgagcgcc

SEQ ID NO: 718 - DNA, 492 bp, Corynebacterium glutamicum
atgactgaagatgacttagatctgctgcaccgcacagtagaactagccacccaggcactcaagcagggaaacagtccttatggatccctgctggttgatcccttcggcgcggtcgtttttgaagaccacaaccgagatgccgatggggatctgaccaagcacccggaattcgccatcgccaaatatgcgatcgaaaattacagtgcatcagaacgtgctgcgtgcactgtttatacctcgacggaacattgcgcgatgtgcgccggtgcccatgcgtgggctggactgggcaaaatttactgcgccaccacaggtgggcaaacagccgcttggtacgcaaagtggggtgcagaatctgggcctttgaacccgatttcagcggacaaaattagcccgaacatatccatcgaaggacctgcttccagatttgaggaagtcctgtatgaactgcatcgatggttttatttagggcagtctccgaataaggctctt

SEQ ID NO: 719 - DNA, 996 bp, Corynebacterium glutamicum
gtgcaatcccgcctgtccaaaatcctgcgcagtagcgtcgtaggcgttgctgtcctagccctgttagctgggtgttctaacaatgcagatgacaccgacgctgattcaacatccacgggaaactccgcttttcctgtttcgattgaacacgagttcggaaccaccacaatcgatgatgtacccgaaagagttgtcacccttggcgttaccgacgccgatattgtcctcgcattggggaccgtcccagtaggcaacaccggatacaaattcttcgaaaacggattgggaccgtggactgatgagttagtggaaggcaaagaattaacactgcttgactctgattccacaccagatcttgaacaagtagcagccctggagccagacctgattattggagtctctgcggggtttgacgacgttgtatacgagcaactatctgatatcgcaccggtggtcgcccgtccagcgggaacagctgcatacgcagtagctcgcgaggaagctaccaaccttgttgcccgtgcgatggggcaatcagaaaaaggacaagagctcaatgaggaaacagatgctctgatccaagctgcgcgtgatgaaaatccttcttttgacggtaaaacaggaaccgtcatcttgccataccagggtaaatacggtgcctacctgccaggcgatgcacggggacaattcctcgattcacttggcatttcgctgccggaagcagttctttcgcgagacaccggcgacagcttctttgtcgatgtccccgctgaaagcgtcaaagacgtagacggtgatgttctcctcgtgctttccaacgacgaaaatctggatatcacagcagagaatccactgtttgaaacactcaacgttgtgcaaaaagacgcagtaattgtggcaacaaccgaagaacgcggggcgattacctacaactcagtgctgtctgttccttttgcgttggaacatctcgcaccacgtattgctgaggctttgaag

SEQ ID NO: 720 - DNA, 471 bp, Corynebacterium glutamicum
atgccggaacacccacttcacgttatcttcgacaatcctgtcatccctcccaacaccggaaacgccatccgaatgtgtgcaggaacaggcgctcacctgcaccttgttgaacctttaggctttgagctgacagaaaagcaccttcgccgagcaggccttgactaccacgacttagccgatgtcacagtgcatgcaaccttcgatgaagccatggctgcagtccctggtcgcgtatttgccttcaccacaacggccaatacccgcttcaccgatatcgcttttgaacctggcgatgcactcctttttggaactgaaccaacaggactccctcaagaacatgttgagcattcccgaatcaccagtgagcttcggatccccatgcttcccggtaggcgttccatgaacctttcaaattccgcggcggtagcgacctatgaagcatggcgtcaactcggatttgtgggtggggtt

SEQ ID NO: 721 - DNA, 852 bp, Corynebacterium glutamicum
gtgactgcaatcaaacttgatggaaacttataccgcggggaaattttcgccgacttggaacagcgcgttgctgcgttgaaggagaaagggattgtgccggggcttgccaccgtgctggtgggtgatgacccagcgagccactcttacgtgaagatgaagcatcgtgactgtgagcagattggtgtgaactcgatccgtaaggatctgcctgctgatgtcacgcaggaagagcttttcgctgtcatcgatgaactgaacaacgatgattcttgcactggttacattgtgcagcttcctttgcctaagcacttggacgaaaacgctgtgctggagcgcattgatccagctaaggatgctgatggcctgcaccctgtaaacctgggcaagcttgtgctcaacgagccagctccactgccatgcaccccgaatggttccatcagcttgttgcgtcgtttcggcgttgagcttgatggcgcgaaggttgttgtcattggccgtggcgtcaccgttggtcgcccaattggcctgatgctgacccgccgttccgagaactccacggttactttgtgccacactggcacgaaggatctggctgcggagacccgtgcggctgacgtcatcattgctgcagctggtcagccgcacatgctgaccgcagacatggtcaagccaggcgcagcggtgctcgatgtcggcgtctcccgcaaggacggcaagttgcttggcgacgtccaccccgacgtgtgggaagtcgccggcgcggtctcaccaaacccaggcggcgttggccctctgacccgtgcattcttggtgcacaatgttgtcgagcgcgctgaaaagctggctggactc

SEQ ID NO: 722 - DNA, 255 bp, Corynebacterium glutamicum
gtgcaaaaagccgggattgtcgtattcgtactggcagtagtggcggcttcggcctttgctctcacagagcactggcgccgagccacattcacacttggtgcatcactgctgtatctttcgctactgcgtctgacctgtgactccaagattcttggagtgctcgcagtgcgatcgaggcgttttgatgccatctacaccgccattgttggcggattgatgacattccttgctacctcagtcgatgcgctgggcagc

SEQ ID NO: 723 - DNA, 1380 bp, Corynebacterium glutamicum
atggaagctattgccatactatttgtcattggggcgattcttgtcgtcgcggtcattgtcctcggtattttcttcttaacttcacgcacctggatcaaggtggctgcagctgatgaagcgctcattgtctctgcgaagaagaagggggaatcgcaggtcattgtccacggcaaagctgtggtaatgcctattacccagactcaccagaagatctctctgcgttcccgtcaggtaaatatgcaggtgacggcacaaagcgatgacaatgtcacgttgaatgtcgaggctgttgcgctggtgaagatcggttccgaagctgagtttattcgtcgcgctgcccagcgcttcgcttccagtgacaaagaaattgttcggttcacacaggatcagctggaaggtgtgcttcgtggtgtcgtggcgcagcaaacagtcacgtcgctcatgcgtgagcgtaaaaaattctccgagcagatcgctgaaacagtcatccccgagctagagaagcagggtttgattcttgactccttccagattcgtggcatcaccgatgatgtgggatacatcaaatccctcggcgcaccggaaattcaggcaaagaagcaggctgcggaaattgcagaaactgaagctgctcgtgcgatcgctaaatcacgcattgctaaccaagaggcagatctggttgaacagacccaacttgatgccaacaaggctgccgctgatgctcaggtcggtgaagcccgtgcccaggctatgcaggctgaacgccttgccgatgaaaaagctcgactagaggttcttcgccaacaggctgaaaataagcagatcgagctggaagccgaagtgaacaaggtggccgacgctgaacgctaccgccgcaagcaggaagtcgaagccgatactttcgagcaaaccaggcgcgcacaggctcaggtcgaaatcgcagaagccgaagctaccgctgcaaaggttcgtgcaatggctgaagccgaagctgttcgattgaagggacaggcagaggcagacgctatcaaggcaaaggccgaggcctaccgcgaaaaccaagaagcactactcgcccagcaagccatggaaatcctgccggaactcatgagcaacttcgcctctggatacgcaaacattggatccatgacagtgctctccggtggagaaggatccgagaattccgtgggttcacgttttgccggtgaacaagcacttggactgaaatccattattgaatcagtcaagcaaaccaccggcattgatctagctgagatcatccaaggccgtgctgctggacatgcacagggctccgctcagggtgcagcgattgctgaagcgctttcacgcgatgaaactgtggaagatcgctctgaaaaa

SEQ ID NO: 724 - DNA, 963 bp, Corynebacterium glutamicum
gtgactttgttgaactctcgtcgggccgctggcgcttttgctaccacgctagtcgccagcactctcggattaagcggatgtacctccgtaacttccagtgctacgagctcccctgaaccgccgactaaagttgcggcggcaatgcagacaacgactggggagacgtcgataagcaatgaaacctcgtttaacgcctcacgcgaaacctcgctgacggcgctgggtttcttggactatcttgacgaggagcaacgcgccgccttgctcggtgaaggcctggacatcagcacgctgacctgggccaaccaggttaccgcgctgcgtgtgctggaatccctcttcaatgagcatgcatacgagctggtttctgcagtgattcagcatgtagctcaagaacctggcgataatccacaccactttctgaagttctcgcctgaaccatccaccgagaattcttgggaattgaccctggatggaccaactgtcggattgaaagtcactttcgatccggacggtcagatcactttcaaggatgctcatttgggcctgagcccagctgaggtcgttagtgtcactgaggcgttagatacctcctattcggaatcgcaaatcaaaaaagctgcggaacaactggtgggaagcctcaatccaacccagcaggcagcgctccaaggatccggtttgcgaggagcacagctcactgaagagcaaaagaccctgttcttaaagatgacctccaactggatcgaccttgccaatggcgattccggctctgaacagcaagaagaaatcgctgatacgttcagtgatacctacatcatttggaatgagcagaaagatggctcagcattcttccagatgaaaggccctgagctcgacttcagctataaagagagcgtgcctgaaaacgctgaactctctgcacggggagtccccaatattcagacctcttttcagtcacct

SEQ ID NO: 725 - DNA, 1131 bp, Corynebacterium glutamicum
atgcccaccctcgcgccttcaggtcaacttgaaatccaagcgatcggtgatgtctccaccgaagccggagcaatcattacaaacgctgaaatcgcctatcaccgctggggtgaataccgcgtagataaagaaggacgcagcaatgtcgttctcatcgaacacgccctcactggagattccaacgcagccgattggtgggctgacttgctcggtcccggcaaagccatcaacactgatatttactgcgtgatctgtaccaacgtcatcggtggttgcaacggttccaccggacctggctccatgcatccagatggaaatttctggggtaatcgcttccccgccacgtccattcgtgatcaggtaaacgccgaaaaacaattcctcgacgcactcggcatcaccacggtcgccgcagtacttggtggttccatgggtggtgcccgcaccctagagtgggccgcaatgtacccagaaactgttggcgcagctgctgttcttgcagtttctgcacgcgccagcgcctggcaaatcggcattcaatccgcccaaattaaggcgattgaaaacgaccaccactggcacgaaggcaactactacgaatccggctgcaacccagccaccggactcggcgccgcccgacgcatcgcccacctcacctaccgtggcgaactagaaatcgacgaacgcttcggcaccaaagcccaaaagaacgaaaacccactcggtccctaccgcaagcccgaccagcgcttcgccgtggaatcctacttggactaccaagcagacaagctagtacagcgtttcgacgccggctcctacgtcttgctcaccgacgccctcaaccgccacgacattggtcgcgaccgcggaggcctcaacaaggcactcgaatccatcaaagttccagtccttgtcgcaggcgtagataccgatattttgtacccctaccaccagcaagaacacctctccagaaacctgggaaatctactggcaatggcaaaaatcgtatcccctgtcggccacgatgctttcctcaccgaaagccgccaaatggatcgcatcgtgaggaacttcttcagcctcatctccccagacgaagacaacccttcgacctacatcgagttctacatc

SEQ ID NO: 726 - DNA, 1311 bp, Corynebacterium glutamicum
atgccaaagtacgacaattccaatgctgaccagtggggctttgaaacccgctccattcacgcaggccagtcagtagacgcacagaccagcgcacgaaaccttccgatctaccaatccaccgctttcgtgttcgactccgctgagcacgccaagcagcgtttcgcacttgaggatctaggccctgtttactcccgcctcaccaacccaaccgttgaggctttggaaaaccgcatcgcttccctcgaaggtggcgtccacgctgtagcgttctcctccggacaggccgcaaccaccaacgccattttgaacctggcaggagcgggcgaccacatcgtcacctccccacgcctctacggtggcaccgagactctattccttatcactcttaaccgcctgggtatcgatgtttccttcgtggaaaaccccgacgaccctgagtcctggcaggcagccgttcagccaaacaccaaagcattcttcggcgagactttcgccaacccacaggcagacgtcctggatattcctgcggtggctgaagttgcgcaccgcaacagcgttccactgatcatcgacaacaccatcgctaccgcagcgctcgtgcgcccgctcgagctcggcgcagacgttgtcgtcgcttccctcaccaagttctacaccggcaacggctccggactgggcggcgtgcttatcgacggcggaaagttcgattggactgtcgaaaaggatggaaagccagtattcccctacttcgtcactccagatgctgcttaccacggattgaagtacgcagaccttggtgcaccagccttcggcctcaaggttcgcgttggccttctacgcgacaccggctccaccctctccgcattcaacgcatgggctgcagtccagggcatcgacaccctttccctgcgcctggagcgccacaacgaaaacgccatcaaggttgcagaattcctcaacaaccacgagaaggtggaaaaggttaacttcgcaggcctgaaggattccccttggtacgcaaccaaggaaaagcttggcctgaagtacaccggctccgttctcaccttcgagatcaagggcggcaaggatgaggcttgggcatttatcgacgccctgaagctacactccaaccttgcaaacatcggcgatgttcgctccctcgttgttcacccagcaaccaccacccattcacagtccgacgaagctggcctggcacgcgcgggcgttacccagtccaccgtccgcctgtccgttggcatcgagaccattgatgatatcatcgctgacctcgaaggcggctttgctgcaatc

SEQ ID NO: 727 - DNA, 2202 bp, Corynebacterium glutamicum
gtgaagaagtcccctaaaatgtcaccgaccgcccgcgttggtctccttgtctttggggttatcgcggcggtgggttggggagcaatcgctttctcccgtggcgaaacaatcaactctgtgtggctggttttggcggcagttggttcctatatcattgcgttttctttctatgcccgactgattgaatacaaagttgttaagccgaaagatcagcgagcaaccccggcggaatacgttaatgacggcaaggactatgtcccaacggatcgtcgtgtgctttttggccaccactttgcagctattgcaggtgccggtccattggttggacctgtcatggccgcgcagatgggctacctgccaggcaccttgtggattatcctcggtgtgattttcgccggtgcagtgcaggactacctagtgctgtgggtgtctactcgtaggcgtggacgctcacttggccagatggttcgtgatgaaatgggcacggtcggtggagctgccggtatcttggcgaccatctccatcatgatcatcattatcgcggtgctcgcattgatcgtggttaatgcactggctgattcaccatggggcgttttctccatcaccatgaccatcccaattgcactgttcatgggtgtgtacttgcgttacctgcgcccaggtcgtgttactgaagtgtccatcatcggtgtggcactgctcctgctggctatcgttgctggtggttgggttgcagacacctcatggggcgtggaatggttcacctggtctaagaccactttggcgttggccttgatcggttacggaatcatggctgcgattttgccggtgtggctgctgcttgcaccgcgcgattacctgtctacctttatgaagatcggcgtcatcggtctgttggcagtgggtattttgttcgcacgtcctgaggtgcagatgccttccgtgacctccttcgcacttgagggcaacggtccggtgttctctggaagtctgttcccattcctgttcatcacgattgcctgtggtgcactgtctggtttccacgcactgatttcttcaggaaccacaccaaagcttgtggagaaggaatcccagatgcgcatgctcggctacggcggcatgttgatggaatctttcgtggcgatgatggcactgatcaccgctgttattctggatcgtcacctgtacttctccatgaacgctccgctggcactgactggtggagatccagcaaccgcagctgagtgggttaactccattgggctgacaggtgcggatatcaccccggaacagctgtcggaagctgctgaaagtgtcggagaatccactgttatttcccgtaccggtggcgcaccaaccttggcgttcggtatgtctgaaatcctctccggattcatcggcggcgctggaatgaaggcgttctggtaccacttcgccatcatgtttgaggctctgttcatcctcactactgtggatgcaggtactcgtgtggctcgctttatgatgaccgataccttgggcaatgttccaggtctgcgccgtttcaaggatccttcatggactgtcggtaactggatttctaccgtgtttgtgtgtgctctatggggtgctattttgctcatgggtgttaccgatccactgggcggcatcaacgtgcttttcccactattcggtatcgctaaccagctgctcgccgctattgcacttgctctcgtgctggttgttgtggtgaagaagggcctgtacaagtgggcgtggattccagctgttcctttggcatgggatctcattgtcacgatgactgcgtcatggcagaagattttccactctgatccggctattggctactgggctcagaacgcgaacttccgcgatgcaaagtctcaaggccttaccgaatttggtgccgctaaatctcctgaggcaatcgatgcggttatccgaaacaccatgattcagggcatcttgtccatcctgttcgcggtgctcgtcctcgttgttgtcggcgcagccattgcggtgtgcatcaagtccatcagggctcgtgcagccggaacacctttggagaccactgaagagcctgatactgaatctgagttcttcgccccaactggattccttgcatcttccagggataaggaagtccaggccatgtgggacgagcgctacccaggcggtgcgcccgtgtcttctggagggcac

SEQ ID NO: 728 - DNA, 609 bp, Corynebacterium glutamicum
atgagatcccatgccaaaggaacagctggaatccacgcccacttgtacaggcccttcttcaccacaacaaccagcacgagagcaagtgcaatagcggcgagcagctggttagcgataccgaatagtgggaaaagcacgttgatgccgcccagtggatcggtaacacccatgagcaaaatagcaccccatagagcacacacaaacacggtagaaatccagttaccgacagtccatgaaggatccttgaaacggcgcagacctggaacattgcccaaggtatcggtcatcataaagcgagccacacgagtacctgcatccacagtagtgaggatgaacagagcctcaaacatgatggcgaagtggtaccagaacgccttcattccagcgccgccgatgaatccggagaggatttcagacataccgaacgccaaggttggtgcgccaccggtacgggaaataacagtggattctccgacactttcagcagcttccgacagctgttccggggtgatatccgcacctgtcagcccaatggagttaacccactcagctgcggttgctggatctccaccagtcagtgccagcggagcgttcatggagaagtacagg

SEQ ID NO: 729 - DNA, 201 bp, Corynebacterium glutamicum
atgatggctcttactcatgcactgtggaaaatcccgcgggcggtgtggtggtatctcactgagctcatgggggacacggcgtattccaagtatgtggtgcacttaaagcaccaccatccggatgctccgattcctactgagcgggagtattggcgggcaaagtatgcagatcaggacgctaatcctggtgcccgctgctgc

SEQ ID NO: 730 - DNA, 609 bp, Corynebacterium glutamicum
atgagcaacgtgatcaatcttgtgctcatgcaggcacattccacgcaccaagttaacctgaatctcatacccagtagcgatgccacggatcagatccttgccaccttttccagcctgctgtgctgcagccaaaatcggaggaatgttatctcctgggtgggagtattccgcagcgaggaacgtgtcatggaaatcaagctcacgcaccgcagtgccgttagcaagcgcagcccattccgcggcataacgtcctggcagaccgaaaacagatgcaccccgaccatcggtaactggcctgacctgtgccatcgcacgggcagagctaactggtcgacgcaacacggaagctgcctgcaccgatgcattgtcgatgatgcggttgatgatcatttcctgagtgtccgcagcaacctcaactgggtcggctgcaacgcgagcgatcttgtgagccaggtgctcctcgtacgggaactcttccgcagaacggtgggtgcgcacttcgtggttaatcatggctggaatgtgactccttctcaacgaactaatgttgcacaccacactaattctttaaaaagcaatgtaggtcactgtaaaagttgtgtaattttg

SEQ ID NO: 731 - DNA, 954 bp, Corynebacterium glutamicum
atgtggaacaccatctaccaggcaattggtcaggcattgcacaccaccacggcgacgaggcagtcccgtaaaggtgcgatttcttcatggaaggcatttgctcctgcgtttgcgggcaagatgtccatcgaggcagtagatcgcgcaatgcgtggcgagggcgcaccgtcaccaatctgggaaggcgaagacggcgtaatcgcgtggctgctgtccggtcttgatcacatctacaccattcctttgcctgcagaaggtgaagccaaacgagcaatcttggatacctacaccaaggaacactcggcggaataccagtcacaggcaccgatcgacttggcgcgcagcatgggggagaagctggcagcacagggcttggacctgcgtgatgtggactccatcgttttgcacacctcccaccacactcactacgtgatcggcaccggatctaatgatccacagaagttcgatccagatgcatcgcgagaaacccttgatcactccatcatgtacattttcgctgtcgcgctggaggatcgcgcgtggcaccacgagcgttcctatgctcctgagcgagcccaccgccgagagaccatcgagctgtggaacaagatttccacggtggaggatcctgaatggaccaggcgttaccactccgttgatcctgcagaaaaggccttcggcgcacgcgcagtgatcaccttcaaggatggaaccgtcgtggaagatgaactggctgtggcggatgcgcatcctctgggagcacggcctttcgctagggagcagtacattcagaaattccgcaccttggctgaaggtgttgtgtccgaaaaggaacaggatcgcttcttggatgcggcacagcgtacgcacgagcttgaggatctttcagaactcaacattgaattggatgccgatattttggccaaggctcctgtgattccggaaggactgttc

SEQ ID NO: 732 - DNA, 912 bp, Corynebacterium glutamicum
ttgttttcctctgctgttgcaccaacggagcgtcgaaaagcattacgcgcggcactggctgcgcctgaaattgcccgcatgcctggtgcattctccccgctggcggcgcgcgcaatccaggaagccggatttgaaggcgtgtacgtctcgggcgccgtcgtggcggctgaccttgcattgccggatatcggcttgaccacattgaccgaagtggcgcaccgctcccggcagatcgcacgcgtgacagacttgcccgtgctggtcgacgccgacaccggcttcggcgaacccatgtccgcagcgcgcaccgtctccgaactcgaagatgcaggtgtcgcgggctgccacctggaagatcaagtcaaccccaaacgctgtgggcacctggacggaaaagaagtagtgggcacggacatcatggttcgtcgcatcgccgcagctgtcaacgagcgtcgcgatgagcaattcgtcatctgcgctcgcaccgacgccgcgggagtggaaggcatcgactccgcgatcgagcgcgccaaagcttacgcggatgccggcgccgacatgatcttcaccgaagcgctgtacagccctgcagattttgaaaaattccgcgcggccgtcgacattccgctgctggccaacatgacggaatttggcaaaaccgaacttctgcccgcgcagcttctggaagacatcggatacaacgcagtgatctacccagtgaccctgctgcgcattgcgatgggacaggtcgaacaagctctcggcgacattgcaaacaccggaatccaaaccgactgggtcgaccggatgcaacaccgatccaggctgtatgagctgctgcgctacaacgagtacaacgctttcgaccagcaagtattcacctattccgctgacagctacaagcccatcttc

SEQ ID NO: 733 - DNA, 1149 bp, Corynebacterium glutamicum
atgtccagcgccacaaccactgatgttcgcaaagggctctacggagtcatcgccgattacacggccgtttccaaagtcatgccagagaccaattcactgacctaccgtggctacgcggtggaagatttggtggaaaactgcagcttcgaggaggtgttttacctcctgtggcacggcgagctgcccactgcgcaacaacttgcggagttcaatgagcgtggccgttcctaccgctccctggatgccggtttgatctccctgatccactctttgcccaaagaagcccacccgatggatgttatgcgcaccgcggtgtcctacatgggcaccaaggattccgagtatttcaccaccgattctgagcacatccgcaaagttggccacaccttgttggcgcagcttccgatggtgctagccatggatattcgtcgccgcaagggcctcgatatcatcgcccctgactccagcaagtcagtcgccgaaaacctgctgtctatggtgtttggtactggcccggaatcacctgcatccaacccagctgacgtccgcgattttgagaaatcactgatcctctacgccgagcactccttcaacgcctccaccttcaccgcccgcgtgatcacctccaccaaatcggatgtgtactccgcaatcaccggcgcgatcggtgctctcaagggcccattgcacggtggcgccaacgagtttgtcatgcacaccatgttggcgatcgacgatcccaacaaggccgccgcctggatcaacaacgctttggacaacaagaatgtggtcatgggctttggccaccgcgtgtacaagcgcggcgattcccgcgtgccatcaatggagaagtccttccgggaattagctgcccgccacgacggcgaaaagtgggttgccatgtatgaaaacatgcgcgacgccatggacgcccgcaccggcatcaagccgaatctcgatttccctgctggccctgcctaccacctgctcggtttcccggtcgatttcttcaccccgctgttcgtcatcgcccgcgtcgccggctggacggcccacatcgtggagcagtacgaaaacaactcgctcatccgcccactgtccgagtacaacggcgaggagcagcgcgaggtcgcgcccattgaaaagcgc

SEQ ID NO: 734 - DNA, 930 bp, Corynebacterium glutamicum
ttgcgaacatcagtggttgtggcgctggacatggtgattcactccttatatataggcgggttagaagatgggcttgtagctgtcagcggaataggtgaatacttgctggtcgaaagcgttgtactcgttgtagcgcagcagctcatacagcctggatcggtgttgcatccggtcgacccagtcggtttggattccggtgtttgcaatgtcgccgagagcttgttcgacctgtcccatcgcaatgcgcagcagggtcactgggtagatcactgcgttgtatccgatgtcttccagaagctgcgcgggcagaagttcggttttgccaaattccgtcatgttggccagcagcggaatgtcgacggccgcgcggaatttttcaaaatctgcagggctgtacagcgcttcggtgaagatcatgtcggcgccggcatccgcgtaagctttggcgcgctcgatcgcggagtcgatgccttccactcccgcggcgtcggtgcgagcgcagatgacgaattgctcatcgcgacgctcgttgacagctgcggcgatgcgacgaaccatgatgtccgtgcccactacttcttttccgtccaggtgcccacagcgtttggggttgacttgatcttccaggtggcagcccgcgacacctgcatcttcgagttcggagacggtgcgcgctgcggacatgggttcgccgaagccggtgtcggcgtcgaccagcacgggcaagtctgtcacgcgtgcgatctgccgggagcggtgcgccacttcggtcaatgtggtcaagccgatatccggcaatgcaaggtcagccgccacgacggcgcccgagacgtacacgccttcaaatccggcttcctggattgcgcgcgccgccagcggggagaatgcaccaggcatgcgggcaatttcaggcgcagccagtgccgcgcg

SEQ ID NO: 735 - DNA, 192 bp, Corynebacterium glutamicum
gtgtatttcgacgtttcacaagatgttgatgatgagcttcatttcagtttcttcgaactttacgcggatcaagcggctcttgatgcccaccgctgcgcgccgcatttttacgtgtggcgcgaagcggtggcgaaacatgttcttcccgggagtcagaagaacatggtggggacgagaatgttgcaccatggc

SEQ ID NO: 736 - DNA, 672 bp, Corynebacterium glutamicum
atgcgcacggtcttccgattcaccggggtagaaaatctcctcggtgttttgtgctttcggagtggatttaacttccccaaccagatcgctgagtgcgtcatcgaaatcttgtggatcgcgaaacgctgcaacatccaacgcgatgaacaagtggccagctccacctgggggagtgggatcatacggaccatgtaccttggtgctgtgctgggaaccagtgagaactccagaaagcacatccatcatgaagctaatcgcataacctttgtgaccagccatgggaaggacgacaccgttgattgcctcagcaggatccgtggtgggtgcgccctcactcgtgatcgcccaagtctcaggaatgggcatgtttgtctgtcgtgcgtggtagatctttccgcgcgcaaccgcagtattggctatatcgactaccgtagccgtttctccaaaaggtgccgcaatagaccatgggttggtaccgatccgtttttctctgccaccccagggcgccatcgccggagatgcattggtggtgagaatggaaacacatccttgcgctgccgctttccgggtgtagtacatggcagttccaaaatgattggagttgcgcaccgacaccgcaccgatgccgaacatcattgccctagtcactgcttctttacgagcatgatcagc

SEQ ID NO: 737 - DNA, 1041 bp, Corynebacterium glutamicum
atgccagaagtcactgtcaacgcccaacaactcactgttctctgcacagacatcctcaccaaaactggagtacctgcagcagacgcccatcttgtcggtgatagtttggtgcaggctgatctttggggtcacccctcccacggtgtgcttcgactgccttggtatgtgcgcagactccacagtggcgcgatgactacacatgcacacgtggaggttctcaatgatttgggtgccgtgttggcgttggatggacacaatggaatcggccaagttttagctgatcatgctcgtaaagaagcagtgactagggcaatgatgttcggcatcggtgcggtgtcggtgcgcaactccaatcattttggaactgccatgtactacacccggaaagcggcagcgcaaggatgtgtttccattctcaccaccaatgcatctccggcgatggcgccctggggtggcagagaaaaacggatcggtaccaacccatggtctattgcggcaccttttggagaaacggctacggtagtcgatatagccaatactgcggttgcgcgcggaaagatctaccacgcacgacagacaaacatgcccattcctgagacttgggcgatcacgagtgagggcgcacccaccacggatcctgctgaggcaatcaacggtgtcgtccttcccatggctggtcacaaaggttatgcgattagcttcatgatggatgtgctttctggagttctcactggttcccagcacagcaccaaggtacatggtccgtatgatcccactcccccaggtggagctggccacttgttcatcgcgttggatgttgcagcgtttcgcgatccacaagatttcgatgacgcactcagcgatctggttggggaagttaaatccactccgaaagcacaaaacaccgaggagattttctaccccggtgaatcggaagaccgtgcgcatcggaaaaactctgcgcacggtatttcattgcctgaaaaaacgtggatggaactgcaagaactggcaatcgagaaccatgttgtaactcaccgt

SEQ ID NO: 738 - DNA, 720 bp, Corynebacterium glutamicum
atggtccaaaaagatgcccaggcctcccctgctacgagaaaagcagatcaggtatacacacagattcgtcgtgaaatcgaagatggaaccttaaatcctgggcaacgaatgtcggaagtgtggctggttgaacacaccggcgcttcgagaaccccagtccgggatgctctccgccggttagccgcagacgagttgatcattttggagccacgtcaggcgcctatggtgtcgccactttcgcttcgccacattaaggatctgtttgagttccgcaggatcgtcgaggtcgcagcgcttgaggaaatctctgttggagcgagtaaatcaccgcgtatctttggtgagttttctacgttggcggcagattttcgagagctggaaaactctgcagacgatgcagatttcaccgccgattttaggcgattgaccagtaagtttgatgatcttgttgcagcaaatactcacaaccaattccttggacgcagcatcttaagtttaaaaccgcacaccacgaggctgcggatcattgcgcattccgatcatgcgcgtctgcgccaatcggttcaggaacatattgaaatgtgtgaagctgtggcctcaggagatttaaggtcggcaggcgctgcgtgtagacagcacctgatccatgtagaaaagagcattttgaccgcattgattaatgctgattctacgggctcgcagggcattgatattaggtct

SEQ ID NO: 739 - DNA, 702 bp, Corynebacterium glutamicum
atgcgtttttctcgagttcttcccgcacttcttatcaccaccgccgtgagcatcccaacagcatctgctgccacactcaccgccgacaccgacaaggaattgtgcatcgccagcaacaccgacgattccgcggtggttaccttctggaactccattgaagactccgtgcgcgaacaacgcctcgacgaactagacgcccaagatccaggaatcaaagcggcgattgaaagctacatcgcccaagatgacaacgccccaactgctgctgaactgcaagtacgcctcgatgccatcgaatccggcgaaggcctagccatgctcctcccagacgatcccacgctggcagaccccaacgccgaggaaagtttcaaaacggagtacacatacgacgaagccaaagacatcatcagcggattctccagcgatccagccagcgatgtactcagccaacttcaacaagccgccaccaccggcacccgcaccgcagaaatccgcgccgaagtattcgccgaccgcaccgatgattacaacgaatcccaaaccgctcttaaagaggatttccaaaactgcatcgatgccatcgatgacgcccgcccaatcccactgcagtacatcctgattggaggcgccatcgctttggcggtcatcgtcctcgggatcagggcgtggactaactcaaggaagcagtccaagcacagccag

SEQ ID NO: 740 - DNA, 897 bp, Corynebacterium glutamicum
atgcccgccccagtaaccgccatcgttgaatccgcaacccagatcagccccaacttcatccggattgtgttcaccggaccagaactcaaagtggtgggcagcgacacaccgctttacgatcagcgcatcaaactcatttttcccaaccccggccaacccctacctgaattcccccaagaaggactctggtacgaagaatgggccaaacttcccgaagactcccgcggcgtcatgcgcacctactccatccgctcactggagcgcaccgaagaagccacccgcatgaccgtcgatttcgtcctccacatcgcgccggggctcaccggacctgcatccacgtgggcggcgtctgctgcagctggtgatgaaattttgattgtggcaccacgactcgatgctgaatatatgggtggcattgaattcgctcccggtgcagccaccaaggtgatcttggcaggcgatgaaaccgcagcacccgcaatcgcgcgcatcctcgaagacctcgcagattccgatattccaggaaccgccatgatcgaaatcccctcagatgacgatgcacttgccatcgagggaccttcctccatcgatgtgaaatggctgccccgcaacggccgcaagcacggtgaattgttgatggaaaccctggccctccaccatgaagaaacagaagctgcagccacctccgaaggcgaacttgtgtgggagactcctgtgttctccgccactggcgaacagatcacagaatccaacccacgttcaggcgactactactggattgctggcgaaagtggtgtcgtgaccagcattcgtcgatctctagtgaaagagaaaggcctcgaccgttcccaagtggcattcatggggtattggaaacacggcgtttccatgcggggc

SEQ ID NO: 741 - DNA, 807 bp, Corynebacterium glutamicum
gtgaccaccaaccatcaactatccgccgaagaaatttccctggcgtacggcgagcgcaccatcatcgattcgctcagcgtcgacatcgtccccggcaaaatcacctccatcgtcggccccaacggatgcggcaaatcaacgctgctgcgcgcctttgcgcgcctccttaaacctagcgccgggcaagcgcttatcgacgcccacccccttccttcactgccaggcaaagaactagctcgcatgctcgggctgttaccgcaatcccccaccgcacctgaaggcatcgtcgtcgccgacctcgtgggccgcggccgccacccccaccaaggactcatgggcagatggtccacacgcgactacgaagtagtggcccaagcattggaaatgaccaacaccaccgagcttgccgaacgccccatcgacgaactctccggcggccaacgccaacgcgtctggatcgccatggcccttgcccaagaaacagacatcctgcttcttgatgaacccaccacctacctcgacatcgccaaccagctcgaagtgcttgatctcctcactgacctcaaccacaaccacggcaccaccatcgtcatggtgctccacgaattgggacttgccgcacgttactctgaccacctcatcgccatgaacgccggaaaaatctacgcccaaggcacccccaccaacgtcatcaccgaaaccatgatgagcgaggtcttccacaccgacgcccgcattatcgccgacccagtctccggcgcaccactggtcatgcccatgggacgacaccacatcaccgcacttcac

SEQ ID NO: 742 - DNA, 1059 bp, Corynebacterium glutamicum
ttggattattcgtcgtcagaaagtcaaagagctatgagccttagccatcaactcaagcgccagcgcgcatcgcgcaactcccgcaggtggctgattgttgcggcattgggcgtcgtcacgcttggtatttttgctttttctttgatgtggggcgaggtgttttatggccctgctcaggtgctgaaagtgttgtctggacagcaggttcccggcgcgagttattccgttggcgtgttgcgtttgccgcgcgcggtgatgggtttgactgcgggtttggcgtttggcgcggcgggcgtgatttttcagacggtgttgcgtaatcagttggcgtcgccggatattatcggcatttcttctggcgcgtcggcggcgggcgtaatttgcattgtgtttttcgggatgtcgcagtctgcagtgtcggcgatttctttgtgtgcgtccttggctgtggcgttgttgatttatctggtggcgtatcgcggtggtttttcggccacgcgtctgattcttaccggcattggtattgctgcgatgctgaattcattagtgtcgtattcgctgtccaaggctgattcttgggatctgccgaccgcgacgcgctggcttaccggctcgctcaatggtgcgacgtgggatcgtgcgatgccgctgattgtcaccactgtggtactcattccgctgctggtggctaatgcgcgcaatgtggatcttatgcgtttgggcaatgattccgcggtgggtttgggcgttgctactaatcgcacgcgcgtcattgcgattattgccgctgttgcgctcatcgccgttgctaccgctgcatgcggcccgatcgcattcgtggcgtttgtgtctggccccattgccgcgcgcattttaggctccggcggatcgctcatcatcccctccgcactcatcggcgggttgatcgtgctcatcgccgacctaattggccaatacttcctcggcacccgctaccccgtcggagttgtcaccggcgcattcggcgccccattccttatctatttactcattcgttccaaccgcgcgggagtaaccctg

SEQ ID NO: 743 - DNA, 996 bp, Corynebacterium glutamicum
ttgatgtcaacaaccaaaaagcttttgtttctcagcgccacgctggttcttttagctgttgcgtgcgtgtgctctgtgaaatttggtgtgcgttccaccagcactgatgatgcgatccaggcattgcttgggcattcggacaccacggagcaagcagcagcattaaagagaattccacggactgtgctgggcatcatcattggtgctgccctggcgattgcgggaaccaccatgcaggcggtgaccaggaatccgctggcagatccaggtatctttggcattcttgctggtgcttctctggctgtggtcattggcatttcctttttcggtttggctggcgcggtccccacgatgatcgttgcggtcgttggttctgcggctgctgcggtgtttgtgtacaccgtgggttctttgggtcgcggtggggccacgccgctcaagcttgctcttgcaggtgcagccaccaccgctgcgctcacgtccttggtcagtgctgtgttgttgcctcgcgttgatgtcatggacagattccgcttttggcagatcggtggcgtgggtggcgcagagtgggatcgaatggccctggctgcaccgtttctcgctgtcggtttcttgctgtgtgtgctcacatccactggtttgaacgcgttggcgttgggtgatgatgtggccaccagtttaggtgagaatgtgctgagaacacggattgtggcgtcgataggcgctgttattttgtgcggcgtggctacggcgctggccggcccgatcgcgttcgtggggctggtggtgccgcacattacgcgcctgattgtgggcacggatcatcgctggctggtgccctgttcggcgctagcgggcgcggtgttgattgttgcggcggatacttttgggcgcgtggtgactcgtccgagtgaaattgccgtgggcatcatcatgccgatcattggtgcgccactgtttatttggattattcgtcgtcagaaagtcaaagagcta

SEQ ID NO: 744 - DNA, 1050 bp, Corynebacterium glutamicum
atgcgtacgtctcgcgttctagccggcattcttgccgcaaccctcacggtgtccctcgcggcctgctcccaggattcttcagaaacgtcctccaattcgtcttcagcagcatcccaaagctctgacgtttccaacgaggcgttccctgtcaccattgagcacgctttcggcgagaccaccattgagtccaagccagaacgcatcgcaactgttggctggtccaaccatgaagtccctctcgcattgggtgtgactcctgtcggctttgagaaggtcacgtggggcgacgatgacaacaacggcatcttgccatgggtggaagaaaccttgagcaagctcggctccgatgagcctgtgcttttcgatgccaccgattccattccttttgaggagatcgccaacactgctccggatgtcattttggcgtcctactctggcatcacccaggaagactacgatcagctgtcccagatcgcacctgtggttgcctacccagaaatcgcatggggcacctccctggatgaaatgattgagatgaactctaaggcgattggcttggagcaagaaggcaaggatctcatcgcagatctggatgcagaggttgcttccgccatcgatgccaacccagagttgaaggatgcgaagcctgtattcgcgttcttcgatgagagcgatttctcgcagattggtgtgtacaccagcattgatcctcgcatgagcttcttgcttgatgcgggtgtccaggaagcttcagtcctcaaggagcactccagcccagatagcttctacgagcaggtttctgcagaaaaccctgaaaccttcgacgatgttgatgtgatcatcacctacggcaccgaagatgatgctgcaaacgctgagctgttgtccaagatgcaggctgatccactgctgtctcgaatcccagctatcgccgagggcaaggttgtgttcttgggtgctaacccactggctgcttcagcgaatgaatccccactatctattccttggggtatcaacgattactttgcaaaactcgccgaacctctgaag

SEQ ID NO: 745 - DNA, 1272 bp, Corynebacterium glutamicum
atgcacgaatctggaaaaaatcctgtcaaggttgtcgactcgcaggcaccacaaggacgcggtgggcatatcggcggacatatcaaacgccgcccgattcctaggcaaacggaaatttccgaggttcgtcgatatatcgtcatgactgccctcgcactcggtggcttcgccatcggtgtgacggaatttgtctccatgggtctgctcagcgcgatcgcctccgactttgagatctccgaagaccaagccggacacatcatcaccatctacgccctcggcgtggttgtgggtgccccgctgatcacagcgtttaccggcaaacttccacgacgccgcctgctgctcatcctggtggccttctttgtggtgggtaacgcgttgtccacactgaatgcgtcctatgaagtcctgttgattgcccgcttcatcgctggtctgccacacggcgcgtacttctcagttgcaggtttggcagcagcatcgatggcaccagacggacagcgtggacgtgcgatcgcctatgtcggtatgggtctttccgtgggtactgtcgccggtgttccagcagcccaagcactgggcgatgctttcggttggtccaccgcctacgtgctggtcaccgtcctgggtgttctcaccttgctggccctatggttcctcatgccacacatgacagagatgaaacccaccagcccgctgacagaactcagtgctttgaagaacagccaggtctggctcaccctgggcattggttccatcggtttcggtggcatgttcgcggtctacacctacatctcttggaccatgaccgaccaagctggcatgccaagctccctgatctggattgtgctgatggcctacggcgtgggcatgatctgcggaaactacgtcggtggacgcatcgccgactggaacgtggaccgcggaatcctcctcgcactgatctgcatcgtggtggccctcatcggtttctacttcacctccaacaacgccatcctgggaaccatcaacttcggactcgtcggattcttcggctccacactgatcccatcactgcagatccgactcatggacgttgcaggacgcgcacaaacgttggctgcatctctgaatcaatctgcactgaatatcggtaacgctttgggcgcagcgatcggtggcgtggttatcggcgcgggttattcctacagcactccagcccttgctggcgctggcctggcattccttgccatcgtggtgtggttccccatggtggccttgcgtaaacgcaca

SEQ ID NO: 746 - DNA, 912 bp, Corynebacterium glutamicum
atgagttttcacatcacatccgtcaatgtcaacggcattagggcagcggtcaaacagcgaagcgaaacaaacctaggtttccttccgtggcttgaagaaactcgcccggacgttgtcctcctccaagaagtccgcgcaagcgaaaaagacaccgccaccgcactgcaacccgccttagataacggatggcactacattggtgccccagcagctgccaagggacgtgccggtgtcggcattttgtctaggcatgaacttgaagatgtgaacatcggttttggatctttccttgactccggccgctacattgaagcaaccatcaaagacaccaccctggatgtgccagtaaccgtggcatctctttacctcccctcaggttcagcgggcaccgacaagcaggatgaaaagtaccgcttcctcgatgaattcgaagggttcctggaccagcgcgctaaagaacgctcccacatggtcatcggtggcgactggaacatctgccaccgccgcgaagacctgaaaaactggaaaaccaaccaaaagaaatccggtttccttcccgacgaacgcgcattcatggattcagtctttggcaccttcccagatgaggcaacccaggttgcaggggccggcgacttcttcggtgccgtggactatgaaggaacgaggcgtcgagaagcaactacggaccctgcgtggttcgacgttgcacgtcgcctgcaacctgaaggcgacggcccctacacttggtggacctaccgcggaaaagccttcgacaccggcgccggatggcgcatcgactaccaagcagcaaccgcagcgatgctcgaacgcgcagaacgctcctgggtagacaaagccgctgcatacgatttgcgctggtcagatcactcaccactgaacgtgatctactcc

SEQ ID NO: 747 - DNA, 657 bp, Corynebacterium glutamicum
atgctgctgacaattctatgggccatcggcatcaccgccgaaggcatgacaggcgcgctggccgcaggccgacaaaaaatggatctcttcggagtatccgtcatcgcatgcgttaccgcgatcggcggcggatccatccgcgacatgctgctgggacattacccgctggtgtgggtggaaaagccactgtatctactgctgatcattggcgcagccattttgacagtgtccatttccttcctgatggagcacttccgtgtgttgttcctcgtgctcgacgccgtgggtctttctgcattcgctgtgatcggcacacaaatcgcactggaaatgggctacggattcatcatcgcagtagtggcatcagtgctcacaggtgtattcggcggcgtcatgcgtgaccttttgtgtgaccgcatcccactggtatttcaaaaagagctctacgcatcaatcgcattcctcgccacctgcgtctactttgcgatgatgtaccttggagcttccgaaaacgtcaccgtcctggtctctgtggtggttgcctttgtagtccgactgctatccatctggcgcggatggagcctccccgtattcgactaccaagaacgcgaatacaaacgagatcccaaaatgcgtctgtggagaatgttccggaag

SEQ ID NO: 748 - DNA, 195 bp, Corynebacterium glutamicum
ttgtacatgggtaagtcattcgcccttctagttcttggcgctatcatcttggccggtggtgtctggtacaccatcgaggttgggtactccgtgatggcaattgttgccgcactgatcatggctgccggtggcggaatcatcacctggggtctcgcagtggctgcagatgtaaattcaccaacctcacacaagatc

SEQ ID NO: 749 - DNA, 975 bp, Corynebacterium glutamicum
atgaaaaaatcactcatcgccattgttgccagtgcgctcgtgttaagcggctgcacctctgattcttctgactcttccggcacttccggaactgtggaaaccacttcgattacaaccagcgttgccgcagctgacggcgcattcccacgcaccgtcacactcgacgattcctccatcaccttagaatccaaaccagagcgcatcgccgtactcaccccagaggcagcatccttggttctccccatcacaggcgccgaccgcgtcgtgatgaccgccgaaatggacaccgctgacgaagaaaccgcagctctggcctcccaagtggaataccaagtcaaaaacggtggcagcctcgaccccgaacaagttgtcgccgccgacccagatttggtgatcgtcagtgcgcgtttcgataccgaacaaggcaccatcgacattttggaaggcctcaacgtccccgtagttaacttcgattcagacgcttggggagacatcgacgccatcaccaaacacctagaaattgtgggtgaactcgtcggcgaagaagacaaagccgcagaagcaatcgcagaaatcgatgcaaaccgcatcgacatcgacaagcctgccacctcccccactgtgctcactttgatgcaacgcggaccacgccaaatggtcatgccagaatctgccatgctcaacggcctgatccgcgaagccggcggcactccagtggtagattctctcggcgcggtaggcaccatcactgcagacccagaacaagttgttgcgatggcacctgagatcatcatcattcaggacttccaaggtaaaggccgagagaacttcgctaatttcctctccaacccagcgctagccaacgttcccgccattgaaaacgacaagattttctacgccgacactgtcaccactggagttactgcaggtaccgatatcaccactggtctgcagcaagtggcagaaatgctgagc

SEQ ID NO: 750 - DNA, 780 bp, Corynebacterium glutamicum
atgcctcaattagttgaaattcgtgatctcaacgttgaattcccctctcgccatgcagtgaaaaacgtgtctttttctgcacctgctggaaaagtcaccgcactgattggcccaaatggtgctggtaaaagtactgccctttcggcgattgcaggattggttgaatccaccggcgaggtaatggttggtgggagtggggttgcgtcgaaaagcgctaaagcccgagcccgcctgctctcactcgtgccgcaaaacaccgagttgcgcattggttttagtgcacgcgacgttgtcgcgatgggccgctacccgcatcgtggccgcttcgccgtggagaccgacgcagatcgacgcgccaccgatgacgccctgcgcgccatcaacgcgctcgacatcgccgagcagcccgtcaacgaattatcgggcggccagcagcagctcatccacatcggccgagcgctcgcccaagacaccgccgtcgtgcttctcgacgagcccgtctccgcccttgatctacggcaccaagttgaagtccttcaactcctgcgcgcccgagctaattccggcaccaccgtgatcgtcgtccttcacgatctcaaccacgttgcccgttggtgcgaccatgcagtgttgatggccgacggcgaagttgtctcccaaggtgacatccgcgaggtgctcgaacctgccacactgtccaccgtgtacggactgcccattgcggtgcgcgatgatcccgaaaccagctcacttcgcgtgatcccgcatccaaatcccttt

SEQ ID NO: 751 - DNA, 1017 bp, Corynebacterium glutamicum
ttgtcgcgcacaggtgtttcgaaaaaaccaaagctcaccgctcctgttgtcatcatcggcaccctcgtcttgttgatcatcgccttcaccgcttccctcatgctgggtcccgtgacggttccattgaatgagcttgcaaccaaccccgttgtcaccgatatccgtgcaccacgcattatcatcgcagcattggtgggtgcggcgctggctgtctccggtgcgatcatgcagacggtgtttcacaacccgttggcggatcccggcattgtgggtgtgtcctccggtgcagctgttgcagctgtcttggcgattgtcaccggtgcgagtttctttggccaatggaccgttccttttgcggccttcgtgggcgcattggtcacggtggctgtggtatatttgatcgctagttcccgcgcgatggatggccgtggcgcagatccggccacgttggtactggtcggcatggctatcactgcctttttgggtgctgttatttccagcgccactgcgaacgcaccacaagattctgagcttcgatccgtgacgttttggctcaacggcgatctggtatctcggacgtgggaacatgtgggcgttgcaataatccccattatcgttgggttgattctagctatcggcggttcccgcgatctgaacttgttgctgctgggtgattccacagcgcaaacatctggactcaacgtcaaccgcgcacgcatcattttgctagcacttgcggcactgctcaccgccacagctgttgcggtctccggcaccattacgtttgttggattggtagtaccccacctggtgcgcattgttttaggtgccgatcaccgagcgttactcccggccgccgcgattttgggcgccacgtttgttatcgtttccgacactgttgcccgcatgatcttctcccccatcgtcttgcaaacaggcgtggtggtggcgttcattggctcaccaattttcctttatttactgctcagcatgcgcaagcgacgcggattggggctg

SEQ ID NO: 752 - DNA, 1035 bp, Corynebacterium glutamicum
atgacgacgcaggataaagatctcaccgcacaaaccgcttccagagtcctttctggaattcagcccaccgccgattcctatcacctgggcaattacttgggagcagtcaagcagtggattgacctgcaagattcctacgatgccttctacttcattccagatctccacgcgattaccgtcgatcaggaaccagaagagctgcgcaaccgcaccatttccggcgccgcacagctgctggccctgggcattgatccagaacgctccaccttgtttgtgcagtcgcatgttcccgcacatgcagaactgtcatgggttctgacctgcctgaccggtttcggcgaggcatcccgcatgacccagttcaaggacaagtcctccaagcgtggcgccgaccgtacctcagctggtctgttcacctacccgatgctgatggcagcagatattttgctgtaccgcccacatcttgtcccagtcggtgaagatcagcgccagcacctggagctcacccgcaccctcgcggagcgtttcaacaatcgtttcggcaaggccttcgaggttccagaaggattcatcccgcagggcgcatccaagatttacgatctgcagaaccccaccgccaagatgtccaagtccggcgacaacccgaagggcatcatcaacctgcttgatgatccaaaggtgtccaccaagcgcatcaagtccgcagtcaccgacaacgacggcgtcatcgcctacgatccagaaaacaagcctggcgtgtccaacttgctggtcatccagtctgcgctgacgggtacctccatcgattcgcttgtcgacggctaccagggcgctggctacggtgcgttgaagggtgacaccgccgacgcgcttgaggctttcaccactcctttgaaggcaaagtacgacgagtacatgaatgaccgcggcgagctcgaacgagtcttggctatcggtgctgagcgcgccaccgaagttgccaacgaaaccttggctgatgtgtacgacaagattggtttcttggcgtctcgtcgc

SEQ ID NO: 753 - DNA, 1083 bp, Corynebacterium glutamicum
atgtctactagaacaacgccacaagaccgttataccgacgaatacggcatcgaacgcgtcaacaaggatgaacccggcctggtggacaaactccgggacaagcacgactggtttgatcatctcatgcgcatgaatgaacgtttcggcgcaaaaggtggcaaccaattgtcggcgggtattacgtatttctccgtgctgtcgatcttcccgattgccatgcttgtcttcggtattgcaggtgtcatccttgccggaaaccctgaagttctcacagatattcaaaatcgaatcaacgatgctttagaaggcgagatcggtaacaccgtcaacggcatcattgattccgcgattgcgcagcgtggtgctgtgttgggcattggtggtgtaactgccctgtggtctggactggggtggatggcgaacctgcgctttggagtttcccgcatgtgggccattgacccaactgaaggcaacttcattcaaaagaagctcaccgacttggtcgcgctgatcgtcttgctgctggccatgggcgtagccttcggtatcacggcgctcggtgcttccggactaaccaaaaacctgctggactttgtgggcctgggggagattccgggcattagctacatcacctgggtggtcgcagcacttgttggtgtcttggctaacttcctggtgttcatgtggctgattttctccctgccacgtaccaaagttcccatgaaaccgggtcttcaggcagcactgcttggcgcaatcggttttgaggtggtcaagcaggttggatcgctgttggcttcaaatgcattgagtaaccccgcgggtgcagcattcggtccgatcatcggcatcatggttgtgctgtatttgatctggcgcatcctcatgtattgctctgcgtgggctgccaccagtgaagaagcgttgcgtcttgcgactgttccagcaccagagcctgcgatcattcgggttcgccatgaaattgatccaggtgaagaagtctcccaatctgctcgaaaagtgggcattggagtggccgtgggtgccgcgactgcgggtgcttttgcgctgttgcgtaaaaaa

SEQ ID NO: 754 - DNA, 903 bp, Corynebacterium glutamicum
atgaacacgaacttgccgaacctatacaccgcatttgaccttgatcgaagtgaatcctccgaagctttaggtgtttccctttctgcccgcgatcttcgcttagaacaaatgggaattgcccaggacgatcctcgacgtgcccaaaccgtccaagctttcgcagtgcttgcagacccagcaaaacgcgccacctacgatgctcaattagaagctggagttccactcacctgggcgcagattcagcatttaggaaacttcggcaccttgccttccacccctactgcgcagccgtttgcggcacctcagccggagccgtcgccggaaccgcaacagcagtggaatagcggacaaaactatgcgtatggcaatccgaccatggattaccaaactcagcagagctacaacccgatgcaggaccaaacccaagcgtcgatgtatgcgcaacctttcgcgaacacccctgcaccgatgtacaacagcaatcaggtttttaacaggcctactgcgggtacgcgtttgtggatggcgatcctcgacagtatttttgccggcatcgctggtggaattgtctccggtattttcggctttggatctgaattcctcaccagtgtcatcatgattttggtgctgatcgtctatatcgtgggtagtgaatccttcctgggatccacccctgcgaagaagataatgggctacgagacccgtgatgtggacactcactccaagctttccgctggtgccgcagcaaagcgcaactggtggaaactgatcagcttcaccggtatcggttctgtggtgtcgtttgtgatggccatcgtttatggctcttccattaatgaaagcaatcagatgcgcggtatgcacgaccgcttggccaacgcagaggtcgtgaagaagaacacc

SEQ ID NO: 755 - DNA, 1137 bp, Corynebacterium glutamicum
ttggaagctcccaacactgatctgtgcccctacaaggaatctccttccccggcgcgcagcacatcagaggtagtcgcgccgggtgcacaaacgcccgcgctggttccggttccatctgttcccgcaggtggtgagaaattggcgacatgcggtgtgatcactcccaatggctttgagcttcctgaagattctgatgaaactatcactgcgtcggcgtggatggtgtttgatattgattccggtgagatcatcgcagcaaaggatccccacggaaggtatcgccccgcatcgatcatcaaggtgttactcagcttggttgccatcgatgagctgaaccccaccaccgtggtcacgggcacgatggaagccgccaacatcgagggctcccgcgtgggtgtcggcgagggcggccagtataccgttgatcagctgctgcacggtcttcttttagccagcggtaacgatgcggcgtatctgttggctcaggaacttggtggggatcaagcaaccctggagaaagtaaacgcgctggccaaggagttgggcactcaagacaccttcgttgccacttattccggtttggatgcgccgggaatgtcgacctccgcatacgacatgtcattgatttatcagcatgcgtggcagaacccggttttcgagtcgattatctccaccgatcacattgatttccctggttggggcgacaatgagggtttccaagtctggaacgataacgccttgttcatgaacgatcctgatggcatcggcggcaagaccggctacaccgacgacgcgaaccacacctttgtcggcggtctcgatcggggtggtcgccgcctcgccgccgtactcttggattccaccgtcagcgacattcgtccgtgggaacaagcacgattgcttatcgacgcctccctccccatcacgccggggtccggcgtgggccagctgggctccggcagcgcgaacgatgtggcaccggcgaccccagaattaccagaacccaccgacaacctgacttcaggtgagggtgggtcgcagaacacgctgcttaagctcgtggtgcccatcggaatcatcgtgctgttgctaatcgccgcactagcgtggacattcagatctcccaagaaaaagaac

SEQ ID NO: 756 - DNA, 1227 bp, Corynebacterium glutamicum
atggctgaaaaaggaatcgttcccgttaaactctccctcacagaaggtgacttctataccctgtgggcaccaaactggcgcgaaggcggcaatgaatggcaagcgtttctcggtgcgaacgatgacctttatgtattcaactccccggaagagctcctcgtcttcttagaatccgacgacaagcatgatctgacctcccacccagagtggaagaaattcaactccggcgacgcagcccgcgttgtcccagacgccaacgcagagctcgacatcatcggcgcaccagcacttcttgccgatcgcccctcctacgcaaacgtcaaaaccctctcccgcatcttcgctgtcatgcgcagcctcggccacgtcaccgctgcctccccagtcaccgtgttcttctcctcccactccgtgctcagcaacgttgaccgcggatccgagcactactccggacccaacggcctgggcgaatggacctccgttggtcgcgcagtagccaccaactggaacggcgttgtcgacgccctcgacgaagccatcaccgtcaaggaagtaaacagcctctttaccgaagacgccgcaacccgcattcaagaagcacaagcagctgttcaggcagctcgcgaggctgaagagcaaatcgccaaggaagaagccgaaaaggtcgacccttacgacaactccccatgggctgcagcaggcatcgaccccatcaaggtctccatcgacggacgcaccatctacaccctgcgcacctacctcggcggacagccagtattcctcggaaaattcggcgaaatcttcaccttcaacagccaaaaatccctcctgcgctggctcgtcgaacacgatgaccacgacctcgcccgcgcctccacctggagcgacctcatgctcggcatcaacgccggtgaaaccgaactcctcgtccacagcgacaacgtctactccttcaacggcctggtcaaagacatcaacacctccgtcgacgccgtagacacccaacaaatggcccgcgcctacgaactcatggcagacaccgccgactgggccgacgacgactccatgaattcctacttcctggccaacccacgcatgcaggactacatctcctacatgctcggcggcagcgacacctccggatatgtccctcacgcaccattcaacgaccactctgagagctggcgcgagctggaggagatgctgatcaagcgattcagcaagttc

SEQ ID NO: 757 - DNA, 858 bp, Corynebacterium glutamicum
atgatcggtctgatcagcgcccttagccgcctagccacacacgaaccagcacaacttccgcaactggccatcccgcaggcgcctgacatttcagccgccatcgcgctcgggcgcgagctcagcgccaaccccaccacccttttatcgcttttcgacgccacgtcacaacaacaccacctccttgtcacctccctcatccaggccgctcccctcattgacgcagcccgccacgacatcgccaccaccgcgcagcactacctcaaccaggcagcgggattagtcatgcgcagtttctccatgaatccggcggaatctttcgcagcgcgcaccgaattaatttcacttcctggactgatgattgccgaagccagtcaacggctagaagagatgtcccgacaggtgcaaccaatcgtcgaaaagctagtgcagattcaggacctcacacctgagcccaccgccgaacccgtcgcggaaactgcgccggtctatatggcggcgcaggcgccaagcaatgacaacgaggtgggcaaacaagcagtagccgcggcgaaagaagccctcggcacaccctatttatggggcgggaccagcacttccggcttcgactgcagcggtttaacacagtgggcttggcgtcgcgccggggtggaaattccgcgcatcgcggaccagcaagcagtcggccggcaagtcacctacgacgaacttcaagaaggcgatctactgatttgggacggccacgtagccatgtacgccggcggtgggcaaatcatcgaagccggcgaccccgtgcagctcaatcccatccgaacctccaacatcgggatggcttttcacggctacttccgacccacaggc

SEQ ID NO: 758 - DNA, 195 bp, Corynebacterium glutamicum
gtggatatcaaactgcgcgccagaatcagtgggaagcgcgggcacagcaggggtgggcaacaaacacagctcgtgggcgagctctttggcgtggggcaaattaatcctcatactttgttggactggaaaagtggccgtttggttccctccaagcccaaattcgcccgcgcggtcttcttctgggcggcaatgatt

SEQ ID NO: 759 - DNA, 351 bp, Corynebacterium glutamicum
atgttaaatcattgccgcccagaagaagaccgcgcgggcgaatttgggcttggagggaaccaaacggccacttttccagtccaacaaagtatgaggattaatttgccccacgccaaagagctcgcccacgagctgtgtttgttgcccacccctgctgtgcccgcgcttcccactgattctggcgcgcagtttgatatccaccaggcactatccgcctcccttgccacctatgcccgcaacctcaccttgctgtcccacaccgccgagaatttaggaaaccgcgcgctgacgggcctcgctgaaatcgaagacaccgacgaccaactcgcacacgcattggagcgcctgaca

SEQ ID NO: 760 - DNA, 633 bp, Corynebacterium glutamicum
atggacatcaccatcgtcaaccacccactcgttgctagccgcctaaccctgttgcgcgacgagcgcagcgacaacgcagctttccgtgcagcagccaacgacctcggcgccatgctgatctacgaagcatcccgagatctggaagtcgaacacttcgacaccaaaacccccgttgccatggctgaaggtactcgcctgaagcagccacccatcatcgttcccatcatccgtgcaggtctcggcatgatcgacccagcgctgtcgatgattccggatgcacaggtcggcttcattggccttgcccgcgatgaggaaacccatgagccagtcccataccttgaggcgctgccacaggatctaagcaaccagcctgtattccttgtcgatcccatgctggccaccggcggttccctcctgcacgcgatccgccttcttgctgatcgtggcgccaccgacatcaccgccatctgcatggtttctgcgcagccaggtgtggacgcattggcggaatctggtcttccagttcgtttggttaccgccaccatcgacccaggtctagacgaaaacgcctacatcgtgcctggtcttggagatgccggtgatcgtctctacggtccgcgaaacatcgacctt

SEQ ID NO: 761 - DNA, 384 bp, Corynebacterium glutamicum
gtgtcgaaggaaatgtcggaaaagcggtggtcaagctatggccacgctttcgcgagccgactgaaaaaacttcgaaccctccgtggcttcagccaagaagagctcgcagatctctccggagtgtcccgaaacaccatttctaattacgagcgcaacgaaaacaacaagggcaacgccgtcgatccgcagctgtccaacatctacaggttggcccaagccctcgatgtgccgcccatcgcgctcatgcccgccggctccgtgcccgtggcaaaaatctgcgtcgacgaaaccgccgccattgacgtgcggtggccttcagaaaaagatccactgcttttcgacgcagacctccggctcacccgcaaccgcgagcagccaggaaac

SEQ ID NO: 762 - DNA, 1182 bp, Corynebacterium glutamicum
atggaaattggtgtgcaggttgcctcatggatggaccgccaccatgacgaggtcataaagtggcgcaggcatttgcacagccatcctgagctctcccacatggaataccgcacgactgagtatttggcctcggttctgaaagatcacggcatggaaccacacctgttcccaggaaccggtttgatggtggatatcggaccagaaggggactcccgcctggcgtttcgcgctgatatcgatgcccttccgctgcttgaatcaaccggcttagagttctcttccacagccactggcgttgcgcatgcctgcggacatgacgtgcacacggtgatcgctttggcacttgcctgtgcactgaacaccatcgaactgcccatcggcattcgggtgattttccagccggcagaagaagtcatgactggtggcgcaacggacgtcattgcccacggtggccttgatggtgtggatgcgatttacgccatccacgttgaacccaaattgaaggtcggtcgcgtcggtgtacgcgctggcgcgattacttctgcctcagatgtgatcgaaatcagagtcaagggtgaaggaggacatagcgcacgtccacacctctccgctgatgttgtttacgccttgagcaaattggtcgttgatcttcccggtttgctgtccaggcgcgtcgatccacgcaccggcaccgtgcttgttttcggcaccatcaacgccggctatgcgcccaacgcgatcccagattccggcatcgtgtcaggcaccttgcgtacagccgacatctctacctggcgtgacatgcgtccgcttatctctgagctggtggaacaggtgctcgcacccaccggagtcacccatgaactgatctacaatccgggtgttccaccagtgcttaacgacgatgtcgccaccgctttgttggcaagcgcagcacgcgacatggacacacaatctgttgtccaagcgccgcagtcatccggtggagaagacttctcgtggtaccttgaacacgtcccaggatcaatggcccggttgggttgctggccggggcacggacccaagcaagacctccatcaaagtgacctggttgtggatgagcgagccatcggagttggcgtcaggctctttggctcccttgtgcagcagtacagtagccgatctgaagctttcttaaattcc

SEQ ID NO: 763 - DNA, 1725 bp, Corynebacterium glutamicum
atgaggcaacctgcacaccaatttccatcacgtgaaatacctttctgttttgtccgcaggcgtatcaggaaaacctgcagcgcggtagagtcgagtctaatagtgatcccacgaaaacaaaggatcggggtgttcatggacgagtctcgtcagcttagtttcggcacagcagggttgcgtgcaccagttggcccggcgcgccatcagatgaatgttttgcaggtaaccagaactacagcaggtgttgctagttggttggcagaacgtgcggcactaaatccagtgccgcatttggttcctgaggatgaaacaggaatcggcagggcgttgtatccccaagatggtccgttgcgggtcgttgtggggtatgacgctcgctatggttcgcatacttttgctgcaaccactgcggaggtgttcgcgggtgctggttttgaggtgacgttgctccccacgcctagccctacgccgttgattccgtggttggtgaacaagcatgggttggatgcgggcgttcagatcacggcttcgcataatggtgcggcggacaatggctacaaggtgtttttgtctaatggtcgccagctttattctgaactggagcctgagcttgaggcgcatatcaatgctgtggaagatccgattcgggttcctcgggtgacggtgcgccccactgctgatcagctgcgtcgatatgttgatgagatggtgtcgttggtgactcctgatcaggctgatttgttgcgggtgaattctgagcggggcaatcttcgcgtggtgtataccgctctgcatggtgtgggtggccgcgcgatggccaatgctttccaatttgctggttttccccatactcatggcgtgaaggctcagcagtatcctgatcccaccttccccactgtggcgttccccaatccggaagagccttctgcgattgagttgttgttggaacgcgcaaaggaaaagaacgctgacattttgtttgcgcttgatcctgatgccgatcgttgtgctgtgggtattcgtaccgctgatggcggccaccgaatgctctctggcgatgaggtgggcacacttttggctactcgtttggttccggagtattccggtgaaggcccacgtcccgtggttgccaccacggtggtgtcttcgcagcttctgggtatcatcgccgaggataaagggtgggattattccgagacactgacgggattcaaaaatctgtcgagggctgccgatggtctcgacggaccgcttgctttcgcttatgaggaagctgtgggcacctgcccggttccagatgtcgtgccggataaggacggcatctctacagcgttgttcatggcgtcgtgggctgccgaactgaaggctcagggcgcaagcctgcagcaaaaactcaatgagttgtatcgccgatatgggtattttgcgtcctcgcaaattgctgtgcgcacgagcagtccacgcgagttagttgatcactggattgcgcatcctcagcaagaactcattggagtgtctgtcaccccacatattcttcctgaaaaacagggcattgctttgcatggccaggtggggcatgtgcatatccgtgctattggtcgagtctctggaactgaggcgaaagccaagctctatttggaagttggtcaggccagctcccatgatgaagcagctcagttgttgcatcagctggaggatgaagtccaaagctggttgagcaagctt

SEQ ID NO: 764 - DNA, 1407 bp, Corynebacterium glutamicum
atggcaaagaggatcgtaattatcggcggtggacctgcaggctatgaagccgcactcgcaggcgctaaatacggtgcagaagttaccgttattgaagatgtcggagttggcggatccgcagtcaccatggactgtgtaccttcaaagtccttcatcgctggtaccggtatcaaaaccgacctccgacgtgctgatgacatgggacttaaccgtgggcttggaaaagcacacctagaaatcgatgcactgaacatccgtgtgaaggaccttgcgaaagcacagtccgaagatatcttgggccagctgcagcgctcagatgtccgcatgattaacggtgtgggccgctttgatgattacaacaccaagcaaaccacccactacattaaagtcacccacagcgatggctccgaagaaaccgttgagtgcgatctggtgctggttgcaactggtgcaaccccccgcattcttaaaggtgcagagccagacggcgagcgcatcttgacctggcgtcaggtctacgacattgaagaactccccacccaccttatcgtggttggttccggtgtgaccggtgcggaatttgtctctgcgtttgctgaactcggcgtcaaagtcaccatggtggcatcccgtgaccgcattttgcctcacgatgacgcagatgccgcagacgtgctggaaaccgttctggctgagcgcggagtatccctggaaaagcatgcccgcgtggagtctgtcacccgcaccgaagacggtggcgtgtgtgttcgcactgctgacggacgagaaatctacggttctcacgcgttgatgactgttggttccattccaaacacggcagatcttggcctggagaacatcggtgttgagctggcaccatccggccatatcaaggttgaccgcgtctcccgcaccaacatccccggtgtgtacgcagcaggtgactgtactgacctattcccactggcgtccgttgcagcgatgcagggccgtatcgccatgtatcacgcactcggtgaaggcgtgagccccatccgtttgaagactgttgccaccgcagtgtttacccgcccagagatcgcagcagtaggtatcacccatgcacaagttgattccggcgaagtgtctgctcgcgtgattgtgcttcctttggctactaacccacgcgccaagatgcgttccctgcgccacggttttgtgaagctgttctgccgccgtaactctggcctgatcatcggtggtgtcgtggtggcaccgaccgcgtctgagctgatcctaccgatcgctgtggcagtgaccaaccgtctgacagttgctgatctggctgataccttcgcggtgtacccatcattgtcaggttcgattactgaagcagcacgtcagctggttcaacatgatgatctaggc

SEQ ID NO: 765 - DNA, 3420 bp, Corynebacterium glutamicum
gtgtcgactcacacatcttcaacgcttccagcattcaaaaagatcttggtagcaaaccgcggcgaaatcgcggtccgtgctttccgtgcagcactcgaaaccggtgcagccacggtagctatttacccccgtgaagatcggggatcattccaccgctcttttgcttctgaagctgtccgcattggtaccgaaggctcaccagtcaaggcgtacctggacatcgatgaaattatcggtgcagctaaaaaagttaaagcagatgccatttacccgggatacggcttcctgtctgaaaatgcccagcttgcccgcgagtgtgcggaaaacggcattacttttattggcccaaccccagaggttcttgatctcaccggtgataagtctcgcgcggtaaccgccgcgaagaaggctggtctgccagttttggcggaatccaccccgagcaaaaacatcgatgagatcgttaaaagcgctgaaggccagacttaccccatctttgtgaaggcagttgccggtggtggcggacgcggtatgcgttttgttgcttcacctgatgagcttcgcaaattagcaacagaagcatctcgtgaagctgaagcggctttcggcgatggcgcggtatatgtcgaacgtgctgtgattaaccctcagcatattgaagtgcagatccttggcgatcacactggagaagttgtacacctttatgaacgtgactgctcactgcagcgtcgtcaccaaaaagttgtcgaaattgcgccagcacagcatttggatccagaactgcgtgatcgcatttgtgcggatgcagtaaagttctgccgctccattggttaccagggcgcgggaaccgtggaattcttggtcgatgaaaagggcaaccacgtcttcatcgaaatgaacccacgtatccaggttgagcacaccgtgactgaagaagtcaccgaggtggacctggtgaaggcgcagatgcgcttggctgctggtgcaaccttgaaggaattgggtctgacccaagataagatcaagacccacggtgcagcactgcagtgccgcatcaccacggaagatccaaacaacggcttccgcccagataccggaactatcaccgcgtaccgctcaccaggcggagctggcgttcgtcttgacggtgcagctcagctcggtggcgaaatcaccgcacactttgactccatgctggtgaaaatgacctgccgtggttccgactttgaaactgctgttgctcgtgcacagcgcgcgttggctgagttcaccgtgtctggtgttgcaaccaacattggtttcttgcgtgcgttgctgcgggaagaggacttcacttccaagcgcatcgccaccggattcattgccgatcacccgcacctccttcaggctccacctgctgatgatgagcagggacgcatcctggattacttggcagatgtcaccgtgaacaagcctcatggtgtgcgtccaaaggatgttgcagctcctatcgataagctgcctaacatcaaggatctgccactgccacgcggttcccgtgaccgcctgaagcagcttggcccagccgcgtttgctcgtgatctccgtgagcaggacgcactggcagttactgataccaccttccgcgatgcacaccagtctttgcttgcgacccgagtccgctcattcgcactgaagcctgcggcagaggccgtcgcaaagctgactcctgagcttttgtccgtggaggcctggggcggcgcgacctacgatgtggcgatgcgtttcctctttgaggatccgtgggacaggctcgacgagctgcgcgaggcgatgccgaatgtaaacattcagatgctgcttcgcggccgcaacaccgtgggatacaccccgtacccagactccgtctgccgcgcgtttgttaaggaagctgccagctccggcgtggacatcttccgcatcttcgacgcgcttaacgacgtctcccagatgcgtccagcaatcgacgcagtcctggagaccaacaccgcggtagccgaggtggctatggcttattctggtgatctctctgatccaaatgaaaagctctacaccctggattactacctaaagatggcagaggagatcgtcaagtctggcgctcacatcttggccattaaggatatggctggtctgcttcgcccagctgcggtaaccaagctggtcaccgcactgcgccgtgaattcgatctgccagtgcacgtgcacacccacgacactgcgggtggccagctggcaacctactttgctgcagctcaagctggtgcagatgctgttgacggtgcttccgcaccactgtctggcaccacctcccagccatccctgtctgccattgttgctgcattcgcgcacacccgtcgcgataccggtttgagcctcgaggctgtttctgacctcgagccgtactgggaagcagtgcgcggactgtacctgccatttgagtctggaaccccaggcccaaccggtcgcgtctaccgccacgaaatcccaggcggacagttgtccaacctgcgtgcacaggccaccgcactgggccttgcggatcgtttcgaactcatcgaagacaactacgcagccgttaatgagatgctgggacgcccaaccaaggtcaccccatcctccaaggttgttggcgacctcgcactccacctcgttggtgcgggtgtggatccagcagactttgctgccgatccacaaaagtacgacatcccagactctgtcatcgcgttcctgcgcggcgagcttggtaaccctccaggtggctggccagagccactgcgcacccgcgcactggaaggccgctccgaaggcaaggcacctctgacggaagttcctgaggaagagcaggcgcacctcgacgctgatgattccaaggaacgtcgcaatagcctcaaccgcctgctgttcccgaagccaaccgaagagttcctcgagcaccgtcgccgcttcggcaacacctctgcgctggatgatcgtgaattcttctacggcctggtcgaaggccgcgagactttgatccgcctgccagatgtgcgcaccccactgcttgttcgcctggatgcgatctctgagccagacgataagggtatgcgcaatgttgtggccaacgtcaacggccagatccgcccaatgcgtgtgcgtgaccgctccgttgagtctgtcaccgcaaccgcagaaaaggcagattcctccaacaagggccatgttgctgcaccattcgctggtgttgtcaccgtgactgttgctgaaggtgatgaggtcaaggctggagatgcagtcgcaatcatcgaggctatgaagatggaagcaacaatcactgcttctgttgacggcaaaatcgatcgcgttgtggttcctgctgcaacgaaggtggaaggtggcgacttgatcgtcgtcgtttcc

SEQ ID NO: 766 - DNA, 870 bp, Corynebacterium glutamicum
atgatggaccatgcacacgattcctgctcaccaactctgcgccgtgatttggaggtcactggccagctccaacctgagaaagctgtcgatttagcagcgccgcacgaagggaaggttgccaatataacgaaggtgacctcctcaaatatggagcacaccatcacgcaggcctcaaaagctaaggaggtggtggtgctcattggtcactccctgctgcccacatttcaggatttggaaaaagacattctgcactttcaggcaggtaataaagggcgattttctgtagcgattgttgatcctgatcgcagtgcagatgtggttgccagatttaggccaaaacagattccggtggcatacgtggtgaaagatggcgccagcattgcggagttcaactcgctcaacaaggagccggttgcacaatggcttgatcattttgtgtcgcgggaaacgatccccaatgaaaaagagggggacgtcgataagcaaatagacccgcgcctgtggcgggcagcggaattggtgaacgccggtgattttcgcgcggcgttggcgttgtatgagcagttgccgcaggatgcgacggtgaagcgggcgcacgcggcggtgtcggtattggcgcggatgtctgtggcggatcggggagaggatccgatcgagaagtcgcgccgggatccagacgatgtgaacaaggcgctggcggcggcggatatgtatgtgttgatgaatcagccggacacagcgctcgcgcaccttgcagcactattgccaaaaccggaggctgcccggcggatcgtggagttgctgaacttgtttgatccgctggacctggtcgcattggaaatcagggcgcaggtggggaatgcaatgagc

SEQ ID NO: 767 - DNA, 486 bp, Corynebacterium glutamicum
atgaagaaggccatgagagctgcgatcgggctcgctgtttccaccgccatgacatttgggatagctccgagcgcacacgcttttaccgcactgtcgagcaacatttttgccccaccagctcgcaatactgaaaatgcgaacggcgatgtgagtcaggttgaattagaagtatttgcgctcgttaaccagcatcgaattgcccatggtgtagcaccgttggcgatgaatgagtctcttaattccggctctaagagctggtcttatacaatgtcgcgaaccggaaattttgttcattctagtggcggaaactatggcgagaatatttactgggctagcaatatccgcccagcttcgctcatttttgaaagctggaagaactcacctgggcataaccggaatatgctagacacgcgctactcccagattggtgtcggagttgtctatgatagttctggccaaacgtgggcgacaactcagttttatttt

SEQ ID NO: 768 - DNA, 1086 bp, Corynebacterium glutamicum
atggccacaacgaccccagtcaccgtgctatcaggatttctcggctccggaaaaaccacattgctcaaccagatcctccaccaccgaggatcccggaaaatcgcagtcattgtcaacgatttttcagaaatcaacatcgacgcagccctcatcgcatccgaaggccacctcacccgcggcgaagaccgcttcgtggaactgaccaacggatgcatctgctgcaccctgcgcgaagacctcgtggattccgtcggcgaactcgccagcagcgaccgcttcgaccacatcgtcatcgaatccacgggtatctccgaaccaatgccggtagccgccacatttgaatggcagtgggatgacggcacccgcctggctgacaaagcaccgatcgacaccatggtcaccctggtcgatgccacccaattcatcgacctcatccgcaaaaacacctccctcaccgaggctgacatgggcgcaaccgaggacgatgaacgcaccatcgccgacctactcaccgatcaaatcgagttcgccgaccgcatctacatcaccaaatccgacctggtggaccgcactgtcctcgagcaaacccgcgcactaatcgccagcatgagtccacgcgcccgcattgacttactcatcgatggcctcaatgacggctcccccatcaccgacgacatcctcggagctttcctctacgacgaagccaccgcccgcgcctacgagggctacacggaagaactcgaaaacccgcacactcccgaaaccgaggaatacggcatcagttccgtggtattccgctctgaccggccgttcaacaaggatcgcctacttcaggtactgcgttccaccactggactcgttcgctccaaaggctattgctggatcgctgatcacctcaacatcgtccaggtctggcaccaagccggccccaatttgagcattcgcccggccgcctattgggccaattcagagatcacccccggcactgaattggtcctgatcggcatccacatcgacggccccaccttgctcgcactgctacaaggcgcgacgcttaccgatgcggaagtggcggcactggttttg

SEQ ID NO: 769 - DNA, 924 bp, Corynebacterium glutamicum
atgtcatctcatgatctcgttgacgtagttgtcgtcggcgccggcgctgcaggtctcgccgccgctgtcgcgctcggccgctcactgcgcagtgtcatcgtcatcgacgctggtcaaccccgtaacagctatgcgcacgctgctcacaatgtcctcggccaggaaggcattgcgcccgccgagctgctggaaaaaggccgcgccgaagcgcgttcctatggcgtcaccattgcgcccgggcgcgtagcaaaagttgagcgcaccggttccaccttcgccataacgcttgacgacgcctccctccttcactctcggcgcatcattttggcccacggcgccgttgacgatctgccagaggtagaaggactgtcagatttttggggaaccaaagtgttgcactgcgcttactgccacggctttgaggcccgcgattctgaaatcgtcgtggtgggtacctcgcccatggctgcgcaccaagcgttgatgttctcgcagttgtccaaaactgtcagcttggtgggcacgatcgacattgatgaacaaaccagcgagagcctagatagtgctggagtaaaagtgttgggcaccaatgcggtgcgcgtatccgccgaaggtgatggcctgtctgtggaactgtccgaaggcgatcatttaagctgcgacaacatcgtggtggcatctcgtccactggtggatggcacgctgtacacccaacttggtggtcagatggaagaaaacccgatgggcaggttcattccaggtacccaaaccgggcgcactcctattgaaggtgtgtgggctgccggaaacgcgcaagctcccatggcgatggtctatggttccgctgctcaaggcgtgatggctggagcagagatcaactttgatctgatcctggaagatatttccgtggcaagcgcgcagagc

SEQ ID NO: 770 - DNA, 1494 bp, Corynebacterium glutamicum
atgcgcatccacgatgtttatacccacctttcggccgataactttcccaaagcagagcaccttgcgtggaaattctccgagcttgccaccgaccccgtggaggtgacaccggatgtttcggagatgatcatcaaccggatcatcgacaacgcggcggtgtctgccgcgtcggtgttgcgccggcctgtgactgtggccaggcaacaagcgcagtcccatccgcgggaaaagggcggaaaagtttttggaatttcaggcagctactcaccagagtgggctgcctttgctaatggtgtggccgtacgtgaattggacttccacgatacatttttagcagctgaatactcccatcccggcgacaatattccaccacttcttgcagtagcgcaggctcagagaagcagcggcagggatctcattcggggtatcgccactgcctatgaggtgcaggtggaattggtgagggggatctgcttgcatgagcacaaaattgatcacgtagcccaccttggtcccagcgctgcagcgggtttgggcacgttgttgcatgtagatgaggaaaccatctaccaggcgatcggccaggcattgcacaccacgacggctacgaggcagtcgcgaaaaggtgagatttccagctggaaggcgttcgcgccagcgtttgcgggaaagatggccattgaggcgatggatcgtgcgatgcgtggggagggttcgcccgcaccgatttgggagggcgaagacggggtcatcgcgtggctgttatcgggcaaagatcatgtttatcatgtgccattgccggaacacggcgagcccaagctggggattctagagacttacacaaaggaacattcagcggaatatcaatcgcaggcaccgattgatctggcgcgcaggatgaagccactggttgacgcggctggcggaacggaacacattgcagagattgtgctgcgcaccagtcaccacacgcattatgtgattggcactggggcgaacgatccgcagaagatggatccgcaggcctcgcgtgaaaccctggatcattccatcatgtacattttcgccgtcgcgcttcaagatggcgtgtggcaccacgagttttcctacacccgcaagcgttccacccgcccggaaactgtggagctgtggcacaagattcgcaccgtggaggatcctgaatggacgcgccgataccattctgatgatcctgcaaaaaaggcctttggtgcgaaagcagtgatcacaatggctgatggcaccgtgattgaggatgaattggctgtcgcggatgcccacccgctgggtgctcggccgtttgcgcgggagaattacattgaaaaattccgcacactcgcgcaggggattgtcattgattcagaacaggaacgcttcttgcatgccgtgcaaagcctgcctgacctggatgatcttgatcagctcaacatcgaagtcgacataagcaaccaggccgcgacgaaagcggggctgtta

SEQ ID NO: 771 - DNA, 888 bp, Corynebacterium glutamicum
gtggggaggcgtcgacaagcatttaaagcggcactcgccgcaccccacatcgcccggctgcccggcgcattctcccctctgattgcgcgctccatcgaagaagccggcttcgaaggcgtctacgtttccggcgccgtcatagctgctgacctggcactacccgatatcggcttgacgacgctgaccgaagtcgcccaccgcgcgcggcaaattgcgcgcgtcacagacctaggagtgcttgtcgacgccgacaccggctttggcgaacccatgtcggccgcacgcaccgtcgccgaattggaggacgccggtgtggccggatgccaccttgaagaccaagtcaaccccaaacgttgcgggcacttggacggcaaagaagtcgtgcgcacagacgtgatggttcgacgcatcgcagccgccgtctcggcccggcgcgacccgaactttgtcatctgcgcccgcaccgacgccgctggagtggaaggaatcgacgccgccattgagcgcgcgaaagcctacttagatgcgggcgccgacatgattttcaccgaagccctccacagcgaagccgacttccgatacttccggcacgccatccctgatgccttgttgctggcgaatatgaccgaatttggcaaaacgacgctgctgtcagccgacgtgttggaagagattggctacaacgccgtgatctaccccgtgaccacgctgcgtattgccatgggacaagtagaacaagcactagccgaaatcaaagaacacggtacccaagaaggatggctggaccgcatgcaacaccgcagcagattatatgagctcctgcgatacgaagactacaacgtctttgaccagcacattttcacctacagaaaaggagaaaacaatgag

SEQ ID NO: 772 - DNA, 378 bp, Corynebacterium glutamicum
atggcggcgtcgattccttccactccagcggcgtcggtgcgggcgcagatgacaaagttcgggtcgcgccgggccgagacggcggctgcgatgcgtcgaaccatcacgtctgtgcgcacgacttctttgccgtccaagtgcccgcaacgtttggggttgacttggtcttcaaggtggcatccggccacaccggcgtcctccaattcggcgacggtgcgtgcggccgacatgggttcgccaaagccggtgtcggcgtcgacaagcactcctaggtctgtgacgcgcgcaatttgccgcgcgcggtgggcgacttcggtcagcgtcgtcaagccgatatcgggtagtgccaggtcagcagctatgacggcgccggaaacg

SEQ ID NO: 773 - DNA, 1182 bp, Corynebacterium glutamicum
ttgaccagcacattttcacctacagaaaaggagaaaacaatgagtgacagccaagtccgcaaaggactcaacggcgtcatctctgactacacaagcatttccaaagtgatgccagagagcaactcgctgacttaccgtggctacgccgtggaggatttggtggaaaactgcagctttgaagaagtgatctacctcctgtggtttggggagctgcccaccactgaacaactccggaccttcaacacgacaggtcgaagctaccgctcactcgacgccggactgatttccctcatccactccttacccaacacctgccaccccatggacgtgctgcgcaccgcagtgtcctacatgggtacctttgatcccgatccgtttacccgcgatgccgatcatatccgaagcattggacacaacctgcttgcgcagcttcccatggtggttgccatggatatccgcaggcgaagtggggaagagatcatcgcacctgaccacaacaaaggtatcgcttcgaatttcttatccatggtgtttggcaatgatgatggttctgtagccaactccgcagatgacatccgcgattttgaacgctccctcatcctctacgccgagcactccttcaacgcctccacattctcagcccgcgtgatctcatcaacgcgatccgatacgtattcggcgatcacaggtgcgatcggtgctctcaaaggcccactgcacggaggtgccaatgagtttgtcatgcacaccatgctggatatcgacgatcccaacaatgctgccgactggatgggcaaggcgttggatcgtaaagaacgcatcatgggattcgggcaccgcgtgtacaaaaacggcgactccagggtcccctccatggagaaatccatgcgctcccttgctgctcgtcaccgtggtcaaaaatgggtgcacatgtatgagtcgatgcaagaagtcatggaggctcgcactggcattaaacccaacctcgacttcccggccggccctgcctattacatgctgggattccccgtcgacttcttcacaccactgtttgtgctggcccgagtgtcagggtggacggcacacatcgtggagcaatttgaaaacaatgcgctgatccgaccattgtctgcctacaacggagtggaagaaagggaggtggtgcccatttcggagagaacc

SEQ ID NO: 774 - DNA, 375 bp, Corynebacterium glutamicum
atggaacccatggaactaaacggcggtcgtttctacgcccgcaagctcacctcagataatcggattgatgatgtcccggcgctctcactgatccttgccgatgcagcacagttcatcgcggacgccaccacagcctggcacgaggacaccgaatacacctgggctatctgcgagcagaccagtgttgaactactggcactggcacgccttgatcccaagcagcgcacactcgaggtcgtgcccgcaggtgatcccgccacccaattgcccaatgatccagtgctcgctccgaaaaccatcggcgatgctgtggcggagggccgcgacaccatcaccagatgggcacaaggctatttagaaatcagcctcactgat

SEQ ID NO: 775 - DNA, 1323 bp, Corynebacterium glutamicum
atgtcgaagctttacgcgggggcaaggatcaatgcactgcgccgaacccatcagctcacccaatcagcattggccgacaagcttgatctctccaccagctatctcaaccagttggaaaatgacggacggccactcactgccacggtgcttctgcagctgatgaaagtgttcgatgttgaggccagttacttctcccctgaccggggtacggccactgctacccgactggctgaaaccttggcgatgaatcagggtccgacgatgtcgatggatgatcttttagatttcgcggatcgtttccctcagttagcgcagcatattatccagcctgctgaggttgatcccacgcatagttctgcgcatgattttgttcgggattattttgccacccacaaaaactacattgattcgctcgatcgccttggagaggagttggcaactgccattggtcagccgggacttcgggttactaggctcgcgcagttgcttgatgcggagtacaacatcacggtgcgtttccgggcgccggatattactggccggaggcactttgatccccaatcgcgtcagattctgctgcggcaagatctcagcgaggcgcagcagtgtttccagttggcggaggaattgacgtttcttgctcatgcagagctcttggataccctgaccacagatcaaccggatctcccttctgaggcagctatccgcctggctaaggtgggtctctcccaatatttcgcggctgctgttgtcatgccgtacacccgctttttggaattcgcccaggataagcactatgacatcgagttgatctctgaggcgtttggagtgtctttcgagtctgcatgccaccgcctgtctactctgcagcgttcgggggcgtcaggggtgccgtttttctttgtgcgctcggatcgtgcaggaaatatctccaagcggcaatctgcagctacgttccacttctcgcgaacagacggcacttgtcctttgtgggcgctgcatcgtgcttttgaacgtcagggaaacatcacccgccaggttgctcgcatgccggatggccggacctatttgtggctcgcacgcgcggtgaaaggtcgaactcatggtttcgggtatcctgctgcggaattcgccatcggcctgggctgcgatatcagcgaggcaccaggcttggtgtattcccaaggccttaatttggatcccgagtccgccgcagagatcggccctggttgtcggatctgtcctcgggagaactgtgtgcagcgtgcattcccaccatcgggtcaagaatctatccgcccagcccctgtccaactcctcaac

SEQ ID NO: 776 - DNA, 246 bp, Corynebacterium glutamicum
ttgtgcattgaaagccgtcagccgattagcgttaaagaaaataaaaaaccacaaggggagcacaccatgaaagacaccaccgagatcaactggcaaggctacgccgatggaaccgcaatccgcgaagcagtcatccactccattgaacgagaagtatcagcgggcgagcagccaaccccaaacgatcttaaatttctcgggctgttccagcaccgcgccgggtatgtgggctcgttgatcaccggt

SEQ ID NO: 777 - DNA, 1359 bp, Corynebacterium glutamicum
atgagccttcacagggttttccatcttcatagcctcgaggacaacaacggtgtcgccttcgttgacttcagcgccttcttcgacgttgaccttgatgacagtgccctgcattggagctgccactgcatcgccggatacgccagcctttgcaccacctgcgcgacgcttcttggccttcttcttaggaccagcggtgccaccgagtgccagatcgcctgggagtgcaacctcaacgcgacggccgttgatctccacaacaaccttctgtgctggggtcttgtcctcatcttcgtcgagctcggaagcgtcaacgtaaggtgcgattgggttatcccaaacctcttcgatccacttggtgtagatctcgaagccttcgtcgttgcccacgaatgctgggttttccacgatgtgctggtggaatgggataacggttggcatgccctcgacaacgtactctgcaagtgcacggcgggagcgctggagagcctgctcgcgggtgtcgccccaaacgatcagctttgccagcatggagtcgaactgtccggagatttcggaaccttcaacgacaccggagtccatgcggacgcctgggccctgtggctcgcggtagctggtgatcttgcctggtgcaggcatgaagttggagccagcgtcttcgccgttgatgcggaactcgaatgcgtggccgcgtggagctggatcttccttgatggagagctcgtggccttctgcgatgcggaacatttcgcggaccaggtcgatgccggtggtctcttcggtgactgggtgttccacctggaggcgggtgttgacctcgaggaaggagatcaggccgtcggagccaacgaggtactcaacggtgcctgcaccgtagtagccagcttccttacagatagccttcgcggaggagtggagacgctcgcgctggtcatcggtgaggaatggtgctggtgcttcttcgacgagcttctggaaacggcgctgcagggagcagtcacgggttccggcgacaacaacgttgccgtgcttatcggcgatgacctgagcctcaacgtggcgtgccttgtccaggtagcgctccacgaagcactcgccgcggccgaacgctgcggttgcttcacgggttgcggactcgaagaggtcagcgacttcttccatcttgtaggcaaccttcatgccacgtccgccgccaccgaaagctgccttgatggcgattgggagaccgaattcttcagcgaaagccacaacttctgctgcgtcttttactggttccttggtgccaggagccattggagccttggcggtatctgcgatgtggcgagcggtgaccttgtcgccgagggagcggatggactcagg

SEQ ID NO: 778 - DNA, 903 bp, Corynebacterium glutamicum
atggcagcaccgttcgacccattcccagcttttgaggaatacgcacaccctgaaaggatcgtgtctgcatcctggctttccgcccgcctcggctcccctggtctgaaggttgtggagtccaatgaagattcccttctttacgatatcggacacctccccggcgctgtgcgcattgactgggcaaaggacctcaacgatcccctcacccgcgatttcattgacggtgaagctttcgctgagctgatgaaccgcaagggcatcgctcgcgatgacaccgttgttgtctacggtgacaagtccaactggtgggctgcgttcaccctgtgggtcttcgaactgttcggccactccgatgtccgcctgctcaacggcggccgcgacgcgtggatggctgaagagcgcgacacctcctacgtggttccggagtacccctccgccaactaccccgtcgtggagcgtgtcgacgaaaaccagcgcgcgttcgtggctgaggtgctcggttcgctcacgcaatccggtggcatgacgcttgtcgacgtcaggaccccttcggagttctccggattggatgagcacggcaacccaacctcaaacaccggcgtgcttcgtggtggacacatcccaggcgcgatcaacctggattggtcggacgctgttcttcccaacggaaacttccgcacccgtgcagagttggacaagctctacgccgatctcaacccagctgacgataccgttgtctactgccaggttggcgaccgcgcggcccacacctggttcgtgctgaagtatctgctcggtttcaacaacgtccgaaactatgacggatcgtgggcagaatggggcaatatggttcgcatgccgatcgaaactggcgaaaacaccaaaaataacgtttcggtgtca

SEQ ID NO: 779 - DNA, 1065 bp, Corynebacterium glutamicum
atgaaaaagagcatcgttgtatttgaagtcgaaggcggctccgacaagcacttcgacggtcaccgtaaagacaccatgcctatcgtcaactccataaatgatgctggctggcaggcagaggttgtgtactaccgcccagagtggaccgaaggtctctttgagtacgtatctgaaaacttcgacggctacatctcacgtgtcaacccaggcaacatcccaggcggcgagcgcggctactttgacctgctcacccgcctgtccgaagcagggctcgtgggcatgtccacccctgaggaaatgatggcatacggcgcgaaagatgcgctggtcaagctatcccaaaccgacctggtgccatccgacaccgaggcgtactacgacgtggagaccttccacaaggttttcccaacctccctgtccttcggtgagcgcgtgctcaagcaaaaccgtggctccaccggctccggcatttggcgcgtccagttggtagacaaggaactggctgcatccatcgagccaggcaccgcactgccattggacactgaaatcaagtgcaccgaagcagtcgacaaccacactgaagtccgcaagctcggcgagttcatggatttctgtgaccagtacatcatcggcgacaacggcatgctcgttgatatgcgtttcatgccacgcatcgtcgaaggcgaaatccgcatccttctcgtcggaccacacccagtgttcgtcgtgcacaagaagccagcagaaggcggcgacaacttctccgcaaccctgttctccggcgcgaagtacacctacgacaagccagagcagtggcaggaactgattgacctcttcgcagacgctcgcccagtcatcgcagaaaagctcggcggcgacaacatcccattgatctggaccgcagacttcatgctcggcgatgtcgttgacggcaaggacacctacgtgctcggtgaaatcaactgctcctgcgtcggcttcacctccgagctggacatgggcatccagcagcttgtggcatcagaggccatcaagcgcatcgaggaattcgcgcagcttactgtt

SEQ ID NO: 780 - DNA, 414 bp, Corynebacterium glutamicum
atggttcaaattaatgacatgcttgcccctcctccagtaaaacttccggaagatcctgccctcggcgccgatccaactttgacctcgacagcgattgcgcatcctgacagcccattggtgtgggcgtaccgagctgaaaatcttatcaaatctgcatcaaatgatgaagagaagattcaggcctacgcttttgcgcgcacgggttaccaccgcagtctcgatcgtctgcgtgccaatggttggaagggttggggtcctgtccccttctctcatgagccaaaccagggagtgttgcgggctatcgcttccctagctcttgctgcgaagctgattggtgaggacaacgaatacgatcgttgccgccagatgctctctgatgcggatccagagtccgtcgcagtcctactcgacaaa

SEQ ID NO: 781 - DNA, 2148 bp, Corynebacterium glutamicum
gtgggaacggcgagagggctttctcaagttctgaaagaagccagacaaggtggaaaacccacttcagccacccagaaagttccacgctccggctacagatatgacctcgatgggctccgcggcatcgcgatcgccttcgtagttttgttccatgttttcgtcggaaaagtctccggcggtgtggatgtcttcctgctgctgtctggctatttcttcttagggtcgcaattgcgttatgcagatcgtccagattcttccatcaacccctggtggccgatttggcgcacgctacgcagattacttcctgcgttagtgctggtgttgggcgtttccatggtcctcatcttggcgtgggtgcccagactgcaacgaatagaaatagccaaccaagcagtagccagcctcttctatgtccaaaactgggagctcgcatcccaaggtgctgcctacggagcagcctctgcagaagtcagtcctttccagcacttgtggtccatggctgtgcaagggcagttctacctctttgccatcttgttgagcatggcgatcatcctgattcgtcgataccgccccgaatactccgcagtgcgactagcgactcctgtgctggcagtgctcacatccgtatcatttttcagtgcaatcctgtggcatttcattgatcaatcagtcaactactattccaccttcaccaggttctgggagctcggccttggtgcactattggtgctgcatgcgcctcgaattttgatttctgcgaagactaaatcaatactcgcagccgtcggtttgtttatggtgctatccactggattcttcatggatggcgcagagactttccctggattccccgcgctgtatcccatcttgggtgcttgcttagtcatccttggcgacggtaaaatctcggtctttctctcccgaaaatggatgctttggctcggcgatatcgcctacccgctctacttgtggcactggcctctgctgatcattttcaccgctttgttcaaccaagaagagccatccatctggctgggtatcgccgtgattatgctgtcccttggcttggcgcagctgactaacaaatacgtagaaaaaccaatgcaacagcagggaaagcgcccactatttagggaatcccgcagtgctgatgctttgcaaaagctgcgttcctccaggcctgcccgaatgcgtgcgtatgcgggtatcgcagtagtcgcagtcggtttcgccctgacatctactccgcaggtgctctaccaacgagtcctcgatacccaaatgagtgatctcgatccggagatctaccccggtgcactctccctggcgggcttcgatgcccccgaagtaaaacccaaaccaaacccctacgtgctggccgataccgtctcacccgcctgggcaaaaggctgcatgtccgtcttcggcgacgatccatctgaactagcaccagacaactacgacgaagattactgcgctttcggcaaccccaactcacccgtcgaggtctacctcgtcggcggatcccacgccgaacaatggatggcaccactcgacgccctaggcaagcaacacaacttcaaagtgatccccctcgtccgccaatcctgccccaccttcgtggtggaactcgacggaattttcagcgacgactgcatcgaattcaacgaaaaagtgatcgaacgcctcgcagaagtaaaacccgacctcgtggtctccaactccaccagaccgctccttgaaaaaggccgcggcatcgacgaagtgccagaatcatacatcacgctgtgggacttcctcgaagccgaagacatcccattcatgggactccgcgacaacccgtggttcatccagccaggaggcgaaggatggatggtgtcccaatgctacgaagaagaacaatccttggtggactgctcgatcaccaaagacaacttctacgcaccagtagaccccgctgaaaaagaactagccatcagaaacaatatgctcgcagtggatacttcacgatggttctgcccagacgacctgtgtatcccagtgatcggcaatgtgtatgtataccgcgacggcaaccacatgtccgatgaatacgcacaatctttggctccattcctgtggagcaatatgcgcaggcttctggtcgct

SEQ ID NO: 782 - DNA, 591 bp, Corynebacterium glutamicum
atgcagatcgttctggcttcgcagtccccgtcccgccgaagaatcctcaattcggcgggcgtcgagcccctcatccacccagctgatgttgatgaggacgcgctccttcactccctcaacggctctgcgccggaggagatcgtccgccagcttgcgctggctaaagcacaggtggttgcgccgtcctatccgggcgacgtcgtcatcggtggcgattccatgctgcttatcgacgccaccctccaaggcaagccgcacacccgcgaagccaccatcgaaagatggaaacaacaacgcggcaacaaggccacactgatcaccggccacgccatcatctttggcgatgaagtgatcgtggagtcctcctccaccaacattcatttcgccgaggccagcgatgtagatattgagcgatacgccgactccggcgaacccttagagtgcgcaggcgcgttcaccctcgaagcacttggtggttggttcatcgattccatcgaaggcgacccctcatccgtgatcggattgtctctccccgtcgtgcgccgtgctttgtaccgcctcggtttcaacgccagcgacttctggaacatg

SEQ ID NO: 783 - DNA, 246 bp, Corynebacterium glutamicum
atgtctgaagaaaccactcaggacaccaaggctgcagagaagccttttctgcagatcgtatctggcaacccaaccgatcaagaggttgctgccttgaccgtggtgttcgctggtttggctaaagctgccgctgcacagcagatggtgtcggcaagcaaggaccgcaacaactggggcaacctggatgagcgtctgtctcgcccgaacacgtttaaccccagcgcgtttcagaatgtgaatttcttc

SEQ ID NO: 784 - DNA, 1611 bp, Corynebacterium glutamicum
atgactgcagcacagaccaaacctgacctcaccaccacggctggaaagctgtccgatcttcgctcccgtcttgcagaagctcaagctccaatgggcgaagcaactgtagaaaaagtgcacgctgctggcaggaagactgcccgcgaacgtatcgagtatttgctcgatgagggctctttcgtagagatcgatgctcttgctcgtcaccgttccaagaacttcggcctggatgccaagcgtccagttactgacggtgttgtgactggttacggcaccatcgatggccgtaaggtctgtgtgttctcccaggacggcgctgtattcggtggcgctttgggtgaagtttatggtgaaaagatcgttaaggttatggatcttgcgatcaagaccggtgtgcctttgatcggaatcaatgagggtgctggtgcgcgtatccaggaaggtgttgtgtctctgggtctgtactcacagatcttctaccgcaacacccaggcgtctggcgttatcccacagatctctttgatcatgggtgcctgcgctggtggtcacgtgtactcccctgctctgactgacttcatcgtcatggtggatcagacttccaagatgtttatcaccggccctgatgtcatcaagactgtcaccggtgaagatgtcacccaggaggagctcggtggcgctcacacccacatggctacctccggtacctcccattactctgcttctgatgattcagatgctttggattgggttcgcgagctgacctcttatcttccatccaacaaccgtgcggaaactcctcgccaggaggccgacatcatgatcggttccatccaggaaaacatcaacgatgtggatctggaattggacaccatcatcccggattccccgaaccagccttatgacatgaaggaagttatttcccgcatcgtcgacgacgccgagttcttcgagatccaggaagactacgcagagaacatcctgtgtggcttcgctcgcgttgagggccgttctgttggcatcgtggctaaccagccaacccagttcgctggctgcttggatattaaggcatctgagaaggctgcccgtttcatccgcacctgcgatgccttcaacatcccaatccttgagttcgtggacgttccaggcttcctgcctggcaccaaccaggaattcgacggcatcatccgccgcggcgcaaagctgctttacgcttacgctgaagcaaccgtcggcaagatcaccgtcatcacccgcaagtcctacggcggagcgtactgcgtgatgggttccaaggatatgggcgctgacctcgtattcgcttggcctaccgcacagatcgccgtcatgggcgcttcaggtgctgttggatttatctaccgtaaggaactcaagcaggctgccaccgaaggcaaggacgttgctgaggtcatgaagggctacgagcaggagtacgaagaaactctggtcaacccttatgtcgcagctgagcgtggcctggttgatgccgttatcccaccttctgagacccgcggccagatcattgagggtctgcgtctgctggatcgcaaggtggtcaatgttcctgctaaaaagcacggtaacattccacta

SEQ ID NO: 785 - DNA, 1629 bp, Corynebacterium glutamicum
atgaccatttcctcacctttgattgacgtcgccaaccttccagacatcaacaccactgccggcaagatcgccgaccttaaggctcgccgcgcggaagcccatttccccatgggtgaaaaggcagtagagaaggtccacgctgctggacgcctcactgcccgtgagcgcttggattacttactcgatgagggctccttcatcgagaccgatcagctggctcgccaccgcaccaccgctttcggcctgggcgctaagcgtcctgcaaccgacggcatcgtgaccggctggggcaccattgatggacgcgaagtctgcatcttctcgcaggacggcaccgtattcggtggcgcgcttggtgaggtgtacggcgaaaagatgatcaagatcatggagctggcaatcgacaccggccgcccattgatcggtctttacgaaggcgctggcgctcgtattcaggacggcgctgtctccctggacttcatttcccagaccttctaccaaaacattcaggcttctggcgttatcccacagatctccgtcatcatgggcgcatgtgcaggtggcaacgcttacggcccagctctgaccgacttcgtggtcatggtggacaagacctccaagatgttcgttaccggcccagacgtgatcaagaccgtcaccggcgaggaaatcacccaggaagagcttggcggagcaaccacccacatggtgaccgctggtaactcccactacaccgctgcgaccgatgaggaagcactggattgggtacaggacctggtgtccttcctcccatccaacaatcgctcctacgcaccgatggaagacttcgacgaggaagaaggcggcgttgaagaaaacatcaccgctgacgatctgaagctcgacgagatcatcccagattccgcgaccgttccttacgacgtccgcgatgtcatcgaatgcctcaccgacgatggcgaatacctggaaatccaggcagaccgcgcagaaaacgttgttattgcattcggccgcatcgaaggccagtccgttggctttgttgccaaccagccaacccagttcgctggctgcctggacatcgactcctctgagaaggcagctcgcttcgtccgcacctgcgacgcgttcaacatcccaatcgtcatgcttgtcgacgtccccggcttcctcccaggcgcaggccaggagtacggtggcattctgcgtcgtggcgcaaagctgctctacgcatacggcgaagcaaccgttccaaagatcaccgtcaccatgcgtaaggcttacggcggagcgtactgcgtgatgggttccaagggcttgggctctgacatcaaccttgcatggccaaccgcacagatcgccgtcatgggcgctgctggcgcagttggattcatctaccgcaaggagctcatggcagctgatgccaagggcctcgataccgtagctctggctaagtccttcgagcgcgagtatgaagaccacatgctcaacccgtaccacgctgcagaacgtggcctgatcgacgccgtgatcctgccaagcgaaacccgcggacagatttcccgcaaccttcgcctgctcaagcacaagaacgtcactcgccctgctcgcaagcacggcaacatgccactg

SEQ ID NO: 786 - DNA, 864 bp, Corynebacterium glutamicum
ttgggcgtgtcgcccttaaagcgcgcttttcgacgcgaccccactacattggcttccatgaacgttgacatttcacgatccagagagccgctaaacgttgagctcctgaaggaaaaattgctccaaaacggtgactttggccaggtcatttacgaaaaagtgacaggctccactaatgctgacttgctggcacttgcaggttctggcgctccaaactggacggtgaaaactgtcgagtttcaagatcatgcgcgtgggcgactcggccgcccgtggtctgcccctgagggttcccaaacaatcgtgtctgtgctcgttcaactatctattgatcaagtggaccggattggcactattccactcgcggcgggactcgctgtcatggatgcgttgaatgacctcggtgtggaaggtgccggactgaaatggcccaacgatgttcaaatccacggcaagaaactctgcggcatcctggtggaagccaccggctttgattccaccccaacagttgtcatcggttggggcactaatatcagcctgactaaagaggagcttcctgttcctcatgcaacttccctcgcattggaaggtgttgaagtcgacagaaccacattccttattaatatgctcacacatctgcatactcgactggaccagtggcagggtccaagtgtggattggctcgatgattaccgtgcggtatgttccagtattggccaagatgttcgagtgcttctacctggggataaagaactcttaggtgaagcgatcggtgtcgcgactggcggagaaattcgtgttcgcgatgcttcgggcaccgttcacaccctcaacgccggtgaaattacgcaccttcgcctgcag

SEQ ID NO: 787 - DNA, 486 bp, Corynebacterium glutamicum
atggggaattcacttgagaaacatattgcagagggagaccggatccacgtcgatctgacatctcctttatccgcaatgttgttccccatttttgaactcattgtgattactggaatctgttggatgggcatcggctttttggatcagcttccaggaatcgatggcaccaaccccgccgatagcttccccgaaggcacccgcaatcttctagtgggtgtgtgggcagtacttgctgcatggcgtttcggtcttcctttaataaggcaacgtcgactccgcgtgatcttgagcgaccgcaaactgctggtccgacgcgcgggtctgcgcaccgggttcgattccattccactgagctacattcagcgagtccaacgtcggcgaaacaccctggtcttaggtgttggtggacaccaccgaccctatgtaatcaaccaggttcccaaggctcgaaaagtggaagcgctgctcaaagatcttacattttgg

SEQ ID NO: 788 - DNA, 1161 bp, Corynebacterium glutamicum
atgcccatcgtcgcagtaattggtgacggccaattagcccgcatgatgcagacctccgccatcgaactcggacaatcactgcgagttctagctggagcgccggattcctccgcagctcaagtagctgctgatgttgttctcggcgattacaccaacattgatgatctgcgcgtcgccatcgaaggcgccgatgtgatgaccttcgaccacgagcacgtccccaacgaacacctgcaccaactcatcgcagaaggcgtcaacgttcagccacgcccagaagcgctggtcaacgcacaagacaaacttgtcatgcgcaagcgtctacgtgaactcggcgcaccagtcccaccatttgctgccattgaatcagtcgaagatgcagtgggattcttcgaagcagttgatggccaagtttgcctcaaagcacgccgtggcggatacgacggcaagggcgtatggttcccagccgatgtagcagagcttcagtcgcttgtggcagagcttctcgacggcggcaccccactcatggcagaaaagaaagttgccctcaacagggaactgtccgccatggttgcccgcaccccaagtggagaaaccaaagcgtggccagtcgtagaatcagtgcagaagaacggtgtgtgtgcagaagcaatcgctcccgcacctgaactatccgcagaactgcaggaatccaccagaggattggcccagaagatcgccacggaactcggcgtcactggtgtcttggcagtggagctttttgaaaccctcgaccaaaacggccagccagagatctttgtcaacgagctcgccatgcgtccacacaacaccggccactggactcaagatggctgcgtgaccagccaattcgagcagcacctccgcgcagtcctcgactacccactgggtgctaccgacactttggctgattacaccgtgatggccaacgtgctcggtgccgacaccgacccagagatgcccatggcaacccgcatggtggaagtggggcgcaagtacccagatgccaagattcacctctacggcaagggacatcgcccgggacgaaagattggccacgtcaacatggtgggatccgaccttgaaaagacccgagccgaagccctggcctgcgcatacttccttgtcaacgctcgctgggat

SEQ ID NO: 789 - DNA, 1872 bp, Corynebacterium glutamicum
atgaaaagtgcgcggccaaaatcagtcgctccaaaatccggacaagctttactcactctcggtgccctaggtgttgtgttcggcgacatcggcaccagccccctgtactcacttcacactgcattcagcatgcagcacaacaaagtcgaagtcactcaggaaaatgtgtacggcatcatctccatggtgttgtggaccatcactttgatcgtcaccgtcaaatacgtcatgctggtcacccgagctgacaaccaaggacaaggtggcatcctggcgctcgttgctttgctgaaaaaccgtgggcactggggaaaattcgtggcagtagccggcatgttgggcgccgcattgttttatggcgatgtggtgatcaccccggcgatctctgttctcagcgcaacagaaggcttgacggttatctccccaagctttgagcgcttcattctgcccgtatctctcgcagttctgatcgctatttttgcaatccaaccgctcggtacagaaaaagtcggcaaagccttcggccccatcatgttgctgtggtttgtcacccttgcaggattgggaattccgcaaatcatcgggcacccagaaatcttgcagagcttgtctccacattgggccctgcgcttgattgtggctgagcctttccaagcatttgtgctgcttggtgccgttgtcctgacagtaacgggtgcggaagcgctctacgctgatatgggccattttggggcgaggccaatcagagtggcgtggttttgcgtcgtcatgcctgctttaatcttgacgtatttggggcagggcgccttggtgatcaaccagcctgaagcggtgcgcaaccccatgttttatctcgcgccggaaggtctgcggattccgttggttattttggcgaccatcgctacggtgatcgcatcgcaggccgtgatttctggtgcgtattcattgaccaagcaggccgtgaatttgaaactgctgccacgcatggtgatccggcatacctcccgcaaagaggaaggccagatctatatgccactggttaatggattgctgtttgtatccgtgatggttgtggtgctggtattccgatcctctgaaagcctcgccagcgcgtacggacttgcagtgaccggaaccttggtgctggtcagcgtcctgtatctgatctatgttcacaccacatggtggaaaacagcgctgttcattgtgctcatcggtattccagaagtacttctattcgcctcgaacaccacgaaaattcacgacggtggctggcttccactacttattgcggccgtgctcatcgtggtgatgcggacctgggagtggggaagtgaccgcgtcaatcaggaacgcgcagagctggaacttcccatggataagttcttggagaaactcgatcagccacacaatattggtctgcgtaaagttgccgaagtggcagtatttccacatggcaccagcgatactgtcccgttgtcattggttcgctgcgtgaaagacctcaagcttttataccgagagatcgtgatcgttcgaatcgtccaagaacacgttccgcacgtgccaccagaggaacgcgcggaaatggaagtgctccatcacgccccgatcagagtcgtgcgagttgatctgcaccttggttattttgatgagcagaacctgcctgagcatctccatgccattgacccaacatgggataacgccacctacttcctgtctgccctgactcttcggagcaggttgcctggaaagattgctggctggcgtgatcgtttgtatctttcgatggaacgtaatcaggcatctcgaactgagtctttcaaattgcaaccaagcaaaaccatcacggttggaacagagctgcacctt

SEQ ID NO: 790 - DNA, 615 bp, Corynebacterium glutamicum
atggcccatatcagcgtagagcgcttccgcacccgttactgtcaggacaacggcaccaagcagcacaaatgcttggaaaggctcagccacaatcaagcgcagggcccaatgtggagacaagctctgcaagatttctgggtgcccgatgatttgcggaattcccaatcctgcaagggtgacaaaccacagcaacatgatggggccgaaggctttgccgactttttctgtaccgagcggttggattgcaaaaatagcgatcagaactgcgagagatacgggcagaatgaagcgctcaaagcttggggagataaccgtcaagccttctgttgcgctgagaacagagatcgccggggtgatcaccacatcgccataaaacaatgcggcgcccaacatgccggctactgccacgaattttccccagtgcccacggtttttcagcaaagcaacgagcgccaggatgccaccttgtccttggttgtcagctcgggtgaccagcatgacgtatttgacggtgacgatcaaagtgatggtccacaacaccatggagatgatgccgtacacattttcctgagtgacttcgactttgttgtgctgcatgctgaatgcagtgtgaag

SEQ ID NO: 791 - DNA, 357 bp, Corynebacterium glutamicum
atgaagaaaaatcctttggttgaatgggtctgggttatggatgaactcggggttggctggtgccaatgcgagaaagattccatcaccggaaaagcaccacatcccgtgaacaagccactggtcaccaaatccattatcagggctctaggcgatgtccccgatgtcatgagcaaccaggacatcagccttgtggtggtggatttgtggaaattcgataccattactcctccaatcgcagaatccctcatgcgttccgtcaaagctgttaacggtgagatgcacccgcagtatcccaccgcgacagcaatggctgcgatcaagcatttctccaacacttttgatggacagattaacgct

SEQ ID NO: 792 - DNA, 495 bp, Corynebacterium glutamicum
gtgggtcctctagttggtttgatcatgggttcggattcggattgggacactgtagcgccagctgcagaggtactcgctgagtttggcattccttttgaagtcggagttgtctctgcacaccgcaccccagagaagatgctcaactacgcaaagactgcacatgagcgcggcatcaagacgatcatcgcgtgtgctggcggcgctgcacacctgccaggcatggtggctgcagcaactccacttccagtcatcggtgttccacgcgcattgaaggatctcgacggtttggattccttgctgtccatcgtccagatgccaggcggcgttccagtcgccactgtctccatcggtggcgcgaagaatgcaggcctacttgccgttcgtattctcggtgctggtgatccttctttggtcacgaagatggccgattaccaagagaatatggcgaaggaagttgaagccaaggacgaagcactgaagaagcgcttgctcggc

SEQ ID NO: 793 - DNA, 453 bp, Corynebacterium glutamicum
atgaatccgatcgtggtgctgggatccaaagttgttgatggtcaagtcactggccttttggcctcaaggctggaaaaggccattgaggtctcatctttgaccccagaagcacccgttgtggtcagcggtttcggtgaagccgccgccatggcagattatttacgcgcccgtggagtgaccaccattgtggaagaaccatgggccaccagcaccaatgagaatttagaaaacgcccacgcattatttccggacacactacagtggactgttgtgaccagtggctttcatgcctggcgcacctatttatgggcttggcatttagggattcccatcaaggtggtcactgctcgtacaccttcagctgagcgcctagggatggcgatgagagagtgttttgcactgccgcattcaacacttcgagtgctgtggcgaaaaatccgaactccaaagaac

SEQ ID NO: 794 - DNA, 792 bp, Corynebacterium glutamicum
atgtcaactgcatattttattgcgcacggaaacgatacgtaccgcccaacggagcattccagcggtgtgtggcgcgatgatgaactccaccttgcaccggttgccggtttggtgattcaccatatggaacgttggcgcagggaagtggttggcgatgctttggtgttcagccgttttagtttggaggtcttgggccagatcgctcgggatgatgtcaccttgagaacagagatcgttcgtcccgggcgcaccattgaacttattgaaaccgtggctgaaatcaacggcagagtgacgattcgtgcacgcgcctggttgctgaagacctctgatcttgcccatatttctggcgatacttttgaagcgttgccgtcaatgactgaactggcagatgttaagtcagcgttccagtggtctggtggatttatggacagcattgtgtttgttgaggacgctgagaaaattccgggcaaaaaccgcgcgtggattaccggcgatgtgcagttggttgacggcgaagattctgagcctttggcagagttttccaaattcttggatgtggccaatggcgtggcggttcgggaagatccaaagacttggatgttcccgaacgtggatcttactttccatctgttccgccagccggtgggcaccaaggtgggttttgatacccgcgcggcgtttggacccaacggcatcggtttgaccacgtcggtgattcacgatgccgaaggtcctgtgggcacgcttaatcaatcattgacagtgcgcccaattgctgagttaaacaag

SEQ ID NO: 795 - DNA, 1314 bp, Corynebacterium glutamicum
atgacaccgaaagaaatacacctcaacctttttgctttcggtgccgggcaccacgcggcggcgtggcgagcggtggagggaagcgtcgaaaagctgggtttaatttcctggtgggaggaactcgcgcgcaccgctgagcggggcaagctggatgcggtctttttggccgatgggcaggcgattaatccggtcggtctggagaatgggccgggctggtttttggagccggtgaccgcgttgactgcgatggcgcgggcgacgaacaatattgggttgatcagcacaatttccagtacgttttggcagccgtttcatgcggcgcggatgatcgccagcttggatcatatttcgggtgggcgtgctggaatcaatgtggtgacatcgatgaccgatgcggaggcgcgtaaccacgggatggatgcgttgccgggtcacgatgttcgctatgcgcgcgctgcggaatttattgaaaccatcactgcgctgtgggattcttggcctgcggaaagtttggtgatggatcgtgctggaaaatttgcggactcctcgctcattaaatctatcgatcatgatggtgagttcttccaagtcgctggtccgctgaatatccccagtcctccgcagggtcgacccgtactttttcaggctggatcctcaccgcaaggacgggaaatcgctgcgaaatacgccgaggcaatttactctgtggcgtgggatttggagcaagcgcaagattatcgctctgatattcatgctcgtgccactgcccagggtcgcgagcccatgccggtgcttcctggtttggtgacttttgttggcacgaccgtggaagaagcgcgtgcaaaacagcaggctcttaatgcgttgctgccggtcaaagactcactaaatcagttgagtttctttgtgggtcaagattgctcgacgtgggatttggatgcacctcccccaccactgccaccgctagaagagttttccggtcctaaaggcaggtacgaaacggtcctgcggatcatcgaatctaaatcaccaaccgtccgcgaacttttgggctacctcgcagcaggcggtgggcacgccacatttatcggcactccggaaagcatcgctgatgaaatcgagcgctggatcgacgagggcggtgccgatggcttcaacctcatgccaccgatgctcccccacagtttggacgactttgttgacttagtagtccctgaactgcagcgacgtggccgattccgcacagaatacagtcacaccacgctgcgcggtcacttgtttaaccaggttgcttattcagcccggtcacttgtt

SEQ ID NO: 796 - DNA, 1500 bp, Corynebacterium glutamicum
gtgcacaccccagacctacaccacaggcatagtcctaggctgctcacaattgacatcatgcctaaacccctacccccagaaacccgacgcaagatcatcgatttcgatccgttcgcaccgaacagcccctcgatcgaagagttctgcagtcggctaaaaatatcgcggcgcagcttctacaacatccgcaaccgataccaacaagacgccaacgcagcactgcatccacactccagcgccccaatcaccgcccggcgaacgtacgatgaatccatcaccagcaccttgctgtccatccgcgcacgcctgaaagcccaaggatgggagtacggcccgatctctattcgattcgaaggcatctccaccggggaactgactgcaccgattccatctgtttcaaccattgctcgtttgttacgcgccgcaggagctgttgaaagtaaccctaagaagcgaccgaagtcgtcggtggtgaggtttcaacgaggtcaagccatggaaatgtggcaaatagatggtttcatctacacactgcacgatactgatctgactcgggtaacgatctatcaaatccttgatgatgccactcggtttgatgtcggaacctgtgtcttccccgcgaatgaaaactcagtcgatgcccgaacagcgctagaacaagcgattgctcatttcggtgccccgcatgaattactcagtgataacggctcagcgtttaaccggatgcggcaaggatacgtcggaagcttggaaagctatctcgcgacggtggggtgtttaagcattaccggcaagcctgggcatcctcaaacccaaggtaaaaacgaacgcagccaccgcacactatttcgtttccttcaagctcatcaaccacacacacttgaggaatgtgcgcactatattgaacagttccgcgatcattacaacaatcgtcgcccgcatcaggggttgccgaataatctcaccccggccgcggcctgggagattgtgggctgtgtggaacaacaacccccgattgatcccgtcgtgcttcaacagcaagccgatcactatgcccgtcgtcgaattgagaagcaatcagatgtcccgcttgttcggcaggaggaatctgttccggtgtctaagatgcagcagaccgagcaacgtcgacgggtacgtcgttttggtaaaaagccggtggatcctgatgtgtttacgtttgctgggaataatcagaaggtggtgttccaggggatgcgtatttctgttcctcgtacgatgagggacagggagttttatcggacggtgacggcaactgagcttggtttctgggatgcgataaccggggagcttgagttgtcgattccgttgccggttgtggcgattgcccggggtaagtcgtatatcaattcttacaacattcgtggggtgtggatgcaacacccgacaccgttgtggcaacgcaaacgtgatgaggctgagaagcgattcaagtcgatagatccgggggatcttctgcgc

SEQ ID NO: 797 - DNA, 789 bp, Corynebacterium glutamicum
atgcttgatatttctgagcaaattgttttggtcaccggcggtgcacgcggacttggtcgcgcgttgtctgaatcatttttgcgcgagggtgctcgtgttgtggtgaactatcaccgttcggctgatgctgccgcagagctggctggtgaaaaggcggtggcgattcaggctgatgttcgtgatcgcgaacaggtgaaaagcatgtttgcgcaggccaaggaacatttcggcagcccgatcaccactgtggtcaacagcgctttggcggatttcagctttgatggcgatgcgcgtcccaaggcggaggacatcaccattgagcgttttaatcagcagtacaccagcgcaatcgagggcgcgctgaacaccatccaggaggctttgcctggttttgaggaggtgggaagtggtcgtgtgattaacatcggcacgaatcttttccagaatccgactgtcccctaccacgattacaccgctgcgaaggctgcgctgctgtccttgactcgcacgtttgccaaggatttgggcccacgccacatcacggtcaacatggtcagcggcggcctgctgcgcaccaccggcgccagcgccgccacgcccgaggaagtctttgatttcatcgccgccggcaccccactggggtccgtcaccactccccaagagcttgccgacgcctccctcttcttcgcatccccctggtcgcgcgcggttacaggccaaaacttggtcgtcgacggaggactggttttcaactgttttgtgtcagagggttgtgcacactcagtgtca

SEQ ID NO: 798 - DNA, 369 bp, Corynebacterium glutamicum
atgaaagattcgtctaagtttgcgacaaaaaattattctgctcgactgttcttattgctttatgtcttaacggtcgtagtcgggtggatatttgcccttgggaatccctattcagtagtaaccgctttttcaatttttgttggagttggttttgctgtagctgcagttgcttgtgccctaacaagaagagctcccttgtggcttttggggttcttaggtggtgtaggaatcgttcttgtcttgatgggaatctatttcagggtaactcagcctgatggaatcctaactggatatttgataccgattggttttggattttttctcgcagaagcagctgtggcaatagagcgttattggcatcgtcgtcac

SEQ ID NO: 799 - DNA, 342 bp, Corynebacterium glutamicum
ttgtccaacctcgcggacatttacggtgcggagacgattactttcgatccggcggggcatcgctggctgcccttcatcgagaaacactggcgccatggtcaagatgatccgatcgagtgcacccgcatcaaagaattgacccgccagatcgccaccaccgacgatccaaatatcagtgttctctggactctcttccagtatggcggggagaacatcggcgacatctccatttactaccttgacaggttttccttccggggtttccaagttcctgctgctgaacacccacgtggggcgatcgccatacacatcggtccacttgtggggatcgctgatgaaatc

SEQ ID NO: 800 - DNA, 567 bp, Corynebacterium glutamicum
gtgatggcgatcatctacaacacatcgagcacgctcaacggcttcatcgcagacaaagacaactccctgcaatggcttttcgacgtccccggcagcgacggtgcctctgaagacttcggtaatttcctttcaaaagccggcaccatcgtaatgggatccaccacctatgaatggctgctcaaggacctagatttcatcagcgatccccacaagtggaccgatgtgtatggcgatcgccccacgtgggtgttcagcagcaggaacttggaaaccccggaaggaaaacctgtcaaggtagtaaatggagatgtcgccgatgttctccccgccatactggaagagagtccagagaacactgatatttggatcgtcggtggtggcgatctggcgggtcaattctttgatgcgggtgcactcgatcggatcatcttgaccatggcgccagtgtttctcgatgaagggcagccagcgatgccccgccggatcgaaagtaatcgtctccgcaccgtaaatgtccgcgaggttggacaattcaccgagatcaccctggagacgattaaaggggct

SEQ ID NO: 801 - DNA, 420 bp, Corynebacterium glutamicum
atgggaattaaacgtttggacaacgtggcgattgtggtggaatcgttggatgaagcagtcggtttctttgagaaattagggatgtccctagatggccgaacaatggtccaaggggattttgctgatcggaccgttggtctcagcggaattcgatctgagatcgcggtgctgaaaactccggatggacattctcgggtggagcttactcaatatctacaaccggaaccgattgcaaccgctccatctgcacctaaccagattgggatgcaccgtttgatgtttgcggtggatgatattgaggaaacgatcgaacatatcggtgcggaaccactagatgggatcgcaaattacgaggacacctaccgattgtgttatctgcgcgggccatctggaattatcgtggcgttggcgcaggaactt

SEQ ID NO: 802 - DNA, 222 bp, Corynebacterium glutamicum
atgagtgctgataaatcccaggaccaatccgaatcgcaacgcaaagggcttcaacccgaagcgctgcttggattcctgggatttttctcattcctcgccgtcatccaggcagtcatcaacgtgttacgccccgaacctgccgtgtggccagctcttctcgcgctcgttttagtaatcgccacagtgtcagtatggagggcttggcgaaagcgccgccctaat

SEQ ID NO: 803 - DNA, 834 bp, Corynebacterium glutamicum
atgactaaacgaacaaaaggactcatcctcaactacgccggagtggtgttcatcctcttctggggactagctcccttctactggatggttatcaccgcactgcgcgattccaagcacacctttgacaccaccccatggccaacgcacgtcaccttggataacttccgggacgcactggccaccgacaaaggcaacaacttcctcgcagccattggcaactcactggtcatcagcgtcaccacaacagcgatcgctgttctcgtgggagtgttcaccgcctacgctctagcccgactggaattcccgggcaaaggcattgtcaccggcatcatcttggcagcctccatgttccccggcatcgccctggtcactccgctgttccagctcttcggtgacctcaactggatcggcacctaccaagcgctgattatcccgaacatttccttcgcgctacctctgacgatctacacgctcgtatccttcttcaggcaactgccctgggaactcgaagaatcagcacgtgtcgacggcgccacacgtggccaagccttccgcatgatcctgcttcctctagcagcgcccgcactatttaccaccgcgatcctcgcattcattgcaacgtggaacgaattcatgctggcccgccaactatccaacacctccacagagccagtgaccgttgcgatcgcaaggttcaccggaccaagctccttcgaatacccctacgcctctgtcatggcagcgggagctttggtgaccatcccactgatcatcatggttctcatcttccaacgccgcatcgtctccggactcaccgcaggtggcgtgaaagcc

SEQ ID NO: 804 - DNA, 1032 bp, Corynebacterium glutamicum
atggccacattcaaacaggccagaagcgctgcctggctgatcgcccccgccctcgtggtccttgcagtggtgatcggatatcccatcgtccgagcaatttggctatccttccaggccgacaaaggcctcgaccccaccaccggactcttcaccgacggtggcttcgcaggactagacaattacctctactggctcacccaacgatgcatgggttcagacggcaccatccgtacctgcccacccggcacactagccaccgacttctggccagcactacgcatcacgttgttcttcaccgtggttaccgtcggcttggaaactatcctcggcaccgccatggcactgatcatgaacaaagaattccgtggccgcgcacttgttcgcgcagcgattcttatcccttgggcaatccccaccgccgtcaccgcaaaactgtggcagttcatcttcgcaccacaaggcatcatcaactccatgtttggacttagtgtcagttggaccaccgatccgtgggcagctagagccgccgtcattcttgccgacgtctggaaaaccacaccattcatggcactgctgatcctcgccggtctgcaaatgatcccgaaggaaacctacgaagcagcccgcgtcgatggcgcaaccgcgtggcagcaattcaccaagatcaccctcccgctggtgcgcccagctttgatggtggcagtactcttccgcaccctcgatgcgctacgcatgtatgacctccccgtcatcatgatctccagctcctccaactcccccaccgctgttatctcccagctggttgtggaagacatgcgccaaaacaacttcaactccgcttccgccctttccacactgatcttcctgctgatcttcttcgtggcgttcatcatgatccgattcctcggcgcagatgtttcgggccaacgcggaataaagaaaaagaaactgggcggaaccaaggatgagaaacccaccgctaaggatgctgttgtaaaggccgattctgctgtgaaggaagccgctaagcca

SEQ ID NO: 805 - DNA, 468 bp, Corynebacterium glutamicum
gtgaaaggagtccggatggcttccggcaaagatcttcaagtttccacatttggctacatctcccgctgccccgtgcaggtctacgaagcaatcgcagatcccagacaactagaacgctacttcgccaccggcggagtatctggccgcctcgaaaccggatcgactgtctattgggacttcgttgattttcccggtgcgtttccggtccaagttgtctcagctacacaggctgaacacattgaactccgctggggacaagcaaatgagctgcgttccgtcaacttcgagttcgaaccttttagaaatttcacccgcacgaaactcaccatcaccgaaggcagttggccgctcactcccgcaggagcccaagaggctctgggcagccagatgggatggactggcatgctgtccgcactaaaagcgtggctggaatacggagtgaacctccgcgacgggttttataagcaa

SEQ ID NO: 806 - DNA, 1272 bp, Corynebacterium glutamicum
atgtcctcgatttcccgcaagaccggcgcgtcacttgcagccaccacactgttggcagcgatcgcactggccggttgtagttcagactcaagctccgactccacagattccaccgctagcgaaggcgcagacagccgcggccccatcacctttgcgatgggcaaaaacgacaccgacaaagtcattccgatcatcgaccgctggaacgaagcccaccccgatgagcaggtaacgctcaacgaactcgccggtgaagccgacgcgcagcgcgaaaccctcgtgcaatccctgcaggccggcaactctgactacgacgtcatggcgctcgacgtcatctggaccgcagacttcgcggcaaaccaatggctcgcaccacttgaaggcgacctcgaggtagacacctccggactgctgcaatccaccgtggattccgcaacctacaacggcaccctctacgcactgccacagaacaccaacggccagctactgttccgcaacaccgaaatcatcccagaagcaccagcaaactgggctgacctcgtggaatcctgcacgcttgctgaagaagcaggcgttgattgcctgaccactcagctcaagcagtacgaaggcctttcagtgaacaccatcggcttcatcgaaggttggggaggcagcgtcctagacgatgacggcaacgtcaccgtagacagcgacgacgccaaggcaggccttcaagcgcttgtcgacggcttcgacgacggcaccatctccaaggcatcccttgcagcgaccgaagaagaaaccaacctcgcattcaccgaaggccaaaccgcctacgccattaactggccatacatgtacaccaactccgaagaagccgaagcaaccgcaggcaaattcgaagtacagcccctcgtaggtaaagacggcgtcggcgtatccacccttggtggctacaacaacggcatcaacgtcaactccgaaaacaaggcaaccgcccgcgacttcatcgaattcatcatcaacgaagagaaccaaacctggttcgcggacaactccttcccaccagttctggcatccatctacgatgatgagtcccttgttgagcagtacccatacctgccagcactgaaggaatccctggaaaacgcagcaccacgcccagtgtctcctttctacccagccatctccaaggcaatccaggacaacgcctacgcagcgcttaacggcaacgtcgacgttgaccaggcaaccaccgatatgaaggcagcgatcgaaaacgcttccagc

SEQ ID NO: 807 - DNA, 423 bp, Corynebacterium glutamicum
ttgccatgttctactaaattaccagcaccagtacacattgtgggtttagcgggtctaaattgggaccgctgttcaaggtcaggagcagaacgcatggctactgccaaagttcgcgatcggtggcaacaactcttttggggcggcatcaagctcaaaggactcaacggcttatttgagctcatcggcggagtgctcctccttcttgtcgatcccgaaagccttcaccactggaccgttctgctcacccaaaacgaactgaatgaagatcccgacaatggcatcgccacgttccttgggcacagcagtgaatcactcaccagccacgctacgttgttcagcgctagatatctactgacgcacggccttgcgaaagtggtactcctggtcgcagtcctgaaaacaaactgtgggcatacccgtgga

SEQ ID NO: 808 - DNA, 996 bp, Corynebacterium glutamicum
atggcaacggtcacattcgacaaggtcacaatccggtaccccggcgcggagcgcgcaacagttcatgagcttgatttagatatcgctgatggcgagtttttggtgctcgtcggcccttcgggttgtggtaaatccactacgctgcgtgctttggcggggcttgagggcgtggagtcgggtgtgatcaaaattgatggcaaggatgtcactggtcaggagccggcggatcgcgatatcgcgatggtgttccagaattatgctctgtaccctcacatgacggtggcgaagaatatgggttttgcgctgaagttggctaagctgccgcaggcgcagatcgatgcgaaggtcaatgaggctgcggaaattcttgggttgacggagtttttggatcgcaagcctaaggatttatcgggtggtcagcgtcagcgtgtggcgatgggtcgcgcgttggtgcgtgatccgaaggtgttcctcatggatgagccgctgtccaacctggatgcgaaattgcgcgtgcaaacccgcgcggaggtcgctgctttgcagcgtcgcctgggcaccaccacggtgtatgtcacccacgatcaggttgaggcaatgacgatgggcgatcgggttgcggtgctcaaggacgggttgctgcagcaggtcgcaccgcccagggagctttacgacgccccggtcaacgaattcgttgcgggcttcatcggctcgccgtccatgaacctcttccctgccaacgggcacaagatgggtgtgcgcccggagaagatgctggtcaatgagacccctgagggtttcacaagcattgatgctgtggtggatatcgtcgaggagcttggctccgaatcgtatgtttatgccacttgggagggccaccgcctggtggcccgttgggtggaaggccccgtgccagcccctggcacgcctgtgactttttcctatgatgcggcgcaggcgcatcatttcgatctggagtcgggcgagcgtatcgct

SEQ ID NO: 809 - DNA, 369 bp, Corynebacterium glutamicum
ttgctgctggctttcatcgcgtatcagctgtaccaaatcgcacttcacgccagcgccggaatgatcgcgccgacaattttccacagtatcggtgtaactcgggaaaaactccaccacgtatggatctgcaatgtcgacggcgtagttggtgtctcctgtttgattcgtattgatattgagaatctgatccatcaccagctcaacgggagcaccagaacgatcacgttttctcgtggttgttcatctacgctttcactgctccatgagacaagcgatgcgccaagggcaagagttgctccgattaaggctaaagtgcgtcgtgtatttatgcgtccaattcgaattttattggggttgggatcttcgcga

SEQ ID NO: 810 - DNA, 4800 bp, Corynebacterium glutamicum
atgtccaacgcacctaaaaagagcttttcagacttcttttccccactagcaaccgaaactgaaacaactattacgctctcggcaattgaggtagagaaagtcaatgccaagactgaagtcactcgaaatattgatccagtcgaagcagcagaacaaatcagccgcgactaccgccgctacctgaaaacacttattagccccagtaataagacaattgcggcagaattcaaccgagagattgatgagtccgaaaaccttgtctacggaccaattttgcagctgactccgccttatgcaccaggtaagtcccctgctcaattaattgatgagggagtcctttctccaaacttctcacgtctcgatgccgcactacccaaagatcgcccgctttatcagcatcaggaagacgctctgcgaaaaatcgctagtggccgaaacttaatcgtttcaaccggtacaggatctggaaaaacagagtctttcctcatcccgatctttgaccaactgctccgccaacaacaagccggtgagttaaatcctggtgtcagagcattgcttctttaccctatgaatgctcttgcaaatgatcaggagaaacgtctccgcgaattattggcagacaccccggaaattacttttggtcgatacaccggagataccaaacagacccgtgaagaagccgagaaatacttcaaactgattaatgggcgaaatgcgacccctctacctaatgagctaattagccgtgatgagatgcaggaaaatccacctcatatcttgctcaccaactacgcaatgttggaatacctcctgcttcgtcctgcagacaacgcattcttcgatgatgcatattccaataattggaagttccttgttcttgatgaagctcatgtctacgccggagcacaaggcactgaagtcggcatgctgatgaggcgcctgaaagatcgtgtccaacgaggaaatcccctccagtgcatcgctacaagtgcttctttggaaggaactaaagaagccatcatgacctttggacaagacctctttggtgaaccttttgagtttgtcaacgaagatccctcgcgccaggatttggtatccgcgcatcggagaaaactaccaaaaacctttacgtggtccctaccagatgagctctttgaccagcctttagaaagtgatggtcttttccaagcactacaagagcgcggtggagatcaatacgaagagctctccaaagaagaacacatcgtaaaactccgcgaactatcccagcaatcaagcactcgagttgaagacatcggcaagggtctttggccaaatgttactgataaagcatcaatgcaccgcacacatatgctggtgaatttaggcagtggcgttctatcccatgatggagtaccagctctgtccgcgcgttatcacatgtttgtccgcgcagttgaaggcgcttttcttgggtatacagagcaaggaaagccaatcgtgtccttggaccggcaagtgacattaggcgacacagctcgaccaatgtatgaaatgggtgcttgcatcaaatgtggaaccgttcatatcagcgcccataatgattctggtttccttgtgcctccagagaattcctcaaatttcgacgaacaacagctcaaatgggtagtcctcaccgatgatttcgaaacagcagacatcgacgaagatgacctagaaactgatgctgacgagaacgtcaaagtccttgagctacaaaaattatgtacggcctgcggaaaactaaacggaaagaactctcttctctgctccggatgctcatcacatcatgaccagtttattgatgtaaagatcttggaaccccggaatggtagccaattaacatgcactcgatgcggtggccgagaaaagaacctgattcgacgactccgaaccgattcaaatgctgcaccttctgtcctcaccacatcattgttccaactgttgccagaatcagctgatcaagatacatcacgcaagatcggtgctggacgcaaactactcacgttttctgactcccgccaggctgccgcttacgcagcaccatatttgcaagcaagttacaccaggttgctagagcgaagaatcctcattgagaccctgcgggatgaagaatttactgaaggcgcatccattgaacgatggatttcccgcgcaagtgaagtggcgaaaaacaatcgagtcctcgctaacaacttgaacccacgcgaaacactagaacagacaggtaactgggtattcgcagatcttgcttcgacagtccgacgtagttcgactgaagggcttggactagccaaaattgaactgacccctgaggctttgtcgcaactcagtttcagaaaaccacttggcgagatgtttggggatccggatgccgccgacgccttttttaatctcttcgctcaagaattccgtcacaagggcgcaatcaattgccctgactacgtcaatcttgaggatgaacgctttggccctcgtcgtgggcagcactttttcaccaaagatggtggaagaaaatcaacacgacgcctctactcatggattccgcaacgaggaaccaacaatcgcaaggacttcattacaaaagtcttgaaccgcatcggacaagcaggtgacgaaggtgaaaatattacgacgcttctccatcacctatggaatgactacactaattccgaaattttgaaggtcccaggcgaaaaggccgaaggctacacacttaactacaactcactgcaagtaagccctggaaaacaacattcctggtatgaatgtgacacttgtagaaatacaacgccatttaatgttctcgggctgtgtccacatgggttctgtaaaggcaagctaaaagaaatcgatacttctttaccggagtatgccaacaatcattatcggaagttggcaacatcgcttgaaattcttccgctttcagccaaagagcacactgctcaatggacgccaacggaggctgcagaggttcagaaagaattcatcgaaggaaaaatcaatgtcctaagctgttctactacgtttgagcttggagttgacgttggtgatctgcagtcagtaatgatgcgcaacgtaccgccacgtacggctaactatgtgcaacgtgcgggacgtgcgggacgccgatcaggttcagcagcttttgtgcttacctttgctaagcgatcttctcatgacttggctgtatttaagaacccaacccagatgattgatggcgaaatgacagtgccatttttgcacattaacaatgcccgaatcgcccgtcgtcacacctattcaatcgctctcgccgcatttttccgagagcaggctgcccaaaatcggttctggaaaaaggccggagagttcttccttggcactgatgcagctccataccttaggcctgctgtcgcagagcaagaggcaacggagatcctcgaagagtttctctcccctgttcctaattacatcactgaagccctccgtcgcgtattccctgagtccctgcatgaggatctggatattgaaaatcaaggttgggttaaacaattccttgaaattttcgatacaactcgtcaggagatctccgaagatttccaaacgcttaaaaagatgcaagggcgagcgctgggcagtgaacaaggcaaaaaggcagatgccttcaaacgcacaatcacaactctgatggaccaagatcttttgggatacttggccaagaagaacatgctgcccaagtacagcttccctgtcgatacagtagatcttcaaacaaacttcagtgaagctggaaataaggtgagcttgtcacgagatcttcagctagcgattaccgactatgctcctggtgcggagttagtagcaggcggaaaattgtggaaatccgctggcattcgacacctagccggtaaaaaggtggaaactttttattggacaacgtgtactgagtgtaaacatactgaaacctctcgttttggatttacatctgaagatgtctgttctcagtgctctgcaccaatatcgctgggtaaagagaacaagttccttatccctcgttttggtttcgttgcagacccaaatccaactgaagtgggcactgctcccccggtccgatcctctaatcgacttgaatttgtaaagcagttcggtgtcaaagatgacagtgaagagttctcaaattcagatgggacagcaactgcgcaagtacttacttcttcttggagtcggacggagatgggagcgcttgaaacaggtcctaacaagaatggattttggtattgccaaacatgcggattcggcactcccaatggcgccgaaatccctaaaagccatcgaaaccccagaactaagcagcagtgtggcacctactacttagaaccccactctttgggtcacacctaccaaactgacatcgcgacagttgccgttccttcttatacaaatcttgacttcgaagggtggcgctctggaatgtacgccatcatcgaggcagctgctgaatgtttagaaatcaatcgtgatgatctaaacggcaccatggcgaaacacgacaacaggccaacgatggtgttgttcgatactgttcctggtggagctggtattacccgaaaagttcgagaaaacttccctcaagtactcgaagcggcaattagaagggtcgaaacctgttcttgtggcatcgatacttcgtgttatgcctgtttgcgatcattttctaaccagcgtttccatctcgatttaaggcgcgatattgcattggacttgcttcaccatatggcggttgcgatgccaaaatctgag

SEQ ID NO: 811 - DNA, 372 bp, Corynebacterium glutamicum
ttgagcatcgagcatggcggttccagaaagcgctgccaggaagacgagtggatattctataaacagatctttaagaatcgctggcttggattgatttccgccaactgcttccaccaagattgcaatgatcgtttcgtattcttcaacggtcagctgaaaatccagcgcaaggagtggggtagggcgcgtgattttctttccatcattgccaataccactgatgcgagcttgcaatttggcgtttgtaaaccgcagttgatcattgagagttttgagatcttgaagatcgtcagcgaaactgcgctcttgtttgagtcggcgagagatagtcacggaatgaggcctttgaacggaagaatcggatcaaataat

SEQ ID NO: 812 - DNA, 3699 bp, Corynebacterium glutamicum
gtgactatctctcgccgactcaaacaagagcgcagtttcgctgacgatcttcaagatctcaaaactctcaatgatcaactgcggtttacaaacgccaaattgcaagctcgcatcagtggtattggcaatgatggaaagaaaatcacgcgccctaccccactccttgcgctggattttcagctgaccgttgaagaatacgaaacgatcattgcaatcttggtggaagcagttggcggaaatcaatccaagccagcgattcttaaagatctgtttatagaatatccactcgtcttcctggcagcgctttctggaaccgccatgctcgatgctcaagaaggtttctggcctgcgttctggaaacgcactcaggtgtcagttccagagcatgtatacgacgcgatccgtaaagaactagttaatagcatccgcaaaaatggcctagaaactttttctctcgctgacctcaatcgacgcgaatatgtcggactcatccaacttcacagtggcctttctgcaaaagacatgctcgccttggtcaaatttatcgatcacactcgagcagaaaaccaaggatgggattctggtgaggactttgcatcatatgcgaagagtgtcttctcctccggggacaacctattaaccacggagtcgctcaagcaattagtcacccacatccctgcgcgttccgtcgacttcatcgccagagtctatgaactaaccaattggtaccgcgacctcaaagacctcaatgaagtagaagccttcgtaggtactcatgggctgccggaattgtctttcaaatttcttctggagtgtctgagcggcgaagctgaacaaattgccgaaaagacgaaagcagcaccagcaagcctggaaaacctggaacctccgcatctctatctggatccacagagttttgaactcagtcttgttttcccagcgatctctaaaactgcagcacttcagattccagcaccagaatggacagtgatttatgacggaaactccattaaagttcgtcccgaacaggactggtcctacggaggtttcgccgaataccgtttgcctttagacaaaccgctctccagcttgagagtcatcactccaacagagaaatccctaattctgattgaaggatttggccacaagaatcccattatgttctttaagaacaacggtcagccatatgcaaaccaagaaatgctcagtggcaacgctgtcacagctatagtcccagctgcagcaatcattcgtgcacgtatgcgagcttccaagactttcaactatcaagacttgggtcccttgtccggatggaacaagtgggtcattcgttcgatcccactcaaacgagctgaatcgatcacagtctcccacggtggcttcagaaaagaactcccagttcgacgcaaagttgatgttcaatggattactgaggatctcacgatcgagaatcttcaaggtctcgatcatgagcccgttttccacacgagtccccgcatcgaattccccacctctggatcaaactgggtaattcagtattcacagattcttccagatggcagcctcatcgaaatggaagattacccagtcgaacctgaaaacttcggatacgaactagacctcttcgaagaatccgacgacccttgggtcgggcaatttttagtaactctgctcaaggatgaaaaagtctatgaaacccgcaaattcaatctcgcggaaggcctcgatctttccctaacattcagcggaggcggacctgaaaatcgatttaggtaccccagcatcaatcagggacaaactggcttaacaaagactttcgcccgttttagttccaattctgaaaagcacatcaggttcccagatgagatcatcgggcttgatgcattcacctctcaaaaagcgtttaacatcgcaagcggtgatttccctgaggactacaacctcgacgttttcatcacgcctccgcaacttcactaccaagtacctgtcacacacagccaaacaaagtgggaaagcacaaagacgacactagatttcaatgactttgccgatggaaacctccagatcagattccctaatgaagtctatgatccaaacttgaaaatcattaaaatggtggcatacaagaaacctgagtccagtgagcctaaatacttaagcaaaattggttcaagcaaagtgtggtctatccctatggatcgcatcaaggaactcatggatgatgatgcccaattccttttgatcgcggagtggttcgctgaaagtaaagaccagcaccgagagaagatcattagcgaagctaagcgaactggaaaaatctccaatgcagcgcttaagagtgctcgtcctcaacctcaagcaagttcccacattgcaacaattgagaaaaagcccctactagctgcggctgaaattaagctttctaccgtggagttggaacttggtcggcacacttctaagagactggaaggctgggcatggtctgcgctcaacccgcttgatccaccaatcaaagtcgatttccaaggaacctcaggctcacttccagacacccacttcgtcgttggccctttaatcgtggaagtgagagaaaaagagtttctctcccaatggcagccaaaagttccctcagttaaagccgtggttgcaaatgatccctcatttgaattggaccctcaatttgatcctttcctcacacaccgatggatgttcgctccacgaagtgggaaggtcttactcccacaagaaatccgcacagtgtgggacgcccgattcaatatgcgccatgtcttagcgcagcgtgaaaaccttcatgtgaaatcgattcaagattttgacgatgccaccagtacctatctcaccagtgatcctcgggtggcattagatgaattggataagagctcaattccgtctaattcccactttgaatcattcatccgatccggattagctgagctttctttcgaagttgacgacacagccggagatatccatcgcgttccctggatcggcctgatccaggaaatgaacgacctcagaattctgcagatacaaggctatgaaacagaagaacgagccatcgaacgccgaaattcgcagagctacatccgtgagataggaggcagtgaattgtggaatatcctaaaaggaaattcagagggattgtctcttgctcaaaaatgcgcaccacaagccactgagattaatgtgattcgtaattcaggcttggaagctatgcgcaatgggctgggcgccgatcagttcagcgccgagtttatttcagcagactcacgcctacgagctcagcttgaatggttggaaaaccgccgagagctcaatgatctcggccagctcccaacgctcttcgatttcgccgagaaatacgagtacctcatcgatcacttaggtgatgatcgcatcaaggtcactgcacgtgagctgtctactcttgcgtcggaacaccgtcgcggcaacgctgaaaactggctttatgcaccatatgtgtcattcatttacagcttgcttaaccgaatgatcgctcatgaagtaatacgtccgatcgctcagatcaattactcacggcacgattgggcaaacgctgctcggctgattcctcgtctcacaggatttgacctggtgagtgccgaagcgaaagtgctcagcgcaataaacaacaacaatataatcccaactgcaatt

SEQ ID NO: 813 - DNA, 633 bp, Corynebacterium glutamicum
ttgcttgctcttgatcctgcctcccctcgtttgactgtttataacgagtccacgggtgcgcgtttggatttctccgccatcactcttgataactgggcgtccaaggttggcaatatgctccttgaggaattggatctggaggaaggctcgctcatcactattgatttgccggtgagctggcaggccgcaatgattatgctcggcgctttagcaactagtgttgaggtctcttttgatgatcccgaggcagatgccatctttacctccctcgatagattttcccactacaagggccatagtgatgtgctgattgtcagcgaggatccttttggtcgtggagttgttgaaggtggcggtgaactgcctaatggtgccatcgattttggccccacagtgcgtttttatggcgatcaattcttccagcctacccgcacattgccggaaatcatccagcattctgatgttccggttggcgccagagttcttgcaactggttggtcagatatcgagtccttcaatcaccaggttttagaaccactcgcagtgggtggctctgcagtaattgtgaccggactggctgatattgagcgtttaaaccagattgcaaccaatgagaagacaacccaccgtatc

SEQ ID NO: 814 - DNA, 2433 bp, Corynebacterium glutamicum
atgcgtggtgacgttcaaaaaataaccaaggtttatgacggcaagcaccgaaccttggaaatcccggtttatcaacgcaattacgactggactgaaaagcaatgttcacgcctctttgatgacctcagcgaagtggtcaaagaaaaccaccgtcaacatttttttggagctgtggttggtaagcctcaaggcagctggacctgggttgtcatcgatggacagcagcgtcttacaacaatcagcttgttcatgcttgcgctggtacattccttgcgcgcatctgaagttgaagaaggtgagtttaatgctggctacaacattgatctagccacattgattgaggatgactacctccgatccggcaatgagggaaacctcaagttcaagctcaagccagttaaaaacgataatgaggcttatcaaaagctcttcggcccagaatctgaattcatagagtcctcaaacctcactgctaattatcgctacttccgcaatgtccttaaggcaaccgatctcaccgcagctcaactatgggaagctatcgagaaactcagggtcatgtatcttgaccttgaggaatttgatgatccgcagcgaatctttgaaagtctcaactccacgggattagagctcagtgaagctgataaggtacgcaacttggttcttatggatcaggagctcaaaacccaagaaaagctctatgagcagcgttggaatcccattgaagtctgcgtgaaatttgataccgacaatttcattcgctggtacttaactctcaaaaccgcgcgcaccccaagaaagcaagatgtttatgaggaattcaagaaattcatccgtaactccaagctcccggtcgaattcatcctcgacgatatgtacgagtacgcgaagctgtaccgagatctcttaggtgccactactgggtttatagctgccgataggtgtcttaagcgttttgtccctgtcatgggcgatgtggttttgccttttctgctgcctgttctcaaagatgctaaagacggcatcatcaccgaatcagacttcctcggagttctaaaagttctggaatcctatttattccgccgttttgcagtcggggttgctagtaacgccttaagcaagatcttctccactgcttatagcgacatcaagaaattctggactccagggcaaagttatagctcactgctggcctacattctgaaacgtcgcgatggttccgggcgttttccctccgacagtgaattccgtgagaacttcgcaaccaaaaatttctggaatattcataacgaaaacaggcgttacttatttgattgtctagaaaatgccgattccaatgatgttcgtgacatccaaacaagtctggatgaaggatctctctccattgaacacatcatgccacgtagcctaaacgatcagtggagagctgaactcggccctgaatatgctcgaattcatgagacttggattaatagaattggtaacctcaccatcaccggctacaactccgcctattcaaattcttcctatgagcgcaagcggacgatggaaaatggatttttggtatccccctatcgcatcaataatttcatcaaaaagcagaagcattggtctgaagaacagctaattgagcgaaccgagctgctcactcaagcagcgctggactactggccccttccaaaagaaaccttccagccaccacaagctgtgcttcctacagaatccttagatagtgatctttctttccgcggacgcgaaattgtcgcctttgaatatgaggactacaaggaaacggtaacgtcctgggcagacatgctccagagcgttctaaaagtcttgaaccaatccttccgccaggaactcatagctttgaccaatgaagaaatctgcctggcaacttcaaacaacagtaacagcagtctccgtgaaattgaccacgggctttttgtagacactggctctagtacgagtgtaaagattggcttcctccgcagagtttttactcaactggggctagagcaggaagcattggttttcacccttcgaccactggcaaatgatgtagaaccccgagatgatgaactcgaggtagaggtagaaaagaaatattccgatttgactaaattcatcccacagttagaagaagctgagaatctcgagggggcggatacagaggttattcctctcctctcaaagctcaaggaacaactgacagcctttagcccggagaatcctcaagcagccctagggggcctacctgttccagaattcctcaaacaaaatgtgattgaacaactaagcgcagagcacatccttgctgtactcactcaacactttaatatcgcatccatgatgggtgatgactatttgctcgaagagctcaggtcaggccgcttaagggaattactgcagcgtttagaggaattggatagc

SEQ ID NO: 815 - DNA, 1563 bp, Corynebacterium glutamicum
atggactttgcctatttggataccccaaatagcaatgacctgcgccgcgttattgaaactgaaggttttgatagctggcgcgtgtatatcgaccccagccagcgctccttagtcacccgcaacttcagcggatcgggtcgcgtttttggtggagctggcaccggcaaaaccgtggtggtagtccaccgtgccaaccgcctggtcacttctgatggacaccttgagaccgacgataagacgcctcgagtcctgctcaccacctatacccgcggtttggccgatgcgttgaaatcctccatgaacgcgcttaatcccactttccccgaggcagaaaaacccggtagtcctggcttgtggatcagcggaattgatgccttggcaaataaggtggttgcgctagcaaacaccgccgaacgtgaggcagcaaccactgctatcttggggcgtgcagccggcagaatcaccccattcatcggcaacggcgaacaagaattttggatcgacgcgatcatttccgcagatcccggcgatctatcagaagaaatcagcaatactgaattcctcgcccaagagtttgaaaccgtaatcctagcccgcggaatcacccaagaaaaggactatctgcgtgcacctcgtcccggccgtggtaccccactaaaccgcgtacaacgcaaaaaagtgtgggcgattattcagcaattcatgacttcctgtgcgcgcgaaggaaagatgtcctggccagcgctttcctccatcgccgcaaacatcctggagcagcgcgccgccgccggccagggccggctatttgaccatgtgcttatcgacgaggcccaggacttccacgccggacattggctcttactcagggctgcggtagccgaaggtcccaatgacatcttcttggctgaggattcacaccagcgcatctacggccaacatcatgtgctaagccgttttggtatttccacccgcggtcgggcgtctaagcgactcacccttaactaccgcaccaccgccgaaaacctcagttacgcacttggcatgctcaccggtgaatggaccgacgccgaaggcgaaacggacacaattgagcactatcgctcagcgcgtaagggccccaagccacacctctaccaatttgaatctgagaccgacgagttcgaagcaatcgctgagctcatcaaggtgtggcaggacaggaccaccgatgtacgcatcggcattttggcacgcacccgtcctttgatcaaccgcgtggttaatgcgctctctgagcagggcatcgatgccgtcaagacgcaaaatgccgaacttgcagcccacgaaactgtcagtgtaatgacaatgcacggagctaaaggcatggagtttacccatgtcatcttgatcggaatgggccgtgacctcattcctttgcaatacaccatgcaaggtttaggcgaggccgagcgtaacgacgcccaacagcgcgaacgctccttgctctacgttgcagcttctcgtgcacgtgatgcccttgttctcaccacgcatactgagccttcggagttgctgccgcgggtt

SEQ ID NO: 816 - DNA, 357 bp, Corynebacterium glutamicum
atgagcctggtatcttcgctgcgggtatccggctctgtggaaggtgcggggatagcgagcgattcgcggatatcttcaatgctcaaaccggcgacaaggccgataagtgcgtctttttcccacgtcgggctgctaggaagcgctgctgcgatgtcatcctctgaggcaagttccaacacaatacgggtggcagccgggtcaatgccgagctcggcttccaggacttctggggtgtgccctgcatgtgcgagcgcctcaccagggctgggcagctccactggggtgggtacttcgacggcgtcccggagttgctcctccgcccgctttgcggcctcttccgctttgcgacgagattcc

SEQ ID NO: 817 - DNA, 393 bp, Corynebacterium glutamicum
gtgccctgcatgtgcgagcgcctcaccagggctgggcagctccactggggtgggtacttcgacggcgtcccggagttgctcctccgcccgctttgcggcctcttccgctttgcgacgagattcctgatcgtctttttgcgcaggaacggtagtttcctcgatgagtcgagtaatgccgttaacagagttgacttcaaggcggatttttcctgccttggtgatggcatcatcatggggataaacaccaaccactacaaagtgatgatcaaattcgtcgtgaagctcaaaaagcactgcgcggaattgatcattgacccgacctgtgcggacgcgggagtcgatgctgtttttgatgggctcaatatgaagccccggggaagctggattggtggc

SEQ ID NO: 818 - DNA, 396 bp, Corynebacterium glutamicum
ttggtgtttatccccatgatgatgccatcaccaaggcaggaaaaatccgccttgaagtcaactctgttaacggcattactcgactcatcgaggaaactaccgttcctgcgcaaaaagacgatcaggaatctcgtcgcaaagcggaagaggccgcaaagcgggcggaggagcaactccgggacgccgtcgaagtacccaccccagtggagctgcccagccctggtgaggcgctcgcacatgcagggcacaccccagaagtcctggaagccgagctcggcattgacccggctgccacccgtattgtgttggaacttgcctcagaggatgacatcgcagcagcgcttcctagcagcccgacgtgggaaaaagacgcacttatcggccttgtcgccggtt

SEQ ID NO: 819 - DNA, 825 bp, Corynebacterium glutamicum
atgcactggctgccatggcatttgtgcgcgcggaatacggcaaagttgccgcctggggtgccaagcgcctacctggcgtcgaaacgcatctttgggtgcgcgaggtctcccgcattgaccgcgccctgggggttggggatgaacaatccatgtttcgctggtccgatgatggcccggcagaagatgccaatacccaacaatggttgccggcgtgttattgccgcagttgtggccgttccggctggatggtcagcctggaacaaggcaccaatatcccggtgttggaagaacaaaaaattcgcctcaactcctttgaacaaccccataaacaaagagcgcttctcgacgccacctctgagcagcgcgcagccattgagcaggggcgcagcgttgctgggccgcgaggagttgatggcacctcagcagtgctgtggttccatagcgccagcaatgaactcagcacgcgccaacccagcccagaagaagaacaatcaggttcttctatcgcagtgctcacccactttggccctgaggcagacgatctctccgccaaacagacctgcccttcctgtggtgatgttgattccatccgttatatcggatcgggaatctctaccctgctctctgtctcactctccaatctttttggtatggccgatttggatagcgctgagaaaaagacgctggtctttgccgattccgtgcaagatgccgcgcaccgcgccgggtacgtccaagcacgttcccgcgcttttgcccttcgtacctatacccggcgcgcagtgggtgataatgaagtcaccttgccatcaatctcccgggcgc

SEQ ID NO: 820 - DNA, 6207 bp, Corynebacterium glutamicum
gtggccaccgagctcaagcggttcttgggccacggtgattccggcatgttccacgggccttatgtgcgtgcacgtttgccctatgctcaggcacaggaatgggaaaatgtgctgagttggttacctgagaactttgtgccctatcaccatcaaaaagcggcgtttcagcggctgagttccctcgataaccgaggtaaagatcgccgccccgatcccaccttggtggtaactggaacgggttccggtaagacggaatctttcctctacccgattctggatcatgccctgcgcctgcggaaacgtggccaacaaggcatcaaggcgctgttgctttatcccatgaacgccttggccaatgaccaggcagatcgtttggcgcggctcattcacaataacccagcacttaaaggtgttaccgccggtatttataccggtgaagccaagggcaatcgcacgcagatgggcgaaagggagcttattaatgatccccaagccatgcgggttagtcccccagatattttgctcaccaactacaaaatgttggatcagctcttgctgcgcagcgtcgaccgcgaaatgtggcaaaaatccgccacctctttgcagtatttagtacttgatgagttccacacttatgacggtgctcaaggtacagatgtggcgttgttgttgcggcgtttggggctcatgctgaaatcccagcagcctgctaattttttggatgatagtgccatgcaccggccattgggcattattacgccagtggctacctcagcaaccttgggttctggtgattccggctcccccatgttggattttgcttacaccatttttggtgagcgttttccagctgatgccatcgtcggggaaactcgcctggagctggatcaatggcgcgcagaaattgcccagaattttggtgccccagcagttagcgagccccgtgagctacccactgtggaagatattgaggtggttttagataccatcgccacagctcaacatgaggacgattatgcacagctctgcttccgcgttttttgtgagaaagtgtggctgtgtgaggctgatctgcacgcagcgatcagtgcttatgcggctcatgatttaactgctgcgattttgcagcatgctgctgattccaccccgcttagcaggcgtgatcaagatgaggtcactgcccttccggagctggtattgggggctaccgcccgcatcttaggtgaggttaaagctgcggaatttatcagccatgcactggctgccatggcatttgtgcgcgcggaatacggcaaagttgccgcctggggtgccaagcgcctacctggcgtcgaaacgcatctttgggtgcgcgaggtctcccgcattgaccgcgccctgggggttggggatgaacaatccatgtttcgctggtccgatgatggcccggcagaagatgccaatacccaacaatggttgccggcgtgttattgccgcagttgtggccgttccggctggatggtcagcctggaacaaggcaccaatatcccggtgttggaagaacaaaaaattcgcctcaactcctttgaacaaccccataaacaaagagcgcttctcgacgccacctctgagcagcgcgcagccattgagcaggggcgcagcgttgctgggccgcgaggagttgatggcacctcagcagtgctgtggttccatagcgccagcaatgaactcagcacgcgccaacccagcccagaagaagaacaatcaggttcttctatcgcagtgctcacccactttggccctgaggcagacgatctctccgccaaacagacctgcccttcctgtggtgatgttgattccatccgttatatcggatcgggaatctctaccctgctctctgtctcactctccaatctttttggtatggccgatttggatagcgctgagaaaaagacgctggtctttgccgattccgtgcaagatgccgcgcaccgcgccgggtacgtccaagcacgttcccgcgcttttgcccttcgtacctatacccggcgcgcagtgggtgataatgaagtcaccttgccatcaatctcccgggcgctgatggataacgccacctctgggcgcacccgttatgagctcctaccccctgacctgaccgatcttgatatttacaaaccttattggcaccccgatgccagcaaggctgagcgccgtgaggcctcccgcaatgtgcataaacgtttaagttttgatctcgccctcgagtttggacaacgcgctgatctaccccgttcccttgcgctgaccggcgctttgagtgcttttgtggatttgcccaaaggtgttgcattgtccgcggctgccgaagcactttatgccatcgaagttcccaccttagatattgaggatgagaacctgcgactgcgctgggtgcaaggtgccctggaacttttgcgcgcccgcgggggcatcaaccatgagtggtttggcgcctacctgcgcaccgatggcaacccctatatgcttaaccgccgccaagcccgcgctgagggcattcccggttttgtccgcggtggtgcacctgaattcccacgtgtaggttccgcactttccggatccctgcgttccagcaccggcaccaccccgcttggtagcccgcgcggacgttatgcgtcctggacctcgcaggtgcttggcatcagcacccacgatgccgccaccgccatcacaaagcttttcgacgctttaagcaaccgcagcattctctcctcaatatctaccgacagcggcggaaaaatctactgcctcgaggccgaacgcatccgtatttttagcgaagaccatcccgaagttctggaatgcagcgtgtgccatgcccaaactggtgtaactgatcatgtgcgtgaacttcttgatggcgctccgtgttttagccctagttgtgggggcgttctccataccgaggaagtagaagacaactactaccgcaggctttattccgcaattgaaccgcgcactgtcattgcccgcgagcacaccagcatgctcaagaaaaaagaccgcctcgcactcgaacaatcctttagaggtggagaaggctcggccaaacaatcccccgatgcgcccaatgtgttggtagctacgccaacgctggaaatgggtattgacatcggcgatctctccaccgtgatgcttgcgtctttgccaacatcagtggccagttatgtacagcgtgttggtcgtgccgggcgcctcagcggaaactcgttggtactcgccgtggtgcgtggccgcggtgtcacattgcctcgtcttaaccaaccgctctccatgatcaagggagctattaccccaccagttgcgtatctttccgccagtgaaatcttgcaccgccaattcttggcatatgtgatcgactgcttagatactcgcgccgaactgccaaaactcgaaacagcaattgatgtttttgataatgccgccggaaaaacacctttggttgcattactcaaagcgcagattcacgcaggcctagatcctttgctggaggaatttgtacgcaccctcaacatgcaaatcagcattgataatattttcgaactgcgcacttgggcatctggaaatagcacagactccctcctcgcgctgctggaaacctcccaaaaagagtggatggaagaacgccgcagccttaccgcgcggcggggagaactcgaaaaaatctttgacaaactagatgcgcgcaatgatgcacatgatgaagagctaaaggaagaaaaacgtaaaaccgcagcttcccttaaagccgtcaaacttcaaatccgtgatctacttggtgaattctggatcgctgctttggagcgttatggtctcctgcccaacttcaccctggttgatgattccgtagaacttaatgtggcggttacttcgttcaacccccaggaagtggaatttgataccaagaatcatgcctactcgcgtgggatctctgcagcgctttttgagctcgctcccggtgcgaccttttatgcccaaggaattgctgccaaagttgattccattgagattggtgaacatggctctgccattgagcaatggcggttgtgccccgtgtgctcgcactccgaaatcctccagccgggtgtctctacaccgggatcgtgtcctacctgtggctcccccgcctttgccgataagggacaaatcctagaggtagtgcaaatgcgtaaggtttcctccgcagtggagaaaactcgcgctgccattagcgatgaccgtgaagatcgctttagcacccgctttaaccagcacgtcagctttgtcgttccaccagatggccatggaaaatcctggtatttgaatgatggttttggcattgagcatctgcccaaggtggaattacgctggctgaacttaggaattggcaatggccaaaagcgtcggctcggtggctttgaagtcaccagcccactatttaatgtgtgccgccactgtggacatttagattccgaggcaggagctaactcacgctgggatcaccgaccctggtgcccacaccgttatgagcaaaaagaagataccgtatctttcgctttgggtcgtactcttaaaacccaaggcgtgctcatgctgctgcccgaatattttggcagtgaagccgattctatggtggtaaccagcctcattgctgctatcaaattaggatttcgtgaggtgttgggtggcgatcctgaccacctggatgtcaccagtgtgcaggtcccccgtacttctggcgatggtgcacttgatgcccttttgctgcacgatcaggttccaggaggcacgggttatcttaaccaatttgccgatcctacaaaggttcgtgaacttatttcccgagcttgggagcgggtgtctaggtgccaatgccagtatgatgaaaggctggcctgcccagaatgtttgttgccttatacccgcactgccacgctcctccagacttcccgcgcagctgcagaaaaagccttgcgcgcaattttgctcaatagctcgcgccccgaagaaatcactgacctttctgcagtaccggactggactttcttggaaaagcgcccagagaacactcttggctctcagttggaactgcgtttccgcgtgatgctgcgacgcgccttaaaaaatcgccatgccaaacttgtggaccgcgtcaacggctcaaactcttatgtggatattgagatgagctccggtgtgcgctggcggatgagcgaacaagttgatcgtggatatacacgccctgatttctggtttgaaccgctcaacggcaactatcccaccgtggctgtttttaccgatggcgctgcgttccatatctcttcagctaactaccgtcttgatggcgatattcagaaacggatgaaactagcgctcgatccagacaatattttgccgtggaatatcactagcttagacctcgaccgctttagtaatcccgctgcacaaggtgaggaaccagcatggtttagccccatcggcaggcagctcagcaaagcaaatttgattcttgatccacaatcaactgcactcctggcagcaacgcctatggatcaactcttggcatttttagataatcccgcggcatcctcgtggaaggagtttgctcatatcgctgctgctcacatgcttgggcataatccacaaaaaaatggcgacggaattgttggtaccttccgcaataagatttccttgcgggccaccatggttaatcgggaactgcgcgcccgccaattgtggcttgctcccaccactccagaagagctggaagtggatacctggactgccttcctcaatttggccaacctcatgtggctggcaccggaatccgtagacgtaagcactaatggttcaccgcataaaattgatattgtgcctgctccagcagctccgcttgctgttgaagttcctgaattgtgggctcccatcttggatggctttaccgccgatgaagatgaagaagccgaaggcgctttgcagatcttggctaaggaacatgccctggttccagagaccaccggtgatgagctctcgagtattcctacgattgctacgtggccgagtgtcaagatcgctttgctctatgaatctgatcccgatgagcctttggaggatgatctcaaagctgaaggttggacgctgctttttgcaaatgacctcgagacctccgatattcccgctgcccttcgtccc

SEQ ID NO: 821 - DNA, 4596 bp, Corynebacterium glutamicum
atgagtgcatttgattcgatcctaaatgttgaagagtggatcagtgaccactacctcaccaatgacgatgccaaaggtgcctcattttccaagcgggtgcgcgagcgcattaaagaatggaaaaccaccgaggacgcaacccagcagagtggccctttaactcgtttttccagcaaccgcctgcagttgcagcatgctctttctgagcttgacgacgccaccaccgccgccagtttagtggcctctgcactggggtatggtgtccccagcgcgcgccacgcgcagcgcggctccgacacaatatcctattcctcttgggtgggaaatgccggcagtgtggaatttcttgcagcgactcccgctgaaagctttgaagagaacttccgatcccttccccttgagccagtagcggtcaatgacaagccccaggatatcaccgcagccaaattggtgggccagattttccttagtgatactccccctgcttttgttgttatcaccgctggtaaatgggtggttttagccgagcgtgaaacctggcctctaggccgccacctagctattgatatttccctggtggtggaacgtaatgacaccaaagcccagggtgagatgcagcagacggtcgtagcactagcccgcgaaaataccgagcgtgccgccgatggcaccacctggtgggaagaaaccattgagcaatcccgcgaacatgctgtcaaggtttctggcgagctacgcagtgcggtgcgtgaatccattgaaatcctgggcaatgacgtgctcacacgctatgaagctaaagagctctccaccgctgagatcgacggtggcgagctagctaagcaatctttgcgctatctctaccgcattttgttcctgctttttgccgaggcttcaccagagcttgaaatcctgccaaccggcaccccggaatatgacgagggttatggcttggcacgcctgcgcgagcttattcttaatcccccagttacccagcatgctcgcacgggcacccacctttatgattccctgcagctgctgttcactctggtggataaaggccaccacccaacagatgctaaggctgtagcttttgatgccgaggctggagaagaaggcctgcacttccgcaacctttcagcggatctcttcctccctgcagccacagaacttattgatcgagttggtctttccaatgaagccctaaacaaggtcttggaaaacctcctgctctcccgggtgcaatccggtaaagaccgcggctttatctcctatgccaccttgggtgttaccgagcttggccaagtttatgagggtctgatgtcctataccggctttatcgcccaggaagatctttttgaggttgcaccacatggcaaagccgataaaggttcctggatgctcccggtctcaaaggctgatgaagtccctgccgatagctttatcgaagttgatcaagaagcccctggtggcggcgtaatcaaggtgcgtaaacgccacccgcgcggatcatttgtgttccgtcagtcctctcgtgaccgcgaacgctcagcgtccttctacaccccacaagtactcaccagctttactgtcacccaggctattgaagaactccaggcatcaaagcgcatcaccacagccaatgatgttctcagcctcaccatctgtgaacctgccatgggttccggcgccttcgctgtggaagcagtacgccaattagcagagctttatttggaattgcgccaagaagaactagagcagcagattccagcggaagaccgtgccaaggaactccaaaaggtcaaagcgcacattgcgctgcaccaggtttatggtgtggaccttaacagcactgctgtggagttggcggaaatctcgctgtggctagacaccatgaatgcagaaatggacgcaccttggtatggcctgcacctgcgtaatggtaactccctcgttggtgccacccgttcgctgtatgcacctagtctgcttaataaaaaagcctggttaactgctactccaacccgctatcggcttgatgatatcgcgcaggctattgatgaaaacaaagcagaacccctcttcaaccacggcatccaccacttcctcttgccctctactggctggggagccactgcagatgccaaagatcttaaagatcttatggctactgaaatcaaggagcttaaatcttggcgtacttccatccgtgcgtctttgagtaaaactcagattaagcagctcaataaccttgccctacgcgtggaaacactatggcgatttgtgctgatgcgtattcgcattgcagaatcccagatctcacgtagcactactctctggggtcaagagccagctgaggtttcggaggttgtcacacgtgagcaaattgaacaagacctctttggcaatattgatggtgcatataaccgtctacgcttggtgatggatgcttggtgtgcgctgtggttctggcctttggatgctgttgctaccgctgagcatccggagcgtccagcccttccagatcttgatgagtggctagccaccctgacggagattctgggtattgatctccctctgaagtccaaaaacgaaaatcagattgtcttaggtccagataccaattggctagccattaatgatgccgaggctactgatcttggtttttctggggcattgagctttgagcgtgttagcgcgaatcacccgtggatcaatgttgcccgccaagtggctaaacaacagagcttcttccactgggatctagacttcgcccacgtttttgccaagggtggatttgatctgcaggttggtaatccaccatgggtgcgaccagatgtgaactttgaggatctgcttgctgaacatgatccgtggtgggctgtaatgagtaaaccaacccaggcatccaaaaaagaacgccagaagaattttcacaacaatcctaagagcctcgaacatgtggtcagtggtgcaggtgaaaccgtggctacttctgcgatcctcggttcggttactctctatccgcatcttaaagatcaacgcccggacctctaccggggctttatggaaaagacttggtctaatgcctccccggcaggtgcgatctcactgatccaccccgaatcccacttcactgagaaaaaagctgccccgctacgtcggggagcatatgagcgtctgcgccgccactggcagttcattaatgagttgattctttttgacgtccacgacttggttaaatatggcgtacatgtctatggcgctccgcaggaatctattaactttttaagtgctgcgtcgctttatcacccacaaacagtgcttgattcacttgatcatgacggttcaggtaatctccctggtcttaaagacgacaatggcaactgggaccgtcgcccacacaaggaccgtatccaactggtcaatgccgatactttgacggtgtggaagtccatcctggaggatgaacaaacgccatacttggatacccgcatggtttataccgtcaacacggaagcagcagcagtgttggaaaagttggcttctgcacctcgtatcaaagaactcgggctgcagttctccagtggctggaatgaaaccaccgataagaaaaagggatactttgacgttggttggggctacccagcttcctggtctgatgccattttgcaggggccgcacctgggtgttgctacaccaatgatcaagcagcccaatccgacaatgaagcataatcaagattggtctgaaattgatttcgaggccattcctgcaaacttcatacctgcaacggcgtaccagcccgatcgccaaacaaagcccacttatgatgctgactacggcacctggactttcggggacaagcaggtaccagttgcagacactttccgaattgcatggagggagatggctgccaccacgggatttaggactgtctacccatcagtaattccaccgggagccaaccatgtgcacacagttaatagcgctgcatcacgttcaaacttaaaaaccattctcgttggagcacagcttggtgcaattctaagtgactattttgctcggtcctcgggttcaagccacatatttaacgacattgttcgcaagattccacttccaaatttcacatccttggaaaagcagttcgcccgcacatacctccgcctcaactgcctgacctcagcttatgccccattgtgggaagagatcaccggtgagccgtgggatgttcaggtgcctttgcgcaatgccgagcaacgtcgagcagcgcaaaacgatattgatgccatggtggcattgtctttgggtattagtgctgatgagctgtgcatgatttatcgcactcaattcccagtgatgcgtagatatgatcaagaagatcattttgatgccaatggccgtaaagttcctaaagagatcatcaagctgcagcagaaacttaaagatggccaagagctcagcgtggaaaagcgcacctgggtgcatccccaatcagaagtgtcctatacctttgaatatcctttccgggtgttggatcgtgaagctgatctgcgtgctgcatatgcaaaatttgaaaaccagctaaaggagcca

SEQ ID NO: 822 - DNA, 2886 bp, Corynebacterium glutamicum
atgtctgaatcaggtgcgctaagttctactgactctctatccccgggtgtcaccattgaagtccgagatgaaatttggctggttactcacgttactcgctccacagatggttttagggttaaagctcgtggtctctctgattatgtgcgggaccacgaagctacgttcttcaccgcacttgataaagatttgaaggtcattgaccctacccaggtcaccgtcagtcttgatgattcctccaattaccgtcgcacccgcctgtggttggaggccaccatgcgtaaaactccggtaccgctctatcaagagtcactttccgtggcagatcaaatgctcgccgatccactggagtaccaattagcagccgtgcgcaaaaccctctctagtgctaacttgcgcccccgcgtgcttattgctgatgccgtgggacttggcaaaaccctagaaatgggcatgatcttggcggaacttatccgccgtggccgtggtgagcgcattttggtagtcaccccgcgccacattatggagcagttccagcaggaaatgtggacccgttttgccatcccgctcgttcgtctagattccgtgggcatccagcaagtgcgccaaaaattgccagcatcacgcaacccttttacttatttcccgcgcgtgattgtctctatggatactttgaaatctccgaagtaccgcgcgcaactagaaaaggtgcactgggatgcggtggttatagatgaaatccacaatgcaaccaatgctggcacccaaaataatgagctagcccgcacacttgcgcctactgccgaggctcttattttggcctctgccaccccgcacaatggtgatccagaatcctttaaggagatcttgcgtttgcttgatcccaccgctgtgatgcctgatggcaccattgatgccgaagctgcacagcgtctgatcattcgtcgccatcgcaatagccctgaggtttcaggttttgtgggcgaaaaatgggctccacgcaatgagcctcagaacttcctggtcgctgcgtcaaaagaagaaaacggcgttgctgcagaactcaaccatgtgtggatttcaccaggtgcgagcaatccgatcaaggatcgcctcttcccctggacattggtgaaggcttttctctcctcccctgcagccttgggcgaaacagtgtccaatcgcctcaaaaaggcctctgcaccagaagaaaaacgcgccctagaaaccctttcacaacttaattctgcgatcaccccgcagacctcacagaagtaccaatctctactgagctacctcggtgacatcggagtgaagaagaactccgatacccgcgtggtgattttctctgagcgtgtcgctactttgcactggctgcaggaaaacctcatccgtgatctcaagatgccacccaactctattgctgttatgcacggcggtctccccgaccaggagcaaatgcgcctggtggatgagtttaaaaagacggattctcccatccgcatcatgatcaccggcgatgttgcctcagaaggtgtgaacctgcatactctctgccacaacttggtgcactatgacatcccgtggtcactgatccgcattcagcagcgcaatggccgtattgatcgttatggtcaaacccacaacccttccatcgttaccttcttgctcgatcccgccgaggattccaaagtaggtgaagtccatgtgctggagaggctcatggagcgcgaacatgaggcgcactctttgctcggtgatgccgcatctctcatgggcaagcactctgagcgtttggaagaagaaaccatccgcgaagtcctgcgcggtgcccaaaactttaatgatgcagtggctgatccagcggaagtcctagaaaacccagcaggcctagatgatattgattggttgctagcccaaatcgcccaagccgatgccaaggcagaaacagaagcagaagcagaaacagaaaaccaaacagcaccagatgcagcttccaatagcacgcagcatgcacaacgccggttgtatgcacaggaaagctctttcctctatgactgcctcctcgaaggtttcaataacgtaccggaggattccatcaaccgcggtggcgtggggttcaaaaaacacgataatgacatcgtggagctcacccccaccgatgatctgcgccgtcgtctagatttcctcccgcaggattatgtggctgcccggaaagttaaggaagatctcctactagcttccacactgatgcgtggccaagaacgcctcaacgctgcgcgcactggtgaagatggcagtacctggccaagtgcccactatctaggccccctgcacccagtcacttcgtgggcagctgaccgcgcgctggcaaccatgccacgttcggaaattccggcggctagtggcaaagtcacagagccaacggtgctgcttatgtccacattgagcaatcggcgtggccaaattgtgtctcgttcttttgtggcttcttctggcccctttgatactgaggtgctgtccgatcccatccaatggttacattccataggcctcgatgaaaccgccattaacccaggtaccgctgcactccccgacgatattgagcagcttatttcccttgctgttcaggccgcccgcggcgagatccgtccattaatgatcgccgcccgcgctcaggctcaaactcgcgttgagcattgggctaagcgagccgaagcctggaataacaaacgaagtggcgcagcgtccacgtcccgtaccgcgcgaactgcaaaattgattgaggagcagcagaaattgagtaatgctctcgagccagaccgtgaacttattaggcctttggccgtcattcttccgcagcccgcaactttgaacaccgaggtt

SEQ ID NO: 823 - DNA, 1554 bp, Corynebacterium glutamicum
gtgactgaaaagtatcgtcccgtccgtgacattaagcctgctccggcagcaatgcaatcaactaaacaagcgggccatcctgtgttccgaagcgttgtcgcttttgtttcagtgctggtgttgttggtatcgggtttggggtatcttgctgtcggaaaagtggatggtgtcgcttctggcaacttgaaccttggtggcggtcgcggcatccaggacggcaatgctgctgacggtgctaccgatattttgttggtgggttctgattcccgttccgatgctcagggcaacacgctgactgaggaggagctggcgatgctccgcgcaggcgacgaggagaacgacaacaccgatacgatcatggtgattcgtgttcctaacgatggttcctctgccaccgctgtgtcgattcctcgcgatacctatattcatgatgacgattacggcaacatgaagatcaacggcgtttacggtgcgtacaaggatgcccgtcgcgctgagctcatggaacagggtttcaccaatgagtcagagctggaaacccgggcgaaggatgctggccgagaaggtttgatcgatgctgtgtcagatctcaccggcatcaccgtcgatcactacgccgaagttggccttttgggattcgtcctgctcaccgatgctgtcggtggtgtcgaagtctgcctcaacaacgccgtcgatgagcctttatccggcgccaacttccctgcaggccgtcaaaccctcggtggctccgatgcgttgtcttatgtgcgccagcgccacgatctcccccgcggcgacctcgaccgcatcgtccgccagcagtcgtatatggcatcgcttgttaatcaggtgctgtcttctggaacactcaccaaccctgcaaagctttccgcacttgctgatgccgtcacccgctccgtcgtcatcgacgaaggctgggagatcatgagctttgccactcagctgcagaacctcgcgggcggcaacgtcacatttgccaccatcccggttacctctatcgacggcaccggcgattacggcgagtccgttgtcaccatcgatgtcaaccaggtgcatgcattcttccaagaagcactcggcgaagcagagccagctccagaagacggctccgacgatcaatctgctgatcaggcccctgacctaagcgaagtcgaggtccacgtcctcaacgcttcctacgtcgaaggcctcgccaacggtatcgccgcgcaactgcaggaattgggttactccatcgcagagaccggcaacgcagcggaaggcctctactacgagtcccagatcctcgccgccgaagaagacagcgccaaggccctcgcgatttccgaagccctcggcggcctccccatcgtggccaactcttccctcgacgacaacaccgtcatcgtcgtatccgccggcgattacgctggccctaccgcggaagcaaacgccgtgacatccagcaccgtcggccagcccggtgcggacgtcggtgaaccgattgaaagccccgagttcgatgctggtggcgacggtccccgttgcgttaac

SEQ ID NO: 824 - DNA, 897 bp, Corynebacterium glutamicum
gtgagtactttgaaatcccccatcgctgtgatcacagtgacctattcaccaggtaaatacttggcgtcgttcctggattctttgcctggtgcgacttcacgagacacccacgttgtgatggcagacaatggttctgtggacggtgttcctgagcaggcagcagcctcacgcagcaacgtggagttcctctcaactggcggcaacttaggctacggaacggctattaatattgccgcccgatcgttgcgtgcgcgccgggaggcaggagagatcgatggggagttcttcctcgtctcaaaccctgatgttgtttttgacgaagactctattgatcaattgcttgaatgtgcgaaacgtcaccctgaagcaggagcggttggcccgttgatccgtgaggcggacggttcggcgtatccgtcggctcgggcggtacccactttggcgaatggcattggtcacgctttgttgggtgctgtgtggaaatccaatccgtggtcggcggcttaccgtgacgatgaagatatggacactgagcgcactgctggctggctgtcgggatcgtgcctgttattaaggtgggatgcgtttgatcgagttggtggttttgatgagcgctacttcatgtacatggaagacgttgacctgggagatcggctggttcgcgccggtttcaccaacgtcttttgcccaagtgcgcagatcatccacgcgaaaggtcatgttgcgggtaaaaacccagagaacatgttgcccgcacaccacgagagcgcgtatcgcttccaggctgatcgcctcgcgaagccgtggcaagccccaattcggttggctctgcgaattggtttgaaattacgagccggagtcgcggttggtgtctctaagatgagaacgaaagcctct

SEQ ID NO: 825 - DNA, 1044 bp, Corynebacterium glutamicum
ttggtcggtggcaaaggtacccgactgcgccccctgaccgtcaatactccaaagccaatgctgccaactgctggccacccattcttgacccaccttttggcccgcatcaaggccgcaggcatcacacacgtcgtgctgggaacgtcattcaaagctgaagtcttcgaggaatacttcggagatggctccgaaatgggcttggaaattgaatatgtcgtcgaggatcagcctttgggcactggtggtggcatccgaaacgtctacgacaagctgcgtcacgatactgcgattgtgttcaacggcgatgtgctctccggtgcggatctcaacagcattctggacacccaccgcgaaaaggacgcagatctgaccatgcatctcgtgcgcgtagctaaccctcgtgcgtttggttgcgtccccaccgatgaggatggtcgcgtcagcgaattccttgaaaagaccgaagatccaccaaccgatcagatcaacgccggctgctacgtgttcaagaaggaactcatcgagcagatcccggcaggccgagcagtttccgtcgagcgcgaaaccttccctcagctgttggaagaaggcaagcgagtcttcggccacgtcgacgcttcctactggcgcgacatgggcaccccaagcgacttcgtccgcggctcggctgacctggtccgcggcattgcgtactccccattgctcgaaggcaaaacaggagagtcgcttgtcgacgcctccgccggcgttcgcgacggcgtcctgctgctcggcggaaccgtagtcggccgcggcactgagatcggtgccggctgccgcgttgacaacactgttattttcgacggcgtcaccattgaaccaggtgcggtcattgaaaattccatcatttcctcgggagcacgcatcggtgctaatgcgcacatctccggttgcatcattggcgagggcgcacaggttggtgctcggtgtgaactcaacgcagggatgcgcgtcttcccaggcgttgtgatcccagacagcggaattcgtttttcgtctgatcag

SEQ ID NO: 826 - DNA, 408 bp, Corynebacterium glutamicum
ttgggagaaggaaaaattttccaaacctgctcggggaccaacatccccgatgagaacagacttaaagtagctttgaaagtgagaggggggcgagtaatggaagattcagctggggacgtatctgcaaagttgaaagcaggccagactcgcaccgcactggagatgactttggatgatctgttcggagcggttgagcaagaatggcaggagcaggcgctgtgtgcgcaaactgatcctgaagcattctttccagaaaaaggtggctcaactcgcgaagccaagcggatctgccagggctgcccggttcgggatgaatgcctagagtttgctcttgagcatgatgaacgctttggaatttggggtggtctctctgaacgtgagcgccgccgcctgaaacgcgaaatttcg

SEQ ID NO: 827 - DNA, 456 bp, Corynebacterium glutamicum
atgcatacgagaactttccgcaatcggcacggacgcggtctccgcggcccactcatgcccgtcgaagttccccgccacgcctctagacgccaagccttcgaccgcgcagtcttagaggcctactcccctctttacgggatttaccaaaaagagctcagcaatctagacatcgctgtcgataccgttcctcgcatgcgactcagcgccgaccttgccattctccccgatgaaatcaccgccgacggccccgttccacttggtcgcgtcatcccaccggcgatcgataccaagggaaaccccacgagagcgcgcatcgttattttcagaatgccgatcgagcaacgagtcaccaacgctgtggaacgccacgagctattgactcatgttctcacctctttggtggcgaactatctgaatattgatccacgagacatcgatccgggattccaggatctc

SEQ ID NO: 828 - DNA, 390 bp, Corynebacterium glutamicum
gtgagtcagtttcgtcgttgttcccgccctggttgtggcaagcctgccgtcgcaaccctcacctacgcatattcggattccactgcggtggttggtcctttggcgcctgcagcagagccccatagttgggatctgtgtgagcatcatgccgagcgtattactgcgccccttggttgggagatgctgcgggtgaacgacatcaaagtcgatgacgatgaggatctgacggctcttgctcaggctgttcgtgaggctggacgcactgtgagtggtctggttcctgaagacgaagtgggcggcaaccatccggtgaaccggagtgcgcggatcgcggaacagaaggttcaccgcaggggtcatctctatgttgtgcctgatcaggacgaatca

SEQ ID NO: 829 - DNA, 1374 bp, Corynebacterium glutamicum
atgcgtacccgtgaatctgtcacagctgtaattaaggcgtatgacgtccgtggtgttgttggtgtcgatattgatgctgatttcatttctgagactggcgctgcctttggtcggctcatgcgtagtgagggtgaaaccaccgttgctattggccatgacatgcgtgattcctcccctgaattggccaaggcgtttgccgatggcgtgactgcacagggtttggatgttgttcatttgggactgacttctactgatgagctgtactttgcgtccggaaccttgaagtgtgctggtgcgatgtttactgcgtcgcataaccccgctgagtacaacggcatcaagttgtgtcgtgcgggtgctcgtccggtcggtcaggattctggtttggccaacatcattgatgatctggttgagggtgttccagcgtttgatggtgagtcaggttcggtttctgagcaggatttgctgagcgcatatgccgagtacctcaatgagcttgttgatctgaagaacatccgcccgttgaaggttgctgtggatgcggcaaacggcatgggtgggttcactgtccctgaggtattcaagggtctgccacttgatgttgcgccactgtattttgagcttgacggcaatttccccaaccatgaggccaatcctctggagcctgccaacctggttgatttgcagaagtttaccgtagagaccggatctgatatcggtttggcgttcgacggcgatgcggatcgttgcttcgtggtcgatgagaagggccagccagtcagcccttcggcgatctgtgcgatcgtagcggagcgttacttggagaagcttccgggttccaccatcatccacaacctgattacctctaaggctgtgcctgaggtgattgctgaaaacggtggcactgcggtgcgtactcgcgtgggtcactccttcatcaaggcgaagatggcagagaccggtgcggcctttggtggcgagcactctgcgcactactacttcactgagttcttcaatgcggactccggcattttggctgcgatgcacgtgctggctgcgctgggaagccaggaccagccactcagtgagatgatggctaggtataaccggtacgttgcttcaggcgagttgaactcccgtttggctaatgcagaggcgcagcaagagcgcacccaggctgtgctcgatgcgttcgctgatcgcaccgagtccgtggacacccttgacggcgtgactgtggaactcaaggacacctccgcgtggttcaacgtgcgtgcgtccaacaccgagccgctgcttcgcctcaatgttgaagctgcatcgaaggaagaagtcgatgcgttggtagcggagattctagggattatccgcgca

SEQ ID NO: 830 - DNA, 1005 bp, Corynebacterium glutamicum
gtggtgcaagtggacaataccttttatgacggttctgcttatgatcctgaaaccgtccgattttttgatgtggcgcaggagggggcccaggttcgccagatcggtggcctcgtggcgcagggcgcgttgagtgcgttcgaggggttgcggccacgtagcgtggtggtgatgctcgacggccagattcaccgcagttgtgtgcgattggtggaaaccttgcattccccgatgcgccagccgctggttattacctccacgctgccacattacatcggtgcgctcgacgtgctgattgtcatcaccgacaacggtgcagatgaaaaagcgctcaaggcactcatcacggcgtcgcagcggggcgtggccacgctgctcattggccctagttcgggcccgcttatcgacgaatccccccaggacaccttcgtccttcccaccttgcccacggccgcaggcttgtcgcctgcccgcatcgtggcgtcgataagcactcttttagatcttttagaagcagaccccagcattatttccgaccgcttggaacacctcgccgactgcattgatgaggaagtggaatcgctatcgccggaacgtgacgaactagtcaatcccggccgaaaactgcgcgcatacgtagatcacgcacggatcgtgcataccggccgaactgatgtgggactcgcgattgccaacgttatcgccccaatctggacccgacgaggcctggtatcagccgtgctggattttcccgagctcatggaatcattgccggaactccgcggacccgagccaattaccgacgatatattccatgacccattcatagatgacgaacccggggtggtaccgtttagggctgttgtctgggccgaagaggaacccggaatccccgatgccatggcgcaaagctgcgacggacctagcaaaggggcgctgacacaagcactgcgtttgctggtgcgcggacagtcagccacgacctattccattgaagaaaaggacttg

SEQ ID NO: 831 - DNA, 1182 bp, Corynebacterium glutamicum
atggagctattggaaggctcactgcgcacctacccatggggttcaagaacactgatcgctgatctcaaaggcgaagaatcaccatcgtctcgcccagaggccgaagtctggttcggtgcccacccaggatcaccatcaaccatcggtggaaacgcactcaacgaagtcatcgcagcgaaccccgaagaagcattgggcacgcgtgttgccgaagcgtttgaaaatgagcttccattcctcctcaaaatcctcgcagcgggagcacccctatcactgcaggcccacccatcgctggaacaggcccgtgaaggattcgcccgcgaaaactcagcaggaattgacctcggcgcaccgaaccgcaactaccgcgacccaaaccacaagccagagctgatcgttgctctcacggaattcatcgcgatggcaggcttccgcccactgcggaacaccctcaccattttcgacgccctcgcctgcgaacccctcgaccgctaccgcagcatgctcaccgtcgacaacgaggaagaatccctccgcgcactgtttaccacctggatcaccatccccatcggtaaacgacacgaactcatcgatgccctcatcagcaacgcccacacctaccttgaggcaagcgatcgtgacgaggacatcgcattcgtgctctcacacatcatcgagctcaacgaacagtaccccggcgatgtcggcgttctgggtgctctgctgttgaacttctacaaacttgccccaggcgaagccctctacctcgacgccgcaaaccttcacgcatacatcagcggcctcggcgtagagatcatggcgaactccgacaacgtgctccgcggtggactgacatccaaatacgtcgacgtcccggagcttgtgcgcgtgttggatttcaactctttggaaaacgctcgcgtggacgttgaagaagacggtgcaacgacccactacccagttccaatcaacgaattccaactcgatcgcgttgcagttcagggcgaagcagaagccaaccacgatggtcccatgattgttctgtgcacctccggaactgtttccttggaagcaggggagaagaccctcgaagtagcagcaggtcacgccgcatgggttccagcaaacgacccaaccattgcgatgcgttctgaggacgcagaagtattcctcgctagggtt

SEQ ID NO: 832 - DNA, 150 bp, Corynebacterium glutamicum
ttggctgacggggcgtgtctgctgccgtcaaaatctggattcggttggggagcctctgcacaaccgtcctatatggccaaaactaaaaagctcgaggcttttggtcacctagtttggtctggctcaaaacttgcatctgtacccaaatat

SEQ ID NO: 833 - DNA, 360 bp, Corynebacterium glutamicum
gtggtagttggagaactgccagaaggggttaaaccggagcttcggccattgtctggacgcacaaaagcattcggtggaagatatggatcttcggtgttgatgggcgccaaagtttggttttctaggtcaggttccgcctctttggtctctgtattacctggggaatcgtacctagcctgggtttgggtggtagacgtagtagtagacgtggcaatatcagaggtgggtcggcttgggctggacatctgccagaccataaaacccagggcggtggcggctaaacagccggcgacgatgaagacgagggctcgtcgagtttctgttttcatcgtggttcacctccgaagtgcagtagttgtc

SEQ ID NO: 834 - DNA, 564 bp, Corynebacterium glutamicum
ttggcgcccatcaacaccgaagatccatatcttccaccgaatgcttttgtgcgtccagacaatggccgaagctccggtttaaccccttctggcagttctccaactaccacctctcgggtgagttctccctcctcagcaggatcggcaagcccgactcaaatcacctccaggtcaaacgagcctagtgaacctggtgatgagtcaactgctgctacacaaccgtcgagcccagacaggccaaccgaacctacaaatccggtagacccaactggaccttctgaacctacggaacccaccgatccgattgagacaaccgatccgattgagacaaccgatccggtagctccgtccaccccgccaacgagcgatgattcaacaagcactccccaaccagatgagtctgatacgccacctaccgatttcgtagaggaacctactgctcctctcaatccggatcagccagccggttcaactactgatgcgacgccaaacgcaacaccaagcgcaccagctgacacaacatccaattctgtagctaactctgtggaaccaactgccacgagc

SEQ ID NO: 835 - DNA, 351 bp, Corynebacterium glutamicum
atgggtgcatgggacgatgcaatcttgactgaggaagtcaacgttgattttctcgacgagatctcagaattagatactcaagacattcttgaggcgttggaagacgcatgtttgctggtggttaaccaggacaacgccactgaagacgaacacctcaacggtcaggcggctgcgacgatcgcggccatcatgtttggcgctccatattctgcgggccaggtgctggagaattacccatttatccgcgaactcgtcggtgagggctctgaagctcttcgcggtgctgcagcgcaggttttggaagaggcagatgtggaatatgacctcgaagcttatttagaggccctcaac

SEQ ID NO: 836 - DNA, 1422 bp, Corynebacterium glutamicum
atggacttcaaggttgccgatctttcactagcagaggcaggacgtcaccagattcgtcttgcagagtatgagatgccaggtctcatgcagttgcgcaaggaattcgcagacgagcagcctttgaagggcgcccgaattgctggttctatccacatgacggtccagaccgccgtgcttattgagaccctcactgctttgggcgctgaggttcgttgggcttcctgcaacattttctccacccaggatgaggctgcagcggctatcgttgtcggctccggcaccgtcgaagagccagctggtgttccagtattcgcgtggaagggtgagtcactggaggagtactggtggtgcatcaaccagatcttcagctggggcgatgagctgccaaacatgatcctcgacgacggcggtgacgccaccatggctgttattcgcggtcgcgaatacgagcaggctggtctggttccaccagcagaggccaacgattccgatgagtacatcgcattcttgggcatgctgcgtgaggttcttgctgcagagcctggcaagtggggcaagatcgctgaggccgttaagggtgtcaccgaggaaaccaccaccggtgtgcaccgcctgtaccacttcgctgaagaaggcgtgctgcctttcccagcgatgaacgtcaacgacgctgtcaccaagtccaagtttgataacaagtacggcacccgccactccctgatcgacggcatcaaccgcgccactgacatgctcatgggcggcaagaacgtgcttgtctgcggttacggcgatgtcggcaagggctgcgctgaggctttcgacggccagggcgctcgcgtcaaggtcaccgaagctgacccaatcaacgctcttcaggctctgatggatggctactctgtggtcaccgttgatgaggccatcgaggacgccgacatcgtgatcaccgcgaccggcaacaaggacatcatttccttcgagcagatgctcaagatgaaggatcacgctctgctgggcaacatcggtcactttgataatgagatcgatatgcattccctgttgcaccgcgacgacgtcacccgcaccacgatcaagccacaggtcgacgagttcaccttctccaccggtcgctccatcatcgtcctgtccgaaggtcgcctgttgaaccttggcaacgccaccggacacccatcatttgtcatgtccaactctttcgccgatcagaccattgcgcagatcgaactgttccaaaacgaaggacagtacgagaacgaggtctaccgtctgcctaaggttctcgacgaaaaggtggcacgcatccacgttgaggctctcggcggtcagctcaccgaactgaccaaggagcaggctgagtacatcggcgttgacgttgcaggcccattcaagccggagcactaccgctac

SEQ ID NO: 837 - DNA, 708 bp, Corynebacterium glutamicum
atgagcatgtcagtggcgcggttgatgccgtcgatcagggagtggcgggtgccgtacttgttatcaaacttggacttggtgacagcgtcgttgacgttcatcgctgggaaaggcagcacgccttcttcagcgaagtggtacaggcggtgcacaccggtggtggtttcctcggtgacacccttaacggcctcagcgatcttgccccacttgccaggctctgcagcaagaacctcacgcagcatgcccaagaatgcgatgtactcatcggaatcgttggcctctgctggtggaaccagaccagcctgctcgtattcgcgaccgcgaataacagccatggtggcgtcaccgccgtcgtcgaggatcatgtttggcagctcatcgccccagctgaagatctggttgatgcaccaccagtactcctccagtgactcacccttccacgcgaatactggaacaccagctggctcttcgacggtgccggagccgacaacgatagccgctgcagcctcatcctgggtggagaaaatgttgcaggaagcccaacgaacctcagcgcccaaagcagtgagggtctcaataagcacggcggtctggaccgtcatgtggatagaaccagcaattcgggcgcccttcaaaggctgctcgtctgcgaattccttgcgcaactgcatgagacctggcatctcatactctgcaagacgaatctgg

SEQ ID NO: 838 - DNA, 720 bp, Corynebacterium glutamicum
atgcatatcgatctcattatcaaagtgaccgatgttgcccagcagagcgtgatccttcatcttgagcatctgctcgaaggaaatgatgtccttgttgccggtcgcggtgatcacgatgtcggcgtcctcgatggcctcatcaacggtgaccacagagtagccatccatcagagcctgaagagcgttgattgggtcagcttcggtgaccttgacgcgagcgccctggccgtcgaaagcctcagcgcagcccttgccgacatcgccgtaaccgcagacaagcacgttcttgccgcccatgagcatgtcagtggcgcggttgatgccgtcgatcagggagtggcgggtgccgtacttgttatcaaacttggacttggtgacagcgtcgttgacgttcatcgctgggaaaggcagcacgccttcttcagcgaagtggtacaggcggtgcacaccggtggtggtttcctcggtgacacccttaacggcctcagcgatcttgccccacttgccaggctctgcagcaagaacctcacgcagcatgcccaagaatgcgatgtactcatcggaatcgttggcctctgctggtggaaccagaccagcctgctcgtattcgcgaccgcgaataacagccatggtggcgtcaccgccgtcgtcgaggatcatgtttggcagctcatcgccccagctgaagatctggttgatgcaccaccagtactcctccag

SEQ ID NO: 839 - DNA, 609 bp, Corynebacterium glutamicum
atgattgtcagcattgagggaatcgacggcgccggcaaaaacaccctggtttcggcattaacgcaggttattgatgcaaaagtccttgcattcccacgttatgaaacctcgattcacgcccaattggccgcggaagcactccacggccgcatgggcgacctcaccgacagcgcctacgccatggccacgcttttcgccctcgaccgccacttcgcgattgatgacttaaatgcgcccggcgtggtgctgctcgaccgatacgtcgcctccaacgcggcttataccgccgccagattgcttgacgacgacgccccccgctgggttgccgacctggaattcgggcggcttgggctcccacgtccgacgcttcaagtgttgttggatacccccgcggaggtagcgcaagatagggctagacgtcgagaagcgcttgactccgcgcgtgcgcgggaccgctatgaatcggattcggcgctgcagcaacgcaccgccgagcactatcgccgcctcgcggcggacaactgggaatcaccgtggatcgtggttgcccctgatgaagaccccggccacgttgcgcagagaatcgtggaattcctgggtactataaac

SEQ ID NO: 840 - DNA, 678 bp, Corynebacterium glutamicum
atgtcacagaaaattctcgtggttgatgatgatcccgccatctccgagatgctcaccatcgtgctcagcgcagaaggctttgacaccgtagctgtcaccgacggcgcactcgccgtggaaaccgcctcccgggaacaaccggatctgattttgctcgacttgatgcttccaggcatgaacggcatcgacatttgtcgcctcatccgccaagaatcctccgtacccatcatcatgctcaccgccaaaaccgacaccgttgatgtggtgctcggtttggaatccggtgcagacgattacgtgaacaagcctttcaaagcgaaagaacttgtcgcccgcatccgtgcccgcctccgcgcaaccgtggacgagcccagcgaaatcatcgaagtcggcgatctgtccatcgacgtcccagcacacaccgtcaaacgaaacggcgctgagatttccttgaccccactcgaattcgacctcctgctggaactcgcccgcaaaccacagcaagtattcacccgtgaagaattgctgggcaaagtgtggggctaccgccacgcatccgacactcgactggtcaacgttcacgttcagcgtctgcgcgccaagattgaaaaagatccagaaaatccgcagatcgtcctcaccgtccgcggtgttggctacaaaactggccacaacgat

SEQ ID NO: 841 - DNA, 684 bp, Corynebacterium glutamicum
atgaaaaacttaatcgttgtggccagttttgtagccaacaccgcggacggtgaggacgatctgcggattttctggatctttttcaatcttggcgcgcagacgctgaacgtgaacgttgaccagtcgagtgtcggatgcgtggcggtagccccacactttgcccagcaattcttcacgggtgaatacttgctgtggtttgcgggcgagttccagcaggaggtcgaattcgagtggggtcaaggaaatctcagcgccgtttcgtttgacggtgtgtgctgggacgtcgatggacagatcgccgacttcgatgatttcgctgggctcgtccacggttgcgcggaggcgggcacggatgcgggcgacaagttctttcgctttgaaaggcttgttcacgtaatcgtctgcaccggattccaaaccgagcaccacatcaacggtgtcggttttggcggtgagcatgatgatgggtacggaggattcttggcggatgaggcgacaaatgtcgatgccgttcatgcctggaagcatcaagtcgagcaaaatcagatccggttgttcccgggaggcggtttccacggcgagtgcgccgtcggtgacagctacggtgtcaaagccttctgcgctgagcacgatggtgagcatctcggagatggcgggatcatcatcaaccacgagaattttctg

SEQ ID NO: 842 - DNA, 1497 bp, Corynebacterium glutamicum
gtgctcggctccatcttcaccgcatcagctgtcgtgatgatccttttggggctgggcatgctgactgtattcacccaacggttggtggatcagaaaatcgatattgcgagctccgaaatcgaccgcgcccgcgtcatcgtcgaagagcaaatcaccgcatccggcgcctcaacatcggtgcaggcgcgagtgaactctgcccgcgctgcgctctccagcttgggtaccagcggcggtacagaaaccaacgccgcctacgatccagtcgtgttggtgaacaacgatgacctggtggtctctcccgagggttaccaaatcccagaacgtctgcgatacttcgtctctgagaaccaagtctcgtatcagttctccagcatcgaccaaggcgacggatcgtcctaccaagcgctcatcatcggaacgcccacggaaagcgacatcccgaacctccaggtgtatctggtgttctccatggaaagcgacgaatcctctcttgctctcatgcgaggactcctctcagctgcactgctgatcgtggtggtgctgctggtcggtatcgcatggctagccacccaacaggtcaccgcgccggtgcgttcggcgagccggattgcggagcgtttcgctcaaggcaaactgcgtgaacgcatggtggtggaaggcgaagacgagatggcccgcctggcggtgtccttcaacgcgatggccgaatcgctgtccgcgcagatcaccaaattggaggaatacggcaatctgcaacgacaattcacatcggatgtctcacacgaattgcgcacaccgctgacaacggtgcgcatggctgctgatctaattgccgatagtgaagatgaactttcacccggtgcgcgccgcgccagccaactgatgaacagggagttggaccgattcgagtcgctgctgagcgatctgttggaaatttcccgacacgacgccggcgttgccgaactgtccaccgcgcttcacgatgtccgcatcccagtgcgatcggcattggaacaagtacaacacttggccaccgagctcgatgtggaattgcttgttaatttgcccgaagaagcgatcaacattcaaggcgattccaggcgcatcgaaagaatcattcgcaaccttctagccaatgcgatcgaccactccaagggcttgcctgttgagttgaaagttgccgacaacgtggacgcagtagcgatcgttgttattgatcacggcgtcggcctgaaacctggacaagacgaattggtgttcaacagattctggcgagccgacccttcgcgcgtccgccattctggtggcaccggcctgggtcttgcgatttctcgcgaagatgcgatgcttcatggaggaaaccttgatgcggcgggaacgatcggtgttggttccattttccgtttggtcttgcctaaagaaccgcatggaaattatcgtgaagcaccgatcccgttgatcgctccagagacaccgtgggaaggggagcagcag

SEQ ID NO: 843 - DNA, 1704 bp, Corynebacterium glutamicum
gtgagtaaaatttcgacgaaactgaaggccctcaccgcggtgctgtctgtgaccactctggtggctgggtgttccacgcttccgcagaacacggatccgcaagtgctgcgctcattttccgggtcccaaagcacacaagagatagcagggccgaccccgaatcaagatccggatttgttgatccgcggcttcttcagcgcaggtgcgtatccgactcagcagtatgaagcggcgaaggcgtatctgacggaagggacgcgcagcacgtggaatccggctgcgtcgactcgtattttggatcgcattgatctgaacactctgccaggttcgacgaatgcggaacgaacgattgcgatccgtggaacgcaggtcggaacgttgctcagcggtggcgtgtatcagccggagaatgcggagtttgaagctgagatcacgatgcgtcgggaagatggggagtggcgtatcgatgctttgccggacgggattttattagagagaaacgatctgcggaaccattacactccgcacgatgtgtatttctttgatccttctggccaggtgttggtgggggatcggcgttggttgttcaatgagtcgcagtcgatgtccacggtgctgatggcccttctggttaatggtccttcgccggcaatttctcctggtgtggtcaatcagctgtccacggatgcgtcgttcgtggggttcaatgatggggagtatcagttcactggtttgggaaatttggatgatgatgcgcgtttgcgtttcgccgcccaggccgtgtggacgttggcgcatgctgatgtcgcaggcccctacactttggtcgctgacggcgcgccgttgctgtcggagttcccaacgctcaccaccgatgacctcgccgaatacaacccagaggcttacaccaacacggtgtccacgttgtttgcgttgcaggatggatcgttgtcgagggtcagttccggcaatgtgagtccactacagggcatttggagcggtggagatatcgattctgcagcgatttcctcctccgccaatgtggtggcagcggtacgccacgaaaacaacgaggcagtgcttactgttggctccatggaaggcgtgacttcagatgcgttgaggagtgaaacgatcactcgtcccacctttgaatacgcgtcgagtgggttgtgggctgtggtggatggggagacgcctgtccgagtcgcacgatcggcaacaaccggtgagctcgtccagacggaggcggagattgtgctgccaagggatgtgacgggtccgatctctgaattccaactgtcacgaactggggtccgggccgccatgatcattgaaggcaaggtgtacgtgggcgtcgtaacgcgtcctggtccgggcgagcggcgcgtgacaaatatcacggaggtggcgccgagcttgggcgaggcggcgctgtcgatcaactggcgcccagacggcattttgcttgtgggcacgtcaattccagagacgccgctgtggcgcgtcgagcaggacggatcggcgatttcgtcgatgccgagcgggaatctcagcgcgccggtggtggcggtggcaagttccgcgacgacggtctacgtcactgattcgcatgcgatgcttcagctgccgactgccgataatgatatttggcgcgaggtgcccggtttgctgggcacgcgtgcggcgccggtggttgcgtac

SEQ ID NO: 844 - DNA, 588 bp, Corynebacterium glutamicum
atggagctgttcttcccgcgcgcatgtggtggttgtggggcgccgggggcgtcgttatgcagtgactgccagcgtgtgtggaggaagccgccaacattggcgcggcttgatttagatttaccggtgtggacgttgtcgccgtatgacggcccgcatcgcaacgtgctcattgcgctgaaggagcacggccgtgcagaccttgtggcgtttgtgggcgcggtggtgggggcgtcgataagctatctggcggctcagggggaaattgagcacgacatcacgctggttccggcgcccacccgcgccacctcgcgacgccggcggggcggcgatccggttgagcgggtgtgcaatgcatcacgcttatcgacgtttccctgccttcaaatctcatcccgcacaccagactccgtcggtcaaactgcgcaacagcgaagactcaatatgcgagtggagttagtccgacaacctcggggttctgtcttgatcatcgacgatgtggtaacaacgggggcaactatttccgcatctgcaaacgttcttcgcgcagcgggtgtgcaggtcagaggagctttaacttattgccaagcg

SEQ ID NO: 845 - DNA, 156 bp, Corynebacterium glutamicum
gtgctacttctcctcccaattgtggtcaccgcattgatgtgtgagtggaattactcgtactacgatgacgcgatcaacttcacttcttatactacttctggtcataaccacattgccaataggggccccttttatatccaagatcacgcttggcaa

SEQ ID NO: 846 - DNA, 663 bp, Corynebacterium glutamicum
gtgactacacctgctgagaacaacacccttagccccgagaccaaagtaagcatcactggtcgaaacgttgaggttcctgatcactttgcagaacgagtaaataccaaactcgcaaagattgagcgcctcgacccaacgctgaccttcttccacgttgagctacagcacgagccaaacccacgtcgtgctgacgaaagtgatcgcattcagatcaccgccaccggcaagggacacatcgcccgagcagaagcaaaggaagacagcttctacgcggcactggaaactgcactagccaagatggagcgctccctgcgcaaagtgaaggcacgtcgcagcatttcccgctccggtcaccgcgcaccactaggcactggtgaggtcggtgcacagttggtagccgagtcccaagaggcacgcggtgccgatgaactgggcaaatacgatgttgatccttatgcagataaggtcgatgacgtcatgccaggccaggttgttcgtaccaaggaacacccagcaaccccaatgagtgtggatgacgcactatccgagatggaattggttggacacgatttctacctcttcgtcaacgaagagaccaaccagccatcggtggtgtaccgccgacacgcattcgactatggattaatttccctgtccgatgca

SEQ ID NO: 847 - DNA, 2535 bp, Corynebacterium glutamicum
gtgtttggattgtccaaggtgctccgcgtcggcgaaggccgtgccgtgaagcgacttcacaagatcgctgaccaggttatcgcgcttgaagataagttcgccaacctaaccgatgaggagctcaaggcaaaaacagccgagttcaaagaacgcatcgctggcggtgaaggactcgacgaaatcttcctcgaagcgttcgcaacagcccgtgaagcagcttggcgtgtgctcggccagaagcactaccatgtacaaatcatgggtggcgcagcgctgcactttggcaacgtcgccgaaatgcgcaccggcgaaggcaaaaccctcacctgcgtgcttccagcatatttgaacgcacttgaaggaaaaggcgtccacgttgtcaccgtcaatgattacctagcaaaacgtgacgcagaaatgatgggccgtgtgcaccgctacttaggcctcgaagtgggagtaatcctctctgacatgcgcccagacgagcgccgcgaagcctacgctgccgacattacctacggcaccaacaacgaactcggcttcgactacctgcgcgacaacatggcacgctccctaagcgacctcgtgcagcgtggacacaactacgccattgtcgacgaagtagactccatcctcatcgacgaagcccgcaccccactgattatctccggaccagtagacggcacatcgcagttctacaacgtcttcgcacagatcgtcccacgcatgaccaaggacgttcactacgaagtcgacgaacgtaaaaagaccgtcggtgtgaaagaagaaggcgtcgaatacgtcgaagaccaactcggcatcgacaacctctacgcacctgagcactcacagctggtcagctacctgaacaacgccatcaaggcacaggaactgttcacccgcgacaaggactacatcgtccgcaacggcgaagttatgatcgtcgacggcttcaccggccgtgtccttgccggccgccgatacaacgaaggcatgcaccaggcgatcgaagccaaagagcgcgtagagatcaaaaacgagaaccagaccctggcgaccgttaccctccagaactacttccgcctctacaccaaactcgccggcatgaccggtaccgcagagaccgaagcagcagagctcaaccagatctacaagctcgacgtcatcgcgatcccaaccaaccgaccaaaccagcgcgaagacttgaccgacttggtgtacaaaacccaagaggctaagttcgcagcagtcgtcgacgacatcgcagaacgcaccgaaaagggccaaccagtcctcgtcggtaccgtctccgtcgagcgctccgaatacctctcccagctgttgaccaaacgaggcatcaagcacaacgtcctcaatgcgaagcaccacgagcaggaagcacagatcgttgctcaggcaggtcttccaggcgccgtcaccgttgccaccaacatggcgggccgtggaaccgacatcgtgctcggcggaaacccagaaatcctcctcgacatcaaactccgcgaacgtggacttgatcctttcgaagacgaagaaagctaccaggaagcctgggacgctgaacttccagcaatgaagcagcgatgcgaagaacgtggcgacaaagtccgcgaagccggaggactctacgtccttggcaccgaacgccacgaatcccgacgcatcgacaaccagctgcgcggtcgttctgcacgtcagggcgacccaggatccacccgcttctatctctctatgcgcgacgacctgatggttcgcttcgtcggcccaaccatggaaaacatgatgaacaggctcaacgtcccagacgatgtgcccatcgaatccaaaaccgtcaccaactccatcaagggcgcccaagctcaggtggagaaccagaacttcgaaatgcgtaagaacgttctgaagtacgacgaagtcatgaacgaacagcgcaaggttatctacagcgagcgacgcgaaatcctcgaatccgcagacatctcccgctacatccaaaacatgatcgaagaaacagtcagcgcatacgtcgacggcgccaccgccaacggctacgtcgaagactgggacctcgacaaactctggaacgccctcgaagccctctacgacccatcgatcaactggaccgacctcgtcgaaggcagcgaatacggcaaaccaggggagctgtccgccgaagatctacgcaccgcactcgtcaacgacgcccacgccgaatacgcaaaactcgaagaagccgtatccgcaatcggcggcgaagcacagatccgcaacatcgaacgaatggtgctcatgccagtcatcgacaccaaatggcgcgaacacctctacgaaatggactacctgaaagaaggcatcggcctgcgcgcaatggcacagcgcgacccactggtcgaataccaaaaggaaggcggcgacatgttcaacggcatgaaagacggcatcaaggaagaaaccgtccgccagctcttcctcctccgcaagcagttcatcaagcaagacgcggaagtcgctgac

SEQ ID NO: 848 - DNA, 672 bp, Corynebacterium glutamicum
ttggccgaaggccgaacgcggaatccaaagcgaccctcaccagcactgacacctcgcgcggcacttcggtgcgtgcgtggattgcctgaggcaacggatcgggcacaagatataacaaatgtgcgaaacctggaattggaacaagcacaacaaatctccttgagagaaaatctcaaggcaaaaaacaagccaccccaatctgtgcgacaatcaaaccacagactacgactattatgtcacgaagaaaccaaagaaagggaaataatgcgcggactaattgttgactacgctggagtactagacggaaccgatgaggaccagcgtcgctggcgcaacctgctcgccgcagcaaagaaaaatggcgtcggaaccgtgatcctcagcaacgatccaggtgggctcggcgcagcgccgatccgggaactcgaaacaaacggggtagtcgataaggtgctgctgtcgggagaacttggcgtcgaaaagccagaggaagcagctttccaggccgccgcagacgccatcgacctgcccatgcgtgactgcgtgcttgtcgacgactcgatcctcaacgtgcgcggcgccgtcgaagccggactcgtaggcgtctactaccagcaatttgaccgtgcagtcgtcgaaatcgtcggactgttcgggctagaaggagaattc

SEQ ID NO: 849 - DNA, 504 bp, Corynebacterium glutamicum
ttgcgcgtctacatcccagcaacgttttccacactccgcggactcaatgaatcccgcgtcatcacagcacgctccggatacggtttcgcagtcaccccagcactccttgacttctacaccgacggtgacgaagaagaaatcgcacatgcagccttccaagacgccgcagaagcctccatccgactcctcgcaatcggcgacgaagaaacatttccctaccgcagagtcgtcgtctcagtagatgttgacgactccgtggtgacctaccagcctgaaaacggcgaatccgtagtcaaactcagcccagcgcacatcaacctcgacgacgtggcagcaatccacatcgacgttgaagcctccgaagcagacaccaaaaaagctatcgaagtcatcgacgaatccgacctcggcgaagaagacgccgaactcaccgtcggagacgcccaagacaacttcatggcctggtacgacccagaagagctccccttcctagtcgagctcctc

SEQ ID NO: 850 - DNA, 987 bp, Corynebacterium glutamicum
ttggctagacgcagctatgacgaatccgatgttcgtgttcgcccaggtaaaggtacccgccctcgtacgaaggatcggccatcgcatgagaatgctctagtgggcatggttgtgacgaaggatcgtggtcgttggggtgttgttctcgatggtcgtcaagatgccattgtgacgatgcgtgcccgtgagttggggcgtacggctatcgaagtgggtgatcgtgtcggagttgtcggcgatacgtctggccgtccgggctcgttggctcgaattgtccgccttgaggagcgcacgagtgtgttgcgtcgtacggctgatgacacggacccgtttgagcggattgtggtggctaatgcggatcagttgttgattgtttctgctgtcgccgatccgccgcctcgggcgggttttgtggagcgtgctctaattgctgcgtttgttggtaatttgcagccggtgttgtgtttgacgaagtctgatttggcggatcctgcggagttcgctgcggagtttgaggctttggaagtgccggttgttgtttgtggtgttgatgatcctcttgatcctgttttggaggtcgtggagggccatattacggcgcttattgggcattctggtgtgggtaagtcgacgttggtgaatcgtttggtgccggatgccgatcgtgagactggtgtcgtgtcgggggttggcaagggtcggcatacgtcgacgcagtcggtcgctcttgccattgataatggttggattatcgatacgccgggtattcgttcgtttggtttggcgcatgttgatgcggacactgtggttggtgtgttcgacgatttggctttagcggcggaggattgtcctcgtgggtgttcgcatttgggtcctccggcggatcctggttgtgcgttggatcgcctggagggtgcgagtgcgcgtcgtgttgaggcggtgcgtgcgttgctcgttgcgttgaggagcaacgacgcgtgggatatg

SEQ ID NO: 851 - DNA, 1413 bp, Corynebacterium glutamicum
ttgtatcgcggtcccggagttccttgcggagccacgactgatcggtcaagtgctatctcggttgcatcaataagcgaatcaccggtggtgaacaaaacaaatcttccacacataacatctattatggtctttgtgtctgattcgtctatctctttgcccatttgggatgctccgcgcgctcgcggccccatagtctcggacctggctatccctggttccaagtcgatcaccaaccgcgccctcatcttggctgcgctcgcatcaactccatccaccatcattgatgtccttcgtagtcgtgataccgatctcatgactgatggtctacgcagcctcggaatcaccattactgaagaggcagtcgatcgctaccgcgttgagcccggacagttgtctgctggctccgttgagtgtggtcttgctggtacggtcatgcgctttttgcctcctgttgctgctttcgctgatggtcctgttcattttgatggcgatcctcaagctcgtgttcgtccgatgaccagcattttggatgcgctgcgttcgcttggtgtggaggtagacaacaacaatctgcctttcactgttaatgctggtgaggtccctgagggtggcgtggttgagattgatgcttccggctcatctcagtttgtttctggtcttttgctttcagcgcctcgttttaaaaatggcgtcaccgttaagcacgtcggtggtcgtctgccgagcatgccgcatattgagatgaccgtcgatatgcttcgttccgcaggcattgagatcgaagagtcagaaaatcagtgggttgttcatcctggtgagatcttgggtcggacctggcgcattgagccggatctttctaatgcgactccgttcctagctgccgctgcggtcactggtggaaccatcaagattaaccactggccaatcaaaactactcagcctggcgatgctattcgttcgattcttgagcgcatgggctgcgaagttgagctggttgctcagggtgaaggttacgatctgtcggtgactggtccggttgctctcaagggcattgagatcgatatgtccgatatcggtgagttgacccctaccgtggcggcgttggctgcgttggcgtcgacagagtctcgtttgaccggtattgctcatcttcgtggccatgagacggatcgtttggctgcgttgactgcggagatcaacaaacttggtggaaagtgcactgagcttaaggatggtctgttgattgagcctgcgtcgctgcacggtggtgtgtggcattcatatgctgatcaccgtatggctactgctggtgcgatcattggcctcgcggttgatggcgttcaggttgaagacattaagaccacttccaaaactttccctggttttgaaaatgtttgggaggagatggttggc

SEQ ID NO: 852 - DNA, 480 bp, Corynebacterium glutamicum
atgcttttggaaccggcgcgttggggattgtttccgcattggaagaaggatgattcaggtcctccgctttttaatgcacgtggcgagacggtggcggagaagccgtcgtttcgtgatgcatttaaacagcagcgttgtttaattccgatggatggttattacgaatggcacgataagaagcctcattttgtttctttaggtgatgagctgatgtgggctgcgggtttgtggtcgactggtttagatcagatgtcggcgacgatggtgacgaccgaatctgtggagccgattgcatggttgcataatcgtttgccacggtttttggagcatgacgagttggagcaatggctgtttggtacagctgaggaagctaaagagatgttgcatccggtttctcaagagtgggtgaagcgcttgagtgtccgagaggtgtcgtctgatgtggggaacgtgcgtaacgatcacgctggcttgctggat

SEQ ID NO: 853 - DNA, 123 bp, Corynebacterium glutamicum
atgcggaaacaatccccaacgcgccggttccaaaagcatctcttccccggggcgaacgatcggaattatctgagtcggagcaaggttgtatcgcggtcccggagttccttgcggagccacgac

SEQ ID NO: 854 - DNA, 1110 bp, Corynebacterium glutamicum
atgttctacttcaccgtcaataatccgcaggatcctttaagcaccgaaattgttgagactaatcgccgtgacctcgcattttggcatcgattacgccccaaagatgacgatgatttagccacagccatcaacaaaatatgcgtgcgcacaggcttatcccgcaaactgatcgccgcttgtttatttagcatctgcttcctgccgtacttacccaacttccacaaactcgtcgaaaagcttggtcatctcgacatggcgcgcatcaacgcgatcactaaagctggcgaaaaagtgccaagcgagaagagagagcttttcgacgcctacctcgtcgattacctgacgcctcgagcggaggctcagtgcttgccccaggcaagctcaatttccgcaatgatgcggaaatttatcgcacaacactgccccgacgacaaggcctcctcagccaccaatgatggctccatccgctaccgcagaaacaacaaaggcgggatcagtatcaccgtcgatgccaccgccagcgaagtaacagaaatcaaagctgccctggaacaaatgtccaaagataaggactgcacaccaggcacttccctactccacatcattcgtggcctgccgacaaaagtcgtactcaacacctacggcaccaaagacagccctgaatacttagaaggaggaacctggctgtcaaaggaacagtctgagttctggaaaacccgaaccacgtccagtcgggatatggacgccgcccacttctcttacaccaccgcctacgctccaacccgagaaatgcgcgtctacatcaaaggtctacgcaccacctgtagcgtccctggctgcagtgtagcggtcgaaaactgccaactggaccacatcatcccctggggtgaaggagggccgacaacaccgtggaatattcatcccctgtgtgtcttccaccacatccagaagactgaagggaggctccagtgctatccactaccggacggcaccgtcctattcctagtggatggaataccggtgttctccatccccgacgggcctttatctaaatcgaataaaacctgggggacaaagttcggcaaatacatggagcgtcgaatcgccgcc

SEQ ID NO: 855 - DNA, 618 bp, Corynebacterium glutamicum
atggctgaaaaccgaaccggcacagtcgatggagacgcgttggctgcccgctttgaagaggaggcactgccactccttgaccagctctatggcggtgctctgcgcatgactagaaatcccgcagatgcggaagatctcgtgcaagacacctatatcaaggcgtaccaggcgttcgcgagcttcaaaccaggcaccaacctgaaggcttggctctatcggatcatgacgaatacctacatcaacatgtaccgaaagaaacagaggcagccatcgcaaacctctgccgatgagatcactgactaccagctcgttgaatctcaatcgcatacctcaacagggctggaatccgccgaggttgaggctctgaaaaatctgccagacggaaaaattggcgatgcaatgaatcaactcagcccggaataccggatggtggtttattatgccgatgtagaagatctcgcatacaaagaaatcgccgagatcatggacgttccactcggaactgtgatgtcccgactccatcgtggaagaaaacagctccgaggaatgttaaaggaagtagcgaaggaacaaggcattggtcttgaacatcccgacatgaagaaaaattcggaggca

SEQ ID NO: 856 - DNA, 258 bp, Corynebacterium glutamicum
atggattggcgccacgaagcaatctgccgtgaagaggatcccgaactgttcttcccagtcggcaactccggcccagcactcgcacagatcgcatccgcaaagatggtctgcaaccgctgcccagttacctcccagtgccttgcatgggcgctggaaaccggtcaggatgctggcgtttggggtggcatgagcgaagacgagcgtcgcgctctcaagcgccgcaagaaccgtggccgcggtcgcgcacgcatcgcagtt

SEQ ID NO: 857 - DNA, 420 bp, Corynebacterium glutamicum
atggccgtgacttctccgaacatgcctgcatcaattcgctggggcggcatcgtcgccctcattcaatccaccatcggattcggttacgcctttttccttatttacagggaagctacgggcgagacggatccaagcatcgtctacgaaaccgataacgccaacacgtgggttggctacggtaccgctgcattcttcatcattgtgttcggaacggttgttgcaggcgcaatcaacatgatgaaggggcatcgctggggacgcggagctgtcgtcatgctgaatattattttgttgccggctgcgtattacatgtttatcgaaggccgattctcctgggcgatcgtcacaggaatctcagctctcttcgttttgggcgcactgtttaataagcgcgccgtcctttgggctaacaacgagatc

SEQ ID NO: 858 - DNA, 1200 bp, Corynebacterium glutamicum
atggcagcaaagcttcaaccactcaaacgcaccaaaaaagacctcatcgcaaccggtgtcatcacagcactagcagtcattggcgtcggcacggtctgggcaaccgcaccaatacgaggatctgaactcacccccgccgacgaaccattcatcgcctcaaccacactggacgccatccccgaaacactcagcgaacattggcgagccaccgacacctcaacaaaccacaaacccctcatcaccggcggagtcatctccaccgccgacggcaacaccatcaagacctacacccccgacggcgccctcctgtggagctacgaacgcgacaaagaactctgcagcctctccgtaggattcgacgccgccgtcgccacctacaaaaccggaatcggatgtggcgacgtcaccgccatcaacgccaacgacggccaataccaagcaacacgcagcgcaatctccagcgaccacgtagcaccgatctcctcgaacgatcggatcggtgttctcgggacagaacgcttggagctttggcgatccgatctggtgcgaaccatcgaatacggcgatgtggaagctcctcaagaatctgggcaacaaccacatccggaatgctcgattacgtccgccatgacacgcaaagatctattggctatcaccgaggattgccctgacggatcttcttacttgaggttcatgggcacaacaccagacgattcccgaactcctgaaatcacccaagacatagaaataaccgatggcaggatcgttgccatcggtcaatcagtggctgcggtgtatacaaacgatccttcgcctcgaatcgtctcctacaacgatgatggtgaactagttggagaacaagcagtcgatgaggttgagttcccggatccgccgtttcaaagcgcgaccgctgatcttccacaccatatgagttggttcaacggagacagcctcgtactgttctctcccactcagctcaatgtacgacaaagcttcaatgatgctttaggaaccggcattgcgttgaacggaagtctcctctaccccaccgctgagggcatcacggtagctaattgggacaccggagaggtgcagcgcaccattccggtggaccgtgcgggctacgacggtgaagttgcgctcggcgttgtagggcaggtgatcgtcgaaaagcgtggctctgagatcgttgctctaggc

SEQ ID NO: 859 - DNA, 1272 bp, Corynebacterium glutamicum
gtgtcttctgaaagccccagacctacgttcacagagctcggcgttgcggtggaaatcaccgacgcactcgaagccctcggcatcaaccgaactttcgcgatccaggagtacacacttcccatcgcgctcgacggccacgacttcatcggccaagcccgcaccggcatgggcaaaacctacggattcggtgtcccactcctcgatagagtcttcgactcagccgacgtcgcagaaaccgacggtaccccccgagccctcgtcatcgtgcccacccgagaactcgcagtccaagtcggcgacgacctccaacgcgcagcaaccaacctgccgctaaagatcttcaccttctacggcggcaccccctacgaagaacagatcgacgcactcaaagtcggcgtcgacgttgtcgtaggcacacccggacgattactcgacctgcacaaacgaggcgcgctatcgctcgacaaagtagcgatcttagtcctcgatgaagccgacgaaatgctcgatctgggctttctgcccgacatcgaaaaaatcctccgtgccctcacccaccagcatcaaaccatgctgttctctgccacgatgcccggcgcgatcctcacactcgcacgcagcttcctgaacaaaccagtgcacatccgagccgagacatcggacgcctcagcaacacacaaaaccaccagacaagtggtttttcaggcacacaaaatggacaaggaagccatcaccgcgaaaattctgcagtcgaaagatcgcggcaaaacgatcatcttcgcccgcacgaaacgcaccgcagcgcaagttgccgaagacctagcctccagaggattctccgtcggatcagtgcacggcgacatgggccaaccagcccgcgagaaatcactcaacgcattccgcacaggaaaaattgacatccttgtagccacagacgtagccgcccgaggcatcgatgttgatgacgtcacccacgtcatcaactaccaaacccccgacgatcctatgacctacgtccatcgtatcggacgcacgggacgcgcagggcacaacggaacagccgtcactcttgtcggctacgacgaaaccctcaaatggactgtcatcgacaacgaactcgaactcggccaaccaaacccaccacaatggttctccacctcaccagagctgcttgaaacactcgacatcccagaaggtgtcaccgaacgagtcggaccaccaaccaaagttctaggcggaacagccccacgaccaccacgccgcacccggaaa

SEQ ID NO: 860 - DNA, 225 bp, Corynebacterium glutamicum
atggatatcaagatcggatttgccgatactgcccgtgaactggtcatttcttctgctttgcagcaggatgaggccgctgcgaaggtgtcggaggctttggctaatgattctggcgttttagatttgagcgatgaaaagggtcgccgttacattattcgtaatagccgaatcgcttatgttgaggtcggcacgagtgctcctcgtactgtcggcttcgctggcgca

SEQ ID NO: 861 - DNA, 846 bp, Corynebacterium glutamicum
ttggtccgctttgcgcgggattatggttggcgtgcgtacgccatcccggtgttgacggtcattactgtttgggtgctgttcgacgtgttttctgccgatcagcccgctaatggtgcgagtggggaagcgtcgacaagcttatcgacgcccacctccaccctccgcgccggccccgaccccgcgcaggccgaaccgcaaagcgttccgctgacggaactgccgcctggcggcagctacaccgaaaccggtgctggcactttccgccaggtcggcgctgctcttcctcgcgtgggcgaggggcaggaacaaacttttacgtacgtcattgagattgaggatggcgtcaacacggccgcttatggtggcgacgatgcgttcgtcgcagccgtcgatgcgaccttgtccgaccccaaaggctggaccgccgaccccgcgtttgccttcgagcatatttctggcgacgaggacccggatctgcgcattcaactgacctcgctgagcactacgcatgagttgtgtgggaatgacatcgagatggaaacgagctgtttctactccgatggcggacgcgtcatgatcaacgaatcacgatggatccgtggagccgcaccttttaagggcgatctgggctcttaccgccagtacttaatcaatcacgaagtcgggcacggcctcggctacgccgcccatgatgcctgcaccgcccctggcgagctcgctccgattatgatgcagcaaactttgagcttgaataattctgaacttttccgcatcgacccagatgaggtttaccccgacgacgacgccacctgcgaattcaacccatggccgtatcctcgcggattt

SEQ ID NO: 862 - DNA, 759 bp, Corynebacterium glutamicum
atgtctaatcaattacccgatcacgtccgcgacgccttccaagtaggtgcgggacctgccgaacaactcggtcaagcttgggacttcggattccgcgtcggcaacactgtgttcgccaaagtgacggcgccggaagtgtcgggctggtcgtcgaaaacccgcgaaaccctgaaaccagaaggcgtgcgcgtcgtacgaccgatccgctccaccgacggccgatttgtggttgcggggtggcgcgcatcggtgttctctacgggaacgatcagcaagcgagtcgatgagacggtcgttgcgggtcttcgtttggcagatgcattagtggatacgcatgcaccggaacctgtggacaatgtgtttaaccgtgctgatgtgcaggcctgggaagagcagcccggtcgaatcggtgaattgttggagccgattaatcgcgtgaaccaggttggtcatgcggatatgttggcgacaacgctgtatgcgggaactcagccacctgcagtgacggatttggtgccagtgctgcgtccgcatggtttcactgcggcattggtgatcgttgatgggttgctgctgggtgcggttgatgagggaattctgcggaggttttcgcatttgccggaaattgagcagctggttttgagggcatttttgttccgtcgaaacttgcaggagttctctgagaacaacgatccgaatgttatttcgaacctaaacagggtggaatcgacactcgtgtcgtatgtttctgacaagatt

SEQ ID NO: 863 - DNA, 3048 bp, Corynebacterium glutamicum
atgtcggaatacaaaccacccattccatcggatccacaagttcggctgattaagccaacatccaagcttcgtcctcgttcgtgggagggcgaagtttcgcatttagttaaacaaggcaccggtttgtggcgggtgactggtgaggcgggctcgggggtgagctccgctgttgtcgatactgtccttgaacgcattcgccaagggtgggagccgtcatcgatgttggttgtcgccacgtcgaaagaggcggcgagtcgcttgaggcaagagatctcggaatccgtagcccagatggattatgtgtcggaggggccgttggtgcgatcggtgcactcggtggctttcgcgctgattcgtgatgcgtcggatgatgatgtgcggttgattacgggcgctgagcaagatgcggtgattcgggagttgctgcgtggtcatgctgatgatggtcgtggggggtggccgcaggagcagcgtgagggtttgcggatggtggggttcgctaggcagttgcgtgactttttgcttcgtgcggtggagcgtggtgtgggccctgatgagttggtggaattgggggagcgatttgagcgcgccaattgggttgctgcgggtgagttccttcgtgagtacaagcaggtgatgaagctgtcgggggcgcatagtttttctgcgtctgagttggtgactgaagcgctgcgtggtcctgagccgtcggtgaagtatcgcggtgtgtttattgatgatgcgcagcatttggatccgaagtcggcggaacttgtgtcgcggtttttccctgaggcggagttggctgtggtggcgggtgatccgcagcagtcggtgtttaggttccgtggtgcgaatccggattttctcaccaagttgagtgtggatcacgaggtggtgttgaaggggaggaggaaagcgtcgacaagcattgtcgtggcagagaccgagtcggcgcatgcggacctgcttgctgacacggtgcggcgcgcgcatctcattgatgggcgcagctggtcggagatcgctgttatcgtgcgctcggccggcatgattgcgccgatttggcgcaccctgctggccgccggcgtgcccgtgcacatcagcccgactgatgtggtgctcgccgaacaacgtatcgttgccgcaatgattctcgggctgcgcgcgctgacggaatcgctcaacgccatcgagttggaggatcttctcctaggaccgatcggtggcgccgatccggtgactctgcgtcgtttgctgcgcgggttgcggcaggcggagatgaagatgggtgggcagaggcgagcgatcgaggtgctcagaagcctgctcgcagagtcggatgcggagatgttgggctttttgaccgatcgtgagctgaatttgctcgagcgggtgcgatctgtgttggaagcgggtcgtgaagcgctcgcggaacacggcagtatcgaagaggtgttgtgggcgctgtggtcggcgaccgatctgtcgaactcgttgtccgcgatcagccttcgaggcggcgcatcggggtcccaggccgatcgcgatttggatgcgatgatggcgcttttcgacgccgccggcgactacgtggagcgctacccgtcagcgggcgtgcggagtttcattctgcatatttctgagcaggaacttccgaccggcatgcgtgagcgacgcggcgcgatcccggaggccgtcgaggtgctgacggcgcacgcgacgacgggtcgtgagtggaagcgcgtgatcgttgctgaggtgcaggagggcagttggccgtcgctcggtgaaactggcacgctgcttggtcaggaagagttcgtcgatttggtggatgagggtattgatcccgatatcatcatttcccgatccgccgaacgactggcggaggaacgccgactgttctacctcgccaccaccagatccaccgaatcgctcctggttaccgctgtgaattcccccgactccgacgaagtccgcgaaccctcccggtttttggaattgctgagtcaaccgatcgttgttctcgagggggaggaagcttcggcgatcgcggaaccggaggagattgggcatcggttgttgtcgattcctgcgatggttgctgagttgcgtcgtgtggtgaatgatccgcgggatccgcgtcggaagcaggctgcgaggcagttgtcgaggcttgcggaggcggggattccgggtgcgaatcctgccgagtggacgaatctgcgcactccgtcgactgatgaggagttgatcaagggggcggtgtcgttgtcgccgtcgcggattgagcagttgttgaattgtccgctgcgcgctgtgttggatcgtttggacagtgaggaggaaacgccgatcgcgatgctcaagggcaccttggtgcacgcgtttgcggaggcggtcgccggtggcgtcgatgcggcgctcgccgaagagaaggtgaccagcgcctacatgcagctggcgaacgtgccgagctggtcgcgcgaaagcaccgaaattgcttttcgacgcatcctctcacgtaccgatacctggctgaagacttctcgcgccgattttacggaagtgggaacggagatggacgtatcggtgaccatcgatgactccgtatcgatccgtggtcgcatggaccgtttggagcgaaacaaatccggcgagttggtggttgttgatttcaaaacgggcaaaactcaaatcgctgcaaaagacatgggcgatcacccacagttgtttgcgtatcaattggcgttgtcgaaaggcgtgctgcatggtgacaaaatcagtgaccccaatcccggcgaaacccccgatcctgtaggcggcggattgcttgtctacccagcaaccgacaccaaggcagtcggccagcgaatgcaggatccgaaaactcaagaagatctcgacgatttcgcagcgatgctccccggcttggcagaacacctccgcggccccaatctgctcgcccgagtaaatcccacatgctcgacgtgtcccgttcgaagcctgtgcccagttcaacccgaaggacgtgtcatccatgcg

SEQ ID NO: 864 - DNA, 780 bp, Corynebacterium glutamicum
atgcgcgcgccgcaccgtgtcagcaagcaggtccgcatgcgccgactcggtctctgccacgacaatgcttgtcgacgctttcctcctccccttcaacaccacctcgtgatccacactcaacttggtgagaaaatccggattcgcaccacggaacctaaacaccgactgctgcggatcacccgccaccacagccaactccgcctcagggaaaaaccgcgacacaagttccgccgacttcggatccaaatgctgcgcatcatcaataaacacaccgcgatacttcaccgacggctcaggaccacgcagcgcttcagtcaccaactcagacgcagaaaaactatgcgcccccgacagcttcatcacctgcttgtactcacgaaggaactcacccgcagcaacccaattggcgcgctcaaatcgctcccccaattccaccaactcatcagggcccacaccacgctccaccgcacgaagcaaaaagtcacgcaactgcctagcgaaccccaccatccgcaaaccctcacgctgctcctgcggccaccccccacgaccatcatcagcatgaccacgcagcaactcccgaatcaccgcatcttgctcagcgcccgtaatcaaccgcacatcatcatccgacgcatcacgaatcagcgcgaaagccaccgagtgcaccgatcgcaccaacggcccctccgacacataatccatctgggctacggattccgagatctcttgcctcaagcgactcgccgcctctttcgacgtggcgacaaccaacatcga

SEQ ID NO: 865 - DNA, 3219 bp, Corynebacterium glutamicum
gtgtcatccatgcgtaggatttctcctcgactgctctcccaatatttgggacaagagcatgcgccaactgatcagcaatctgcgatcattggatccgaacccggcccactgttggtagtggctggtgccggcgcaggaaaaacggagacgatggctgcacgagtggtgtggttggtagcgaacggattcgtcgccccagatcaagtgctgggtctgacatttaccaggaaggcggcgcaacagctgtcgcagcgcatccgaaagcgtttggagactcttgctggtgtgcctcgcctgaaagacattgatcccaccggccagttggagaaaaaccttcaggcgatcaccccaacggtatccacctatgactcctatgcgggcacgttgattagagaatacggattgctgcttccagtagaaccttccgcaaggttgatcacacaaacggagctttatcacatcgctcgcaacgtggtgaacaactacgacggtgagctcaccgccacccaaacgccggccactgtcacggaatacctcctcaagctggtatccgaaatggacaaccacatggttaccgcagaggatatccgtgaggagtccgatccgttcattaagcttttcgacgaactccccaagggcaagggtcagcgcgacaacctcaacgccgaaatgacgaagtggcgggatacacaggtcgctcgcctccagtacttgcccctcgtgaaggctttgaaagaggaactgcacaatcaggctgtggtgacgtttggtgagcagatgtctaaggcagctcatctcgcatcgacgcatcctcaggtgggctattcgcagaggcgacggttccgcgttgtcatgcttgatgagtatcaggacaccagccactcgcagcgtgtgttgttgagcagtcttttcggtggcaccgatcctggtctcactgttaatgctgtgggcgatccaatgcaggcgatttatggttggcgaggtgcgacagcggcgaacttggagaatttcgttgacgatttccccgtcatccatctcgatggaaaaacgagagcaccgaaaaacgagttgaccacaagttggcgaaacccaccagaagtcctcacccttgccaacgcagtttcgcgggaggtgcttgggtcgcccgatgcgccgactcggacggtgcagccgctgcagcctcgggaaggcgcaccgaccggtgaagtgtcgctcggatggtttggtacggcggcgcaggaacgtgagtttgtggctgatgagatggtgaagcattggaatgcgcgggaggagaagggcacatttactgctgcggtgttggtgcgtaagaagcgtcattcggcaccgatggcggaggagctgaccaagcgtggcatccccgtggagatcgtcggactgtctggtttgttggatatccctgagattgccgatctaatttctctagcaactatgctcgtgcgtcctcacgataatcgggctgcgttgcgtattttggcgggcccgcatgtgggtttgggtgtggcggatttgcagcggttgcagggtcgtgcgcgcaatattgcgggtcgtgtgtctcgtgagcgtcgagagaagaacccagatccattagcggagcttgatgcgattattgaggaagcgactgcgattgaaccggaagctgtggttggtctagctgatgcggttgccgatttgggtgagggcgatcgtttcagcgaggaggggttgagtcgtttgaagcgactggccactcagttgcgatatttgcgtaagtacagcttgggtcgttcggtggcggacatttttgctgatattgaaactgtgttcaatattcgcacggaggtgttgtcgaggcaggatcctcacgccgatggtgctgctggaacggtgcatttggataagttcgcagaagaggtcgcaagtcacggtggcattgggctgcctgagctgttggactattttgagctcgcgaaggatcaggaagagggccttgagccgggtgaggtgacggttcgcagcgatcgtgtgcagatccttactgtccacaaggctaagggtttggagtgggatatcgtttcggtgttgcatgccgatgcgtcgacctatgatgcgaaggcttcgacgtggttgaaaaatgtcacgatgatcccgtcgtcgcttcgtggcgatgccgggaccggcgccccagagatggatacctctgaggcggacgatcgcaaagctctggaagattccggcaaggagtacaccagtgaagtgcgtgaggggttacgggaggaaaattcgcgactgttttatgtcggtatcacgcgcagcgaacgggtgttgctcgtgacgggttcggcgcttgatgaaagtggcacaaaggcgaaagttccctacggccacttggagatccttcgggataaagcgccggagtgcgtggtgtcgtggtgggaaggggaagagggggacgtcgaaaagcaaaaacctgcggaaggcgtcttcccgcaactgctcgccgctgactcctccggcgcggatttggtgcgcggcccgcgcgccgagccaaacaacgagggcgggctggaaagcttgtgggaaaaagaggtaagcgcgcttatcgacgaacaccgccgcctttccaaccccatcgtcgaagtcgaaacgccccgcgaactcacggccaccgacctcgtctctatgaaaaacaatcccgaacagttcgcccgacgaatgcgtcgccctgtcccgttcaaaccaaacacctacgcaaaacgcggcacactgttccaccaatggctcgaagatcggtttggcagcaccgcgcttctcgacgaaaccgagctccccggcatcgacgaggactactcggatgacgcattcatcgaactccgcgacgcgttcctaggatctacttgggaaaaccgcacaccggaattcgtcgaacatcccttcgaagtaacgatcggcgaacacgtcatccgcggccgcatggacgccgtcttccacaccgatggcacctggatggtggtcgactggaaaaccggacgcaccccaaccggccccgaaatggacgcagcgatcatccagctcgctgtctatagactcgcctgggcacgactcaaaggcctcgaacctgaagaagtccgcgcagcattccattacgtcgcccacgatcacacctttgagccgaacgatctgccgactcaagaagaactagcccggctgctcagtcaggaa

SEQ ID NO: 866 - DNA, 1332 bp, Corynebacterium glutamicum
atgacgcttcttacgcaccaacaccgcagcagtaaatgtgcccttctcctcccgcgcattccaatgcttcaccatctcatcagccacaaactcacgttcctgcgccgccgtaccaaaccatccgagcgacacttcaccggtcggtgcgccttcccgaggctgcagcggctgcaccgtccgagtcggcgcatcgggcgacccaagcacctcccgcgaaactgcgttggcaagggtgaggacttctggtgggtttcgccaacttgtggtcaactcgtttttcggtgctctcgtttttccatcgagatggatgacggggaaatcgtcaacgaaattctccaagttcgccgctgtcgcacctcgccaaccataaatcgcctgcattggatcgcccacagcattaacagtgagaccaggatcggtgccaccgaaaagactgctcaacaacacacgctgcgagtggctggtgtcctgatactcatcaagcatgacaacgcggaaccgtcgcctctgcgaatagcccacctgaggatgcgtcgatgcgagatgagctgccttagacatctgctcaccaaacgtcaccacagcctgattgtgcagttcctctttcaaagccttcacgaggggcaagtactggaggcgagcgacctgtgtatcccgccacttcgtcatttcggcgttgaggttgtcgcgctgacccttgcccttggggagttcgtcgaaaagcttaatgaacggatcggactcctcacggatatcctctgcggtaaccatgtggttgtccatttcggataccagcttgaggaggtattccgtgacagtggccggcgtttgggtggcggtgagctcaccgtcgtagttgttcaccacgttgcgagcgatgtgataaagctccgtttgtgtgatcaaccttgcggaaggttctactggaagcagcaatccgtattctctaatcaacgtgcccgcataggagtcataggtggataccgttggggtgatcgcctgaaggtttttctccaactggccggtgggatcaatgtctttcaggcgaggcacaccagcaagagtctccaaacgctttcggatgcgctgcgacagctgttgcgccgccttcctggtaaatgtcagacccagcacttgatctggggcgacgaatccgttcgctaccaaccacaccactcgtgcagccatcgtctccgtttttcctgcgccggcaccagccactaccaacagtgggccgggttcggatccaatgatcgcagattgctgatcagttggcgcatgctcttgtcccaaatattgggagagcagtcgaggagaaatcctacgcatgga

SEQ ID NO: 867 - DNA, 1005 bp, Corynebacterium glutamicum
ttgagcattattcgaatcccgcaggcggcgaaaagaagcccctgggcgctgatcttaacgcgcatcggatacgcgatggtgctgctggttatcgtcaccatggttgtctattttgaccgcaacggatactccgaagacctcacgttcatcgacgcgttgtactattccacagtctcgttgaccaccgtgggctacggcgatatcaccccggtgacgcaatcggcacgcctgatcaacatcatcgtcctcaccccagcacgcatcggcttcctgatcctcctggtcggcaccaccttgtcagtgctcaccgaagaatcgcgccgggccctgcaaatccaacgttggagaaaacgcatgcgcaaccacaccgtcgttgtcggatacggaaccaaaggtcgctccgcggtcgctgcactgcttgccgacggcgtccccgccaaccagatcgttgttatcgacaccgatcaagtctccctcgacgccgccaacaacagcggactcgtcaccgtcaaaggctccgccaccaaagcagatgtgttgcgtctagctggcgtgtcacgagcgcgcgccgtcgtcgtggcaccgaacctggacgatactgcagttctggtgactctatcggtgcgagaaatcgcgccgcaggcaatgattgtggccagtgtccgagaatctgaaaaccaacacctcctcgaacaatccggtgcggactcggttgtgatctcctcagaaaccgctggccgaatgctcggtctggcaacagttaccccatcggttgtggagatgatggaagacctcctctcacccgacgaaggattctccgttgccgaacgactagtcggtgaggatgaaatcggctccaacccacgacacctcgctgacatcgtcctcggtgttgttcgatccggtgagctctaccgcatcgactccccagaagcagaaactgtagagcccggcgatcgtctcctttacgttcgccgagtatttagcgaggaggtaaatgacaaa

SEQ ID NO: 868 - DNA, 714 bp, Corynebacterium glutamicum
atgagaattcttcccatcggcccccacgatgaaatcgccgtcaacggatcaatagtccttctatccgagcacgacggagacatcgtatcggtcggccccgacctcggcacggtgcgagttacccttgaagagatcgaaagtttaggtacaccgacggcaccccgcgatctgggttctcgggaagtcgacgcatgcgtatcgttgctccgcaaccgcgagttagtgcgattcgatccccacgatggcagtgaattaacctatcgggaacatagcgttgcttacggtgcgagtggcaagccattgtttccccgattggatccagcggtgatcggcattgtggagctgcgaggtgaggatcgtttgcttctgggcatgaatgcgcagaaacgccaacgctattcattaatcgcaggttatgtttcgcatggtgagtcgctggaagacgcattcaccagagaagtgttcgaggaagcggcgcgccgggtatctgagatttcctatgtgtcgtctcaaccatggccgatctctggttcgctgatgctgggtatgaagggcttcacggaagatgagttgcctcaaggcgaaactgatggtgaattagcggagacaatctgggcttcgccactagacattatcgatcgtaagattccgatcgccccacccggatcgattgcctacgacatgatcaacgcctgggcgcgagataaacaaaac

SEQ ID NO: 869 - DNA, 2034 bp, Corynebacterium glutamicum
gtgatcaatttgcaggacctcgacgaggatcaacgcatcgctgcttctgcgcctcgcggaccagtgtgcattctcgccggagccggcacgggtaaaactcgaacgattacttatcgcatcgcgcatctgattgatcagggttttgtgagcccgaatcgtgttcttgctgtgacgtttacatcccgcgcggcaggggagatgcgtcatcgcttgaatctcatggggatcggtggcgtgcaggcaaggacattccacgcagcagcgaggaagcagttgttgtatttctggcctcaggtggcgggtaatctgccgtggcgcctgttggataataagtttcaacttgtgggtcgtgcggttcgtggtgcgcggttggaatcgcagactgaaaaagttcgcgatattttgggtgaaattgagtgggcgaaggcgtcgttgattacacctgagcagtatccggatcgtttgggtacgaggacccctccggcgcccgcggagaaaatcgctgaggtgtatcagcgatacgaaaacatgaaggcaacccctgaggggatgttgcttgatttcgacgatctgttgcttcacaccgccggcgcgttggagaattccccggcggtggcggaggagttccgccagcagtatcgcagctttgtggtcgatgagtatcaggatgtgacgcctctgcagcagcgggtgctcgatgcgtggctcggcgatcgcgatgacctgacggttgtcggcgatgcgaaccagacgatttattcgttcacgggggcaacacctgaatttttgcttaatttctcgaggaaatatccggaggcaaccgtcgtcaagctgcagcgcgactaccgctcaacgccgcaggtcaccgcgctggccaataccgtcatcggccaggcgcgggggcgcgttgctggcacgcgcctggagcttcagggaatgcggatcgccgggccggagcccgaattttcggctttcgacgacgaacccaccgaagcccgcgaagttgcgggccgcattttgacgctgcttaaaaacggcgttcaggcctcagaaatcgccgttttgtaccgcatcaacgcgcagtcggcggttttcgagcaagcgcttgccgacgccggcatcgtatatcaggtgcgcggcggcgaaggctttttcacccgcccagaaattcgccaagccctgagtcaactgatccgcacttcccaacgcgacgtcgatgaaagcgatctggtgcgtctgacgcaacgcacactcgtgccacttgggttgagttcggaagagcccagcggtgcccaagagcgggaacgctggcaatcgctcaacgctttagtcgatctggtgaaagaccttgttaaagccacaccagatttggatctcacaggcttgctgctgaaacttcgggaacgccaagaggcgaagcatccgccgaccgtcgaaggtgtcaccttggcatcgctacacgcggcgaaaggcctcgaatgggatgcggtgtttcttgtcggacttgtcgattccacgttaccgatcagccacgccattaaatctggcgatgaagcaatcgaagaggaacgtcgcctgttctatgtcggtgtgacccgtgcccgcgaacacctccactgcagttgggcactcgcgaggcaagaaggcggacggaaatcgagaaagcggagtcgattcctcgatggcatagtcgtggagatggcctccgaatcgggcacacctcgcagcaatcgtccgaaaaactgccgagtgtgcggatcggttctttcaagccctgccgaaaaagctgtcggtcggtgtgcgagttgcccgatccaagcggatgaacgagtcttcgaacagctgcgaacgtggcgcaatgacaccgcgaagcgcgaaaacaaagcggcgtacatggtgttcagcaatgcaacgttgatggcgatcgctgaaatgaaccccaccaacgaaaacgaattgctcagcgtgccgggtgtggggccgatgaagatcgagaactatggcgatgacgtgctcgcgattttgggagcactt

SEQ ID NO: 870 - DNA, 591 bp, Corynebacterium glutamicum
gtgtgtcatctgaaaaatttcccccaaaacttaatcgacacagttacttcatctggccttatttcatcacagttacaatcatctgtcatgcaggaaaagccagagatgccagcgattgaggtcatccgttcagcgaaacgcaccaaaactgttcaagctcgaattgtggacgggcaaatccaggtgcgcatccctgcgaggatgtctaaagcggaggaagaaaaagcggtgggggagatcgtcgcaaagctaaagcgacgcacccaatcggccgtctcaagcgacgctgacctgattgagcgcgcccataagttgaacaagactgtgttggaggggcgggcgcgggtggaaagtattcggtgggtgagtaatcagaaggggcggtgggggtcgtgcacggtggcgactgcggagattcggatttcggatcgtttaaagcacgtgccggattatgtgttggatgcggtgttggtgcatgagctgacgcatacgtttattgcggggcattcggcggagttttgggagtgggcagacaaaacgcccctggcagagagggccaagggctatttggaggcgtatcagcggtggggc

SEQ ID NO: 871 - DNA, 816 bp, Corynebacterium glutamicum
ttgggggaaatttttcagatgacacacatcgctttagccaactctgcccaagttctgatccgcccggattctgcgattcaattcggcatcgacgccacccgcgctggcgtcttaaatatcgatccatcgctgtcgtcgcgagtcgtcccggtgctgcggaatctgcggaccgcccgaccgatcgttgatgtcatcgccgacctcacgactgcaggcctcgcacccaccgctgcgagcagtttgctcgaggaccttttagaattcggtgtggtccgcgaatcggcggcggcgcaggtgttgctgttcggggacggttcgcttgtcgacgtcacctccttccttttggaaacctccggctttgttcccagaccccagatcatcgatgagtcgcctcgagagtttttcgagcttccctccagccacattttggttctcaacaagctcgcacattcccaacgtctatccccgctgcttcacaaatatgcgccgacgtatctgtgcgccgcgatcgtcgataatcgtggcatcatcggcccgggccggagatcacgatcggggccgtgtttgatgtgtgtggatctgcatcgctgcgatatcgatccgcattggctctctattatcaatcagcaacccaacggtcccacctttcctgatcccgtcacggagatggcgacggctgcccgactcgtcgcctgggtcactgccgatacatggttgcccggcgttgtggaggaagtaaacccccacgatcgaacaaactcggtacgcaccctccctgtgcatccaaaatgtccgatgtgttggagtttaggttcc

SEQ ID NO: 872 - DNA, 603 bp, Corynebacterium glutamicum
atggggtcgaagtcttcgccgtcggattcgccgaggagtgcgtcgatgaattcggctggtttgtcgatatcttcggcggttgggaggaagtcggggtggttccagactgcgtcgcggcgttctacccctactgcgttttcgactcggcgccacagttcggctgcttcggagaccttcggtgcgccgagctcaatgccgactacctgggagaatgcttgttctgcggatccgccggttgcgcggcggcgcttccaggcttcgttcatggcgtcggtggatgggatgcgttcgctcagggcttgggtaactacgatgtcgacccagccttcgacgagtgcgaggagagtttccaggcgggatactgcgttggcgttgcgggatccgatgcgtggggacaggtccataccttggagttcgttcatcatttcctggaggcgttcaggatctgggttgtccatttggaagttgcccatggcctcttggatgtgtgaggtgtcgatttctaggccgacggcgtattcctcaacggaggaaacgaggcgctcgacaagccacggcacgtgcttgaagaggcgttggcgggcggcttcgcgggcacagatg

SEQ ID NO: 873 - DNA, 1446 bp, Corynebacterium glutamicum
ttgccttgtagattggtaaatatgaactctaatggctttggtttctcttttggcaacaacgatgacgacgatgacaaaaaccgcaacaacgacccattcggccttttcggtggcaacttcggattcggaggacaaggtggcgctggtggccccggcggattaggcgatattttaaaccagttcggccagatgctgtccggaatgggagattcgatgaactcccccgaagcagcaggcccggttaattatgatttagcagcacgcatcgcccgccagcagattggtcgcgtagcgccggtgaaggattctgagaaggaagcagtcgaagagtcccttcgccttgctgaactctggctcgataacgccacccagctccccacttccgggcaccgcgtcgaagcgtggaatccagaaaactggttagaaaacaccctgcctgtgtggaagcgtcttgtctcccctgttgcggagcaaatgaacaaagcccaattagaaaacctccctgaagaagcccgcgagatgatgggcccgatgtcttctttgatgaactccatgtcttcgatgaacttcggagttcaattaggaaatgcgctgggcgacctcgcaaagcagaccctcaccggctctgacttcggtttgcctatctccccagtcggcgtatctgccgtcctgcccggcaacatcgccgaagcatccaaaggcctcaacgtggcaccgcaagaaatgctcgtttacatctgtgcccgcgaagccgcccgccaacgcctcttcaagcacgtgccgtggcttgtcgagcgcctcgtttcctccgttgaggaatacgccgtcggcctagaaatcgacacctcacacatccaagaggccatgggcaacttccaaatggacaacccagatcctgaacgcctccaggaaatgatgaacgaactccaaggtatggacctgtccccacgcatcggatcccgcaacgccaacgcagtatcccgcctggaaactctcctcgcactcgtcgaaggctgggtcgacatcgtagttacccaagccctgagcgaacgcatcccatccaccgacgccatgaacgaagcctggaagcgccgccgcgcaaccggcggatccgcagaacaagcattctcccaggtagtcggcattgagctcggcgcaccgaaggtctccgaagcagccgaactgtggcgccgagtcgaaaacgcagtaggggtagaacgccgcgacgcagtctggaaccaccccgacttcctcccaaccgccgaagatatcgacaaaccagccgaattcatcgacgcactcctcggcgaatccgacggcgaagacttcgaccccatcgcagaaatcaccgccctggaaaaactgcttgcggaagaggcagagaagaaaaacgattccgaagatgattccgaggacgacggttctgaaggaacctccgacaagaac

SEQ ID NO: 874 - DNA, 1050 bp, Corynebacterium glutamicum
gtgaatcgccgaatcaagactctgacgtggggtgctatccctttggtgctgctggcatcgttggtaagcattgaccatattccgggaacaaacatcaacttgagcgtgccttatgccgctgaaggcccaggtcctacgatcaatacgcttggtcaggtcgacggcgaggatgttgtgtccatcagtagtgctgatctggatgagaccgaaggtaacctgaacatgaccactgtgtcggttcgttccggcatgacattgtcgcaggtaatttcccgatggctgtttaccgatgacacaatcgttcccatcgagcaggttttccctcccggccaatccaccgaggaagtcgaagaatccaaccgcaccgcgttcatctcttcggagtcttccgcaacgatcgccgcgatgaattacctcaacattcccgtcgaagttgaagttgcagaagtcctcaccgacagcgccgcaaccggaattttcgaacccggcgacaaacttctcagcatcgacggcaccgcaatctccactcccggcgatgcacaaaccatcgtgcgatcgaaagctcccggcgatgagatcacgatttcctacgagagaaacgatgcggaatctcaagcaaccatcactttgagggaacacccggatgattcttcggtggcgttgttgggtatttcaatgttgtcggtgccttcgagcgcgattgaggttgattacaacttggaagatatcggtggtccgagcgctggcatgatgttttcgttggcggtcgtcgataagctttcgcctggcgcgctgaatggtggcaagtttgtcgctggcactggcaccatcgcggaggacgggtcggtgggcccgattggcggtattgcgcacaaggtgcgcgctgcggaggacgcgggcgcggaagtgtttttgagccctgcggacaattgcgcggaggcgatgagtgcgaagcctcaggatatgacgatcttgaaggtggattcgttgtctcaggcaatcgatcagatggctgcctacaacgagggctctgatttccagacgtgtggc

SEQ ID NO: 875 - DNA, 675 bp, Corynebacterium glutamicum
gtggcgtccaccccgcacaagcatgtccgcgttgcactgggattagtggcgctcattcctcttttagctgcatgtacgggcggcggatccaccgaaacttccactgaatccacggcagaaacaactcctgcgacaacaacggaagcaacgacaactcctgctaccactgcttcgtcttcagtaattgaaacgacagagtcaagcactgccgaaacgtcgacgaaagagagtggggagacgtcgacaagcaaacctcgtatgaccaaggacgttgaagtcgcctataaagctttctcctcgctcgcgcccgtcgagctttttgagcaattcgaaacctgcgacccgtcaggggtcgaggattccttcgcgtgcaacgggccggaagttggccaattccaattctttgacaatgcgtcgaaggccacgagcacgacgcagctgctcacggaactgcgcagctcacgcgtggttgaggattccggatccaaggttgtgggctggaccacgattggcacgatgtcgattatcacggtcgttgataatgaccaaggcctagtgctgcagcaaatggtgtcctccgacaaaatcgatccggaggaacgcatctacgaacttgggctgtcgacaccgaaggacactgaagagtcctcggaagaaacctcagcgtctaaaaac

SEQ ID NO: 876 - DNA, 522 bp, Corynebacterium glutamicum
atgaacgattccatttttagtccccaagcactgaataaagcgatgctcgaagccgtcgagtttatccacgccgaaggttgggacgccggccctaccctgttcgcattggtccccactgaaatgctggtggatactcttgatgaggcagctgacgactccccactaacccttgttgtacaggacaacctccctgacaacttgctgccaggttccgaagcgttaggtgactatgtgtcccgtttggcgtggccagcagagattgccggcgcggtgttggctcaggaaattatgttcaccgatgctgccgttgcaggctcagaaccacgacccgctcgtcttttttccggcgttttgcgcggcgaagcagaactcacccttctgcagcttcgccccaccgaagaggaattggcagaacgcggaccgtttgctgaagatgaaatcgaactgcgcggcggcccaggggttgcaccgggtgtaatcgcagcactgcgctacaccctcgaagcggacccagacgaaatc

SEQ ID NO: 877 - DNA, 2955 bp, Corynebacterium glutamicum
ttgtcgactggtctcacacctcctccccaaccgatcaagcgacctcccaaggcggtgacatggatcttcgccattatcgcgttggtcattctcatcgccccaatgagtgttggcttctataccgactggctttggttcggtgaagtcgatttccgaggcgttttcagcaaggttattgtcactcgcattgttctctttgtgatctttgcgctaattgctgggtttgtcacatggcttgctggttattttgtgacaaaacttcgacctgatgagatgtcggcgtttgatacccagtcgcctgtgtatcagtaccgtcagatgatcgaaaacagccttcgtcgcgttatggtgatcattccaattttcgtcgcgttgctggctggcctaattggtcagcgttcgtggcgcaccgttcaaatgtggctgaatggccaggactttggcgtttcggatcagcagttcggcttggattatggattctacgcgtttgatcttccgatgcttcgcctcatcgctgactcactgtcgatgatgttgatcgttgctttcctgatcgcactcgttggccattacctcatgggtggcattcgcgctggaaaccagatgacgggccagaagtcctttgtatcccgtggtgcgcgcactcagcttgcggtaactgctggtctgtggatgcttgttaaggtcgctggctactggctggatcgctatgacctgctgactaaggaaaactcaaccttcacaggtgcaagctacaccgacatcaatgcacagctgccagcgaagatcatcctgctggttatcgcattgttcgtggcgatcgcgttcttctctgcgatcttcctgaaggacctccgcatcccaggtcttgccgtagttctgatgctgctgagctctgtgatcattggtgctgcttggcctttgatgctggagcgtttctccgttcagccaaaccgtgcagaaaaagaagccgagtacatttctcgaaacattgaatcgactcgctatgcctatggcatcaccgatgaagatgtcacctacgaggaaaactggggagcaggggagaccaccaatgaagaagtcgccgctgattctgcaacgatttctaacattcgtctgctggatccacagatcctgtcaccaaccttcacccagcaacagcagctgcgaaacttctacggtttcccagaccagctggcgatggaccgctttgaagtagatggcaaactccgcgactttgttgtggcagcacgtgagctcgatccaaacgccctgcagcaaaaccagcaggactggattaaccgtcacactgtttatacccacggcaacggcttcattgcagctcaagcaaaccaggtggatgaggtcgcccgcgacgtcggatccactcgtggtggttaccctgtctacaccgtctctgatttgcagtcgaatgctcgtgctgcagaaagcgaagatgctgaggagcttggcatcaaggttgatgagcctcgtgtgtactacggaccactgattgcttctgcgactgatggtgctgactacgcaattgtcggtgacaccggcgatggcccagtcgagtacgacactgacacctccagctacacctacgaaggtgctggcggcgtggacattggaaacatggtcaaccgtgcgatgtttgcattgcgctaccaggaaatgaacatgctcctgtctgatcgtgttggttccgaatccaagatcctatttgagcgcgatcctcgttcccgtgtggaaaaggttgcaccttggttgaccactgactccaagacctacccaactgtgattgatggtcgcatcaagtggatcgtcgatggctacaccaccttggatagtcttccgtactccacgcgcacctcactgacggaagcgactcaggatgctgtcatgcctgacggcaccccacagccactgatcacagatagggtcggttacatccgcaactccgtgaaggctgttgttgatgcgtacgacggaactgttgaactctacgaattcgacaccgaagatcctgttctgaaggcatggcgtggcgtgttcccagacaccgtgaaggacgggtcggagatttccgatgagcttcgcgcacacctgcgttacccagaagatttgttcaaggtccagcgtgacatgctggccaagtacaacgttgatgattctggaacattcttcaccaacgatgcgttctggtctgtcccaggtgacccaactgcagcggagggccgccaggaacttaagcagcctccttactacgtggtggcagcagacccagagaccggtgagtccagcttccagctgatcaccccgttccgtggacttcagcgcgagtacctctctgcacacatgtctgcgtcgtctgatccagttacctacggtgaaatcactgttcgtgtgctgcctaccgattctgtgacccagggtccaaagcaggcccaggatgcgatgatgtcatctgaccaggttgctcaggaccaaacactgtggcgtggatcgaacgatctgcacaacggaaacctgttgaccttgccagttggtggcggagagatcctctacgttgagccgatttactcgcagcgcaaggatcaggcatcggccttcccgaagcttctgcgcgtgctggtcttctacaagggtcaggttggttacgcaccaacgatcgctgaagccctatcgcaggtcggcattgatccgaaggaagcgcaggacatcgaagaggtagatggcaccgctacgacgccatcgactgatgagactgacactgacactgatcagcctgcaaccgaaaccccaactgcaccagtgagtgaggcggaaggaatcgcggccatcaacgatgcgttgagcaaccttgaagctgctcgcgatagctctttcgaagagtatggtcgtgcactcgatgcgcttgatcgtgccgtcgatagctaccagtccgcacag

SEQ ID NO: 878 - DNA, 1359 bp, Corynebacterium glutamicum
atgcttgccgaccttcccatcgccttaaacccacacgaaccaacatccatccccacgcagctcacagaacagatccgtcgtctcgtggcgaggggaattctcaccccaggagacccgcttcccagcagtcgctcactatccacccaattgggggtatcccgcggcagtgtggtgaccgcttatgaccaattggccggtgaaggctacctcagcaccgcccgcggttccggtacaacgatcaacccagatctgcatttgttgaagcctgtggaaattgagaagaaggagacgtcgagaagcgtcccgcccccgctgctcaacctgagccccggcgtgcccgataccgcgacgctcgccgattccgcatggcgcgctgcgtggcgcgaagcctgcgccaagccacccacgcactcccctgagcagggacttttgaggctgcggatcgagatcgccgaccacctgcgccagatgcgtggcctcatggtcgagccggagcagatcatcgtcaccgccggcgcgcgcgaggggctgagtctgctgctgcgcaccatggatgcgcctgcccgcatcggcgtcgaatcgcccggctaccccagcctgcgccgcatcccgcaggtgcttggccatgagacgatcgatgtgccgaccgacgaatccggcctcgtaccccgcgcgctgccccacgacctcaacgcgctactggtaacccctagccatcaatatccctacggcggctcgctgcccgccgatcgccgcaccgcgctagtcgcgtgggctgaggcaaacgatgcgttgcttattgaagacgacttcgattctgagctgcgctacgtcggtatgccgcttccgccgctgcgtgcgctggcgcccgatcgcacgattctgctcggcacgttttcctccgtgatcacaccacaagtcgcctgcggatacctcatcgcgccgacgccccaggcgcgcgtgctcgccacgcttcgcgggattctcggccagccagtcggcgccatcacccaacacgcgctcgcgtcctacctcgcctcaggcgctttacgacgccgcacccaacgtttgcggcgcctttaccgacaccgccgctccatcgtccaagacaccctcggtgacctcccgaatacgcagcttcgccccatcaacggtggcctccacgcagttctcctttgcgacaaaccccaagacctcgtcgtcaccacactcgcctcccgaggccttaacgtcaccgcgctttcccactactggggcggcaccggcgcagacaacggcatcgtcttcggcttcggctcccacgacgaagacaccctcagatgggtgcttgctgagatcagcgatgcggtgtctctaggc

SEQ ID NO: 879 - DNA, 951 bp, Corynebacterium glutamicum
gtgactgaaagtggatctaccgctagtccactttgtggcgttggatcatctgtcatgaccgaaactcaagaaacttaccaagcaaccactcgtgtgaagcgcggccttgccgacatgctcaagggtggtgtgatcatggatgtggtcacccctgaacaagcgcgcatcgccgaagatgcaggtgccagcgcagttatggcactcgagcgcgttcccgccgatatccgttctcagggcggcgttgctcgcatgagtgatcctgacctgatcgaaggaatcgtcaatgcggtctccatcccggtcatggcgaaagctcgcatcggtcacttcgtggaagctcaggttctggaagctctcggtgttgatttcatcgacgagtccgaagttctcagccctgccgactacacgcaccacatcaacaagtggaagttcgacgttcctttcgtctgtggcgcgaccaacctcggcgaagctttgcgacgcatcaccgaaggcgctgcaatgatccgttccaagggcgaagccggcaccggcgatgtctctgaagctgtccgtcacctgcgcaccatccgcggcgacatcaatcgcctgcgctccctggatgaggatgaactcttcgtcgccgccaaggaattccaggcaccatacgacctggtccgcgaagtcgcctccaccggcaagctccctgtggtcaccttcgttgcaggtggcgtcgcaaccccagccgacgctgcactcgtgcgccaaatgggcgccgaaggcgtctttgtcggctccggcatcttcaaatccggcaatccagccgcccgcgccgcagcgatcgtcaaggctgcaacgcttttcgacgacccctccgtcattgccgacgtatcccgcggcctgggtgaagccatggtgggcatcaacgtatccgacgtcccagcaccacaccgactcgccgagcgcggctgg

SEQ ID NO: 880 - DNA, 345 bp, Corynebacterium glutamicum
atgcccaccatggcttcacccaggccgcgggatacgtcggcaatgacggaggggtcgtcgaaaagcgttgcagccttgacgatcgctgcggcgcgggcggctggattgccggatttgaagatgccggagccgacaaagacgccttcggcgcccatttggcgcacgagtgcagcgtcggctggggttgcgacgccacctgcaacgaaggtgaccacagggagcttgccggtggaggcgacttcgcggaccaggtcgtatggtgcctggaattccttggcggcgacgaagagttcatcctcatccagggagcgcaggcgattgatgtcgccgcggatggtgcgcagg

SEQ ID NO: 881 - DNA, 600 bp, Corynebacterium glutamicum
gtgatcgttggagttttagctctccagggcggggtggaagaacacctcaccgccttggaagctctcggagcgacgacccgaaaagtacgtgtgccaaaggaccttgatggtctcgaaggcatcgtcatccccggcggggaatccaccgtgttggacaaactggctcggacattcgacgtggtagaacctctagcgaatctcattcgcgacggcctacccgttttcgctacctgcgctggcctgatctatctggcgaaacacctcgacaacccagcaaggggacaacaaaccttggcggtagtggacgtggtggtgcgtcgaaacgcatttggcgcccaacgcgaatccttcgacaccaccgtggatgtttccttcgacggtgcaacattccccggagtgcaggcctcgtttatccgagctcccatcgtcactgcttttggtcctacggtagaagcgatcgctgctctcaacggtggggaggtggttggtgtacgccaaggcaacatcatcgcgctgtctttccatcccgaagaaaccggcgattaccgcatccaccaagcctggctggacctggtgagaaaacacgctgaactggcgatt

SEQ ID NO: 882 - DNA, 363 bp, Corynebacterium glutamicum
atggattcaagtctaggcagtgttgtactgatgctattttcggtagtccttatagcagttgtctgcatttcaatgacacgcatggcagcacaggcgaaattagataggcatagctcggcaggaattcgctcccgccacactcaagcttccaacgctgcttggaaagagggacactccgctgcattgccacttatttatacgattggatgggtcgcagcgataacgaccccaattgcaattgctaccgaactagctctcggtactccctggggtattctctctgacttggccggaatgctgtgcgaggttgctgtcttgctcttagccacgagagtcgctaacaacgcggcccgatcagtcata

SEQ ID NO: 883 - DNA, 1062 bp, Corynebacterium glutamicum
atgcgcagaccggtctcacgccgcgccatttttgcaacatctgttttggttgcgggggtgagcatcatgtcaccttcggccaacgcagctgaggctccggcatcggaatgggtgaatacgacagcgatcgtagatcaagcgaatgctcagttgtcgcagtttggcgtgagtcttgaccgaagtgcagcagaactttttgatgatcaggcaaactcccaaattgatgcagcgctttcaccgtatgccgataaggttccaacctctggcggccaggtagtcgagcaaagtcttcaggttgtggagcaggaagttcaaaaggcactgcccaactatgaaatccgtaccgatctgcaatcccaggtgatgggtgcaactctaggagaggtgctgcaccgagttcctggatcatggtttgatgcgccagcagttcctgaagaatccaggattgtagaggaacagggtaaatccctgtatgggcccggtaccccgatctatctcaacggaaattccatgtgcacgcttgcggtgactggaactgatgcagatgggcgcaagatcggtatcactgcaggtcactgtggaaaatcgggcgatgcagtccgttcggctgactccttctgggtcggcgataccggaacagtggtgtacaacgcgcctaacgctgactactccgtgatcgagttcggttccaatgcagagttgagcaatacctacaacggtgtcaccgcgaatgctgtcggcggtggcgtgactaatggccaagaagtatgcaaaaacggagttgctactggctacacctgtggtttggtgtggactgctgatgagcgcatgacgatgtctcaggtgtgtgcgggtcgtggtgattcgggtgctccgctgattgcagatggtcgtgtggttggtcttgtatctggtggtgtaattcctgattacaacctggcatgcgccactccgttgcagggacctttcttcatgccaacgctgtcagtgaacatggatactgtcctaactgatttggattcgcaggatcttcccggtcgaggttttcagccaactgctgga

SEQ ID NO: 884 - DNA, 501 bp, Corynebacterium glutamicum
ttgactctgtgtcggagccgaaaaaagagcttggatcgcttgtttaaatctaagcttcgtttagttcttgccgggcactttttgaacgcggatccatcggcgatggcttcaattttcgatgtggattttgaatctggtgttattagttccgtcattagggcacgtgagcttacgttggatgacttctctttgggctgtgttacgcctttggttgcttttgtgggttgggagtttcctcaaggggttgagccgtgtttaccggtgaaggttgagcagtcgatcatttatccgcgtactagtgagggggtaggtgcttctcaaggtgaagggatgggtgatgctgattttgaagggttctctggtgcgtggtgtgctggtctggagctctacctggctctgaagctgggtgctcgtgtgacatgtcagatggggtattcgctggaaggtctcactcgtatggtcagccctcgatgtctttacggtctgcgcttcggcaaatgg

SEQ ID NO: 885 - DNA, 585 bp, Corynebacterium glutamicum
gtggtgtgctggtctggagctctacctggctctgaagctgggtgctcgtgtgacatgtcagatggggtattcgctggaaggtctcactcgtatggtcagccctcgatgtctttacggtctgcgcttcggcaaatggtaattgatcgatctgctgctaaagagattttcggtagagggtctttggaagagctcacgattaagattgcgacgaatgctggttatgggaagctctctcaagatgttgctcctcgttcaggctggaatgctttcgaggagactatggagtctattggtggttctgcggttactagtccttatcatgctgccatgactacaagcttggttcgtgccttgcttttggctatctcaaatgagattgagattcttagtgttactactgatggtttcattaccagggaatctaacattgaggctcttgagtgttgtggcattgctgatgtatttcgtgattcgcgtggtgcgctgacaggtgaccggacggtgtgggagatcaagcatcttcaagatgatttgctgaatttcacaactagcgccaatatctcaccttcatatgaaggtggagga

SEQ ID NO: 886 - DNA, 1581 bp, Corynebacterium glutamicum
atgaaactgttttctcaagctgcaggtatcatcgccgcagcgctccttgtcacaggtggtatagcgcctgtggcacaggggcaagcgcttcaggtggttacacctgagcagcaagagtcctatgtccaacagttccatcacgacggtgataccccacctgttgttgatggggttggtggctacaccgagcaagaagtcgccgagattcatgaggctatccgtcaagcccaagactctggtgcacctaatgatgaacttattcctggtgagatgtggtcagataaggtcgagttaccctcaacgattgataaagcagctgctgatgaagctgagatagctattgcacagcaacagtcccaaccccaggcgagaggactagccgctgctgcagcgtgtcagacattttggccgtcaccttatcaagtttgtggtgctatcttagagcgctatatccagcagggtgcccagtttgggtggatgttgttgcttactgaaggccaagcgcttaaccctgatggtcagggatatcgtcagcggtttatgaatgggtttatctattggcatccttctactggtgcgcacgcggttaataattacagtgcacaagtctgggagcgtaacggttgggagtctgggtggatggggtatcccactggtggtgaagtccctgtgtctgggtctaatccgattgatggtgagttgagtgggtgggtgcaaaccttccaaggtgggcgagtgtatcgcagtccggtattggacggtttccaggtggccagtattaatgggctgatcttggataaatggcttgaattgggtggtcctgatagtgaccttggttttcccattgcggatgaggctgtgacagctgacggtgtgggtagattttctgttttccagaacggagttgtctactggcatccgcaacacggagctcaccctatattagggaatatatacagtatctggagagaagaaggagctgagagtggggaattcggttaccctatcggcgatccagaaaagtatacagaaaacatggctaatcaggtattcgaaaaaggcgaacttgcagctaacctataccccaatcctcttgaggcttttattgagtttttaccctttgctaatcttgaggaagcaatagagtattttgagaacggattgtcaaattctcgtgtagaggcgaattcacttaacgccaagaaagattcgattcaatgtcaatcgcaatccgctaacattcatgtgagaacgaagagtgacggagtcgggattagggttccaaagattgggtttaaggctaggatggattgcgaccttcctggaactgtctcagatgtagtggggtatggatggatttactacgactattggggacgatgggctcaagcagcatatgcacaacaattcttcggtaataggaattctgttgtgcaaaccaatttagaggcgggttgcagcggggagaagaatacattattttggggtacttcatattttcaggtgacttatgaaggtcagccgtatttcggtcagtcagcaactaactacgcttatcttccgtgtacgatagaccgtagt

SEQ ID NO: 887 - DNA, 429 bp, Corynebacterium glutamicum
atgtattccgacaagctgattctcttgttcctttctgagcaggattcaagctatgaatgctgcgtaggtttattagatggctcagatggacttgattatattgaaaagcttctgaagggtaggaagctgaagaaccattttcttgaatgggaagatattaacaaggctgatgttgctcgtgaagaaatatataaagggcaattggtgcatctggtgtttgtgacggctctttccacgcctggtgaaatttcttttgtttttccaggtcaatctcttatgagtgcaacactcgaagaagactttgctgcgcttgtgctcgaagaggagcgcacatcatttagacctgaactgtctcacctgtggtcactccccgtagggtgggtagctccggggcttgagggtttcgtggagcgtaattccgaggcagct

SEQ ID NO: 888 - DNA, 510 bp, Corynebacterium glutamicum
atgatgaaggaacgacgaatcaagactttggcagccttagtaatctgcggcctgactgtttcaggatgcggcaattatttgggagacattaatgtcaaagggcgcgctggtttttcagtatctgaagcaggtgatctcattgttcgtgtacaaccatgtgggttgcctattgatacagtagacatggccggcccaatgccacaggatcaaccaccccaagcaaacccggtgtatcttcaattgagtgatcccgacggtcgtactgatcctttcatagtagatcctgaaaacttagacccgagctgggcaattatagcaggtgacggcctgccaacagatcctgatgcactcatcatcgttaatgcgcatgtcgagggtgagagtactcaaacctcacaggtgtcagcgtatgttagggatgttcaggggttgaggacagatcaaatctatgtaggtacccttgaaagctcacgaatagttgacgagagtacttttcttcattgtcgcaag

SEQ ID NO: 889 - DNA, 222 bp, Corynebacterium glutamicum
atgacacaaatcggtattcacgcagacaacaccccgtactgcataaattcagtacggggtgttgttttcaggattgaaaaagacttacgcgacactaaactacatcgctactctcatcaacaagggtgtgctgcactggtgaaaatcctcaatagtctgcaagatgagaagtcctttaatcgcaaccatgtctatctcaaggccacatggttggaccacgat

SEQ ID NO: 890 - DNA, 309 bp, Corynebacterium glutamicum
atgattgatatgtgcaccactcctcgacaagagatcatgatccgcgagcaatttaaggagatcaacaacggtagggttgtacctcattacgatcagcttgaacagctcgcagagattttttcaactaaagactcaatcgacatggtcaacgagatactcaatcgcgatacggattttctcagtaatgaaggcacaatttttatggaatacattttcaacggtggattccatacggacaacggctatcaaccgttgtcctatgcatatgttgaacgaggcttagcgatccgccctccacgcatagtgctc

SEQ ID NO: 891 - DNA, 780 bp, Corynebacterium glutamicum
atgagcaaatatgcagacgatttagccttagccctcgaacttgccgaacttgccgattccatcaccctcgaccgcttcgaagcctctgacctggaagtatcctccaagccagacatgactcccgtcagcgatgccgacctggcgaccgaagaagcactccgtgagaaaatcgccaccgcccgccccgccgactccatcctcggtgaagaattcggtggcgacgtagaattcagcggccgccagtggatcatcgaccccatcgacggcaccaaaaactacgtccgcggcgtccccgtatgggcaaccctgatcgcgctgctcgacaacggcaaacccgtcgcaggtgtcatctccgcacccgcactggctaggcgttggtgggcatccgaaggggccggcgcatggcgcaccttcaacggcagctccccacgcaaactgtccgtgtcccaggtgtccaagcttgacgacgcctccctctccttctcctccctctccggctgggccgaacgagatttgcgcgatcagttcgtctccctaactgataccacctggcgactccgcggctacggcgacttcttctcctactgcctcgtcgccgaaggtgccgtcgatatcgccgctgaaccagaagtcagcctctgggatcttgctcccctgtccatcctggtcaccgaagccggaggaaagttcacctcactggctggcgtcgatggaccacacggtggcgatgcagtagccaccaacggcatcctgcacgatgagacgctggatcgtttaaaa

SEQ ID NO: 892 - DNA, 819 bp, Corynebacterium glutamicum
atgatcaaaaccatcacaaagaccttcgtgattgctcacgatcaggattctgatgagcatcttgcgcaggcactggtgtacaacgctggacgtttggcatggcgcatgcgcgaaaacggtgtggatacggattacaagacttctgtgtctgatgtggtcacggatgccgatcgtgcggccgaggccttcgtcgcaggcgttcttgaagcgttgcggcctgaggacggcgtgcttggcgaggaaggcgcggaccgggcgtcgaaaagcggaaaaacctgggtcatcgacccggttgatggcacctacaacttcacccagggctcagattattggtgctcggcgctcgcgctggtcgagggcgatccatccgcgccatcgcgcgtgcttttcggcgccgtacaccgcccagccatgggttatacgtggttcggtggcccgggaatccgcaccacgctcgacggcaaggagctagatttgcttgtcgacgcccccctcaatcaaatctccctggccacctacatccacccgtcacgcatcgcggaacctgatattcaaaaggcgtggatgagcgttgccacccaccctgcaacgctgcgcatgttcggcgccggctccatcgatttggccaacatcgccgacggcagcatcggcgcatgggtgcagcacagcgtcgcagattgggactggctacccggccgcgcactcatcgaaggcgtcggcggagcatgcatcaaagtgaccgccggcggcgtcgaatggtccgttgcaggaaacgcggaagcagttagtgagatctccgaaactttaagcgcactagac

SEQ ID NO: 893 - DNA, 1104 bp, Corynebacterium glutamicum
atgcgtcccgaattttctgcagaactctccgagctagacagcacgctgacaaccattgaaaaagtgctgaacccgcaagagatgtctgaccgagtcagagaacttgaagctcaagcagctgacccgtctctgtgggatgaccctgaccatgcacagcaagtcacctctgagctgtcccacgtccaggcggagctgcgcaaaattaccgatctgcgccagcgcatcgaagatctgcccatcatggtggaactcgcagaggaagaagacggcgatacctccatcgcggaagaagaactcgccgatctgcgttctctgatcgatgcgttggaagtaaagaccatgctgtcgggtgaatatgatgctcgcgaggcagtgatcaatattcgatccggtgccggtggtgtcgatgctgcggactgggctgaaatgctcatgcgcatgtacacccgctgggcggaaaagaacggccacaaagtagatatttacgatatttcctacgccgaagaagccggcatcaaatccgccaccttcgtggtccacggcgactacatgtacggccagctctccgtggagcaaggcgcacaccgcctcgtgcgcatcagtccttttgataaccagggcaggcgccaaacctccttcgccgaggtagaagttcttcccgtggtggaaaaagtggactccatcgacatccctgatgccgatgttcgcgtcgatgtctaccgctcctccggcccaggtggtcagtccgtgaacaccaccgactctgccgtgcgcctgacccacatcccaaccggcatcgtggtgacctgccaaaacgagaaatcacagatccaaaacaaggcatccgcgatgcgtgttctccaggcaaaactgcttgagcgtaaacgccaggaagaacgcgccgaaatggatgccctcggagctggaggcaatgcatcctggggtaaccaaatgcgttcctacgtgctgcacccttatcaaatggtgaaggatctgcgcaccaactttgaagtcaacgatccgcaaaaagtccttgacggcgatatcgatggccttttggaagcaggtattcgctggcgaatggctgagagccagtcggcggaa

SEQ ID NO: 894 - DNA, 687 bp, Corynebacterium glutamicum
gtgatcaccttcgagaacgtcaccaagaactacaagacatcaacccgccctgcattagacaatgtgtccctacacattgaaaaaggcgagttcgtgttcctcatcggcccatccggctccggaaaatcaaccttcctgcgcctgatgacgcgggaggaaaacgtcagctccggatcgctgacactggctgattttcaggtgaacaaacttcgcggcacgcaagtaaacaaactgcgccaacgcatcggatatgtgttccaagatttccgactcttaaaaaacaagaatgtctacgacaacgtcgcattcgcattggaggtcatcgggaagaagaaggacaagattcaagaacttgtccccgaaactctggaaatggttggccttgccggaaaagccaaccgcatgcccaacgaactatccggtggtgagcagcagcgcgtggccatcgcccgagctttcgtgaaccgcccactcgtcttgcttgctgatgaaccaaccggcaacctcgaccccgatacctccgatgagatcatgattttgctcaaccgcatcaatcgcctcggcaccacggtggtcatgtccacccacaacgcccgaactgtcgacgacatgcgcaggcgagtaatcgaactgcaattgggcaaactagtccgcgatgatgcccacggcgtctacggcgaaatgcga

SEQ ID NO: 895 - DNA, 264 bp, Corynebacterium glutamicum
atgtcgtcgacagttcgggcgttgtgggtggacatgaccaccgtggtgccgaggcgattgatgcggttgagcaaaatcatgatctcatcggaggtatcggggtcgaggttgccggttggttcatcagcaagcaagacgagtgggcggttcacgaaagctcgggcgatggccacgcgctgctgctcaccaccggatagttcgttgggcatgcggttggcttttccggcaaggccaaccatttccagagtttcggggacaagttct

SEQ ID NO: 896 - DNA, 900 bp, Corynebacterium glutamicum
atggcttttggatatgtactgcgtgaagctgttcgcggcatgggccgcaacgtcaccatgaccatcgcgctcatcatcaccacctctatttccttggcacttcttgccactggatttttggtgaccaacatgaccgaccgcaccaaggacatctacctggatcgcgtcgaagtgatgatccaactcgatgaggacacctctgccaacgatcccgaatgcaccgcggagtcctgcaccgaagttcgtgatgtcttagaaggactcgacggcatcgattccatcacctaccgttcccgcgaggcctcctacgaacgattcgtagaagttttcaaagatactgacccagttctcgtcgctgaaacctctcccgacgcattgccagcagcgttccacgtccgacttgaagatccacttgccgttgagattctcgatccggtccgcgatcttcctcaagtaagcaacgtgatcgaccaggtggatgatctgcgcggagcaaccgaaaaccttgactccatccgcaacgccaccttcctcatcgcggctgtgcaagttttggcatcgatcttcctgattgccaacatggtgcaaatcgctgcattcaatcgtcgtgaagaaactgaaatcatgcgcatcgtcggcgcatcgcggttctacactcagggaccattcgtcttcgaagcgattctatccaccctcattggtgcggttttcgccgtcggcgcgctcttcttgggtaaagaactcgtcattgataaagcactccgcggactctacgattcccagctcatcgcaccagttaccaccacagatatttggctggtcgcaccgataatttccggcattggcgtggtgatcgccggcattatcgcacaactcaccctgcgcttctacgtgaggaaa

SEQ ID NO: 897 - DNA, 492 bp, Corynebacterium glutamicum
atggccaagaagaaaaagaaagtcgacgaaaacaactcagttctcgcgaccaatcgcaaggcccgccatgactaccacatcattgatacgtgggaggcgggcgtggtgctcttaggcaccgaaatcaaatcactgcgcgaaggtaaggtatccctcgtggattcctttgccaccattgataacggagaaatctggcttcagcatctccacatcccgcagtattccatgggctcctggacaaaccacacgcccaagcgcacccgcaaacttttgctgcaccgcaacgagattgattccctgatgggtaaagtccgcgacggcaaccgcacgttggttccgctcaagctttacctcaaaaacggtcgcgtcaaactcgaactcggactcgcacaaggtaagcaggattacgacaagcgccaagatatcaagcgtcgcaccgaagaacgcgaagtcacccgtgagctcggccgtcgcattaagggaatcaacgcg

SEQ ID NO: 898 - DNA, 351 bp, Corynebacterium glutamicum
atgagtattcacatcgcaaaagtccacgacgtcctcaaaggtgaaaaaacctacggaaccaccattttggtggatcggctctggccacgcggtgtgaaaaaagacgaccttgagccagacctctggctcaaaagcgtcgcccccacaaccgaactccgaaaatggttcggccacgacccagctaaattctccgaattcagcacccgttacaccgaagagctcaacgccagcaacgacaaagacctagagacgcttgtcgacgccacctcccgccaccccgtaaccctcctctacggtgctgccgaccgcgaccacaaccacgccattgttctagccaagtggctaaagaaa

SEQ ID NO: 899 - DNA, 537 bp, Corynebacterium glutamicum
gtggccgaaccattttcggagttcggttgtgggggcgacgcttttgagccagaggtctggctcaaggtcgtcttttttcacaccgcgtggccagagccgatccaccaaaatggtggttccgtaggttttttcacctttgaggacgtcgtggacttttgcgatgtgaatactcatttacgcgttgattcccttaatgcgacggccgagctcacgggtgacttcgcgttcttcggtgcgacgcttgatatcttggcgcttgtcgtaatcctgcttaccttgtgcgagtccgagttcgagtttgacgcgaccgtttttgaggtaaagcttgagcggaaccaacgtgcggttgccgtcgcggactttacccatcagggaatcaatctcgttgcggtgcagcaaaagtttgcgggtgcgcttgggcgtgtggtttgtccaggagcccatggaatactgcgggatgtggagatgctgaagccagatttctccgttatcaatggtggcaaaggaatccacgagggataccttaccttcgcgcag

SEQ ID NO: 900 - DNA, 300 bp, Corynebacterium glutamicum
gtgcttgcccttccatcctctatcatcgaccccctctggtgccagttcgccgcgctgatcccacccgtgaccgacacccacccacttcggtgccaccgcccacgcatcccggaccggatcatcttcgacaagctcatccaggtcctcgtcctcggcgcctcctatgccaagatcgccgacacgacatgctcggccaccaccttgcgcacccgccgggacgagtggatcaccgctggcatcttcgagcagctggaacagatctgtttggaattctacgaccgtatcgtcggactcgatctc

SEQ ID NO: 901 - DNA, 405 bp, Corynebacterium glutamicum
ttgatgctcaccgagcaactttttcggcaccaggtagggatagacagggcgcttcagtcggcgcacaatgcgacaattcgagccaatccgaacttagagatcgagtccgacgatacggtcgtagaattccaaacagatctgttccagctgctcgaagatgccagcggtgatccactcgtcccggcgggtgcgcaaggtggtggccgagcatgtcgtgtcggcgatcttggcataggaggcgccgaggacgaggacctggatgagcttgtcgaagatgatccggtccgggatgcgtgggcggtggcaccgaagtgggtgggtgtcggtcacgggtgggatcagcgcggcgaactggcaccagagggggtcgatgatagaggatggaagggcaagcacgagtgctcc

SEQ ID NO: 902 - DNA, 825 bp, Corynebacterium glutamicum
atgtccacagctctccccgatcagctcaagtgggaatacagtgccttccccgtgcagatctcgcagaagcaacggcttagtcccggcttcatgcggatcaccgtcactggtgacaagctccgattctttggccagtggggtttggaccaacgcatcaaactgatcattccaagcccggctgggaacatcccagatttcggaattctcgacgaacccactcccccaccgacaacgtggcttcctcgtgctaagtcttttccagcggaccaacgaccgatcttgcgcacctacaccccatctgcggtccgacccgaactatgcgaagtagacattgatatctatcttcacaacccttcgggaccagtatccagatgggcaaagaactgcagtgttgacgatgaactaatcatcaccggccctgacgtacgcgcaggagaaaccggctacggaatcacctatcatccgacttctgcgatcgatcgcctctgtctcatcggcgattgtgcatcagctcccgcgatcgcaaatatcgtcaatcaatcaaaagtacctactacggttttcctccacgtagacagcctagaagatgatgtattgatcgccgatagctccaccaagctcactttcgaagacatcgacgcttacaaagcaaaggtcttccaatgggcttcagccaatgcagcagatccttcagtacacttctggatcgccggtgaaactagcatggtgcgcttcattcgcaaagaactaatcaacagctaccgagttgattcctcacgaatcactttcctcggctactggaaatacggccgacgaaccgtagac

SEQ ID NO: 903 - DNA, 918 bp, Corynebacterium glutamicum
atgtcatctcgcagaaaactctcctccgcactgatcgtgcttctcgcagcagcactacctcttactgcttgttcctccagctcagaagaggaagcatccaccagctctgcgactcgcgaattcacagacgctcacggaacaaccgaagttcccgaaaatcctcagcgcgtcgttgtcctcgagccacttgagctagacaccgcaatcgccctcggaatcaccccagtgggtgcagctgtcgccaacaacgtcactggtattcctgcatatctcggcgtcgatggaatcgagcctgtcggcaccgtttctgagccaaatatcgaagcgatcgctgctctcgagcccgacctgatcctgggcaccgattcccgccacgccgaaatctacgaccgcctcgaatccatcgccccaaccgtgttcatgacaacccatgttgatccgtggaaagacaatgtcgtcttcatcggcgatgcattgggcaagaagcaggaatccgaggatctcatccaaggctttaatgacaagtgcgaagagatcaagtccgagcatgatgtcgaaggtaagaccgtcaacatgattcgtccccgcgacgagcaaaccatgagcctatacggcccgacctcatttgccggcagctctttggagtgcgcaggactcaccattcctgatcaggaatggaaggatgacctccaggccgacatcgctcctgagaacttcatgctcgccaccgccgactacgtctttgtcaccgcaactgatgtcaccgatgaaaatgagctccccgaagtaatccgagaaaaccgcgaacagttcccatcactcacccttgtcgataccagctactgggtatctggcgtcggtccacttggcggcagcaaagtcttggaagacatcgatgccttcctcgacgcacagcaa

SEQ ID NO: 904 - DNA, 588 bp, Corynebacterium glutamicum
gtgtctaccgaaatccacaacgccccacccaaggccccaacttggcttggctgggtgctcatgatcggcggaataatcggcctcattttgtcggtgatcatcatggccgaaaaacttgccatcctcgaggatcccggtcacatcaccagctgcgatttcaatgcagtcctagcttgtggcgatgtcatgcgttccggccaagctaacgcgttcggcatcccgaatccgctcatcggcatcgccggtttcgccgctgtcgccatcatcggcgccggcatcctcgcgggcggcgggttccgcggttggttctggttcggcgcccaggccggactcacttttgccatgatgttctgccactggctcgcctaccaatccatgtccgtcatccgcgcgctctgcccttactgcatgggcgtgtggaccgtatcgatcatcatgttcgtgctggtcactgcatggaatgtgaaaactttcagcggctccgacagcacgttcgtcaacgcactgtacaaatacaagtgggtcatcgcgatcgtctggctgctgctcatcgcagccgcagctgtgtggtcattccgctacatgttc

SEQ ID NO: 905 - DNA, 1014 bp, Corynebacterium glutamicum
atggtgaaaaaccgattcaagctagtttcaatcgcaactgttgctgccctggcgctcgttggctgctcttccaccgacagcacctcttccgagtcttcttccgctgcagagtcaaccgctgcagctagcaccctgactatcgaagacaaccacggcaccgaagggatctccctgccaatcgagggcgtcgctgcgaccgacaaccgcgcattcgaactgcttgatcgctggggtgtagagctcgttgcagctccacttcagctggttccatttaccgttacgggctacaccgaagagggcggcgtcgctaaccttggctcccaccgcgagccagacctggaagcacttgctgctgcacagccttccctgatcatcaacggccagcgcttcgctcagtactacgatgacatcattgccctgaaccctgacgcaaccgttgttgagctagacccacgcgatggcgagccacttgaccaggagcttatccgccaggctgaaaccctcggtgagatcttcggcgaagaagaagatgctgcaaagatcgttgctgatttcgagtccgcacttgagcgcgctaagaccgcatacgcagcaatctccgaccagaccgtcatggcagttaacgtttccggcggaaacattggctacatcgctccttccgttggacgcacctacggcccaatcttcgacctggttggactcaccccagcactcgaggttggcaacgcgtcctccgaccacgagggcgacgacattaacgtcgaagcaatcgcagctgcaaacccagacctgatcctggtcatggaccgcgatggtggcaccagcacccgcaacgaagctgattacgttccagcagagcagatcgtctccgacaatgaagcactggcaaacgtcaaggctgtcaccgacggatacgtttactacgcacctgcagatacctacaccaacgaaaacatcatcacctacaccgagatcctcaacggcatggcagatatgttcgagaaggcagctcag

SEQ ID NO: 906 - DNA, 999 bp, Corynebacterium glutamicum
atggcaacaccagcatcggctcccacttccgaaccacgtctcaaacgcaccagagccaagctttttgattggaagcttctcatcggcatcattttcgtcgccggcctcgtggtgctttccctcctcaccggccaatacgacattttcggtggcgatgatggccaactgatgttcgaggcagttcgcatcccgcgtaccgtttccctcattttgtccggtgcagcaatggcgatgtgtggcttagtcatgcagctgttgacccaaaacaaattcgtggaacccagcaccacaggaacaaccgaatgggcaggtcttggcctcctcttcgtgatttacttcgtgccagccgcgaccgttttggatcgcatgctcggtgccgtggtgttttccttcatcggaaccatggtgttcttcctctttctacgccgagtaacactgcgttcctcattgatcgtcccgattatcggcatcatgctcggtgccgtggtgtcatcgatctccagcttcttcgccttgcaattcgacatgctccagcaattgggaacatggtttgcgggttcctttaatacagtgttccgcggacagtacgaagtgctgtggatcgttgtcatcgtcgttattgcagtgttcttcttcgcagaccggctcaccgtagctggccttggcgaggaaatcgcgacaaacgtgggtctcaattacaaccgcatggtccttatcggaactggcctcatcgccatcgcaacaggtgtggtcaccgtcgtggttggtagcctgccattcctcggactcatcgtgcccaacgttgtgtccatgttccgtggcgatgacctgcgctcgaacctgccatgggtatgcctaaccggcatcgcgatcgtaaccatttgtgacttgatcagccgaaccatcatcgcgcctttcgaaattccagtttcagtaatcctgggcatcatcggcgcagtggtcttcgtgatcatgattgtgaggcaacgtggccgtgga

SEQ ID NO: 907 - DNA, 942 bp, Corynebacterium glutamicum
atggccgcgctgctggtcaccgcgcttgccttcacctggggcctcatttggtacaagaacccgatgcccgttgggcatccggccttcgcgctgattgcagaacgacgcatggagtcggtctttgtcatgctgattgttgcggtttgccaaggctttgcgacggttgcgttccagaccgtcaccaacaaccgcattatcacgccgtcgatcatgggctttgaatctctctacacactgattcatacctccacagtgttcttcttcggcgcaactgcactgctggccaccagaaatctcgaaatgtttgtcggccagctggtgatcatggttcttttgaccttggtcctctacacctggctgctttccggaaaacgcggcgatatgcacgccatgctgcttgtcggcatcatcattggtggcggactcggatccatctccacctttatgcagcgcattctgaccccatcagaattcgatattctttccgcccgacttttcggatcagtaaacaacgcggaaaccgaatacttcccaattgctgttccactagtagtagtggcgtccgtcttgttgctgctaagctctcgacgcctcaacgttgtagggcttggcaaagatgccgcaaccaaccttggaattaatcaccgacgatcctccatttacacactggttctcgtctctgtattaatggcagtatccaccgcacttgtcggaccgatgacattcctcggattcttggtcgcgaccttggcatatcaattcgccgacacttacgaccaccgatacatccttccgatgtccgcactcatcggattcgtcgtactcagcggcgcttactttgtcatgaaccacgtgttccgcgcacaaggcgtcgtgtccatcattattgagatggtcggcggtaccgtcttcctcatcgtcatcctcagaaagggcagactg

SEQ ID NO: 908 - DNA, 753 bp, Corynebacterium glutamicum
gtgattacgttaactaatgtccgcaaggaatactccagcgacgttgccatcggccccgtcaaccttgagatcccagccggcggcatcaccgcgttggtcggcccaaacggtgcaggcaagtcaacactgctcaccatgatcggtcgactcctcggcatcgatgaaggcaacatcaccgtagcctcctacgatgtcacctcaaccgcatccaaagatctggccaagatcatctccatcctgcgccaggaaaaccactttgttaccaagctgaccgtgcgccagctcgtaggtttcggacgcttcccatatagcaagggccggctgacggaagaagacgagggaatcatctcccgctacatcgacttcttcaatctcaccgaactcgaagaccgctacctcgaccagctttccggcggccagcgccagcgcgcctatgtcgccatggtgctgtgccaagagacggactacgtgcttctcgacgaacccctcaacaatcttgatatcgcacactcggtggaaatgatgaaacacctcgagaatgctgcagcccaatttggccgcaccatcatcgtggttcttcacgacatcaacttcgccgcgcgctacgccgattacatcgtggccgtaaagcacggaatgatcgaaaaagagggaacacctgaacagatcatgaaaaacgagatcctttcagaaatcttcaatacagagatcgaagttattgaaggaccacacggcaagattgcttgctaccac

SEQ ID NO: 909 - DNA, 147 bp, Corynebacterium glutamicum
ttgagacagcagggaagtcgttacgccattcgtgcaggtcggaacttacccgacaaggaatttcgctaccttaggatggttatagttaccaccgccgtttactggggcttaaattctcagcttcgccttacggctaaccggtcctct

SEQ ID NO: 910 - DNA, 273 bp, Corynebacterium glutamicum; identical to SEQ ID NO: 87

SEQ ID NO: 911 - DNA, 1209 bp, Corynebacterium glutamicum
ttgaatcctttgcgcaccaatcaatgggggatcaaatatagtagctgcatgagtaatgacttcgtcgtttctaggcttagaccctttggtgaaacgatttttgcaaccatgacccagcgagctgttgaggcgggtgcaatcaatcttggtcagggctttcctgatgaggatggtcctcgtcggatgttagagatcgcgtcggagcagattctcgggggaaataatcagtattcggcggggcgtggggatgcttcgttgagggcagctgtggctcgtgatcatttggagaggtttgatctggagtacaaccctgattcggaggtgttgatcacggtgggggccactgaggcgattacggcgactgtgttgggtttggtggagcctggggatgaagtgatcgttttggaaccgtattacgatgcgtatgcggcggctattgcgttggcgggggcgacgcgggtggcggttcctttgcaggaggtggagaactcgtgggatgtggatgtcgataagttgcatgcggcggtgactaagaagacgcggatgattatcgttaattcgccgcataatccgacgggttcggtgttttctaagaaggcgttgaagcagttggcgggtgttgctcgtgcgtatgacttgttggtgttgtcagatgaggtgtatgagcatcttgtttttgatgatcagaagcatgtgagtgtcgcgaagctgcccggtatgtgggatcgcacggtgacggtgtcgtcggcggcgaaaacgttcaatgtgactggttggaagacggggtgggcgttggcaccggagccgttgttggaggcggtgttgaaggcgaagcagtttatgtcttatgtgggggctacaccttttcagccggctgtggcgcatgcgattgaacatgagcagaagtgggtgtcaaagatgtctaaggggcttgagctcaagcgggatattttgcgtactgcgttagataaggcggggctgaagactcatgacagtatgggcacgtatttcatcgttgcggatattggggatcgtgatggtgcggagttctgttttgagttgattgagaaggttggggtggcggcgattccggtgcaggcgtttgtggatcatccgaagaagtggtcgtcgaaggttcgttttgcgttttgcaaaaaagaagagacgctccgcgaagctgcggagcgtctcaaggggattaagaaacta

SEQ ID NO: 912 - DNA, 639 bp, Corynebacterium glutamicum
gtgcacaacttctccttcgacgtggacgaatcctacgccaagaagaacaacgaaatcctccgcgacgcaaagcgactccagatctcagcactgtgccttggactcatcctcggcggcggagccgtagccgtctacctgttttctaacggagcagtgtggatgtggatgatcgccatcgtcatggtcttcctcgccctgttgagcttcatcatgattcctgtgatcccccgccaaatgggcaacgcacaaacgctctacgatgactacgaactagcccccgccatcatcgcagaagtaaacccccgcgatgtggtcctcctggcactcgtcaaccgcaatgtgaaccccgaagccaaaccagagtgggcattggccacccgcacgatcgttcgcgtcggagcacacgaacgtcgcctcggcgaacgtatcccatccgtcgcaatcaccggccgacgcaccgtcaaagaccaagaccactgggatgaaatcagccccatgccaattacctggggcaccacggacaaagacatcatccgtgaagccgagaaaactatcccccacgaactctgggccaaactagaaaagaaccgcggcaagttggaggacgttaaaaagacccccaacaacctgttcaaacta

SEQ ID NO: 913 - DNA, 1671 bp, Corynebacterium glutamicum
gtggcttttggcgatggacctttaatcgtccaatccgataagacagtcctgctagaaatagatcacccccaagcaggcgaagcacgcatagctctagcaccttttgcagagctcgagcgtgcacccgagcatattcacacctaccgcatcacccctctggcgttgtggaacgcgcgcgccgcaggccacgacgccgaacaagtcgtggacatgctggagcgtttttcacgcttccccgttccgcaagcgctcctgatcgacatcgcagagacgatgtcccgctacggacgtgtgcgcctgcaccgtcaccccgcacacgggctgatccttgaatctggcgaacctgcgatcctggtggaaatctcccggcacaaaaagatcaaacccatgctgggcgcacaagtggatcctgaaaccatcgtggtccatccgtcagaacgcgggcgcctcaagcaggaactgctcaaggtcggttggccagcggaagatctcgcgggatatgtggacggtgaatcccaccccattggtctctccactgaatttgaagactggtcgctgcgcgattatcagcaaatggcagccgattccttctgggaaggcggttccggcgtagtcgtgctgccttgtggcgcgggtaaaaccatggtcggtgcagcctccatggctcgcgcacaggcaaccaccttgatccttgtcaccaacaccgtggccggccgacagtggaaagacgaacttcttcgccgcaccacactcaccgaagacgaaatcggtgagtactccggcgaacgcaaagaaatccgacccgtcaccatcgccacctaccaagtagtcaccaggcgtaccaaaggcgaatacaaagctctcgagctttttgattcccgcgactggggcttaattatttacgacgaagtccatcttcttcccgcccccgttttccgcatgacctccgacctgcaatccaggcgacgcctcggactgactgccaccctcgtgcgcgaagacggacgagaaggcgatgtcttcagcctgatcggccccaagcgttacgacgcaccatggaaagacctcgagtcccaagggttcatcgccaccgccgactgcgtagaaatccgatccaccatgaccgatgctgagcgcatggtgtacgcgactgccgagtcggcagatcgttaccgtctagccgccactgcccacactaaggtggccgtggtgcgcaaactcctcgaagagcacgctggtaagcccacgctgatcatcggcgcatacctcgatcagttggaagaactaggtgcagaattcaacgcaccagtcatcgacggcaaaacgcccaacaaaaagcgtgaagccctctttgatcaattccgttccggctcgctttccgtactggttgtctccaaagtggcgaacttctccatcgacctgcccgaagcatccgtagccatccaggtctctggaacattcggcagccgacaagaagaagcccaacgcttaggccgcctcctgcgacccaagcacgatggcagcgaagcccacttctactccatcgtcagccgcgacaccctcgacaccgaatacgcagcccaccgccagcgattcctcgccgaacaaggctacgcataccgcatcctcgacgccgacgacatcctcttcccactacccaagaaagagcta

SEQ ID NO: 914 - DNA, 2199 bp, Corynebacterium glutamicum
atgaaaaaagactcccccatccccaccctcaaggggtggttggatactcaaagtgatgatcagctctccacaatccttagaaatcgacccgatacggttctccctttaccacctaatttggcctctcttgctgcgcgtttacagctgagggcgtctgcgattcgcgcggtgttgaaactcaatgcgttggaacttggtgtgttggaggccgtggccaaccttggtggtgaactccacccggttactgcccccgaagtggtggaatatttgcatgtggcgttggcagaggatcttccagcgcaagacacgattggtgcggctcttgccacgctgaaaaatttcgcgttggtttatggcgatgaccagttgatgattgctcaggagacgatgcctgcgttgcctgttcattggcggttgcttccggaggtaagtgatcgcgggcagagtgaggaacaggtgagggaaagcgtcgataagctttctgataggcaccgcaaacttttgcacacgcttgcggcctcgggtggcttcggtctgacgcgcgatgcggcgcctgatgcggatccgtcgcggccgattccgcagttgctggcgtcggggttgttggcgcgcgtggatgagcagaccgtgcgcctgccggcgatggtgcggcgtgtgattgagggccgcgagcagctgcccgctcaggtgcgcccaattccgcgcacggcggcgccaggttcgaatgatggcggcattgcagccggccttgaggtggtgcggcacatgcgattgcttatcgacgccctcagccacgttcccgcccccacgctgaaagtcggagccctcggtgtgcgcgtggtgactcgcctgagcaaggaattagaccttgatgagaccgagctggcacgtctactgagtttgggtatggccagcggtctaatccgtaaaggcgtgcccgatccattgcccatggatgatgatggcggcgattacgtcgctcccaccccgctggctgacgaatggatggaatatgatctggcgcaccaattgggcacgttgatgtctggttggtggaagcaaacttacgcgccgtggttggtgggtcgggctgatgataaggacaagccgatccatgttctcagtaaaacaagcatcattgattcgcttcctgatgctcgtgcgaagatcctgtcctctttatctagggttttagtggacaatctgcacgcggatttagcattccattatccccttgcggcgagtcggatgaatcctgacaccatcacacagctggtacaggaagcccagtggatcggagcatattctcaaggcgtgaccgcagcgggtcaggccttaattgatggcgaaaaccctacggaggtaatcaaggctcctgcgccggtggagaatttcatcgtgcaaggcgatttcaccatcatggttccaggaccactaacccctgcgatgcaaaaaaccatggattcgatcgcatcgttggaatcacctggtttggcctcggtgtatcgactcagcgagaaatccatcaggcatgctctggatcttgggctcaccaccccggaaatcttggagtttctcaaagaacattccatgacagatctgccccaatctgtgggctatttgctcagcgatatcgccagaaagcacggcaccctccgaggcggccctgcactgtcctatatccgtagcgacgatcccgctttgctgcattccgcagtggaggcgggcgccgatgtggcgcttcggcagatcgctcccaccgttgcgattgctcaagcacccctgcttcaggtgatcactgtgctgcgtgctgccgggttccaacctgtggcagaagacggcgaaggcgcaagtctgaatatctcgccatcccctgcacgtgtgcccgcagcttccccaccaccagttgttccggcactggatgaaagccgggtacaggcagcagtcaaagcaatccgacgggaaaattcagcatctcaaggaactgtttccacacagccaactctttcggtgctgcaggctgcagtgcgagggcagcgcacggtgacgttggggttcgtcgataagcaaggcgtggccgtgcaccgcgtcgtcaagcctttaaccgtcaacgccgggcaggtggacgctgtggatgaagccacaggtgcggtgcatcgtttcatgttgcacaggatcacagaagtaatagtggataac

SEQ ID NO: 915 - DNA, 219 bp, Corynebacterium glutamicum
ttgttcccagagtttgaaagaatgtatgacatggcaaacgtagagaagaagcacttcgtcgatccggcatggccggagcacaatccagctgacggacacgtcgttactgaactcatctccaaggtcgcaggcgcgtccagcccatggggcgatgacaaggaattcccagtttctgcagaagagaccggatacgttcacccgtacacccggatcaaccgc

SEQ ID NO: 916 - DNA, 843 bp, Corynebacterium glutamicum
gtgcagctagatttagccgacgaaagcgttgtagtaagactcaacctcagctggaacggtgatgccgtactgagcgagggtgccggtgacagcgccgtaggtggacttgatggtgttcaagtcggtggagccaactgcgatgttggctgcaggagcgttgtactcagcaacagctggtgcagctgcagctggctctggggtggaggtggtagcggagaggtcacgctgggttggagcggagttcagtccaagggaagcggagcaagcaggccatgcgccccagccctgaccagccaaggtgcgctctgcaacagcgatctgctgctcacgggttgcctggtatgcgtaggtagcgaactcctggccgccgtaagcagcccaggtgctagcggagaactgcagaccaccgtggtagccgttaccggtgttgattgcccagttaccaccggactcgcactgtgcgaggcgatcccagtcggaatcaggtgcagcagatgcagaaggagccatgatggttgcagcagcaccgaaagcgatggtggaagctgcgagcttggtgaacgcggagctagtcttagtggagtgacgtcccatgaaaagttttcctctcatttgtcgccgtcgaggttagctgtcgggttagagcggaggagttgctctgccagtggatgtctggcttcaccccaaggagttggcctccatgccttcttttgtgaaaagatggtgggtggtttccccgtccctgtctgcaatatggcccacatgaatgcgggagtttgtggtttaaagttctgttgcaccaaggaggttgttcaacttccgaccccagacagggtttggcga

SEQ ID NO: 917 - DNA, 597 bp, Corynebacterium glutamicum
atgagaggaaaacttttcatgggacgtcactccactaagactagctccgcgttcaccaagctcgcagcttccaccatcgctttcggtgctgctgcaaccatcatggctccttctgcatctgctgcacctgattccgactgggatcgcctcgcacagtgcgagtccggtggtaactgggcaatcaacaccggtaacggctaccacggtggtctgcagttctccgctagcacctgggctgcttacggcggccaggagttcgctacctacgcataccaggcaacccgtgagcagcagatcgctgttgcagagcgcaccttggctggtcagggctggggcgcatggcctgcttgctccgcttcccttggactgaactccgctccaacccagcgtgacctctccgctaccacctccaccccagagccagctgcagctgcaccagctgttgctgagtacaacgctcctgcagccaacatcgcagttggctccaccgacttgaacaccatcaagtccacctacggcgctgtcaccggcaccctcgctcagtacggcatcaccgttccagctgaggttgagtcttactacaacgctttcgtcggc

SEQ ID NO: 918 - DNA, 381 bp, Corynebacterium glutamicum
gtgcctgtcggaacagtgaagtggtacgacgcggagcgtggtttcggctttgtctccaatccaggtggtgaagattgcttcgtaggtaagcaagtacttcccaagggagtcaccgaattgcacaagggacagcgaatcgattttgacttcgccgcaggccgtaagggccctcaagcacttcgaataaagattcttgaaactccacgcaggcgtccacagcacaaatacaagccagaagagctcaacggaatgatctctgacctcatcacgcttctagaaagtggagtgcaaccaggccttgccaaagggcaatacccggagcacaaagctggagcgcaggtagcagaaattcttcgcgttgttgcgaaggagcttgagtct

SEQ ID NO: 919 - DNA, 525 bp, Corynebacterium glutamicum
atggcaagccggaagaccaagcgtaaaaacctcattcagattctcagccttatcgttgctgtgttattggtggtgattttgtctgtggtgttccagcaatggtggaacaatcgcccagagccactcccccaagagatctctatctcagcatcttctcccgctggtgaaatcgaggtattcccattcagcatgtgtgaaccaggtgttgaatgcgaagagaacgaggtgccaacgctggaagttggtgctgatgaagagttgcacctgacgattccagaggcaattcatgatcatgactggtacttgttgaccatttatgatgatccggctgcaaatgacgagttctaccacaccagttacgacgccaccgaggcaaccgttcctggttctgtggatccaaccgaagagggtgcggagcgcccacgtctggtcgtagtggaagtgtccgctgtgatgatcggtgaggatgaaaatggtgaggaaagcccttacaccgtcacgtggtcgctatccacgatgaacgag

SEQ ID NO: 920 - DNA, 774 bp, Corynebacterium glutamicum
gtgaaaaagcttgcatccatagcgatcctctccagcctccctttggcttcgtgttccactcctccaacagattcagaggctgtcgttgagcatctggttccagaaattatctccacccactcttttgattccacctcgtttactcaggggttggaattagatggcgacgagctgattgtgggaactggccaatacggtggttcccgaatctatcgcagctccgttgatggccaggaatctgtttcccaatcgcttgatccagaattcttcggtgaaggcatcaccaagtctggtgatgccatctggcagctgacatggaatgaaggtgtcgctttcaagcgtgatgcagatactctcgaggagttagatcgcgtttcatataatggccaggggtggggaatttgctcaactgacgatgccctcatcacctctgatggaagctccaccctcacctttagggatccggaaacctttgcagagaacagcactgtagatgtgacactagacggctctccggttgggaacctcaatgagctcgaatgcgttgatggcgaggtatatgccaatattttcctcgatacagacatcatgcgaatcgatccgaactccggcgaagtcaccgcagtgatcgatgcctcaaatattcctaacaacgccacaccagatacaaacaatgtgctcaacggcattgcacatattccggattccgatcgtttttatatcactggtaagcgttggcctgacctctatgaggttagattcgtccctgctgac

SEQ ID NO: 921 - DNA, 699 bp, Corynebacterium glutamicum
gtggtgaccacaagttttctcatggttgacggacacatccgcaatcttcagggccacatcgatcgcctcgaggcggcagcccctactgcttcacagttccatgatcgcatcatcactcaattgcgtgaagctccgggcagtgttcaggcagctgtcacgattgaaaataaccactataacgtcgagctgcgcccgccccgcaagttaaattcactggtcacccttgatacccacggccaccgcgatgagcgcctacatccaaagattaaaggccacgatatcgcgtggcagaacacggccaccgcaaacagccgccgccagggcgccgatgatggattgcttgtcgacgagtccggccaggtgatcatggctatcaatgcctctctcttggcgattaagggcgacaccgtgtttcattccacgcaccccaggtcgctgccgtctgttctggaatcaacggtcattgcctacctgcaggaacaaggctgtaatgcaaagcctcgagagcaaggcttcaacatcaatgatttgcgctcttcggaagtgtggctggtggattctttgtccggcatccgtcgcgtcgctgcatggctcgaatacggttccaaattcccagtctcagaaacgcgacctgtggcagctttcgtgccgacgttttctgaagtcaatgactacctatggagcactgcacagcaagtg

SEQ ID NO: 922 - DNA, 138 bp, Corynebacterium glutamicum
ttgagttacagtgtgggcgtaggtgaaattggtttgggccactggggtgggtttttggtgggttcatcacttttaggcggtggacttgccccatctggtaggcagatggaaaaattctgttgcgctaaaggtttcagc

SEQ ID NO: 923 - DNA, 1473 bp, Corynebacterium glutamicum
ttgaggtatccggcaatgacgtcagggaaatcaacgagtactaggggagccctagaccggtatttcaaaatctcggagcgaggatcaagcattggcacggaaatccgtgcaggtgtggtcacattcttcgcgatggcctacatcatcatcctcaaccccttgatccttggcaccacccctgacgtagagggcaacaccctaggcatcgcacaggttgcagcggcaacagcgcttgccgctggtgtcatgaccatcgcgtttggtttgattgcgcgttatccattcggcattgctgctggcctgggaattaacaccatggtcgccgtgacactggtttcaggtgagggcctgacctggccggaagcaatgggacttgtggtccttgacggtgtggtcattgttattttggctgtgtccggcttccgtgttgctgtgttccgtgcgatcccagcatccatgaaggcggccatcagcgtgggtatcggcctgttcatcgccatgatcggcctcgtggatgcaggctttgttcgccgtattccagatgctgccggtactactgtgccagtgactttgggcattgatggttccattgcgtcttggccaacgttcgtgttcgttgtcggtgttcttctctgtggcatccttgttgtccgtcgagttcgcggtggactgtttatcggcattttgggaaccaccattttggcgatcatcgcagaagcaatctttgattccggtgcgtcctttgaaaatggtgaagcaaacgcagaaggctggtcactcgccgttcctggtctcccagactccttcggtggcatcccggatctttccatcgtcggcgcagttgatttgatcggtgcgttcagccgcatcggtgtggtcgccgcgaccttgctgatctttaccctggtccttgcaaacttcttcgacgccatgggcaccatgaccgctcttggtaagcagggcaacttggttgatgatgaaggcaaccttccagacattaagaaggcactggttgtggaaggcgcaggtgccattgtcggtggtgctttctctgcatcctccaacaccgtgttcgctgactcttctgcaggtgttgcagacggcgcacgaaccggccttgccaacgtggtcaccggctccttgttcttggctgccatgttcttgaccccactgtatgaaatcgtccccatcgaagcagcagcaccagtgcttgtagttgttggcgcgatgatgatggggcaggttaccgagattgatttctccaagttctacatcgcattcccagcgttcttgaccattgtgatcatgcctttcacctactccattgcaaacggcattggcgttggattcatcatgtacgccatcatggctgcagcggcaggcaaagcaaagcaagtgcactggctgatgtggctggtcgctggactcttcgtcgtgttcttcgcgattgatcccatcatggaagctgtcggc

SEQ ID NO: 924 - DNA, 912 bp, Corynebacterium glutamicum
atggggacgatttcatacagtggggtcaagaacatggcagccaagaacaaggagccggtgaccacgttggcaaggccggttcgtgcgccgtctgcaacacctgcagaagagtcagcgaacacggtgttggaggatgcagagaaagcaccaccgacaatggcacctgcgccttccacaaccagtgccttcttaatgtctggaaggttgccttcatcatcaaccaagttgccctgcttaccaagagcggtcatggtgcccatggcgtcgaagaagtttgcaaggaccagggtaaagatcagcaaggtcgcggcgaccacaccgatgcggctgaacgcaccgatcaaatcaactgcgccgacgatggaaagatccgggatgccaccgaaggagtctgggagaccaggaacggcgagtgaccagccttctgcgtttgcttcaccattttcaaaggacgcaccggaatcaaagattgcttctgcgatgatcgccaaaatggtggttcccaaaatgccgataaacagtccaccgcgaactcgacggacaacaaggatgccacagagaagaacaccgacaacgaacacgaacgttggccaagacgcaatggaaccatcaatgcccaaagtcactggcacagtagtaccggcagcatctggaatacggcgaacaaagcctgcatccacgaggccgatcatggcgatgaacaggccgatacccacgctgatggccgccttcatggatgctgggatcgcacggaacacagcaacacggaagccggacacagccaaaataacaatgaccacaccgtcaaggaccacaagtcccattgcttccggccaggtcaggccctcacctgaaaccagtgtcacggcgaccatggtgttaattcccaggccagcagcaatgccgaatgga

SEQ ID NO: 925 - DNA, 828 bp, Corynebacterium glutamicum
atgacaacgcgcacggtaatttctgatcccgcagatcctcgtctggatgatgtccgcgatctcaaccattccgattcccggccagacctacccggtggcaaaggccttgttgttgccgaaggtccgttggtggttggtcggcttctggaatcgcgttacccagtgcgtgcgatcgtcgggtttaaaaacaagctggattctttcctcgacagcatcgatgcatcccttgttgaaggcatcccagtgtatgaggtatcccgcgagctcctcgcagaggtcgcaggttttgatatgcaccgcggacttctggcgacagccgatcgcaccgaggaagcaagtgttgcgcaggttctagaaaacgcccgcaccgtggtggtgctggaaggcgtaggcgatcacgaaaacatcggatccatgttccgcaacgcagcaggcatgggcgttgacgccatcttgttcggcaacggttgtgccgatcctttgtatcgacgtgtcgttcgagtctcaatgggccacgtgctccgcctgccgttcgcacacttggaaggcacctacaccacgtggcagcgcagcttagagcagctcaaagaagccggattccacctcgtttcactcaccccagatccagaggcggaacacctcgaagatgcgctcgcaggcaaagacaaagtggctctactcgtgggcgctgaaggcccaggcctgaccgagcatgcgatgcgcgccaccgatgtccgcgcccgcatcccgatggcgccgggtaccgatagcttgaacctggctacctcggcggcgattgcgttttatgaacgggatcgctcacagcgt

SEQ ID NO: 926 - DNA, 876 bp, Corynebacterium glutamicum
gtgctgatgccaagtcaattgggagaaaacgcggcgatcgtcaccctctggtttgttagcgcatccgatccccaatccatcatccgctcggaacctcgggcggatcgtggatatggccgaaaactgttggcacagctcaacccaacgtggccaattacccccatcgggcagttcgccctcaacagatccgttcctgctagtgccaacgagttctacatcgctggttttcccggcatcaccatcattcaaaccgtgttggaagatgtcacctctttatccaagctgaatcctcggttactgcgcagcgtcccggcaacagatgtctacattttcgccgtcaatgaagaaaccacccttggtggcttcgcacacatctacaacggtgagatcaaacgatccttcatcgcctatgaagagcgcgtcttcgaagacaacggcatccccggcggctttgaaaccccctactgggcaggcaaaaaaggcacccggaaaactgcgctgtcgttgcccttcaaccccatcgaactagtccacgaagcacaacgtgcatggctcggattcgacgccaccacctcccctgacatcaacgtcgttgcctatgccaccgatggtcgccccgagccgcgcatcgctgcaccccgcataattaacagcgaggaagtgacaaggtccgccgtcgaaaagctaggactgcgcgaatccgccttctacgacgactacgaagaatacgaggcacccgatcgagtggtgtccaagcgcattacctcaaacgcgaaaaaagcggccagctcagcacagaaatttggtaaatctctgtggcgagccagccgcgaattcgggtcaaacatggcggaaagactccgccacactgaccgc

SEQ ID NO: 927 - DNA, 933 bp, Corynebacterium glutamicum
atgcgggaaatattcctgatcagcggtgattccaccgaatcatccttggttttcaagacctccgaagaggacggcgctgaggaatttttcattgctgtaacagatgaactccacgccattcttgcaggtcatagcgagattaagagcgccccagaacccgaagaacacaaagaggtcccacctcctgttctagagccggtcgctgcggtagaagagccccgtgaggaaaaagaaattgaccctcgtatcagcgctcccctgacgatgtcaccccgcgaaattcagattcgggttcgctcaggcgccaccatcgaagaattagccgaagaaatcggcgtcaccgaagcccgcgttgagccctatgcccaccccgttttgctggaacgtgcccgcattgccgacttggctaagcaatcacaccccatcagggaaaatggtcctgcaaaactgactctctgggaaattcttgcaacggcgtttgccactcgcggccacgatctcaccacagcacgctgggacgcctacaaagacgccaccaaccagtggatcgtgcgagttgattggaaagcaggactcagcgacaactacgcggagtggacgttaaacctgcacaacaccagcaatcccaccgctgatccgcggaccccagtcgcagccgatttgatcgatcctgaattcattcagccggtacgtaccttgacgtccgtaaactccacccaggaacagtacgacgacgaaaccgatgttttcgacaccgtaccaagccctgacgacgcaccagactcagaatccgatgccgttgctgaaatcaccaacgacaacgaacctgaagtcgatgcggaaggcccacgcaacaggcgtcgaaaagcagtaaccccacactgggaagatgttcttttaggagttcgcgcaaacacaaagcgcccgaagaaa

SEQ ID NO: 928 - DNA, 1128 bp, Corynebacterium glutamicum
atgaccgacttccccaccctgccctctgagttcatccctggcgacggccgtttcggctgcggaccttccaaggttcgaccagaacagattcaggctattgtcgacggatccgcatccgtcatcggtacctcacaccgtcagccggcagtaaaaaacgtcgtgggttcaatccgcgagggactctccgacctcttctcccttccagaaggctacgagatcatcctttccctaggtggtgcgaccgcattctgggatgcagcaaccttcggactcattgaaaagaagtccggtcacctttctttcggtgagttctcctccaagttcgcaaaggcttctaagcttgctccttggctcgacgagccagagatcgtcaccgcagaaaccggtgactctccggccccacaggcattcgaaggcgccgatgttattgcatgggcacacaacgaaacctccactggcgccatggttccagttcttcgccccgaaggctctgaaggctccctggttgccattgacgcaacctccggcgctggtggactgccagtagacatcaagaactccgatgtttactacttctccccacagaagtgcttcgcatccgacggtggcctgtggcttgcagcgatgagcccagcagctctcgagcgcatcgagaagatcaacgcttccgatcgcttcatccctgagttcctcaacctgcagaccgcagtggataactccctgaagaaccagacctacaacaccccagctgttgctaccttgctgatgctggacaaccaggtcaagtggatgaactccaacggcggcctggatggaatggttgctcgcaccacagcaagctcctccgccctgtacaactgggctgaggctcgcgaggaggcatccccatacgtggcagatgcagctaagcgctccctcgttgtcggcaccatcgacttcgatgactccatcgacgcagcagtgatcgctaagatactgcgcgcaaacggcatcctggacaccgagccttaccgcaagctgggacgcaaccagctgcgcatcggtatgttcccagcgatcgattccaccgatgtggaaaagctcaccggagcaatcgacttcatcctcgatggcggttttgcaaggaag

SEQ ID NO: 929 - DNA, 1473 bp, Corynebacterium glutamicum
gtggagaagcgttttccgactatggtgtggggcatggaacacacttcagcattgacgctcatagactcggttttggaccctgacagcttcatttcttggaatgaaactccccaatatgacaacctcaatcaaggctatgcagagaccttggagcgggctcgaagcaaggccaaatgcgatgaatcggtaattactggagaaggcaccgtggagggcattccggtagccgttattttgtccgatttttccttcctcggcggttctttgggcacggtcgcgtcggtgcgcatcatgaaggcgattcaccgcgccacagagctgaaactcccactgctggtctcccctgcttccggtggtgcgcgcatgcaggaagacaatcgagcttttgtcatgatggtgtccataaccgcggctgtgcagcgtcaccgcgaggcgcatttgccgttcctggtgtatttgcgcaatcccacgatgggtggcgccatggcctcgtggggttcatctgggcatctcacttttgcggaacccggcgcgcagataggtttcctgggtcctcgcgtggtggagttaaccactgggcatgcgcttccagacggtgtgcagcaggcggagaatttggtgaaaactggtgtgattgatggaattgtgtcgccactccaattgcgtgcagcggtggcaaaaaccctcaaggttattcagccggtagaggcaacggatcgtttttctccaacaactcctggcgtggcacttccggtgatggaggcgattgcgcgttctcgtgacccgcagaggcctggaatcggggagattatggaaacgttgggggcagacgtcgtcaagctttctggtgcgcgtgctggcgcattgagcccggctgtgcgcgttgccctggcgcgcatcgggggccggcccgtggtgctgattgggcaggatcgccgcttcacgcttgggccgcaggagctgcgttttgcgcgtcgtggcatttcgctggcgcgcgagctaaacctgccgatcgtgtccatcatcgacacctccggcgccgaattgtcgcaggcggctgaggagctcggcatcgcaagctcgattgcgcgcaccttgtccaagcttatcgacgctcccctccccaccgtttcggtcattattggtcagggcgttggcggtggcgcgctggccatgctgcccgccgatctggtctacgcggccgaaaacgcgtggctgtccgcattgccaccagagggcgcctcggccatcctcttccgcgacaccaaccacgccgcggaaatcatagagcgacaaggcgtgcaggcgcacgcacttttaagccaagggcttatcgacgggatcgtcgccgaaaccgagcactttgttgaagaaattctcggcacaatcagcaacgccctctccgaattggataacaatccggagagggcgggacgcgacagtcgcttcacacgatttgagcgtttagcgcag

SEQ ID NO: 930 - DNA, 339 bp, Corynebacterium glutamicum
gtgaatgcagaacaaatcacccaggggcgtcgccagccgacggctcaagagtttcgggacatgcaggcgagcccagaatttggagagctccgcagcaagttccgttcctttgctttcccaatgaccgttgccttcttcttgtggtacgtcgtctacgttctggttgcatcctttgcatcagagtggatggcaaccccagttttcggcgcaatcaacattggcctaatcttcggcttccttcagttcgtaaccacattcgtcattacttacatctatgtcatgtttgcgaacaagaacttggagcctcgtcaggctgctattcgccagaagatggaaggt

SEQ ID NO: 931 - DNA, 1653 bp, Corynebacterium glutamicum
atgaattccactattctccttgcacaagacgctgtttctgagggcgtcggtaatccgattcttaacatcagtgtcttcgtcgtcttcattattgtgacgatgaccgtggtgcttcgcgtgggcaagagcaccagcgaatccaccgacttctacaccggtggtgcttccttctccggaacccagaacggtctggctatcgcaggtgactacctgtctgcagcgtccttcctcggaatcgttggtgcaatttcactcaacggttacgacggattcctttactccatcggcttcttcgtcgcatggcttgttgcactgctgctcgtggcagagccacttcgtaacgtgggccgcttcaccatggctgacgtgctgtccttccgactgcgtcagaaaccagtccgcgtcgctgcggcctgcggtaccctcgcggttaccctcttttacttgatcgctcagatggctggtgcaggttcgcttgtgtccgttctgctggacatccacgagttcaagtggcaggcagttgttgtcggtatcgttggcattgtcatgatcgcctacgttcttcttggcggtatgaagggcaccacatacgttcagatgattaaggcagttctgctggtcggtggcgttgccattatgaccgttctgaccttcgtcaaggtgtctggtggcctgaccacccttttaaatgacgctgttgagaagcacgccgcttcagattacgctgccaccaaggggtacgatccaacccagatcctggagcctggtctgcagtacggtgcaactctgaccactcagctggacttcatttccttggctctcgctctgtgtcttggaaccgctggtctgccacacgttctgatgcgcttctacaccgttcctaccgccaaggaagcacgtaagtctgtgacctgggctatcgtcctcattggtgcgttctacctgatgaccctggtccttggttacggcgctgcggcactggtcggtccagaccgcgtcattgccgcaccaggtgctgctaatgctgctgctcctctgctggccttcgagcttggtggttccatcttcatggcgctgatttccgcagttgcgttcgctaccgttctcgccgtggtcgcaggtcttgcaattaccgcatccgctgctgttggtcacgacatctacaacgctgttatccgcaacggtcagtccaccgaagcggagcaggtccgagtatcccgcatcaccgttgtcgtcattggcctgatttccattgtcctgggaattcttgcaatgacccagaacgttgcgttcctcgtggccctggccttcgcagttgcagcatccgctaacctgccaaccatcctgtactccctgtactggaagaagttcaacaccaccggcgctgtggccgctatctacaccggtctcatctccgcgctgctgctgatcttcctgtccccagcagtctccggtaatgacagcgcaatggttccaggtgcagactgggcaatcttcccactgaagaacccaggcctcgtctccatcccactggcattcatcgctggttggatcggcactttggttggcaagccagacaacatggatgatcttgctgccgaaatggaagttcgttccctcaccggtgtcggtgttgaaaaggctgttgatcac

SEQ ID NO: 932 - DNA, 816 bp, Corynebacterium glutamicum
gtggacgtgtcaagaacttctaaggttcacccgggatggcgggtgtctactgtccttttagcaggagtagttattattggcggaatttttactctccctcagaaggaggaagtaaaggtttccgaattgcagccacaggccagcgctgcatccatcccgtcttcatcttccacagctgggaaagcagtggaagaaagccctctaacgcagtttgtggaaaactcgacaggctcccaaattacgtacatgagcctgaaagacgatttccatactggcacgtctacggaacgttttgcgcgcccagcgttaagtttgtctaagctctacatcgctgaatatgtgctcgagcacggcacgaataatgagaagtctttggcgatggaaatgatcaaagattcctccgacgtatccgccgaaatcttgtatgaggcgtacccagaatcaattgaggagattgcggatcaatacggattgctctccacaaggggagacgcgcactggggatactcggtgacatccacttacgatttggtgaaatttgtcagcgctctcattatcgatgatccagattcaccgatccttgaagcgatgcgtaatgccagcgcagtcgcggctgacggttatccgcaagactgggggacagcggtgcttgatgaggcagaaggatccaaatggggatggtctgatgatctcatgctgcactcctctgtgacctttggcgaagactatgttgtggcagctgctgtgactggatcaaaagaagacctcacccaattggtggaaaaccaattgggtgaggttgtgagtcagcacggc

SEQ ID NO: 933 - DNA, 840 bp, Corynebacterium glutamicum
atgcaaataaaccgccgaggcttcttaaaagccaccacaggacttgccactatcggcgctgccagcatgtttatgccaaaggccaacgcccttggagcaatcaagggcaccgtcatcgactacgcagcaggcgtccccagcgcagcatccattaaaaatgcagggcaccttggagctgtccgttacgtgtcacagcgacgccccggcactgaatcctggatgatcggcaagccagtcacactggcagaaacccgagcttttgaacaaaacggcctcaaaaccgcatccgtctatcaatacggaaaggcagagaccgccgattggaagaacggcgccgcaggagcggcaacccacgctccacaggcaattgcgcttcacgtggcagctggtggccctaaaaatcgccccatctacgtggcgatcgacgacaacccaagctggtctgaatacaccaatcagattcgcccctacctccaggcattcaatgttgcgctgtccgctgccggctaccagttaggtgtctacggcaactacaacgtcattaattgggctatcgccgacggccttggagaattcttctggatgcacaactggggatcagaaggaaagatccacccacgcaccaccatccaccagatccgcattgataaggacaccctcgacggagtcggcatcgacatgaacaatgtctatgcagacgactggggtcagtggaccccaggcaacgcggttgacgatgccatccccaccattcctggaaactccaacacgggaacaggtactggaattgatgctgacaccatcaaccaagtaatcaagattcttggcaccctatctagc

SEQ ID NO: 934 - DNA, 8907 bp, Corynebacterium glutamicum
gtgagtatttcttcactgacaccgctgcactctttcaaagagccagcaattctgtacgccggtcaggcttctgcctggcagcaggtgatcgctgattccagcgaagaccacatcaccgcaacgcacctgcgcgagctcctgtctcgctcccgtgcaaagactgcacctttcgctcgccaaatcaccgccatcgtgcctggctcacttgctcgtcttgaggaactgacccgcgaagacgcacaaatcggtgcagacatcgacgcacagcctgccgtttccattccaggcattctgctgggacagatcgctgcaacccgtcagctgcgtgacctcggactcgatgtcgcagcagcttcccgccttggacactcccagggcattttgggcgttgaagcagtagacaatgaagaagacgttttagctttcgccatcctgctgggcgcagcagcttcccagttcgctggcaagggcgcacatatgctctctgttcgcggcctgtcccgtgagatcatccaggacaccatcgctggtgtcgatggggtagaggtctccctgcgcaacgctcgtgcacactttgttgtctctggtaagccagaggcactgaagaaggctgctgctgctctacagcgcgcagctgatgtttacaacgaagacatcaacgaaaagcgcaagggtggatccctggcagagcctaagtttgactacttggatgtggccattcctttccaccactcctccatgcaggacgcagccgacttggctgtcgagtgggcaaccacctgtggcctaaacgtcaacgcgcgcgcgttggcagaagcaattctagttaacccagctgactgggttgagcagatcgcaaacctcaaggctgattacgttctttccctcgatgcaggcgtcagccgtttcaccgctccattgctagacggtcgcggaatctctttggttcctgcgttctccgctgcagagcgcgacaacttggctcgccctggcttccacgttcctaccgctgaggattggtccgagttcgctccaaagctggttaagcttccaaacggtgagcacaaggttctcaccgggttctcccgcctgactggttattccccaatcgtcctggctggcatgaccccaaccaccgttgatcctgagatcgttgcagctgcagcgaacgctggacactgggccgaaatggccggtggcggacagtactctgaagaagtcttcaccaagaacaaggaaaagctcgtttccctgctcaaggttggacgctccgcacagttcaactccatgttcttcgaccgctacatgtggaacctgcagttcggtgcacagcgcatcgtttccaaggcacgtgcaaccggtacctccatcaacggtgttgttgtctccgctggtatcccagaggttgaggaagcaactgagctgatcaacgatctgaacgctgatggcttcccatacgttgcattcaagccaggcaccgtggatcagatccgcgcaaccctgaagattgctgatgcaaacccagagaccaagatcatcatccagatcgaggacggacacgctggtggccaccactcctgggtcaacttggacgatctgctcctgaccacctacgcagagctgcgttcccgcaagaacgttgtcgtcatgatcggtggcggcatcggaacccctgcaaaggctgcttactacctgaccggtgaatggtccaccgatttgggcttcccagcaatgccagtggacggcatcctcgtgggtaccgctgccatggcaaccaaggaagcaaccacttctcctcaggtcaagcaggcactggtcgacaccccaggtgttgatccacacgacgctggcggctgggttggccgtggcgatgctcgtggtggcgtgacctctggtctgtcacacctgcacgctgacatgtacgagctggacaacgattctgctgcagcttcccgcctgatctcttccatcgattctgatgattacgcagatcaccgcgaagagctcatcgaggctatcaacaagaccgctaagcctttcttcggcgaggtcgaagagatgacttacgcagagtggatccagcgttgggttgagcttgcttacccaactcaggacccaacctgggatgatcgtttcctcgatttggttcaccgcattgaagctcgtctcaacgaggcagagcacggcgccatcaccacactgttcccagaccatgcgtctgtggaaaatgaggaagaggccgtcgaaaagcttcttgctgcttacccgcaggcccgcgagatccaggtctctgcgcgcgacgccgcgtggtttattggtctgtgccgcaagcaccacaagcctatgccttgggttccagcaatcgatgctgacctagcacgctggtggggccttgacaccctgtggcagtcccagaacgagcgctacggcgcgaactcagtccgcgttatcccaggaccagtctccgtcgccggcatcgaccgtgttgacgagccagttgcagagctgctcggccgcttcgaagctgcctgcgttgacgctctcgacggcgagccagaagagatcttcgctcgcctcaatgagtccaagaacgagcgcgaattcctgctggctaccccacacatcgtgtggcacggcaacctgatcgacaacccagctcacgtcctcaacgagggtgctttcgagctcatcgaggaggatggctactgggtcatccgtatcctggctgattcctacttcgacgatctgccagttgagcagcgcccatacctggttcagcatgttgacatcccagttgagctgggtgacgctgttgcaaccggtggctccccagttgtttcccgtgagaagctgcctgagtctgtcttcgcacttcttgctggcgttgctggtgttggatctgtttccgctgctggcgatgagatcaaggcacttccagaggcagttcaggacggcaccccattcggcaccgtccgcgattctttcaccctgcctgcatccctgctgaccgcacacaccgcagtcaccggcgcagcgctggaagcacacaacgttggcaccccagacgtcctgatgggcgcttgctggccagcaatctacgcggccctaggcaccggtaagctctccgatggctatccagtcatcgaaggcctgctcaacgcagtccacctggatcaccttcttgatctgcgcatcccactcgaggagctggcaaacggccgcaccatcgatgttgaggcacgcaccgactccatcgaagagtccgcatccggccgtatcgttaccgtgcgcatcgtgctcaccaccgaaggcgaagtagcagccaagctggttacccgcttcgcaattcgtggacgcatcaccaccaacgaaatggctgcaccagcagattcctacggcgcacgcgacgaagttgtcgaggcaacccctcgttccttcatccgccaggcaactgtttctgcacctgcagacatgaccccattcgccatggtttctggtgactacaacccaattcacacctctgacaacgctgcaaagcttgttggcctggacgcagctcttgtccacggcatgtggctgtccgctaccgcacagcacctcgctggtcttggctctgaggtcattggttggacctactccatgtacggcatggttcagctcaacgacgttgttgacatcaccgtcgagcgtgttggccgcgcaggtctgaagcctgcatacgaggtcacctgccgcattgatggcaacgttgtctcccgcggacaggcactgctcaaggctccttccaccgcttatgtttacccaggccagggcatccaggctaagggcatgggccagggcgatcgcaccgcaagcgcagaggctcgcgctgtgtgggagcgtgcagatgcacacacccgcgcaaacctgggcttctccatccagcaggtcattgatgaaaacccaactgagctgaaggtcggggacaccaccttcgtgcacccagctggcgttttgaacctcacccagttcacgcaggtcgcgctcgccgtggttgcctacgctcagaccgagcgcctcaaggctgcaaacgcaattgtcgacggctccctctacgcaggccactccctcggcgagtacaccgcactggcatccttgggcaacatcttcgaactcgaaggcgtcatcgacgttgtgttctcccgcggttccgcaatgcactccctggttccacgtgatgagaagggccgttccaactacggtcttgccgcattccgtccgaacatgatcaacgttgcagccaccgaggtggagaactgggttgaccgtgtcgctgaagaatccggcgaattcctgcagatcgttaactacaacgttgatggccagcagtacgcagtcgcaggtaccttggctggcctgaaggccctcaaggcttctgcatctgcaaacccacgtgcttacgtgaacattccaggcattgacgtgccattccactccagcgtcctgcgcccaggcgttcctgctttcgcagagaagctggacgagctgctgccagagaccatcgacattgatgctcttcgcggccgctacatcccgaacctggttgctcgtcctttcgagctcacccagagcttcgtggatgccatccttgctgttgttccatccgagcgcctcaagggcatcaaggtggaggacaccgacgagaacaccctggcacgtctgctcctcatcgagctgctgtcttggcagttcgcatcccctgtgcgttggatcgaaacccaggctctgatcatcgataccgtcgatcagatcatcgaggtcggcttggcagcatcgccaaccctgaccaacctggcactgcgcaccatggatgtcattggcaagtcccgcccagtattcaacgtggagcgcgaccaggacaccgttatgctcaacgatgttcgccaggcacctgttgctgaggttgaagaagaagcagttgaggaagcacctgcagcagccgcagctccagcagctgaggcaccagttgctgcagctccagtagccgcagccgcacctgcacctgttggaaacgcacctgaactgaagttcaacgctgccaatgccatcatggttctcttcgctgtccagaacaagatcaacattgatcagatcaccgcagcggatacctctgagaccctgaccaacggtgtgtcctcacgccgtaaccagatgctcatggacatgtccaccgagctgtccgtcccaaccatcgacggcgcagctgacgctgacgtagctaccctgcagggacgtgttgtcaccgcagctcctggctacaagcctttcggaccagttctttccgagaccgttcgtgcacgtcttcgcgcactgaccggtgcagcaggtctgaagacctcctacatcggcgatcgcgtgaccggcacctggggacttccagaaagctggaccgcacacgttgaggttgaattgctgctgggcacccgcgaaggcgagtccgtccgcggcggcaacctgggtagcctgcctgctaacgcatccagcaagggcgacgtcgatgcgcttatcgacgcagccgtgcagaatgttgctgcagccaacggcaccagcgtctccatgtcctccggcggtgcagcttcaggtggcggagttgttgattccgcagcacttgatgcctacgcatccaccgtcactggtgaagaaggcgtcctggcaaacgttgctcgcggcatcctgtctcagcttggtctcgacaccaaggacgaggttgaaggcgcagagatcgacaccgaactctacgacgctgtcgaagcagaactgggcaccggctggctgaagcttgtcaccccagtgttctccgctgatcgtgcgatcttgttcgacgaccgttgggcatctgcacgtgaagatctggcacgccttgccaacggcgaggatattgccgtcgagcgctttgctggaacgggggagaccgtcgtcaagcaagctgcatggtgggctgagcacgttgaagacaccgctctcgctgcaaccctgaagcaggtttccgaggtggctgcgaagccagccaacgagccacacatcgacgatgttgcgctggttaccggtgcggctcctgagtcgatcgccggtgcagttgcggctcgcctgctgtcccagggcgcgaccgtcattctcaccgcatcgaacgtctcccaggcgcgtaaggaatacgcacgcaagctctacgctgcgaacgcaacccctaacgcaaagctgtggattgttcctgcgaacatgtcctcctaccgcgatgttgatgcagtcatcgattggatcggcaacgagcagcgcgtcaccgtcggcagcaccgtcaccgtgaccaagccagctctgaccccaacccttgcgtacccattcgcagctccatccgtatccggtaccttggcggatgcaggcccacaggctgaaaaccaggcacgcctgctcctctggtccgtggagcgcaccatcgcaggacttgcagatcttgcatcccgcggtgtcgatggacgcgtccacgttgtactcccaggttccccgaaccgcggaatgttcggtggcgacggcgcttacggcgaagtcaaggctgctttcgacgccatccttgccaagtggggctccgagaccggctggccacagtttgtctccctcgcacaggcacgcatcggctgggtcgcaggcaccggcctcatgggtcgcaacgacgtgctcatccctgccgctgaaaagctgggcatccacgtctacacccctgaagagatctcttccgaactgctgggtcttgcatccgcagaatcccgcgaaaaggctctggaagcaccgatcgattacgacctgaccggtggactttccggtggcgtatccatcgcagcactggcagcatccctcgagtccgacgcagtagagaccacctctgcagcagaagacaccatcaaggcgcttccatcacctaagcacccagagcagccagtgggcacgccagttggagaggtcaagaccgatctcgaagacatggttgtcatggttggcgttggcgaagtctcctcatggggctccggacgtacccgcttcgaagctgagtacggcatccagcgcgacggctccgttgacctcaccgcagcaggcgtccttgagcttgcatggatgatgggtctgatctcctggagcgaagatccaaagccagcctggtacgacgctgacggcaccgaagtgcctgaagaagagatctacgagcgcttccgcgacgaagtcatcgcacgatgcggtgttcgtgagcttgtcgacgacgcattcctcgtcgacggcggctccctcgacgcagctgaagtcttcctcgaccgcgacatctccttctccgtaacctctgctgaagaagcacaggcctacgtcgatgcagatgcttccgtgaccgttgaagaagcagacggcgaatggatcgtgaccaagaagaagggctccacctccttcgtgccacgcaaggcaaccctgacccgctccgtagcaggccagctgccaaccgacttcgaccctgccaagtggggtatcccagcctccatgatcgatgcactcgacaacatcgcagcgtggaacctggtcactgcagtcgacgccttcctgtcctccggcttcagcccagcagaactcctgcagtccatccacccagctgacgtgtcctccacccagggcaccggtatcggtggcatgcagtccctacgcaagctgttcgtcaaccgcttcctcggccaggatcgtccatccgacatcctccaggagaccctgccaaacgttgtggctgcacacaccatgcagtcctacgtcggtggctacggccagatgatccacccagtggcagcatgtgcaaccgcagctgtctccgtggaagaaggcgtggacaagatccgcctcaacaaggcagatttcgttgtcgccggtggtatcgatgacatccaggttgaatccctgaccggcttcggtgacatgaacgccaccgcagacacccaggcaatgctggacaagggcatcgacccacgcttcatctcccgcgcaaacgatcgacgtcgcgcaggcttcctcgaagcagcaggtggcggtaccgtcctcctggcacgtgcatccgttgctgctgaactgggactgccagttctcgcagttgttgcacacgcacagtcctacgccgatggtgctcacacctccatcccagcaccgggacttggcgcactgggtgcagcacgtggtggcaagaagtccgtacttgctcgcgaactgaacaaattgggtctgaccccagatgacgttcgcgtggtctcgaagcacgacacctccaccaacgccaacgatccaaacgagtccgagctgcacaacctgctgtggaagaccattggacgcgaagccgacaacccgatgttcgtcgtctcccagaagtcccttaccggacactcaaagggcggtgcagcactcttccagatcggtggacttgtctccatcctggaaaccggcaagctgccacagaacgcatcccttgactgcgttgacccagagatggaagcaaagggcgagaacttcgtctggctgcgcaagccactggatctcggcgcaggctccattaaggccggcgtacttacctcactgggcttcggccacgtggctgcagtcgtcgtgctggcaaccagcggcatcttcgagcaggcaatgcgcaacgcaggcctcgacgtcgaagcatggcgtgcacgcgcaacccagcgcctgcgcaccggtgcaaaccgcctagaagctggcatggttggccgagcaccattgttcgagcaggtcgacggacgtcgcctgccagagcatggcgctcaccaagcagagatcaacttgcttatcgacgctgacgctcgcctcggtgctgacggcatctaccagggc

SEQ ID NO: 935 - DNA, 489 bp, Corynebacterium glutamicum
atgaaacttctcaagtttgctgcagcaggaaccttcgcactagccctggctggctgcacacagactgagtctctcgtagcaacaatcgaatctgcaacctctgcagcacaggcatccggaaacgacgtagaaggagaccaaacctccgcgttcgaactctccgttggcgaatgcttcaacgacacctacgaagaagaaatctccgaagtacccatcgtcgactgcgcagaacctcacgacaacgagatctactacctctacgacatcgaaggcgacgacttcccaaccgacatcaccaccacaggctacgaaggctgcctcccaacatttgaaggcttcgtaggagctccttacgaaacctccatctacgaggtctacccaatgaccccaacctttggctcctggacaaacggcgaccgcgaggtagtgtgctccgtgtacttggccaccggtgagcagatgaccggaaccgcagcaggaaccgcgcag

SEQ ID NO: 936 - DNA, 186 bp, Corynebacterium glutamicum
ttggttcgagtccacggcggtcaatggaagatcatggccggtgaaagaactgaaaacctccaaatctcacttgtcttttacgtggacttcggagaaaagggaggaacactcccatatgggaccatcaactatttctcagatagccaggatcccactgggctgaaaaggctctttgacatcagtgtt

SEQ ID NO: 937 - DNA, 1047 bp, Corynebacterium glutamicum
atgctcgacaatagtttttacaccgcagaggttcagggcccatacgaaaccgcttccattggccggctcgaactcgaagaagggggtgtgattgaggattgctggttggcttacgctacagctggaacgctcaacgaggacaagtccaacgccatcctcattccgacgtggtactccggaacccatcagacctggttccagcagtacatcggcactgatcatgcgctggatccatcaaagtatttcatcatctccatcaaccaaatcggtaatggtttgtcggtctcccctgccaacacggctgatgacagcatctcgatgtccaagttcccgaatgttcgcattggtgatgatgtcgttgcccaggaccggctcttgcgccaagagtttggtattaccgagctctttgccgtcgttggtggttcgatgggtgcgcagcaaacctatgagtggattgttcgcttccctgaccaagttcatcgagcagctccgatcgcgggcactgcgaagaacactcctcatgatttcatcttcacccagactcttaatgagaccgttgaggccgatccagggttcaatggcggcgaatactcctcccatgaagaggtagctgatggacttcgccgtcaatcgcatctttgggctgccatgggattttccacagagttctggaagcaggaggcatggcgtcgcctgggacttgaaagtaaggagtcagtgctcgcggacttcctggatccgctgttcatgtccatggatcctaataccttgctcaacaacgcttggaagtggcagcatggcgatgtctctcgccacaccggcggcgacttggcagcggctcttggccgagtgaaggctaagaccttcgttatgcccatcagcgaggacatgttctttcctgttcgtgactgtgccgcagaacaagcactcatcccaggcagcgagcttcgagtgatcgaagacatcgccggtcaccttgggctttttaacgtctctgagaattacatcccacagatcgacaaaaatctgaaagagctgttcgagagc

SEQ ID NO: 938 - DNA, 426 bp, Corynebacterium glutamicum
atgctacagagcccgaagagagccatcggcctgtccgccgcattgctcacgctcaccgcgtgtggggcaaacgacgagctttccagttatctcacctccattgagacagctacagctcaagtttccctcaacgacatttacaacgatcaatggtccgaatttgcagtcgtttgcccctacacgccaagtgactatgcgaaggcggaacttgacgtcggagataccccctggccagataagtggccagacgaacaaaccaattttcttctcctaaaaagtgacacgggcgaatacaaatgggtgcgatatcgcaggtcaaacctcgacttttgctctgaaccaaggattgacttcacgctcttccccactgctgcaacgctggaattcaccgctaacgatggctggattctcgagtctgtacaccct

SEQ ID NO: 939 - DNA, 267 bp, Corynebacterium glutamicum
atgaccaggtataagccttcgttccatgatgtgcagcgtcgtccaattgtggtcaatcagatcactaaagatagtgttccagtgctggcggttgatgagatccaagatgatggaacgcctcgccggattatgctgctcaacaagtatgatgccaagcagttgagtgcggcatgtgaccgttatttgcaggagattttctccgcgacatttgcgggagttaatacggatttgtctcccgatgatatggccaaactgtttggtgatgaa

SEQ ID NO: 940 - DNA, 237 bp, Corynebacterium glutamicum
atgagcaacgtaaccatttacgccacagattggtgcccttactgccgatccctcctcaaaggtctcgacggccaagagtacgacctcatcgacgtcgaccaagatgaggaagccggcgagtgggttaagtcagtcaacgacggcaaccgcatcgtcccaaccgtgcgctactccgatggcacccacgcaactaatcccctagctgcggaagtaatcgccaaaatcgaagcattagcc

SEQ ID NO: 941 - DNA, 456 bp, Corynebacterium glutamicum
atgatcggtgcgatttgggcacaaggccgcgacggcatcatcggcgacggcaccgacatgccctggcacatcccggaagacctcaaacacttcaagaaaaccaccatgggccagccggtcatcatgggtcgtcgcacgtgggagtctttgccgttcaagccgcttcccggccgcgagaacttcattctctcctcacgcgagcccggcgactggtccgccggcggcacagtggtcaccgaaatccctaaaagcggctggatcatgggcggcggcgaggtctacaaggccaccgtcggcagcgccgacgttttagaaataacgcttatcgacgccaccttcgatgtttccactcccgtctacgcacccgaaatcccggcgaacttcaacctcgatgacgaatccgagtggtttacctcaggcgagtatcgttacaagttccagcgctacatcaaggtt

SEQ ID NO: 942 - DNA, 798 bp, Corynebacterium glutamicum
atgactgttccaacgccttatgaagaccttcttcggaagattgctgaagaagggtcccacaaggacgaccgcaccggcaccggcactacttctttattcggacaacaaatccgctttgatctcaatgaaggttttccccttctgaccaccaagaaggtccatttccactctgttgtgggtgagcttttgtggttccttcagggggattccaacgtcaaatggctgcaggataacaacatccgcatttggaatgaatgggcagatgaggacggcgagctgggccctgtttatggtgtccagtggcgttcttggccaacccctgatggtcgtcacattgaccagatctcaggtgctttagaaactctgcgaaacaaccctgattcacgtcgcaatattgtctcggcgtggaatgtttccgagcttgaaaacatggctcttcccccttgtcacttgcttttccagctctatgtcgccgatggcaaactgtcttgccagctctaccagcgttctgcggacatgttcctgggtgtgcctttcaacatcgcatcttatgcactgctcacccacatgtttgcccagcaggcaggcttggaagtcggcgagttcatttggactggcggcgactgccacatttatgacaaccacaaggaacaggtcgcggagcagctgagccgcgaagctcgcccctaccccaccttggagctcaacaaggcagcgtccatgtttgagtacagcttcgatgacatcaccgtgtccggctacgatccacacccattgatccgcggcaaggtcgccgta

SEQ ID NO: 943 - DNA, 756 bp, Corynebacterium glutamicum
atgactgctcagattgatgattcgatcctcacccatcgtctcgcccaaggcaccggagaaatcctcaaaggtgtccgcaatgttggggtgttaagaggtcggaatctcggtgatgccggcgacgaactcgcacaaagttggattgctcgagtgttggagcagcaccgccccaacgatggattcctgtctgaagaagccgccgacaacccagaccgcctatccaaggaccgcgtgtggatcatcgatcccctcgacggcaccaaagaattcgccaccggccgccaggactgggcagtacacatcgcactggtagaaaacggtgttcccacccacgccgctgttggcctccccgaccttggcgtggtgttccactccgctgatgcccgcgccgtgactggcccttactccaaggtcatcgccatctcccacaaccgcccaccaaaggttgctctatcttgcgcagagcagctcggctttgaaaccaaggcccttggatccgcaggcgctaaagcaatgcacgttctcctcggtgactacgacgcctacatccacgccggcggccaatacgagtgggattccgcagcaccagtcggcgtctgcaaggcagcaggcttgcactgctccaggctcgacggttccgagctgacctacaacaacaaagacacctacatgccagacatcttgatctgtcgccctgaacttgcagatgaacttctcgagatgtgcgcgaagttctacgaggagaatggaacttac

SEQ ID NO: 944 - DNA, 4560 bp, Corynebacterium glutamicum
atggctaaaagcattctttcccgattccgacctcaagtagcggagtggttccgggatgtctttgcatctccgacccctgttcaggagggaacgtgggaggcggtatctaaggggaagaatgccctcgtggtggcgccgaccggtagtggtaaaaccttggctgcgtttttgtgggcgttagattccctcactgaacaaacaggtcaacaggttttagacacgggaacaccggtgcctgttcgtggtgggaaagtgaaagtgctctacatttccccactcaaagcgcttggcgtggatgtagaaaataatctgcgtgcaccgttgaccggtattgcgaggactgcctctcggatgggtttggatgtgcccaatatcactgtggcggttcgttcgggtgatacgccatcggcggagcgggcccggcaggtgcgtaagcctccagacattttgatcaccactccggagtcggcgtatttgatgttgacctcaaaagcgggggcgaccctttcggatgttgatgtggtgatcatcgatgaaatccacgccatggccggaaccaaacggggagtgcatctggcgttgacgctggagcgtttggaaaagctcgtggggcggcctgtgcagcgagttggtttgtctgcaacggtgcgtcctttggaaacggtggcgggtttcttgggcggtggcagacccgttgagattgtggctccacctgcggagaaaaagtgggatctcactgtcactgtgccggtggaagacatgtcggatttgccggttcaggagccgggatcaactattggtgaactagtcatggatgatccgttggggattactggcgaatcagcgctgcctactcaaggctcgatttggccacacattgagcagcaggtgtacaaccaggtgatgtcggcgaaatcgaccatcgtgtttgtaaattccaggcgttccgcggagcgtttaaccagtcggttgaatgaaatctgggcgatggaacacgatccggaatcgctgtcgccgcagctgcgaagagatccggcgcagattatgtcgtcagcggatgtggcaggaaaagcaccacaggtgatcgcacgtgcgcaccacggatccgtatccaaagatgaacgtgccaccaccgaaaccatgctgaaggaaggtcggttgcgcgcagttatttccacctcctcgctggagttgggcattgatatgggtgccgtggacctggtgattcaggtggaatcgccaccgtccgtggcaagtggcctgcagcgcgtggggcgtgcggggcacacggtgggggcgacgtcgataggctccttttatcccaagcaccgctccgacttggtgcaaaccgcggtgaccgtgcagcggatgaaggaagggctgatcgaagagatccacgtgcccaaaaacgcgcttgatgtactggcacagcagacggtggcggctgtctcgattaaagatgtgcaggtcgatgagtggtacgagactattcgcaaggcgtatccgtaccgggatttggcgcgcgaagtcttcgattccgtcatcgacctggtcagcggtgtgtatccctccacagattttgccgagctgaagccacgtgtggtgtacgaccgggtttcaggcgtgctggagggccggccaggatcccaacgcgtagcagtgaccagtggcggaacaattcccgatcgaggaatgttcggagtcttcctcgtcggcgatggtccccggcgcgtcggcgagctcgatgaggaaatggtctacgaatcccgcgtgggcgatgtgtttacgctcggggcgtcgagttggcggattgaagagatcacccgcgaccaggtactggtcactcccgcgccgggtcacacgggtcggctgcctttttggacgggcgatgccgcaggccggcccgctgagctgggtaaagctttaggcgcttttcgacgctcgaccctcaccgatccatccagctccggcttggaaggctgggcgcacgacaacctgatcgcctttttacaggagcaggaagaatccaccggtgtgttgccggatgagaagacgttggtgttggagcgtttcaaagatgaactaggcgactggcgcattgtcctgcacactccttatggacgaggagtaaacgcagcatgggctttggccgtcggggcgaaaatcgctgaagagaccggcatggatgcgcaagccgtggcaggtgatgatggcattgtgcttcggttgccggaaggggatgaagatcccagcgcagcgttgtttatgtttgaggcggaagagatcgaaacgctagtgacagagcaggtgggtaactctgcgctgtttgccagcaggttccgtgaatgcgccgcgagggccctattgctgccgagacgaaaccccggcaagcgcgcaccgctgtggcagcaacgacaacgagcagcacagcttcttgatgtggccagaaagtacccgagtttcccgatcattttggaaacagtgcgcgaatgtcttcaagatgtttacgatctgcccgctctgaagaatctcattgaggatctacagctgcggaaggtaagaatcgcggaagtcaccacccagcagcccagtccttttgcctccgcattgctgttcaattacaccggtgcattcatgtacgaaggcgacagcccgctcgcagagaaacgtgccgcagcgttggccctggatccggcactgttggcgaaattgctgggtgaggtggagcttcgacaattactggatcccgacatcatcgcagaagtgcaccaacaattgcgcaggcaaggcgatcgtgcggcgagaaacaatgaagaactcgcagattctttgaggattttaggaccgattcctttggatgaattgggcgaacacatcacctttgaaaacccagacctggaggatcgagcaatgactgttcggatcaacggtcgggaacatttagcgcaggtcttggatgcacctttgcttcgagatgccttaggtgttcccgtaccgcctggtgtgcctgcgcaggtagaaaccattacggatgcgttggaacagttagtcaacaggtgggttcgtaccagagggccatttactgcgaatgatttggcagaagcctttggactgggcatcgccacggcgatcaccgcccttcaaagcgcacctgtgattgaaggccgctaccgacaaggcgtggacgtgcaggaatactgtgcgacagaagtgttgtcgatcataaggcgacgcagcctcgcagcagcgaggaaacaaaccaggccggtatcgcaatcagcctttgcgcgattcctgcttgattggcaacagatcgcaccggtgggcgccacacctgaactccgaggcgttgatggcacctacacagtcattgaacaactcgccggtgtacgtcttcccgccagtgcgtgggaagatctcgtgttgccgcgccgggttgccgactattcaccgatccatctcgatgagctgacctccaatggggaagtcctcatcgtgggagcgggccaagccggaagccgcgatccgtggattagcttgctgcccgtggattatgcggcgcagttggtgggggaggcgtcgacaagcatgagcccattgcaggacgccgtgcttgaccagctgcgtgcgggaggcgccttcctgttttctgacattctcgaagagaatttcggctacaccacagcccagctgcaagaagcgatgtgggggctggtggaagcaggcctggtcagccctgatagcttcgcgccgatccgcgcgcgcctagcgtcgggaaccacggcgcatcgggcgaaacgtcgaccagcgagatcccggctgcgcacccgcaccagcttcgcgagcgacgtgcccccagacatgcgcggacgatggacgctgtccgtgcaacccgccgacgccaccagccgctccgtcgcacacggcgaaggctggctcgaccgctacggcgtgctcacccgcgggagcgtcgtcgccgaagacatcgtcggaggcttcgccctggcctacaaagtgctctccggcttcgaagaaagcggcaaagcgatgcgcggctacttcatcgaagggctcggcgccgcgcaattctccacgcccgccatcatcgaccgcctccgcggccacgacgattcccccgacgtcgaaggctggccctccggcgccaccgacccagacgtctacctcatagccgccgccgaccccgcaaacccctacggcgccgcacttccctggcctgagcaggggcccagccgcgccgccggagctatggtcgtgctttgcgacggactcctcctcgcccacctcacccgcggcgggcgcaccctcaccgtgttctccgacaatatccccaaaatcgcgacagccctaatcacatacgaaaggctcacggtagaaaaaatcaacggcgacaacgtcttcgactccccactcctggaacaattccgcaaacacggcgccaccatcaccccgaagggaatgcgatttcgaccaccagtggcacgggaaaccccctcagatacgcttcccaccaggacttttcgtggaggcttcggacggcgc

SEQ ID NO: 945 - DNA, 768 bp, Corynebacterium glutamicum
atgccagaaggtgattccgtattccaactctcccgcaaacttcaattcatgcgcggaagagaagtgctggaaacctccctgcgtgtgccatcagtggcacttcacgatttcaccggtcaaaccgtcaaccgcgtatggccctacggaaaacacctcttcatgcaattcggtgaagagatcctccacacccacctcaaaatggaagggacgtgggctgtccaccgcaaaggcgatcgctggcgcaaacctggacacaccgcgagggtagtgcttgtgctgtcggaaaacatcgaggtggtggggcattccctcggctttgtcagagtgttccccgcaaaccgctactccgaagagatcgcttacctcggccccgacgtccttgccgaagaattcgacatcaacaccgcacggaacaatattgcatcgaacccttcccgaacaattggcgaagccctcctcgaccaatccaacctcgctggagtaggcaacgaataccgcgctgagatctgcttcctcatgggcgtccacccggcgacacaagtaggatacgttgacgtcgaaaaggctctgaagattacccgaagactcatgtgggaaaatcgaaattcgccgattcgagtgaccaccggggttcgacgcgccggggaatccacctatgtgtttgggcgtaacaataaaccgtgcaggagatgccgaaccccaatcgtgaaagccgagttgggggagcgaataatctggtggtgtccgcgctgccaaccgctaaactcg

SEQ ID NO: 946 - DNA, 408 bp, Corynebacterium glutamicum
atgagactaatactcaacctgatttggttattcttcggtggcatttggctcgcgttgggatacgtattcttcggaatcatcgcatgtatcttcatcgtgacgattcccgccggtatcgcaagcttccgcatggctaactacgcgctgtggccgtttggtaggacggttgttcgtaatcctaaagccggagggttttctgccctgagcaacggactgtggtttatcattgctggactgtggctggcgatcgggcacctcaccaccgcggctgcccaggcgatcaccatcatcggaattccactggcgatcgcaaacatccgaatgatccccgtgacgtgtttcccgttcggcaaagaaatctatgacagcaaccgcattcccttcggctacgaaccgatggttaagttt

SEQ ID NO: 947 - DNA, 600 bp, Corynebacterium glutamicum
atgattttggattgggttatctccatcatggaggcactcggcgccgttggcgtgggtgtcgcggtgtttttggagaacgttttcccgccgattccaagtgaggtggtgcttccgctcgcgggtttcaccaccacgcaaggcgatctcaatgtgtgggcggcgcttatgtggtcggtgatcgggtcggtttccggagcgtttttgctttacgggttggggcgctcaatcggggcggcacggttgcggcaggtcgccgactggatgtggcttgtcgacgcgaccgacgtggataaatccctatcgtggttcgaaaagtacgggaagtattcggtgtttttcggtcggttggtgccgggtgtccgaagtttgatttcgattccggcgggcgtcgacaagatgaatccggttctcttcggtgtgctcactgcggtgggcagcaccatttggaatgcggttctgatttggactggtgtgtggttgggggcggaatgggagacggtgtcgatgtggtttgagagctattcaacgatcatttacgtaggtatcgcgctcatcgtggcttatgtgttgtttgttttagtccgtcgccgaattaaaact

SEQ ID NO: 948 - DNA, 1173 bp, Corynebacterium glutamicum
gtgaagaatcctcgcctcatagcactggccgctatcatcctgacctcgttcaatctgcgaacagctattactgctttagctccgctggtttctgagattcgggatgatttaggggttagtgcttctcttattggtgtgttgggcatgatcccgactgctatgttcgcggttgctgcgtttgcgcttccgtcgttgaagaggaagttcactacttcccaactgttgatgtttgccatgctgttgactgctgccggtcagattattcgtgtcgctggacctgcttcgctgttgatggtcggtactgtgttcgcgatgtttgcgatcggagttaccaatgtgttgcttccgattgctgttagggagtattttccgcgtcacgtcggtggaatgtcgacaacttatctggtgtcgttccagattgttcaggcacttgctccgacgcttgccgtgccgatttctcagtgggctacacatgtggggttgaccggttggagggtgtcgctcggttcgtgggcgctgctggggttggttgcggcgatttcgtggattccgctgttgagtttgcagggtgccagggttgttgcggcgccgtcgaaggtttctcttcctgtgtggaagtcttcggttggtgtggggctcgggttgatgtttgggtttacttcgtttgcgacgtatatcctcatgggttttatgccgcagatggtaggtgatcctcagctcggtgcggtgttgttaggctggtggtcaattttgggattgccgctgaacattctgggaccgtggttggtgacgcgtttcactaactgcttcccgatggttgttatcgccagtgtcatgtttctcatcggtaatggtgggttttgtttggctccggatgttgcgccgtggttgtgggcgacgttgtctggtcttggtccccttgcgttcccgatggcgttgacgctcattaatattcgtgctgaaactagtgctggtgcttctgcgttgagttccttcgggcagggtttgggttatacgattgcgtgtttcggtcccttgttgactggtttcattgtcgatgcgacaggcagcttccgaacaatctttgtgctttttgcggttgcaacactcttcgttattagaggcggttactttgcgacaaggcaggtttacgtcgaaaagcttttaaatcgc

SEQ ID NO: 949 - DNA, 717 bp, Corynebacterium glutamicum
atgttgtccgtgtcgataccgaactctgcgaccttttcagcattggtggacactgcgacgaagtgcttcgcgacagcctcttcaccgagcttctctaccagccaagcacgagctgcacgagcgttggacagcgtctcctgggtggtgaaagttttcgaagcgatcacgaacaatgtggattctgcatcgaggtcttccaacacagaaacgaggtctgctgggtcgacgttggagacgaattctgctgagataccagcggtcgcgtatgcacgcagagccttcgtagccatggctggtccgaggtcagagccaccgataccaatgttgacgatcttcttgatcgtgtggccggtgtgtcccaaccagttgcctgagcgcagcgcagtagcgaagtcacgcatgcgtcccaaaacttcgtggacatcagcagcaacatcttggccatctactgacagatcagcttcggcaggaaggcgcagcgcggtgtggaggacagcgcggtcttcggtgttgttgaggtgttcaccggcaaacatcgcgtcaatgcgttcgcgaaggccagattcttcggtcagtgcaaggagcttggtgagggtggcgtcgtcaagcagattcttcgacaggtcgacgtggaggccagccgcggagaaggtgtacttctcggcgcggttttcttccttgaaaagttcacgcagagtggttgcctggaagtttgag

SEQ ID NO: 950 - DNA, 1620 bp, Corynebacterium glutamicum
atggcggacatttcgaccacccaggtttggcaagacctgaccgatcattactcaaacttccaggcaaccactctgcgtgaacttttcaaggaagaaaaccgcgccgagaagtacaccttctccgcggctggcctccacgtcgacctgtcgaagaatctgcttgacgacgccaccctcaccaagctccttgcactgaccgaagaatctggccttcgcgaacgcattgacgcgatgtttgccggtgaacacctcaacaacaccgaagaccgcgctgtcctccacaccgcgctgcgccttcctgccgaagctgatctgtcagtagatggccaagatgttgctgctgatgtccacgaagttttgggacgcatgcgtgacttcgctactgcgctgcgctcaggcaactggttgggacacaccggccacacgatcaagaagatcgtcaacattggtatcggtggctctgacctcggaccagccatggctacgaaggctctgcgtgcatacgcgaccgctggtatctcagcagaattcgtctccaacgtcgacccagcagacctcgtttctgtgttggaagacctcgatgcagaatccacattgttcgtgatcgcttcgaaaactttcaccacccaggagacgctgtccaacgctcgtgcagctcgtgcttggctggtagagaagctcggtgaagaggctgtcgcgaagcacttcgtcgcagtgtccaccaatgctgaaaaggtcgcagagttcggtatcgacacggacaacatgttcggcttctgggactgggtcggaggtcgttactccgtggactccgcagttggtctttccctcatggcagtgatcggccctcgcgacttcatgcgtttcctcggtggattccacgcgatggatgaacacttccgcaccaccaagttcgaagagaacgttccaatcttgatggctctgctcggtgtctggtactccgatttctatggtgcagaaacccacgctgtcctaccttattccgaggatctcagccgttttgctgcttacctccagcagctgaccatggaatcaaatggcaagtcagtccaccgcgacggctcccctgtttccactggcactggcgaaatttactggggtgagcctggcacaaatggccagcacgctttcttccagctgatccaccagggcactcgccttgttccagctgatttcattggtttcgctcgtccaaagcaggatcttcctgccggtgagcgcaccatgcatgaccttttgatgagcaacttcttcgcacagaccaaggttttggctttcggtaagaacgctgaagagatcgctgcggaaggtgtcgcacctgagctggtcaaccacaaggtcatgccaggtaatcgcccaaccaccaccattttggcggaggaacttaccccttctattctcggtgcgttgatcgctttgtacgaacacatcgtgatggttcagggcgtgatttgggacatcaactccttcgaccaatggggtgttgaactgggcaaacagcaggcaaatgacctcgctccggctgtctctggtgaagaggatgttgactcgggagattcttccactgattcactgattaagtggtaccgcgcaaatagg

SEQ ID NO: 951 - DNA, 1176 bp, Corynebacterium glutamicum
atggaggtgccttccttgtttaccaacttcttcgcagtcaacaacccagacagtccgcccgcacgacaaaaaaccaaactcagagaactggaacaccgcttctggcaagaacacctgccaggcgacgacgatgaccattccaccgcaatctccagcctcgccatcgtcacaggtctaacaaaagcgcaggtctcccgcatatccatcgcgtttgccacgctcgccgacttgcccgaactcaaagccctgcaacaaaagctgtaccacctcgacctctcccgactgatcaccattagcaacgaactcgccggcatcaaccccgacaacctcgccggcgccgacgcaatcctcaccgaatacctcaccgccaccagccccaaccagattctgccaagcccggcgtccataggacgcaagataaaagaaataagagatttgcttgacgacgcaagagccaccggttcgcgcggtacccaagacgacagctctttcggagtgaccttctccccagacggaaccgccgaaatcggagcctccgtcgatgctgtggacgggcacatcatcaacgacgccgtcacccaacacgcgaagaaaaacgacctcacctacggcgaagctttcagcgacatccttcggaacaatatccaagtcaaggtagtcctcaacttgtacaccgccaaagacctcgccaacgccccagtgtgggccagcggaatcggctggttggatgccaagactggaacattctggtcagagaaagccaacaaagaacaagacatggatgcggctgccaaaatcagcaccgacaaacacgatcctccaccagcgttgcgtgacgcactcattggtcgtgatggcacctgccgattccctggctgttcagtcccagcgctcaaaacccaagccgaccaccgcatcccctacgaagaaggcggagaaacttgcctaggcggaatcggctgcctctgtcaacaccaccacaacatgaaaaccgacggccgagtcacctaccttctcgatcccttctccggcatcatcgtctggctcatgggagacggaacatgggcagtgtcagaacccaacgggccgctcaatcccaaaaatgcgagatgggcgcaaacagtcgcccaacaccgggcacgccaccacaagcgttgggttaaggaggacgccaag

SEQ ID NO: 952 - DNA, 381 bp, Corynebacterium glutamicum
gtggataacttatccgagttttccgcgtcccatgcgcagcaaaattccagcgagggcagggccttcctcgccgatctcttcacggaattggttgatgattgctacttctcgggtgtgcacgagacgtgttccgcccgagctcatgcgtgtttttccgatggtttgggaaatcttcgtgcggcgtttcaccgcatcgaggatttcgcggtccaagcggttgatctcctcgcgatacttttggatctccgcatcggacaatgggtcatccgtgccagaaggcatcctgatctcgaagttgtcacctgcattagtcatgcacactattctgccacgtctggctgtcgactatgcgtgtccaccccacctagtaggttattgggg

SEQ ID NO: 953 - DNA, 309 bp, Corynebacterium glutamicum
gtgtgcatgactaatgcaggtgacaacttcgagatcaggatgccttctggcacggatgacccattgtccgatgcggagatccaaaagtatcgcgaggagatcaaccgcttggaccgcgaaatcctcgatgcggtgaaacgccgcacgaagatttcccaaaccatcggaaaaacacgcatgagctcgggcggaacacgtctcgtgcacacccgagaagtagcaatcatcaaccaattccgtgaagagatcggcgaggaaggccctgccctcgctggaattttgctgcgcatgggacgcggaaaactcgga

SEQ ID NO: 954 - DNA, 2289 bp, Corynebacterium glutamicum
atgaatacttctccttttaccccaggttcccccgatctcatcgatggcttgaatgagcaacagcgtgctgctgtggagcatatcggttctccgctgctgattgtcgctggtgctggttcaggcaagactgctgtgttgaccaggcgtattgcttatttaatgcgttaccgtggtgtgcatccgcagcaaattttggccattacctttaccaataaggctgccgctgagatgcgtgagcgtgtcagtcagctggtgggcccggttgcggagcgcatgtgggtggctacgttccactcggtgtgtgtgcgtattttgcgtcagcaggcgcagttggtggaggggctgaacactaacttcactatttatgattcggatgattcgaggcgtttgctcacgatgatcgccaaggatctggagttggatattaagaagttctcggcgcgtacgttgctgggtgctatttctaatttgaaaaatgagttggttactccgcaggaggctcttgcggatgctgaacgcacgcacaatccttatgaaacagtcgtggccagggcgttttcggagtatcagagcaggcttcgccgtgccaacgctgtggattttgatgatttgattggggagactgttcggattttccgggagcatccacctgttgcggagtattaccgcagacgtttccgccacgtgctgatcgatgagtatcaggacaccaaccacgctcagtatgagctgatttctacgctcgtcggcaagcctgaccaggatccgtctgagctgtgtgttgtgggtgattcggatcagtctatttatgctttccgtggcgccacgatccgcaacattgaagagtttgagcgcgatttctccaacgcccgcaccattttgctggagcagaattaccgttccacccagacgattctttctgctgccaacgcggtgatttctcaaaatgagaaccgtcgacctaaaaacctgtggactgcgctgggggagggcgagcagatcattggttatgttgccgacaatgagcacgatgaagcccgttttattgctagtgagatcgacaatttagttgaccacggcatgagctattccgacatcgcgatcatgtaccgcacgaacaattcctcgcgcgcactagaggatgtcttcatgcgcaccggcgtcccctacaaagtagtcggcggcacgaagttctacgaacgcaaagaaatccgtgacatcatcgcttacctgcgcgttttagaaaaccccgatgacaccgtcaacctccgtcgcatcatcaacacccccaagcgcggcatcggcgatcgcgcgcaggcgttcatcgcgctgcacagcgagaacaatcagatcagcttcgggcaagcgcttctcgacgccgccctcggcaaggtcgacctgcttggagcgcgcggcaagaatgcggtgattaagttcaatgagcttttcgacgccctccgctccgaactccccaccatggtcaatgaggtcaccggcctgccagacatcggccaagtcatcagtcgcatcctcgacatcactggctacaaggcagaacttgaggcatccaacgaccctcaagatggcgcacgcctagacaacctgaacgagcttgtctccgtggcccgcgagttctcctccgacgccgcaaaccgcatggttaatgaagttccagaaggcgaagcccaaccgggcagcttacaggcattcttggagcgagtctccctggttgccgacgccgaccaaatccccgattccgacaacggcgtagtcaccctcatgaccctgcataccgccaagggccttgaattccccatcgtgttcctcacaggctgggaagacggacagttcccacacctgcgttcccttggtgatgccaaagaacttgccgaggaacgccgcctcgcctacgtgggtatcacccgcgcccgcaagcgcctctacatgaccagagccatgctgcgtagctcctggggcaacccggtgaccaacccaccgtcacgtttcctccaagaagtgcccgcagaactcatcgattggaggcgcgaagaaccccagatgtcttccgcctgggctcctcgacccacccgaagcatccccaccaaaactcgcaccaacaataagcagttggatctgtcggtgggggatcgcgtcaatcacgacaagtacggcttgggaaccgtgctctcttcagatggcagcggcccccgagccaccgtcaccatcgatttcggttcctccggcaaggttagattgatgcttcttggtggcgtcccgatggagaagcta

SEQ ID NO: 955 - DNA, 2223 bp, Corynebacterium glutamicum
gtgaccacacttctagcagcaacccgccccaccctgcgcgatgcctttaaacacccatggcgatcgctggcagccatcttgttggtggccgtaccgatgttcctggtgagtttctttcttacctatgatcaatcaatcaacaatgcagctagctatcctggttcccaggtacaagctcactatgacggagaaggagcctaccaactcctccaagaaaaccttccagaagacttccacctggaactctttgccaatggttatccagaagtctccttcggtgatgaggaagtcaatttctttgttgtgcaatcaacaaacgtacaacaagcctcatttcccgccgatgcactcgatgttttaggtgccacaatcggtgataccgtgaccattcacggcaccccggtggaagttcagtcgatttctcccacaaatatcttattgcccgaaggtactctgttttctcttgagaatttctccgaatcagaaactttttccggcacctggtacttccccggatcgaatttcaccgaagaaaaccgacaagcactagaagcagttggctttgaagttaatgaatatcggcgcggccccatatccgtcgacccaaatttgatcccaagctacatcatgggatttttatcgacgacaattctcgccgtcgttgcactcatgctgatctcaccagtatttacaatttccgcctcaaggcaaaccagaactttcgcactgctcgcctcacagggtgccacacctagacacattcggtgggcagtgcttacatatgggctcttcgcaggtcttgttggggcatccattggtttagttctggggcaaataggcatctacggctggtggaaatacacctatcctgaattctccctcaccaccccctggctagttcttgtaggtttttgggcgctggcaatcatcgcttcaacgattgctgcattcttaccggcagtttttgtcagtagatcaagcatcatcaacggaatctacggaggaatctccgacaaaatcatccggtggagccctcgaatgctcatcgggccaatcgtcttaattgcagctgcggtaatcgccttgtttatcggtgacggagagtggggaggcgtcgtcaagcaattatgcttcctggcagccgtcatcgccctgccggcctcagtgcctgcggtgttgtgggcgcttgggcgcctgcctggtttgacattcaaactagctacgcgcgatatgctgcgccgatcaatgcactccattcctgcgattggtgcgctggcggcagtgattatgcttggtacatttatgcaaacaactggacttgcaacccaagccagcgatagagaagctaccgcctcggtgtatcctgaggccgtattcttacgcggtgacacacaaatccctggactcatggggcaaaaaatcgatgtatacggtgataaccatggctttggtatctatgaactagatgtagatttttactcggccaactatgtgcccgcactgacctcattttttggcggaccagttattgccacgcccaagattttagacatgttcggtgtccacgaacaagccgacatctacgcgccatcaacctataattccgggctgcaagaatacgcaatataccccggcgatgaaacctacatgctagacaccgctgctgttttaccgccgctgtactcacatgttttattaagcccagaaacttttgaagaaatcggaggacaaacagaattcttgggaacaatcgtgcttccccaagaactagatgaccaaactgtacaagcaatcaatcggtcaagagatgcgcatttcagccacgacggccataattcttcacttgcttccagtgctgcactaactgcggtggcaattgtggtcgtttcccttgtgatcgtgctggctaatcgcaaactccaacagcacgcattgattgccatcggagcaacacctggaacaatctacaaagtcaatgccttaaatgcagcgttgcttgcccttgtcggaggcatcatgggccttgtctccggatggattgcagcgctgctgacaggcaccactgatgaaattgttgatggagcaattttgaactacggcacgcttgaacacatgatgctgccgtggcctctgttggtaagcctcctcgttgtggcgccgctggtgtgcgccgtgattggggctatagcttctccatcgggacgccaccaagaagcatcaatc

SEQ ID NO: 956 - DNA, 666 bp, Corynebacterium glutamicum
atgacaaacacgcctttcccccttgaacttcaaaacatctcctgcgccttcggagaaggcccacgccacgtctccgcgctcaacaacgtctcgctggcagtcaatcccggcgaactcgttgccatcatgggcccgtccggctcaggaaaatccaccttgctcaacgtcgccggcctcctgcagcgcgcaacctctggccatgtgcttatcgacggtgccagcgcctcagacctcaacgccaaacgcgcagctgaaaccaggcgtcgccacatcggagttattttccaaaactacaacctggtccccaccctcaccgtcggagaaaacgtcggtctgcccctagaactcgacggcaaaaccgaccgccaggcagtagcaatcgcactcgcggaagtcggcctcgaaggcttcgacgaccgcttccccgaagagatctccggcggccaagcccagcgcgtcgccatcgcgagagccctcatcggcccccgaaaaatcttgcttgccgacgaacccaccggcgccctcgacacctccaccggcgacgcagtcctccgcgtcctccgccaaagaatcgattccggtgccgcaggcctccttgtcacccacgaaccccgcttcgccgcgtgggcagaccgaacaatcatgcttagggatggtgaaatccag

SEQ ID NO: 957 - DNA, 507 bp, Corynebacterium glutamicum
atgtccataaaacatgcactcttggtgctcatgctcgacgaaccaacctcggcaagtcagctgcaaaccaagtttgaagaaacaatggggatctggcagctcaatatcggccaagtcacccaaaccatccagcggctacagcgcgacggcctggcggaaaccgcaggcaccaccgtcagttccaacggccgcaccgtagatactttccagcccacggacttaggtcgcgaacttgtcgcgcagtggttcgaaagtcccgtcaccgtcacactgtccgaacgcgatgaattagtcaccaaaatcgccatcgcagaatcacgtggcctcaatttgattccacttttagacattcaacgcaacacagtcatggcggaactacgcgcactcaacaaatccagccgcgatctcgccgaaaccagaaacacccagcggctcctcgtcgaaaagcgaatctttgaactagaagcccaggcacgttggctcgaccgaattgaagcattggagcag

SEQ ID NO: 958 - DNA, 711 bp, Corynebacterium glutamicum
ttgcagaagcacactcgaggtggcaagcaccgcaagcagactacctccccagtaactaagggtggtgtcgcttttgttgcagtagctaccggtgccgtgtcaactgcaggcgcaggcggagcagttgctgcacaggcttccaatcagcccgttgaggtcaacttcgagcttactgcaaacgacacaactgacctcgtggctggaagctccgcccctcagatcctgtccatcgctgagttcaagccagttgtgaacttgggcgatcagatcgttaagaccattcagtacaacgctgaccgcattcaggctgacctggacgctcgtggcccttcagtggttcgccctgctgaaggttcttacacctccggcttcggtgctcgttggggcaccaaccacaacggtgtggatatcgctaacgcaatcggcactccaatcctcgctgccatggacggcactgttatcgatgcaggtcctgcttccggtttcggtaactgggttcgcctccagcacgaagatggcaccatcaccgtgtacggccacatggaaaccgttgaggtgaccgttggtcagactgttaaggctggcgagcgcatcgcaggcatgggtagccgaggattctccaccggctcccacctccacttcgaggtttaccctgcaggcggtggcgctgttgatccagctccttggcttgcagagcgcggcattactctt

SEQ ID NO: 959 - DNA, 1425 bp, Corynebacterium glutamicum
atgagcaagaaaaatagttcgcagacacgacccggtcagatccgacgtcgccggccaaaaccgcaagcacctgcgcaaacgccacagaaggcagctcagcaatcaaagttgctgcgtttccttccaaccgtgctgattccgcatggcgtggcggtgcttttggttattattctcgccgtagcctccctaatgttcaccaattcttcaatggtgaatctttcggcaacgattgcacagctgtggctttccctaaatctcggtgcggtggacggcagtggggaagtgatctcagtactgcccacgcttcccggctttatattcctctgggccatcgccgcgcgcatccaccgcgcagtcaaagatcgtgtcagcatcgccgacttaggcgtcctcgcagcactcgtcctcggcatcccgcttgcgctcaccgccatcgcagcgttcatgcttttcgacgcctccagcgtcctcaacgtcgaggtcccgccaatcacgcgcctcctacgcgtgatgttgttccacctcagcgccctcttcctcggcatggggccacgcctgtggcaggcgttggcgcgccgctacggtgctccagaatggcttatcgacgccatcacccaagctttccgcttcctcatcgcatttggaacagtctccttggtttccgtgctcgtgatgaccgcgatcaaccacagtgcattcaccgcgaccatgcagggctacgacgactccgcctctgttgtggccttgatcgtcctgagcattctgtatctgcccaacatgatgatctttgcgatgggcaatctgatcggctcacccctttacttcggtgacgcctccatcagcgtcttcagcgtgcattccgttccattgccaccgcttcccatcctcgcagctctccccagcgaagccctctcatgggcagtggccttactggtcatccctgcaattattgccacctgggtctgcgtgagaaaccccatgcgccttgccgtgaacacaacagcagcagtcatttcagcactgtgtttcctcgtcctggcagttttcgccggcggaaccttgggcgtatacaactacgtcggactcaacctcctggcgtcagttggcctagttttcgtctatttcgccctcgttggactcctcatcgccggaatcgacaagctgcgcaaccctgtagaagttaagtctgttaaggctgtggctgttgtggagcccgagcctgaagaagttgaagaggacgaagaggagcatgttgaagaagaagtagatgaggaggaagaggaagttgaggaaggggtagaagaggtcgaagaagacgacgcagaggatcctgaagagaatcctgaagaggaagaatccgacgaagaaattgagacagaaactgaggctgaagaaaccaatgatggttccgaggccgaagaccgt

SEQ ID NO: 960 - DNA, 228 bp, Corynebacterium glutamicum
ttggaaggaaacgcagcaactttgattgctgagctgccttctgtggcgtttgcgcaggtgcttgcggttttggccggcgacgtcggatctgaccgggtcgtgtctgcgaactatttttcttgctcatcaataaacaactgtgccactaatacggatagttttggcgatggcacgtcggagagtaacactgtgagaaaagtattactttttgcacaatttgctaaaaag

SEQ ID NO: 961 - DNA, 627 bp, Corynebacterium glutamicum
atggttccgaggccgaagaccgttaacatatctgttgtgaattctgactctacgaccaccattgtcgtgctagcttccggaacaggcaccctccttcagtcactcattgaagcgcaaggtacctattcgatcgtgggcgttgtctctgacgtcgaatgccctgcactttccagagccgcagatgcaggtattgatactgcagttgttccgcttggaaaagatcgtgcacagtggaaccacgagcttgcagacgcagttgcagtaagcgacccagatttggtggtctctgcgggattcatgaaaattttgggcgaaggtttcctctcaaggttcccgtcccgcatcatcaacacccacccagctttattgccttctttccctggtgcccacgcggttcgcgatgctttggcatacggtgtgaaagtgtcaggttcgacagttcaccttgtcgatgctggtgtggataccggcccaattattgctcaacgagcagtgccggtagaagtgaatgatgatgaatccagcctgcatgaaagaatcaagcaggttgagcgtaaactcattgtagaagtcctgaacagcgtggaattttcgcgtcagggtggcgtacaactcaactggagaggc

SEQ ID NO: 962 - DNA, 1560 bp, Corynebacterium glutamicum
atgagcgatgatcgtaaggcaattaaacgcgcactaattagcgtgtatgacaagactggcctggaggatctagcccaggcacttcaccgcgagaacgtggaaattgtttccaccggatccactgcggcgaagattgctgagcttggtattcctgttaccccggttgaggagctcaccggtttccctgagtgccttgagggccgtgtgaagacactgcaccctaaggttcacgctggcatcttggcggacacccgcaaggaagaccacctgcgtcagctcaaggaacttgaggtcgccccattccagcttgtcgtggtgaacctgtacccatttgctgagaccgttgcgtccggcgccgatttcgatgcttgcgttgagcagatcgacatcggaggcccatccatggttcgtgctgcggcaaagaaccacccatctgtcgctgtggttgtttcaccgaaccgctacgaggatgtccaggaagctttgaagaccggtggattctcccgcgcggagcgcaccaagttggctgctgaggctttccgccacaccgcaacctacgatgtcaccgttgcaacctggatgagcgagcagctggctgccgaagattctgagactgagttcccaggttggatcggcaccaccaacaccttgtcccgcagcttgcgttacggtgagaaccctcaccagtctgcagctttgtacgtgggcaacacccgcggacttgcacaggctaagcagttccacggcaaggaaatgagctacaacaactacaccgattctgatgctgcatggcgtgcagcgtgggatcacgagcgtccttgtgtagctatcatcaagcatgcaaacccttgtggcattgctgtttctgatgagtccatcgcagcggcacaccgcgaggcacacgcatgtgactctgtgtccgcattcggtggcgtcatcgcgtccaaccgtgaagtcagcgttgagatggctaaccaggttgcagagatcttcactgaggtcatcatcgctccttcctatgaagagggcgctgtggagatcctgagccagaagaagaacatccgtattcttcaggctgaagcacctgtgcgtaagggctttgagtcccgtgagatctccggcggtctgcttgttcaggaacgcgacttgatccacgctgagggcgacaactccgcaaactggactcttgctgccggctctgctgtttctcctgaggttctgaaggacctggagttcgcgtggactgcagttcgttccgtgaagtccaacgcaattctgttggctaagaacggcgctaccgttggcgttggcatgggacaggtcaaccgcgttgactctgctcgcttggctgtcgaccgtgcaggtgcagagcgcgctaccggttccgttgctgcttccgatgcgttcttcccattcgctgacggctttgaggttctcgctgaggctggcatcactgctgttgtgcagcctggtggatccattcgcgacaacgaggtcattgaggcagccaacaaggctggcgtgaccatgtacctgactggtgcgcgacacttcgctcac

SEQ ID NO: 963 - DNA, 819 bp, Corynebacterium glutamicum
atgtctgaacttatttgtggaccagctattctcttcgcaccagctggacgtgctgagatcattccaaaagcagcatcgaaggccgatatggtcatcattgatttggaagatggggcaggggaggtagaccgtgaggtcgcctacaggaacattagagaatcggggttggatcctaaacgaaccattgtgagaaccgtagggccgagcgatccacactttttggctgacgtggagatggtgaagtccacggatttcacacttgttatggttcctaaacttcttggcagcgtgcctgaggaattagatggcctcaacattatcgccatgattgaaacccctcaggctgcaaccagcattcctcagattgctgcggaccctaaagtcgttggaatgttctggggcgcggaggatctcacacacctcttgggaggcactcattctaggttcttgggtgatgagtccaatgaaggctcctaccgagacaccatgaggcttacacgcgccctgatgcacctccacgcggcggcgaatgggaagttcaccattgatgccatccatgcggatttccacgatgaagagggcctctatttagaagcggtcgatgctgcgcggactggtttcgctggcaccgcatgcattcaccccaagcagatcgagattgttcggagagcctatcggccagaggctaaccagttggagtgggcgaagaaagtggtggaggaagcagaaaaccatccaggtgcgttcaaactggatggtcagatgattgatgctccgttgatttcgcaggcgcggatggttatttcgcgtcagcctgct

SEQ ID NO: 964 - DNA, 666 bp, Corynebacterium glutamicum
atggcaggagcagtgggacgcccccggagatcagctccgcgacgggcaggcaagaatcctcgcgaggagattcttgacgcctctgctgagcttttcacccgtcaaggcttcgcaacaacctccacgcatcaaatcgctgatgccgtgggaatccgccaagcctcgctgtattatcacttcccgtccaagacggaaatcttcctcaccctgctgaaatctactgtcgagccgtccactgtgctcgccgaagacttaagcaccctggacgccggacctgagatgcgcctctgggcaatcgttgcctccgaagtgcgtctgctgctgtccaccaagtggaacgtcggtcgcctgtaccaactccccatcgttggttctgaagagttcgccgagtaccacagccagcgcgaagccctcaccaacgtcttccgcgacctcgccaccgaaatcgtcggtgacgacccccgcgcagaactccccttccacatcaccatgtcggtgatcgaaatgcgtcgcaacgacggcaagattccaagcccgctttccgcagacagcctcccggagaccgcaattatgcttgccgacgcctccctcgccgtcctcggcgcgccgctgcccgccgaccgggtcgaaaaaacgcttgaactaatcaagcaggctgacgcgaaa

SEQ ID NO: 965 - DNA, 327 bp, Corynebacterium glutamicum
atggtggtaaacattcgtgagaacctcatgattcccacggtgaagatcgctcgctgggcagcacacaaggctggttctttggcgcctacgactgcgcagcgcctcgtggatgcccgtggtgtgctcaccaatgatgaagtcgacgcgctgacacaggtgtggacttccgcactgagcttgcagtcgaaacgttggatggatcacatccatgatcaagaaaccaccgcttgggagcttcccgcgctgcaacgtgccacttttggcgcatcggctcggttgctttctgaggtgttgcggtccgttgaagcccgtgaaatcgataccaaa

SEQ ID NO: 966 - DNA, 321 bp, Corynebacterium glutamicum
atgaagcccacctcagttaacagcgctgaaatcttttcattcggatcttcttggctatcgacgaccgccagccacctcacgggcgaggtaggcagtgcgtctccacgccccacggggccggtgagcaccacgtgggcatccaagccaggggagtgcaaaacatcagtaataacttgtgacagccaccctgcaagctccgcgggctcttcaccgtggttcagtgcattgcccaacaaatccagcgattccttcagcacaccgcggacggtggcaaaatcctgtgcaagtggggcagcatccgctagctcagtcaatgagggg

SEQ ID NO: 967 - DNA, 249 bp, Corynebacterium glutamicum
atgaagcagcgtaacaacgctaagcgcgtccgccttgagcagactcgccgcccaaagaagaacccgctgaaggcagcgggcatcgagaaggtggactacaaggacatcaacacccttcgtcagttcatctccgaccgccacaagatccgttcacgtcgtgtcaccggtctgaccccgcagcagcagcgcgaggttgcaaccgccgtgaagaacgcacgcgaaatggctctcctgccgttcaccagccgc

SEQ ID NO: 968 - DNA, 303 bp, Corynebacterium glutamicum
atggctaagaagtcaaagatcgccaagaacgagaagcgcaaggaaatcgtcgcccgctacgcggagcgtcgcgctgagctcaaggcaattatcagtaacccaaacacctctgacgaggatcgtctggatgcacagttcgaactgaacagccagccacgtgatgctgctgctgtccgcgttcgtaaccgcgactcacacgatggtcgcccacgcggctacctccgtaagttcggtctttcccgtgtccgtatgcgcgagatggctcaccgtggtgagctgccgggcgttcgtaagtccagctgg

SEQ ID NO: 969 - DNA, 162 bp, Corynebacterium glutamicum
atggcacgtaatgatatccgccctatcatcaagctgaagtctactgctggcactggttacacctatgtcacccgtaagaacaagcgcaacaacccggaccgtatttccctcatgaagtacgatccagtagtccgtaagcacgtcgaattccgcgaggagcga

SEQ ID NO: 970 - DNA, 234 bp, Corynebacterium glutamicum
atgtcggcacattgccaggtaacgggacgcaagccgagtttcggcaagtctgtctcacactcgcaccgacgcacttcccgccgttggaaccccaacgtgcagcgtcgcaagttctatgtcccttccgagggacgcaccatcactctgaccgtttccaccaagggtctgaaggtcattgaccgcgacggcatcgaagccgttgttgctcagattcgcgcacgtggggagaagatc

SEQ ID NO: 971 - DNA, 1611 bp, Corynebacterium glutamicum
atgcgtgaccttttaccctctagagacgactatcagctactccgcttctcctggaagatggacattgctgctggcgtcaccgtgggcattgttgccctccccctcgctctcgcctttggtgtgagttctggagtcggagccgaggcaggattagtgactgcgattattgctggcctggttgcagcaatcttcggcggttccaatgtgcaggtttcaggaccaacaggagcgatggtggttgttctcgctccaatcgtcgcccaatatggtgtcggtgcggttgcattactcagcctgatggctggagttatcgtccttgtcgccggagtgcttcgattaggccgaacggtgagtttcattccgtggccggtcatcgaaggatttacggcaggcatcggtgtgattattttcctgcaacaggtgccagctgcgtttggttattcgggccatttgcccaccaatgcgctcctcgctgcgattcacactgtttcacacgccacgaaggacgcaattctacctctcttaattattatcgtcaccgctgcgatcatgattgtgttgggaaagatcgccccaaagctccctgccagcttcattgccattttggtggtgtccattggcgtggctctgctcaagcttcccgttgagttgatcggtgagctccccaattcccttcctgcccctcacctgcctgatgtgaacctggagatgttcacgagtttgctggggccagcttttgctgtcgccgcgctcgctgctattgagtctctcctttccgctcgtgtggcagcctccatggccgatacgggtccttataatgctgaccgcgaattggtcggtcaggggttggcgtcgataagcgctggcttttttggcggcatgccggcaactggcgcaatcgcgcgtacggcggtcaatgtgcgctccggcgggcgtacccgtatagcgtcgattattcacgcgcttgtgctgctcggcgttgtgtatgtggcggcgaatatcgttgcggtcattccgctcgccgcactgtcgggcgtgctcatggtcaccgcgagccgcatggtgtccattgaagtgatctcgcgcgtcatgcgctccactcgctctgatgcgatcgtttttgtcatcaccgcgatcgtcaccatcagcgtcgacctcgtcattgcggtcggcatcggcattgccgtcgcgacgttcttcatgctgcgacgcatgagcatgaacgccggcgtcttccgggaaaccttgcccgaaccggccacgcttaacgacgaaaagatcggccttttccgtatcgagggcgcattgttctttggcgcagctgaacgtctttcgcagcaaatccttgattatgaggacctcgaagtggtgatcctgcgcctgtcacacatccaaatgatcgacgccaccggcgcccaccagctcaccgagcttgtcaatgcgctggaaagaaaaaatgtcactgtattaattaagggcgtccggaaagaacacattcacgttctcggcgtcctcggagcgatcagatcactgcggcatgagaaccacctcttcgatgaccttgccccagcggttgaacatgcccgaaaacacgttaagatcgacaacagt

SEQ ID NO: 972 - DNA, 312 bp, Corynebacterium glutamicum
atgttgagttccaaggacttgccgatttatcagcgcaaagctgaccttttcaagggtttggcacatccataccgcatcagagccctggaaatcattgccacgaataatgaagtttcagtcggtcagataaccaaagagatggatttggaagcctctcacgtgtcccagcaccttaaggttttaaggaaatttggactggtttcctcccaacgcgaaggcttagttgtttattaccggctcacctacccggaggtcgcagactttcttaaggtgagccgctcactattaaagaggatggctggcgaagatgcg

SEQ ID NO: 973 - DNA, 264 bp, Corynebacterium glutamicum
atgaaaaaggatatccaccctgactaccatgcggtagtcttccaggacgcaggtactggcttccagttcctgaccaagtccaccgcttccagcgaccgcaccgtgtcctgggaagatggtaacgagtacccactgatcgtcgttgacgtcaccagcgagtctcacccattctggaccggcgctcagcgtgtcatggacaccgctggtcgtgttgagaagttcgagcgtcgcttcggtggcatggctcgccgcaagaagaaggca

SEQ ID NO: 974 - DNA, 171 bp, Corynebacterium glutamicum
atggcagttccaaagcgccgtatgtcccgcgcaaacacccgcatgcgccgttcccagtggaaggccgacaatgtcgcccttcaggaggtcaagatcgacggtcagaccgttcgcatcccacgccgtctggttaaggcagcacagctcggtctcgtggacgtagagcagttc

SEQ ID NO: 975 - DNA, 447 bp, Corynebacterium glutamicum
ttgcgcgggacatacggcgctttggaactgccattgttttccctcctatgccttcttcttgcggcgagccatgccaccgaagcgacgctcgaacttctcaacacgaccagcggtgtccatgacacgctgagcgccggtccagaatgggtgagactcgctggtgacgtcaacgacgatcagtgggtactcgttaccatcttcccaggacacggtgcggtcgctggaagcggtggacttggtcaggaactggaagccagtacctgcgtcctggaagactaccgcatggtagtcagggtggatatcctttttcatttactctcgattccctcaggattgaaacttcaggtcggttccagcggatgccagatcgtgcccgagttgggttcggtaagtatgcatcaccatgatttggcaatgaacctccaataccttacacctgttgcgctg

SEQ ID NO: 976 - DNA, 696 bp, Corynebacterium glutamicum
atgaaaattttagttgttgatgacgagcaagctgtacgtgactccttgcgacgttccctttcgttcaacggatacaacgttgttctcgcagaagacggcatccaagcactagagatgattgacaaggaacagcctgctttggtgatcctcgatgtcatgatgcctggtatggacggacttgaggtctgtcgccaccttcgcagcgaaggcgatgatcggccaattcttattcttactgcccgcgataatgtttctgatcgtgttggtggcctcgatgcaggcgcagatgactatttggctaaaccatttgctcttgaagagctgttggcgcgcgtccgttcactggtgcgtcgctctgcagtggaatcaaatcagagttccagcattgaacaggctctattatcttgtggcgatttgacgcttgacccagaaagtcgagatgtctaccgcaacggacgcgccatcagccttactcgaacagagttcgcgctcctgcaattgctcctcaaaaaccaaaggaaagtgctcactcgcgcccagattttggaagaggtatggggctgcgatttccccacttcaggcaatgccctcgaggtctacattggataccttcgacgcaagactgaattggaaggagaagaccgcctgatccatacagtacgaggagtcggatacgtcctgcgagagaccgctccg

SEQ ID NO: 977 - DNA, 1365 bp, Corynebacterium glutamicum
atgtcgttgcgttggcgcttggctttgctgagcgccactttggtagctttcgccgttggtgttattactgttgctgcatattggtctgtctccagctatgtcaccaactcaatcgatcgtgatctggaaaaacaagcggatgcaatgcttggacgagccagtgaagcgggattctatgcaaccgcagaaaccgaaattgctctgttaggtgaatatgccagtgacactcgaatcgccttaatcccacctgggtgggaatacgtcatcggtgaatccatatcactgcctgattcagatttccttaagagtaaagaagcggggaaacagatcctcgtaacaagtgctgagcgcattctcatgaaacgagatagctcgggcacagtggtggtttttgctaaagatatggtggataccgatcggcagctcacggtgcttggcgtcattctcttgatcattggcggcagtggtgttttggcgtcgattctgcttggtttcatcattgcgaaggaggggctgaaaccactgtcaaagctgcagcgtgccgtcgaagagatcgaacgaactgatgagcttcgtgcgattcccgtggtgggaaatgatgagttcgctaagttgactcgtagtttcaatgacatgctcaaggcactgcgggagtctcgtacccggcaatctcagttggtggcagatgcaggacacgagctgaaaactccactgacctcaatgcggacaaatattgaattgctgttgatggcaaccaacagtggaggatcgggaatccccaaggaagaattggatggccttcagcgtgatgtattggcgcagatgaccgaaatgtctgatttgattggtgatcttgttgatcttgcgcgtgaagaaaccgccgaaacgtcaagcattgtagatctcaaccaagtgttggaaattgcgcttgaccgaatggaaagccgtcgcatgacggtgcggatagatgtttccgagactgtggattggaaactgctgggcgatgatttttccttaaccagggcattagtaaatgttttggataatgccattaaatggtcgcctgagaatggcattgttcgagtgtcgatgtcacagatcgacaaagcaacggtccgcattgttattgatgattcagggcctggaattgctgaaaaagaacgaggattagttttggaacggttctatcgcgccgtcagctcccgttccatgccgggatcgggattaggtcttgccatcgtgaatcaggttgtgaatcggcatggtggccaactcgttgtgggtgaatcagatgatggcggaacgagaatcactattgatttgccaggggaacccattcgcagcgggttcgaaaatgtcgatgat

SEQ ID NO: 978 - DNA, 1239 bp, Corynebacterium glutamicum
gtgcgtagttcatatccgcagtggggtaacactgcttccaatcaaaacccctatcctggtgcgggcttcggctctgaacaaaacactcaacaaggaaatgagcaacaagctccagcctggaccagttgggataatcagcctctaagcacagatgtaaagccagctaaagaaaagcgaaaagttggcatcggaacggcactcgcgttaatgcttgttggttctattgctaccggtagcgttgtgggtgttgcagcaacccagcttggttcggactcttcaaccccagttaatgctcttgagcagcccagcgtgcagcgcaccactaatgctgaaccaggttcagcggaacaggttgctgccgcagttttgccttctgtcgtctctattcaggccattactaggacgtctgcttctgagggctctggatccattatttcctctgatggttacgtcatgaccaataatcacgtcgtggcaggcattgaacaatctggtgtgttagaagtaagtttctccgatggaactacagcgcaagctgattttattgctggtgatccttccacagatattgctgtgatcaagattagggatgtgtccaaccttccagttatgagctttggagattcggacgcattaggcgttggacaaagtgtgatggctgttggttctccactgggtctgagctccactgtgaccaccggtattgtgtcggccgtgaaccgtcctgtgcgagcttctggtgatggcggagagtcgtccctcatcgatgctatccagaccgatgctgcgatcaaccctggtaactctggtggtccgctggttgatatggatggcaacctcattggcatgaattcggtaattgcatcgatttcgagcaccagcgattccgcaggttccattggtcttggtttttctatcccatccaactttgccaagcgcgtggccgatcaattgatcagcaccggccaggtaactcagccgatgatcggtgtgcaggttggcactgacaactcagtgacaggcgctgtgattgccagtgttcaagatggtggaccggccgcagatgctggacttcagccaggcgatatcgtgaccaagctcaatgatcgagttattgatagcccagactccttgatcgctgctgttcgttcgcatgattttggcgaaaccgtcactttaacaattacacagccagatacctcgcagagccgggaggtagaggttactctgacgagtgag

SEQ ID NO: 979 - DNA, 585 bp, Corynebacterium glutamicum
atgagcaaggatccattgggaagtcttaccgatgttgtagacacacgagttccgcttccggatgttgaaccggatccggagttcctgaaggctacggaaaaagaattccacatggcatcccagaagcgcgctcttgttgtcctggtgggcgatcatgtcgctgaggcagatgggactggccgtttggttacggagctgctcttagagtctggcttcaacgtggacgctgtggtcagcgtgaagtctaagaagtctcagattaggcaagctattgaaaccgcagttgttggcggcgctgaccttgtgctgaccatcggcggagtgggcgttggtcctcgggataaaactcctgaggcaaccagcgctgtgttggaccaggacgtcccaggaatcgcgcaggcgcttcgttcctccggtttggcctgtggcgcggtggatgcaagtgtttcccgaggcgtagcgggcgtatccggctcaaccgtggtggtcaacctcgctgagtctcgttcggcaattcgtgatggcatggcaactctgacaccgttggttgattttgttgtagatcagcttcgcacttccgtggtt

SEQ ID NO: 980 - DNA, 198 bp, Corynebacterium glutamicum
ttgagttggtcgggtgtgagtagacaacgtagacgagcgttccgtgcgtcagatgcaaaggactatgatcgcacggcagattctcctctggaatcaacaactaacgatgatgtccgggaagtttctttagatccagaacaagatgaccaaccaacaggtgaggaattctggaaagaacagcaaccaccgcatcatggt

SEQ ID NO: 981 - DNA, 405 bp, Corynebacterium glutamicum
atgcttaaaggttttagagatttcgtccttcgcggaaatgtcattgaactcgcagttgccgtggtcatcggtactgccttcaccgctatcgtgacagcattctccgagagcatcatcaacccattgatcgcttccatcggcagcacagaggttgaaggcctcggcttccacatccgcgccggcaatgccgcaacattcgtggattttggtgctgtcatcaccgcagcgatcaacttcctcatcatcgcagcaattgtctacttcgtcctcgttgctccaatgaacaagctcagcgaaaccctcgcaaagcgcaagggtgttgaagaagacgagaccccagcttccatcgaagcagaactcctcaccgagatccgcgatctcctgcaggagcaaaagcgccttcag

SEQ ID NO: 982 - DNA, 651 bp, Corynebacterium glutamicum
atggacttaaaaaagacattcaccaccccgagttggcaccgcaccctagttttaagaagaataatcgccttcatcctgatcgggattgcaggactgctgatggcacattcttggctcaagaaggatccaactgccgttgtcatagtgcaagaaattcctgctggcaccaaggttgaggcctctgaccttggacttcaggcaatccctacttccctactgcccagcacctcctacgattcgattgacgatgtagttgggctcgttgcggcctccacattaagttccggggaaatagccacaaagcctcgattcgtgggcaccgaattgataaactccattgcgacaaacgtcactgatagctctttggtggaagaaattaacatggttccactcagtttggctgaaccttccgtcatccccctactgcagcatggggacaccatttcggttgtttcccaagacccagacaccggtctcccagagaacattgctgcaggtggaacagtaattctggcgggtggtacagacccctcaaccatcttgattgcgcttccacaatcaatcgctgaaaaggttgcagcacaatcgctcaatacccctctggcggtagtcctgaccggagacagagcagataattacacaaccgaagaa

SEQ ID NO: 983 - DNA, 570 bp, Corynebacterium glutamicum
atgagccaaactaagcaggaactgcgcacgaagcttcgggaagcgcgcaccaatatggatgaggcttctcgcacgcgagaaaacgcagccatcattgccaacgtttcttattacatccgctcaaagcagccaaaaaggattgccgcttacgtgccggtgcgtaccgaacctggtgggcgattgcttctcgacgccctccacgccgaaacttccgcgcttattttgccagtctccctcgaggatcgacgcctcgactgggctctttatgaaggcccaaccagccttgttcctggcgcatttggcatccaggaacccggtggcactcgccttggacctgaagctctcaacttctgcgaccttgtcatcgcccccgcactggcatgcacccccagtggaatcaggctaggtaaaggtggcggtttctacgaccgcgctctagccaccggagtcaaggctgacgtgattactttgctcttcaacggagaaatccgcgacgatatcgaagtggaagaacatgatcttcccgtcaacgtcataattacccccgcaggtgttcggaacctaggagcc

SEQ ID NO: 984 - DNA, 897 bp, Corynebacterium glutamicum
gtgcctgctgcaggactgggaacccgattccttccggccaccaaaaccgtacccaaggagttgctgccggttgtcgataccccaggtattgagctgattgctgctgaggctgccgaacttggtgcgaccaggctggcgatcatcactgcgccaaacaaagctggggtacttgcacactttgagcgttcttctgaattggaagaaacgctgatggagcgtggcaagactgaccaggtggagataatccgccgcgccgccgatttaatcaaggcagttccagtaacccaggacaagccgctggggctaggtcatgctgttggtttggctgagtctgtgttggatgatgatgaagatgtcgtagcggtgatgttgccggacgatctcgtgttgccaaccggtgttatggagcgcatggctcaggtccgagcagagttcggtggatctgtcctttgtgcagttgaggtttctgaagctgacgtttctaagtatggcatctttgaaatcgaagctgacaccaaagattccgatgtcaaaaaggtcaagggcatggtggaaaaaccagccatcgaagacgcgccatcacgcctcgccgcgactggccgctacctgcttgaccgaaaaatctttgacgccctgcgccgcatcacaccaggcgctggcggcgagttgcagctcaccgacgcgattgatttgcttatcgacgaaggccatccggtccatatcgtcattcaccagggcaaacgccacgatcttggcaaccctggcgggtacattccggcgtgtgttgatttcggtctgtcccaccctgtttatggtgcgcagctaaaagatgcaatcaaacagattttggctgaacatgaagctgcggaacgtattgcagacgattctcaagtaaaa

SEQ ID NO: 985 - DNA, 1257 bp, Corynebacterium glutamicum
gtgcgatcagtcgagcaacagctatccattgtcaccgaggcagcggtagctccagagccagtgcgtattgctattgcagaggcactgggtttgatgtgcgcggaagaggttcaagctagtcgtgctttgccgggtttcgcgcaagcagcgattgatggttatgcggttcgagcagtcgatgtcggcggcgagaagtcgcttagccagcaactgccggttgctcctccggaaaaatccctgcccgtggtgggtgaagtagctgcgggttctcagcagccgttgcgcctgcagcctaaacaagcagtcatggtccacaccggtgcgccactgccgatgcttgcggatgcggtgctgcccatggcgtggtcagatcgtggccgcaaacgagtaaccgcgcagcgacctgtgcgctctggcgagtttgtgcgcaaagaaggcgatgacatccaaccgggagacatcgcagtcagcgccggcgcggtcttaggccctgcccaaattggtttgctcgcagctgttggtcgctccaaagtgttggtgtacccacgcccacgcatgtcggttatctccgtaggcgctgaacttgttgatattgatcgccagccaggcctcggccaggtttatgatgtcaattcctattctctggctgccgccggtagggaagcgggcgcagatgtgtaccgctacggcattgctgccggtgaacctcgtcgcatcaaagagatcattgaatcccagatgctgcgctcggaaatcatcgtcatcaccggagctgttggcggtgctggttcagctggcgtgcgccaggttctcaacgagctaggcgatatcgacaccgaacgcgtcgcaatgcaccccggttctgtccaaggattcggtctgctcggcgagaacaagattccatgcttccttctgccttccaatccggtggcgtcgttagttatttttgaaaccttcgtccgcccggtcgtgcgcatgagcctgggcaagagcaatgcggcgcgccgggttgttcgagctcgagcgctcaaccacgttgtgtctgtggcgggtcgaaaaggtttcatcaggtccaggctcatgcgcgatgcagaaacccaggactacctcgtggaggctttgggtggtgcaacgggcgcaccatcgcacctattggcaggattgtccgaagcaaacggtatgatccgcattccagaagatgtcacagaaatccgaccgggagatgtcgtggacgtgatcttccttgcccaaggtcga

SEQ ID NO: 986 - DNA, 660 bp, Corynebacterium glutamicum
atgcgtaatgcaccgtcaggtccgacgcattttcgacaccccggctggccagagtcaacgcaaacggtcattttgccggatggcggcaggctacgtttgaggcccttgaagcgccgtgatttccgcgcatggtcggatttacgcatgcgcgataaggaattcctcaagcccgtggagcccacggttcccacgtcctggagtgaagcgcattcgcggttgtcctggtgggataacatcacctatttgatgcgcgctgcgcgaaaaggcaccgtggttcccatggtcatcgagttggatggccggttcgtggggcagttgactatcggcaacatccagcacggcggcatctccgatgcctggattggctattgggtttccagcgcggtgacggggcgcggtatcgctacggccgcctgcgcgctcggcgtggatcatgcttttcgacgcataggtctgcatcgcctcaccgccacctatctacccagcaacccagcatccgggaaggtgctcggacacagcggtttccgcccagaaggctatctcattagaaatctgcatattgatggacaatggatggatcaccattttgtggcattgctggcggatgagtattcaataaccgcggtggaacgtctcactagagagggacgattgcgccga

SEQ ID NO: 987 - DNA, 1020 bp, Corynebacterium glutamicum
gtgctccacgtgtccggaatccttgtgatcggcctgattgtggtggtgtggcttgttgtgctcgcaccgctacttcttcgaggccaaaagcccattgctaaggctggagaagcattcgacgacacccgcgttatctctgaaggcggaagcaacattccgtctcctcgtcgccctggcttgagttctgctcagctagacgatgaggaagatacagatgatgtggatgatgattatgagatcgtcgattctcccagcattttccgaccacgcaaagaggaacccgtcgaggaagatctcgacaccgatgtagagcttgaagaagacatcgaagtttctctagaaactgatgactacgttgagcctgctcccgtcgtagaagtttcacaagagtggaatgtggaagatcattacgagctagatgattcctacgacaccccgcttgatcacttgcacccagctgcaagggctcgtgcatatgaggacttccaggaacaccagcctgagcagcagcctgaggtcgaagaatttgatgcagacgatgagctgactgaagaagatgttgcctttgcacagcgtcgacgtggccgtggctactacgacccagaggctgaccgtgagttcgctgcctcccagtatgttcgccgccagcgcaccctgttgggtcttgcagccacagtcgttatctctgtaattctcggattcgtctttggcggttgggtctggggactgccagcagtagcattggctgcgaccgcattgtacctgatggctctgcgcagtcaggttcgtgaggagaatgctcttcgcgctcgtcgaatccgcaggctccgccgctcccggatgggtgtacgaaactctgaagaccttccttcccgtttgcgtcgtccaggtgcagttgtcctcgagcttgatgatgaatcgccagatttcgaaggcctcccaacggtggcaatgccggaggaaccttactacgaggagccacgtcgaaacattcgacacctgggtcagcgtcgcgtgagc

SEQ ID NO: 988 - DNA, 1200 bp, Corynebacterium glutamicum
atgtccggaacctccccaaaactaaaagtctttacctttctagctgtcctcgtggcagcttttaatttgcgctcagccatcgtgtcggtcggcgcagtgcttgatgatctcgtccatgattttggggcgtccggatcaaccgcaggaattatcacagccataccaggaatcgccttcggcatttttggtgtggctgctgtgcctttagcgaagaaaatcggactcagtggtgcacttacatccggaatgatcgttggactcatcgggttgtcaatccgcccatgggtcggcaacatttgggcatttatcttcctcaccggcttcgtggtgatgggaattgcggtcgccaacattttgcttccggcgtggatcaaactccacggtggcaaaagcactgtcgcattgatgacggtgtacaccaccgtgcttggtgttggatctaccttggggccgttgtccacattgctgtttagcggatcgaatgcgtggcgctgggcaatctttatttgggcacttcctgccgttttgcaggtggcaatctggctgcccatgtggtgggacaagaagtatgacttcccagccgagactgtgaaatctggttcgactggaaagatctggacatcgccaacagcattcttcatcatgctgttcttcggtttgcagtccatgaacgcatatatccaaatgggatggctgcccaaaatctttatcgatgcaggtgtaagtcccgcacatgcctctatcggattgtcgattgtgggcatcatgggcattgttggtggattcaccatgcctgtcgcaatcgctaggaccagggataagaacctcgtgtggttccccgtggtctttggtgcatcgatgttcctcggttatgtgggaacgtggctgtggccgtcccaaggctggtacctgtggtcattccttcttggtttaggtggactctgcttcccgatggctatcgccctgattccagcgcgtacgaaagatccgagaattaccgcaagcttgtctggatttgtgcagccggtgggttacattcttgcagcccttgggccattggcagtgggagcgatctaccaggcgattggctcctggtcagagatcctcgttggtttggccttgggcacagtagtgttgtcgattgtgggattcagagcagcacgcaatgtgacggttgatgatgaattgaggagatcaaag

SEQ ID NO: 989 - DNA, 1419 bp, Corynebacterium glutamicum
atggtgaatccaccaacaatgcccatgatgcccacaatcgacaatccgatagaggcatgtgcgggacttacacctgcatcgataaagattttgggcagccatcccatttggatatatgcgttcatggactgcaaaccgaagaacagcatgatgaagaatgctgttggcgatgtccagatctttccagtcgaaccagatttcacagtctcggctgggaagtcatacttcttgtcccaccacatgggcagccagattgccacctgcaaaacggcaggaagtgcccaaataaagattgcccagcgccacgcattcgatccgctaaacagcaatgtggacaacggccccaaggtagatccaacaccaagcacggtggtgtacaccgtcatcaatgcgacagtgcttttgccaccgtggagtttgatccacgccggaagcaaaatgttggcgaccgcaattcccatcaccacgaagccggtgaggaagataaatgcccaaatgttgccgacccatgggcggattgacaacccgatgagtccaacgatcattccggatgtaagtgcaccactgagtccgattttcttcgctaaaggcacagcagccacaccaaaaatgccgaaggcgattcctggtatggctgtgataattcctgcggttgatccggacgccccaaaatcatggacgagatcatcaagcactgcgccgaccgacacgatggctgagcgcaaattaaaagctgccacgaggacagctagaaaggtaaagacttttagttttggggaggttccggacatagtccgaaaccttaccctgtggctagctcacgcgacgctgacccaggtgtcgaatgtttcgacgtggctcctcgtagtaaggttcctccggcattgccaccgttgggaggccttcgaaatctggcgattcatcatcaagctcgaggacaactgcacctggacgacgcaaacgggaaggaaggtcttcagagtttcgtacacccatccgggagcggcggagcctgcggattcgacgagcgcgaagagcattctcctcacgaacctgactgcgcagagccatcaggtacaatgcggtcgcagccaatgctactgctggcagtccccagacccaaccgccaaagacgaatccgagaattacagagataacgactgtggctgcaagacccaacagggtgcgctggcggcgaacatactgggaggcagcgaactcacggtcagcctctgggtcgtagtagccacggccacgtcgacgctgtgcaaaggcaacatcttcttcagtcagctcatcgtctgcatcaaattcttcgacctcaggctgctgctcaggctggtgttcctggaagtcctcatatgcacgagcccttgcagctgggtgcaagtgatcaagcggggtgtcgtaggaatcatc

SEQ ID NO: 990 - DNA, 405 bp, Corynebacterium glutamicum
atggataaaccggtcgtgagggatgcagctctgctgatttttcgcgctgtgctcggagtgatctttgtggcacacgggtgggaaaagctgttcatctccggagttaccaagacaacaggacaattttcagcctggggagtgcctcaacccaagctctcggtgtggatcacatcgatctctgagctgctcggtggtgccttcctagtggttggtttgctcaccacctttgttgctggtgcattagcgctgttgatcgccgctgctatttactttgtgcacttgagttcgggctttttcacagttgagaacggcatcgaattccccttgctcatcattgtttctttgctcgtgatcgttgtgtttggttctggtagagccagcgttgatggggtgctcacgcgtggt

SEQ ID NO: 991 - DNA, 714 bp, Corynebacterium glutamicum
ttgtgtttggttctggtagagccagcgttgatggggtgctcacgcgtggttgactgtagtgccattcaagccgcgctgtccgccaaattagatggtgagccgacaggcttggatgatgcagtaattgaagcgcacctcgctaattgtgaagagtgcagaaattactacaaccgtgctgctgagttgaatcggatgctcaatttttgcgccgcggaacctcgcaccctgaccccgcctgatctatcagagatcattctggcagaggtggaaccagaatggcgcaggcatgccaacgccaaggttgtgggatccctgctatcgcgggtgttgttggtgatcctgggtgtggtttacctcgcctggggtatcacaatgttgggggattcggcgtcgataagcgtccaagaagacccgctcacctcgcgcctgctcgcggaggccgttgcctaccgcattgctctttctgtggggctgttatttgcggcgtggaagccgcggattatcgcgggcatgctcccgatttttggaacgttgtggacatttagtgctggttttgctgcgcgcgatctcgtgtttggcgtcgccgattcacagacgggactgtccattggtctgctgttgatttctacgattgtgctgtcgtttgcgttggtgaatagttctggaccgggtattttgcggcgcacatggaactcattgaacgccgcgcccggc

SEQ ID NO: 992 - DNA, 1167 bp, Corynebacterium glutamicum
gtgggaggcatgagttttgctgaacatgcgatcatctggcacgtctaccccctgggcgctttgggtgctcccatccggcctgaagcccccgcacctgtcacacatcggctccccaatctaattgggtggctggattatgttgtcgaactaggctgcaacgccctcatgctgggaccggtattcgagtccgtcagccacggctacgacaccctcgatttctaccgcatcgacccgcgcctcggcaccgaggaagacatggacgcgctgctggaggctgcgaatcagcggggcattggagtgcttttcgacggcgtcttcaatcatgtttccagttcctctaaatatctcgacctgaccaccggggcgtcatttgaaggccacgacatcctggcggaactcgaccacacgaatcccgccgtagtggatctggttgtcgatgtcatgaaccactggctcgaccgcggaatcgcaggctggcgactcgacgctgtctacgccatcgcccctgaattttgggaaaaagtcctgccagaagtgcgacgaaaacacccacacgcatggatcgtgggggagatgatccatggagattactccgactacgtgaaaagctccggcattgattccgttaccgaatacgaactgtggaaagccatttggagcagcatcaaagagcgcaatttctttgaactcgaatggactttgagtcgccacaatgaattcctcgatactttcgtaccgcagacattcattggtaaccatgacgtcacccgcattgccacccgaatcggtcaatcaaatgcgatcctggccgcagcgatcctcttcacggtcggaggaaccccaagcatttactacggcgatgagcagggctttacgggattgaaagaggataacgttttcggtgacgatgccattaggccacctcttcctgccgagttttctccactgggcacctggattgaaaacatttataaggctctgatcgcgctgcgcaggcaacacccgtggttgtatcaggcgcacaccgaagtccttgagattgctaatgaagcgatgacctataagtccgtcggtcttggaggtgaagagctgacagtgcatcttgatttggaagaggtgtctgttcggatccttgatggcgagaaggtgctgtttcagtacagcgct

SEQ ID NO: 993 - DNA, 1560 bp, Corynebacterium glutamicum
gtgagccaagccctacctgttcgtgaccaggggcgggaccaggggattttcgctggtactctcccgcccgcaccgccaaagttcaagtggacccgcctggatacctatacctgggcgatcatcgcggtgtttgctttagtcacgcgttttacaggtttgagcagtgcaaccgcctcaggcaccccagtttttgatgaaaaacactacgtcccacaagcctgggacatggtccgctcctggatcaaccccatcaccggcggcattgaatccaaccccggctacggactcgtcgttcacccaccgttggccaaacaacttgaagcactcggtgaatgggtcttcggatacacccccctcggctggcgcatcatggtcgccattttcggaacactcaccattttcgccatcatggcaatcgcgcggcgcctcagcggatccaccatggtgactttcatcgccggaattctcgcgcttgccgacggcgtcctcctcgtctcatcacgcttcggcatgctggacatcttccttgttttcttcatcaccgcagcagcatgggcattgatccgagaccaccaacaaatgcaccaacgcctcaacgatttactcctcaccaacggccaaatcaccaaagactttggcccccgattcggcttccgatggtggcgtttcaccacaggtgtattccttggtctcgcgctctccgtcaaatggtccggactgtactacatcgcattcttcggcctgaccagcgtgttcctagacttgtggctgcgcaaacgctacggcgtccgacgctacgtcaccggcaccctaaaaaatgacgtcatcccagcgctcggctccttggtgatcatccctgccctgctttatatctggagctggcgagcctggttcgcctccgaaacctccgtctaccgccacgccaaaacagacggcaccatcacagaagactccatcctgcagctcttccctgagtcaattgcgggctggatccactatcacatcagcgtcctggaattccacggctcactgaccacatcctcaggtcacagccacccctgggattccaagccgtgggcctggcttgtctccggtcgacccatcctctacttctcctccaccgacatctcctgcgacgttggcggcacctgccgacgcatgatctacctcttcggcacgcccgccatttggtggctgacagtcccagtcattctgtgggcgctgtggtctttcttcgcacgtcggagtcgtggctatgttgtcccgctggttgctttcgccgcaggatttttaccgtggcttgcagcatacgaccgccaaatgtacttcttctacgccaccgccctagttccattcaccatcatcatgttggcactcgcctgcggtgaactgtggggccgtggaaaaatgacccccactggcttaacccgcggatcaatggcagtggtcacctacatttccctcgtggtgatgatgtttctcgcgttttcgccactgttttacggatttgtcatcccagattatgtctacgaatccttgatgtggttcccaagctggcgc

SEQ ID NO: 994 - DNA, 825 bp, Corynebacterium glutamicum
ttgcccactggaattattatcgcggcgactccgctcggcaacattggggatgcgtctccgcgcctggtccacgcgcttgccaacgccactgtggtagctgcggaggatacccgcaggacggcgtccttggctgctgcgttgggggtggaaattaaggggcagttggtctcgaactttgaccataatgaacaggcgcgcgtcggcaagcttattgaagcagcgcgcacgggcacggtgctggtggtcagcgatgccggcatgcctgtggtttctgatccgggttttgcgcttatcgacgccgcccacgacgcgaacattccggtcacctgcttccccgggccgtcagctgtgccaactgcgttggcattgtcgggccttcacgtgggccgctttgccttcgacggtttcgcgccgcgcaaacaaggtgcgcgcaccacgtggttggagtcgttgaaaaccgaaaagcgcgcggtatgtttcttcgaatctcctcaccgcatcgcagaaaccctggctcacgctgccgaagttttaggtgaacgacgcgtagcagtgtgccgtgaactgtccaaaacctacgaacaggtaaagcgtggaaccttgccagagttggcagaatgggcacaagatggggtgcgtggcgagatcaccgttgtcatcgaaggcgcgggcgatatcgcggccgacgtcgattcgcttatcgacgccgcccagcagcgcgtcgattccggcgagcggttgaaagcggtgtgcgcagacctcgcgaaaatccatggcgtgagcaaaaatgaactctacgatgcggttatttctgccagggaaaat

SEQ ID NO: 995 - DNA, 1830 bp, Corynebacterium glutamicum
atgacgaagaacgtgctcgtatctgttgcctggccgtatgccaacggaccccgtcacattggacatgtggcggggtttggtgtcccctccgatgtgttcgcaaggttccagcgaatgtctggcaacaacgtgctcatggtgtccggcaccgatgagcacggcacgccacttctggttcaagcagacaaagaaggcgtcaccgttcaagacctagcggataagtacaaccgccagatcgtcgaagacctcaccggcctgggcctgtcctatgaccttttcacccgcaccaccacctccaaccactacgcagtagtgcaggaactgttccgtggtctgtacgacaacggttacatgatcaaggaaaccaccctcggtgcgatttccccatccactggccgtaccctgccagaccgctacattgaaggcacctgcccaatctgtggcaccgacggcgctcgtggcgaccagtgcgacaactgcggaaaccagctcgatccagcggacctgatcaacccggtgtccaagatcaacggcgaaaccccagagttcgttgagaccgaacacttcctgctcgacctgccagcactggctgaagcactaaccgagtggctgaagggacgcgaagactggcgtccaaacgtgttgaagttctcgctcaacctgctggacgatatccgcccacgcgcaatgtcgcgcgatatcgactggggcatcccaatcccagttgaaggatggcaagacaacaacgccaagaagctctacgtctggttcgacgctgtcgtgggctacttgtccgcatccatcgaatgggcctaccgctccggcgacccagaagcatggcgcaccttctggaatgatccagaaaccaagtcctactacttcatgggcaaagacaacatcaccttccactcccagatctggccagcggagcttctcggctacgcaggcaagggctcccgcggtggagaaatcggtgacctgggtgttctgaacctgcctactgaggttgtttcctctgagttcctgactatgtctggatccaagttctcctcatccaagggcgttgtcatctacgtgaaggacttcctcaaggagttcggcccagatgcgctgcgatacttcatcgctgtcgcaggcccagaaaacaacgacaccgacttcacctgggatgaatttgtccgccgcgtaaataacgagctggcaaacggctggggcaacctggtcaaccgcactgtatccatggcgcacaagaacttcggtgaagtaccagtacctggcgcactggaagaatctgacaagaagatccttgatcttgctaccgctgcctttgaatccgttgctgcgaacctggatcagtccaagttcaaggccggtatctctgaaatcatgcacgttgtcggtgaggccaacgcctacatcgcagagcaagaaccatggaagcttgccaaggatgacaccaagcgcgagcgtcttgccaccgtgctgtggactgcgctgcaggttgtttctgactgcaacaccatgctgaccccatacctgccacacaccgcccaaaaggtgcatgagaccttgggccgtgatggaatctgggctgcaacaccacagatcgtggaagtcaccaacgaatcaccacgccagccaatcggcgtggggctaccagatccagagcacacctacccagtaatcatgggcgactacaagacccagctggctaagtggcagcgcatcgacgttgtgccaggcaccaccttggagaagccagcaccgctgattgctaagctcgatccagaacttggtgaaaccggcccagaatgggcaccagtgcagaac

SEQ ID NO: 996 - DNA, 2049 bp, Corynebacterium glutamicum
atgaacgcaacgagggaagaagccaacaacttactagctggaatcgccggacctggcgcacagctccgcgatgatcaatgggtagcaattgatgcattggtaaaccaacgcaaacgcatgctggtggtgcaaaggaccggttggggtaaatcagccgtctacttcatcgccgccaaactgttaagagcacgcggtgcgggcgcagccgtgattatttctccactactagccctcatgcgtaaccaggtggcgtccgccgaacgcgccgggattaaggcagcgacactcaacagtgccaatatgacggaatgggaaaccatccagcaacaagtcgtttcaggcgacgccgatgtgctgttaatttcacctgaacgcctcaacaacccagactttagagacaccattttgcctcgactagcagctgaaacaggcctagtggtggtcgatgaagcccactgtatttccgactggggtcacgatttccgccccgattatcgccgcatccgcgacctgttagcgggacttgcgcccaatattcccgtgctagcaaccacagccaccgccaatgaccgcgtggttgaagatgtccgtgcccaactaggagatggcacaggtttgcttcgtggtgggctagaccgtgaatccctttacctatcagtggtgaacctgctcaaccccaccgaacgcccagcttggcttgccacccacctcaaagaactgacgggttcgggcatcatttactgcctcactgtgtcagctgcacatgatcttgccgatgcacttaattctgttggatggaatgttgccgcgtacaccggtcgaaccgaagcaggagagcgcgaacgtttagaacatgccttgatcaacaacgagatcaaagcactagtagcaacctctgcactgggaatgggctttgacaaacctgaccttggatttgttgtgcacatgggcagccccagctcaccggtgtcttattaccagcagattggtcgcgccgggcgcggcaccgctcgtgccgatgtcatcctgctgccaggaactgaagacaaagagatctgggagtactttgcatcagtatcgttcccacgcgaagaggtagtccgccaactgcttgcggtgttaaccgatgaggcgcaatccactgtcaaattggaatcacaagtagatctttcccgatcacgccttgaacaagtacttaaagtgctagacgtagatggcgcagtcaaacgtgtacgtggcggatgggtctccaccgggcaagagtggatctacgatgcggaacgctacgcaggacttgaacaagcaaggaaaattgaacagcaaagcatggtgaactaccagaacaccactgagtgccgcatgctgtacctccgcaaagaactagacgatgtggaggcaactactccgtgcgggcgctgcgacaattgcacgggcaaaacgtgggggctcgacaccgatgcctcgatcactttgaaagtggaccaacagcttcaaacacccggagtgaaaatagccccacgaaaaatgtggccgactggcattagtgtcagaggaaaaatcgcagggctagaagaaggacgagcactgggacgactcaatgacattgcccgtggacctgcactaaaggccctgctggacagcggagcttattctgatgatccatggatggcacgcatcatcgaagtgctgaaaaactgggattggaccaaccggcctgccaacgtggtcgctctcggcaataccaactttggatcaactgagatgatcatccaggtagctcaatcaatcgcagcggtgggacgaatgaactttgcgggtgtacttcccgccgcgccgggtgctgaagaagtcatggctcagaattccgcataccgagtagaagccctattgaaacaatgggactggtcgcaaggcttgcaactagttcccggtcccattttgctggtgacagaccttattgatactggctggtcggtgacagttgcaggaaatggcattgcgcagcggacctcagagaaggtgctgccgttcgctttagcgagtagggga

SEQ ID NO: 997 - DNA, 633 bp, Corynebacterium glutamicum
atgcagatcattgatctctctcatgcgttcgcgcccggacaaccccactaccctggggatccagatcaagaaattaagacggtctccacgattgaaaacgatggctttttaatgcatcaatacagacttgttggtccctggggaacgcatgtagatgcacctgcacatttcgatccacaaggtcggacgcttgatcagatccctgtggaggaaacgcatttacccctttattgcctgaggttttctcgccccgatctatgtactgctgctgatatagaagcgtttgaacatacacacgggaaaatcgaaccaggatccttcgtcgcactccacactggatgggaatggggtaaacaagggatcgcacccggctggtctatcgaggctttagaaatcctccatgcccgtggagtcattgccattggccacgatcttcccgatacagatccttcactggaggcacagcgctggtggctgtgccgtgaccattggcagattgaaaacctcaccaatttggacaaggttcctgcaacgggtgcgatgattgcttgtccttggccagttccaaaagatggtgctagtttcccagtgcgtccaattgctctcgtcccagagcacctatcccctactcgc

SEQ ID NO: 998 - DNA, 1158 bp, Corynebacterium glutamicum
atggctaccaccagcctccccacgacgattacaccggattccgaggagaccgtagaaaagcgtcactccctgaccccgatcctggattcacttccctgcgagtcagttccctatgctctggctgcaggtgagggacaacaacaccagcttggcccctaccatctcacagttatgtcccgtcccgaagacaacggtggaatattttcgctggctcgtgtgagcgcaggcaagactcccgccacccggttcttctctgtcgcaggaccgacgttcctctacatgatggaggggcggttgactctctggttcgctgatggacgtcaagagatcatcgctggcggcagtgccaccattcctacgaatacgccctggtccttcgcctgtgagggcctagtaaattcagctctagtgtactactcatcctcgaatgcattcctacacgcggcagagaaacttggcacgtcctcgttctcccacaccttccgcgtcagtggcgaggtcacagggattccctacgaggaactggaggattgcggattcacattctatgagcgggaccaccttgccgagctcgggccgcatttcgatcgcctcccagaagatatgaaggcgtttgccctgaacgatggtgagggggaccggcttgagcagttcgagcagatcaacagcttcgtctgccgtccgagacacaccggaaatcagttcctcgctatgcagaccaagggtgccaagacgccttatatacctcgtcatttccaccgccttcacaccgaaaacttcatctgtctggacgggcgcgtcaaactgcacgtcaacggtcaagagatcatcctctcccgtggggattacgttcatgccccagccggaaccatccactctttcgccttcgcagggcacaatacccagatgctgggagtgctcaccacagaggtattcgagaagttctttgactacataaacactccgactaatgctcgagttcagctggaggacggggggaagccattttttcctgctgaagcattcgcgaaagtccaagctgaactcgatgtcgtggtggtcggccccccacgaattagtaccctggatgttgttacaaactcgcgtttcgaaccaattaacagaactatcacctatcgtgcgctggacgctaaccaa

SEQ ID NO: 999 - DNA, 531 bp, Corynebacterium glutamicum
gtgtcctcccatgtccgctgcgttatggaaggctacggacctacccagatcgaaaagctcttacctgcatacacacaggtcaacacagccgggaataatccagcgacgacgcctgagcaagatctcctcggcggagctgcaacctcgccggaaaactacgaccaccagctgcagtacgcagtcgacgccagtccggtgcatcagaatgcggcacaggcaccgcccttcctgatcatgcacggcactggtgaccggatggtccctccggagcaatcggctgcgctgcacacccatcttgtgcaggctggtcggcagtccaccctggtactcattgagggctttggccacggtttcctcaatcccggggaagtcgcggagctggggccaaacgttcgactagacaatggtcggctcgagcgggagcctcagacaaatttcagcgcgcagcagagtccgggaaacccctttgaactacagggacttgccgccgaccatgagatgatcaagcgctttttcaccctgcaccttcgc

SEQ ID NO: 1000 - DNA, 294 bp, Corynebacterium glutamicum
ttggaagccgaagcacctgtagaggatctctcagcgttcatcgagcaagagaaggcgtcgtttcccattacatggatgtgcagaaagttgggtgtgtccagagcgtcgtattaccggtgggccaagcctgcgggtctgactccgacagccataaggcatttagaactcagggctgaggttgcccaggagtttgaaaaaagcaaccagatggctggcagggatcagctgaccacgttgctcaaccagcgtggtgtcaaagtttctactgggactgtgggatcaattatgaacgaa

SEQ ID NO: 1001 - DNA, 477 bp, Corynebacterium glutamicum
gtgtcagacgaatgcgggcctggaagaacaccacggtcagtgaccctttctgcccggaccgagcatattaaaaatcatatgctcgatagccacgggaaacgagactttaccgctaccgtgcctgggaccaggctcgttggtgacattacgtacttaaagacgggttccgggtggctgtatgtggctaccgtgatcgatttggctacgcggatggtggtggggtggtctatggattctaatatgcgcacaccgttggtgatcaatgcgctggctatggcgcgtgatcatgggtgtcttcatcctgaaggcgcaatttttcactccgatagaggatcgcaatacacctccgagcagttccagacatggtgcgccggcaacaagatcacccaatccatgggattgaccggggtgtgttgggataacggaagtcgcggagaattttttctcacatttgaagaccgaaatgtatcaccacta

SEQ ID NO: 1002 - DNA, 414 bp, Corynebacterium glutamicum
ttgacgagcgcaacctgggggatctaccagcggatgatcgcggcctaccgcgagaaggaccgatccctcggccgcgcggcgatggaggcgctcatcgacgccgtcagccaagacgtccccgccgggctggacgagttgcgcaagctcggtcggaccctgaaggctcgcgccaccgacgtgctggcctacttcgagcggcctggcaccagcaatggccccacagaggcgatcaacggacgcctggagcacctgcgcggctcggccctgggcttccgcaacctgaccaactacatcgccagatccctgctcgagttccggcggattcagacctcaactacaccctcatctgtgaagagccgctttagacatccctcatcgtcacggaccactatgaacgatgtcccgactcaccta

SEQ ID NO: 1003 - DNA, 864 bp, Corynebacterium glutamicum
atggcagaagaagtgcccgtaatacgccttgacctcaagctggtcgtcgatctcctccggcagcacctcgagccagttccaatcgtcgcgacgcagggccacatcgatggggatgagccctgcgatgtgccggcgcttcaacgcggcgtagcgagtggcggcactggccgcgccgaaccggttgagcgacgcgctcttttcttcatcagacgtgcagatgaagaactcaccagtgtgctcgggctctgcgaagaactccttgagcatcttctcgctcgcggccttctgcgactcgctgacggtgagcagcaggtgatgctcgaaacggttgcggtactccatcatgcgcttgggcagctggttgggcagcacgctgaacatggcttgcgataccgtgtcggcgaaggtcggaccaatgccgggaatcttcgagaacaagccgttggcccacgtcttgaacgagaacatgcgcgtctgcagcgctggactcatgaacttcaggaagacgaaggtgtctttgccgtacttctcggccaagtcgaaggcactgcggcccatgtactcaccagagataggcagcggcatgtcggcttcgaggaacaaccgacggatctcttcgagctcgtgcgtgttgttcgtgccgatgtaaaacacggtcgggtgcacttcgcgagggaaggtgcgggtgcgcaccgcgaacaccatcagcttgccggccgagccggaagcctcgaacaggtactcggggttcgcattgtagcgagcaggcgaaggcacgatcttgcgcaagtgctcggcgtactcggtctcgttcgagtcttcgggagctggggtgacatcctcgggagaccactcgccgcgctg

SEQ ID NO: 1004 - DNA, 1713 bp, Corynebacterium glutamicum
atgacgcaaccaggacagaccaccacgacttcgcacgaagcgatcgatgcgttcaagagaatcgtcggcgacgaacatgtactgacctctgagcgtgccacgatgccattcagcaaaggctatcgattcggcggaggaccagtcttcgccgtggtgcgccccggcacgctggtcgagatgtggcgggcgctgcaggtatccgtcgacaacaacctcatcgtcatcccgcaggcatcgaacacgggcctgactggtggatccggccccggcttccaagactacgatcgccccattgtgatcatctcgactcaccgcatcgatgaggtgcacctcatcaacgacgcgcgcgaggcgatctcgctcgcgggcaccccgctgacacacctgaccgacgcgctcgccaagcaccagcgcgagccgcactcggtgatcgggtcgacatcaatcggcgcctcggtcatcggcggcatcgcgaacaactcgggcggcagccagattcgcaagggtccggcattcacgcgcgaagcgatcttcgcccgcgtcaacgacgacggcaaggtcgagctggtcaatcacctgggcatctcgctcggagacgaccctgaggtcgcactcgaccgtctacagcgcggcgagtggtctcccgaggatgtcaccccagctcccgaagactcgaacgagaccgagtacgccgagcacttgcgcaagatcgtgccttcgcctgctcgctacaatgcgaaccccgagtacctgttcgaggcttccggctcggccggcaagctgatggtgttcgcggtgcgcacccgcaccttccctcgcgaagtgcacccgaccgtgttttacatcggcacgaacaacacgcacgagctcgaagagatccgtcggttgttcctcgaagccgacatgccgctgcctatctctggtgagtacatgggccgcagtgccttcgacttggccgagaagtacggcaaagacaccttcgtcttcctgaagttcatgagtccagcgctgcagacgcgcatgttctcgttcaagacgtgggccaacggcttgttctcgaagattcccggcattggtccgaccttcgccgacacggtatcgcaagccatgttcagcgtgctgcccaaccagctgcccaagcgcatgatggagtaccgcaaccgtttcgagcatcacctgctgctcaccgtcagcgagtcgcagaaggccgcgagcgagaagatgctcaaggagttcttcgcagagcccgagcacactggtgagttcttcatctgcacgtctgatgaagaaaagagcgcgtcgctcaaccggttcggcgcggccagtgccgccactcgctacgccgcgttgaagcgccggcacatcgcagggctcatccccatcgatgtggccctgcgtcgcgacgattggaactggctcgaggtgctgccggaggagatcgacgaccagcttgaggtcaaggcgtattacgggcacttcttctgccatgtgatgcaccaggactatgtcgccaagcagggcgtggatctcgaggcgctgcacgaccgcatccagcacctgctggaggagcgcggcgcgaagctgcccgccgagcacaactacggtcgcatctacaagctgccggagtccatggaagagcacttcaaggagctcgatccgacgaatacgttcaacgccggtatcggcggcacgtcgccgcacaaggactgggcc

SEQ ID NO: 1005 - DNA, 840 bp, Corynebacterium glutamicum
gtgcttgccgacgacgtggtggtcgtcgcggagttccgggatcgcatctaccccggcctggtggagacaggcagggttgagcggggcggcgacaagccgttccacacggtcgtcaacgctgagaactaccacgcgctggagatgctgacctatacgcaccggcattccatcgacgccatctacatcgacccgccgtacaacaccggggcgagggactggaagtacgacaacgattacgtcgcgagtgatgacgactatcgacactcgaaatggctggcgttcatggagcgacggttgaagatctgtcgggagctcatgcgtagcgatgctactcttgtggcaactatcgatgagcatgaagtaaaccgtttgggcgtgttgctagatcagctcttcccggaatctacgcggcaactcgtcacaattgtcaacaaccctaaaggcgttactcagggatatctttcgagggtcgaagagtatgcgttctttgtatttggtcctgacgcgcgaatcggttcggtcgatgacgaccttctgacgcatcgagacatggccgatgctgaaggggaactgcagaggcctcgatggaaggggctcttgcggtcgggcgacgactcgcttcgagctgaccgtaaagatatgttctatccggtgtggttcgatgagtcgactgggcgactcagccacgcgggcgaagcattgccacttgacgaaactcctgacttcagtccgcaggatggcctgacgccgatctggcctattaggcgggacatgaaggaggggcctacccgggcagcgccacgccgttcgatccttgactacgcgctacaccctcatctg

SEQ ID NO: 1006 - DNA, 219 bp, Corynebacterium glutamicum
ttgagtcttgggccggggaaaccccaccagcgccgctccattgttgaagcgtttgtcgataccaattccgcctccaagactgaggaaagcactatgttcaatgtccgcatgaccaccagtgtgcatagacggttgaaactacaggcatttaaagaacatcgcacgatgaaagaaatcgtagagcaatcagtagtcagataccttaacgagtgcgaagat

SEQ ID NO: 1007 - DNA, 294 bp, Corynebacterium glutamicum; identical to SEQ ID NO: 1000

SEQ ID NO: 1008 - DNA, 477 bp, Corynebacterium glutamicum; identical to SEQ ID NO: 1001

SEQ ID NO: 1009 - DNA, 357 bp, Corynebacterium glutamicum
atgctgactattgcttctcgtctagacgtgatgaaccggttgggtcgggccatggcggatccgactcgttcccgcattctcctggcgctgctggaggggccggcctacccggccgctctcgcccaggatctggaactgacgcgctcgaacgtgtcgaaccatctcgcctgcctgagggactgcggaattgttgttgccgaaccgcaggggcgacagacccgctacgagatcgttgatgctcatctggcgcaggcgttgaacgcgttgctggatatcaccctggccgtcgatgacaacgccgaatgcatcgacgccggatgcgccgtacctgggtgtgtcactggacaggagagtgcg

SEQ ID NO: 1010 - DNA, 621 bp, Corynebacterium glutamicum
gtgtgtcactggacaggagagtgcgtagtggcaaccggtctactgtcggcgattggtctgtttatcgccaccaatatcgacgacatcatcgtgctctcgctgttttttgcccgcggggcggggcaaaaagggaccacgcttcggattctggctggtcagtacctcggcttcatgggcatcctcgcggccgcagtcctggtcacgctgggggcaggagcattcctacctgctgaggcgatcccgtacttcggactaattcccctggccctgggactatgggcggcctggcaggcctggcgaagcgatgatgacgacgatgatgatgcggagatcgccgggaaaaaggtgggtgtgctgaccgtcgccggtgtgacgtttgccaacggtggcgacaatatcggcgtctacgtcccggtcttcctcaacgtggacactgccgccgtcatcatctactgcatcgttttcctcgtcctggtggcaggcctggtcctgctggcaaagttcgtggccacccgcccgcccatcgcagaagtccttgagcgctgggagcacgtgctgttcccgatcgtcctgatcggcctgggcatcttcatcctcgtcagcggcggcgccttcggcctc

SEQ ID NO: 1011 - DNA, 342 bp, Corynebacterium glutamicum
ttgccactacgcactctcctgtccagtgacacacccaggtacggcgcatccggcgtcgatgcattcggcgttgtcatcgacggccagggtgatatccagcaacgcgttcaacgcctgcgccagatgagcatcaacgatctcgtagcgggtctgtcgcccctgcggttcggcaacaacaattccgcagtccctcaggcaggcgagatggttcgacacgttcgagcgcgtcagttccagatcctgggcgagagcggccgggtaggccggcccctccagcagcgccaggagaatgcgggaacgagtcggatccgccatggcccgacccaaccggttcatcacgtc

SEQ ID NO: 1012 - DNA, 831 bp, Corynebacterium glutamicum
atgtctaagaagaagcctcgccccattccggttcctgcccaatttatccctggtctcattgatgcgcatacacatttggcatcgtgtggaggagatcttgcagggttggtggaaagggccaaggaggcgggcgtcgaaaagctttgtaccgtcggtgatggtttggctgaggccgagcttgcgctggaggccgcgcaacagtttggcaatgtgtttgctgcgtgtgcgattcatccgacgaaggctgatcagttggatggggctgcgcgtgcgcggctgacgcagatggcggcggatccgaattgtgtggccattggtgagactggtttggattcgtattggatcaagcacgatccagaggacacggcggcgttggatgtgcaagaggaggcgctgcgctggcatattgatttggcaattagtgcggataagccgttgatgattcacaatcgtgaggcggatgctgatttgatgcgagtgttggcggatgctccacctccaaaagatacgattctgcattgtttttcttcgccgttggacgtggcgaaggaagcgttggatcgtggatatgtgttgagttttgcgggcaatgtgacgtttaagcgtaatgaggagttgcgggaggctgctcgtattgcgccgatttcccagattttgattgaaaccgatgcgccgtatatgacgccggagccgtttcgggggagtaggaatgagccgtcgttgattggtcatacggcgctatgcattgcggaggttcgggggatggctgtggaggatgttgcggcggctttgaatgagaattttgatcgcgtttatggggtcacaaatcta

SEQ ID NO: 1013 - DNA, 1071 bp, Corynebacterium glutamicum
gtgccgttgcgtttggctaccggtggcgtgctcgccaccttgcttatcggcggagtcaccgctgcagctaccaaaaaggacatcattgttgatgtcaacggcgagcagatgtccctagtgactatgtccggcactgttgaaggtgtgctggcgcaagctggtgtggaacttggtgaccaggacattgtttccccttcactggattcatccatcagtgatgaagacactgtgactgttcgtactgccaagcaggtggcgctcgtggtggaaggtcaaatccaaaacgtgaccaccactgcggtttccgtggaggacctcctgcaggaagtcggtggcattaccggtgctgatgcggtggacgctgatctttcagagaccatcccagaatctggtttgaaggtgagtgttaccaagccgaagattatttccatcaatgatggtggcaaggtcacttacgtttctttggcagctcagaacgtacaggaagccctagagctgcgggatattgagctgggtgctcaggaccgcattaatgtgcctctggatcagcagctgaagaacaacgctgcgatccagatcgaccgcgttgacaacaccgaaatcactgaaactgtgtctttcgatgctgagccaacctacgtggatgatccagaagctccagctggcgatgaaactgtggtcgaagaaggcgctcctggaaccaaggaagttactcgcaccgtaacaaccgttaatggtcaggaagaatcttccacggtgatcaatgaagttgaaatcaccgcagcaaagccagcaaccattagccgtggcaccaaaactgtcgctgcaaactccgtgtgggatcagctggcacagtgtgaatccggcggaaactgggcaatcaacacaggtaatggcttctccggcggcctacagttccacccacagacctggctcgcatacggtggtggagctttctccggtgacgcttccggtgcaagccgtgaacagcaaatctccatcgcagaaaaggttcaggctgcacaaggttggggagcatggcctgcttgcaccgcaagcttgggcatccga

SEQ ID NO: 1014 - DNA, 879 bp, Corynebacterium glutamicum
atggaagaaccctcaggtgcacagctgctcggcccggtagaaatccgtgcgctggcagaaaagctcgacgtcacaccaactaagaagttggggcagaactttgttcacgatcccaacacggtgcgtcgcattgttgctgcggcagagctcaccccagacgaccacgtggtggaagttggccctggtctgggctctctgacccttgccctggtggaatctgctgcttcagtaactgcggtggaaattgatccccgtttggctgcggaattgccggagacttttcagtggcgcgcgccggcccttgctcacaagttgagcatcgtgctgaaagacgccctgaaggttcaacaatccgatatggctgttcaacccaccgccttggtggctaacttgccgtacaacgtctctgtccctgtcttgttgcacatgatggaggagtttcccaccatcaacaaggtgcttgtcatggtgcaggcagaggttgctgatcgtttggctgcggatccaggatcgaagatttatggtgtgcctagcgtgaaggcgtccttctacggtccagttactcgcgccgggtcgattggtaagaatgtcttttggccagctccaaagatcgaatccggtttggtgaagatcgtgcgcgaagacaccgcgtggaagcaggacgatgagacgcgtaagaaggtgtggccgatcattgatgctgctttcttgcagcgccgtaaaaccctaagagctgcgctttctggacactacggttctggccaggcagctgaggaagctttgcgggccgctgatattgatccaacgcttcgtggcgaaaagcttgatgtcactgactatgtgcgcctagctggggtgttgcagcaaaaggatgagaag

SEQ ID NO: 1015 - DNA, 933 bp, Corynebacterium glutamicum
gtgaaaattaccgctaaggcgtgggcgaaaaccaacctgcatttaggtgtgggaccggctcacgacgatggatttcacgagctcatgacggtgtttcaaaccattgatctgtttgacaccgtcaccttaaccaccctcgatgaggagttggtggaggaggggagcgtcgtcaagcaattatctgtgaccggtgcccgtggcgtgcctgaggacgccagcaatcttgcgtggcgcgctgtggatgcgttggttaagcggcgcgcggaaaagacgccgctgtctgcagtttcgctgcatatttccaaggggattccggtggctggcggcatggctggcggctctgcggatgcggctgcgacactgcgcgcagtggatgcctggattgggcctttcggcgaggacacattgctggaggttgccgcggagctcggctcagatgtgccgttttgcctgcttggtggcaccatgcgcggtaccggtcgcggcgagcagctggtagatatgttgacgcgcggcaagctacattgggtggtggccgcgatggcgcatggcctgtccacgcctgaggtattcaaaaagcatgatgagctgaatccggaatcgcatatggatatcagcgacctcagcgccgcacttctcaccggcaacaccgccgaggtggggcagtggctgcacaatgatctgaccagcgccgcactcagtttgcgccctgaactgcgcagcgtcctccaagaaggcatccgctccggcgcgcatgcaggaattgtctccggctccggcccgaccacggtattcttgtgcgaatcggagcacaaagcgcaagacgttaaagaggcgctaatcgacgccggccaggtgtacgctgcttacaccgccaccggccctgcggcctcaaccgccgaccagcgcggcgcacacattttgactgtttca

SEQ ID NO: 1016 - DNA, 642 bp, Corynebacterium glutamicum
atgccttcttggaggacgctgcgcagttcagggcgcaaactgagtgcggcgctggtcagatcattgtgcagccactgccccacctcggcggtgttgccggtgagaagtgcggcgctgaggtcgctgatatccatatgcgattccggattcagctcatcatgctttttgaatacctcaggcgtggacaggccatgcgccatcgcggccaccacccaatgtagcttgccgcgcgtcaacatatctaccagctgctcgccgcgaccggtaccgcgcatggtgccaccaagcaggcaaaacggcacatctgagccgagctccgcggcaacctccagcaatgtgtcctcgccgaaaggcccaatccaggcatccactgcgcgcagtgtcgcagccgcatccgcagagccgccagccatgccgccagccaccggaatccccttggaaatatgcagcgaaactgcagacagcggcgtcttttccgcgcgccgcttaaccaacgcatccacagcgcgccacgcaagattgctggcgtcctcaggcacgccacgggcaccggtcacagataattgcttgacgacgctcccctcctccaccaactcctcatcgagggtggttaaggtgacggtgtcaaacagatcaatggtt

SEQ ID NO: 1017 - DNA, 1833 bp, Corynebacterium glutamicum
atggccaatctgattaatctcgagaacgtctccaaaacctggggattaaaaacgcttctcgacggtgtctccttaggtgttcaaaccggcgaccgcattggcgtcgtcggcctcaatggtggcggaaaaaccaccctgctggaagtacttactggcatcgaaaagccggatcagggccgtgtgtctcacaactctgacctgcgcatggctgtggtgacgcagcgtgctgaactcaatgatgacgacaccgtcgctgacgtggtgcttggacctttgggtttggaagttttcgaatgggcatcaaacgccacggtgcgcgacgtcctcggtggcttgggcattgtcgatcttggccttgacaccaaagtgggcaacctttccggtggcgagcgccgacgcaccaacctggccgccgcgctggttcgcgaccttgacctgatcgtgctcgacgagcccaccaaccacctcgacgtggaaggcgtgcaatggttggcgtcctacctgctgtcacgccgcatcgccattgttgtggtcacacacgatcgctggttcctcgacacaattgccaccaccacctgggaagttcacgacggcgtggtggactcctacgaaggcggctacaacgactggaccttcgcccgcgccgaacgcgcccgccaagcagatgccattgagcagcgccgtcaaaacctcgcgcgtaaagaactcgcatggctgcgccgcggtgcaccagcacgaacctcaaagcctcgataccgcatcgaagccgccgaagctttgatcgcagacgtgccagcaccacgcgacaaagtcgagctcatggcattttccaagtccaggcaaggccgcgttgtcattgaacttgaagacgccacagtagccacccctgatgatcgcatcctggtagaagacctcacctggcgtttggctccaggagagcgcatcggtcttgtcggcgtcaacggctccggcaaaaccaccctgctgcgcacccttgccggcgagcagccacttcaggcaggcaaacgcatcgaaggccaaaccgtcaaactgggatggctccgccaggaactcgatgacctagacctcagccgccgactcatcgactgcgttgaagatgtcgcttcctacgtgatgatgggcgacaagcaggtctccgcttcccaattggcagaacgcctcggattctcacccaagaggcaacgcaccccagttggtgacctgtccggtggtgaacgccgccgactccaactcacccgcgtgctcatggccgaaccaaacgtgctgctcctcgacgagcccaccaacgacctggacattgacaccctccaagagctggaatcccttctcgacggatggccaggcaccatggtggttatctcccacgaccgttacctcatcgaacgcgtcaccgactccacctgggcactcttcggcgatggcaagctcaccaacctgccaggcggaattgaagagtacctgcagcgacgagcagcgatggccgcggccgaagacagtggagtgctgaacttgggtgcggccacgcaggctggaaccttttctgctgcaacagagcaggctgccacttctgtggaaagttccggaatttcttcccaagaacgccaccgcatcaccaaggaaatgaacgccctggagcgcaaaatgggcaagcttgaccagcaaatggacaagcttaatcagcagctcgctgatgcagcggaggccatggacaccataaagctcaccgagctggacaccaagctccgcgcagtgcaggaagaacacggcgagctggaaatgcagtggctggaactcggcgaggaaatcgagggc

SEQ ID NO: 1018 - DNA, 792 bp, Corynebacterium glutamicum
atgccgtcggcaggcgaggagattttagagcagcgcgcacagctggagtttgatcagcgccgcgccgatgtggtgatgatcggcagccaggtggtttatggttccgtggggctcagtgctgccattccggtgatgcacaacgaaggcctccgcgtggtcgctgtccccaccgtggtgttaagttccatgccgcgttatgcaagttctcaccgccagccgatgtcggaccaatggctcgccgacgcgctgcaagacctggtggatctggggattatcgatgaggtttccaccatttccaccggctattttacctccgcttctcaggtgcgtgtggtcgctgcgtggctgcagaaaatccgcgaaacccatccgcatgtgcgcatcgtggtggatcccatcatgggggacagtgacgtgggaatttatgtcgccgacgagatcgcaaccgccatctgccaggacttatgccctctggctaccggaatcattcccaatgctttcgagctctcccacatggttggctccggcgatccgcgctcgctgctcggcccgtttggcgagtggatcatcatcaccagcgccactgaaactgtgggcaccaccgtcacccgcatcgtcacccgtgacagcgtccaggaaatcgcctccgccaccgtcgataccacggccaaaggggcaggcgacgtctacgccgcagcattaatcgccgccctgcataaagatttttcgcttatcgacgccgccagccacgcatccaacaccgtctgcgccggcctgcagaccaaagcgctt

SEQ ID NO: 1019 - DNA, 480 bp, Corynebacterium glutamicum
atgagttcgctcgacaatgccccgctgctggaattggatgttcaggaatgggtaaaccacgaaggcttgagcaatgaggacctgcgcggcaaggttgtggtggtggaggtgtttcagatgctatgccctggatgcgtgaatcacggtgtccctcaggctcaaaaaatccaccgcatgattgatgaatcccaagtgcaagtcatcgggctgcacagcgtgtttgagcaccatgatgtgatgacacctgaggctttgaaagtgttcatcgatgagtttgggatcaagttccccgtggcagtggatatgccgagggaaggccagcggattccttcgacgatgaaaaagtatcgtttggaaggaacgcccagcatcattttggctgatcgaaaaggacggattcgtcaggtgcagttcgggcaggttgatgatttcgtgctgggattgctgctcggcagtttgctgtcagagacggacgaaacc

SEQ ID NO: 1020 - DNA, 321 bp, Corynebacterium glutamicum
gtgattttgattaatgtgaaattcaagccattgccagaatatgtagacaccttccgcgagcaggtagcggagtttacagaaaagacccgtgcggaagaaggaaacatcttcttcgattggtcaattaacaccgacaacccaaacgagttcatcctcatcgaagcattccaggacgacgctgccgaagctcacgtcaacagcgaccacttcaaggcggcctgtgagctgttcccaaccatcctgtctgagaccccagagatcatcaacacccttatcgagggcaagactgagtgggaccgcatggcagagttcgcagtcaac

SEQ ID NO: 1021 - DNA, 321 bp, Corynebacterium glutamicum
atgcatatcgtcaacattcgcttcaagcccaaggctaagtacgtggatacattccgctacacagtcgacaaattcactgagtcaaccaggacagaggaaggctgtctctactttgattggttccgcaacaccgattacccaggcgagtaccttgtaattggtgtgtggacggatgaaggtgcgacggaacataagaagagcgagcacttcttgcgagctcaagaaacacttccaccgttgctgcaacaaactccaatgattattcagagtgagttttccaagaagaagggttgggaacgtttcagcgatttcaccgtctac

SEQ ID NO: 1022 - DNA, 960 bp, Corynebacterium glutamicum
atgcgaaagaaaaaagacggtcaaaatctcccagacttccggaaaaatccgccaaagctggataaaaaggcttatgaaaaagaactaaaaagacttcaagccgaactcgtcgatttgcaacaatgggttgtggaaaccggtgcgcgcgtggtcatcgtcatggaaggccgcgacgccgctggtaaaggttctgcgatcaagcgcattacgcagtacctcaacccccggtccgcaaggatcgaagcgctgcccaccccaaactctcgggaaaaagggcagtggtatttccagcgctacatcgaaaaattgccgactgctggtgagatcgttatctttgaccgctcctggtacaaccgtgcaggagtcgagcgcgtcatgggattttgcacctcccaggagtaccgccgattccttcaccaggcaccaatctttgaacgcctgttggtggaagatggcattcacctgcgtaaatactggttctctgtatctgatgaagagcagattgagcgtttcgaagaccgcctgagcgatccgctgcgccggtggaagttgtcgccaatggatttacaatcgatcacccgctgggaagattactcacgcgcaaaagatgagatgttcatccacacggacatcccgtcagcaccgtggtacacggtggaatctgaggacaagaagcgttcccgcatcaacgtcatttcgcatctgctctcgacgattccttatgagaagatcgatcgtccattgccggaaatccctcatcgcccagattctgaatctgattatgtacgtccccctcgcgatgagttccgttatgttccagatgtggcagcacacttggaagaagagcgcatcaagaaagaagaaaaagccaagaaggcaaagaagccagctaaggctgcaggaaagaactcggataagcagaagtcttccggaggaaaaggcaagaagaagtccaagaaa

SEQ ID NO: 1023 - DNA, 792 bp, Corynebacterium glutamicum
atggactttcgcctcgtcgcgacagacatggacggcacacttttaaacacccaccacgaagtcccagagaaattttgggacatcctggaacaaatgcgtgccaaaggaatcgccttcgcaccagccagcggccgtcaattagccaccttgcaaaaacaattcgggcacgcgggtgaacccatttcttacatcgcagaaaacggcaccgtggtagtccacgacggcgaaattatctccctgaccaccatcgactccgacaccgtacactccatcatcgatgccgtgcgcgcatccgacatcgatatgggagtagtggtctgccgaccagaacgcgcctacgtcgaacgcaacgacgaagctttccgcgccgaaggcctgaaatactacgtctccatcgaggaagtccaagacctccacgaagcagtcaacaatgaagtaatcaaggtagcgatctttacattccaagatgccgaaaaggactgtgcccccatcatccgcgcagcctcccccaacgccaacgttgttgtctccggccagcactgggtcgatgtcatggatccttcagccaacaagggccaagctttggctgctctccgcgatgccctcggattggaagaatcccaaactctcgtgtttggcgactacctcaacgacactgaattgatcaaggccgccggcaagtcttacgccatgtccaatgcccacccggacattttggaattggccgacgaaattgcaccatccaacattgaagagggcgttattgtggtgctggagaagttgcttaacggt

SEQ ID NO: 1024 - DNA, 1017 bp, Corynebacterium glutamicum
atgtctaacgtagtgaacacttttgtccagaattccaccggtatggtggagcttaatcgtcccaaagcgctcaattctcttaatcaggaaatgatcgatctcgttcaggaagctctaaccacttgggctgatgatgatcaggtgcagcaggttctcatttactcatcctcggagcgtgcattttgtgccggcggtgatgtgcgcgcggtccgtgagagcgtgttggagggcgatgttgcggccggcgataagtatttcatcgatgagttcgcgatgaacaacacgttgggaacctatccgaagccggtcatttctgtgatcaacggcgtcgcgatgggtggcggaatgggaatttccatgcatggatcgcaccggatcgtcacggaaaaagcgttcgcgtcgatgcctgagatggcgatcggctatgttcccgatgtgggctttacttatttcggtcagcgtgcatcgtcgctggccatcgccacatttttggcggtgaccgggtggcgcatgagccctgccgatatgctgtgggctggcgtcgcaacgcattttgttgaggatgcgcaggggttcattgatgcggtcttgaacgagtcgcttgatggcgcgctggagaaattctccacgcaacctacgggcagcagcgagctggccggcgtcgccagccagattgaggagacctttgggcacagctcttgggcgcttatcgacgcctccctccggtctcaccccgatgctgaatttgttgccaaggtggatgggctgatggcgtcggcagcaccggcatcggtggtggctaccgtgaagctgatgcatcaaaacagtgaggcgaccactctgcgtgaaggcttggacaatgaattggcgatgtctctttatatgatccgccagcctgattttgctgaaggtgtgcgtgcagtgttggttgataaagaccgcaatgcagccttctccccagccaactacgaagatgttgatgagtcacattttgtgaccttgttccagcgcagttca

SEQ ID NO: 1025 - DNA, 654 bp, Corynebacterium glutamicum
atgcatcagcttcacggtagccaccaccgatgccggtgctgccgacgccatcagcccatccaccttggcaacaaattcagcatcggggtgagaccggagggaggcgtcgataagcgcccaagagctgtgcccaaaggtctcctcaatctggctggcgacgccggccagctcgctgctgcccgtaggttgcgtggagaatttctccagcgcgccatcaagcgactcgttcaagaccgcatcaatgaacccctgcgcatcctcaacaaaatgcgttgcgacgccagcccacagcatatcggcagggctcatgcgccacccggtcaccgccaaaaatgtggcgatggccagcgacgatgcacgctgaccgaaataagtaaagcccacatcgggaacatagccgatcgccatctcaggcatcgacgcgaacgctttttccgtgacgatccggtgcgatccatgcatggaaattcccattccgccacccatcgcgacgccgttgatcacagaaatgaccggcttcggataggttcccaacgtgttgttcatcgcgaactcatcgatgaaatacttatcgccggccgcaacatcgccctccaacacgctctcacggaccgcgcgcacatcaccgccggcacaaaatgcacgctccgagga

SEQ ID NO: 1026 - DNA, 777 bp, Corynebacterium glutamicum
atggccctttcggtggatggggccatgtttgcacaatgcttgaagaagggtagggcagtgaagccgctgggcaagatcgccgttccttggacttggtacctgggaattgttggggtcatcatatttgatgtggtggcagcaataacgatgctcaccctcgtgcccaacaaaatgcccgaaagagtcaacagtgggcttgtcgcgctgggtggatcgtatgcacccccgatgagccgggaaacactcattgccagagtcattgccggtgcagtgctggttctggtgatttctttaggtatttcgctgctgatttccgcgcagtccaagaacctcgcgtccgatcacccggatgcatctgccattcagattgctcggcgttgggcgtttttgaacaatattcaaagctgtatcggctggtttagtttcttcctcgcagcgattttgagcatctcatcgctaagactcaacggcccaggtgccaccacgcatcttgagatggccgtttacatcatcgctgtgtcggtgttggcttgggcgttgatgatttccttgcgacgcggccaggtggcgattgatcgtgccattccaattcgggaagatgattccgaactgaaatggggcatgatctaccacgatgcttcagacaaacgagttttcgtggaactcgatgatggccacacgaccgtcatcaacatggcgcgcgggggagcgtggctgctcatcgcagtgatggtgctgcctgcgctggccatcgtcggttgggttttgctagaaaac

SEQ ID NO: 1027 - DNA, 1212 bp, Corynebacterium glutamicum
gtgcatatccttaaaggtatggaaattccgctgcccacatcccttatcgatgtcatcactgatggtgccctcggccaaacctgcattgatcaggcatttgctgcccaattggggcgagttactggagtcgaattcaacctttctgacgataaaaccgcggctgaagtgaggatcaataaggcgtcggggagtccttttgataccaccggtgaagtcattgcgtggattaataatcaggaatttgagtgggtcagcacgcgcggtgaggatttgggactgcctgaattgcagggcattcagccgctcgacgatgatctgatcaccgccgcacgcacgctgtatagcaatgcgccggcgttcatcgccccgttgcgcgatggtcgcagggcgttggttgcgatcaatcacacgccaaaactggttggtatccgtcgcacgctcatcgaaggcctgcaggcgctgaagcctggaactgacctcaaacgggcattgacttcatttgctgcattctgcgaactgggcatccgattcgatgacaaccgcatctccttcagcgatggcacctcgctgttgcttcgtggcggcaaagtcatcgaaatcgcaggcgggctgagcttgcgcgacgtacgcgcggatgcggcgttcatgtccgctgagcatcaattgcttttcgacgccatctcctcgtctcacaacgtcacctttgacccacacaccaacgtggcgaccgtggcaaacgaacaccaagttcacgccatcccccttgctgttatcgacggcacgcgttgggtatggacatggtctttaaaagaactcaatggtcaagcaactgaaggccttgcccgctttggtttcgataacggcctactactgctcaccaatgcagagatccttgctgaggaagccaccgcattcaacctgattgatgtggctaaacaggtgctcaacacttggacgcacaccatcgtgcagcaacctgatggcaccggaattgtcctgctgctggatcatcctcggctgcagcttccgccagcatcacatgcagctgttgaggccacgctgtatcaccagctaccaggcgatattgatgcccgccgcgcggtggcgtcctatgcagctcaccgacagcttccttttgatggctacgcactcaccgttgagggccaacaagtcggcgtgacttttgacggcgagcatttaacaaaggtgggc

SEQ ID NO: 1028 - DNA, 1386 bp, Corynebacterium glutamicum
gtgttgtctggaaccggcatcgcagcagctcaagactctgcatttgactacggtatggatccgagcatgaactacaacccgatcgacgacatcaaggatcgtccccaagggttatccaaccttccctacttcggaagcaaactaaccagctggggctcatcagatgccaccgcctcatccggcatcgtcacctccgcactcccgcaatacaccgacccacgctaccccctcggcaaagacgacctgcccaaagcaaccatcgacatggagccagaagctcttgcgcgccttgagcgattcgtcggcgttgacggtgatcgcatccgccaaatcaacgcgtactcgccatcaatgggacgcaccattcctctagtctgggtcgtgccagaagacaacaccgtgcctggcccaacggtctacgcactcggcggcggcgacggtggccaaggcggccaaaactgggtcacccgcaccgaccttgatgagttgaccagtgaaaacaacatcaacctcatcatgcccatgctcggatcttttagtttctacgctgactgggcaggcgaaagcgaatccatgggtggtgcgcaacagtgggaaacattcctcatgcacgaactacccgagccgctagaagcggccatcggcgcagacgggcaacgcagcatcgtcggcatgtccatgtccgggggatcggtgctgaactttgcgacgcatgaccccaacttttattcctctgtcggctcattttctggatgtgccgaaaccaactcctggatggggcgccgtggcatcgcagccactgcctacaacggcaatgtcgtgcctgagcaaatctttggtgaagtagacagtgattactctcgctataacgatcctttgctcaacgctgcgaagctcgaagaacaagacaacctctacatcttcgccggttccggtgtgttctctgaactagatgtcatcggtgacaacgcaccgattgatgaggatgcgttcaaaaaccgcgtcttggttgggtttgaaatcgaagctatgtccaacacctgcacccataacctcaaggctgcgaccgatcaaatgggcatcgacaacatcaactacgatttccgaccaaccggaacccacgcctgggattactggaacgaagcgctccaccgcttcttcccgttgatgatgcagggcttcggcctcgacggtggtcccatcccgatctataaccctaacggtgtgacctccagcgagtcttcctcagaactgtcttctgatgtgagccttggcaccgtgatcggtagtgtggcgggaagctccggatcaagtgcaggcagcagcgtccgagagttcattgcaggaagttccggatcaagccaatcagcaggaagcttctacgaa

SEQ ID NO: 1029 - DNA, 579 bp, Corynebacterium glutamicum
gtgtcggggcttagagaaacaaaaaaggctgctacgcggacagcattgtcacgtgctgctgcggagatcgccttgatggaaggccctgaggcgttcacggttgcggccattgcagctgcagccggggtctcccccaggacttttcataactacttcccttctcgggaagacgcattggtgcaatttgtggtcattcgcgttcaggaactcacggatcagctatacgagtttcctacaagcgtgcccccacgagatgccattgaacaattggtgataaaccaattgcgggatggcgatgacgctatggattctttcagcgcaatgtttcgaatcggtgagatccttgaaaatcttgaccccatcaagtgtgttatcgataaggagcgactcattgctccgttgcttgagttcatggttgaacgtgacaaagaccttgacaagttcgatgcggcaactctgatccatttgcatgcagcggcaattgcaacctcgctgcatacgttttaccaagcttccgagccccgggacatagaagatggagtcgcattgatccgtcgggcatgcgcctggattaagaaa

SEQ ID NO: 1030 - DNA, 2373 bp, Corynebacterium glutamicum
gtggcgaaattcctgtataagttaggctccacggcctatcaaaagaaatggccgtttcttgcggtctggctcgtgattctcataggtatcacgacgctggcggggctgtatgccaagccaacgtcgagtagcttctctatccctggtcttgattctgtcacgaccatggagaagatgcaggagcgtttccctggttcggatgatgcaacatcggctcccactggttctgtcgtcattcaggcaccggaaggcaagaccctcactgatcctgaggttggggctgaagtaaaccagatgcttgatgaggttcgggcgactggtgtgctgaaggatgctgattccgttgtggatcctgtgttggctgcgcagggtgtggctgctcagatgaccccagccctggaggctcagggtgtacctgcggagaagatcgccgcagatattgagtcgattagtccactgagtgcagatgagactaccggcatcatctcgatgacttttgatgcagattctgccatggatatatccgcagaggatcgtgagaaggtcaccaatattcttgatgaatacgatgacggcgatctgactgttgtctacaacggcaacgtgtttggcgcagctgcaaccagcttggacatgacctctgagctcatcggcctgctggtggctgcggtcgttcttatcgtgaccttcggttcgttcatcgctgccggtatgccgctgatctctgcaatcattggtgtcggaatcggcatcatgggcattcagttagccacggcgtttactgattcggtcaatgacatgactcctaccctggcgtcgatgattggtctggctgtcggtatcgactacgcgctatttatcgtgtcccgtttccgcaatgagttgatttctcagactggcgctaatgatctggagccaaaggaattggctgagcgtctgcgcaccatgccgttggctgctcgtgcgcatgcgatgggaatggctgtgggcactgcgggttctgcggttgtattcgcgggtaccacggtgctgatcgctctggttgctctgtcgatcattaatattccatttctaaccgtgatggccattgctgccgcaatcaccgttgccatcgcagttctggttgctctgtccttcctcccagctctgcttggcctgcttggcactcgcatcttcgcagcacgcgtgcctggacctaaggttccggatcctgaggacgagaagccaacgatgggtctgaagtgggtccgccttgtgcgcaagatgccggtggcttacctgctggttggcgtcgttttgcttggtgcaatcgcaattcctgcgaccaatatgcgcctggccatgccgactgatggcacctccacgctgggcaccgcgccgcgcacggcgtatgacatgacggcagatgcgttcggcccgggccgcaacgcgcccatgattgcgcttatcgacgcaaccgacgtccctgaggaagaacgcccattggtgtttggacaggcggtggagcaattcttgaacactgatggtgtgaagaatgctcagatcactcagaccacggagaatttcgataccgcgcagatcctgattaccccagaatttgatgcgatcgatgagcgcacctctgagactctcgcaactcttcgtgcagatgctgagaccttcgctgatgacaccggcgcgacgtatggcattactggcgtcaccccaatttacgatgacatctctgctcgcctcggcgacgtcctggttccttacgttctgatcgttttggttctagcgttcctcgtgctgttgctcgtgttccggtccatttgggtcccattgatcgcggctctgggctttggcttgtcagttctggctacctttggtgctaccgtggcgatcttccaagaaggtgctttcggcatcatcgacgatcctcagccactgctgtccttcttgccgatcatgctcatcggcctggtatttggtctggccatggattaccagatcttcctcgttactcgtatgcgtgagggcttcaccaagggcaagactgcgggcaacgcaacgtcgaatggtttcaagcacggtgcccgcgtggtcactgctgcggcgctgatcatggtgtctgtgttcgcggcattcatagcgcaggacatggcgtttattaagaccatgggctttgctctggccgttgctgtgttcttcgatgccttcgttgttcgcatgatgattatccctgcaacaatgttcctgcttgatgacaaggcttggtggctacctaagtggttggataagattcttcccaacgttgatgttgaaggtgagggtcttagtgaactacatgaggctcgcaccgaggaactgaaggaaaatgtaggtgtcggggct

SEQ ID NO: 1031 - DNA, 498 bp, Corynebacterium glutamicum
atgactcaaagtgctccagaattcattgccaccgcagacctcgtagacatcatcggcgacaacgcgcaatcatgcgacactcagtttcaaaaccttggaggtgccacagaattccacggaataataaccaccgtgaaatgcttccaagacaacgccctcctgaaatccatcctgagcgaggataatcctgggggagtgctggttatcgatggcgacgcatccgtgcacaccgcgctagttggcgacatcattgcaggacttggaaaagatcatggttggtccggagtaattgtcaacggagcaattcgagactccgcagtcatcggcaccatgacctttggttgtaaagcccttggaaccaacccgcggaaatccactaaaactggttccggcgaacgagacgtagtggtatcgattggtggcattgacttcattcctggtcattacgtctacgcggactctgacggaattatcgtcaccgaggcgccaattaagcag

SEQ ID NO: 1032 - DNA, 666 bp, Corynebacterium glutamicum
gtgccccaattgtttcatgccgtgagttttgcattaatggactccgtaaatgtcctgctcattggcataatcgtcgcgattgctgctttgctgcctcgcaagggtaaatatgggccaatcgccacgctactggttgccggcgattggcttggcgttttcctcctcagtattttggtgatgctcgtttttgatggactagaggatttagttcagggctttttggattcaatctggttcggagtcatccttcttgtaactggcatcgtttccttcgttgcgacactggtttctaaaaccgacagcactagaaagcttgatggattcctagcgccagtaaaaactcctagttggaaaactgttggagccggattgatccttggaatcgttcagtcagcgacatctgtacctttttatgcagggcttggatatttgagcgttggcaatttcagtccagaaattaggtatggcggacttgtggtctatgcgaccttggctctgagtctgccgattatcgtggcaattctcgttggaatggttcgcaaataccctgaaagtcctgttggtaggttgtttgaactgattggtcaaaataaagagagagtcaccaaatggtcgggctatctcgtgtcactggttctgtgcataatgggcattacttcgatcctg

SEQ ID NO: 1033 - DNA, 381 bp, Corynebacterium glutamicum
gtgtgccaaattttgaacccgaaaccgaagcgtcatttcatcaaatcaaacatcgaaatccccatcgatggaggtaagaagaagctcgattatggaggttgggttgaggtggaacactctgacctcatgacatatctgaattatcgcaatgtgatgaaaaaggttcgcatcccaggattcttggcaagcaaattcccaggcctcgaagactcttatgggacgccagttcttttaactgtgaagcatgaagactattacccgcatttccagccactcgaagaatcctcgagcatgtatcaagacttccacaaaggaatttcctcgagggaagctgaccttcgaatcaatagttggctactagtgactcatgagtacatgcgc

SEQ ID NO: 1034 - DNA, 1551 bp, Corynebacterium glutamicum
atgagcatcaccacacacgtccaagcactcaccacagcactcaacgccatcgacaaccatttggccagcatgcttgaccatggtgtcaccccagaccaatacaaggccatcgagcccgacctcatcgccctagaacacaccatcaaccaccacgccaccatcgccgcccaaaccaccgccctcgccgaacgcaccaatgctgcgcagtcgattggctccacccacctcatcgactacctcaccaccaccttcggcctatctaaagcacgcgcccaccaccgcatcaatctcgcccactccctctaccccataccgaagccaaactctggatctggcaacggcggtaatggtggcaatcccgacggtggtcctgatggtggcgactcgggtgatgacgactccggcgatgatgaccccgaccccgaaccggacaagcctgaagacggcaaacctgatagtgataagccccgtaggccacggatcagcgcggaaaaacacgccatcatcaccgacgaactcgcccgcctcaacccgaataccacacccagcgccgaggaactgcgcaaccaagccctgagtcaggcgatctggcgcaccccagaagacctccgcacgtggctacgccaccaggtcaccaccgcgaacaaaaacaaccccaaccccatcaccgccatgaaaaggcgctacctctcagtaggtaaacccgatgccgacaacatggtccgcatcagcggcctcgtgcccgcagccaccgcagcactgatcaccgcgaacaccgcaccgttaaccaaacgcggcaacctcgtggatctaccagcagcagaagatatgcgcacccgagggcaacgccatgcggacgcgttgcatcacatcatggagatctacaaccacggtattgtcaccccagctcgtggtggaacagccagcatcatcatctccatgaccaccgatgatcttgacgagatcaaccacgccaacagcagtggtgaaagtctgcttaacaacctgtaccccaccaatacgggttactcattgaacttggcggagatcatgaacctcatcgctgcgaaatacgacttcgctgtgctcctcgatggtgagacggggcagccgttgaacgtcaatcggatgcagcgctcagcgaacctgactcaacgcatcgcgttgtttgcttctgagttggtgtgctcggcacccaattgtgatcggccgcagttagagtgcgaggttcatcatttagatccctggatgagaggtgggctgaccaacctggtcaatctcacgcatcagtgctttaatcaccacccacgcaacgatgattccaggagtggggtcaatggtaaagggtttatggaccgcgatcctgctactggaagagtggggcactacccagtgggtggtgaggggccggtgtttaaccggtcggctgctgctgatcgttccggtggtgcgtgggcgaggcgtaagcatcatggcccgccacccacaccgccggacccgccggatccgcctggtcctgagccggatcctggtgatgagggcagattgttc

SEQ ID NO: 1035 - DNA, 936 bp, Corynebacterium glutamicum
atgaaggataggcgccacttgtcgctgaacagtgcaatcagttcgccgtcggtgcgggtgaagatttccacgccgcgctgcttcgccagttccggtgcggtttcggcggtggtgcggcgggcgacggagtatggaatcggatcggcgacggtttcgacgttgtattcgacttccatgcgggcttgcatcacttcgaactgcattgggccgacagcggccatgactgggttggcgtcgccacgcaggtcgttcttgaggatctggacgacaccttcggagtccagctgctcgagggctttgcggaactgtttgtatttgccgagtgatttggcgcgcaggatgcggaagtgttctggcgcgaattttggcattggtgggtattggatttttcggccttcgaagatggtgtcgcctggtgcgagggcgccggcgttgacgaggccgacgatgtcgccggggaaggcggtttcgacggtagagcgggtgcggccgaagacggtgagggcgtatttggtggagaagctgcggccggattgggagtgggtgacttgcatgccgcggtcgaattcgccggagacgacgcgcatgaaggcgagggtatcgcggtggtttttgtccatgccggcttggactttgaagacgacgccggagaagtcgtcggtggtgtcgcggtggtcgtccattgcggaggtggcggcttcgagggctttggggtctgcgtcgcggccggcgggggatggtgcgagttggcagagggtgtccaggatttggtggacgccgaagttgagcatcgcggaggcgaagatcagtggggaggtggtgcagttgaggaagagttcctggtcgtggacggcgccgtcggctgcgaggagttctgcttcttcggtggcgttttcccagacgtcgccttcgcgttcgatggcttcttctggggtg

SEQ ID NO: 1036 - DNA, 1647 bp, Corynebacterium glutamicum
atgagcaacgccaatcccgacaccaccgccgccgaggcacatcgccgcagaacattcgccgtaatcgcacaccccgacgccggtaaatccaccctcaccgaggcattggcgctgcatgcacacatcatctccgaagccggcgccacccacggcaaagcaggccgcaaagccaccgtttccgactggatggaaatggaaaaagaccgcggcatctccatcgcctcctccgcactccaattcgagtacgcaccagaaggccacgcaggcgagcccttcatgatcaacctcgtggacaccccaggccacgccgacttctccgaagacacctaccgcgtcctcatggccgtcgacgcagcagtcatgcttatcgacgccgccaaaggcctcgaaccccaaaccctccagctcttccgcgtctgcaaagcccgcggcctgccaatcatcaccgtgatcaacaaatgggaccgcgtcggccgcaccccactcgagctcgtcgacgaaatcgtcaaagaaatcgaactccaaccgaccccactgttctggccagtcggtgaagccggcgacttccgcggcctagcccgcatcaacaacgacggcgaagtcgaagaatacatccacttcacccgcaccgccggcggctccaccattgcccccgaagacttctacaccccagaagaagccatcgaacgcgaaggcgacgtctgggaaaacgccaccgaagaagcagaactcctcgcagccgacggcgccgtccacgaccaggaactcttcctcaactgcaccacctccccactgatcttcgcctccgcgatgctcaacttcggcgtccaccaaatcctggacaccctctgccaactcgcaccatcccccgccggccgcgacgcagaccccaaagccctcgaagccgccacctccgcaatggacgaccaccgcgacaccaccgacgacttctccggcgtcgtcttcaaagtccaagccggcatggacaaaaaccaccgcgataccctcgccttcatgcgcgtcgtctccggcgaattcgaccgcggcatgcaagtcacccactcccaatccggccgcagcttctccaccaaatacgccctcaccgtcttcggccgcacccgctctaccgtcgaaaccgccttccccggcgacatcgtcggcctcgtcaacgccggcgccctcgcaccaggcgacaccatcttcgaaggccgaaaaatccaatacccaccaatgccaaaattcgcgccagaacacttccgcatcctgcgcgccaaatcactcggcaaatacaaacagttccgcaaagccctcgagcagctggactccgaaggtgtcgtccagatcctcaagaacgacctgcgtggcgacgccaacccagtcatggccgctgtcggcccaatgcagttcgaagtgatgcaagcccgcatggaagtcgaatacaacgtcgaaaccgtcgccgatccgattccatactccgtcgcccgccgcaccaccgccgaaaccgcaccggaactggcgaagcagcgcggcgtggaaatcttcacccgcaccgacggcgaactgattgcactgttcagcgacaagtggcgcctatccttcatcgagaaggagcaccctgatttcgtgctggagtcgctggtagctgag

SEQ ID NO: 1037 - DNA, 1269 bp, Corynebacterium glutamicum
atgtcccgtccaatcgttaaacaagcattcaccgtcaccgcagtcaccgcgatggcttttgccctggcatcatgcacccgcgcagtggatgcaacctccgcagatggaaccgcgagcaacaccgcagcttcctgtgtggatacatccggcgactccatcaaaatcggcttcatcaactccctgtccggcacgatggctatctctgaaaccacggtgaaccaatccctgcacatggcagccgatgaaatcaacgcagccggcggcgttttgggcaagcagttggagatctctgaagaagacggcgccagcgaacccgccaccttcgccgaacgctcccaacgcctcatccagcaggaatgcgttgcagccgtgtttggtggatggacctccgcctcccgcaaagcaatgctccccgtctttgagggcaataactccctgctgttctacccggtgcagtacgagggcatggaatcctcgccgaatattttctacaccggcgccaccaccaaccagcagatcatcccggctcttgattacctgcgtgaaaacggcctgaaccgccttttccttgtcggttccgattatgttttcccacgcactgcaaattccatcatcaaggactacgccgaagccaatggtatggaaatcgtcggcgaagactacgcgccgttgggatccaccgacttcaccaccatcgccaaccgcatgcgtgactccaacgcagatgccgtgttcaacactttgaatggcgattccaacgtggcgttcttccgccagtacaacagcctcggcttcaatgcagacacccttccggtgatgtcagtatccattgcggaagaagaagtcggaggcatcggcaccgcaaatattgagggccagctggtggcgtgggactactaccaaaccatcgacaccccagaaaacgagaccttcgtggagaatttcaaggacctctacggccaggacaaagtgacctccgatccgatggaagctgcttacactagcctctacctctggaaagaaatggtagagaaggccgattcctttgatgtcgccgcaattcaagcagccgccgacggaaccacttttgatgcaccagaaggaaccgtggtggttgacggcgataaccaccacatctccaaaacaccgcgcatcggtcgaatccgcccggatggattgatcgacaccatttgggaaaccgattccccagttgatccggacccatacttgtcttcctatgactgggccaagaccaccgctgcgacttcc

SEQ ID NO: 1038 - DNA, 882 bp, Corynebacterium glutamicum
atggacattttactcaatcagctcgtagccgggctttcagttggatcggtccttctattggtcgcagtgggattgtcactgacctttggacagatgggcgttattaatatggcgcacggagagttcatcatggtcggcgcatacaccgcatatgtggtgcagctggtcgtcggttctgccggtttatccctactgatcagcattccgctggcctttattatcggtgggcttttcggagttctcctcgaacaattcctgctgaagtatctttatcacaggccactagacacgctgctggccacattcggtgtcggtttgatccttcagcagctggcccgaaacattttcggagctcccgcagtggatgtcagggcaccggaatttctccgcggaaacgtcgaagttctaggcgtcttggtgccgaccgcgcgactattcatcctggcgctggccatcgcatcagtgactgcactagctgtgttcctaaatcgcactgcctggggccgacgcatccgcgccgtggttctgaaccgcgacctcgcggaaaccgcaggtattgatacccgagctactgaccgaatgacgttctttgtgggctccggtcttgccggaatcgccggggtagctatcacattgattggcgcgaccggccccaccatcggtcagaactacatcgtggatgccttccttgttgttgccgccggtggcatcggccgggtgaagggcgctgtgatcatggctttcgtgctgggaattactcaagcattcgtggaatatacgacaggtgcgagcatcgcgaagttcatcgtactcatcgctgttgttgccttcctgcagtttaggcctcaaggactcttccaaacccaaactaggagcctcgta

SEQ ID NO: 1039 - DNA, 1077 bp, Corynebacterium glutamicum
atgagcactcaactcaagctgaagaagcccgcaaagaagaaaactacgccgaaacttagcgtcgtaaatgctcccacgctgcgcactgcggcgttgggcctggccgcgctcgctgcggtattgctgtgcgccccgctctttttatccacattccagctgacgttgatgtcgcgcttggtgtgttatgcgatcgtcgcagtcggcatcgggctggcgtggggcagaggcggcatgctcacgctggggcaaggcgtgttctttggaatcggcgcgtacatcatggccatgcacatgctgtacagcgattcgcagatttttgggaccacagttccgcaatggtggtccatttttgccaacccggcagtcgcactcatcgcagttgtggcgcttcccggcatcgtggcttttgtgctcggcttctccattttcaaacgacgcatcaaaggcgcctactttgccatcgtgaaccaagcgctcgccgcagctgttgtggtgttgctggtcggacaacaagattcccttggaggttccaatggtctttccggatttcgatcgttcatgggttttgccgtctacgaccccatcaaccgcatcatgttttacttcaccgcagtgggagttctcttggctttggtggctatctcatattggctcatgcgcagccgctatggagaactgctcgtggccaccagagatgcagaagaacgcgtccgattcctcggatatgatcccgcattgatcaaaaccgccgcatatgtcattgctgcgatgattgccggaatcgccggagcgctgttcgtgccgatcgtgggcatcatttcacccgcagaaatcggcgtggtgccatcaatcgtgttcgtgatcgccgtcgccgctggtggcagggcatccctattcggtcccgtagttggcgcgctggtgctgggctgggtggaatccacacttgctcaaactttccccagcatgtggtcctatttccagggtgcgatcctggttctcgtgatcgtgttgctgccgggcggaattgcttcaattaaactttccgcgctcaaaaataaggccaggaaggccacctca

SEQ ID NO: 1040 - DNA, 726 bp, Corynebacterium glutamicum
atgagccttaaaatcaccaacctcaaagtcgctttcgggtcgttcatcgccgtgaatgagattagttttcaggtgctgcccggtcacgtccacttcctcatcggtgccaacggtgcaggtaaaaccacctgcattgacgcgatcagcggattggcgccggggcagggatcagtgcagttggatggcactgagattctgggaacccctgtgcaccgcattgctcggatgggtgtggggcgaacgtttcagaccgccagcgtgtttgaagaattgtctgtgttgcagaatctggatattgcgtgcgggattcatcgtccgttgcgggcgcttctcggggtgcgtcatcggattgatccccgaattgaacacgccctggaggtcacgggtcttgctgatctggtgaatgctcaggcgggaaccttgtcgcatgggcagaaacagtggctggaaattgcaatgttgctggtgcaggatgcgcaggtgctcatgctggatgagccggtggcgggcatgagtgaggaggagcgtgtcgcaacgggtgagcttttgcagagggttgcgcggggacgggtggtgttggtggtggagcacgatatggagttcatgcgtcgttttgccactcgcgtcactgtgatgaatcgcggcacgatcttgtgtgaggggtcggtcgatgagattcaggcgaatccggatgtgcagtccatttatttaggtacggcagggaag

SEQ ID NO: 1041 - DNA, 699 bp, Corynebacterium glutamicum
atgttggaaatcactaatttgtgtgcaggttatggccgcacgcaggtacttcattctctttcaatctccacgagcagcaacggcatcctgtcgatcctcggccacaatggcgctggtaaatccaccttgctgcgaaccgcggtggggttgattaagccgacttccggagaggtcaaacttttcggccaggatgtcacctcgttgtccacgcatgagcgagtaaagcgcggaatggcttatgtgccgcagggccagcagtcttttacgcagcttagttgcatggaaaatttgcaggtggtagcggatctgcagggacgtgtgggcaaggcacgcatcgcggaggcgcttgatcgctttccggcgctgacccaggtgctggaccgccaagccggcctgttgtcgggtggtcagcgtcagcagcttgccatcgcccgcgcgctgatcacggcgccaaagcttttgcttctcgacgaacccaccgagggtattcagccttcggtggttgctgaaattcagcagaccatcatcgatttggctaaggacggcatgagcattgtcctggtggagcaaaacattggttttgcattggatgctgcaacaagctacgccattgtggcgcgtggtcaggtcgtggaatcgggacaaggcgctgaaaccaccgcagagaagcagactaaagtgcgggaatctctagcaatc

SEQ ID NO: 1042 - DNA, 612 bp, Corynebacterium glutamicum
atgacttccgtgagttttttgtctaaaatccaagcactgtttgcccccaagcctgaacttcccgccgccaaatggctggtcgtgggcctgggcaaccccggcgccaagtacgaatccacccgacacaacgtcggttacatgtgccaagacatgcttatcgacgcccaccagcagcagcccctcacccccgccacgggctacaaggccctcacaacgcagctcgcaccaggggtgctcgccgttcgatccaccacttttatgaaccactccggccaaggtgtcgcaccgatcgccgcagcgttgggtatcccagcagagcgcatcatcgtgatccacgacgagctcgatctgcccgctggaaaagtacgcctgaaaaagggcggaaacgaaaacggtcacaacggcctgaaatccctcacggaagagctcggcaccagagactacctgcgcgtccgcatcggcatttcacgaccaccagcaggaatggccgtgcccgactacgttttggaaccagtcgatcacgaccaaccaggcattgaacttgccgccgaggcagtggatttgctgctggcccagggattatctgctgcgcaaaacgctatccacagccgc

SEQ ID NO: 1043 - DNA, 1023 bp, Corynebacterium glutamicum
atgagcatccttgacacgttgaaaactcccgtgattgtcgccccgatggctggcggcccgtccactcccgcgttggtcaatgcagcagcagaggcaggttccctcgggttcttggctggtggcgtcatgcctcttgagcagctgaaacaggaattgtcagaggtaaaaggcgtctttggcgtcaacctgtttcgcccgcagacggatgcgcctaagccttcagacattgatgagctggcgggattgttgtcctcggcgtttcggcaatttggcctcgatgagccgacggtgcctacgccggatttgagcaatgggtgggaggctaaatttgaggccgttcttgccgctaagcccgccgttttttcctgcacctttggtatttttagcgctgaagaattcgcccggatcaaagccaccggaattgaggcgtgggtgacggtgaccaatccggaggacgcgctggctgcgcagaaagctggcgccaacgcgcttgtcgtgcaaggccccgaggcgggtgggcaccgctctacctggtccattgaagtggagccggacgagcgcgacctgaaaaccctcctcgcagctgtcaaacaagcgggcgtttacctcccgctcatcgcagccggcggcctttcaacctccgcagacgtggcagcaattttagaagccggcgccagcgctgcctcctgtggttccgcctttttgcttagcgacgaagccggcaccagctcacttaaccgcgagatcttggacgccgccccagcacttggtttggaatcggtgtcatctcgcgcattttcgggccgttatgccaggggagtggaaaccaggttcacccgttcgaacgaggggttacccccgttgtacccatacctcaacccaatgatcacatctttacgtaaggtggcgggaagtgcagggaactgggattacgcctactgcctggtaggagtcggcctggaatcgattgcgaagggtagtgcaaagcagatactggaatcattaacaccttccgctttgggc

SEQ ID NO: 1044 - DNA, 1065 bp, Corynebacterium glutamicum
gtgctgtacggtttcggccgcatcggtcgcctgctggcccgcatcctggtttcccgcgaggcactgtatgacggtgctcgtctgcgcgccatcgtggtccgcaaaaatggtgaagaagacctggtcaagcgcgcatccttgctgcgtcgtgattctgtccacggtggattcgatggcaccatcaccaccgattatgacaacaacatcatctgggccaacggcaccccaatcaaggtcatctactccaatgacccagccaccattgattacaccgaatacggcatcaatgacgccgtcgtggtagacaacaccggccgctggcgtgaccgcgaaggcctgtcccagcacctcaagtccaagggcgttgccaaggttgtactcaccgcgccgggcaagggcgatctgaagaacatcgtgtacggcatcaaccacaccgacatcaccgcagatgatcagatcgtttccgcagcatcatgcaccaccaatgccattaccccagtgctcaaggtgatcaatgatcgctacggcgtggaattcggccacgtagaaaccgttcactccttcaccaatgaccagaacctgatcgacaacttccacaagggttctcgccgtggtcgcgcagcaggtctgaatatggttctcaccgaaaccggcgctgcaaaggctgtatccaaggcgcttccagagctggaaggcaagctcaccggcaatgccatccgcgttcctacccctgacgtgtccatggctgtgctcaacttgaccctgaacacggaggtggaccgcgatgaggtcaacgagttcctccgccgtgtgtccctgcactctgacttgcgccagcaaatcgactggatccgttccccagaggttgtttccactgacttcgtgggcaccacccacgcgggcatcgttgatggtctagccaccatcgcaaccggtcgccacctggtgctttacgtgtggtacgacaacgagttcggctactccaaccaggtcattcgcatcgtcgaggagatcgccggcgtgcgtcctcgcgtgtacccggagcgcaggcagccagccgtacta

SEQ ID NO: 1045 - DNA, 369 bp, Corynebacterium glutamicum
atggtggctagaccatcaacgatgcccgcgtgggtggtgcccacgaagtcagtggaaacaacctctggggaacggatccagtcgatttgctggcgcaagtcagagtgcagggacacacggcggaggaactcgttgacctcatcgcggtccacctccgtgttcagggtcaagttgagcacagccatggacacgtcaggggtaggaacgcggatggcattgccggtgagcttgccttccagctctggaagcgccttggatacagcctttgcagcgccggtttcggtgagaaccatattcagacctgctgcgcgaccacggcgagaacccttgtggaagttgtcgatcaggttctggtcattggtgaaggag

SEQ ID NO: 1046 - DNA, 531 bp, Corynebacterium glutamicum
gtgaataactctccccttttagttgttggcctgggaaatcccggcccgaaatacgttggcacccgccacaatattggctttgaggttgcagaagaactagtgtcgcgcagctttggatcatttagtgtgcacaagcgctccaacaccgatatcgcgcagcttcctgggctaattgtggccaagccgcgcagctttatgaacctgtcgggaactccgattcgggcgctgtgtgacttctttaagatttccccagccaatgtcatcgtggtgcatgatgaattggagcttgatttcggctcagtgaagctacgtcagggtggcggggatcatgggcacaatggtctgaaatccacgtccaaatctttgggaactaaggactattggaagctcagcatgggtatcggtaggccaccgggtcggatggatccggcaagttttgtgttgaagccttttggcaagcaagaactggcggatattcccatcatggcggctgacgctgcagatctcgtcgaaaagcatttgcagcagggc

SEQ ID NO: 1047 - DNA, 600 bp, Corynebacterium glutamicum
atggcaaagtaccaaaccattgaggctgctgtccgctctgagttcggcaagggctctgcacgtcgtgcacgcgttgctggccagatccctgctgttgtttacggcgcagatgttgagtccaacctgcacgtcaccatcgaccaccgcaccttcgctgcgctggttcgccaggaaggcgtaaacgctgttcttgagctcgacatcgagggccagaagcagctcaccatgatcaagcacatcgaccagaacgtgctgaccttccacatcgaccacttggacctgcttgccattaagcgcggcgaaaaggttgaggttgacgttccagttatcgtcgagggcgagccagctccaggcaccatgtgggttcaggatgctgacaccatcaaggttgaggctgacgttctgtccatccctgaagagttcaccgtttccatcgaaggccttgagctcggcgcacagatcaccgcagctgacatcaagctcgagggcgacaccaccctggttgaggatcctgagaccctcatcgtcaacatcgttctcccagctgtcgaggaagaagacaccgaagaggacgaagcagctgaagaagcagctactgag

SEQ ID NO: 1048 - DNA, 429 bp, Corynebacterium glutamicum
atggcacgacttcagcacgacatgattttcatcaacctaccagtatctgaccttgcagcatctaagcgtttttatgcaggtcttggcttcaaagaaaacaccgtcttcagtgatgagcacactgcatcttttgaggtcagtgacgccatcgtggtgatgcttctggaaaccgcgcgcttcagtgatttcactaagcgccccatcgtggagaagaacggctcccgcgaagtgctcaactgcctgtctgtatgttccaccgaggatgcggatgagttcgtgcgtcgcgcccaggaattcggaggcacgatcacccgtgagcttgcagcggaaggccccatgtacggcggagcttttgatgatccagatggacacggttgggagctgatgtacttcgatccagaggcactcgctcagatgatgcctgagggc

SEQ ID NO: 1049 - DNA, 624 bp, Corynebacterium glutamicum
atgcccaccacggacgtcttcaaccgcgtccggttggcattggaacctctagctgatcccgcacgtgccaccggaatggcaagctacatgcgggatcagttttcttttctcggcatcccatccacccccagaaaagaagcctgcaaacccgtgctgtccgcgctaaaagagttggacactgactttgtctcagactgctttggcgcagctgaacgggaataccagtatgtcgcctgcgatcacatcaatcgcgtcggcatcaccgatctaggttttgccaaagcattagtgcagaccaaatcctggtgggacaccgtcgattccctagcaaaaccgatcggcgccaaacacgatgatgatctgatgaaaacgtgggcgcttgatgaggacttctgggtgcgccgcatcgcgatcatccaccaactgggccgcaagaaaaacaccgacgctgccctgctggcctggatcatcgagcagaacctcggctccagcgagttcttcatcaacaaagcgatcggctgggcactgcgggatttcgcccgccacgaccccagctgggtccgggcttttgtcgacgccacggacctttccccactgagccggcgagaagccctgaagaatatt

SEQ ID NO: 1050 - DNA, 975 bp, Corynebacterium glutamicum
atgactgctcactggaaacaaaaccaaaagaacctcatgctgttttcgggtcgtgcgcacccagaactggcagaagctgtagctaaagagctcgacgtcaacgtcaccccaatgacggcacgcgatttcgccaacggtgaaatctacgtccgcttcgaggaatcagttcgtggctccgactgcttcgtcctgcagtcccacacccagcctctcaacaagtggctcatggaacagctgctgatgatcgacgctttgaagcgtggttccgcaaagcgcatcaccgcgatcctgccgttctacccatatgcccgccaggacaagaagcaccgcggccgcgagccaatttctgctcgcctcatcgccgacctcatgctcaccgctggcgcggaccgtatcgtgtccgtggacttgcacaccgatcagatccagggcttcttcgacggcccagtcgatcacatgcacgccatgccgatcctcaccgatcacatcaaggaaaactacaacctggacaacatctgcgtggtctcccctgacgcaggtcgcgtgaaggttgcagagaagtgggctaacaccttgggcgatgccccaatggcgttcgtgcacaagacccgctccaccgaggtagcaaaccaggttgtcgccaaccgcgtcgtcggtgacgtcgacggcaaggactgcgtgcttctcgacgacatgatcgacactggcggcaccatcgccggcgctgtgggcgtcctgaagaaggctggcgcaaagtcagtcgtcatcgcctgcacccacggtgtgttctctgacccagcccgcgagcgcctgtctgcatgcggtgctgaagaagtcatcaccaccgacaccctgccacagtccaccgagggctggagcaacctgaccgttttgtcgatcgcaccgctgctggctcgcaccatcaacgagatcttcgaaaacggttccgtcaccaccctcttcgagggcgaggcc

SEQ ID NO: 1051 - DNA, 1455 bp, Corynebacterium glutamicum
ttgagcgcaagcgatttctcgagcgcagttgtcgttttggcagctggtgccggaacccgaatgaaatcagacttacaaaaaacgttgcatagcatcggtggacgcagtctcatttcacatagcttgcatgcagctgccgggcttaatcccgagcacattgttgcagtaattggacatggacgcgaccaggtgggtccagccgttgcccaggttgcagaagaactggaccgggaagtcctcatcgctatccaagaggaacaaaatggcacgggacacgctgtgcagtgcgccatggatcagctcgagggctttgaaggcacgatcattgtcaccaacggcgatgttcccctgctcaccgaccacactctgtctgcactgctggatgcacacgtggaagttccaaccgctgtcaccgtgttgaccatgcgtctggatgaccccaccggctacggccgcatcgtgcgcaacgaagaaggcgaagtcaccgccatcgttgagcaaaaagatgcttcagcagaagtccaagccatcgatgaggtcaactccggtgtctttgctttcgacgccgccatcttgcgttccgcactggctgaactgaagtccgacaacgctcagggcgagctgtacctgaccgacgtattgggcattgctcgtggcgagggccacccagtgcgcgcccacaccgccgccgatgctcgtgaactcgccggtgtcaacgatcgtgtgcagctcgcagaagccggcgccgaactaaaccgtcgcaccgtcatcgccgctatgcgtggtggcgcaaccatcgttgatccagcaaccacctggatcgatgtggaggtttctatcggccgcgacgtgatcatccaccctggcacccagctcaagggcgaaactgtcatcggagaccgcgttgaagttggtccagacaccaccttgaccaacatgaccatcggcgacggcgcatccgtaatccgcacccacggtttcgactccaccatcggtgaaaacgccaccgttggccccttcacctacatccgcccaggaaccacactgggaccagaaggcaagctcggtggcttcgtagaaaccaagaaggccacaatcggccgtggctccaaggttccacacctcacctatgtcggcgacgccaccatcggcgaggaatccaacatcggagcctcctctgtcttcgtgaactacgacggtgaaaacaagcaccacaccaccatcggcagccacgttcgcactggttctgacaccatgtttatcgctccagtgaccgtgggtgacggagcgtattccggagccggtacagtaattaaagacgatgttccgccaggagcccttgccgtgtccggcggacgccaacgaaacatcgaaggctgggtgcaaaagaagcgccctggaaccgctgcagcacaagccgcagaagccgcccaaaacgtccacaaccaggaaggc

SEQ ID NO: 1052 - DNA, 1227 bp, Corynebacterium glutamicum
atgacaaatcccacagaggagcgcaacgcacgccgcctcatttgggccaacggcctgcaaaacatcggcgatcaaatcgttgccgccaaaacagtcctgccctggttgctgcaagccgctggcgcgccgggctttttgctggcgcttctggttccaatccgcgaagccggatcgatgctgccgcaagctgccattactggctgggtgctgaggcagacgtcgagaagcaaagtctgggtgattggctcgaacggccagttcgtctcggcgctgggtatcggcgtggctgcgctgtttttgcgtgggtgggcgctgggcatcacggtgatcgtgctgcttgcggcgctgtcgctgtttcgatcgatgtgttcgattgcatcgaaggatgttcagggcaaggtgatttccaagggcaagcgtgggctggtaacgggccgcgcgacggtgattggcggtgtgatgggcctggttgcaggcctggcgatcgctattttcttgggctcgcattccccgacgagggtgctggccgcagtggtgatcgcgagctcgtttagctggctgtttgcctccattgttttcgcgcgcatcgaatacgcgaagccagcgactccaaaaaacgcgccttccgcaaacccgtgggtgcgtcgctgcatcgccgcattaaaagatgataaagcttttcgacgtttcgttctggttcgctcaatgatgctggtgacagcactctccacggctttcatcgtcgcactcgccgctgaatccggaaacagcatcgactccttgggattcttcctcatcgcctccggcttggcgtccatggttggtggccgaatctctggaatctggtcggatcattcctccaaaaacgtcatggcgggcggtgccctattcggttccatcgtgttaatcctcgtggtgctcagctccgcgtttgcacccgcgcagatcaacacgctggtgttcccgttgagtttcttcctcatcaccttggcccacaccgccatccgcgtggcccgcaaaacttatgtaatggacatggctgaaggtgatcagcgcacccgctatgttgccgacgccaacacactaatgggtgtagttttgctcattgttggcgcattatctggcttcattgcaattttcggaaacgaagccgcactgctcttcttggcggcaattggcctgcttggaaccattagcgcccgtggcctcaaggaagtatccgccgga

SEQ ID NO: 1053 - DNA, 1533 bp, Corynebacterium glutamicum
ttgccagagttgaatcgtcggacttttttcaaaggggccggggtgctggcagcaacggtggtgggtgcgcaggtgctggtggcgtgttcctcagatgatgtgcgtggttatgggggagagccgcggacgttgcctattccaccagcagatttaggtacgcgtgagggatctagcgtgcactttgccctggaggctcagactggggagagtcagattttgccggatgtcacaacgaagacgtggggtttcaatggcactcatttggggccgacgttggtggtgaagaaaggtgatgacgtccacgttgatgtgataaacaatttggatgaaatgaccactgtgcactggcatggcatgaagttgccggcgattgctgatggtggtccgcactcaccgatcgggcctgggcagacgtggtcaccaacgtggactgtggccaatgatgcagccactttgtggtaccacccgcacactcatggcctgacaggtttgcatgcgtaccgtggtttggcggggatgatcattgtggaagatgaagcaacagacaagctggatctgccacgcgagtacggtgtggacgatattccgctggttttaatggatcaccgcttcttagaagacggttcccttgatgaggaagacctccccgatcttgggctgttgggcgatacccccactgccaatggcattaccaatgcgcactttgatgccaccacgcgccgggttcggttccgcgtgctcaacggctccaatatgcggttctataacttggcgttttcagacacgcgcaccttccaagtcattgccagcgattccggtttgctggatgaacctcaagaccgcaccaccttggctattggcccaggcgagcggtgggaaatcgtcgtggagctagagcccggcgaggacgtcaccttggaatctgtaggttttgaggacaactacggcgtccctgatgatgagttcgtgcccgatttcggcatgtcagattccttccagctgctcaccatcaccggcccttccgatgatgctgcgcaagcacctgctttgccgggcgtgctggtgaaatccaccgaacctgacgtcatcgatgccactgaacgcaccttcatcatgaacaccttctccatcaacgatctacagatggacatgcagcgcgttgacgtggtgattgaccatgaccagccagaagtgtggattgtcaccaacgacaactccgactggccccacaacttccatgtccacgacgcccggtttaaggtgctgaaatttgaaggcaccgacgtagagctcttcaacgacggctggaaagacaccgtcggcctgccaccgggagcaaccgcaactttagccgtggaatttggccactacccagacccgcaatggccctacatgtatcactgccacatgctctaccacgaggatcaaggcatgatggggcagttcgtcatcgtggagccaggcgacgagccggcggcggtgctggggtcgggcacgggctccagcattgactccgccggcggacatgcgcac

SEQ ID NO: 1054 - DNA, 918 bp, Corynebacterium glutamicum
atgacaacgacaccagcaatcgacgtaacagacctcgtgagaacctacggcgactacaccgcagtcaagggcctgaatttccatgtacagcgcggtgaagtatttggtctgctcggcaccaacggggccggcaaaacctccaccttggaagtcatcgaaggactttccgcacccagctccggcaccgtgcgcatctccgggcttgaccccgttgccgaccgcgcgatcctgcgccccgagctcggcatcatgctgcaatcaggcggcctgccatcacagctcaccgtcgccgaaaccatggacatgtggcacggcacctgcacgtatccgcgcgccattaaagatgtgcttgccgacgtcgacctcctacaccgcgaaaacgtcaaggtcggcgcgctttccggaggcgaacaacgacgccttgatttggcctgcgcactgcttggcgacccctcaattttgttcctcgacgaacccaccaccggcctcgacccagaatctaggcgccacacctggcaactcctgctggacctgaaacagcgcggcgtcaccatgatgctgaccacccactacctggaggaagccgaattcctctgcgaccggattgccatcatgaacgccggtgagatcgcagtggaaggcaccttggatgaactggtggcccgcgagaagtcgatcatcagtttcgtgctgcgtggcgggcaggtggagttgccggtcttgagtggggctgaaatcatccgcgacaacaaccacgtccgcatcgccaccaccaccctgcagcagcacaccttagaaatacttacctgggctgcagagaccgggatcgcgctggaaggcttcgctgcaaaacccgccaccttggaatccgtattcatggacatcgcctcactcgagaacacctcgctgcaaaccgcc

SEQ ID NO: 1055 - DNA, 831 bp, Corynebacterium glutamicum
atgaccacgtcacacaccgcccgcggcctgcaacatgcaaccccggagcgccgcaagacttcatttttcaaaacctctctgtttaaggccgaatggctccagttccgcagaaataaaaccctgttgttcatggccaccgtattcccagtcggaatccctttgttgctctttctcatcggaaatggtggggcagcagagtccgcgaactccttcgactacttcgtcatgtacaccctgctatttgtgcagttctacacggtgctgtccatggcaaccacccgccgtgatgaacgtgtgctgaaaaggctgcgcacgggagaagcccgcgacatcgatatcatcggtgccatctgtttccccggcgcgctcctcacactgatcttcaccgtggtgatcattccattgctcatggttttgggagctcccgcgcccatcaaccttgtgcccattgtgtttgccgtactgatcggactacttctttgtagtgctcttgccttgatgaccagcggtttcacccgaaacgccgaagccgcacagatgacctccatgcccgtgttcatgcttgcgatgggtggacttggatcaatccgcttcgtattcggcgacagcattgtggctgatatcttggcctacaccccattcgccgcgatcagtgaccttgtccaaatcggctgggctggcgccaccttcgccgacagcgttggtggagtagaggcagcaaacttcgctggaattttccaagacatgctcataccacttggaattctggcagcgtggacagctgcagcggtgtgggcggcgaaccgctacatgcgctgggactcgtaccgc

SEQ ID NO: 1056 - DNA, 1257 bp, Corynebacterium glutamicum
atgaataaagatttctggaccgcaggctggaccgcccgctggttttcgcgcggggtttcccttttggccagcccagttaccgccccactgaactcttggcggagattgcctaacttggccaagtacaccctctacaccagggtgtcgttgcaagcgatccccgtggtgttgctgtcggcgtatttcctgggcatcgtagctaatgcaggcaccctgaatccctcatttgtgtggctgctgggtttctcggtcatccttttaatagtgacggtattggtttatgaatatcagccatcgctgaattctcatcctaggcgcagcgtacagccgttcttcttcaccgggttggtgctcaacgttttaggcgttgtggtgtctgtggtgcttcaaattccgggcttaaacatgtcggacaacacccgagcaactgcccttattttcactcttacctgcgtatttctgctttcgatcgcctacattccgtggatgaattaccgatgggtttggctgatcgcaatgtctgcagtgttgtggtggaccagcacaacgactgattatttaagtgcattgtgggtggttatcccgccactcatggcaggaaccgtccgactttccgtatggaccgtcgatgtcatgaaagaggttgagcgttcccgcgaattggaagcctccctccgcgtcaccgaagaacgccttcgtttcgcccaggaactccacgacactttaggacaacacctggcggcaatgtccgtgaaatcagaactggcgcttgccctggcgaaacgcggcgacgaccgcctcgaaaacgagctgcgtgagctccaaaaactcacccgcacctccatgtcggaaatgcgcgacgtcgtctccggctaccgcaccgtcaacctcgccacggaaatcgagggcgctaaaagtttgcttgccgacgcccacatccacctttccgtcatcggcaccacgtcccaggtgtcacccgctcaccgagaactgtgcgcgtggcttgtccgggaagccaccacaaacattctgcgccactctgatgcaacggatgccaccctcacgttgagcagcacagaggtgcgcatggacaacaatggtgtgaacaaggacatcggcagactctctggtctcagcgccctgcgctcacgagcggaatcagccggaatgacgctcattgtgtcccgcgaagacgaccagttcagcgtccgcatgctcattaatgcacctgcaaatacacctgcagaaaaggaagct

SEQ ID NO: 1057 - DNA, 609 bp, Corynebacterium glutamicum
atgatttccatttccatcgccgacgacgaagccctgatcgcaagctccctggcaaccttgctcagcttggaacccgatttagacgtccgacctaccgcaggatccggtgaagaactcattgaaacgtgggcggatccaagcaaccgaaccgatgtatgcgtccttgaccttcaactcggaggcatcgacggcatcgacaccgccacccggctcatggaaaccaccccagatttggccgtgctcatcgtgaccagccacgccaggccccgacaactcaaacgcgcgcttgcagcaggtgttttaggattcttgcccaaaacatccaccgcagatgaattcgccaccgcaatccgcaccgttcacgctggacgacgctacatcgaccccgaactagccgccatgacgatcagcgccggtgaatccccattaaccaaccgtgaagaagaagtcctcgaactagcaggccaaggactaagcgccgaagaaattgcggtggcagcgcacctcgcgccgggaaccacccgcaactatttatcccaagctatgacaaaagtaggcgcgcagaatcgctttgaagcgttcacgcgcgccagggaattgggctggttg

SEQ ID NO: 1058 - DNA, 204 bp, Corynebacterium glutamicum
gtgaagcactactggtcaatgtattttggggctggccctctgaatacacctcacacaaaggaagtttggttcatggacatcgtatctatcgttaaccactggtttgagtggagcaccaacaactgggtaaacatgactggtctcccacgtgagactttcgtaccagctttcgtaggctccacagttctggcagttctctccttc

SEQ ID NO: 1059 - DNA, 1155 bp, Corynebacterium glutamicum
gtgaccgcctggctttgtagttttccctccggtgtccaagatgaatatgacatgatgaatggcgtggtacagcctcaggaacatctcgatgcaacgttgattgctgcagacttccacggcaaccccgaaaactctggtgaccgcaaagagcgcctgaattttcaaggttggaagtatgcccttaatcgcacggtcagggatgtttttccagatggcctgctcgatttggcggccttgttgacgttcttttccattctgtcgatcgcccctgcagtgctgctgggctattcggtgatcacgatttttctggccagtgactccaccgaaatcctcaaccttgtccgcgatgaggtaaatcagtacgttccggaagatcaatcccatgttgtcaacggcgtgattgattcgatcgcaggctcggcagctgcaggtcaggtcggtgtcgcggtcggtgtgatcacggcattgtggacatcttcggcatatgtgcgcgctttttccagatgtgccaacgctgtttatggccgaagcgaaggccgcacattgatcaaacgctgggcaatgctgcttttcctcaaccttgcgttgctgcttggaatcatcatcattttggtctcctgggtgctcaacgagaccttggtgatgggaattttcgcccccatcgcggaaccacttcatctcacgaatgtgctcagcttcctcacggaccggttcatgccgatctggatctgggtgcggttcccagtgattgtgggggtgctcatcatgttcgtggccacgctgtattactgggccccgaacgcccgcccgtggaagtttcgctggctcagcctcggatcattcttggcgatcgttggcatcctgctcgcaggcgtgggcttgaatttctacttcacgctgttcgccgcttttagttcctacggcgcggtgggttcgctgctcgcggtttttattgcgctgtgggtgttcaacatttgcttaatcatcggcctgaaaatcgacgtggagatcagccgcgccaagcaactgcaggcaggaatgccggcggaggattacagtttagtgccaccacgctctatcgagaaggtggcgaaaatgaagcagcgccagcagcgcttgatggatcaggctgcggcgatccgggaggaaagcaat

SEQ ID NO: 1060 - DNA, 1440 bp, Corynebacterium glutamicum
ttgatgagaacaacacacaccgcttcaagcattctgcgaagaatgatcaggcggcagcggggcaaggttgcgtttggcgcattctttttggggatgtggcagctgtcggaagcattggtgccgattgcgattggtttgatcgttgatcatgcggttctcacaaaagatctccgccgattagtggtcgggcttgtcgcttttgttgtgctgtttgtggtgttgagtttttcttatcgtttcggttcgcgcgcgttgaatagggccgtgaactttgaatcccatgcgctccgcgtagaggtagccgatcatgcgttgaagaatctggatccgcgcaatttggtgcctggcgaggtgatgtcgcggtccaccgcagatgcggattcttcgacgcgtattttcgggcagatcggaaccggtgtttcggctgcgacgggatttcttggtgcagcgacctacctgttgatcagtgactggctggtcgggttgttggtgcttgtgctggtaccgatcatttcgggagtggttgcactggctagcaagggcatttctaaaaggagtgtcacccagcaggagaagttggcggagtctggtgcgcaggcaagtgacatcatgatggggctgcgcgtgatcaaggcgatcggtggcgagcgttgggccgtgaagacttttgaaaaggcgtcgcaggcatcagcgagagcggcggttgatactgcagttgcttcgggcaaagtcgctggtattggtgagttgtccattgcggtgaatttggctgcggtgttgttgcttgctggttggcgggtcaccacgggggagttggggcctggccagttgatcgcaattgtgggtgtggcggtgtatttgtcagagccgattcgcttgctgagcaactcgattaatgcctcagctattgcgcacggtgcagcggagcgggtggctaatttcttaaacctcgacgaatctcaggcacagtacgaaagcagcgaaacaatcaatgacggcgaattcctcgtcatcgtgcccccagccagcacgcttccacacggcgacaatatcttggctacacctcatgctgccgacattttcgaaggtaccttgcggtcaaatatttccatgaatcatgaggacaacgtgccaattgatccgcaggtaattcgcgcttctggtctgactgacatcattgaggtggacggacttgatgcgccggtgcgcgatacgggaagcaatttatcgggtgggcagcgtcagcgagtggctttggccagggcgttgcatgcagacgcggaagtactggtgctgatggatccaaccagcgcggtggattcagtgacggaggtgtctatcgcgcaggggattaagcagctgcgagcaggcaaaaccaccattgtggtgagttcttcgcccgcgttttacaacttggcggatcgggtgatttcacatgtc

SEQ ID NO: 1061 - DNA, 153 bp, Corynebacterium glutamicum
ttgccccgctgccgcctgatcattcttcgcagaatgcttgaagcggtgtgtgttgttctcatcaaaaccctgtctatgtgtcagttcaattcccaacagcctaacttaggtaacactgacttaaaacaattgtttgataagaacaacaaaggc

SEQ ID NO: 1062 - DNA, 1734 bp, Corynebacterium glutamicum
atgtctaatttgatggcatcatcgacaccgaaacaggcgttcagcgctgctttcacgcaactgaaaccgcaccggatcaagttatttggggttgttctttgtggcgtgttggtggccgtcgcggggttggtagggccctgggcggtgggtggactcgtcgataagctccttgcaaccccgagcatgcgcgacgttgtagtgttcgcgctgcttatcgtggctggcggcgttgtttcgagcctgggcacgtggtggggcagcgcgctgatggcgcgcgcgttggagccggcgatcgcggggctgcgcgaggatgtgttgcgcgcggcggtgagtttggatgcgaacacgattgaaacggcggggcgcggcgacgtgatttcgcgtatcgcggatgattcgcgggaggtgtccactgcggcgagcaccgtggtgccgctgatggtgcaggcgggctttaccgtggtgatttccgcgtttggcatggcggcggttgattggcgcctcggccttgtcggtttggtcgcgatcccgctgtattggaccacgttgcgcgtctatttaccccgctcaggtccgctttatacgcgtgagcgcgaggcctttggggtgcgcacgcagcggcttgtcggcgcagtcgaaggcgcggaaaccttgcgcgctttccgcgcagaagatacagaattaaagcgtatcgacgcagcctccggcgaagcccgcgacatttccatttctgttttcaggttcctcacatgggcattttcccgcaacaaccgcgcggaatgcatcaccctcgtgctcatcttgggcaccggcttttacctggtcaacatcgatctggtcaccgtcggcgcagtctcaaccgccgcactgatcttccaccgactcttcggtccaatcggcacgctcgtgggcatgttctccgacatccaatccgccagcgcatcgctgatccgcatggtgggcgttattaacgcggcatcgaaccaggtcagcggcacctcgccggcgtctgccagcaccgctttaacgcttttcgacgtctcccaccactatcacactgcacccgtcatcaagaatgcatccgtgcagctggaaccaggggaacacatcgccattgtgggtgcgaccggcgctggtaaaagcacgctcgccctcattgcggcaggcctgctcagcccaacttccgggcaggtggctctcggcggatcgagtttttctaacgtcgaaccggaagcattgcgccagaagatcgcgatggtcagccaagaaatccactgcttccgaggatctgttttagataatcttcgtatcgcacgccccgaagccaccgatgcggacatccacgccgttctcgccgatattggtgattcctggttggagcgcttaccgcaaggcatagacaccatcgtgggtgatggcgctttccgtttaacctctgtggaaaaccagatcatggcgcttgctcgcgtacatttggccgacctagcaatcgtcatccttgatgaagcaacggctgaatcaggctctgatcatgcaaaacagcttgaagatgcagcccttaaagtcactgaaaacagatcagccatcatcgtggctcaccgcctcaaccaagcgaaaaccgccgatcgcatcatcgtcatggactccggagaaatcatagaatctggaacccatgaagagcttcgagcgatcggcggccgatatgaacaactgtggactgcgtggtctgcgcgc

SEQ ID NO: 1063 - DNA, 1965 bp, Corynebacterium glutamicum
gtgacccaaagcacattccttaaatcggtagctgcgttcactgtcgcagccttaaccctgaccatctcttcgtgttccagcggtgaagacacctccgcaagctccacggatactgaaaactcctcaacccaagcagcagcgtctcccccacttgcgccttgtgaacttcccgccgacgcttctgctgaagaggaagtagaaggcactcacacaggtgaagatatttctgttgccccggaaatcggtaccggctaccgcgagggcatgacccctgttcaaacccaaggttatgcggtggcaactgcaaaccccatcgcttctgaagcagcctgcgcggtgttaagagaaggcggcactgcagctgatgctcttgtcaccgcgcagtttgttttgggactgacggaaccgcagtcgtctggccttggtggtggcggatacattctgtactacgacgccgaagccaatgcggtgacagccattgatggccgtgaaacagcgccagttgctgctgatgaaaactatctcattcatgtttctgcagaggatcaaacggcacctgttcctgatgcccgacgttccggcaggtcaattggtgtgccaggaatcgtggcagcccttggacagctgcatgattcattcggaaagacctcctggcaggacgtgctgacaactccgcagcagctcgcaactgatggtttttccatcagccctcgcatgtcagcatcaattgctaactccgctgaggatctctcccacgatccggaagctgccgcatatttccttgatgaaaacggtgatgcgaaggcacccggcacacttttacaaaaccctgactatgcagaaacgattcgtctcatctctgaaggtggccccgatgcgttctacacgggtgagattgcagcagacatcgtggaacgcgccacccgtgaggttgacggtttcacaccatcactgatgagcacggcagatttggctgcctacactccggaaactcgtgaagctttgtgtgctccctaccgcgacaagattgtttgtggcatgccaccgtcatcatcgggtggcgtcacagtgatggaaaccctgggtatcttgaacaactttgatctcgcccaatacccacccactgaggttggtttggatggcggattgccaaatgcggaagctgttcacctgatttcagaggctgagcgcctggcttatgctgatcgcgatgcttacatcggtgatcctgctttcgtggaagttccagcaggtggtgtcgaagagttgatcagcgatgtctacacgggtgaacgctcagaacttattgatccagagcattcaatgggtcaggcaactgctggtctgagccaggaaccagtcatggctgccctgccggaaagtggcaccagccatatttccatcatcgattcctatggcaacgcagcatcgttgaccaccagtgtggaagctgctttcggttccttccacttcacccgtggtttcattttgaataatcagctgacagatttctccgctgaaccacttgatgaggacggcgagcccgtggccaatcgtgtcgagtcagcaaagcgcccacggtcttccatgtcgccaatgctagtgttcaacgccagtggcgatggtgaaatcgcggatctgaatatggtgctgggctcccctggcggatccttgattattcagtacgtggtgaaaaccctggtcaacatcatcgactgggatatggatccacagcaggcagtgtctgcgcccaactttggtgcgatgaaccagcctaagactggactgggaagcgagcatccgctgatcgccaatgattcagcagagcttgtatctgaactggaaagcaaaggccacgaagttaatgtgggcgagcaatccagtggcctatcggcgttggtgaaaaacggcgacaccattgtcggtggcgccgatccacgtagagaaggcgtggtcttgggtggc

SEQ ID NO: 1064 - DNA, 249 bp, Corynebacterium glutamicum
gtgaagggcattcatcaggaaattagccgtatcgagcgtagccacgattatctgtggagcgtccgagaagacctgcatgcacgattcgacaaccaactgaaggcacactttgtagacagtgtcctggatagcattgcagaaggatatgaaggccgaatcaaccgattccgcaaaatcttcattgaaatgaaagcggttgaagagctgcgcaccatcgccgccacccgcccaagccacctcttggctgca

SEQ ID NO: 1065 - DNA, 519 bp, Corynebacterium glutamicum
gtgatagcatacttgaccatatcgaattctctaccagctcgaggcatcatgactctccccacccctacacattccaccaaaggcagttcaggccgcatgaaacgaatggcccttatcggctcctcgctcattatttccatgggacttattactgcgtgcggttcggccgctgcagaacccgaagcccctgcaccaacagttaccgaaactgtaacagccacggtgacaaccacagctaaagccagcacgatcacctcgacagtgacggaaactacctccgcggaagatcttgcccaagaaattgtgaagccagcggccgtggaggaatattcagagcctcaggtaaatacgccacagcagtttgcggccatcccggaacctgcaccggcggttgcaccagctcaaacgtattacgccaactgcgcggcagttcgtgcggcgggtgcagctcccctttatgcgggatcacctggatatagttccaagcttgatcgcgatggcgacggaattgcctgcgaa

SEQ ID NO: 1066 - DNA, 192 bp, Corynebacterium glutamicum
gtgaataacttggatcctgaagttgaagagccgaatatttctcagtgggaaagtcttgatgatgacattatccctggaaattgcactaaagtgtttctatctgaaccccagctaatgcatggtcctctccttagagcgtttggtgctgttgcaacttggggcgggagccaagaaggctccgtttttattgtg

SEQ ID NO: 1067 - DNA, 909 bp, Corynebacterium glutamicum
ttgccgataccaccgggtcttcttatccagctcaggagcatatttctggacccagcggtagatcgtggtgtgatcgaccggcactccccgctcggtcatcatctcttcgaggtcgcgatagctcacgccgtagcggcagtaccaccgcaccgcccacaggatgatttcacgagggaactgccgaccggagaagatgcccatggacctgattattccacgccggtcttcctactgccccaactttgcaacagcaccgttttaggttatcctgcaggtgaccctgaactccaagatgatggttggtatagacaagcctttgcagatggtttcttgcatggaaaacaactgagtacattttttcccgcatgggacgagtttgcatgggacgattccgctggtggcgaaccgggggtactaatgtcaaggcaggcggcgaactatgataaaggaccagctggtggaaataaatacactgatcaggtcgttcttgaaactgaggatatgtgtggcaatgaaataatcctccgtagagggtggtacaactcggatgcctccagaaaagataagccgtgggggtacgataaaattcggcacaaacatggtgtttttagtttgtggtcagttagtatagtatttgaaaattcgtgtatcaacaggattgaaggtacacagcaggtttatgaagaagaagtttatcaagtgaaatgtgatcgactcttcttaaattgtgaacaaaccgggcagtcttttgtatatcgcggtatttatgaaagaaatatatataagcctggtgctacagagccacttggtttgaggacattttttcctgtacacaatgagggaacgcatggttcaagtgatgtaaccccaacatggtttagtacagacattccaacattggacttatgg

SEQ ID NO: 1068 - DNA, 243 bp, Corynebacterium glutamicum
atgctcctgagctggataagaagacccggtggtatcggcaagttcctgactggcaggccaggtcctggcgggtggatgagacctatatccgggtcgggggaaagtggtgctacctctatcgggcaatcaccgccggtagccagaccctggacttctacctctccccgaagagaaacgtcgcggcggcgaagcgtttcctggcgaagacgctgcggtcgaataaatcggcaggctatccgcggg

SEQ ID NO: 1069 - DNA, 708 bp, Corynebacterium glutamicum
atgggcatcttctccggtcggcagttccctcgtgaaatcatcctgtgggcggtgcggtggtactgccgctacggcgtgagctatcgcgacctcgaagagatgatgaccgagcggggagtgccggtcgatcacaccacgatctaccgctgggtccagaaatatgctcctgagctggataagaagacccggtggtatcggcaagttcctgactggcaggccaggtcctggcgggtggatgagacctatatccgggtcgggggaaagtggtgctacctctatcgggcaatcaccgccggtagccagaccctggacttctacctctccccgaagagaaacgtcgcggcggcgaagcgtttcctggcgaagacgctgcggtcgaataaatcggcaggctatccgcgggtgatcagcaccgacaaggccccctcactcgccagggcaatctctgagctgaaggcggaaggcgtctgtccatcgacggtcgagcatcgtcgggtgaaatacctcaacaacgtcattgaaggcgaccatggtcggttaaagcggatcctggggccgaaaggcgcattcaaaaaccgaacgtctgcctaccggacgttgaaagggatggaggcgatgcactcattgcggaaggggcagggcacgatgtttgcctatggtcacccgaatccggatgcagtgattgttagccgggtattcgagacggcc

SEQ ID NO: 1070 - DNA, 462 bp, Corynebacterium glutamicum
atggtaatgacgtacaaagcagattatgatcttgacttggaaaaagtagtttttcgtatgtcgcagctgttcgaggatcttattccgtcagaaaacgcttttgattattatgacaagtcaacgtggcctaccctgactatggctgcgacatgggttcaggatgattgtctccttattgtttttagggttgaggaaagcagaggtgagacgttcgtgggttatttttctcggatctcgcctcgatataatcccgacaacatcgaatttggtgcagtagagctaatgtatgctgactcaattgcaggtgattggtttatagagaaggtcgatctgaaagctccgcaaaagatacattggagaaatacccaccatagcctcaatactccggcggatatagaagaattattggactatgctaatgagataccaatgtggttgagtccagaccttgagaagtggatg

SEQ ID NO: 1071 - DNA, 597 bp, Corynebacterium glutamicum
atgactgacaagtttgacagagtccttgctgtagaggtgtgcattcaggagtggatcgacgagcaaaacctcacgctagaggtgccattaatgattgcacgtttgcagcttagagacgtcgcgaaggatatcactgctgttcacgaagaaaaattctacgacctcactgatatcgatactgatgcctttgtgaaaaacatcaaactgggatggaatgaacgcttgatcaagaaaagcctctttccacaaccggacgtgcataaacaacatttcacagaaactgaacatggcattgacgcgactgtgacggtctggtcgaagggcttcgatccggaaagtggccccgacttcttggtttcctatgtggatggtctttggtcagccgatattagaaaccgcatcacgaaatttcagaatagagaaatcgttagcaaattctattttactccagaacatattaaggaggatggagatttctccgcagagatttttattaaccgaccagaaaatgacgacgactcacaagatttggtcgaggtgtggactgatcaagacaccagatactgcggtgaaatgatcatctatttcaaatggctc

SEQ ID NO: 1072 - DNA, 312 bp, Corynebacterium glutamicum
gtgtgggaaattgacgctacagatcgtggacacgattttccaccaccgaaatttgaaacgttttctgaattgagtacgcgaatctacggcagcaggttaaggcagtatcaaagaaaacgaaaacccccgctcattagcactgaaagtgctggtgaacggggggttctacttgcttccccaccaggactcgaacctagaatgacggtaccaaaaaccgtagtgttgccgattacaccatggggaactgcagtaattaactgcaccgctagagtttacatcattgtcttagaaaaccaattattggggtccgct

SEQ ID NO: 1073 - DNA, 651 bp, Corynebacterium glutamicum
atggttcgacagcggatgaccggcaaggaacgtcgggagcaattaatctctattgggcgtgcggttttcgctgagcgcggtttcgacggcgcgagtgtggaggagattgcggcgcgtgcgaatgtgtctaagccggtggtgtatgagcatttcggtggcaaagagggcttgtatgcggtggtgattgatcgtgagatggtcaagctggaggcgatgatcacggggtcgttgcagcatggtcgttcgcgttatcgcattgagcaggcggttcttgcgttgttgacgtatgtcgaagatgagacggatggctttttgattttggtgcgcgatatgcggcccggtgagcgccggtcgtatggcactttgcttaacgacgccacgacgcaggtgtcgcacatcctcggcaatgccttcacccgatctgggctcaacgctgagtacgcgaatctttatggtcaggcgttggtgggcatggtgtcgatgacggcgcaatggtggttggatgagcgcactccgccgaaggaagaagttgccgcacatattgttaatctttgttggaatggtttgacggggatggaagccgatccgaagttaactcccatcagttctgctgagggtgcgatttttggtcaagaaaaggagagtgaagcg

SEQ ID NO: 1074 - DNA, 3627 bp, Corynebacterium glutamicum
ttgaaggtcgctgcaaccgaccccaagttgaaggggttgatgtcgaatgtggggcagcagcatctgcatatcactggcattgatcaggctcgtccgtgggcgattggtgcgttggcgcatcatgctccggtgttggtggtgactgctactggccgtgaggctgaggatctcacggctgagttgaaggcgatgatgggcgataaggtggcgtggcttccgtcgtgggagactctgccacatgagcgattgagtccgggtgtggacattgtgggcaagcgtgctcaggtgctcaatcatctaggcgacctcaaagtcgtggtggctgctgcgcgtgcgttttgccagccggtactcaaagatgctgaaggtcgtgcacccctcactcttaaagaaggcgcggagtttgatttctctgccctgaccactgagctggttttccgtgcgtacaagcatgtcgatatggtggccaagcgcggtgagtttgctacccgcggtggcattttggatattttccccaccacattggattatccggtgcgtgtggagttctggggcgatgaagtctctgacattaggcagttctctgtcgccgatcagcgcaccattccagaaatcaccatcaagagcattgagattttcccggcacgggaattgctcattactgaagaagtggcatcgcgtgcggagtctcttatttctaagcacccgggcaacccgacgcttgtggagatgctgtcgaggattgcggattcccaagatgttgatggcatggaggcgttgattccggcgctgacggatacgccgatggttccgatgctggagctcatgccggaaaacacccatgtgttggtgattgctccggagaaggtgcgccgacgcattgcggatctggaagcaaccgatgctgagtttttgatggctggttgggaagcagctgcgatgggtgctgatggtccagtggctgcggaaggcctggacttggaagcttctagctatcgcagttatgaaagtttggaggtttctgcgtcgaaaagcgatgtgcgttggtggactttcgcgccgccgggcatgtttgaggcctcggaggaggcgacgctgccgcttgattttgaagccgggccggcgccgcgcggtgagctgccgaagatcgatgcgatgatggcgcagctgcttgcgcacacaaccggcggtgggcgggctgcgtttatcgcgccgacccaaggtgcgattaagcgcatggtcgatcgtttcgcggaaaagggcattcccacccatgtggcgaccccgggttgggagccaacgcctggtcaagtgactctttatcatgcgctgagccatgctggcctggtgtttccgaaggtgcgtaaacaccgcgatggcgctgcaatgccgttggtggttattacagaaaccgatctgactggtaaccgtgttggcgatattgcaggggcgaaacgtcgacctgcaaaacgccgcaacaaggtggatcctttggcgctggagccaggggatttggtggttcatgaaacccacggcattggtcgttttgtgaagatgactgaacgaaccatttctgcgggtgatgagacctcgcgccgtgaatacattgtgctggagtacgcgccatctaagcgcggacagcccggcgatcagctgtatgtgccgatggatgcgctggatatgctcagccgctacgtcggtggcgagaagccgacgctgtccaaaatgggtggttctgactggaagaacgccaagaagaaggctcgcgctgccgtgcgtgaaatcgccggtgagctggtagaactctacgctaagcgccaatccgcgccgggtcacccgtttgcgccggatacgccgtggcaaaaagagatggaagataacttcccctacgttgagaccgaagaccagatgttggcgatcgatgcggtcaaggaggacatggagaaaagtgtccccatggaccgcgtcatcatcggcgatgtgggttatggcaagacggaagtggcggtgcgcgcggcgttcaaggctgtgcaagacggcaagcaggtagccgttctggtgcccaccacgttgcttgcgcagcagcaccagtccacgtttgaagagcgtatgactggtttccctgtcaccatcaagggattgtcacgctttacttcgcctgcggaatcgcgggagattctctccggtttggctgcaggatcggtggatatcgtcatcggtactcaccgtttgctgcagactggcgtgcagtggaaaaacctagggcttgtcattgtggatgaggagcagcgtttcggcgtggaacataaggagcacatcaaggctctgcgtactcacgtggatgtgctgaccatgtccgcgaccccgattccgcgcaccctggaaatgtccatggccggtatccgtgagatgaccaccatgctcaccccgccggaagatcgccacccaattcttacctatgtgggaccgtatgaagacaagcaggtcgcggcatcaattcgccgtgagctgctgcgcgatggccaggtctttttcatccacaacaaggtggcagatattgagaagaaggcccgcgagatccgcgatctagttcccgaagcccgagtggtcgttgcccacggccagatgagtgaagagctgctggaacaaaccgttcaaggtttctgggaccgcgaatacgatgtgctggtgtgtaccaccatcgtggaaactggtctggatatttccaacgccaacacgcttatcgtggaaaatgcccaccacatgggcttgtctcagctgcaccagctgcgtggccgcgtgggtcgttcccgtgagcgcggttacgcctacttcctgtatccaaagggcgcgacactgactgaaatgtcctacgaccgcctggcaacgattgcccaaaacaatgatttgggtgccggtatggcggttgccatgaaggatttggaaatgcgtggcgccggcaacgtgctgggtgcagaacaatcaggccatatcgctggcgtgggctttgacctgtacgttcgcctcgtcggcgaagcagtggaagcctaccgcgcgctggctgatggcaaagttgttgatggcaccgtcaagggaccaaaggaaatccgcgtggaccttcccgtggatgcccacattcccgaaaagtacatcaacgccgagcgtctgcgtctggaaatctaccgcaagctcgcgcagtccgaatcggaagtggatctgcgccttgcggtggaagaaatggaagaccgctacggtcccattccagaagaagtggagcgcctgctggctgtgtccagattgcgccacctcatgcgcgaagcccacctcaccgacattgcggtgcagggcacgcgcatcaaggtccaccccgttgacctcgccgattcgcagcaagtgcgcctaaagcgcctgttcccaggcgccacctaccgcgcagccgctaaagcaatccagctgtctttcccgaagacaggcaacaaggtcacagatcctttgcttcgcgacgtcgacctcctccagtgggtagcgaacttcatttccaacatgttcaacttggaggaaatcgatgttcgcggaccacaaccaggaaagcctaagaagaaatcatcagtgatctccgtcagcctg

SEQ ID NO: 1075 - DNA, 1224 bp, Corynebacterium glutamicum
atgaaccaccaaatcccctggctccagcgccaaaggatccaccttgttgcggcgttttgcaggtcgacgtttcgcccctgcaatatcgccaacacggttaccagtcagatcggtttctgtaataaccaccaacggcattgcagcgccatcgcggtgtttacgcaccttcggaaacaccaggccagcatggctcagcgcatgataaagagtcacttgaccaggcgttggctcccaacccggggtcgccacatgggtgggaatgcccttttccgcgaaacgatcgaccatgcgcttaatcgcaccttgggtcggcgcgataaacgcagcccgcccaccgccggttgtgtgcgcaagcagctgcgccatcatcgcatcgatcttcggcagctcaccgcgcggcgccggcccggcttcaaaatcaagcggcagcgtcgcctcctccgaggcctcaaacatgcccggcggcgcgaaagtccaccaacgcacatcgcttttcgacgcagaaacctccaaactttcataactgcgatagctagaagcttccaagtccaggccttccgcagccactggaccatcagcacccatcgcagctgcttcccaaccagccatcaaaaactcagcatcggttgcttccagatccgcaatgcgtcggcgcaccttctccggagcaatcaccaacacatgggtgttttccggcatgagctccagcatcggaaccatcggcgtatccgtcagcgccggaatcaacgcctccatgccatcaacatcttgggaatccgcaatcctcgacagcatctccacaagcgtcgggttgcccgggtgcttagaaataagagactccgcacgcgatgccacttcttcagtaatgagcaattcccgtgccgggaaaatctcaatgctcttgatggtgatttctggaatggtgcgctgatcggcgacagagaactgcctaatgtcagagacttcatcgccccagaactccacacgcaccggataatccaatgtggtggggaaaatatccaaaatgccaccgcgggtagcaaactcaccgcgcttggccaccatatcgacatgcttgtacgcacggaaaaccagctcagtggtcagggcagagaaatcaaactccgcgccttctttaagagtgaggggtgcacgaccttcagcatctttgagtaccggctggcaaaacgcacgcgcagcagccaccacgactttgaggtcgcc

SEQ ID NO: 1076 - DNA, 228 bp, Corynebacterium glutamicum
atgacgatatccaccgatcctgcagccaaaccggagagaatctcccgcgattccgcaggcgaagtaaagcgtgacaatcccttgatggtgacagggaaaccagtcatacgctcttcaaacgtggactggtgctgctgcgcaagcaacgtggtgggcaccagaacggctacctgcttgccgtcttgcacagccttgaacgccgcgcgcaccgccacttccgtcttgcca

SEQ ID NO: 1077 - DNA, 1968 bp, Corynebacterium glutamicum
atgagtaatactgcaggcccccgcgggcgttcccatcaggcagacgccgcgccgaatcaaaaggcacagaatttcggaccatctgccaaaaggcttttcggaattctaggccatgaccgtaacaccttaatttttgttatcttcctagccgtcctgagcgttggacttaccgtcttgggcccatggttgctgggtaaagccaccaacgtggtgtttgaaggattcctatctaagcgcatgccggctggtgcgtcaaaggaagatatcatcgcgcagttgcaggctgcaggtaaacataatcaggcttccatgatggaagacatgaaccttgttccaggctcaggcattgattttgaaaaattagccatgatcctcggactggtgatcggtgcttatctcatcggtagcctgttgtcgttgttccaggcgcggatgctcaaccgcatcgtgcaaagtgccatgcaccggctgcgcatggaggtggaggaaaaaatccaccgcctaccgctgagctatttcgattccatcaaacgtggtgatctgcttagccgtgtgaccaacgatgtggataatatcggtcaatccctgcaacaaaccttgtcacaggcgatcacttccctactgaccgtcatcggtgtgttggtgatgatgtttatcatctccccactgctcgcactcgtggcgctggtatccattccggtcaccatcgtggtcactgtggtggttgcgagccgttcccagaaactctttgcggaacagtggaagcagaccggtattttgaatgcgcgcgtggaggaaacctactctggccacgccgtggttaaggttttcggacaccaaaaggatgttcaagaagcattcgaggaagaaaatcaggctgtgtataaggccagctttggtgcccagttcatctctggcatcatcatgcccaccatgatgtttgtgggtaacttgagctacgtggccatcgcagtcgttggcggcttacaggttgcctctggatcactatccatcggtggcgtgcaatcctttatccaatactcacgccaattcacccaaccgctgtcgcaattgggttccatggccaacttgctgcagtccggcgtggccagcgccgagcgcgtttttgagcttatcgacgaagacgaacaggacagtgatcctgcgcagcccaacaccgttgctgctggcgcgaaccgtctggaattcaaagatgtgtccttcggctactcggaggatcgtccactgatcaacaacttggatctggaagttcgttccggcagcaccattgccatcgtgggtcccaccggtgcgggcaagaccacattggtgaatttgatcatgcgtttctacgacatcaacagcggttccatcactcttggtgaaacagcacaagacgccgtggatatccgcaccatggctagagaagatctgcgatcacgaaccggcatggtgttgcaggatacgtggctgtttgccggaaccatcagggataacattctttacggtagacctgaagcaactgaggaagaaatgcttgctgcgtccaaggccgcctacgtggatcgttttgtccgttccctgccagaaggctacgacaccgtacttgatgatgaagccatgaacctatcggtgggtgaacgccagctgatcaccatcgcgcgtgcattcttggctaatccccgactgctgattctggatgaagccacctcatcggtggatacgcgtaccgaattgttgattcagcgcgccatgtccaagctgcgccaagaccgcaccgccttcgtcatcgcgcaccggttgtccacgattcgtgatgccaacctgattttgatgatgaaagacggcgagatcgtggagcagggcaatcaccgtgagttgatggccctggagggcgcatattgggagttgtataactcccaattcaacgcccccgcgaaagaagaattacaggctgacggagatcac

SEQ ID NO: 1078 - DNA, 1731 bp, Corynebacterium glutamicum
atgctgtggtcgatattggtgaggtttttaaaacccgcatggcccctaattttaaccgtcatcattttccaattggcgcaatcaatcacctccctcctactccccacgctaaacgcagacatcattgacaatggtgtggtcacaggtgatatcggctatatttggcacaccggtggaatcatgctggccctgacattagtccaggttgcctgcgctatcgccggtgtttatttcggttccaaactatccatgagagtgggccgcgatctgcgttcggcgatctttggcaaggtagtgaacttctctgagcgtgagatgggtcagtttggcgcaccgtcgctgatcacccgaaacaccaacgatgtgcagcaggttcagatgctggtgcagatgacctccactttgatgatttccgccccgatgctggccattggtggcatcatcatggcggtgcgtcaggatcttggtttgtcttggctgatggtggtcagtattccggtgctcatcatcgtggtggcgctgatcattgtgcgcatggttccgttgttccaaaccatgcaaaagcgcattgaccgcatcaatcagattatacgcgagcagctcaccggtatccgcgtgatccgcgcgttcgtgcgtgaagatgtggaacgcgaacgattcaccactgctagtaaagatgtcgctgatatcggcgtgcgcaccggtaacctgatggcgttgatgttccctgccgtgatgctgatcatgaacctttctgccgttgctgtgatttggtttggtgctttccaggtggaatccggcgagacgcagatcggtacgctctttgcattcttgcagtacatcatgcagatcctcatgggcgtcatgatggcagcgttcatgtttgtcatggttccgcgcgctgccgtttccgctgatcgcatcggtgaggttctggaaaccacaccgtctgtgcaggcgccagaaacaccggcgcagccgtcgacaagcgctggcgaaatcgtgttcaacaacgcgacttttgcctaccccggcgcggatgaccccgtgttaaataatgtgagcttccgcgttgcgcctggtagcacgacggcgatcatcggctcgacgggttcgggtaagacgacgttgatcgggctggttcctaggcttttcgacgtcaccgaaggcgacgttaccgtcgatggcaccgatgttcgtgaatttgagccgctgaagctgtgggatcggatcggtcttgttccgcagaagtcgttcctgttttctggaacgatcgccagcaacctgcgttatggcaatgaagatgccacggaaacgcagctgtggcaggcgcttgcaattgctcaggcggcggactttgtgcgtgagatgccagagggtcttgattctgagattgctcagggtggaaccaatgtttctggtggtcagcgccagcgactagccattgccagggcgttgttgaagcaacctgagatctatattttcgacgattctttctccgccctcgatgtgagcacagacgccgctcttcgccgagcgctgagcaccaacctgccggatgcaaccaagttgattgtcgcccagcgtgtcagcacgattcgagatgccgatcagattgtggtgcttgataacggcgaggttgtcggtattggaacgcacacgaatttgctgaacacgtgcggtacctaccgtgaaattgttgaatcccaagagactgcgcaggcgcaatca

SEQ ID NO: 1079 - DNA, 2382 bp, Corynebacterium glutamicum
gtgtttggcgccgaagatcccgcaaatagctctttggtagacaaccttgggctcaccctgccgtggtctcttaatgatccgcattttctcaccgcagggtttagcgcttccaccaccacagcagcgctcatgtccacgttgtggatcatcgtgtttgcggtgccctctgaacggattctgggcagcctcaaattcgcgatcacagcagcgcttatccacatcacttccattccgctgggcatcggcatcgcccacctcatcgaagaagccgatctcaaccgctggggcaacaacatgttggccgatgtgctgctcaccccagatttctgggtcttcggcgtcgccgctttcgcatccgcctccatgccactgctctggcgacggcgcacccgattgttcctctttactatcaccttgacgctgctgctttatacgggcacgcttgccgacgtcaccatgctcaccgcgaccatcatcggcaccgttgccggcgagttgaacaggcatcggaaaaccccaggtggccgctggcttcccggttccctcaccgtgcgtgaagcgcgcattatgacggccattttggtcactgccgtagcagcaggtccagtgcttgctgcgcttaatccactcacccacggccctttttccagtgcaacgaaattgatctggcagccccttgtcactgaagaacacatgcatcacctctgccacacagacagcacctctgatgcatgccaaggtgcgcttgatcagctccaacagcacggtgttggcccttccgttgccaacctgattccactgatcctcaccgtggtccttgcgatggggcttagccgcggacgtcgacttgcatggattttggcggttttggcccagctcatttccatcgcagtgttgatgttccagctgaccaaactatcggctgattccaccgatcttctatggtcagtcaatgcctttagcgtgatcgttccttggctggtggcgctcgccgtcttggtgttttcccgccgtgcattccaggtgaagattgataccacccggatttctaaatccttaggcgctctcatggttacatggttggcaacggcagcattgtggatccttgccacattgttcctgccacacgcattccacccacatccaacattggggctggctttcaaagaactccccttccgctatctcccaccaactatcgaaacggtgttaagccatcaactcttccccagaagccctgctgggtgggcagtgtttgaatggactggaacgctattctggctggtcgtagcagcaactctttatcatctgctcatgggtgtgcccagcaacaaagcgcacgaggaccaagaaaacgcagcgactctcctgcgctctggcagcggcgatcacttgtcctggatgaccatttggggtggcaatacgtattggtgggcaccagaaaatgcaggatatgtggcctaccgcgtgaaaaggggcatcgcaattacattgggtgagcctattctgggtccggattcatccgtctctaaagcagagctggccgcacagtttgaagaatttgccagcaaccaaggctggattgttgcgtggtattccgtttgtgaagaattctcaaaggaacgcatcaacgctggccaccacacacttcgtgtggctgaggaagcagtcttaagctcagctaatgcggatttcaaaggtaagcacttccaaaatgtccgcaccgcccgaaaccgcgcggccaaagagggcgtaagttccatctggacaacctgggctgatttgagtgccgaaatgcagcacaagatcatcacgctgtcggaagaatgggtctctgataaagctctgccggagatgggcttcacgcttggcactgtcaacgagctctcagatccagatacctatcttcttctcgcgattgatgaggaagagcatctgcacggtgtgaccagttggttgccggtctatgaaaaaggacgcatcgtcggctacacacttgatgtgatgcgccgtgatccgcaaggctttaaatctgtcatcgagtttctcatttccgaggccgtcgttatcgcaagggatcacgatctggaatggatgtcgatgtccggcgctcctttgagtacgcccccaggtgtggccgacgacggcaccatcggacaaattttggagcttttgggccgagcaatggagccgttctacggtttccgttccctcgctgcgtccaagaacaaattccacccagaacaccacggttggtacttgtgttaccgcgatgaattatcgttaccaagcattggccttgccgttgctgcctgctacctcaacgagtttccgctgccgaattggctgaaaaagaccgccacttccgccccaagccacagc

SEQ ID NO: 1080 - DNA, 297 bp, Corynebacterium glutamicum
ttgacgtacggcgaagtcgctaaacttcgcgtaatcttggggccaattaatcaagtgcagatgaattgtttagaaaggctggagaccatgggtatttttgacgaagctaagaagaaggcaaccgaattcctcgactctgattcaggcgagcagaagtccgatggactgctggataaggccgcagacaaagctaagggtctcctcggtgaagacaaagcggatcagattaacaaggtccgtgacgctgtcgatgagcgcattggcaaaaacaacggcggcgaagagaatccagccaac

SEQ ID NO: 1081 - DNA, 585 bp, Corynebacterium glutamicum
atgcgcgtcgtagttgttgatcctaaacaccccgtccttccagtctctttcctcgaggctgttcttgggcggggtgaacctgtttctatcgatcccgattttccatttgatattgaaaaatgggggatcaagacgtcgacaagcgcctcctggtttatcatcgcaaaaccgcaaagcacgctgcttatcgacgcgcccctcaaccctttgcatgaggccgtcggcgtcatgcgggcggccgtgggccgcggcgagtgggaacgcacgcaaacccatgagagtttgattccgtatctggaagaagaatcgcaggagtttattgaagcgattcatggtggcgatgatgagcacatgaaaagcgaactgggggatgttttgctgcaggtgctttttcatgcagaaatcgccgcccgtcagggtcgattcgacatttttgacgtggcggcgagtttcgtagccaagatgcaatctcgttcgccgtacctgttcgacggctctaccggaattgtggacaccgacgagcagcagcggctgtgggctcaaggaaaagcccaagagaaactaagcagtgaagaaggaagaaga

SEQ ID NO: 1082 - DNA, 426 bp, Corynebacterium glutamicum
ttgtggcttttgccatatttatttcatttccatctcagtgatctcttaaggaaacccatgaagaaactacgtttcgccaccatcgctgccgctaccgttgccctgactgcgagccttaccccctcagcttccgcacaggatttcaaccaaatcatcgacaactttgattgcggcatccttcagaccgctatctacaccaccggcctggctcacgagaactccactcgctcagagctcgccgctaatctgcgcaactccgcagctgtcggccaactagacttcccattgaatatcgcggctaccggctactccgagcgcatcgctaaccgcgcactgacctgcggaatcgtgaaggaagatccacaggacttcctctcccagctgcagcttctgtcctctaacctatcttcttccttcttcactgct

SEQ ID NO: 1083 - DNA, 378 bp, Corynebacterium glutamicum
atgaagctttcacaccgcatcgcagcaatggcagcaaccgcaggcatcacagtggcagcattcgcagcacctgcttccgcatccgacttcgcaaacctatcctccaccaacaaagaactgtcccctcagtacaactgggttgcttgcggcatccttgagggtggcctcaaagcagctggcgtccttgaagaaggccagtacaaccgcgagctcgcagaagcaatcgccgcaaagggtgaaggcttctggaccactcagttcccacaaatcggtgattggaacgaagatcaggcagcagcacttgccgaccgcgcacaaacctgtggcctagttaaggctgacacctacctttctgagctgtcctccaacttctcttcc

SEQ ID NO: 1084 - DNA, 786 bp, Corynebacterium glutamicum
atgagttcaggggttagaaaagcaatgggatttggatgcggttcggttttggccgtcatcatggtgatctcatttgttggatgggcgctcagcttcatggatggaacggcacctattcgccaactccagcaaatccctgaagatgttccgccggcgcgtggtgtagaagttccgcaaattgatacagaggcagatggacgcacatccaaccatttgcgtttttgggcggaaccaattgctcaagatactggtgtgtccgctcaagcgattgcggcttatggaaacgcagagctcatcgcgagtactgcgtggcctggctgcaatctggggtggaataccttggcaggtatcggccaggtggaaacccgtcacggtacctacaacggcaaaatgttcgggggcagttccctggatgaaaatggagttgcaacccctccaatcatcggcgttccacttgatggttcaccggggtttgcggaaattcccgacactgatggtggggaattagatggcgatactgaatatgatcgcgcggtaggtcccatgcagttcattccggaaacgtggcgacttatgggattggatgcaaacggtgatggggtagcggaccccaaccaaattgatgacgcagcattgagtgccgcaaacctgttgtgttccaacgatcgtgacttgtccactcctgaaggatggaccgcagctgttcattcttacaacatgtctaatcagtatttgatggacgttcgagatgctgccgcgtcctacgctttacgacagccggcgatc

SEQ ID NO: 1085 - DNA, 1275 bp, Corynebacterium glutamicum
gtggctgaaatcatgcacgtattcgctcgcgaaattctcgactcccgcggtaacccaaccgtcgaggcagaggttttcctggatgacggttcccacggtgtcgcaggtgttccatccggcgcatccaccggcgtccacgaggctcatgagctgcgtgacggtggcgatcgctacctgggcaagggcgttttgaaggcagttgaaaacgtcaacgaagaaatcggcgacgagctcgctggcctagaggctgacgatcagcgcctcatcgacgaagcaatgatcaagcttgatggcaccgccaacaagtcccgcctgggtgcaaacgcaatccttggtgtttccatggctgttgcaaaggctgctgctgattccgcaggcctcccactgttccgctacatcggtggaccaaacgcacacgttcttccagttccaatgatgaacatcatcaacggtggcgctcacgctgactccggtgttgacgttcaggaattcatgatcgctccaatcggtgcagagaccttctctgaggctctccgcaacggcgcggaggtctaccacgcactgaagtccgtcatcaaggaaaagggcctgtccaccggacttggcgatgagggcggcttcgctccttccgtcggctccacccgtgaggctcttgaccttatcgttgaggcaatcgagaaggctggcttcaccccaggcaaggacatcgctcttgctctggacgttgcttcctctgagttcttcaaggacggcacctaccacttcgaaggtggccagcactccgcagctgagatggcaaacgtttacgctgagctcgttgacgcgtacccaatcgtctccatcgaggacccactgcaggaagatgactgggagggttacaccaacctcaccgcaaccatcggcgacaaggttcagatcgttggcgacgacttcttcgtcaccaaccctgagcgcctgaaggagggcatcgctaagaaggctgccaactccatcctggttaaggtgaaccagatcggtaccctcaccgagaccttcgacgctgtcgacatggctcaccgcgcaggctacacctccatgatgtcccaccgttccggtgagaccgaggacaccaccattgctgacctcgcagttgcactcaactgtggccagatcaagactggtgctccagcacgttccgaccgtgtcgcaaagtacaaccagcttctccgcatcgagcagctgcttggcgacgccggcgtctacgcaggtcgcagcgcattcccacgctttcagggc

SEQ ID NO: 1086 - DNA, 144 bp, Corynebacterium glutamicum
atgcggagaagctggttgtactttgcgacacggtcggaacgtgctggagcaccagtcttgatctggccacagttgagtgcaactgcgaggtcagcaatggtggtgtcctcggtctcaccggaacggtgggacatcatggaggtg

SEQ ID NO: 1087 - DNA, 540 bp, Corynebacterium glutamicum
atggcaaagcagaagaaaactcataaaggccttgttcctgtctcaagcagggaacgtgcttcagagtcagtttctgctacccgcgccccatttagattgggtgccgtcggcatcggtgcaatcgcactcgtagttcttctcatcctgtttgtcatcgcgattcctgtgcgtaactattttcagctgcgctccgacatcgcccaaacagaggcttccattgaagccaaagaacaacagatcaaacaactggaatctgacctcaacaggtaccaatcagaggcgtacatccgcgaacaagcacgcctgcgcctaggcgtcattgaacctggagaaaccgcgttcagaatcgtggacccagcactagataccgacacctcagtcacctctgacggcaacgaagagaaaccactgggagcttggtatgaaaacctctgggactcagtcaccaagccagaagcactcggcgaagaggaaattgcgcctccagcagttgagggagaagttccaacacttgcaccaactgaggaagcaactgtgcaa

SEQ ID NO: 1088 - DNA, 546 bp, Corynebacterium glutamicum
gtgaatgaagcagatctgaacgctgtcgaagagcaattgggaagggccccacgaggtgtcctcgatatttcttaccgcagccctgatggagtacccggtgtggtgatgaccgcaccaaaactggatgacggaaccccattcccaaccctgtactacttgacagatccacgcctgaccaccgaggcatcccgcctcgaggtcgcattggtaatgaagtggatgactgatcgcctttccaccgacgaagagcttcgtgccgactaccagcgcgcccacgagcacttcctggcaaagcgcaacgcaattgaagatctcggcacggatttctccggcggtggcatgcctgaccgagtgaagtgcctccacgtcctcatcgcctatgcactggcagaaggcccagaccatttccgtctcggcaccgaagcagtagcaatggctgccgaacacggcgacctccgcggtaccgccatcccagaggactggccaacagtacaagacctgggcatcaacatggaggactttgatttctcccgagcaggtggggct

SEQ ID NO: 1089 - DNA, 963 bp, Corynebacterium glutamicum
atgacccgttacgcggccatcgattgcggaacaaactccatccgcctcctgatcactgaagtcactcctgagggattcaaagagatcacccgtgaaaacaccatcgttcgcctgggcaaaggcgtcgacgccaccggtcagctagaccccgaggcaatcgagcgcactcgtgtcgctttggaaaactacgttgaactcatggaaacccatggggtagaggccgtacgaatggttgccacctccgcaacccgcgatgcgtccaaccgcgatgaattcttttcgatgacccgccagcttctgtccaagatccgtcctggataccaagctgaagtaatttccggcgaagaggaagctctgctgtccttccgaggtgcaatcgttgacctgcctgaagaccaaggtcctttctgtgttatcgaccttggcggtggatccactgagttcatcgttggcacctacgacggtgaaatcctaggctcccactcaacccaaatgggatgcgtgcgcctgaccgaacgaatcatgcgcagcgacccaccgactgaaaccgaagtggaaatcgcccgcgactacgttgcagaacgcatccaggaagtaaaagccatcgtcccaatttcaaaggcaaaaacctttgtgggatgcgcaggcaccttcaccacaatctccgcctgggtgcaaggcctagaaagctacgaccgcgacgcgatccacctctctgcactcaacttcgatgcactgcgagttgtcaccgatgagatcatttcagaatcatcatcacagcgcgccagcaacccagttgttgatccaggtcgcgccgacgtcatcggtggcggatccgttgttgtccaagcagcgatcgacttagcctccaaagaagccggtgtagactacatcattatttccgaaaaagacatcctcgacggcctcatccttggcctggtagaagccgactctttgaagaaa

SEQ ID NO: 1090 - DNA, 984 bp, Corynebacterium glutamicum
ttgttccgcaatcgatggccgcgtaacgggtcattaagccccacctgctcgggagaaatcaaagtcctccatgttgatgcccaggtcttgtactgttggccagtcctctgggatggcggtaccgcggaggtcgccgtgttcggcagccattgctactgcttcggtgccgagacggaaatggtctgggccttctgccagtgcataggcgatgaggacgtggaggcacttcactcggtcaggcatgccaccgccggagaaatccgtgccgagatcttcaattgcgttgcgctttgccaggaagtgctcgtgggcgcgctggtagtcggcacgaagctcttcgtcggtggaaaggcgatcagtcatccacttcattaccaatgcgacctcgaggcgggatgcctcggtggtcaggcgtggatctgtcaagtagtacagggttgggaatggggttccgtcatccagttttggtgcggtcatcaccacaccgggtactccatcagggctgcggtaagaaatatcgaggacacctcgtggggcccttcccaattgctcttcgacagcgttcagatctgcttcattcacactcatgtcttctattctgtcatgagtctgtgtctaaagcgctattgcacagttgcttcctcagttggtgcaagtgttggaacttctccctcaactgctggaggcgcaatttcctcttcgccgagtgcttctggcttggtgactgagtcccagaggttttcataccaagctcccagtggtttctcttcgttgccgtcagaggtgactgaggtgtcggtatctagtgctgggtccacgattctgaacgcggtttctccaggttcaatgacgcctaggcgcaggcgtgcttgttcgcggatgtacgcctctgattggtacctgttgaggtcagattccagttgtttgatctgttgttctttggcttcaatggaagcctctgtttgggcgatgtcggagcgcagc

SEQ ID NO: 1091 - DNA, 930 bp, Corynebacterium glutamicum
atgctcaccctcaacgatgtcatcaccgcccaacaacgaaccgcccctcatgttcgacgaacgccacttttcgaagcagaccccatcgacggcacacaaatctggatcaaagcagagttcctccaaaagtgcggcgtgttcaaaacgcgtggagcattcaaccgccagctcgcagcttcggaaaacggactactcgacccaacggttggcatcgtcgcggcatcaggcggaaacgcaggactcgcaaatgcttttgccgcagcatccttaagcgttcccgccacggtattggtgcccgaaactgccccacaagtaaaagttgatcgcctcaagcaatacggtgcaaccgtgcaacaaatcggatctgaatatgcggaagcatttgaggcagctcaaacctttgagtcggaaactggtgctctgttttgccacgcctacgaccagcccgacatcgcagctggagcaggcgtcattgggctagaaattgtcgaagatcttcccgacgttgacaccatcgtggttgctgtcggtggcggtggactctatgcaggaatcgcagccgtcgtagcagcccacgacatcaaagtggtggccgttgaaccctccaaaattccaaccctgcacaactcactcattgccggccaaccagtcgatgtgaacgtttctggtatcgcggcagattctttgggggctcgccaaattggacgagaagcctttgacatcgcaactgcccatcccccaataggcgtcctagtggacgatgaagcaatcatcgcagctcgacgccacctctgggacaactaccgcatccctgccgagcatggcgctgccgcagcactcgcctctcttaccagtggagcatacaaacctgcagcagatgaaaaagtggcagtcattgtgtgcggagcgaacactgacctcacaacactg

SEQ ID NO: 1092 - DNA, 195 bp, Corynebacterium glutamicum
atgcctgcaattgaacttccagaacctaacgaaccggttccagctggtgatttcattgccgatccagatgccacaatgcattactttgcagtggaccgttccggatcccttcaatgggagcaaggctcatttagctacttcgacgtggaagcgcacatcgttgagttgattcctgcatcagtaagcgatgcgttt

SEQ ID NO: 1093 - DNA, 330 bp, Corynebacterium glutamicum
gtgggcgtgtcctacatcatcgccggcgatgagcagctggatatggcagaagccgttcgcaaaattggggagacctttaaaactgaggaaattatccttggtggcggaggaaccctgaactggtccatgctccgcgacggtttgtgcgacgaggttagcatcgtgatgatgccaatcgccgatggtgaaaagcacacccactctttgttcgaagccgatgaaaaatactcagcaccgttgccgatcggtttttcactcgccagcgttgaaccactagaagatggaagcgtttggatgcgttacggggtcaatggcccagtggacgcgaac

SEQ ID NO: 1094 - DNA, 189 bp, Corynebacterium glutamicum
atggataaggtcaaattctttcgctcccgggacaacaaaaatattgcgggcgtgtgcgcgggagtcgcgaagtattacgacctcgacgcggatacagtgcgctactggtacgtttttgctcatttctttggtgttccgatgttctcggtttatctaattcaatggctaatttatccccaggaggagagt

SEQ ID NO: 1095 - DNA, 993 bp, Corynebacterium glutamicum
atgagttctgccagcttgttgtggtgccattccggtgtgtcaacagttcgttttggcgagagaattttcactctcgtcgcaggcgacctgctgttcgcgcctgaggaagcccaggttgccgatgattctcaaggacttgttctcaacatccgctttgagaccctcaacatcatgggacctgcgcgtcgcatccacctgggtcacgtgtggaatgatcgcctgacctttgaatacagtcgctcgctgttcggtaaagagaccctgtcgccagacatcgcgcgcctgttcaccgaccgcgttcccacccctccgctgccagctccgcgtaaagcgcgcgcagtggcgcaggtgctggtgtccaaccctgcggatcagaccagtttggaagaatttgcggagatccaaggcgtttcggcgcgtactttgcagcgccagttcctcaaatccacgggctattcattcagcgaatggcgtgctgcgcagcgcgtctgcgtcgccgcgagcctgctggcccacgacttcagcatttcagtggttgcgaacctcgtcgggttcgccgcgaccagcagcttgaccagagcttttcgacgccacaccggtgcaactccgtccacctttactactggacagatcggcatgggctccgcaggtcacccaccacgcatcccagcaaccaccacgtttgccgaagcgcatcaggaccagcagctgtggatttacagcggaaccgcaaccgtcaccacccccggctactgccgattcatgggacaaggtgacatggtgaccatccctgccggcacccaaacccgcattgacgtggcagccggatccatcgcattcccagtcccagttggactcgacgaatggggaatggacctaacccgcgtcgtggctgttaataaccagcagccaaagccactgaccattttggaacagtctgaatggtccaagctcagcgaagaacttctgaacactcctgtacctgtacaaatg

SEQ ID NO: 1096 - DNA, 816 bp, Corynebacterium glutamicum
gtgcgaagcagcaatcccgtttttagttcccttaaggaaactcaacgtccacaaggccagaacccatacggtggttacgacaacttcggtggtgtctaccagcaaaacgtagctccacagaaggcggagcgcccaatgactgtggatgatgtgatcaccaagactggtatcactctcgcggttattatcgtttttgcattggtcacctttggcgtgtggttggttagccccggcctcggaatgatcttgacccttgttggtgccatcggtggtttcatcaccgttctggtcagcaccttcggcaagaagtacggatctgcggcagtcactttgatttacgcagtattcgaaggcctcttcgtcggcggaatttcccttctgctgtccggcttcacagttggtaacgccaacgcaggtggcctcattggccaggcagtccttggcaccatcggtgtattcattggcatgctgtttgtatacaagactggcgctatcaaggtcactcctaagttcaaccgcatcctcaccggcatgatggttggcgtcctggttcttgtcctgggcaacgttgtatgggcactgttcactggtggcgcaagcccactgcgtgacggtggaatcatcgcgattatcttctccctcttctgcatcggcctggcagcattcagcttcctctccgacttcgatgcagctgaccgcctcgtccgcgaaggtgcaccttccaagatggcatggggcgttgcgcttggtcttgcagtgaccttggtctggctctacaccgaaatcctacgtctgcttagctacttccaaaaccgc

SEQ ID NO: 1097 - DNA, 387 bp, Corynebacterium glutamicum
ttgttgtcttctcctggaggctatttaagaagtttaaattgtgtccatgagttcgcgtatggcaatgacagtttgagacggccacaggcgattctgagaagccattttctttgggcgccgtggcagtttttattgggtcccaccgccgaactgcatattcgaaccaaggagcctcaaaaatcgagctcgctttggtctcaaacgcacatttatcgcgcgttgaagtgtgcgtttgagaccaaagagccctccacaacgcacgtctttggtttggatatgacaggtgcccaagaactcaccccgccccatgctcacagagcccccatcagaagccaaaagaccccttccctgcccaagaagaacaggatgaaggggtcttgtgctgcg

SEQ ID NO: 1098 - DNA, 450 bp, Corynebacterium glutamicum
atgacaactctttcacgtaagttcttcgtttctgctaccacagccctggcggcagtcgcactggttgcgtgttcccctaatgagattgattctgaactgaaggtgccaacggcaactggcgtttctttaccttcgaagaacgtttccgcgacctcaactgctactacagatgaggatgcgcctggctacattgattgcgtagccgcaccaactcagcaacctgctgaaatctcactaaactgtgcaatggatattgatcggctcacggatatttcttggagcgaatgggatactgattccgcaactggaaccggtacccgcatcgtaaccgctgcaaatggtcaagagaccgaaaccgaagatattgaggtgaagctttccttccccaccgagtcttcccaaggcctagtgttcactcaggtcaccgtcgatggacaggttctcttcctc

SEQ ID NO: 1099 - DNA, 522 bp, Corynebacterium glutamicum
atggcaagtgtagataagcaatacatcaccccagaaaccaaggccaagctggaggaagagctcaacgccctcatcgcacaccgccctgcagttgctgcggaaatcaatgagcgccgtgaagaaggcgacctcaaggaaaacgctggctatgacgccgctcgtgaaatgcaggaccaggaagaggcccgcatcaagcagatctctgagctgctggccaactccaccactgagcgcgaaggcatcatcgaaggtgtcgcaaacgttggctccgttgttcacgtctactacgacggcgacgagaacgacaaggaaaccttcctcatcggtacccgtgctggcgcttccgagaacccagatcttgagacctactctgagcagtccccactcggcgctgcaattctcggagctcaggaaggcgacacccgtcagtacaccgctccaaatggttccgttatctccgtaactgttgtttctgcagaaccatacaactcagcaaaagccgcgacactccgcggcaaaaac

SEQ ID NO: 1100 - DNA, 483 bp, Corynebacterium glutamicum
atgagtacaaattccaactctccatccaacgcatcaggcgcttcgaacattccaaacacccaacgtccggctagccgatacaattcgcctcgcccggaagctgctgcaggcaggaacatcagcggaaaaatcatcgcagtcattggcgtgctgctggtgatcgccattgtgattgttggcgcaaacttcctcaaaaaccgcgatgcacaaacagtgtccggccaaatgggttcatttgaacgcatcgacgacgacaccttccgctttgaagttgacgtcacccgcgatgacccaagccaagtcgcctactgcatcgtgaccgcaaaggactactcgcacgcagaagtcgggcgtcgagaagtgcttgtggagcccagcgaccactcaacggtgcgtatctccacgctgatccccacccgcgaaccagcagtttccggtggtgtttacggttgttcaaccgtgatcccatcacatatgaacctg

SEQ ID NO: 1101 - DNA, 873 bp, Corynebacterium glutamicum
gtgagtggtctacgcctaatggcgatccacgcccaccctgacgacgagtcaagcaagggcgcagcaaccatggcgcgctatgcagctgagggcaatcaagtaatggttgttacctgcactggtggtgagcgtggagacattctcaaccctgctatggataagccaggaatcctggacaatatttttgctgtgcgtcaggaagagatggcgaaggccatggaaattcttggcactgagcacagatggctaggttatgaggactctgggctgccccaaggtgatcctttgcctcctctgcctgagggctgttttgctttagaagactcggataaagtcacccaagatttagtgaagattctgcgcgagttccgcccacacgtcatcattacctatgatgagaacggcggttacccacacccggatcacctcaaggttcatgaggtgtcgatgcttgcatgggagaagtccggcgatgcagcgtatgcacctgagttgggcgcaccgtgggagccactgaagctttattacacccacggctttatccgtcagcgcatggaaatgttccatgatctgctcattgaacagggcaagcccagcccatacaccccgatgcttgagcgttggaaggcaaatgaggctgatgtgatggctcgagttaccactcaggttccttgtgagcgcttctttgatcagcgtgatgacgccctgcgtgcgcacgcaactcagattgatcctgcgggtgctttctttggaactcccgttgaggtgcagcgtcgcctgtggccgactgaagagttcgaattagctaaaactcgtgtgaagacgtcgatcccagaagatgacctgtttgccggaatcacacccgatgcagaa

SEQ ID NO: 1102 - DNA, 318 bp, Corynebacterium glutamicum
gtgattgacctcagccctgtattcaatacagctgccggcgtatacaacgacaccaacgcaatcatcttggctcagcagcagcaaggtggaccacttggacctgagtttggaaaggcctcgccggttggtttgctactgatcgtcgcgatgctcgttgccattcttgttctcggctgggcgttccaccgacgctggtcacggatgaatcgtcgtcgtattttcgcagagcgcaacggccttgatcccttcgatattgagggtgttcgcaaggcaatggctgaggccggcttgaatgaaaagtccaaaaagggcttcctt

SEQ ID NO: 1103 - DNA, 1098 bp, Corynebacterium glutamicum
atgagttctccagtctcactcgaaaacgcggcgtcaaccagcaacaagcgcgtcgtggctttccacgagctgcctagccctacagatctcatcgccgcaaacccactgacaccaaagcaggcttccaaggtggagcaggatcgccaggacatcgctgatatcttcgctggcgacgatgaccgcctcgttgtcgttgtgggaccttgctcagttcacgatcctgaagcagccatcgattacgcaaaccgcctggctccgctggcaaagcgccttgatcaggacctcaagattgtcatgcgcgtgtacttcgagaagcctcgcaccatcgtcggatggaagggattgatcaatgatcctcacctcaacgaaacctacgacatcccagagggcttgcgcattgcgcgcaaagtgcttatcgacgttgtgaaccttgatctcccagtcggctgcgaattcctcgaaccaaacagccctcagtactacgccgacactgtcgcatggggagcaatcggcgctcgtaccaccgaatctcaggtgcaccgccagctggcttctgggatgtctatgccaattggtttcaagaacggaactgacggaaacatccaggttgcagtcgacgcggtacaggctgcccagaacccacacttcttcttcggaacctccgacgacggcgcgctgagcgtcgtggagaccgcaggcaacagcaactcccacatcattttgcgcggcggtacctccggcccgaatcatgatgcagcttcggtggaggccgtcgtcgagaagcttggtgaaaacgctcgtctcatgatcgatgcttcccatgctaactccggcaaggatcatatccgacaggttgaggttgttcgtgaaatcgcagagcagatttctggcggttctgaagctgtggctggaatcatgattgagtccttcctcgttggtggcgcacagaaccttgatcctgcgaaattgcgcatcaatggcggtgaaggcctggtgtacggacagtctgtgaccgataagtgcatcgatattgacaccaccatcgatttgctcgctgagctggccgcagcagtaagggaacgccgagcagcagccaag

SEQ ID NO: 1104 - DNA, 633 bp, Corynebacterium glutamicum
atgatccttgccggagttagcatgggaagcatcgatcatgagacgagcgttttcaccaagcttctcgacgacggcctccaccgaagctgcatcatgattcgggccggaggtaccgccgcgcaaaatgatgtgggagttgctgttgcctgcggtctccacgacgctcagcgcgccgtcgtcggaggttccgaagaagaagtgtgggttctgggcagcctgtaccgcgtcgactgcaacctggatgtttccgtcagttccgttcttgaaaccaattggcatagacatcccagaagccagctggcggtgcacctgagattcggtggtacgagcgccgattgctccccatgcgacagtgtcggcgtagtactgagggctgtttggttcgaggaattcgcagccgactgggagatcaaggttcacaacgtcgataagcactttgcgcgcaatgcgcaagccctctgggatgtcgtaggtttcgttgaggtgaggatcattgatcaatcccttccatccgacgatggtgcgaggcttctcgaagtacacgcgcatgacaatcttgaggtcctgatcaaggcgctttgccagcggagccaggcggtttgcgtaatcgatggctgcttcaggatcgtgaac

SEQ ID NO: 1105 - DNA, 675 bp, Corynebacterium glutamicum
atgtgtgatggcaaccgacgctgggcccgggaagcgggcttcactgatgtcagccatgggcaccgagtgggtgccaaaaagatcggcgagatggtccgctggtgtgatgatgtagacgtcaatctcgtgaccgtttatttgctgtctatggaaaaccttgggcgatcctccgaagagctgcaattgctgttcgatatcatcgccgatgtcgctgatgaactcgcgcgtcctgaaaccaactgtcgagtccgcctcgttggtcatttagatctgctcccagacccagttgcttgtcgtttacgcaaagctgaagaagctaccgttaacaacacaggcatcgcagtcaacatggctgtcggttatggcggacgccaggaaatcgttgatgccgtgcaaaaacttctgaccatcggcaaggacgagggcctaagcgttgatgaactgatcgaatccgtcaaggtagatgcgatctccactcacctgtacacctctggccaaccagacccagacctggtgatccgcacctctggtgagcagcgactttccggattcatgctgtggcaatctgcctactccgaaatctggttcacagacacctactggccagccttccgacgcatcgacttcctccgcgccattcgcgactactcgcagcgcagcagaagattcggtaaa

SEQ ID NO: 1106 - DNA, 174 bp, Corynebacterium glutamicum
gtgagcagcgactttccggattcatgctgtggcaatctgcctactccgaaatctggttcacagacacctactggccagccttccgacgcatcgacttcctccgcgccattcgcgactactcgcagcgcagcagaagattcggtaaataacttattctccaaggagagacatgtc

SEQ ID NO: 1107 - DNA, 519 bp, Corynebacterium glutamicum
atgtctgactacatcgtcgcatttgaatccgcatacggctctaccaagcagtacgcagaatctctggcgcaacgcctcggcgtagatgccttaaattttgaacaagcgtgtgcggaactcgcggcgaacccgaccgcagcaatcgtggttttgagctttgttcacggcccatcccatccaggtgcgaaattcattaccgataccgatctctccggccaccgcgtcgcactgtgcaccgtcggcatgacgcttgatgatgtcgtgcaaaagaaggacggcgcagctcgatcactgggaaacaaggcagacgatgtcacccgtttctaccttccgggacgccttaattactcagagctctcgaccgcgcaccgcaccaccatgtggacgatcgtcaacatgctgaaagcgaagccgttgaagaatgacaacgacaaaatgatgatcaacacttttgataccgatgttgaccgcgtcgatgagtcccgcctggacgcagtggaggagtgggcgaggggcctc

SEQ ID NO: 1108 - DNA, 318 bp, Corynebacterium glutamicum
gtggcagatttctacggttcggccgtgtttgaccctgttcgtccgcgccaagttgaaattgagaccaaagccgcgctgattgagggctcctttggcctaaatctgcacttatcccgacgattaagtgtcatgttaaaccaaggggttgagccgcactgtggcttttggcctcaaaatgcagtcgagctcaaaacccactgtatccagcgcagatgtgcccaaaaatacataggtctaaattcgcttctaaaggcttggcgtcagcatatccagacgcacacaccttcgaaaattccgactgctcaaaacgcctcacag

SEQ ID NO: 1109 - DNA, 936 bp, Corynebacterium glutamicum
gtgaaaccttccccacgcacaccagatttcagcccctaccttgatttcgaccgcgcacaatggcgcgagctgagaaactcaatgcctcaggtgctgacccaaaaagaagtcattgaacttcgaggcatcggagaaaacattgacctcgctgaagtggcagaagtctaccttccgctgtcccgtctgattcacctccaggtagcggcccgacagcaacttactgcagccaccgaaaccttcctcggaacttccccctctatctctgtgccgtttgtcattggtgtcgcgggatccgtcgccgtcggtaaatcaaccaccgcccgactcctccaagttctgcttcagcgctggaattcccacccccgcgtggacctcgtcaccaccgacggattcctctatcccggcgcggaactaatccgccgcggattaatgtcccgaaaaggattccccgaaagctacgaccaacgtgcactcctccgctttgtcaccgacgtaaaatccggaaaactcgaagtcaacgcacctgtctactcccacaccgcgtacgaccgagttccaggcgaattcaccacagtccgccaacccgacattttgatcgtcgaaggcttaaacgtcctccaaactggcccaacattgatggtcagtgaccttttcgacttcagcgtctacgtagatgcccgcaccgaagatatcgaaaaatggtacatcgaccgcttcctcaaactccgcgacactgcattccgtcgccccggtgcccacttctcccattacgccgacatggctgatccagagtccatcgccgtcgctcgagaactgtggcaatcgatcaacctgcccaacttggtggagaatattcttcccacccgagttcgcgcgtcgttggtactgaaaaaaggtagcgatcacttggtggaacgggtgaggatgcgcaagatc

SEQ ID NO: 1110 - DNA, 1302 bp, Corynebacterium glutamicum
atgaccgatgcccaccaagcggacgatgtccgttaccagccactgaacgagcttgatcctgaggtggctgctgccatcgctggggaacttgcccgtcaacgcgatacattagagatgatcgcgtctgagaacttcgttccccgttctgttttgcaggcgcagggttctgttcttaccaataagtatgccgagggttaccctggccgccgttactacggtggttgcgaacaagttgacatcattgaggatcttgcacgtgatcgtgcgaaggctctcttcggtgcagagttcgccaatgttcagcctcactctggcgcacaggctaatgctgctgtgctgatgactttggctgagccaggcgacaagatcatgggtctgtctttggctcatggtggtcacttgacccacggaatgaagttgaacttctccggaaagctgtacgaggttgttgcgtacggtgttgatcctgagaccatgcgtgttgatatggatcaggttcgtgagattgctctgaaggagcagccaaaggtaattatcgctggctggtctgcataccctcgccaccttgatttcgaggctttccagtctattgctgcggaagttggcgcgaagctgtgggtcgatatggctcacttcgctggtcttgttgctgctggtttgcacccaagcccagttccttactctgatgttgtttcttccactgtccacaagactttgggtggacctcgttccggcatcattctggctaagcaggagtacgcgaagaagctgaactcttccgtattcccaggtcagcagggtggtcctttgatgcacgcagttgctgcgaaggctacttctttgaagattgctggcactgagcagttccgtgaccgtcaggctcgcacgttggagggtgctcgcattcttgctgagcgtctgactgcttctgatgcgaaggccgctggcgtggatgtcttgaccggtggcactgatgtgcacttggttttggctgatctgcgtaactcccagatggatggccagcaggcggaagatctgctgcacgaggttggtatcactgtgaaccgtaacgcggttcctttcgatcctcgtccaccaatggttacttctggtctgcgtattggtactcctgcgctggctacccgtggtttcgatattcctgcattcactgaggttgcagacatcattggtactgctttggctaatggtaagtccgcagacattgagtctctgcgtggccgtgtagcaaagcttgctgcagattacccactgtatgagggcttggaagactggaccatcgtc

SEQ ID NO: 1111 - DNA, 1860 bp, Corynebacterium glutamicum
atgcgcgttttaattattgataattatgattctttcacgtttaatctcgccacctatgtggaagaggttacgggtcaggcacctgtggtggtgcctaatgatcaagaaatagatgagatgcttttcgacgccgtcatcctctcacctggcccgggccacgccggcgttgcggctgattttggtatctgtgcaggcgtcattgagcgtgcacgcgttccgattttgggtgtgtgtttaggccaccagggcattgcgttggcctatggcggtgatgttgatttggcgcccaggccggtccacggtgaggtttcgcagatcacccatgatggttcaggtttatttgcaggcatccctgaaacgtttgaggcggtgcgttatcactcgatggtggcaacccgcttgccggagtcattgaaagctacagctaccagcgatgatggtttgatcatggcattggcacatgaagtgcttccgcagtggggtgtgcaatttcatccggaatctattggtggacaattcggccatcagatcattaagaacttccttaatttagcgcgcacatatcgctggcaactcacggagaaaactattccgctcagcgttgattcagcagcggtttttgaaacattctttgcccattcctcccatgctttttggctcgatgatgcccaaggaaccagctatcttggtgatgccagcggtcctctcgcacgcacaaaaacccataatgtcggcgagggggatttcttcacctggctaaaggaggatctcgccgccaactcagttgcgcccggtcaaggttttcgtcttggctgggttggttacgttggttatgagcttaaagcggaagctggcgcacgggctgcgcacacttcgagtcttccggatgcgcacctcatttttgccgatcgcgccatcgcagtggaatcggatcaggttcggttgctggcgttgggggagcaggacgagtggtttgaagaaaccatcaagaagctgcataatcttgtcgccccgcggatacctgcgtccggacacctcgctttgcaggttcgagattccaaagatgagtatctcgacaaaattcgcagagcccaggagctgattactcgcggcgaatcgtatgaaatctgcctgaccacaaaacttcagggcaccactgatgtggcccctctggctgcctatctagcactgcgtggggccaatcccaccgcatatggtgcgtatcttcagctgggggatacctctattttgagttcctcgccggagcggttcatcaccattgattcggcagggtatgtggaatcaaagcccattaaaggcaccaggccgcgtgggcgaacagcgcaagaagaccaagaaatcattgctgagctgcgcagtaatcctaaagatcgtgcagaaaacttgatgatcgtggatttggtccgcaacgacttagcccgcggcgctttgcccaccacagttaaaacatccaagcttttcgacgtcgaaacctacgccacagtccaccaacttgtcagcaccgtctctgcagagttggggccacgcagtccgattgagtgcgtgcgcgcagcattccccggtggttcgatgactggtgccccaaagctgcgcaccatggagatcatcgatgagctggaggcagctcctcgcggtatttactcaggtggcttgggatatttttccctcgacggcgcagttgatctctccatggtgatcagaactctcgtcatccagaacaatcacgtggagtacggagtgggcggtgcacttcttgctctgtctgatccggaggctgagtgggaggaaatccgcgttaaatcacggcctctgctgaatttgtttggggttgaattccca

SEQ ID NO: 1112 - DNA, 723 bp, Corynebacterium glutamicum
atgacgtacctcgtgtgggacggtgcaacactcgtagaaggcgcgctggaatcaacacccacagttgttgattcctacctagccaaagaccaccgcgtggtgcgctgggatcttcatgaacagcgcttcgccactagcgtggacgtggacccgtgggattttctccacgcagtaagggaagcaattccacgccagggctcatggtttcccaaagttgaatggcatggcgatgatcttttcgcagtcaatattcgcccggcaccaacactgcgaaaggccacatcattgtggctttccgaagacccagatccacgcacacagccaaccattaaaggcccagacctagatgtgcttgctcaccttcgcagtcgcgccaacgataacggctgcgatgatgcgctgttgatcagcgcggatgggttcattctggaagctgccaacgccaccgtggtgttttgggcggatccacagacggtcatcgtgcccaggggagatgtgctcccatcggtgacactcgccgcaaccattccgctgtgggaaaaagccggaatcacattgcgctatcaaaacattcggcacattggttttcccgcgtggtgcggtagttcgctgcatggttggacacctgtggtcagttggggcaggggattgggcaaaattgcagcagcgaaagctccatcggtgaagccctggaatgaaaaattgcgcccaaccatttttctg

SEQ ID NO: 1113 - DNA, 864 bp, Corynebacterium glutamicum
ttggagccactccggtgggttttcctgcaggttcttgaactcttggtgagtcaatgcacctgtttggaactcctctggcgtggcgggcaaaaacagtccgagcttcttagcggcggtctgtggcttcatagccctgcccgatggctggcgtacagattcttcgttcacgcccacaacggtagcattgttttcatgctgaccttaagtttcatcactggcacggagccaggaaagtggtttacccgattccgagatcggactcatcacggtggacttgagacccttgattcggacgacgccctaggcctcatgctcgctggccaggcacaactcgccttaaccaggcttccagatgcgcgtatcgacgcctccctccacgtggtcactctttatcaggaacaacccggagtcgcttttccaaaagactttttcctcagtgccgaagaaggcgcggtggaccttgcggacttagatggggagatcatcaactggtccatgcccgatagtggggaagtcgatgccgctgctgttcgcgatgctctgcaaatcgtggcagcgaacgtcggtgtggtgatcgcccccaggccacttctcaaggtgttgagcaagaaattggtggagcaccgggacatcaagggtggaactgaaacatctatcgccctggtatggaagaaagatgaggattctgaagagattcaagacttcgtcggtattgctcgcggtcgaacgcggaattccagcaggcagcaaacggtaaagctcagtgctcgtgaaaaaacactggcaaaacaagcccgcaggcagggggagaaaccaaaaactccgaagcgtccgcaggcaagaaaacgtcccggaaaacggcga

SEQ ID NO: 1114 - DNA, 393 bp, Corynebacterium glutamicum
gtgggcgtgaacgaagaatctgtacgccagccatcgggcagggctatgaagccacagaccgccgctaagaagctcggactgtttttgcccgccacgccagaggagttccaaacaggtgcattgactcaccaagagttcaagaacctgcaggaaaacccaccggagtggctccaaaccctacgccgcgagggcccacaccctcgtccagtggtcgcccaaaaattgggcatcaccatcgcggctctgaaaaagaacgacatggacaaaccactgaccaccgccgagatcaaggcacttctggaaaaccagccagaatggttgcgcaccgcacgcacacagcttgctgaaggtcgcgaaaccgcaaagaaagaaactgaagaaactaccgaagac

SEQ ID NO: 1115 - DNA, 537 bp, Corynebacterium glutamicum
atggttgaaagagacttcactatccgaccaatccgcgagggtgatttccctcaggtgagggacatctacgaattgggcctggagacgggacatgcgacttatgagacttctggtcccacgtgggaccagttctcccaatctaaaatcatggataccgtcatggtggcggtagaaaacaacgacccggacttcatcctcggatgggtgtctgctgctccaatttcaagccgacaggttttccatggagtggtggaagattccatctatatccacccccagggccaaggccgaggaatcggcggcgctttgctcgacgcccttatcacctactgcgaaagcaacggcatctggtcgatccactcctggatcttcccggaaaacctcggttctgcgaaactgcatgaatcgaagggcttcgtgaaggtgggcaccatgcaccaaatggcaaggatgccctacggcgagatggaaggacaatggcgcgattgtgatctgtgggagtgcctcttatccgttccagagcaagctcaaagttcc

SEQ ID NO: 1116 - DNA, 879 bp, Corynebacterium glutamicum
atgagcttcaaagtaatttccactggcccccaagccatcttccaagaccgaggtcgcttcggttttgccagcgctggtgttggaacctcaggatcctttgatcgtttatccgctgctcgcgcgaatcacgctttaggtaatgatcccaatgcaaccgtggtagagattctgctcggtggctttgaggtggaggcgttgcacaccacctcgatcgtgttcacgggaactgaagctgaagtgatggttcgaacggctggtggacaatccaaaaatgccaccaccaacaccatcatcgatgttgcagctggtgaacgtatccgcgtcgagcccgcaacctatggcatgcgtgcctactttgctgctcgcggtggatttgcagtagaaaaaactttgggatctgcttcaaccgatctgatctcccacatgggccctcgcccgatcgagcccggggatgtcattgacgtagcaacagacattgcagattctcagtggtggccaaaacttcggcaactgcccaccttatggaaacgcatgccaacagaaacgcttaccgtcatccgaggtccacgtgacaaatggttcacgcaagaatccctcaacaacttttttactcaggtgtttacggtgagcaatgactccaaccggattggtttgcgcatgcactcaagcgagccgatccaacatcgtgtggaaggcgagctgaaaagtgaaggaatggtccgggggtccatccagattccgcctggtggaaaccccgtggtgtttggtcccgatcatcctgtgaccggtggctatccagtaatagcagtacttacatcaaggtcgtgtgatcgttcggcccagctgttgccgggcgataaagtcagatttaaattgctt

SEQ ID NO: 1117 - DNA, 1056 bp, Corynebacterium glutamicum
atggtgtcggtaagctctgctgcgccctttgcggctggggtcagcgcaattgaatcaacgatctctgcgaaacgattcggggtgatctgcttggtgtcaaacgtcactaacagtgtttgcgcagcgggaatagtatcgatgattccagggacctgcatgcccaccaaagagcggttgagtgcaagaacagcatccaagatgctgccttggacggcttcggcatcttcagcaagcaaatcgatgatgactgcttgctcaccacatggcctaacgagcatgggaaacctgaacctcatgagctgcaagggtggtcacgattttctccaccaatgcgagagcttgcggattatccccatgaacacagatggagttggcgtcgacaagcacgctctccccggtgatcgcggtgatgggctggccggtggcaaacgccaaggcctgcctggctgcggtttcggggtcgtgcagtaccgcgccgggaagcttgcgggaaaccagctggccatcggcggtgtaggcgcggtcggcgaaagtttcctgctcaacttgaagccccacggcgcgggcctgctcgacgatttgggagccagccagggccatgagggagagctcaggattgaccagcttgatgccctcgatgactgctgcggcctgggcttcgtcaaccgcaatggtgttgtacagcgcgccgtgtggttttacatattccacaaccgcaccgctggctttagccgcagcttgaatggcgccgatctggtagatcgtttcggcgacgaggtcatcgtgagcgatgtcgaggttgcggcgaccaaaacctgcgatgtcgttgtaaccaatgtgtgcgccgatgcggacgtggcgtgcatgggctgcgcgcacagttttgaacaacacagtggcgtcgccggcatggaaaccgcaggcaatattggcgctggacaccaagtcaagaacagctacgtcgttgcccatgacccagctgccgtagctttcgccgaggtcgctgttgagatcgatggtggtcatgaaaaaatcctttcaaaaaacgttaactgc

SEQ ID NO: 1118 - DNA, 669 bp, Corynebacterium glutamicum
atgaggttcaggtttcccatgctcgttaggccatgtggtgagcaagcagtcatcatcgatttgcttgctgaagatgccgaagccgtccaaggcagcatcttggatgctgttcttgcactcaaccgctctttggtgggcatgcaggtccctggaatcatcgatactattcccgctgcgcaaacactgttagtgacgtttgacaccaagcagatcaccccgaatcgtttcgcagagatcgttgattcaattgcgctgaccccagccgcaaagggcgcagcagagcttaccgacaccattgagattcccgtggtctacgacggccctgatctagaaaccgtagctcaacacacaggtctgagcgtggaggaagttatcgccacgcattctggcaccgtgtggactgctgctttcggtggatttgcaccaggtttttactatctgatcccccagactcccctgtgggatattccccgcttggaatcgccacgcaccaagattcctgcaggttctgtcgcagtggccggtgaattcagcgctgtgtacccgcagcagtcccctggtggttggcaactgctgggcactactgagattcccatgtgggatgtggaccggtggcaaccatcgcttctcaagcccggtgattcagttcgatttgtgcaggtgaagaaa

SEQ ID NO: 1119 - DNA, 756 bp, Corynebacterium glutamicum
atgaccaccatcgatctcaacagcgacctcggcgaaagctacggcagctgggtcatgggcaacgacgtagctgttcttgacttggtgtccagcgccaatattgcctgcggtttccatgccggcgacgccactgtgttgttcaaaactgtgcgcgcagcccatgcacgccacgtccgcatcggcgcacacattggttacaacgacatcgcaggttttggtcgccgcaacctcgacatcgctcacgatgacctcgtcgccgaaacgatctaccagatcggcgccattcaagctgcggctaaagccagcggtgcggttgtggaatatgtaaaaccacacggcgcgctgtacaacaccattgcggttgacgaagcccaggccgcagcagtcatcgagggcatcaagctggtcaatcctgagctctccctcatggccctggctggctcccaaatcgtcgagcaggcccgcgccgtggggcttcaagttgagcaggaaactttcgccgaccgcgcctacaccgccgatggccagctggtttcccgcaagcttcccggcgcggtactgcacgaccccgaaaccgcagccaggcaggccttggcgtttgccaccggccagcccatcaccgcgatcaccggggagagcgtgcttgtcgacgccaactccatctgtgttcatggggataatccgcaagctctcgcattggtggagaaaatcgtgaccacccttgcagctcatgaggttcaggtttcccatgctcgt

SEQ ID NO: 1120 - DNA, 591 bp, Corynebacterium glutamicum
atgctggactccggacgaaccggccccaacaacgtcaaagctgtttccaattcctctatcaccggcatcctgatcactggcctcatgcgcgtggtgctcttcctcgcggttctcggtgttgtcgcaggtggcgtcaccctatccaccacgggcaacccagccgcggaagcattccagcacgctgcaggcgatatcggactacgcatcttcggcgccgtgctgtgggcagcgtccatttcctcagtcatcggcgccagctacacctctgcaaccttcctggtggaaaacaagccagagaagaagcgtctgcaaaactgggtgaccatcatcttcatcctgatttcttgctccgtgttcatcgtgctcggcacggcaccagcaatcctcttggtcttcgccggagcattcaacggtttggtcctccccgtaggctttaccctgatgatctacgtagcgatcttccgccaaaaagatctcctcaagggttacaaatacccagtgtggctgatcgtagtgggagtcatcggcctggttatcgcatggttcttggcttatgtctccttcggtggagtcttcgatcttcttagcagt

SEQ ID NO: 1121 - DNA, 672 bp, Corynebacterium glutamicum
gtgtgcgccagcgtaagtgatgtatccaccgacggttccacccacaagtgtggtgatgacaagccagtcgatggtgtcaggaagtactgcattcttcagcgccgagccaactggaggttgggagacgaaagccacgtagacggtgagcaggatcatcacgacgccgaggaccacgaggaatttgtccagagcagcaccaagtcgcttgaacaagaagatcgcaatcgcgatggccgcggtgatcacgccaccaactttgacgtcccagccaagcagcgcgttaagcccaaggccaccaccggcgatgttgccgatgttgaatactacgccgccaatacagaccagtacggccagcacccaaccaaaacctgggataaccgtgttgccgagttcttgggcgcgcatttcagagacgccgatgatgcgccacacattcagctgcaccgcgatgtcaatgaggatcgacaccaggatcgcaaatgcgaaagctgcgccgagctggttggtgaagacagcggtttgggtgaggaaccctgggccgatggcagaagttgccatgaggaagatggcacccatcagagcgcttcggccagaggcggttactgcagcttgcttgagggatggcgcattggcttttgcaatgtcgccaggcccaggggttccagtgctggc

SEQ ID NO: 1122 - DNA, 603 bp, Corynebacterium glutamicum
gtgagcaggatcatcacgacgccgaggaccacgaggaatttgtccagagcagcaccaagtcgcttgaacaagaagatcgcaatcgcgatggccgcggtgatcacgccaccaactttgacgtcccagccaagcagcgcgttaagcccaaggccaccaccggcgatgttgccgatgttgaatactacgccgccaatacagaccagtacggccagcacccaaccaaaacctgggataaccgtgttgccgagttcttgggcgcgcatttcagagacgccgatgatgcgccacacattcagctgcaccgcgatgtcaatgaggatcgacaccaggatcgcaaatgcgaaagctgcgccgagctggttggtgaagacagcggtttgggtgaggaaccctgggccgatggcagaagttgccatgaggaagatggcacccatcagagcgcttcggccagaggcggttactgcagcttgcttgagggatggcgcattggcttttgcaatgtcgccaggcccaggggttccagtgctggctgagactagctggctgtcatcggcatttttgttgtcggccattgtcgcgctcctttcgtgggggctttcaaaa

SEQ ID NO: 1123 - DNA, 681 bp, Corynebacterium glutamicum
gtgtgtccccagtcctttaagatcagtcacatgacgcaggcaatagcagcatcccttgatttagcggctcgaatcaccgccaaaattgatcaaggagtgctcactccaggtactcgactacccgaggttgctttggcagaagaacttggcgtttcacggaacacgctgcgtgaagcttttcgggtactcatgcaagacggactggtggatcatattcccaaccgtggggttttcgtgcacacgttcaccaagtcggatgtggaagatatctatgcttaccgcacatttatcgaggttgctgcgattaggtcggcgcggaaaaatcctcagttgctggagcagtctttgggggtaatgcgagaggcctacgaaaggggtgctgcagccaatgccgtgggtgattggcaaactgtcggttctgccaacagtgcttttcacttggcgattgtggacctagcaggagtggctaggttgtcagcagacgctcgaaaagtgttggcgctggctcgcatcggattcatggccacctacaacgtggagacattccatagcatttacgtggaaaagaaccatcaaatcttgaagtatttggctgccggtgaattcgaagaggcggaacaatacctccagaaatacttcgaagattcgcgcgatgatttgtctgcgcacctaccggaattt

SEQ ID NO: 1124 - DNA, 1278 bp, Corynebacterium glutamicum
atggttgcaacgacgccagggaaggaggcgcaccccatggcatttggattttttagtagacgtaagaaaaagaacaaagacaaaaacccgaatgaaaattcagcagtgcccgcacactctgaagattcacctcaggaggtttttgagggtaatggtcgtcaggtaggcgaccccattgaacagcaggttgatcgagatgctaaaggtcgtctcacagcggcggatttcttgccggacgctgatctgccacagctgaatcgttcgcgtgcaaatatgctgcgccgtgaattggagtaccgtttttcactccagaatgcccacattaatatcgatggaaacacggccatgattcagcgttcagatggcggggcagcacatgtctcgttgcgcaccctcgcgatgaatgcagctggccttgataactttgatcaactccctgaactggtggaaagcttcgttcacggcacgctggccgatgcaacattaaacgatctttctactgctgacctgtataaagcactgcgccttcgcctgctgccaacacctggcgaaggcgacgatctagttgagcatggactcgaccgggaaagccagatccgcgacgattcaatcctgcgcaccttcacctctgacatgtcgatcgcgctggtgctcgataccgagcatgccatccgcatccagccactcaaagagctcgaggagttcgatgacctcagcgccctagagcgggctgcggaccgcaatacctggcaagagctttacgacgcaaacgttgacgcttccttcgtcgacgctgaatcagacagcgaagggtcatcattttgggctttcgaatctaactcgtactacttgggtagtgcaccactgttcctcaacgatctgttggcaaagtgggcacctgacctggaccaaagtgatggcgtcatctttgctgtccctgatcgtgatctgttgattgcgcgtcctgtgaccaccggcgaagatctgatgaacggaatcaccgcgatggtgaggatcgcgatgcgctttggcctcgggaacccgacgtcgataagcccgcgcctgcacctgctgcgcgacaaccaggtgaccaccttcaccgacttccgcgtcgtctctcctgaaatggaagctgaatgggaagacagcgcgtttgacgcgccaccggccggcgcgatcggcattgaggtgcgcccagatccgtatctgatggagcgcctccaacagggcggctttggtgatttcggagatttcggcaagccccgcgatctagatatg

SEQ ID NO: 1125 - DNA, 1419 bp, Corynebacterium glutamicum
atgagtgatttcatgaccgagcaggaattccgtattgagcacgacaccatgggtgaagtgaaggttccagcaaaggctctgtggcaggcacagacccagcgcgctgttgagaacttccctatctctggtcgtggtctggaatccgcacagatccgcgcaatgggtctgctgaaggcagcttgtgcgcaggtaaacaaggactccggtgcgctggatgcagagaaggcagatgccatcattgcagctggtaaggagatcgcgtccggtaagcatgacgctgagttcccaattgatgtgttccagactggttccggtacttcctccaacatgaacaccaatgaggttatcgcttccatcgcgaaggctaacggcgttgaggttcacccaaatgaccacgtcaacatgggtcagtcctccaatgacaccttccctactgcaactcacgttgctgcaaccgaagctgctgtcaatgacctcatcccaggcctgaaggttctgcacgagtctttggcgaagaaggctaacgagtggtctgaggttgttaagtccggccgcacccacctgatggacgctgttccagtaaccctgggccaggagttcggtggctacgctcgccagatccagctcggcatcgagcgcgttgaggctactcttcctcgccttggtgagctggctattggtggcaccgctgctggtaccggtatcaacacctccgctgatttcggcggcaaggttgttgctgaactgatcaacttgaccgacgtcaaggagctcaaggaagctgagaaccacttcgaggctcaggctgcacgcgacgctcttgttgagttctccggcgcaatgcgcgttatcgctgtctccttgtacaagatcgctaacgatatccgcctcatgggctccggcccactgaccggtcttggcgagatccgtctcccagacctgcagccaggttcctccatcatgccaggcaaggtcaacccagttctctgtgagaccgctacccaggtttccgctcaggttatcggcaatgacgcagctgttgcgttctccggcacccagggccagttcgagctcaacgtgttcatcccagtgatggctcgcaacgtgcttgagtccgctcgcctgctggctaacacttcccgcgtgttcgcaacccgtctcgttgatggcattgagccaaacgaggcacacatgaaggagctcgctgagtcttcaccttccatcgttaccccactgaactctgcaatcggctacgaagctgctgcaaaggtggctaagactgctttggctgagggcaagaccatccgccagactgtcatcgatttgggcttggttgatggcgagaagctcaccgaggaagagctggacaagcgcctcgacgttcttgctatggctcacaccgagcgcgagaacaagttc

SEQ ID NO: 1126 - DNA, 489 bp, Corynebacterium glutamicum
atgacttcagcaatcaccaccgcaactgatcttcgctccgtactgcgaaacgtaccaaccccaattagcttcattgcaacccacaccgatcagcctctgggcatgatcgttggttcattcgtcagcattagcgccgaaccaccattggtaggcatcttcttgcagaagagctcttcttcatggccagctatcgagcaggcattagttaccggccaagagctaggcatttctatcctcggcggggcacacgcagaccatgtgcgtaagctttctggcccatccgaccagcgctttgaaaaccttgggtgggcatccaccgaaaacggtgcgattcaccttgaaggcgctgatgcacaactaaccacgaaacttcatgatctccaggaaatcggcgatcacttctttgcagttctagaagttattgacgcttccgctgaccaagacttcagctcagcgctggtgtaccaccgctcacaggtgtcctcgctg

SEQ ID NO: 1127 - DNA, 261 bp, Corynebacterium glutamicum
atgagttgggcttttaacggtttcctatccgatgacgcactggttgaacttatgggactggacttccgcaacagaacagattatttcacaacagaagagcaaaaactgtacggaatggagcttaaaaccgcaatcgaaaaccctgactccgctgcctttatcaatcacgtgagaatcattcgcgagaaaagaggacgcgaaccacttaacaccgaacaagaggaaagtctccacactcaccacaaagcgttccacgaattt

SEQ ID NO: 1128 - DNA, 447 bp, Corynebacterium glutamicum
ttggagctttctgcgcacacccctttggaagaatttcaccaaatcctcacccgtttgcgcatccaactccttgcagaacacgcccatcgctctactccaagccctgcatggacacccacaacaccaggcttattcacttacgacgatgaggcattttcgggcgtaattatccgaaaatttccgagcagcacaactagtgaacgctggctgatcattggttcagattgggaggatatcagcccttttcaaagcaaagaaaaaggacatctccacatttctcccgcagccccagaatggacgggtcttgtttctctagaggatttctatccttaccgcggttccgttattggcgatgcaccgtcatctgtgacctggtttgaggatggaatctggcacgtttccggggaaagaaagaagcaatgggacaccctcgatccccacagaccc

SEQ ID NO: 1129 - DNA, 564 bp, Corynebacterium glutamicum
atgagcaagatcgccatcatcaccggttccacccgtccaggccgcgtcaacattgacgtagccaactgggttctcgagcgcgcacaagagcgcaacgatgcacagtacgagctcgttgatatcgccgatttcaacttccccgtcctcgacgaagcaatgccagccggctacggccagtatgcaaacgagcacaccaaggcatgggcagcaaagatcgcagaatttgatggcttcatctttgttaccggcgaatacaaccactccgtcccagcagcactaaccaacgccctttcctacctctccgcagagtggaacaacaaggctgcaggcatcgtctcctacggctccgcaatgggcgttcgcgcagctgagcacctccgcggcatcctttccgagcttcagatcgcacacgttcaaaagaccggcctgctgagcatcttcaccgacttcgaataccctaacttcaagccttccgagcagggcatctcctctgtggacgctatgcttgagcagcttgttgtctggaccaaggcaatgtccaccattcgcgagtctgcgaacgtc

SEQ ID NO: 1130 - DNA, 1488 bp, Corynebacterium glutamicum
atgtctattttaattaaggagcagaacatggccacggccgagaacacaacacaggagaatcggaaaatcctgttcaacgcatttgatatgaactgcgttgcgcatcagtccccaggactgtggacacacccgaaggataaggcgcgagactacaacactcttgattactgggtgcaccttgccaagactttggagaagggccttttcgacggccttttcatcgcagatgtgcttggaacttacgatgtttatggttctagtaatgaagcggcgttgagcagtggtgcgcaggtgcctgtcaatgatccgatccttcttgtttctgcgatggcctatgccacaaagaacctcgggtttggcattactgcaggtactgcctatgagcacccgtatccttttgcgcggcgtctggccacacttgatcacctgactaatgggcgtgtggggtggaatgtggttactggctatcttccctctgctgctcaaaacatgggtgacaccgatcagctgccacatgatgagcgctatgacaaagcagatgaatacctggaagtgatctacaagcttctcgagggctcctgggaagacgatgctgttcaaaacaatacggagacgagtgtctttacggactcctccaaagtgcacgccattaatcatcatggcaagtactttgatgtgccgggcattgccatcactgagccgagtgtgcagcgtacgccggtgatctaccaggcgggtgcatcgccgcgcggattgaaattcgctggtgagaatgcagaagcagtgtttatcaattccagcaccgtggaggcaatcaccaagactgtcgcaaaaattcgcgctgctgcggtcgctgcgggacgtgatccacatgcggtgaagatctttgcgatgcaaaccatcatcactggtgaaacagaagcagatgcgcaggcaaagctggaggaatacagtcgctatatcgatcctgtcggtggtctgaccttgatgtctggatggaccggcgcggatctgtcgcagtatgacctggatgaaccgatcaccaatattgagtcaaacgctattcagtccactgcagccaccattagcaacggcaccggtgaaggtgcgtggacggtacgcaaactgggtgaggcaaccggcatcggcggcttcggaccagtgcttgtgggatctggcgctaacgttgccgcggaacttgcacgcatccaggatctcagcgatgttgatggtttcaaccttgcttatgccatcaccccaggaacttttgaagatgtcgtggactttgtggtgcctgagctgcaaaaacttagccgctacaagacggaatacgcgccgggttccttgcgcaacaaattgctcggtaaaggtgatcgcctggacgatacccaccgcggcgcaagctaccgcctaggcgctcggaactccaccgccactattgatctcagttccatatccgcccaactagtttcccagggagcccactca

SEQ ID NO: 1131 - DNA, 1080 bp, Corynebacterium glutamicum
atgatctcaccgcaaacaatcatcgacaatcttgctccagtcctcgcggagatcgcagcaacggctgcgcagcgcgaacaggatcgagaattcagccgtgatttggcaaagcagcttagtgccggtgggttcactaaactccgcattccagttgaatttggcggtttgggttttagccttccagaagcatttgaggtgctggtggcagcggccgctgcagattcaaatatcgcgcagggattgcggcctcacttcttggcagtggagagcttattgatcgctccttattcagagcaccgcaccaagtggctgcgaaaaatcgctgagaaaggcgtggtcattggcaatgcgttgactgaagtgggaaacaagccaggtgagctgaaaaccaagatccgaaaggaaggcgagtcttacgttctcagcgacaccaagttctattccacgggcagtctttacgccgactggattcaagtacatgcgaaagatgaggaagatcaagatgttttcgcctttgttgatcgcgacgcatcaggcgttgttttggtggattactgggacgaatttgggcaacaactatttgcctccggaaccagcttctttgaaaaagtcgtggtagatccactggacattgtcacccgtgattacaccgcacccagcgctttccaggcgctggcgcagtcacatcatttgtctacgttgactggtatttcgcaggcaatcacccgtgacattgttacctatgtacaaaaccgcacccgtattttcagccacggaagtggtgaccttccacgctttgatccgcaggtgcaacaggtggtgggtgaggtgaaagccaagtcgtatgcagtcgagaaaatctttcagggtttcgcacaagaactggatcttgtcgtcgataaggcaaaagccggcactgctacggaggtcgatctggccgctgtcgacctgagcgcctaccaagcccagttagcggtggcacctttggtgctgagccaggccacccaggcctttgaggttggcgcagatgccttaaacggcggccacgtggctgcccaatacacgatcggatccttgtca

SEQ ID NO: 1132 - DNA, 1197 bp, Corynebacterium glutamicum
atgagccaagaaattttgagccattttgcacccgcattagagcgcattcgaagcggcgccgtcgagcgcgaacagcagcgcgccttgccagtggaagagattaaagagctggtagagctaggttttactgggcttcgagtgcccgaagaactaggcggtgcgggcgcttccctggaaagcgtagttgagttactgatcgagatcgcgggcgccgattccaatatcgcccaagccctgcgcggacattttgccttcgtggaactactcctggaagcgccggagagcgaattccgcacccattggctgcgcgaagtcgccaccggaagacttgtgggcaacgccgaaagtgagaaacgcggcgtttacggcgatccgcagaccttcatcgatgaggtggagactgaaaacggaccgattttcgtgctcaacggcactaagttttataccaccggcacctattttgcggactacacctggaccaccgcgctgctgcgcaacctcaacggccaagaaactttggtcagtttgccggtcgatctgcacgcgccgggcgtggatgttgttgatgattggagcgggtttgggcaaaagctcaccgcctctggaacgaccacgtttaaagacctggaggtggatccgcggtggatcattccacgcactgatgcgcccacgctggtgtggacgtatctgcagctgagcctgctgaccgtgctggttggcagtgccgcagcagctgtcgatgaggtggttgcccgcgcccaatcctccaccagaaatgcgtggaaccctggcgtcgagcgccgcagcgatccggccgcaaccatagcgatcggcgacgcacgcagccgagtcaccgttattcgtggagcgcttctcgacgccacccgccacgtttccaacgccgccacgatcgtaacccccgaagccttcaacgaggcggacgctattgttgcagcgctctggcccatcgtctccggacaagctttggtggtgacatccaacgttttcgatgcggtgggtgcatctgcagtgcttggtgagcattccattgatcgccactggcgcaatgtgcgtaccgtgtcctcaaacaacccggtgttcctggccaagaatgcagtgggggagtatgccctcaacggcactcctgtgggtaccaacattggtaaagcactgagccgtccggtgagcctaagcagc

SEQ ID NO: 1133 - DNA, 780 bp, Corynebacterium glutamicum
atgctcaccaagcactgcagatgcacccaccgcatcgaaaacgttggatgtcaccaccaaagcttgtccggagacgatgggccagagcgctgcaacaatagcgtccgcctcgttgaaggcttcgggggttacgatcgtggcggcgttggaaacgtggcgggtggcgtcgagaagcgctccacgaataacggtgactcggctgcgtgcgtcgccgatcgctatggttgcggccggatcgctgcggcgctcgacgccagggttccacgcatttctggtggaggattgggcgcgggcaaccacctcatcgacagctgctgcggcactgccaaccagcacggtcagcaggctcagctgcagatacgtccacaccagcgtgggcgcatcagtgcgtggaatgatccaccgcggatccacctccaggtctttaaacgtggtcgttccagaggcggtgagcttttgcccaaacccgctccaatcatcaacaacatccacgcccggcgcgtgcagatcgaccggcaaactgaccaaagtttcttggccgttgaggttgcgcagcagcgcggtggtccaggtgtagtccgcaaaataggtgccggtggtataaaacttagtgccgttgagcacgaaaatcggtccgttttcagtctccacctcatcgatgaaggtctgcggatcgccgtaaacgccgcgtttctcactttcggcgttgcccacaagtcttccggtggcgacttcgcgcagccaatgggtgcggaattcgctctccggcgcttccaggag

SEQ ID NO: 1134 - DNA, 690 bp, Corynebacterium glutamicum
atgttggtacccacaggagtgccgttgagggcatactcccccactgcattcttggccaggaacaccgggttgtttgaggacacggtacgcacattgcgccagtggcgatcaatggaatgctcaccaagcactgcagatgcacccaccgcatcgaaaacgttggatgtcaccaccaaagcttgtccggagacgatgggccagagcgctgcaacaatagcgtccgcctcgttgaaggcttcgggggttacgatcgtggcggcgttggaaacgtggcgggtggcgtcgagaagcgctccacgaataacggtgactcggctgcgtgcgtcgccgatcgctatggttgcggccggatcgctgcggcgctcgacgccagggttccacgcatttctggtggaggattgggcgcgggcaaccacctcatcgacagctgctgcggcactgccaaccagcacggtcagcaggctcagctgcagatacgtccacaccagcgtgggcgcatcagtgcgtggaatgatccaccgcggatccacctccaggtctttaaacgtggtcgttccagaggcggtgagcttttgcccaaacccgctccaatcatcaacaacatccacgcccggcgcgtgcagatcgaccggcaaactgaccaaagtttcttggccgttgaggttgcgcagcagcgcggtggtccaggtg

SEQ ID NO: 1135 - DNA, 1176 bp, Corynebacterium glutamicum
atgagtgaaaacaatcccactaccttgcactggttcctacccacctatggcgattctcgcggaatcacagccggcgggcatggcttcggcttccactccggaagccggacagcagacctcgattacctctcccaaattgccctggccgctgaacgaaacggttttgaatccgtcctgactcccactggattgtggtgcgaagatgcgtggatcaccaccgcagcgctgctgtctaggacatcaaaactgaaattcctcgttgctattcgaccaggccaagttagccccaccatcatcgcgcagcagggtgctgccttccagaaattctcaaataaccgcctgctcatcaacgtcgtggtgggtggcgaagaccatgaacagcgcgctttcgctgattattcttccaaagaggagcgctaccacaaggctgatgaaaccttagagatcatcgatcacctatggaacagcgcagaacctctaaatttccagggtgaattcctcagtgtggaaaacgcggtattgaaggaacagcccgaggtttccccaccgatttactttggcggatcctcacaactcggcatcgaaatcgcagcccaacattccgatgtttatctcacctggggtgaacctgcggaaaaggtagaggagaagcttgcccgggtgcgcgccgaagcagataagcgaaaccgcgaactagactatggcatccgcctgcatgtcattgctcgaccaactgaggatgaagcctggtcagtggctcaaaatcttcttgaccaacttgatcaggaagaggttgcccgcattcaggaagggcttgcgcgttctcaatcggaaggtcagcgtcgcatgacggaacttcatggacaaggggcagcattcacagcaggagcagatgctcgctcccttgaaattgcaccgaatctctgggcaggtgttgggctagtccgcggtggcgccggcacagcgttggtgggttcctatgagcaagtcgcgcaagcaattttgcgataccgcgatattggtctgagccacttcattttctccggctatccacatttggaggaaacctatcacgtgggcgaaggagtggtacctgagctcctcaaattgggtgttccggtgaacaaccatgaagaacaacgcaacgacgtggtagcgactccgtttatttccaga

SEQ ID NO: 1136 - DNA, 963 bp, Corynebacterium glutamicum
atggagctggtgcgagttacggaagcagctgcactggcttctggacgttgggttggacgtggcatgaagaatgaaggcgacggtgccgctgttgacgccatgcgccagctcatcaactcagtgaccatgaagggcgtcgttgttatcggcgagggcgaaaaagacgaagctccaatgctgtacaacggcgaagaggtcggaaccggctttggacctgaggttgatatcgcagttgacccagttgacggcaccaccctgatggctgagggtcgccccaacgcaatttccattctcgcagctgcagagcgtggcaccatgtacgatccatcctccgtcttctacatgaagaagatcgccgtgggacctgaggccgcaggcaagatcgacatcgaagctccagttgcccacaacatcaacgcggtggcaaagtccaagggaatcaacccttccgacgtcaccgttgtcgtgcttgaccgtcctcgccacatcgaactgatcgcagacattcgtcgtgcaggcgcaaaggttcgtctcatctccgacggcgacgttgcaggtgcagttgcagcagctcaggattccaactccgtggacatcatgatgggcaccggcggaaccccagaaggcatcatcactgcgtgcgccatgaagtgcatgggtggcgaaatccagggcatcctggccccaatgaacgatttcgagcgccagaaggcacacgacgctggtctggttcttgatcaggttctgcacaccaacgatctggtgagctccgacaactgctacttcgtggcaaccggtgtgaccaacggtgacatgctccgtggcgtttcctaccgcgcaaacggcgcaaccacccgttccctggttatgcgcgcaaagtcaggcaccatccgccacatcgagtctgtccaccagctgtccaagctgcaggaatactccgtggttgactacaccaccgcgacc

SEQ ID NO: 1137 - DNA, 570 bp, Corynebacterium glutamicum
gtggctgagaaacgaccgaaaatttttgatggcagtcgagacatgattatctcgttggtagtctccgcgatcatcatgttggtagcggtgggattcacgggaatgtgttctttcaatacaggatcccctgaaaatgggcaggtacctgaagttgatgcttccacttttatgtcaatggaagcgcgcgcaatgactgatcatgcaactaggttgccggaaactcctgaaggctggaccacaaattcagctcgacgcaccatggtggatgacaccccggcatctgtagttggatatgtcaccgcagatgagggctatattcagctcactcaaactggtgaaaccgttgaggatgctgtggctggttatgatactcgctggcgtgatctttctgagtcttatgatcttgatggccacgacgtgggaatttacacctcacaggaatctgatgtgcgtgatctgcgtgtgatggatctgggcgatgcccgcgtcatggtctcgggtgctgctaccgatgaagaattcaatgatctgcttcgcgcagttgcgaattcggagccactgcctaccaat

SEQ ID NO: 1138 - DNA, 1902 bp, Corynebacterium glutamicum
gtgtctcagcctctcagcaagcgtctcagcatacgaaaagcactcgccagcgccttcatagttgcgctggcgttttcgctttccccagtagccaaagcccaagccaatgaaactccgacgatgatcgtgttggacaattcaggctccatgacagctcaagatgccggcggacagacccgtatcgatgcagcaaaacaagcctccactcagttaattaatgacatctccgaccgcaccgacgtaggtctgacctactacggcggaaacaccggcgaaacagaagcagacgttgagatgggatgccaagacgtcaccatccttggcggcccctcccgaggaaatgcagacaccttaattgacacgatcaacagcctgcagcctcgaggcttcacccccatcggcaaagcactcaccgataccgccgccgagctccccgaaggcggaaacattgtgttggtctccgatggcatcgccaactgcaccccaccggatgtctgcgaagtagcccaagaactggctcaaagtggaatcaacctggttatcaacaccatcggactaaatgttgatccagcagcgcgcgaagaactggagtgcatcgctggagtcggtggtggcacttacgcggatgcttccgacgcgcagagccttaccgatgcgctgacacgagccgccagtaggcaatacaactcttacacctccgatgtgacaaaaattgatggggcatcggaacaaagcgcagccgtagaaattgatgaggatacagaactattcctcaccgacctgccacaagaatcccgcttttggaaaatccctgtagagccaggtgaaaccatctcagtttctgccaacacagttaccgacccaacagtactcaccatggggcaaggcggaatcaagcttgaagcccaactccatactgaagaggctccacaatacggcctgcgtggtcggtgcactcgggtctcatttgataatttcaagcccggccttggtgtacgcggaatccaaaacgcgtccgttgcatcaaaagaagtgggcaccaacaactgtgacaccgatgccatctacctcgaaatttctagaagcggagattacctcaacgggcaggacattccaacggaaatcaccatcgagcgcttcggaaaagtagatgaatcaacaatcggaaatgtcacagaggaacatagctccgtcgatcttaccgaggctgcagcatcagaggcacaccctgtcacacctggccagtggttcacatcggccgctgatctagatcccgcaggtgagaaagtctcctccatcatcgttccaggagaaacccacttctatgcgctgcctgtcgactacggccaagaactgcgcgcagctgtagaaacaacttttgaccaaatcgacagttccgcgcttggcacgcatctttatatccaagcgttcagcccaaaccgggcagagatagagctcaccaatagagatacgtcatatgcggacgacaacgggctcaaaacttttggattcttcaccccagtgagtgcagcaaatttgttcgagaaaagttctcaaggcatatcgctaaggagcccatggcaaggtggcacccaatacctcgcagtgacatacctaccaagtggtcaagatgaagatgtatccgcaactgatcagctgcccacattggaatatgaactcgtggcagaagcgtttggagaccctgttgacccaccggttttcgcttcattgacgggagcaaccccaagcacctccacccccccatcagatgttgcggaagatgaacaaatctccgaggcaacagaagaagactcaagcagtttccccatcgtgtggattgggctgggtgtcattggcttaggcataatcattggtttgatctttgcgctgagaagaaagaat

SEQ ID NO: 1139 - DNA, 285 bp, Corynebacterium glutamicum
atggtcgcttgggtgccttgcgcttttcgacgcaaaaccacagccacgatggccaacactagtccgagggacgtcatcaaaccgccaactaatccggctgatgtgagtccaagggaagtggtgatggttgcaccagcaagccaggcagcaacagcatttccaaggttgaacactccgatgttgatggaggaggccatgccaactaatgaggcctcactgcaagcagtgctggatcaattgcgcaatgaaccggagttagcgccgttcattgaggtgatggaaaac

SEQ ID NO: 1140 - DNA, 225 bp, Corynebacterium glutamicum
atggcctcctccatcaacatcggagtgttcaaccttggaaatgctgttgctgcctggcttgctggtgcaaccatcaccacttcccttggactcacatcagccggattagttggcggtttgatgacgtccctcggactagtgttggccatcgtggctgtggttttgcgtcgaaaagcgcaaggcacccaagcgaccatcagcgttgtggagcaccagcccgcccaa

SEQ ID NO: 1141 - DNA, 243 bp, Corynebacterium glutamicum
atgaccaatccagatatcgtcggttccggccaaggcaacgattccttcgagccagtcgcccaattatcctacgagcgtgcacgcgatgaactcgttgaaattgtaaaaattttggagctcggccaaatgggcctcgacgaatccctcaaatactgggagcgcggcgaagccctagcaaagcgctgcgaagagcacctggccggcgcctcagcgcgcgtcgagcaagcattaaaccaggcagaa

SEQ ID NO: 1142 - DNA, 1251 bp, Corynebacterium glutamicum
gtgtcgtctgagaaagcttcatcaaaatcaacccctgaggcaccgtggccagtccgggaagtaaatactcaagtcaagcagtggattgaacggcttggccatttgtgggtggagggccagctcgctcagattaatgtgaagcccaattggaagctgtcgtatttgacgcttcgtgatgtggagcaagaaatgtctgtgcagctgacctgcccgacggacattatccgcaatcgccccacaccgctcaaggatggcgaccgcgtgattgtgtacggcaagcccgcgttttatgcaggccgcggcactttttcgctgtgggtgactgatatccgtcccgtgggtattggtgagttgctggcgcgcattgaggagctgcgtaaaaggcttgccgcggagggtctttttgatccagctcggaagaagcgactgccatttctgcccaaccgcgttggtttgatcacgggacgtggttcagcggctgagcgcgatgtgctgagcgtggctaaggatcgctggccggaagtgcagtttgaggtgatcaacacggcagttcagggcgcttcagctgttcctgaaatcatcgaagcgttgcgggttttagatcaggaccctcgcgtggatgtcatcatcattgcccgcggcggcggttctgtggaggatctgctccccttctctgaggaggccttgcagcgcgcagtcgcggcagcgcagacgcccgtggtgtccgcgattggccacgaaccagatacgccggtgttggacaatgtcgccgaccttcgcgcggcgaccccgaccgatgcagcaaagcgcgtggtgcctgatgtggcagaagaacgcatgttgatcaatcagcttcgcagtcgtagtgccgcggcgttgcgcggttgggtgcagcgcgagcagcaggcgttggcagcgattcgcaccaggccggtgctggctgatccgatgaccccgattaaccgccgacgtgatgagattgcccaggctgtgggcttgattaggcgcgatgtcacccatctcgtccgcaccgagcaagcactggtggcgtcgttgcgcgcacaggtttccgcgctcggcccgtccgcaaccttggcgcgcggttattccgtggtgcaggttattcctcgcgacggcagcgccccggaagtggtcaccaccatcgagcaatcaccgcccggcagccagctgcgcatccgcgttgccgacggctccatcactgcggcatccatgggcacccagcaagcaaac

SEQ ID NO: 1143 - DNA, 975 bp, Corynebacterium glutamicum
atgagctcacctgttatcagccccgaaaccaaaaccggaaagaagatcctgcttgcagcccctcgcggatactgtgccggcgtagaccgtgcagtggaaaccgtcgagcgcgcgctcgaggaatacggcgccccaatttatgtccgtaaagaaatcgtgcacaaccgttacgttgtggacaccctggcagaaaagggcgcgatttttgtcaacgaagcatctgaagcaccagaaggtgccaacatggtgttctctgcacacggcgtgagcccaatggtccacgaagaagctgcagctaaaaacatcaaggctattgacgcggcctgcccgctggtcaccaaagtgcacaaggaagtccagcgctttgataagcagggattccacattctcttcatcggtcacgaaggccatgaagaagtagagggcaccatgggtcattccgttgagaaaacccacctggttgacggcgttgctggcattgccaccctgcctgaattcttaaacgatgaaccaaacctgatctggctgtctcagaccacgctttctgtggacgagaccatggagatcgtccgcgagctgaaggtgaagttccctcagctgcaggatccaccgtcagatgatatttgctacgccacgcagaaccgccaggttgccgtcaaggctatcgctgagcgctgcgagctgatgattgtggtcggttcccgcaactcctccaactcggttcgtctggttgaggtcgctaagcaaaacggtgccgataacgcctacctggtggattacgcccgcgaaatcgacccagcatggttcgaaggcgtagagaccatcggtatctcctccggcgcttccgtgcctgagatcctcgtccagggcgtcattgagcgcctggctgagttcggctacgacgacgtcgaggaagtcacctccgccgctgagaagattgttttcgcgctgcctcgcgtgctgcgccacaagaat

SEQ ID NO: 1144 - DNA, 429 bp, Corynebacterium glutamicum
atgacccatggtgccctctacttcttcatggccttcgtgaccgatgaagagaatgtggaatccctgcttatcaaagcgctggacttccttgtgcactttggtgaccagcgggcaggccgcgtcaatagccttgatgtttttagctgcagcttcttcgtggaccattgggctcacgccgtgtgcagagaacaccatgttggcaccttctggtgcttcagatgcttcgttgacaaaaatcgcgcccttttctgccagggtgtccacaacgtaacggttgtgcacgatttctttacggacataaattggggcgccgtattcctcgagcgcgcgctcgacggtttccactgcacggtctacgccggcacagtatccgcgaggggctgcaagcaggatcttctttccggttttggtttcggggctgataacagg

SEQ ID NO: 1145 - DNA, 828 bp, Corynebacterium glutamicum
gtgtcacatggatcagcatcgtcgaggagaagctctaggccgccccagcagaccgcttttgtcggtttgccaacgtggtctggaccttcagttgttttggcatccctcattacgggaatgctcgtcagcctgatgttaggcgtgatcgggctgccctatcagctgattttcatcatcgctactctcggtgtgaccttgctggttgaggcccgcggattattcttgacggttgcgtccattcccattctgtttggtattttcacaccactgacttcgtggtttgtgtcccaacaaggcgtggctgcgaatgtgtcccctggtgtttccgtcacggaaatcctcacggctgtttatcctttggcgcagttgttccccaccctgatcatggtcactttggtggcggcattgatcgctgtggtgcggattattctgctgcgcaggaaccaggaatctcgtcaggtttctggggaacttacccggcgcgcgcagcgtgaggctgaggaagctaatcagaatgctgctcgtcgtgctcgcgcacagagcacgagggtacaaagttctaaaacacgtaaccgtcgcgcgcaaccaaccggcgataccggttcacaagtcacggttgatgagttgatcaggcgtagccaggagcgccggcaaactgttgcgcagcgccaaactgagcgcggtgtgccgtttactccaactccgggtcctgtggtggcccccaagccgcgcccgagcgcccctgaggcgccggctcctacggatgtgggtgagcgtcgacaagcagcccctaaacgccgcacctcgctcgacgatgatctgtacagc

SEQ ID NO: 1146 - DNA, 1320 bp, Corynebacterium glutamicum
gtggtcataggtgattacttcaagagggtgtccatgtggagtttgcggttggtgttcgtcgccgccgctgtctttattttatggtgggtcattggtcggttctggcagggcgttttgccggtcaccttggcaatcatcatctgtactgtgctgtcctcaccaaactcatggttgcggaagcatggagttcccagtgtggtgtcggcgtttatcaccatcggcacgttttttgccgtcgtgggtgctattttgtggttaattgcgccgagtatcgcccaacaatcccaggtgttgtacttccaggcatttgagggcattttgagcattcagctctggctgcagggtccaccgttgaacttggattcgggtgatttgagccgctacttcaacgaggccgccgcgtggctgcaaaaccaggcaggtgccattgctggagaaatcttctcgggcctgggcgctgcaaccagtgtgatcgtgacgcttggtgtggtgttggtgctcacattcttcttcctcaaagacgggcaccggttcctcccgtggaccaggaagattggtggaaagcaagctggctggcacgtcaccgagctgctcacccgtgcgtggaccaccttgtctggattcgtccgtgcgcaggcactggtctctgcggttgatgctgtgttcattggcatcggtctacttattgtgggcgttcccatggcgttggcgctgtcggtgattacctttgttgctggtttcattcccatcattggtgcgttcaccgcaggtgcgttggcagtgctcgtggcattagtctcgctgggctttaccgaagcggtcatcgtgctggttatcgtcgtggcagtgcagcagctggagggcaatattttgtcaccactgttgcagtcaaaggctatgaatttgcaccctgtcatcgtgttgctgtcggtaactgtcggtggcacgctcttcggcattgtcggtgcattcttggcagtaccagtggctgcgatgattgctgtattcttccgctatttccaggacatgacttcactacgtgctggcgagaaggtggcttctgatctgaagtttgaaagcgaatacggcgagttcgctggccgtgccatggaagccgatggtgaaatcttccgcaggcgctactaccaagacttgcttggtggcgacgctgagaccaacgaactgaaaattcctgagtttttaggtgaggatcgtgaatcggtagatcctaatgaggttcgtcgtaaagaattgaaacgacggtttacctcggcaaggacggcaacttcgcaagcattcgataaaatacgcaagagaaac

SEQ ID NO: 1147 - DNA, 180 bp, Corynebacterium glutamicum
atgggaactactgcaatcatcatgatggtgttgttcatggtcatcatttggggtggcctggtttatgccaccatcgcacttcgacgcgaaccagatgagaaggttggactgtttggaacctctccatatgccaccgactctgttcttattgagcaagagtctgaacgacctgcaacggcc

SEQ ID NO: 1148 - DNA, 1737 bp, Corynebacterium glutamicum
ttggggaattcttattggtcctttgtgcatgactggagactcgttaagatgtcagctccacaacatacgcctccgacgtcccctcagaagggcgaacgccgcgaagttttctcatcccgttctgtctttattctcgccgctattggttctgcggttggtttgggcaatatttggcgcttcccttatgtcgcttatgacaatggtggcggtgccttccttattccttatgcgatcgcgttgctcaccgcgggtattccgctgttgtttctcgatttcgcgatcggtcaccgctataggggttcggcgcctcttgctttccgacgtttcaagaaacaaaccgaaaccatcggctggattcaggtcggaatcgctttcttcattaccatttattacgccgcgatcattggctgggctgggctttatgctttcaagtccttgaataaggcgtggggtgctgatcctgacacctatttcttctctgacttcttgaactttgattctgaagcagttgtgtccatggatatcgttccgcagatcgccattgcactgtttattgtgtggatcgccgctattgtggttcttgcgatcggtgtggataagggcattggtcgtgtgagcatggtgttcatgccgttgctggtgatcatcttcctcattgtggttatccaagcggtcctgcttcctggtgctgaaattggtttggatgcgctgtttactcctaactgggaagctctgaagaacccgaccgtgtggatcgctgcttacggccagatcttcttttcactgtctgtgggattcggcatcatgcttacctactcctcgtacctgaagcctcgcaccaacctcaccagcactggtttggttactggttttgcgaactcctctttcgaggtgctggccggtatcggtgttttcgcagcgctgggcttcatggctgcaaatgctggcgttggtgtggatgaagtcgcgacctccggcattggccttgccttcgttgctttccctgcgatcatcaacgaaatgcctctgggcggactgttcggattcctcttcttcagctcattgaccatcgcgggctttacttccctgttctctctgttggaagtggttgtttccgcagtgaaggataagttcggtctgaatcgtaaagccactgcgattggcgtgggcgttgtcatggctctgctgtccctgggtctgttctccaccacctctggtctggcaacgctggacatcatggacaagttcaccaacaacatcggcattgttgccgttgcgttgatcgcagtggtttccatcgactgggtcctgcgtcgcatcgatgaattctccacccacctcaacgcgatctccgcattcaaggtgaacaccatttggcgcatctccgttgtcaacatcaccaccttggttctgggctccacccttgctcttgagctcacctccctgatcaatgagccttacggcggttataccgtgctgcaaaatggcctctttggctggggcgtgctggctgtcatcctggtggctgcattccttttgcccatggtttcttggccaaagggcacgcttgtcgacggcccacccggctccgacttcggcgttctgccggagttcaagcgtacgctgcaccgcccgcgtcgctgggcgtccaatgacccgatcagtccttttgatgccaatgaggatgcatcacgcttccctaccgtggcaatcaccaatcctgaagctaaggagtcc

SEQ ID NO: 1149 - DNA, 1233 bp, Corynebacterium glutamicum
ttgaagctcttcatatcccgcgcactcatcgccggtactgtttctttgactcttttctcttcaccgctcgcttccgcacagagctcgggactcagttcagtactaagttccgaagacagctcagcaactaattcagagcaggactttgagaaaagctccgaatccggatcttccgcccaggatttcatcgcgctttctactgccaacccagatctcactggcggttctgttgaaggcttgctgagttcgatgtcgctgattggttcgtcccagttgcctcttggaggcccgctcttgagtagtgattccaactatccgctcgagacagacccctcgattactgaggcaagaatcgtcgaaaagcgtgttttaaatggtcttcgactggaaaaatggtctgttgcgtcgccttcgatgcagcgcaatgtggatgtgcagatcatgaagtccgcggaggcggactcccctgctccgatgctgtacatgcttgatggaatcggcggaaataagaattcttctggttggatcaatggtggcgagggtccgaaggttttcgcggatgaaaatgtgactgtagtaatgccgttgggtgctgcttcatccatgtactcggattggttggaagaggaccctgcgctagggcgcatcaagtgggaaacttttatcgtcgaggagctcgcgcccctgcttgaggctgaggaagagctgaacttcaatggtcaccgtggcatcggcggattatccatgggtgctactggtgcggttcatttagctaactcgaaccctgatctctttgatggagtcattggcatctctggttgctactccacgcttgatcccattggacaaaccacggtgtcactaattgttaattctcgcggtggcaatgtagaaaatatgtggggtcccactggttctgaaacttggaaagctcacgatgtcacatcaaatcctgaggggctgcgcgacatggctgtctatttgtcagctgcgaacggagttgtagatgacatcgatttggcggattccgagaaagagcctttctacaatttgctggctggcgtagtgcttgagcgtggttcgctgagctgcacagaggcattggatgagtcgatgagcagggccggcatgaaccatcaagtggtggactacaaagattccggaacgcacaattggcgcaactttaatccacagttacagcctggctgggatgcgatcaagcacgctctttac

SEQ ID NO: 1150 - DNA, 1083 bp, Corynebacterium glutamicum
gtgacccttactcttggaatcgtcggcctgcccaacgttggcaagtccaccctgttcaacgccctgactcgcaatgacgtgctcgcagcgaactacccgttcgccaccatcgagccaaacgtgggccttgtcgagcttccagacgctcgccttgaacgcctttctgaaatcttcggctctgagcgcatcctgccagcaaccgtgtctttcgttgacatcgccggaatcgttaagggagcttccgaaggcgaaggaatgggcaacgctttccttgccaacatccgcgaagcagacgctatctgtcaggttgtgcgcgcattcgctgacgaaaacgtcattcacgtcgatggtgaagttaacccagcaaccgatatctctgtgatcaacaccgagctgatcctcgccgacctgcagaccgtggaaaaagcactcccacgcctcgaaaaggatgcacgcaaagacaagggacttggcgaagtcgtagatgagaccaaaaaagcccttgcgatcttgagcgatgaccgcaccttgttctctgcagcaaaagctggcgacattgatctggccctcctgcgcgatctccacctgatgacagcaaagcctttcctctacgtcttcaactccgacgaaaaagtgctcaccgacgacgccaagaaggacgaactccgcgcactagtcgcgccagcagactgcgtattccttgacgcacaaactgaaaccgaacttcttgaactcgaagaagacgaagcagcagaactcctcgaagctgtaggccaaacggaaccaggcctacactccctcgcacgtgcaggatttgaaaccctcggactacagacctacctcaccgcgggtcctaaggaatcacgcgcctggaccatccacaagggcgacaccgctccacaggcagcaggcgttatccattctgacttcgaacgcggcttcatcaaggctgaaatcgtctccttcgaagatcttgacgctgctggttccatggcggaagccaaggcccagggcaaagtccgccaagaaggtaaggactacgtgatggtcgatggcgacgttgtggagttccggtttaacgtc

SEQ ID NO: 1151 - DNA, 297 bp, Corynebacterium glutamicum
atggctcagaagctctacccgccgattcaccctggtgagattctcatggaggacttcatcaagggcttcggcctcacacagaacaaggtcgccgtatcgatcggggtgcctccgcgacgcatcaacgagatcgtgcacggcaagcgatccatcacggccgatacggctctgcgtctcgggcggtacttcggtatcgacccgcagttctggctgagccttcagactcagtacgagttggagctcgatcgcgacgccggtgcagcgacttacgcacagatcacgccgctgaaggtcgcg

SEQ ID NO: 1152 - DNA, 822 bp, Corynebacterium glutamicum
gtggccagaaaacatctgctctccctggcagactggaacagaggcgagcttgaggcattattcgagctcgcggagcagtatgaagctggcggtgggccacgattcgatggtgccgcggcgatgttcttcccgccgacgagtttgcgtacacggctctcattcgagcgtggggcaacggcaatgggactccagccgatcacgttcccgtcagacagcctggacaaggacgaagatctcgtcgacgtcgtcggctatctctcgcagtgggctgatgtcgttgtcgtccgacacccgcaattgacggcgcttcagcggttggcgtcagcggatgcagcgcccgtgatcaacgcgatgacgagtgagaaccatccgtgcgaagtcctctcggacttgtatgcgctgtctcgtcaccatgacatttcggccctgcggtacctgtttgtcggtggcgatggcaacatcgccagggcctggtgggaggcggcccaagcgttcggcctcgagatgcggcagagttgtcctgaagagctgcgtgtcgtcgggatgccgtgggaggagaacctgccgcatgcaattgcatcagcggatgtcgtgctgacggatgggccaggtagacatgcggagttactcgagccgtatcgtgtgaccgctgcgttgttggatcgcgcgccccgtggagtgcggctcgcgccctgcccgccgttcatccgcgggcgcgaagtgagcgccgatgcgatcgagcatccggcgttcgtcgggtactcgttcaagcgtcatctcatgccggttcagcaggcgattctggctcggtcgatcaatgcg

SEQ ID NO: 1153 - DNA, 501 bp, Corynebacterium glutamicum
gtgactccgccaaatacccaacgccgccgcttccgccgcaagcggcctgctgacatcgatctcatggccgacatgctcggggatcctgaagtgatgcgtttctacccctccgcgaaaacacgcgagcaggcagccaggtggatcacttggaatgaagagaactacgcggagcacggctacggcctatggatcgtcgagacgatccacggcgagttcgttggcgactgcggcctcacgtggcaagaggtgaatggcgcacccaagctcgaggtcggctaccacgtcgtcaccgcaaggcagggcctcggttacgcgaccgaagccgccattgcatgccgcgactacgcacgcgacgttgtaggctcacccgagttggtcgccatcatccaccccgagaacgaagcttcggaacgcgtcgcccgaaagctcggtatgcatcgactggcagacgaccatggcggaaacattcccgtccggacggttctcgggatgacgtttgag

SEQ ID NO: 1154 - DNA, 630 bp, Corynebacterium glutamicum
gtgctgcccgcaggacagagcgcccccaaaagctcgcttcagacgggatccaccccctcgagatggacgtcaccgatgacaatcgatgaaggccgtcgccagttcgaggtcaatgtattcggcgcgatggccctcacccgactcgtcctgccccacatgcagaaacaaaagtgggggacgatcgtgaacatcacatcgatgggcgggaagatctacacgcctctcggcggctggtatcacggcaccaagttcgccctcgaggccctctcggacgccctccgcctggaggtcgccccattcggcatcgacgttgttgtcatcgaaccgggcggcatcgccaccgagtggggaggaatcgctgccgacaatctcgacgcagtgtcgaaagacagcgcatacaagcgccaggctgacgcagtatcgaagtcgttgcgatctgaggcgaacagcaaccgcaactcaccaccgtcggttgtcgccgatgcgattggaaaggccgtgacggcacgtcaccccaagacccgctatgccatcggcttcggtgccaaaccgctgattgcctcgcgcaacatcctcaccgatcgccagttcgacccagtgatcactcgagcgactggcgtcccccgcgac

SEQ ID NO: 1155 - DNA, 1206 bp, Corynebacterium glutamicum
atggcctatgacttcgtcattggaatggacgtcggcaaatacttccaccacgcctgcgtcctcgatccccagggcagacaagtcctatccaaacgcatcaaccaacacgaaggctcgctacgcaagctcttcgacaaattcctggccaatgacgccgaggtccttgtcgtcgtcgatcagcccaacaacatcggcaggctaaccgtcgcagtcgcccaagcaatgggagccgacgttcgctacctccccgggcttgccatgcgacaactttcacgtatccacgtcggcaactccaagaccgatgtacgggacgcttatgtcatcgcccatgccggcctcaaccttccggatgccctgcgtagcgtcgaccgcgttgaggaagtcttcctccagctgaaagtcctcaacggtatcgacgaagacctcgcccgcgcctacacacgcctgatcaaccagatgcaatccgcgctcgtgggcacctaccccgcattcgaacatgtcctgcgtgggcagatgattcaccgcaagtggattctccaccttctggcgaaatacggtggccccaccaagattcgacgcgtcggcaaagcacggctggcagctttcgcacgtggtcacagggcacgtaatcctgagccagttatcgatgccatgcttgctgcgatccacggccagacggtatccatcgccggcgcagaatacgcggaacttggcgtagcaatgtccgccaaagatgcactagccaagctggagcaccgcaaagagattgaaggccaggtactcgagctgatccaggacattcctcagaccgagattctcttgtccatgcccggcatcggcccacgtagcgccgcgcaaatccttatgaccgtcggcgatatgtccgactttcccgatgcagcgcacctggcgtcctatgcaggcctgtcgccgcagacaaatcagtcgggaacgtcgatcatgtcgaattcgcccaaccgggccggcaacaagaaattgaagaacgccctatggcagtcgtcttttgcatcgatcagattccacgagcgttcccggcaattctatgaacgaaaacgcaacgaaggcaaaagacacaacgccgcagtcgtcgcgctcgcacgccgacgcctcaacgtcctcttcgccatgatgcgcagcggagagctctacagagacatccccacagcccaggaggccgcagcggcc

SEQ ID NO: 1156 - DNA, 3042 bp, Corynebacterium glutamicum
gtgaatacgaccagtcgttggctacttgccaattccagtgaccccttgttgtatcgagacagttcactgctggttgctttgttgcgtcagattgtctttgcgttcgcgtatttgattgctgtaattggctcatactcactggtatacggcgattcgttagtcgcaattgtgtggccatcagtgggaatcgctgtgtggtgggccgtgacctgcagaagctggaaaaacttcgccctgatttgtggatacgtgtttctagtcccagccatatacctgcacttttttgcggaaacctccctcaggggagtgattctggcaggaattgcgcacgctatcgcaggtcctggcgttgcactggttatggcattcatggaaaatgcgcaattgccagaactgttgcgtaaacggcatgcattcgcacccttctcccatattcgccttccaggcgatgtattccggctcctcgtcgcgggcattgtcatggtcgcaatatccaaattgattgtgattcttgcttatgcactggcagatttgccgtattcattcaccctttatctgacgatggcccttcgtgacttgactggcattattgtggttgccgggcccggaattgcactttcgacgccgctggtactaaatattcaccgatcagcatggcgcgagttcgcagttgttatcatagctacggtcggagtgctggcgctcattttcggatttgctgtggatcttccgacggtctacttggcaatgttgccattgtattggagtgcaacccgtcttccagtgcttttagccgttcttcatgcggtgtttacttcagcaatagtcgtaattctgtatttcctattaggtaccggatcttttgcgattacggatgaatccatactggtgcaggcaacgacaattcagctttttgttctgatgtgtatcttgttgtcgctagttgtgtcaacgacagtccagcagacatcagcactggttgaagagctagaggtggtagcgaagacccttcctgatgcgctttttatcgtaaacaaaaatggaacagcatttcctgttaacgcaggcgcgaaaaatttcgtcaagcaatcaccggatgggcattattccatgccgaaactacagaatatagacggtgaacccatggatgagaaagaaagtccgagcagtatggccttgcgtggacaaggtgtcgaaggagtattagccaagttaggtgaagtactgggagaagatccggacttggcgcgtcgaatcttcgaaattagtgcctcaccgatgtatctgcgtggagaaactgaaccgggtcatgcgctcgtgatttggcatgacagtactaatgagtattacacgatgcaacaattgacgcttgcatatgaagaatcgcggctgctatttgaaaaagcccctcaagggattgccatgctggacccttcgggagaaatcgtaatggcgaatcgatcctttggtgacttggtgggaacgactcctgttcgactcctaggacgaaatctagaggatttcggagtagaggagggaaccatggaatacgtgacccctgttctgtcggacccagaagccgttgtgcacttagatcgttcgctcgaaacattgagaggtaaacagaaaaacgttgctatgtcatttagctcgatgggcaatgttggaggcagaatcggaactttactcgttaatgttgtcgatgtaaccgagcgccaagaactcatcgagcttgtggagcatttggcggatcatgactccctgacaggattggtcaatcgcaggcggctggaatctgatatcgaagagcttatcctcaagaatgaacgcgattcgaccgatagtgcattgttgcttttggatctggattacttcaaggaagttaatgattccctcggccatgaggctggtgaccagttgcttattgagtttgctgagatcctcaaagacagcgtgagggattccgacattgtcggacgcatcggcggcgatgaattcgttattgttttgcctgacacagacagggatggcgctgaagcaatcggtataagaattattgagttggtcaatcagcacttcaaaggccgaggaaaagtgttatcgcgggtgtcagtaagtatcggcgggacgctcttttctgatgctcgtgcccaaggtgtgaatccattcattcttgctgatcagctgctttacgatgctaagcacgcaggtagaaatcgggttgcggtgcgcagagctgaaaacaccattgtccgctcagctaagcccgcattctcagttgaggaactttcggagatcctggagtcacattctattcgcctcgagctgcagccgatcctagaacttgaaacaggtcgggtgggtgcagccgaaggtctgctccgaatcaacttggatggcaccgatgttcctacggggcagtttgttcagtcggttgaacaggccgggctagccccgaagcttgatatcgcagtcatgagagaaggaattaatcatattgagaggctgagagctgtgtgtccgactttcagcctcgctttgaatctgtcgggctattctctgagctcggcgaaaatacgggaggaactaagagccgaatttagagctcgcgatctgccaaggggatcaattaggtttgagattactgagaccgctccgattgaagacattgacgcggcaaaagagtttgtgcagatgttgaaagattttggcttccacatcgtaatcgatgactttggcgcaggacatgagccttatcaatatctaaagaagttcgactttagcgtgctgaagattgcaggtgaattcatagaaggtatggtcaccaaccgcgtggaccgaagcatcgtcgaatctattgctcaacttgctaaggatgaggagatggaaactgtcgccgagtttgtttcaagcaaggagattttggaggcggtacgagagataggcgtaacgtacgcccagggtttccatattggtaaatctaagccgattgatgaatttatagctacttatctcgagacgaaccaaaccgctacctggggg

SEQ ID NO: 1157 - DNA, 765 bp, Corynebacterium glutamicum
ttgttctacggtgagtcaggctccggatggcttggccaatatcagcgcaacgaatacacccgttatagccgtgacatctatcgacgccgcggacgtgtgtttgttttgactggaacagcgtcggcttttcggccacgcggcctgcggacagtagcggaatcacgcgggacattgatccccggacgtaaaggcgatgtttatgacaccgcggcgttgaccgaagataatgagttgaccctggctttgaaatcactcggagggcttatggtgtcacccaatgagtgctcagtagtgacagaagtgatgccgacttggagagaattatggcatcaaaggcttcgatggcaacgcggtgcgctggaaaacctcggtgcttatggcatcacaccacaaacgacacggtattggttccagcagctgggaatcggttacggcgcattagccttggtcgcctatttcgcagtcattatcattacgtttctcgcccgcgatcaatggatctggtatccattctggatgctgctgggactgttgttcatgattgaacgcgtgctaacggtgtggagatccacatggtttgccaggtttgttgctgcgttattaatcccagagctcatctacgccagctatctcaacctggtatttctcaaaggcgttgtggatattctattggccaagcaagctcactggggtgagcatggtgacaagacaatgcaggtagccgatgcagctgccgaaattaacgatgaaggggaggaacgccga

SEQ ID NO: 1158 - DNA, 219 bp, Corynebacterium glutamicum
atgatcttttcagaagagattctccataccgactggttcgcagcacttgctgctttcgtcgcgattaacacaacaatctatgtggttcttgctattgccaagacgctgccgaagatttatgtcactgactacttaccgcggaattatgagcgtgctgagacacgcagcatttatccagacgttgaagaaccgaaaaggaagaagtctgagaagaaggat

SEQ ID NO: 1159 - DNA, 333 bp, Corynebacterium glutamicum
atggctacttcggcactgaaatttttgctgcttgggtttggcgcgattggtcgccaacttgttacgctcttcgacgagggagagtttggagtcgaggcgtttacccgtgctgtctccccacacattgcgcatgggactttgggaattgagctgtatgacgaccaactgcccaagctcatcgcagacagcggcagtgtggtcgaagtagcacacggcaaggatctcgttctgacgtcggtgggcgcgctagctgagcaggtcgtgcgacaagcgctacttgtaggttccgggaaagtgcacgtgacttcgggcgcaatcgggctcttccggttt

SEQ ID NO: 1160 - DNA, 291 bp, Corynebacterium glutamicum
atggccgataaacgccgcgcaaagaccatgatgcgcgagattgttgaccagatgcggctactgaaaggacaagcgaatcgagaacttgcacaactaggccgcagcctacacaaacgcctcggtgacatcctggcgtatttcgatgtcggaatctctaacggacccgtagaagcaatcaacggacgactcgaacacctccgcggaatcgccctaggatttcgcaacctcaaccactacatcctgcactgtctcatccactccggacaactcacccacaaaatcaacgcactc

SEQ ID NO: 1161 - DNA, 375 bp, Corynebacterium glutamicum
ttgcttgatgtagtcgaaggccgcagtgctgatgcgttgcgggcgtggcttgcacgccgaagcccagcatttcgacaccaagtacgcattgtaactatggatggattccaaggctatgccacaaccagcaaacaacttctgcccgccgcacgccgagtcatggatcctttccacgtggtactcctcgccggcgataaactcacccgatgccgacaacgtttgcagcaggaaaaataccaccggcggggtttgcatgatgacccgttgtataagaaccggaaaaccttgctgaccacgcaaaaatggttgagtaagaaaaagcaaagcgtcttgatgagttgtttagctttgataaagactacgcggcactgcaac

SEQ ID NO: 1162 - DNA, 144 bp, Corynebacterium glutamicum
atgagtatcgcagcaaccgcgaaagccctcggtctaggctgggatctcacctgccaactagccctagatatgtgccacgaactcatctactacgaccccacccacctagaaattgtgcacgttattggcgtcgatgagcacaaa

SEQ ID NO: 1163 - DNA, 141 bp, Corynebacterium glutamicum
atgttcgtcgatgaacatgaccaagcaatgcttgatgccagaaatccaaatatcctctacgaacgcaatggtcacacagttttcaaactcgaaatcgccttattcgacaacatcgattgtaacgcctcgacatcgaccgta

SEQ ID NO: 1164 - DNA, 366 bp, Corynebacterium glutamicum
atggctttccccgtgacagaagacaaaatcctggcagctgaggaaacccttggcaggcgcctccccgaaactttgcgcgaacgactacttcaaaacaatggtggcgaagtcatcgacaatgaaaacaacgactggattctccatccagttcgtgatgacagcgaccgaaaaaggcttgtccgaactgccaacgacatcatccgcgagaccgaatctgcacgtgaatgggacaatttccccgaaaatgcgatcgcaattgcaaatgacggaacgggcgacttaataattctgcttcccgacgatgatgctttctacatctggtcgcacgaagatgaacccctgatcgaaactgaacttgaggatgcc

SEQ ID NO: 1165 - DNA, 498 bp, Corynebacterium glutamicum
gtggcgtcgccagagaatattctcttgtatcttcccgaaaaggaagaacagcaggtgcgggaggtgtttgctggtctggaggagcaagggtttcccgtccagaatcaaaaaccacacatcactattactttttctccctcgatgccagacgatgttgtgcagcgagcctcggagctgcttccacctgtgatgccagccagattcgcgcgcgttggaacagtggtatttggaaccaagcgaaaacaaaccgtggcgtggctgttggaaacatctgaagaactagaggaagttgcgaggaatattagcgcacttaatccgaacgggcgtgggcaacgttgggttcctcacttaactatggggttgcggcttccgagggagattgttcccgattacattcgagccttggatgaggtgacgtcgccgcatttcaaagagttcaccgcaacaacggctgcatattggcgacctaaaattcatcacctcaccgtttttaaggct

SEQ ID NO: 1166 - DNA, 843 bp, Corynebacterium glutamicum
gtgaatatccatttatgctgctgtagtcggctatgtggacgcatggtggcaacctctcagtttatcgatgacagcgaggctgcccaggcggtacgcgcagctattgttgcaggataccgaaacattgatactgccctagcgtatggaaacgagcgcggcgttggcgaaggcattcgcaccgctggagtgccccgcgaggagctctttatttccaccaagctagctgcagaaatcaaagattacgatggagcagtcgccgcgattgatgagtctttggcgaaaattggcttggattatgtcgatctgatgctcattcactccccacaaccatggagtgatttccgtggtggggactattcagagggaaaccgtgaagcgtggcgcgcgctggaagatgcctacaaagccggaaagattcgatccattggtgtctcgaacttcctggaggccgatctggagaatatcttagactccgcgacggttgctcctcacgttaatcagcttcttgtgcatgttggaaacaccccaagcgagttaatcagtttctgcgattccaagggcattctggtcgaagcatattcacccatcgcccacggagagatgctgaagaaccagcaggtcaaggcgattgctgacaagtacaacgtgagcattccgcagctatgcattcggtacacaattcaactgggaacggtgtctttgccaaagactgccaacccagatcatatgagctccaatgcgcagatcgactttgaaatttccgaggaagacatggcggcacttcaagaagtgaccgcccgcgattatggcgagcacagcggttttcctgtgtattccggcaag

SEQ ID NO: 1167 - DNA, 321 bp, Corynebacterium glutamicum
atgggacaaaaagtaaccgcaggtcgtgacatcctaggagagtttgcacctaagtccgctgaactcaacgatgatgtcctctttggccaggtgtggtcgagggaatcagagctttccccacgtgaccgaagcatcgtgatcgtgacaatgttgatggcaagtggcgtgctggatagtgcttttgaaagccacgttcagcgagccaaagacaacggtgtcactgctgaagaaatcgcagagatcatcacccacgtggccttttatgcaggttggccaaaggcttgggctgcgttccgcatcgcaaaggacatttacaccaag

SEQ ID NO: 1168 - DNA, 663 bp, Corynebacterium glutamicum
atgccgtcaatatcatcggtatcgtcagcccgaagtgctgcaaaagttgcggtcaggctttccttgggcaggtccataagtggcagaaagctcgaaggttttgtttcgtgcttttgcatcattcaaactgctaaccaaaactcgcgcgatttgatcacgcgcaatcacgccatcggctgggccacccgactgattggtgtcgccttgaagcatgacgatctgacgctcgtcatcgttgttgtaatcaaaccaaccagggcgaacaatggtgtaaccgtgtccgctagctcgaacaagttgctcgccatgtcgcttccactcggcataagccacacctgggcgggtcgttccaacggcggtcatcagcacaatttttacatcttttcccttgactgccttcaacgtgttggcaacgccggtgtaatcaacatcccgcacatcgcttttacgagtggaggtgccgtgagtgaaaatgattccctcgacgccttttacagctttctcaatcgaggaaggatcaagcaggtctcctacgataatctctgcctcagctggaagcacccgtgcacgggacttgctacggacaaatgccttaacttggtatccctggttaagtgcttccgagacaacatgtcggcctatgcttcctgttgctcctatgac

SEQ ID NO: 1169 - DNA, 195 bp, Corynebacterium glutamicum
atgatgcaaaagcacgaaacaaaaccttcgagctttctgccacttatggacctgcccaaggaaagcctgaccgcaacttttgcagcacttcgggctgacgataccgatgatattgacggcatcctcgattccaatatcgttcctgtggaatccactgccccactattccaaacagatctagccagcgtttctgcc

SEQ ID NO: 1170 - DNA, 654 bp, Corynebacterium glutamicum
atgagtgagacagttttagtcataggagcaacaggaagcataggccgacatgttgtctcggaagcacttaaccagggataccaagttaaggcatttgtccgtagcaagtcccgtgcacgggtgcttccagctgaggcagagattatcgtaggagacctgcttgatccttcctcgattgagaaagctgtaaaaggcgtcgagggaatcattttcactcacggcacctccactcgtaaaagcgatgtgcgggatgttgattacaccggcgttgccaacacgttgaaggcagtcaagggaaaagatgtaaaaattgtgctgatgaccgccgttggaacgacccgcccaggtgtggcttatgccgagtggaagcgacatggcgagcaacttgttcgagctagcggacacggttacaccattgttcgccctggttggtttgattacaacaacgatgacgagcgtcagatcgtcatgcttcaaggcgacaccaatcagtcgggtggcccagccgatggcgtgattgcgcgtgatcaaatcgcgcgagttttggttagcagtttgaatgatgcaaaagcacgaaacaaaaccttcgagctttctgccacttatggacctgcccaaggaaagcctgaccgcaacttttgcagcacttcgggc

SEQ ID NO: 1171 - DNA, 1737 bp, Corynebacterium glutamicum
atgagtattaagtgggcgcgctttgtaccggggataaccgcgatgcggggctatcaacgatcctggttgaagggtgatgtcatcgcgggtataaccgtggccgcgtacttggttccacaagtcatggcttatgccgtcattgcggggctgccagctgtcgttggtctgtggggagttctggctcccatggcgctgtactttttcttgggcacgtctcgaaatctctcggttggtcctgaatcaaccaccgctctgatgacggctgcaggtgtgggagctttagtcggggcagctggcgggcctgaacgatacgcagaagtagcggcactattggctattgcagtgggcattgtatgcgctgttggttttattggccgattgggatttcttaccaggctgttgtctcgaccggtgctcgttggatatttgatcggtattgcagtcttgatgatcgtcagtcagctgtccaaagtcacccaggtgaatgtggagagcggtcagacgtggcaggaaataatatcgtttatcaaagtagctggccaggcacatattcctacagtgattttggcagtcgtggtgttgagcttgctgtatctggcaaattggttgacgcctaaatttcccagcacactcatggttcttctgctttcggcagccgcggtggggttttttcatctggataggtttggtcttgaggtcattggtgaggtgccccgtggcctgcctcaaccaagtattccctcgattggcgatctagagatctggtcgttgttgccctatgccgtgggtattgccatcgttggtttttcagacaatgtgttgactgctcgtgcattcgcgtcgggaaaagatgaggtgattgattccaaccaggagctgctcgcactgggaaccgcaaacctggcgaatgggttcttccagggatttcctgtgtcatcgagtggctcccgaactgttcttggagacacggcaggtgctcgcactcaggtgcattcacttgtcgtggtggcgctggtgatcatggtgctgttgtttgctggtcctgtgctcgagtctttcccagatgcggcacttggcgccttagttatttatgcagcaacgcagttgattgatatcgcagagatcaaaaggatcgcacgtttccgcaagagcgagttggtcatcacagcggctactgctgcatccgttgtggcttctggcgtgctcgcggggatcggcgttgcggttacgttgtccatcttggatctcatcagacgtattacccgaccttatgccgatgtcctaggatatacgccgggcatggctggaatgcacagcttggaggattatcctgagtcgacagcagtcgaagggctcgtggtttttagatacgattccccactgtttttcgccaacgctgatgatttttccaaacgtgccatcgaagccgttgatgaagcaactcaacccgtgcattggtttttactgaatgctgaagcgaatacggaagttgatctcacggccgtcgatgccatggaagcacttcgcaaaaccctggaggaacggggtatccgatttgcgatggcccgggtgaagcaagatctacgccgaagcctcgagcctgcaggtttcattgaatccgtgggggaggagtacattttcgccacactccccactgcagtcaaggggtattccgtggagtttcgcgatcgttttggaaactatccagaaggcgttccgaaagaaattttggaactt

SEQ ID NO: 1172 - DNA, 597 bp, Corynebacterium glutamicum
atgaggtgcataaacaaaacggtagatcagcaaatcgcactgtttgggcaatcgggaagcggaaaaactgcattattgtgctctttttatggtaccgcacgggaatcctcgcaagaggacgtgaaattattcgagatctctgccgaagatgatcgacacacagaattgatgagactgtatctgggaatgagagatgattcgcttttcccacctgcgaatcgatttgagtcaaaaaatacagtcttttctctgaaacaaaaaggtgttccgattaaagaagcacggaaggcagatcaggtccgggtgacctggaatgattatcctggcgagtggttcgagggaggggccacgacggaatcagaaaaacaggacaagatcaatacttttagaaacctgttgggttcagacgtagcactctttttggttgatgggcaaaggcttcatgactatgccgatgatgaggagcgctatcttacgtacctttttgatagcttcactgaatccttgagccaaatcaaagaggcgattttggaggatggtacaccgctccaacagttccctcgcatctgggtgattgctttgtctaaagctgattta

SEQ ID NO: 1173 - DNA, 498 bp, Corynebacterium glutamicum
atgaaatcaatgaactgcgttcaaagctgctcgaatttatcgataatgatgaagccttctcatttggaaaagacttcctacttttatcatcagcgaaattcactcccgggacatactgatctcagccagcgcaagggcgtcgatgtgctcctacctctggcttgtgttctgccgatccagcaccagctctggtggcaggagctgagagttttgccaattaacttggcgaacagacttgttggaaatgaatttgtcaagaatggcatgaagatcatcttcaaaatggctagtaacaagttcatcgacaacaaaaaggggctggctatgctagtttttgccgaacttgtgatggaaatgcttgatcagcctgaagaacaacttcataatgtgcgtggagtggctattgagaagcgggagttcctcaaagctctcaccgctgatttcaccagcagacttaaacaagctcaaaccgataagattcttgtttgggatttcgca

SEQ ID NO: 1174 - DNA, 345 bp, Corynebacterium glutamicum
ttgggatttcgcatgactattatgtgggcgacccgtggaaaaaattggggtttccgattcctcgccgacggtgccgaaagtgatccacttcctacctatacgaaagcttttgaaaatcgggagtgggaaagagaatttattcggacgagtccagaattcacagctgctcgcattgacgacccgctcgatcgcaccgacaacgtcggtcggaccataccgcatgattttgttcttcgtgggcagtttgcggagggtatcaacacactagaggatgtccgcgagatcatttggccactagtcgcgcaacagtatgaagacatatgggatcaaccaattaactctgat

SEQ ID NO: 1175 - DNA, 153 bp, Corynebacterium glutamicum
ttgccaggtttaaccgttgattgggacactttgttagacccctatgattctgagcagagtgttgttgtgtggactggtaagccaggcagcaatacccacaaatcactcatggttcttgctggcctggctaaggcgaaaacgtccaatgctcag

SEQ ID NO: 1176 - DNA, 639 bp, Corynebacterium glutamicum
atggcctgggggctgagcttcaatgagccatcggggttgcggcgaagaaggccgctgtcgcggagcgcgcgctccagtttggccaaagtttcggcagagacagcggcgtcatcgccgagttggcggcgaatcgcatcaatgtcgaggtcggtgtgggagttgctcagttgttcagcaaggttgtcgagttcggcgaggtcctgcatggcgccggtgccatcaccaagtcccatgccttcgtcgccggagaattgttcggagccatcccagttgaggtcggggcgcagaccttggaggtttccagccaggtcaccgagcaattcctgcagctctggggatccgaaagcttgggcagatagtttcatgagttcgcggcgttgttcctctgatatggagttgaacatgcgactggctgcggcggaacgggctgcgagggcatcgatgagctcattgatgtcgcgcggctgctcggggaagtgctcgccgtgtttggccataaaattggcgaaatcggtgggagtgtccgttccctcgcggtgtttggagagcaggtcgttgagatcgcgcagcatttcggcgatggctgctttgtcctcgtcggaggcaccttccatggcttgtttcatgccggagaattgc

SEQ ID NO: 1177 - DNA, 1956 bp, Corynebacterium glutamicum
atggccacttcacattcacgaccccgccgcagccgttacggacgctacaccggaggcccagatccgctggcacctccagtggatctcagcgatgccctgcgcgatattgctgatgatgtcatggctggttattcccctgagcaggcactacgtgaatacctgcgcagaggcgcccgaggacaggaaggcctcgatgatctagcctggcgtgcagccgaacgccgccgagaattacttagccgaaacaacctcggtggcacactcgctgaggttcgcaagcttctcgatgaaggcctcaagctggaacgcgctcaactggcccgcgatatcgatatggatgacaccgatcgagcattccgcgaaatgcagatcagcaacctccctgaatccaccgccgctgccgtttccgagctaaattcctacgattggcaatcccaagaagcacgccaaaagtttgaacaaatccgtgacctgcttggccgtgaaatgttagatcagcaattctccggcatgaaacaagccatggaaggtgcctccgacgaggacaaagcagccatcgccgaaatgctgcgcgatctcaacgacctgctctccaaacaccgcgagggaacggacactcccaccgatttcgccaattttatggccaaacacggcgagcacttccccgagcagccgcgcgacatcaatgagctcatcgatgccctcgcagcccgttccgccgcagccagtcgcatgttcaactccatatcagaggaacaacgccgcgaactcatgaaactatctgcccaagctttcggatccccagagctgcaggaattgctcggtgacctggctggaaacctccaaggtctgcgccccgacctcaactgggatggctccgaacaattctccggcgacgaaggcatgggacttggtgatggcaccggcgccatgcaggacctcgccgaactcgacaaccttgctgaacaactgagcaactcccacaccgacctcgacattgatgcgattcgccgccaactcggcgatgacgccgctgtctctgccgaaactttggccaaactggagcgcgcgctccgcgacagcggccttcttcgccgcaaccccgatggctcattgaagctcagcccccaggccatgcgccgtctagggaaagcgcttctcgacgccgccagcgaacaattatcgtcccgcccaggctcgcgagactcccggttggcaggagcaaacggtgaagcgacgggagcatcccgaccttatgttttcggagacacccaaccatgggatgtcacccgcaccatcaccaatgctctgcagcgaacagccggaacagatacggaaggtccgctgcgcatcaacttagatgatgtggaagtcattgaaactgaagcccgcaccctcaacgccgtggcactgctagtagacaccagttattccatggctgccgaaggccgctgggtgcccatgaagcaaacagcgcttgccctccaccacctggtatccacccggtttagaggagatgaactagcactaatcacttttggtcgacatgcccaaaacatggacatcgaggaactgactgcactgccaccggttcacgaacaaggaactaatctccaccacgcattactgctggcagaacggttctttgctcgccatccctccatgaaagcaagcctgctcattgtcacagatggcgaacccacagctcacctcgaagccgatggacacgcctggttcaactggcccactgacccagaaaccatgttcaagaccgtcacccaactagataaagtaaccaagcgaggaacccacaccacactcttccgactgggacatgatcaaggattagagcactttctcaaccaactagccgaccgtgttggcggcaccgtggtggctcccgatctggacggactcggcgccgcagtcgtgggcgagtatttacgacaccgctac

SEQ ID NO: 1178 - DNA, 1296 bp, Corynebacterium glutamicum
ttgcgcgtagaaatccgcgacaacctcctagccaaacttcgcagcggcgaagatccgtggccaggcctgcacggcctgaactacacggtcatcccgcagcttgaacgcgcgctcatcgccggccacgacatcgtgctgctcggcgaacgcggccagggtaaaacccgcctgctccgcacgttaataacgcttctcgacgagtggtccccgatcattcccgggcgcgacgttccagaacaccctcttgcgccaaacgtagagatctccgatgatcagcccattgaatgggtacaccgcgatgcgcgctataccgagaaacttgccaccccagatacttccgtggctgatcttatcggtgatgttgacccaatgcgtgttgctgaaggccgcagcctcggtgatctagaaaccattcactacggtctgattcctcgcgccaaccgtggcatcgtggcgatcaacgagcttcctgacctcgctgaacgcatccaggttgccatgctcaacgtcatggaggaacgtgatgtgcagattcgtggctacaacattcgtttggacttggatgtgctggttgttgcctcagccaaccctgaggattacaccaaccgtggccgaattatcactccgctcaaagaccgcttcggtgcagaaatccgcacccactacccacttgagttggacgatgaagtggcaattatccgccaggaagcagagcttgttgcgcaagtccctgatatcttggttgaaattcttgcccgctacacccgagcgcttcgtgaatcctcatcggtgaatcagcgttctggtgtgtctgctcgtttctccattgcaggtgcagaaactgtggccgcagcagctcttcgacgcgcagcagtgttcggcgaagatgaggccgttgcccgcctggttgatttggaagcagccgtggaagtcctcggcggcaagattgaatttgaatccggcgaagaaggacgcgaatgggaaatccttgattatctcctgcgcaccgcaaccgcagaagcgctgcgttccactctgcgctcgctggatctcaccccgctcatcgcagcattagacggcagcatcaccgtttccactggcacgaacatcaccgcgtcagaatttttggcttcgctccccgaactcggcgaaagcacgctatatgacgacatcgctcaagcttttggtgccaccacaccaagtactcgcgcgatggccattgagcttgctttggaaggtctttacctttcccgaaaaattgccaaggattctggcgaaggtgaaaccatttacggt

SEQ ID NO: 1179 - DNA, 642 bp, Corynebacterium glutamicum
gtggttttactcattcggcatgggcaaaccccaacaactggtcaggttctgcctggtcagacgccgggtttacacctgtctgataagggtgaagagcaggcgcgggaggtggcacagcgtctggcggaggtgccgattaccgctgtgtattcatcgccgatggagcgtgcgcaggaaacagcagcaccgacggtcagcgctcatggcctcgagttgacggtggaacctgggcttattgaatgcgatttcggcgagtggacgggccggaaactaactgagctcaatgccctagaggagtggaaagcggtgcagaagacaccgtctaccttcaggtttccaggtggtgagagtttcgtggaaatgcaggatcggatggtggaggctatcggcaacattgcgcagcagcatccgggagaaatcgttgctgcgtttagtcatgccgacacgatcaaggctgcggtggctcattttgtaggcactccactggattcttttcagcgcattttcatcgacacggcgtcaatttccgcagtggaatttaccgggaaatcttcaggcgtctcctcccatatgctgctgacaaattccagaacaggatcgttgggataccttcgagacaaacttccgaaagctccgcaacca

SEQ ID NO: 1180 - DNA, 705 bp, Corynebacterium glutamicum
atgatcacctcaccatttgagcgcgagctgaagctgctcaacgagggggaactgggtattgtccagcagttggtggaatcaagcaacatcggattcatcgtcgatcttgaattagatggcgattatgggtgggcggtctacaaaccggaattgggggagcaacccctgtgggatttccctcctggcctgtacaaacgtgaacgtgcagcctttgtgatcagtgagtttttgggttggaacatcgtgcctccaacggtgatcatgcacgatgccccggctggtgtgggctcggtgcagtggtttattgaaaacaatggcgaacactattttccactgtttgacacccgcgctgacctgcatccgcagtttgtccgcatggctgtgtttgatctgttgtgcaacaacactgaccggaaagcgggccatgtgttgttagacggcgatcatatttggggcatcgatcacgggttgtgtttttccgtcgaaccgaagctgcgcacggtgatttgggatttcgcaggctgcaccattccagatgacttggtgacagatgttgagcagcttttggaggacgtcccggaagaacttcatcagcttcttcatcccgcagaaattgatgcgctgcagcgccgtgcctcaagaatcagcaggttaccgttccttccgcaggcgaaatcgcatcgtcaattcccttggccacttgtt

SEQ ID NO: 1181 - DNA, 762 bp, Corynebacterium glutamicum
atgtctgacctgaagtcacttgccacgaaatttgctagcgatcatgaatccggaaagctgctggtcctgcctaccgtctgggatacctggagcgcggggctcgtagaagaagcaggatttagtggcctgaccattggtagccacccagtcgcggatgcgacaggaagctccgatggtgaaaacatgaattttgcagattatatggcggtggtcaagaagatcacctcggcggtatccatccccgtaagcgttgatgtggaatccggttatggtctctcgcctgcggatttgatcgcacagattttggaagctggcgcagtgggcatcaatgtggaagatgttgtgcacagcgagggtaagcgtgttcgtgaggcgcaggagcacgctgattacatcgctgcggcacgtcaagctgccgatgtggcaggtgtagatgtggtgatcaacggtcgcacggatgccgtcaaacttggtgcagacgtttttgaagatccgatggtggaggccatcaagcgcatcaagctcatggaacaggcaggcgcgcgttcggtgtaccccgtgggtctgagcaccgccgagcaggttgagcgcctggtggacgctgtgtcagtgccggtcaacatcaccgcgcacccggttgatgggcacggcgcaggcgatctggccaccctcgcaggccttggcgtgcgccgcgtgaccttcggtccgctctggcaaaaatggctggctgccacctcggcgcagcagcttaagggctgggct

SEQ ID NO: 1182 - DNA, 1641 bp, Corynebacterium glutamicum
atgaccgaaacacttgtggtgaatggccttgcaggcggctatgggcaccgcacattatttaacgatgtgaatctcaccgtagctgccggcgatgtcgtgggcgttgtcggcgtcaatggcgctggtaaatccacatttctaaaaattctggcgggcgtggaaaagccactggctggaactatcgcgctttcgccagccgatgcttttgtgggctacttgccacaggaacacacccgcacgtctggagagacgatcgcagtttacattgctcgtcgaaccggctgccaagctgcaacaactgccatggatgacaccgccgaagcgtttggtgcggatccagacaacgctgccttggccgatgcatacgccgaggcgctggatcggtggatggccagtggcgcagccgatttggatgaacgcatccccatcgtgctcgctgatttgggctttgagcttcccacctcgacgctgatggaaggactttcaggcgggcaggcagcccgggtcgggctggcggcgttactgttgtcacgttttgacattgtgcttctcgacgagcccaccaacgatttggatctcgacggtcttgagcaactggagaattttgttcaggggcttcgcgggggagtcgtactggtcagccatgatcgtgagtttctttccaggtgtgtgaccactgtgctggaactcgatctgcaccaaaattcccaccatgtttatggcggtggatatgattcctaccttgaggaacgcgcagtgctacgccagcacgcccgtgaccaatatgaggaatttgcggaaaagaagaaggaccttgtggcacgtgctcgaacgcagcgtgaatggtctagtcacggtgtccgcaatgctattaaacgtgcacctgacaacgacaaacttcggaagaaagccgctgcggaatccagtgaaaagcaggctcaaaaagtccgccagatggaaagccgcatcgctcggttagaagaagttgaagagccacgtaaagaatggaaactgcagttcagcgtcggtaaggcgtcgcggtcaagttctgttgtttccacgttgaatgatgcaagcttcacccaaggcgatttcaccttgggaccagtatccatccaagtaaatgctggcgatcgcattggcatcacaggacccaacggtgctggtaaatccacattgctgcgcggactattgggaaaccaagaacccaccagcggtactgccacgatgggcacgagcgtggcgatcggagaaatcgatcaggcacgagcgttacttgatccacagttgccactgatttctgcgtttgaaaagcatgttccagacttaccgatcagtgaggtgcgcacactgctcgcgaaatttgggctgaatgataatcatgtggaacgggacgtcgaaaagctatctcctggcgagcgcacgcgcgccggacttgcgctgctacaggtgcggggcgtcaacgtgcttgttcttgatgagcccaccaaccaccttgacctggaggccatcgagcaattggagcaagcgttggcctcgtatgatggtgtgttgctgctggtcacgcacgatcgtcgcatgttggacgctgtgcagaccaatcgtcgttggcatgtcgaggctggcgaagttagggagcta

SEQ ID NO: 1183 - DNA, 396 bp, Corynebacterium glutamicum
atgacctccattaaagcaacccgcaccagcccaaacacttacactgtggttaatgatttcggagccgaacttaaagtcagcgcgccgggagttcctgggacgttttccccgggtgaattattgcaggccgctgttgttggctgcgcttctttgtcggcagaggctcagctcgcgcaccagttgggccaggatttcactgcgagcgcgactgtcgaatccacggagaccacagggctgatcactgatctgctgtacacgttgcaagttgatatggcaggcctcgatcagcaggcgcaggacaaacttattgccagcgccgcgaagaaaattgatcgcctgtgttctgtgaagcgatcaattcaccatggcatcaatacggaaacggttatagctccc

SEQ ID NO: 1184 - DNA, 342 bp, Corynebacterium glutamicum
atgtctgatcaattagctccctgccctgagtgcagcagtgaatatacctacgaaaacggcggcgttctggtctgcccaatgtgtgcccacgaatgggtcgaaggtgaagtagcggaagaaaccgcgactgtcatcaaagactctgtgggaaatatcctcaatgatggcgattccgtatcgattgtgaagagcctcaaagtcaagggtggcggtgccatcaagattggcaccaaagtcagcggaattcgtcttcttgaagagccagttgacggccacgacatcgacgctaaggtccctggatttggtcaaatgcgactcaagtccagtgttgtaaagaaggcc

SEQ ID NO: 1185 - DNA, 474 bp, Corynebacterium glutamicum
gtgtctacagatccagaagagttcgaccaagctgaaaccctcgatcaactcgcgtatgagatcatcctgctcacccggtatggtgtccaaaacacaccgaccaacaagcgcgaagccatcatggatcgcagcgccctcatcttgctcacccgccttgacgctcaaggacctatgacagttaatgagctagctgaaagctttggacttaacgtttctaccgtgcaccgccaactcaaagcagccattgccaatggcttaattgaagtcgtcgatgatcaagcatgccccgctaaacttcatcgtccaactgagttgggtaaagaaaaactgcagcaggagcttcttgcccgccagcaggatctcacccgcattcttcatgattgggatgaggaagacattaaaacgcatgccaagctattgcggaagcacaatgaaagcttggaagaatacctcgatatgaagtggccccgcccc

SEQ ID NO: 1186 - DNA, 1218 bp, Corynebacterium glutamicum
gtgtccgtagctgaagaagggaaactttttacaccaacgtttgtcatgggatggtttgccaaccttttccagttcctggtgttctacttcctcatcaccaccatggctttgtacgccatcaaggaatttcaagcctctgaagtagaagctggcttcgcatccagctcaattgttatcggcgcagtcttttccaggtttttctccggctatattattgaccgttttggtcgacgcaagattgtgctcatctcagtcctagtcactaccattgcgtgtgccttgtaccttcccatcgaatcattgccattgctatacgcaaacaggttcctccacggtgttggatacgcttttgctgccaccgcgatcatggcaatggtccaggagctcattccagcgtcacgacgttccgaaggtactggttacctggcattgggcactaccgtttctgcagcacttggaccagccctagcactttttgtcctaggaacatttgattacgacatgctgtttatcgtggtcttggcaacctcggtcatctctttgatcgccgtcgtgttcatgtactttaagaccagcgaccctgagccttctggggaaccagccaagttcagcttcaaatctattatgaacccaaagatcatccccatcggcatctttatcttgcttatttgctttgcttactctggcgtcattgcctacatcaacgcatttgctgaagaacgcgatctgattacgggtgctggattgttcttcattgcctacgcagtatcaatgtttgtgatgcgcagcttccttggcaaactgcaggaccgtcgcggagacaacgtcgttatttactttggattgttcttcttcgttatttccttgacgattttgtcctttgccacttccaactggcacgttgtgttgtccggagtcattgcaggtctgggatacggcactttgatgccagcagtgcagtccatcgctgttggtgtagtagacaaaaccgaattcggtacggccttctccactttgttcctgtttgtggacttaggttttggctttggacctattatcctgggagcagtttctgcggcaattggtttcggacctatgtatgcagcactggcaggtgtgggtgtgattgccggaatcttctacctgttcacacacgctcgcaccgatcgagctaagaatggctttgttaaacacccagagcctgtcgctttagttagc

SEQ ID NO: 1187 - DNA, 1308 bp, Corynebacterium glutamicum
atgaagtctaccggcaacatcatcgctgacaccatctgccgcactgcggaactaggactcaccatcaccggcgcttccgatgcaggtgattacaccctgatcgaagcagacgcactcgactacacctccacctgcccagaatgctcccaacctggggtgtttcgtcatcacacccaccggatgctcattgatttacccatcgtcgggtttcccaccaaactgtttatccgtctacctcgctaccgctgcaccaaccccacatgtaagcaaaagtatttccaagcagaactaagctgcgctgaccacggtaaaaaggtcacccaccgggtcacccgctggattttacaacgccttgctattgaccggatgagtgttcacgcaaccgcgaaagcacttgggctagggtgggatttaacctgccaactagccctcgatatgtgccgtgagctggtctataacgatcctcaccatcttgatggagtgtatgtcattggggtggatgagcataagtggtcacataatagggctaagcatggtgatgggtttgtcaccgtgattgtcgatatgaccgggcatcggtatgactcacggtgtcctgcccggttattagatgtcgtcccaggtcgtagtgctgatgctttacggtcctggcttggctcccgcggtgaacagttccgcaatcagatacggatcgtgtccatggatggattccaaggctacgccacagcaagtaaagaactcattccttctgctcgtcgcgtgatggatccattccatgttgtgcggcttgctggtgacaagctcaccgcctgccggcaacgcctccagcgggagaaataccagcgtcgtggtttaagccaggatccgttgtataaaaaccggaagaccttgttgaccacgcacaagtggttgagtcctcgtcagcaagaaagcttggagcagttgtgggcgtatgacaaagactacggggcgttaaagcttgcgtggcttgcgtatcaggcgattattgattgttatcagatgggtaataagcgtgaagcgaagaagaaaatgcggaccattattgatcagcttcgggtgttgaaggggccgaataaggaactcgcgcagttgggtcgtagtttgtttaaacgacttggtgatgtgttggcgtatttcgatgttggtgtctccaacggtccggtcgaagcgatcaacggacggttggagcatttgcgtgggattgctctaggtttccgtaatttgaaccactacattctgcggtgccttatccattcagggcagttggtccataagatcaatgcactc

SEQ ID NO: 1188 - DNA, 1074 bp, Corynebacterium glutamicum
atgctctaccttgataatgcagccaccaccagtgtgcgcaatgaagcacttgaggccatgtggccttatctcaccggagcgtttggcaatccgtcaagtccccatgaggtgggaagactcgcctctgcggggctggaggatgctcgaactcgggtggcccgcattatcggaggacgccccacacaggtgacgtttacgtcgggtggatcagaagccaacaacctcgctatcaaaggagcgtgcttagctaatcctcgtggccggcacctcatcaccaccccgatcgagcatgacagtgtcctagaaactgctgcttatcttgaaaggtttcatgatttcgagatcacctacctatcccccgatcacactgggctgatctccccggagggtctccgcaaagcagtcaggccggacaccacattgatcagcattggttatgccaacaatgaggtgggaaccattcagccgatagctgagttggcggcggtaagcagtacgccttttcacaccgatgcagtgcaagctgcacatttaacctttgacttgggagttgacgcgttaagtttgtcgggtcataaattcggtgcgcctaaagggattggagtgttatggtcaaagcttcccctggagccggtaatccatggcggcggccaggaaaaagggcggcgtagtggcacggaaaacgttgcgggggctatcgcctttgccactgccttggaattggccagggcggaatcctatccagatcttggcgaattcatcgaggaagttctcactatcccgggagcacacctgactggacatcctaggatgcgcattgatggacacgcatcttttctcttcgacagcataggatctgaaactgttcttctggaattggaacgccaaggcattgtgtgctcccctggttctgcctgtggttccggagaggtatcccatgtgttgctggcgttggggcttgaggaggatcaagcacgaacggctgtgcgctgtacttttagtacaacacacagccgtgaagatgcgctcgtggcagcctctgctcttaaatccgcggtcgccttaatcagaggg

SEQ ID NO: 1189 - DNA, 837 bp, Corynebacterium glutamicum
atgactacccatattgaccgcatcgttggcgcagcgttatccgaggatgcgccatggggcgacattacctccgacacttttatcccaggatcggcgcagctgagcgccaaggttgttgcccgggagccaggtgtgttcagcgggcaggcgcttttcgacgcctccttccggctcgtcgatcctaggataaacgcatcccttaaggtggctgatggtgacagctttgaaaccggggacatcctaggaacaattaccggcagtgctagaagcatcctccgttcagagcgcattgctctcaacttcattcagaggacgtccggcatcgctacattgacatcgtgctatgttgcagaggttaaaggcaccaaagcccgcattgttgatacccggaaaaccacacccggcctgcgcatcattgaacgccaagctgtccgtgacggtggcggatttaatcaccgagccaccttgtccgatgctgtcatggtgaaagataaccatctcgcagccatcgcatcccaggggctcagcatcactgaagcgctgtcgaatatgaaagctaaactcccccacaccacccatgtggaagtcgaagttgatcatatagagcagatcgaaccagttcttgctgctggtgtggacaccatcatgttggataatttcaccattgatcagctcatcgaaggcgttgatctcattggtggacgtgcactggtggaagcatctggcggagtcaacctcaacaccgcgggaaagattgcatcaaccggtgtcgacgtcatttccgttggagcgcttacccattctgtgcatgcacttgacctaggactcgatattttc

SEQ ID NO: 1190 - DNA, 1182 bp, Corynebacterium glutamicum
atgccggatgtctacggccccggcgcgtcacaaaacgatccgatccctgcgcatgctccgcgccagcaggttctccccgaggagtaccagcgcgcaagtgatgacgaactgcatcgtaggatccgggaagcgaaagacaccctgggtgacaaagtggttatcctaggacacttctaccagcgcgatgaagttatccaacacgcagattttgttggtgactctttccaacttgcccgcgctgccaaaacccgacccgaggcggaagcgattgtgttctgcggtgtgcacttcatggctgaaaccgctgatctgttatccacggatgaacaatcagtgatcctccccaaccttgccgcaggttgctccatggcagacatggctgaccttgattccgtcgaagactgctgggagcaactcacctcaatttatggcgatgacaccctgatccctgtgacctacatgaattcctctgcagcgctcaaaggtttcgtgggtgagcacggcggaattgtatgcacctcctcaaatgcacgttccgtattggagtgggcgtttgaacgcggccaacgagtcctgttcttccccgatcagcacttgggtcgaaacaccgcgaaagccatgggcattgggatcgatcaaatgcccctgtggaatcccaacaaaccactgggtggcaacaccgtttccgagctagaaaacgcaaaggtactgctctggcatggtttctgctctgtacacaagcgctttactgtcgagcagatcaacaaagcccgcgccgagtaccccgacgttcacgtcatcgtgcaccctgaatcccccatgccagttgttgacgccgccgactcatccggatccactgacttcattgtgaaagccattcaagcagcaccggcaggatctacctttgcgatcggcaccgaaatcaacttggttcagcgcctggcagcccagtacccgcagcacaccatcttctgcctcgaccctgtcatctgcccatgctccaccatgtatcgcattcaccctggttacctggcctgggcacttgaggagttggtggctggaaacgtgattaaccagatttctgtctctgaatccgtggcggcaccggcgcgagtcgctttggaaaggatgctatctgttgttccagcagctcctgttactcctagctcctcgaaggatgcg

SEQ ID NO: 1191 - DNA, 642 bp, Corynebacterium glutamicum
ttgcccgcttcacctgaaatccagatggccgtatccacgatcatcttcgcgctgcgccccggcccccaggatctccccagcctgtgggcccccttcgttccgcgcacccgcgaaccacatttaaataaatgggcactgcccggcggttggctgccaccacatgaagaacttgaagatgctgctgcccgcacactcgcagaaaccaccggcctgcaccccagctatctagaacagctctacactttcggaaaagtcgaccgctccccaaccggacgcgtgatctctgtggtgtattgggcacttgtccgagccgatgaagcgttgaaagccatcccaggagaaaacgtccagtggtttcccgccgatcatctccctgagctggcatttgaccacaataacatcgtcaaatatgcactagaacgacttcgcaccaaggtggaatactccgaaatcgcccactccttcctcggagaaaccttcaccatcgcccagcttcgatccgtgcatgaggcagtccttggacacaaactcgatgccgccaacttccgaagatccgtggccacctcgcccgatctgatcgacaccggcgaagtgcttgcgggaacaccgcaccgcccacccaaactgttcagattccaaaga

SEQ ID NO: 1192 - DNA, 600 bp, Corynebacterium glutamicum
atgggcctaattatcgatacaactggcctggcacattcgcctcaagcaccgttaaccctgttcagagtattgggtgctgctgcggtacttgttggatcgctggccgcagtgggagtgttctctaagaaaaacatcggacagacccaatcccaaggtgcctccatttggttgtggcgcctcttcggagtggtgatgggcatgtgccaagcaacccaggttgcagtcaatggttacttgggaactgtcctaggatcccccattgagtcagcactggtgtctttcgctgttggcaccaccgcgctgtttattctgctgttggtcacccgaaccaagtggcgtggaatcaacggcgctgggaagaaaaacccatggtggatgtggatcggtggcgtcatcggcgcgactgttattttcagtactgcttacctgggaccgatcattggcactggtgttaccgtggtggttatgttgctgggcatgatgttggccagcctgatgatcgacgcttttggaatccttggcagcccgcgccgccacattcacatcgcgcagcttctcgggctcgtggtgatcatcctcggcgtaacaatgatcagaatc

SEQ ID NO: 1193 - DNA, 600 bp, Corynebacterium glutamicum
atgaaaattacccgccacatccatgcatgcgttgagatctcacagggaaacgatcgaatcattattgatcccggtacttttggcgccccagatttatgtggcgcgaccatcctggtcacccacaatcatgccgatcacgttgatcccgagttgctcaagcccggcatgacgatttacgcgcctcgatcagtagcacattcaattccagtagaatgccacatcgtggaacacggccgaaactttaccgttgggtccctatccgttgaggttcttggttctgaacatgcgatgctcacccattccatgccgatcgcggaaaacgttggatacttaatcaacggccgagtgctccaccccggcgataccttccaacccattaaagatgtcgaactcgccctggttcctgtcaacggcccctgggtgaaaatgctggatgtggaaggctatttgaagaaatttccaccaaagcgtttcatcggcattcacgatggcattgttaatgatcgcggtttggcgatcaacaagaagttcttaacgcatcttggtgaaacctatggctcggaatactcgccgcttgaagagggagagtcgttggaaatt

SEQ ID NO: 1194 - DNA, 342 bp, Corynebacterium glutamicum
atggatctgcacaaggtagctgcagcgcacgcggcgactcttcccctgagcaccaaagagtttcctttcggacccgagcacgaagtgtacaaagtgcggggcaaggtatttttgctgctcacgatactaaatgatgagccgattatcacgctgaaatcagaccccgagattggcgcttcactacgcagtggcttccccaccatccaggctggatatcacatgaacaaagtgcactggctgagcattagcgatggtgaacggatcacgaaagacttcatcgaaggtctcgtggaagagtcctatgaactggtaatttccaccttgccgaagtataaaaggcct

SEQ ID NO: 1195 - DNA, 789 bp, Corynebacterium glutamicum
gtgcgtcgggcagtcaccggcgcgcaagatttcaccgattatgaatgggaaatcctgcacccaggggtgcttcctaccccacttaacgttgcgttggatgagctccttttggaccaagttgccagtggtcagcgtggcccgacgatgcgcatttgggattgggatgatcgcgccacagtgatcggtagtttccagtcatatgtcaatgaaatcaaccaagaaggcgttaatgaacatggtgtgaccgtggtacgacgcatgtctggtggcggtgcaatgtttatggagggcggcaactgcatcacctattccctgtatgcaccggaatctctcgttgctggtttgagctatgagcagtcctatgaatatttggatcgttgggtgattgctgcgctgaagacacacgatgttgacgcttggtacgtgcctatcaatgacatcacctccaccggcggaaaaatcggtggcgctgcacagaaacgtcgcagtggcgcagtcctccaccacgtgaccatgtcctatgacatcgatgcggacatgatgacccaggtgttgcgcattggaaaggtgaagatttccgacaagggtcttcgcagcgcaaagaagcgcgttgatcctctgcgccgccaaacaggtgcatcacgtgagcaaatcatcgacaccctaaagtccacattcagtgctaggtacggcgcgcaagaagtagagctcagcgatgaagatttcgcggcaggccacgacctagtaaaaaccaaatacgccaccgaggagtggactaagcgagttcaa

SEQ ID NO: 1196 - DNA, 411 bp, Corynebacterium glutamicum
atggtcggcacgatttccacctacatcgcattcaatggaaacaccacggaagctctgaaacattggcaagaggtttttggtggtgaacttaatcttttaacctacggtcagctcaccttggaaggtatgccgtttgatcctccagcggatgcgttggcgcacggcgtcctcacgttggacaatggtggtttgatttctggcagtgattcttttgagggagaaatgctcgtcaaagacaccgcgtactccatgttgtataacgcggagtcagtggaagatggtcgcgcgcggatcgacaagattgtggcggctggcggtgaggaagccatgaagtttgaacaggctccgtggggcggtttctttggccaggtttttgataaatttggtgtgatgtggaatatttcctcagac

SEQ ID NO: 1197 - DNA, 1293 bp, Corynebacterium glutamicum
gtgtcaacgaccaccccaacccgcgcaaccaaaagtgtcggaacagttctcgcactcctgtggttcgcaattgtcctcgacggctttgacctagtcgtcctgggtgcaacaatcccgtccatgctggaggatcccgcgtgggatctcactgctggacaggccacacagatttccaccatcggcctcgtcggcatgaccattggcgcactgaccatcggtttcttaacggaccgtctgggtcgacgccgtgtcatgctgttctctgtggcagtattttctgtattcactctcctgctggcattcaccaccaacgtccagctcttcagcctgtggcgtttcctcgcaggtgttggccttggtggagcactccccaccgcaattgccatggtgaccgagttccgccccggcaccaaagcgggctctgcatccaccaccttgatgaccggctaccacgtcggcgcagtagcaaccgccttccttggcctcttccttatcgacggctttggttggcactccatgttcatcgcaggtgccgtaccaggactgatcctgctaccactgctgtacttcttccttccagaatccccgcagtacctcaaaatctccggcaagttggatgaggcgcaggcagttgcagcatcttatggactttccctggatgatgatcttgatcgcgaacacgaagaagaactcggcgagtcctcctcactttcctccctgttcaagccctcgttccgccgcaacaccctggcgatttggggcacctcattcatgggactcctcctggtctacggcctgaacacatggctgccacaaatcatgcgccaagcagactacgacatgggtaactcgcttggattcctcatggtgctcaacatcggcgcagtgatcggcctttatattgcagggcgaattgccgataagaactcccctcgcaaaacagcactcgtatggttcgtgttctctgcattttccctcgcgttgcttgctgtccggatgccactgatcggtctgtatggcatcgtgctgctcaccggcatctttgtgttcagctcccaggtactcatctacgccttcgttggtgagaatcaccctgccaagatgcgcgcaaccgccatgggattctccgcaggaattggtcgcctcggcgccatctctggcccgttgcttggtggtctgcttgtcagtgccaaccttgcttacccatggggcttcttcgctttcgctggcgtcggtctgctgggcgcgctgattttctccgcatcgaagactctgaggcatcgcgagaacgct

SEQ ID NO: 1198 - DNA, 1185 bp, Corynebacterium glutamicum
atgaaccacgtaccagtggcaattattggcgcaggaccagcaggactaaccctcgcccacctcctccaccttcaaggtgtggaatcaatcgtctttgaatcccgcacccgcaaggacgtcgaagaaaccgtccgagcaggcatcctggaacaaggcaccctgaatctgatgcgcgaaaccggagtcggcgcacgcatggaagcagaagccgatcacgatgaagcaatcgacatctccatcaacaatgagcgcacccgcattccgctgaccgaactcaccggccacaaggttgcgatctacccgcagcacgaatacctcaaagatttcattgccaagcgcatcgaagatggcggcgaactccttttcaccaccactgttgattccgtagaaaactacgaaggcgacctcgccaaggtgacctacaccgaagccgatggttcctccaccaccatcaccgccgactacgtcatcgcagctgacggctccaactccccttaccgcaagctgatcaccgaagacggtggcgtgcgcgcccgccatgaatacccttacgcatggttcggcattttggtggaagcaccaaaaacccaaaaggaactcatctacgcaacccaccctgagggctttgcgctgatctccacccgtaccgatgaaatccagcgctactacctgcagtgcaaccctgacgacaccccagacatgtggcccgatgaccgcatttgggaacagctgcacctgcgtgcggactcccctggcatcaccgtgtctgaagggcgcatctttgacaaggccgtgctgcgtttccgctccgcggtcaccgaaccaatgcaaaagggacgcctcttccttgctggcgatgctgcacacaccgtgccgccaaccggagctaagggcctcaacttggctgttgccgatgtctcagtactcgcgccagcactggttcgtgccctgaagaagaaggacaccggcttgctcgatagctacacctccctggcagtcccccgcatctggaaagcacagcacttctcctactggatgagctccatgctccacgcagtacccggcgaagatcactttgccacccagcgccgattcgctgaattgcgctccgtcctagaatcccaatccggccaacgctacctcgcagagcagtacgttgggcgcgacctaccacgcttcgaggta

SEQ ID NO: 1199 - DNA, 588 bp, Corynebacterium glutamicum
atgcaaaaaactaatcaaccaaagtcttcctggcgtgttattgacatcgtcatcgcatccgttttgggtgtcgcctgcggattgattttcatcgtgtggaattccatcggctacgcctggaccaccgcatttcacgcactcacaccaggccttggcggcatcgccattggtatttggctgctcggtggtgtgctcggtgggttggttatccgcaagccgggtgccgcaattttcgttgaagtagtggccgcatgtgtctctgcagcgcttgcttcacagtttggtatctccaccatttactccggcttggcgcagggaatcggcgctgaaatcatcttcgcgctgttcctctaccgtcgctacagcctgcccaccaccatgcttgcaggtatgggcgcaggtggcggcgcaattttcctggaaatgttcttctacggaaacctcgcaaagacgatgtccttcaacatcatctattccaccactgtccttatttccggtgcgatccttgccggcctgctcagctggtacctggtccgcgcgttggcgaggactggtgcacttgatcgtttcgccgctggccgcgaggta

SEQ ID NO: 1200 - DNA, 1338 bp, Corynebacterium glutamicum
atgaccaccgcacttggaacgcgcgttgttgcgcgcaactttggctaccgccatgcttcccgggaaaaccccgcgctcaaagacatcaacttcgagatcgcacctggtgaacgcatcctgctcaccggcgcttccggcgccggaaaatccacgctactcgccgcgctcgctggcgttttaggcggttctgatgagggcgtttctacgggcgaattgcttgtcgacgccccctccatcggtttggttctccaagatccagattcccaagtcatcgcctcccgcatcggcgatgatgtggcgtttggctgcgaaaacctccaaattccgcgcgaggaaatctggccacgggtggaacgagcacttgaattggtgggcttggatctaccactgagccaccccacgaaatatctttccggtggccaaaaacaacgcctcgctcttgccggtgtgatcgccatgggtgctcgtctgattctgcttgatgaacccaccgcaaaccttgatcctcaaggccaaaaagatgtggtcgcagcagtggatcgcgttgttcaggaaactggagcaacactcatcgtggtggaacaccgccatgagctgtgggtcaacatcattgaccggatcatcagtattactgacggcgaagatgtccaacctgcagagttgatcaaggtgggccagttgcctggggcgcagccgtcgacaagcaaaccgatcttgtgggcgaatgatttgctgtgcacctggggcggcctgcgtagttttgaggtgccggaaggcgcctcgacggtgatcaccgggccgaatggcgctggaaaatccacacttgcgctgaccatgggtggattgcttccgccgaaaagtgggcagctggaactctctgacacggtgcgcggcggccttaacacgcccccgcacaagtggcgttcagctgatctagctgcacgtattggcactgtctttcaggatccagagcaccaatttgtggcgcgcactgtgcgtgatgagctagaaattgggccgaaaatcatgaaagtcgatgcaagcgagcgcatcgaggagctgcttgatcgtttgcgcctccgccacttggaaaacgccaatccgtttaccttgagtggtggagaaaagcgccgcctatctgtggcgacagccttggtggcagcaccgaaacttctcattttggatgagcctacgtttggccaagatcccgagaccttcacagagctggtgacgatgttgcgtgaattaacagacaacggaatcagcattgtgtcggtaacccatgatcctgatttcatcgcagcgctgggcgatcaccacattgaggtgagcgcgaag

SEQ ID NO: 1201 - DNA, 753 bp, Corynebacterium glutamicum
gtgaacctgctgatcaaaattaatcccgtcacccgcatcatcgcgttgatggtactgaccacgccgttgctgctgagtttggatgtgatgtcggcagcgatcgcgctggtggcaaccattattctggcaccatttgccggcgtgacctggaagatgctgctgaaacgtggctggatgctgttcctcatggcaccggtggctgcattatccatggcgctttatggcaggccggatggaaaagagtactttagcttcctgctcattcacgtcactgataattcactggctttggctgctgccattgggctgcgtgttctggcgattggtctgcccgttgtggtgctgattgctcgcattgatcccaccgacctgggcgatggtttggcgcagctgctcaaactgcctgaaaggtttgtcatcggtgctgtggcaggaagccgactgatgacgctttttcgggaagattggtactccatgtccagggcaaggcgtgcccgcggaattgctgatcagggcaagatcaagcactttttcaccatgacttttggtttgttggtgctctcgcttcgccgtggatccaagcttgcaacggcgatggaagcacgcggttttggtcgcacgactggccgcacctgggcaagggaatccaccgtcggcgcgcgcgatctggtgctcatcttggtgtgtgctgccatttccgcgatcgctctaaccgtgtccattcagactggtttctttaagttcttgggcaca

SEQ ID NO: 1202 - DNA, 531 bp, Corynebacterium glutamicum
atgatcacagttttaattgatggacaatccggtgcgggcaaaaccaccttggcgggtgagttagctgcccgcaccgggtttcagttggttcatttggatgacttttatcctggttggactggccttgaagcggcatcggagattgttgcacgccatgttttggacgcggacaaccccggtttcttcacgtgggattggcacaacaattgccaaggcgattggatcaagttggagcctggtcgaagtctcattatcgaaggctctggatcaatcactgctgcaacaaaacgcaaggcatcgctgttgggcgagctggtgaccgttcgtatcactggtcctgaggctttaagaaaacagcgcgccctcaaccgcgatcctgattacgcaccattttggaaagtgtgggcgcagcaggagcaacgccatttctctttaggcgttgaggtggatcatgagattgtgctaggttctgatgaggcttcgggacgacccgaagaaatctatgacagcctgggaacggcccagagttct

SEQ ID NO: 1203 - DNA, 1050 bp, Corynebacterium glutamicum
atgccgttttcttggctaaaaccaattgattatgcccgcatctttgtcggctgggcatcgatttttatcatccccctcatcacactgccatcaattattgagttggcgctgatcgtggcagtcatcctattctgcgcatttggcgtggtgaagatggcggagcgtttggctcatattttgggtgatccttttggatcgttgatccttaccttgtcgatcgtgatcattgaagtgattttgatctgtgcggtgatgctggggcctgctgattcaaccactgctggtcgggattccgtgatggcagtgtccatgatcatcatgggtttggtcgtgggattgtgcctactcattggtggtttaaggcatggaagcatgccacacaatggggtgggaactccgacctacttggtgctgatcgcaactttttccgtaatcgcctttgcggttccagctttcaggggagaatactccactgggcaggcacttgttatttcaacactgacagcagtggtgtacgggttcttcctgtttcgccaaatgggtgcccaagctggtgaatttcaagaggtcgaggtcgcagaaaaggcagacgacgcagcaaaatgggaggtcccatttagaggcttaatcttgattatcactgtgctccccatcgtgttgctgtcccatgacatggccacggtgatggatgaagtcctggcaagccttggtgcacccgtagcaatggctggattaattattgccaccattgtcttcttgccagagaccatcacctccttgaaagctgcgtggacaggagagattcagcgagtaagcaacctcgcgcatggagcccaagtatcaacggtggggctgacaatcccagctgttctagtgatcggcgtgatcacaggtcaagatgtagttttgggggagaccccgatcaacttgttgctgctgggaaccaccattgcggtgacagccattgcgtttagctccaagaaagtcagtgctgtgcatggctcggtgctgctcatgcttttcggtgtttacatgatgagcatgttcgcc

SEQ ID NO: 1204 - DNA, 708 bp, Corynebacterium glutamicum
gtgggaatgagtgcacttgagacattgcaatggcaggactggtcaagcgtcttaattgtggtagctcacccagatgatccggagtatgggctttccgcggctgttaaagaatggacagacgccggggtggaggtgtcttacctgctgctcacccacggggaggcaggtatccaaggtttagaccctaaagaaaccgggtcattgcgcgcagcggaacagcgggctgcatgtgatgtggtaggagttagaaatctcaccattttgaatcacccagattccatgttggtgtacaatctggtactgcgcaaagatattgctcgggaaatccggatccgtaaaccaaatgctgtggtggtatccaattttgatgtagaggcctacggtggtttgaaccaggcggatcaccgcgtggcgggattagccgcaattgatgcgacccgcgatgccgctaatccgtgggcgcagccagagctgttgcaggaggatctgcagccgtggggagctgaagtcatcatcattgccggacacccagagcccacccacaccatggatctggctaaagattctgttgatgccggagttgcatcccttcaagctcacaaggaatacttggccgctcttccagatcccccgaagccggaggagttcattccggcgtttctcgaggtagagggcggttacgcagcggccttccgagttttcggacgg

SEQ ID NO: 1205 - DNA, 723 bp, Corynebacterium glutamicum
atggaaaaccctggtgatctcggcgctatgccacagtacggttttgagcatatttcgatgctcatcaccgctgtggttttagcgattcttgtcgtccccattgctcgtcgattcaacttcgcaccggcatttggctgggtgctactcatcgcaacacttctgtcgaacctgtggaattttatgcccggctattacacgctggaccaatcttggccattccacttctcagatgcattgcgcattattgctgccatcgcattgattaatcgcgcgcggtgggcagtttcagtgactattttgtggggcaccacgatcaacctgatgtcactgctcactccagatgttcagtatttacaggttccctggctggagtttttaatgtactggtttatgcacatttctgtgttcctagcagctataattctcattttcgcttttggagaaaagccagggctgtccggagtggttatgtccgttgcagtggcgattagctggggcatcatgtgcctcatggtcaacgcatttttgggaaccaactacgggtacctctccacagaaccagaatcagcgtcaattctggatttgttgggaggatggccgttctacatcgtcgcggaagtattactcctgtgtgcagtgtgggctttgtggtcttatctgattgataagctgcctatcacgtatcgccctgcttaccgtccgaaaactcggaaggccgctgcg

SEQ ID NO: 1206 - DNA, 2340 bp, Corynebacterium glutamicum
atgcaaaaagctgattcccatgattggatttcggtccacggtgcgaatgaaaacaacctcaaaaatgtgtcggtgcgcatccctaaaaggcgtctcaccgtgttcacgggtgtgtcgggatctggcaagtcctcgctggtgttcggcacaattgctgcggaatcacgccggttgatcaacgaaacctatagcacttttgtgcaaggtttcatgccgtcgatggcaaggcccgatgttgaccatttggaaggcatcaccacggcgatcatcgtcgatcaggagcagatgggcgcaaacccacggtctacggtgggtaccgcaactgatgccaccgcgatgttgcgcattttgttttcccgaatcgcggaacctaacgcgggtggcccgggagcttattccttcaacgtcccctctgtttccgcatccggcgccatcacggtggaaaagggcggaaacaccaagcgggagaaagctaccttcaaacgcacgggtggcatgtgcccagcgtgcgagggcatgggcagggcctcagacatcgacctcaaagagcttttcgacgcctccctctccctcaacgacggcgccctgaccatccccggttacaccccaggtggatggagttatcggatgtattcagaatcgggcctttttgatgctgccaagcctattaaggatttcaccgacgaagaacgccacaacttcctttatcttgagcccaccaagatgaagatcgctggcatcaacatgacctatgagggtcttatcccccgcattcagaaatccatgttgtctaaggatcgcgaaggcatgcagaagcatattcgtgcgttcgtggatcgagcggttaccttcattccttgccctgcgtgtggtggaactcgattagcgccacatgccttggagtccaagatcaatggcaaaaacatcgctgagttgtgcgcgatggaggtccgtgatttggccaagtggatcaaaacggtggaagccccctcggttgctcccctgctcaccgcactgactgaaaccctggataacttcgtggagatcggtttgggctatatccaactcgatcgccccgctggcacgttgtctggtggtgaggcacagcgcaccaagatgatccgccatttgggctctgcattgactgacgtcacctatgtttttgatgaacccaccgccggtttgcacgcctacgacattgaacgcatgaacaagttgctgctcgatcttcgcgataaaggcaataccgttttagtcgtggagcacaagccggaaaccatcgccattgcagatcatgtggtggaccttgggccaggtgcaggcgcgggtggaggtgaaattcggtttgaggggagcgtcgacaagcttaaagacagcgacaccgtgactggcctccattttaatgaccgggcgtcattgaaggaatccgtgcgtgcgccgcatggcgccctggagatccgcggggccgatcgaaataatttgaacaatgtggatgtcgatattccgctcggcgtgttcacggcgatttccggcgttgcaggttcgggtaagtcctcgttgattcatgagattccgcgtgatgagtcggttgtgtttgtcgatcaaaccgcaatccacggttctaatcgttccaatcctgcgacatatacaggcatgctggattcgattcgcaaggcttttgccaaggccaatgatgtgaaaccggcgctgttctcccccaattctgaaggcgcgtgcccaaactgtaagggcgccggctcggtctatgtcgatttgggcatgatggctggggtatcttcgccgtgtgaggtgtgcgagggcaagcgttttgatgagtccgtgttggactaccactttggtggcaaggacatcgcagacgtgttggggctgtcggctgccaatgcgtatgagtttttcgcggcgaaagattcaaagattttgcctgcggcaaagatcgcaaagaggcttgtcgacgtcggcctcggctacatcaccctcggccagccgctcaccacgttgtccggcggtgaacgccagcgtttgaagctcgccacccacatggcagacaaggccaccacctttattttggatgagcccaccacaggcctgcacctcgctgatgtgaaaaccttgctggatctttttgatcaactggttgatgacggcaagtctgtcatcgtcatcgaacaccacctcggcgtgctcgctcacgctgaccacatcattgatgtcggccctggtgcaggttctgatggtggctcgattgtattcgagggcagccccgcggaactcatcaaaactgatactccaacaggacgccaccttaaagcttatgtagat

SEQ ID NO: 1207 - DNA, 495 bp, Corynebacterium glutamicum
atggctaaaacacattttcaaggcaacgaaactgctacctccggcgaactgccacaggtcggcgacaacctcgcagagttcaacctcgtcaacaccgaactgggcgaggtctcctcaaaggacttccagggccgcaagcttgtcctgaacatcttcccatccgttgacaccggcgtttgtgcaacatcagtccgcaagttcaacgaggcagcagcaagcctggaaaacaccaccgtgctgtgcatctccaaggatcttccattcgcactgggccgtttctgctccgcagaaggcatcgagaacgtcaccccagtatccgcattccgttccaccttcggtgaagacaacggcatcgtgctcgaaggctcaccacttaagggtcttcttgcacgcagcgtcatcgtcgtcgatgaaaacggcaaggttgcttacacccagttggttgatgagatctccactgaacctgattacgacgctgcacttgctgcgctgaac

SEQ ID NO: 1208 - DNA, 216 bp, Corynebacterium glutamicum
gtgagtggcagaatggatcgatctagccatgagcggaacgtcgaaaccggtgactgcccagaggcgatcggtggtgaggcgaacatttcagagttttgcagcattgatgagctcggggaattcggcgaacttggtgaattcagtgcgcctagtgagtccagtgaggtaggtgaacttggccgcctgttagctaacgttgttacctgtacgtcgggt

SEQ ID NO: 1209 - DNA, 1776 bp, Corynebacterium glutamicum
atgtatacccattcaacaggcactcctcagcttgatttcgacggtgacatctatccccttcacctcttcttctctgcacagactgcccaacatttcgctctcgagcgcgtcaattggcatgtcttacgcgctattgtgaaacctgagcaaggcgaactcatcgtcgaagcgcttctcgcaccaatagaatccgcaacaaaaatcggtgtttgggttcaagatgaatttctcggggtgattgcagagtcccagttcctgttgaattctcaattgtctcgaatttttgcctctggccacctgatttccagccaactacttctcacaccgagtaaaggatctctcgcttcagttcttcttccaaacctaaaattcgggctcatcagcaatgatcctccacgagctgattcccacctcttaccgctaggcagaatgtggcgcgttgagcccaccgttcatgctctgtttgaggatttctcacttggctccacgattctttttgggctgaggcttgatttagaagccctaattgtctcctataacggaatagaatgtggcatcttaaactttgatgacgcctcagcactaagctctgctgtgaaattctcaaatgcaaatggtctcacccccacggtgctcggccacgtagtccgggagaacggtgaaacatccttcgagattgacgttctcccactggagttgtggtcgaagaagcagcatcgccttgaggttttaaaaatccctcggttgatacctaaagaggcagattcccaaaattatgtgaaggcgacagcgctcctttcagacgagattctgcgaccacaaacgctgtccaaaaaggcactgtctttgtcggacaccgcagttaagtacagccctcatgttgcttgtggcgtggggatgtttagtcttttcgccgttattccctttgacaagttgagtgatcatagtgcgatgctgctcgcagtcattagcttgatgctttttgtgctggcattagtaattcttttcaagagaattcagtcaactaatactcagcgttggaacttggcctcgtcagtcggattactcgcgacacttccgattatcatattcctggttgctgatacattgattcctcagggcagcctggaaaaccatgctcaacccgacgtacaggtaacaacgttagctaacaggcggccaagttcacctacctcactggactcactaggcgcactgaattcaccaagttcgccgaattccccgagctcatcaatgctgcaaaactctgaaatgttcgcctcaccaccgatcgcctctgggcagtcaccggtttcgacgttccgctcatggctagatcgatccattctgccactcacacgagaaaattccgcttcagaaagcgcagtgacagctcttggaccgtcgatagtgcagcctgcatctgaatcgattacaactccagctcaaacgtcgcaaagtcgccacgcaattgacgatggtgacgacagtaaaacctcaacgggaagaccagctcccactactaactcgccgatcattgctcttcccccaacgtggattatcgggccggaagatccagaatccaccgaccctacagcaccaaccgagcccaccgagccaagcgaacctgtagcaaccgacgaaccctcagagacctctgaacaaacttcacctctcttagctccgtcgaccacccccgaaactgaaccggaaacaactgaagctccggtggagaccaccgaagcttcatcagaaattaccgtgagcgaagtaaat

SEQ ID NO: 1210 - DNA, 954 bp, Corynebacterium glutamicum
atggccggtggattggcagcactattagacgatgtcgcagcaattactcgagcggctgcagccagcctcgatgatgtcacggcgatggctggaaaaaccagcgttaaagccgcaggcgtggttgtagatgacacggcagttaccccgcaatatgttcaaggtgtcaaacctgcacgcgaactgcccatgatttggcggatcgctaagggctctttggtaaacaagatcatcatcattttgcccatcgcgttgcttctttccgcgtttgctccgtgggctctcacaccaattttgatgctgggcggctcctacctgtgcttcgaaggtgcagaaaagatctggcactccctccacaggcgcatcaaaggtgaacagcacagcaccgaacccaagtcgcaggaaagcccaaagtcagaggatcagctggtcaaaagtgccatcacaactgacctcatcctttccgcagagatcatggttatttcactcaatcagattgcagatcaaactatctggatgcaggctgcggttcttttcgtcgtaggtattggcatcaccgcgctcgtgtacggcgtagtcggtgttcttgtgaaaatggatgacgtcggacttacactttcaaagcgtgactccgcaggtatccagaaatttggccgcggcttggtcaaagcgatgcccatcgttcttcaagttatttctgttgtcggcgtttttgccatgctgtgggttggtggccacatcatggtcgttggaactgaagagttaggatgggaacttccctaccaccttgttcacggactagagtcctgggctaacggtatcggaggcagtgctctgggatgggttggcaatactttcgggtcacttgtgttcggcctcatttggggcgcgattatcaccgttgtggtcagtgtgatcaagaagttcattccacagcgtgcgcaaaactcgtctcat

SEQ ID NO: 1211 - DNA, 900 bp, Corynebacterium glutamicum
atgaaaattgcgatcgttggcgctggtgcagttggtggatatttcggagcgttgttacaagaatctggtgcagatatcacgatggttgcacgtggacgaacattagaagccttgaagtctaaaggactccacatcaacgatgcaagaggcgaacgctacgtaccaattcctgcagttgcgagcgtgcaagaactaaaagatgcagatgtagtgatgattgctactaaagcattatcgcggtctttagatctcgctgaacttttgggtgggatacctgcgaattcggtggtcgcgattactcagaattcgattgaatctgctgatctagcagcgaagagtatcggtgctgatcgtgtgtggcctggtgtggttcgtgggttctttgttcatgaggggccagcctcagtgtcatacaagggaggcccactgtcctacacgtttggtgattctggtgaactttctaggcaattcgcaagcactcttgaacaggccggtattgacggagttctgcatcccgatattttggtggatgtgtgggagaaagccatgttcgtagaggttttcggcgggttgggggctttcgtcgaaaagcaattaggtaccttgcgtacgcattttagggcttccctggaagccttgatggaagaggtggctgaggtggctcgcgcggcaggtgttgcgttgccgagcgatgcggtggagcgcaccatgaattttgcggatcggatgcctgagaattcgacgagttcgatgcagcgtgatttggccgcgggagtggctagtgagcttgaggctcagacaggtgcaattgtgcgggcagcgcacaaagtgggtgtgaaaactccgcttcatgaccttatttatgctggtcttaagctgaaagaagaggaaaattcactt

SEQ ID NO: 1212 - DNA, 366 bp, Corynebacterium glutamicum
atgatcgttacatccaccgcgcgcgtttctatagatcgtccctcgcgctatgccaaacagttaactagccatttgggtgaaaaactgagcacaagctgggacccggaggcagaacgggggtctgttgtcttggtgggaaagggcccagaccacgaagaccagcggtttgcttttgatggatctgctacctgtgatctggttgccggcgacggcgtgctgttgctccacattgaatcgcccgccagcctggttgagcgttttgaaaatgtcatcggcggccatctggtcggcttcgctcggcgcgacgagatgaagattgcttttcgacgtggtgatggatcagaagggctgtcttttgagtccgtc

SEQ ID NO: 1213 - DNA, 297 bp, Corynebacterium glutamicum
ttgcttttcgacgtggtgatggatcagaagggctgtcttttgagtccgtctaacataatccgcatcgcagctgttctaatccccaatgatcaggatcagattctctgcgtccgcaaagagggaactgaattgttcatgtttcccggaggcaagcaggagttgtgggagactcctgcacaggcagccgcgaactcgaggaagaagacctcgatctttatgggcgttttcaggcaccggcagcaaacgaacctggcttctatgtggactgccatgtgtttagcacatttgatgtgttct

SEQ ID NO: 1214 - DNA, 261 bp, Corynebacterium glutamicum
gtgggagactcctgcacaggcagccgcgaactcgaggaagaagacctcgatctttatgggcgttttcaggcaccggcagcaaacgaacctggcttctatgtggactgccatgtgtttagcacatttgatgtgttcttgaactacacaccggatgtgtacgaagaactcgctgaggcgaagtacttctcgcctaaaccacgatcgaagaagctcgcgccactaactcgtgacgtatttgaggctatctcaagtgaagtgcgt

SEQ ID NO: 1215 - DNA, 387 bp, Corynebacterium glutamicum
atgctgatctccctgctgatagtccttatcctgggagtagtctgcatcggtataggaattcacttcatcggaaaagatcggcattttcaatctaatgcggtcgaagtcgaggcagaagtaactggatttgttgagctcgaagacgaacgctatctgacgcagtaccgcttcgagcttgaccaccacgaggtgttcggagttctaccgaagtccactccccgacccatcaccaccaaaggcgccgtgattcccttgctggtgaacagagacgattccactcaggttcggcgcctcactgcacgcaaggacgtcaccttgaggttcttcctcattttgatcgggggcctcatggtctgtactgctgtgccactgctatttttcgttgcc

SEQ ID NO: 1216 - DNA, 834 bp, Corynebacterium glutamicum
atgtcttctgcgtcatttaccaccaaagcactgtccgtactcgcagctttaacggctgcgtctgcccccttagtggcggcgtcacctgcacatgctttggcaaatgctcgcaacgttacgggttcaagcaccacttcagattcaattgttcgtctgcacatcggtaacactgcatgtacaggaaccatgatcaccccaacgtgggcgatcaccgcccgccactgtatccctgagggcggtattgccggtgcagctattggttcaagcactttgagccaatttcagcaggtgtcccaagcgatcttgcaccctactgcggacttagctctcgttgagcttcccaatcaggcaagttccaacacggttgatctctacggtgcacacgtgcagcctggtgaaaatggtcaagcagccggctggggtgggtactctgcctttggccaaaatgttgcacagcaagccgatgtgcaaattcaacgcagggtagtcaatgtgccaagccccgaccgcaccgctgtgctgcttgaaggcactgtttctaacggtcgtctcgtaccaggcgattccggcggacctttgtacatcaatggtcaactggctggtgtgctcagcatgtccactgacgtagaaaacgatgcactagacggcaccgtcggctggtacatccccgttgctgaacacgccgagtggatcgcctactacaccggcaagcacattgcccccattgctggtgcgcccgcagaacttgttgacgccaccgccaaccccaccttcatccctgctccacagcctttcaccggttcatccatcggtggttgggcgctgggcagctcc

SEQ ID NO: 1217 - DNA, 345 bp, Corynebacterium glutamicum
atgaaagtcacgattttccataatccgcgttgttccacatccagaaataccctcgcttacctccgcgacaaggacattgagcctgaaattgttcagtatctcaaagacacgcccaccgcttccgagctcaaagaactattcaatacgctgggaattccagtccacgacggcatcagaacccgcgaagctgagtacacagaactgggcctgtcaccagaaacacctgaaactgagcttatcgacgccatcgttgcccatcccaggctccttcagcgtccgatcgtggtgacggccaaaggcgcgcgcattgcgcgccccaaaatcgacgtcattgacagcatcttg

SEQ ID NO: 1218 - DNA, 1200 bp, Corynebacterium glutamicum
atgattattcaaatcctaagagtggcatttgccttcgtcggcatcattgttggcgccggtttcgcatcagggcaagaggtcatgcaatattttgtggccttcggcatagacggaatttggggagtcattgtttctgcagtgatcatgtcggtgatggcgttgatcattttgcagctcggaagctatttcaatgcaggtgaacacggtgaagtgttccgccgagtaagtcaccccgttttctccaaaattttggacatcggcgttgtggtgacgttgttctccaccggtttcgtcatgtttgcaggcgcgggatcaaatctgaatcagcagtgggggcttccgctctggatcggttctgtgatcatggttcttctggtgctggctgcgggcatgttggacgtggataaagtaaccacagtcattggtgcaattactccgttcatcatcattttcatcactgccgcctcgatctacacgctggtaggtaatttcagctcagtggagcagcttgattctgctgctttagaagtcggcacgacgttgcctcactgggctgttgcagcggtgaactatgtgggattcaacctgatggttgcggtgtccatggctgtggtcattggtggatcaatgtttaacccgcgggtcgcaggtcggggcggtttgctgggcggattgatcctgggattcttgatcatcatcagtgcgctaacactgttcgccaccgtggaagaagttggccaagatgatatgcctatgctgacgatcatcaacaatttgaacccgctggctggccaagtaatggcagtggttatctacggaatgatcttcaacacggcactgggtatgttctacgcattgggccgtcgtctcactgcgaaaaacccacagcgattccgtccggtttatgtggtcacagtgctgattggttttgtgttgagctttgtgggattcaagaacttggtgggctatgtgtacccagtcttgggatacattggcctgctgctgattgcagtgatgatggtggcgtgggtgaggggacgcgtacgcatctacaaggaatccgaacgccgcatgcggatcgcagacttgttgcagatcggccatgacggagcgttgagtggagcagagctggcggtgctcaaccaggaaatccaagattcaaacttggatgaggaacaaattaaagcagcggttaggaag

SEQ ID NO: 1219 - DNA, 537 bp, Corynebacterium glutamicum
atgactgatcttcatcccgtaaagcaggaaattttcaacactgctgaatccataaacacagatcccaaggggtttctccgcgaggtagacaccttcaaagtaaccgacttcggcctgtacatggctcgtggtgcaaaccaccccaagttcggatacttggaaagctggctcctcccagaacttggattgcgtgccaacattttccacttccgcaaaggcgtggatgaacgtcaggattactacatcgatgtcgctgaaattcgcgtcgaagacaacatctggaccacccgcgacctctacgtggatctcatctctgtctgcggagaaccagtaacagtcatggacatcgacgaactagctgcagcaacctcagcagggcttatcactgcagatgacgctgagcgcgcaattgatgccaccttgaatgctgttgaaggaatcacccgccacggcgacgatcctatgcagtggctgcgctccaagggaatcgaactcacctgggctgacgccagccaggtagagctcgtccctgcagag

SEQ ID NO: 1220 - DNA, 714 bp, Corynebacterium glutamicum
gtgacaaagacactcccccgactgcttacagtcgctgccgctctagccattgcactcccggcaaccccggtagcatcggctgtcacaccagttgaacaagctttcaacgcctcatcgaatctctccagcggtctccccgtagaccaatggggacgccccaacgagcagttccgccaacaaatcgaacaggcagtaaaccaaccgtgggtcccgcaggaaatcaagaacatcgtttctcaggccatgggttttatcaccggtgacggcagcgaaggtggggacattgaaatccccgacaacgcaccacgcatcgcgcagttcttctggcccacccgatcagaaaactgcatcaacggaaattctgcagccgtaggatctgccttcgcagttccaggaccagcagatctccccctccccggcgcaggtgtcggccaaacctccttcgtgttcaccgcactgggaactggccccctcgcagaacagcaaagcaccgcaatgactgttcaatgggcaaacttaagcaacttcacccatggcaccacgacgttgagcaacaccggaatcaaccccgatggcccctcaacgatttccggtgtggcagacacaggacgcggcatcatcgtcgcctccatgtcaggcggcctcaccacatccaccgaaaacggttcagcgaactgtaatttcatcccgactgccgtcgtattcgatgtgagg

SEQ ID NO: 1221 - DNA, 1911 bp, Corynebacterium glutamicum
gtgacccacccagagtttcgtaacgtagcgattgtcgcgcacgttgaccacggaaagaccacactcgttaatgccatgcttgaacagtctggcgtattcagtgaccacggtgaagtagccgaccgtgtgatggactccggtgacctggaaaaggaaaagggcatcaccatccttgccaagaacaccgcgattcgtcgtaaaggcgctggcaaggacggcaatgacctgattatcaacgtcattgacaccccaggccacgctgacttcggtggcgaagttgagcgcgcactgtccatggttgacggcgttgtccttctggttgacgcatctgaaggcccactgcctcagacccgattcgtgcttggcaaggctcttgctgcgaagatgccagtcatcattgctgtgaacaagactgaccgccctgacgctcgtattgacgaggttgttgaagaggcacaggatctgcttcttgagctcgcatctgcacttgatgatgaagaagcagcacaggcagctgagcagcttcttgatctgccagttctgtacacctccggtcgtgagggcaaggcttccactgagaacccaggcaacggcaacgttcctaattccccagatctgatgcctttgtttgagaccctctacgaggttctcccagagccaaccgctgacattgatggccctctgcaggctcacgtcaccaaccttgactcttcctccttccttggtcgtatcggcctggttcgcgttcacgcaggtaccttgcgtaagggccagcaggttgcatggattcactacgatgaagaaggtaaccagcacaccaagaccgctaagatcgcagagcttctggctaccgttggcgttgcccgcgttcctgctaccgaagttgttgcaggtgacatcgctgctatctccggcatcgaagacatcatgattggcgataccctcgcggatcctgagaacccagttgcactgcctcgcatcaccgttgatgagccagcactgtccatgaccatcggtgtgaacacctcaccaatggctggtcgtggcggcggagacaagctgaccgcacgtgtggtcaaggctcgtcttgagaacgaactgatcggtaacgtgtccctgaaggtcaacccaactgagcgcccagatacctgggaagttcagggtcgtggcgaaatggctctgtccatcctcgttgagaccatgcgtcgcgaaggcttcgagctcaccgttggtaagccacaggttgttacccagaccatcgacggcaagctgcacgagccttacgagatcatcgtcatcgacgttccttccgagtaccagggcaacgtgacccagctgctggctacccgcaagggcctcatgcagtccatgtccaccaccccaggttccgactggatccgcatggaattccgtattcctgctcgtggcctgattggtttccgtacccagttcatgactgaaacccgtggtaccggtatcgctaactcctactctgacggcatggatgtttgggctggcgaaatcaagggccgcgcacacggttccttggttgctgaccgttccggccagatcaccgcttacgctctgacccagctggcagaccgtggtagcttcttcgttgagccaggcactgagacctacgaaggtgtcgttgttggtctgaacaaccgtgaagaagacatggacatcaacccaaccaaggaaaagaagctcaccaacatgcgtgcagcttccgcagacaccactgtcaccttggctaaggctcggtctctctccttggatgaggcactggagttctgtggcgtcgacgagtgcgtcgaggttacccctgatgttctgcgcatccgcaaggtcatcctgaacgctactgagcgtggccgtgcacgttcccgtgcgaagagcctgaacaag

SEQ ID NO: 1222 - DNA, 1506 bp, Corynebacterium glutamicum
ttgggggtgagaataaggtttggaattctaagtgttgtcgcctgcacggtttcgttggtggcatgtcaggctaatccgggtcctgcgcccgttgaggagccaactacagccactgcgacgaccacggcaactgagacgaccaccgtagagactgaagcccccaaacaagatcgggaaaccatcagtattggtatcgatccgatccgcaacggtttcaatccacatttgttgtctgatgattctccactggtgcgcgatactgcatcgttggtgttgccgagtgcttttgagggcaatcagctgaacactgacttgttggacaatgttgagcaggtggatgaaaccacggtgaggtacacgattgctcaggaagcgcagtggagtgatggcactccgattactgggtctgattttgagtacttgcgcaggtccattgtggcggggacaggaacgctgaacgattctgcatattcggcgatttcagagattaggacctcaggcggtggaaaaactgtcgacgttatttttgaacatcctgtcgctgattggcatttgctgtttaacaatttgttgccgagtcatttgatcactggcaattccacattccagacagcgttttatgattccatcccggcctctgcggggcgctacatggtgcgttccattgatcgtcagcgcggcgtgattacgttgtcgcgcaatgatcgtttctggggtgcaaatccggcacacgtggaagtactccaattcaacaccgttgcctctgcatcccgggcgggggagtacctgcgcaccgggcagagttcgtttatgaatctgtcaccgcaggaaaccctggtggacacgttgaatttggtgccggacacggaagtgcgggtgtctgacacgacgcgcacgctggagctggtattcaacgccgaagcgctggcaccggcgcagcgcgcctacctgacatcgcttatcgacgtccccctcaccgccaagttagctggcggtcgcagtgcaaacctgggtgtgccccaaacggtggaggcgagcgtcgataagcaagaaattcctgcgttgcgcctggcggcggaccccgccgacgatgctggtttggcagctgcgcggggcatcgtcgatatgctggctgcggatggaatcaaggctcaggtcgtgacaaccgatttgaattcggcgattgcgggtaattttgatgcgatcgtggcgtggaccagaactgccacggattcgattgcgttggcggaccgagtgggttgtggcgtgaacttggcaaagtggtgcgctgagggaaccacggaatatatcaacggtgttttggcgggtgagattgatttcgatcctgcgtgggagcagcagtttaacaccgagaatcacttgcgggttccgatcctgcgggagactcgggtagaagcgaaaaataacggtatcctcggggctgcggatggctggcctgggggaatttcaagtgctgcaagttggaggaaaaacgatgttgaagaa

SEQ ID NO: 1223 - DNA, 870 bp, Corynebacterium glutamicum
atgttgaagaatgatctgtctggtgctcgagttgtagctgtgcatgcgcaccctgacgatgaggcgattaccaccggtggtgtgcttgcggatcttgctgctcgtggcgccgatgtcacggtaattacctgcacgttgggcgagcagggtgaggttatcggtgagacattcgcgcagctagtcaacggtgatgcggatcagcttggcgggtttaggatccatgagctttacgcctcgctggagattctgggcgtgcgtggcattcatctgggtggcgctggctgctggagggattccggtatggttggtgatcctgcaaatgagcatccgcgtgcgtttattcactctggtgaccgtgcagtggagcaattgaaagaacttcttgcggaattgaagccacatcttttgatcacctatggccctgacggcggctatgggcaccccgatcacattcgtgcgcatgaaatcacccacgcagcagccggcgagcaacgcattctgtgggctgtgagcgaccgtgaggagctcgaggacggtctaaaggcaatcactgggcttcctgaaggttggggcaggggagagctctctgcggtcgattccgtggacctctctgttgagctgaacgatgaagtgtatgccaccaaggtggaatccatgcgcgcgcatgcgacacaattgtggatcgctgacggttccgtatctcgcaccaacccggttgccgcacacgcagtgacacagcaggacaatgtgaaggtgtgggcgctatctaatttgattgcacaacccatcatgcgccacgagcactaccaactcggcgccggaacaccactgcctgaaggtgcaactggagtgcttgacggactggagttc

SEQ ID NO: 1224 - DNA, 438 bp, Corynebacterium glutamicum
ttgacggactggagttctgacacggttatggcagaatctaagcaggttcggaacaagagtttcattcaccgaaacctcggcaaaggggaggtgtttggaggtctattttggctcagtctaggggcacttatttcggtgcttttggaggtcatttacctgggcacccggatcactttgcctggcggaacatcgctggcgtttccctacacaatcgccattgcattcttgttcaatatggttttgaccaggacttccatgctgtggaccgatcattggcttgcaaaattcactccactgacagtgtggattttagggttcatggcgctgctggtgtggaccgtggttgcaggggatcaattaattccgaataatattcgcacagtgctgctactttttgctggtttttccggtggaatttggcctgcggtcaaggggaag

SEQ ID NO: 1225 - DNA, 315 bp, Corynebacterium glutamicum
atgacatacacaatcgcacagccctgcgttgacgtcttggatcgtgcctgcgttgaagaatgcccagtagattgcatctacgaaggtaagcgcatgctgtacatccacccggatgagtgcgttgactgtggtgcatgtgagcctgcttgcccagttgaggcaatcttctacgaggacgatgtcccagacgaatggcttgactacaacgatgccaacgctgcattcttcgatgatctgggctccccaggtggtgcggctaagcttggaccacaagattttgatcacccaatgatcgctgcgctgccgcctcaggca

SEQ ID NO: 1226 - DNA, 1101 bp, Corynebacterium glutamicum
atgacctctcgcaccccgcttgtttctgttcttcctgattttccgtgggattcgctcgcttccgcaaaagccaaagctgcgtctcacccggatgggatcgtgaatctttctgttggcactccggttgatccggtcgcgcccagcattcagatcgcgttggcagaagcagcggggttttcgggttaccctcaaaccatcggcaccccggaactccgcgcagccatcaggggcgcgcttgagcggcgctacaacatgacaaagcttgtcgacgcctccctcctccccgtcgtgggtaccaaggaggcaattgcccttcttccattcgcgttgggtatttccggcaccgttgtcatcccagagattgcgtacccaacctacgaagtcgctgtcgtggccgcaggatgcaccgtgttgcgttctgattcgctgtttaagctcggcccgcagatcccgtcgatgatgtttatcaactcaccatccaaccccacaggcaaggttctgggcatcccacacttgcgcaaggttgtgaagtgggcgcaggaaaacaacgtgatcctcgcagctgatgaatgctacttgggtcttggctgggacgatgaaaacccaccgatctcaattttggatccacgtgtctgcgatggcgaccacaccaacttgatcgccattcactcgctgtctaaaacctcaaacctcgcttcttaccgcgcaggttacctcgttggcgatccagcgctgattggtgaactcacggaagtccgtaagaacttgggtctcatggttcctttcccaatccagcaggccatgatcgcagccctcaacgacgatgaccaagaggcagggcagaagctcacctacgcgattcgtcgagcaaaactcatgcgcgccctgttggaatccggctttcaggtagataattctgaagcgggtctgtacctctgggcgacgcgtgaagaaccttgccgtgacactgtcgattggttcgctgagcgtggcattctcgttgccccaggagacttctatggccctcgcggagcgcagcatgtgcgtgtggcgatgaccgaaaccgacgagcgcgtcgacgcctttgtttctcgcctgagc

SEQ ID NO: 1227 - DNA, 621 bp, Corynebacterium glutamicum
ttgagtttgaagttttccgtcgaaagaggccatttgagttccgagtccagtcctgagtcgagtaccgagcaaaaaacctggggtagtcgatttcttcgcgcttcccggcagttcatcaagttcggaatcgttggaggctctggcactttggttaacttggcggtggcagcactgtccaagaagatcgcgggatggacggcagggattcatgaaagcgatgcgttcatgaatttgcttggatcggctttccatatccgttggtaccacgtgttcatgaccatcgcattcctcgtggccaatacctggaactatcagctcaaccgcatgtggaccttcaagacagcgacaatcgtgtcctggtggaggggtttcttcccattcctggctacaggtcttgtcgcgtttattgcgagccaggtggtcgcaaccttgctgatgaacgagacatctccgattgccttgtcctctgaaattttcgacgactccaccggcttccgcacaaagttctattgggcactggtgatttccattctggtttccatgccggtgaacttcattgtgaacaagtactggacattcaagaagccgaagtccaaggtcgtcgtggaaacggaccctgtc

SEQ ID NO: 1228 - DNA, 1185 bp, Corynebacterium glutamicum
gtgaatccaggggggatactcatgaccactgacatctacttcagccacaacaacccacacgacccatacgcccaccacaccaccgaactcaaccgcgacacccatcacctctgggtcgtcttaaccaccgactccgacgacttcgacgcagactcctttaccaccgaagtcatccggatcaccggctactcccgccacgaagtcaacaacggccttaacgccatggccgcgatgaccaacctcccacacctgcgcgccatccaagaacgctactacttcctgagcatccgctacctcgcctccatcatgatcgccgtggccaaagcagaccccaccctgtgggaagaactcgacctgcgcatcaccgacgccttaacaccagtcaccgcaggggaagtgatgatccaatcctccaccctgtccaaacgcatcgccgcctggatcaaagaactcgaccccgaacccacaccagagcccataccgaaagaggactatgttcacgtccacaccactgatgaggcgacctatgtccgcatcaaaatcagcggccccaaccgcctgatcctcaatgacatcatcacccaactcaaagacacagacaccgaggacagcctgcctgaagcgctcatggcgttcctgatggagaaaatccagttaaagatcaccaagtaccttttcaccccacataagcaccctgagcaggtgtggtcaccggactacggtgacattggtcccgaagcctatgccaatgccaccctcgtgtgcgccaaggacttagatgaggtcgctggagccacggagaagagctacaccccgagtgagaagatgaaagccctgatcagagctcgggatgggcattgccgcttcccagggtgttgcgtcccggcgagtaaatgccaggtcgatcacattatcccgtgggcggagggcggcccgacagcggcgtggaacctgcagttgttgtgccagcggcatcacaatatgaaaaccgatggtcgctttactgctgatgctaatggattggcggagattagatggattgggccgatggatgtgccggcggtgaccaggccgacgggtccgttggtgaaagcgatgccgcgggggatttggggtcaggtgttgagggatcggatccaggctaggtttgagcggatccgcgtccgcgccctcaacaaagaagac

SEQ ID NO: 1229 - DNA, 891 bp, Corynebacterium glutamicum
atgactactgcttccgcaaccggaattgcaacactgacctccaccggcgacgtcctggacgtgtggtatccagaaatcgggtccaccgaccagtccgcgctcacacctctagaaggcgtcgatgaagatcgaaacgtcacccgcaaaatcgtgacgacaactatcgacaccgacgcagcccccaccgacacctacgatgcatggctgcgccttcacctcctctcccaccgcgttttccgccctcacaccatcaacctagacggcattttcggcctcctcaacaatgtcgtgtggaccaacttcggaccgtgcgcagttgacggtttcgcactcacccgcgcgcgcctgtcacgccgaggccaagttacggtttatagcgtcgacaagttcccacgcatggtcgactatgtggttccctcgggcgtgcgcatcggtgacgccgaccgcgtccgacttggcgcgtacctggcagatggcaccaccgtgatgcatgagggcttcgtgaacttcaacgctggcacgctcggcgcttccatggttgagggccgcatttccgctggcgtcaccgttgatgacggcaccgatgtcggtggcggcgcatctatcatgggcaccctgtccggcggcggccagcacgtcatctcgctgggcaagcgctgcctgctcggcgccaattccggctgcggcatcccgctgggcgacgactgcatcatcgaggccggcctctacatcactgcaggcaccaaagtgcttttcgacggctccctccacaaagcctccaccctcgcgggctcaaacggcctcatttttaggcgtgactccgtcagcggacaagttgtcgcagtgcccaataccaaagttgtcgaactcaacacagctttgcactccaac

SEQ ID NO: 1230 - DNA, 663 bp, Corynebacterium glutamicum
atgctcgatcgcctcgttgagatcgcgattcggcgcgaaacggaagttgaggttcatccacgcgaggtctggaatgacgttgtttgccacgcccgattcgcagaaaacgatgttgaggccttcacggtaggtcaagccatcaatgttgacttctgcggccttatacgcagcaaccttcgaaatgatcggcgacaacttatgcatcgcattatcacccaaccagcttctcgccgaatgggcacgcacaccatgcgccgtcaccttgatgcgcagattgccctggcagcccgcctcaatccagccgccagtaggctcacccaacaacgccaaatcagccgccaaccactccggatgctcatcgcgaatgtggcccaaaccattgaggtgatcagcaacttcctcgcactcatacgcaatcagcgtcagatcatgtttaagctcagtcgacgtggccaaggtggcaaaagtatgcaaatacaccgccaacccagatttcatatcgacggtgccacagccatacatgatgccgtcttccacacggcttggcagattgtccgcgatcggcactgtatcgatatgaccagcaagcatgaccctcgaggccaatcccctgttcgtgcgagcaagaacgttgttgttgaagcggaagacctctacaccagg

SEQ ID NO: 1231 - DNA, 768 bp, Corynebacterium glutamicum
atggctcctaaacaaactcccagcccagagaagaatcgaaacctggtgggaccagttctgcaacgtcggcagacagagggtacttttgatcaacgcttgctagaaatgcgcgctgatcacaattggaagcacgccgatccatggcgtgtactgcgtattcagtctgagtttgtggcgggttttgatgccctccacgagatgccaaaggccgtaaccgtctttggttccgcacgcattaaagaggatcacccgtactacaaggcgggtgtagaacttggtgaaaagctcgttgcagcggactacgcagttgtcaccggtggcggtccaggtctgatggaagcccccaataagggggcaagcgaggccaatggtttatcagttggtctgggcattgagttgccacatgaacagcatctgaacccttatgtggatttgggtctgaacttccggtacttcttcgcacgcaagaccatgttcctgaaatactcccaggcttttgtgtgtctgcctggtggtttcggcacgctcgatgagcttttcgaggtcctctgcatggtacaaaccggcaaggtaaccaactttcccatcgtgctgatcggcactgagttctgggcaggtttggtggattggatccgtcaccgcctggtagaggaaggcatgatcgatgagaaggatgttgaccggatgttggtcactgatgacctggatcaggccgtcaaattcatcgtcgatgcacacgctggattggacgtagcgcgtcgccacaat

SEQ ID NO: 1232 - DNA, 831 bp, Corynebacterium glutamicum
atgagttctttgccggtcatcatggccatcgtcaatcgcaccccggattctttctatgacaagggtgcgacatttgaggacaccgctgcgctaaacagggcagcggaggtcattgaacaaggcgccggcattgtcgatatcggtggggtgaaagccggcccgggggatttcgtgtcggcggaggaagagatcgaccgcgtggtgccaatcatcgctgcggtgcgagaacgttttcctgacattgatatttctgttgatacctggcgggcgtcggtggctgatgtcgcagtggcgcatggagcaacgctgatcaatgacacttgggccggccatgatcatgagttggtgcaggtagcagggcagcacaaggtgggttatgtctgctcgcacaccggcggggtgattccaagaacgcgaccatatcgggtgcatttcgatgacatcgtggccgatgtaattacggagaccaccaaattggcagagcaagctgttcgtgccggggtgccagaggaacgggtgtttattgatcccacccatgatttcgggaaaaacaccttccacggactggagcttttacgacggatcgatgaggtggttgccacgggctggccggtgctgatggccttgagtaataaggatttcattggggaaactttggaaaggggcgtcgataagcgtgttgctggcacgcttgctgccactgcctgggcggcggcgcgcggcgttgcggcttttcgcgtgcatgaagttgcggaaacctttgacgttttgcagatgacggcggcgattatgggcgatgtggcgccacttaacaccattcgggggcttgcg

SEQ ID NO: 1233 - DNA, 729 bp, Corynebacterium glutamicum
gtgagcagcgtaagcgtggtgattcctgcgctcaacgaagctccaaccgtggccaaagtcgtggaggcggtcctcgctgacaacccactggaagtgctggtcatcgacgccgattccaccgacgcaaccgccgccgaagcccgatccgccggtgcgacggtgctgaattggcgcgaaatccttgataccgaaccgattccaggcaagggcgaatcactctggcgaggtgttgcagcagcgcgcggagacatcgtcgtatttgtcgatgccgacctcaccagcttccgccccggcatggtgaacagccttgttgcccccttcctaaacgatgacattcacctggtcaaagccgattatgtgcgtacattcggtgatcatacaacagggggtggacgcgtcacggaactcaccgcaaaacccctcctccgcgcgcttttccccgagctaagccacatccgccagccgctcggaggcgagtacgcgatccgccgcagcaccgcgcttgccatgccttttgtgtccggctacggcgtcgaagtgggcttgcttatcgacgtcgccacccaatttggcacctcgtctatcgcccaagtagacctcggaagcagaagccacaaccatcaatctttggaagcgcttggctcgatggctgacgtggtggcaacaactattttgcagcgtttcggacatgatctcccggtcgtgcagcgtgaacccttgggtatccac

SEQ ID NO: 1234 - DNA, 306 bp, Corynebacterium glutamicum
atgctgacctggataatcatgatcattgtgttgatcgcgctcatcgtgattttcacctgggtgttcgccaaactttttggtcggggagaacaaacccaaccattgccggaaaacaatgagatcgttgagcacaaccggcaggcggtgggcgaggggaatatcgataagatcatgttcgataccgtgatcagaggctaccgccaagaccaagtcgatgatgtgatcgagcatctaaaatggcaggtagattctttaaatgctcagcttgagcaggctcaccttcgggcaaaaactttcgaaacgggc

SEQ ID NO: 1235 - DNA, 165 bp, Corynebacterium glutamicum
atggcagctatgaagcctaggaccggaagcggaccaatggaagcggttgaggaaagtcgcaagattgtcatgaggattccatcagacggcggcggacgtctcgttgtggaattgaataaggaagaagcagccgaacttggagctttgctgttggaggcagccaaa

SEQ ID NO: 1236 - DNA, 864 bp, Corynebacterium glutamicum
gtgctttcccacatcattgatgtcctcgccgacccgatcgatggcaccccacttgtaggcgccgaagatttctcacggttggtgtctgaatctgggcattcctacgatgttgctcgtcaagggtatgtcaccctggctggtggcgcaggtctgcgctattcaggcgatgatgcacagatgatcgcggatcgggaaaccttcctttctggcggtcacttcgcgcccttcgtggaagctgtcaccgagcatgttcaagatgtcgttgaccaggcaggccttagcgatgacgcacagccagtggtctgcgaaatcggcgcgggaaccggctactacttgtcccatacccttgattctgttgcaggatctcgcggaattggcattgacgtttccgtgcacgccgcaaagcgtttggcaaagtgtcaccctcgcgtcggcgcagtcatcgcggacgcatgggcacgcctgccgattgcagataactctgtcgatgccatcacggtgattttcgcaccacgcaacgctgcggaatttgcccgcattttgaagccaaagggacaggtcatcgtgcttaccgcagataccggccacttggctgagcttcgtgaaccactgggcatcattgatgtggaggccggcaaagttgatcgcatgatcgaacaagcggcaggccacctcaagccagttggcgaaagagacttggtggaatttgaaatgctgctggatcaaaaatccattgcatctcagatcggtatgagcccttctgcacgccacattaagcctgaggctttggcggaacgcatcgccgctctaccagaacaaatgaaggttacagcccgggccaagatcaccaggctggaacgcatc

SEQ ID NO: 1237 - DNA, 1494 bp, Corynebacterium glutamicum
atgacgaacgtttccgggtatcaccgaccagagctgcacatcaccgctgaaagtggtgttttgtttgcacctgcaggcgttctgttggatgacgacacgtggcatttcttccaccagtaccgtccctcaccagatcacggccccaggtgggcgcaccaattcgcagagcgcactccatttgtgtgggatatctgcgatgacgtgctagcccctgaaggcgatgaaacccaggttcgcgctggctcagtggtgtccaacaacggtggcgttgatctgtacttcacctcggttgttggccccacttccactatccagttggcacacatcaacaacatccgtggcaccaccgaactgatcaatgaggacgagctggggctcgatccagatgtctcccgaatcggcgaagtggttggcaacactgatggttatgtaaagttccgctcaccgtgcgttatcccaggttgggaagaccaaggaaaccgcgatgaaggccactcaggatggttgatgctcgcagttactggcccagttgaagccccaacagtagtggtcctcgactcgccagatggaagagaatggtccattacaggtcccctgtctctcaacggcctctctggattagagtcagacgaagttctagttgctcctcgcatgattcgtctgcgcgatgaagtggatcatgaaatctacgatgtcctcattgtcaccattgaacaagacgggattgacatttcgggatacctggtaggccagctcaacggctcagaattcgatgtgaagactccatttacccgcatcgattttggccatgatttctctcgcccccgcaacaccaactacgccgaaaccaccatcggctacgacttcgcccacatctttggtctcatgaatggcgtaggtcgtttggactcccccactgagcatctcagttggaaggaagaaggctgggcaaacgctatttctttcccacgtattgtcacgctccaggacggtacggtcttccagacccctccagaaggattgcttgatgccattcatgaatccgaggcagcggcaggttggaccggactgtgcgaaatcccatcaaacagcgcagttgaagtggcgttgaaggaccaagaaggtgaaatcgctgcaacaatcactcaccgccacaatcagctagtcgttgatcggtccatgaaccccaaccacgcgggtgatccacacgcgattgcaccattgactgatgatgaaacagattcactgttcattgtcgttgacggctctacagtagaagtttttgctgatggcggttatgtatcaatggcaagccgtgtgtatttcaacaacggaccattcagcgaatttgaggtcaccaccaccggtgacgcaagcattattcgccaggaaagtcacttccctgttgatttcagttcggtgtccctagatatagatgatctcactgcgctcatgcagttcgatgaaaacgaaccgcatgaaggcccagtgaga

SEQ ID NO: 1238 - DNA, 1227 bp, Corynebacterium glutamicum
atgcccccatttcggtatcgctgcgcaactgtttttagatggctaatctttgaaattatgagagtcggaatgatgacaagagagtatccaccagaggtttacggcggcgctggcgtgcacgtcaccgaattgacccgattcatgcgtgagatcgctgaagttgatgttcactgcatgggtgcacctcgcgatatggagggagttttcgtccacggcgtcgatcctgccttggaaagcgcgaaccctgcgattaagacactgtccaccggtttacgcatggcagaagctgcaaacaacgtggatgtcgtgcactcacacacttggtatgcaggtcttggcggccaccttgcagctcgtctccacggcattcctcacgtggctaccgcgcactctttggagccagatcgcccatggaagcgtgagcagcttggcggtggatacgacgtgtcctcctggtctgaaaaaaatgccatggaatacgctgacgcggtcatcgctgtgtcggctcgcatgaaagattccatcctcgctgcgtaccctcgcatcgagccggacaacgtgcgtgttgtcctcaacggcatcgacactgagttgtggcagcctcgcccgactttcgatgacgcggaagattccgtactccgctccctaggcgttgacccacagcggcccatcgtcgcatttgtcggccgcatcacccgccaaaaaggcgtcgagcacctcatcaaggcagcagcgcttttcgacgagtccgtgcagcttgtgctctgtgccggcgcgccagacacccccgaaatcgcagctcgcaccaccgccctggtggaagaactccaggcaaagcgcgaaggcattttctgggttcaggacatgctgggcaaggacaaaatccaagagattctcaccgctgctgacaccttcgtgtgcccatccatttacgagccactgggcatcgtgaacttggaagcaatggcctgcaacaccgcagttgtcgcatccgacgttggaggcatccctgaggttgttgtcgacggcaccaccggcgccctcgttcactacgacgaaaatgatgtcgaaaccttcgagcgcgatatcgccgaagcggtgaataaaatggtcgctgatcgagagaccgcagccaaatttggtctcgcagggcgcgaacgtgctatcaatgatttctcctgggcaacgattgctcagcagaccattgatgtgtacaaatccttgatg

SEQ ID NO: 1239 - DNA, 1215 bp, Corynebacterium glutamicum
gtgaagggtagaccaaatgttctagcaatcgttctcgcaggtggcgagggcaaacgactttttccgttgacggaggaccgagctaagcctgcggtcccattcggcggaacttacagattgatcgactttgttttgtcgaacctggtgaactccggattcctcaagatcgcggtactgactcagtacaagtcgcattcattggataggcatatttcattgtcgtggaacgtgtctggtccaacggggcagtacattgcttctgttcctgcgcagcagcgcctgggcaagcgatggttcactggttccgcggatgcaattttgcagtctctgaacttgatctctgatgagaaaccggattatgtcatcgttttcggcgcggaccacgtgtatcgcatggacccaagccagatgctagatgagcacattgcatctggtcgcgcggtgtctgtggcaggtattcgcgttccacgtgaggaagcaactgcgtttggttgcatccagtccgatgtcgacggcaacataaccgagttcttggaaaagccagctgaccctccgggaacccctgatgatcctgacatgacttacgcgtcgatgggtaactacattttcaccactgaagccctgatccaggcgctgaaagatgatgaaaataacgagaacagtgatcatgacatgggcggagacatcattccgtacttcgtctctcgcaatgatgcgcatgtttatgatttctccggaaacattgttcctggcgcaactgagcgtgacaagggctactggcgcgacgtcggtaccattgatgcgttctacgagtgccacatggacctgatttccgtgcacccaatcttcaatctgtataactctgagtggccaatccacacgacctctgaaggtaacttgcctccggctaagttcgttcggggcggtatcgcgcagtcgtcgatggtgtcttcaggttccatcatttctgctgggactgttcgcaactccgtgctgtccaacaacgttgtcgtcgaagagggcgcaacggtggaaggtgcagtgctgatgccaggcgtgcgcatcggtaagggtgctgttgtccgccatgcgattctggacaagaacgtggttgtccgcgacggagagctcatcggtgtcgaccaagtgcgcgatgcgcagcgcttcaaggtgagcgccggcggcgtcgtggttgtcggtaagaaccaggtagtc

SEQ ID NO: 1240 - DNA, 639 bp, Corynebacterium glutamicum
gtgagtaacgccttcgagtatcttcgcacttatgtcgagtccactactgaaaccgacgctgctgtagcgcgcgctcgtgaagacgccgccgagttcggtctccccgccccggatgaaatgactggccagctgctaaccactttggctgccaccaccaatggcaacggctccactggtgccatcgcgattaccccggctgccgggttggtgggtctgtatatcctgaacggactggccgataacaccacactgacctgcattgatcctgaatcagagcatcagcgccaggccaaagcactcttccgcgaggccggctattcccccagccgcgtacgcttcttgctctcgcgcccgctcgacgtgatgagtcgccttgccaacgacagctatcagcttgtcttcggccaagtctcccccatggatttaaaggcgcttgtcgacgccgcctggccgcttcttcgacgaggcggtgcgctggtgctcgccgatgcgctccttgacggcaccattgcggatcaaacccgcaaggatcgtgacacccaagcagcacgtgacgccgatgaatatattcgttccattgaaggcgcacacgttgctcgcctgccccttggtgcaggcttaaccgtggtgactaaagcc

SEQ ID NO: 1241 - DNA, 639 bp, Corynebacterium glutamicum
atgaaaaagaagtcccgagatgacgcacccgtcgtaatcgaaaccgttcaagcagaacatgctgaagaactcacgggcactgcagcattcgatgctggacaggcagacatgccaacatggggcgagctagtcgcagaacatgcagatagcgtttaccgcctcgcgtaccgtctttccggcaaccagcacgatgctgaagacctgacccaagaaacattcatgcgtgtcttccgctcgttgaagagctaccagccaggcacctttgagggctggctgcaccgcatcaccaccaacttgttccttgatatggttcgccaccgcggcaagatccgcatggaggcgctgcctgaagattatgagcgcgttccgggcaatgacatcaccccagagcaggcatacaccgaagctaaccttgacccagctctgcaggcagccctcgatgagttgagcccagacttccgcgtggcagtgatcctctgtgatgttgttggtatgagctatgacgaaatcgcagagaccctcggagtgaaaatgggtaccgtgcgttcccgtattcaccgtggacgcagccagcttcgtgcaagtttggaagctgcagcaatgaccagcgaggaagtttctttgttggttccaacccac

SEQ ID NO: 1242 - DNA, 492 bp, Corynebacterium glutamicum
atgttcaattccgacaccaccgcgaatctccaagctaaaagtcgagatcgtgcaggatctaaagcaaagcgcagcaggccaagttttgattcagtagcgcgggatgttttggatgttcgaacaaaaacagcacaagttaaaaacaaggctaaagagttttcctctgttgatcacctttcagcagacgccgcagccatgtttgtagacaatgaactgtcccgtggcgccatgcatcgcgccaggctgcacattgtgcactgcgctgaatgtagggaagagattaaccgtcagcgggaaaccgttgattatctccgctcagagtgcaaaaacgaagaagtgtccgccccaatggacctcaaagcacggcttgccagcctcgccactgagtgcatgcctggccctggcgcagagaatttagcaatgcagcgcccagagtcttttgtggctaaagttgagtccgtagtgcgcgcagttcgtaagaaccaaggccgc

SEQ ID NO: 1243 - DNA, 468 bp, Corynebacterium glutamicum
atgttttctagcgtgggttggggagagatcttcctcttagtcgttgtgggccttgttgtcatcggcccggaacggttgcctcgtttgatccaggacgcacgcgctgcgctgctcgctgcacgtaccgctatcgacaatgcaaagcagtcgttggacagtgattttggttcggaatttgatgaaatccgaaagccactaacccaggttgcacagtacagccggatgagccccaagacggccatcactaaggcgttatttgataatgattcctcgttcctggatgactttgatccaaagaagatcatggccgaaggaacagaaggcgaagctcagcgcaacaagcaggcagctgacaacaatgcgaatgtggtggaacgtccagctgatggttccaccgcacgcccaacgcaaaacgatccaaaagacggcccgaattactcaggtggcgtctcttggaccgatattatt

SEQ ID NO: 1244 - DNA, 1125 bp, Corynebacterium glutamicum
gtgatgactcaagtaaccgaatccgctgtccgcagcgcgctatcccgcgtagaggatccagagatcggtaagcccatcacagagctcggcatggtcaaatcagtgtccatcgacggctctgatgtccaggtggaggtctacctgacgatcgcggcttgcccgatgaaaaccaccattgtcaccaacactgaagcagctctcaaagacatcgacggggttggccaagttcatgtcaccaccgatgtcatgagtgatgaacagcgccgtgcgctccgcgtctccctgcgcggtgaaacttctgagccagtgattccattcgctcagcctggttccactacccgcgtttacgctgttgcttccggcaaaggtggcgtaggaaaatcctccatgacggtgaacttggctgcagccctagccaagcgcgggctgtctgtgggaattttggatgccgatatttacggacactcagtgcccggaatgctcggctcggaccaacgcccacaccaggtcgatgacatgatcatgcctccccaggcgcacggcgtgaagatgatatccattgctcacttcaccgaaggaaatgctcctgtggtgtggcgtggaccaatgctgcaccgtgccatccagcaattcctcactgacgtgttctggggcgacctggatattttgctgctggatcttcctccaggaactggtgacatcgccatcaccgttgcccaattgatcccgaatgctgagttgctcattgtgaccactcctcaggctgccgcagctgaggttgccgagcgagcaggaacgatctctgtgcagaccaaccagaaggttgctggcgtgattgaaaacatgtctgccatggtgcttcctgatggcaccaccatggatgttttcggcaccggcggcggtcaaaagattgctgatcgtcttaccgctgtgacaggtgaagaggtcaaggttatcggatctgttccattggatccgaacctgcgtatcggtggcgatgtgggaaatcctattgcgatttctgaaccacactccccaaccgctgcagcgatcaatgagatcgctgaacacctagctcaccgcaaggtatcgctggtgggtaaaacgcttgggcttggcgttaaa

SEQ ID NO: 1245 - DNA, 579 bp, Corynebacterium glutamicum
atggctgatttcaaccgctctgaattagacagcccactttttggatcccgcaaacgatttaaattcgacgatgacaccattggtgcctacgccgaaaaagtagcccggttctttggcacgggacagtacctgttttggcaaaccattttcgtggtggtgtggattttcctcaacatcggtggttgggcctggagttgggacccctaccctttcatcctgctcaacctggcattctccacgcaggctgcttatgctgctccgctgatcctgttggcgcaaaaccgtcaagaagaccgcgataagcacaccattttggcggatcgtcggcgtgctgaagagacaaaagccgatactgaattcctcgcacgggaactcgcaggcgttcgcttagccttgggagatactgtcacacgtgactatttgcgccatgagttagaagatctccgcggacttcttgaccgcattgaagccaagctcgacgacgaggcagcgtcccgtattgcagaccgccacgaacagcacggatcaggacctcaagatttgtctgaccccactcagggtgatgttgcagacgaattt

SEQ ID NO: 1246 - DNA, 1290 bp, Corynebacterium glutamicum
atgagtggaatttcccgactttacgtgggccgcctcgctgggatggtggtccgaggccccgatacggatgctattggtcgcgtccgcgatgtcgtggtgaatattcgcccttatgggcatgattcccgcgcattgggattagtggttgagctagttaataataaacgccgtatttttgtccccatgttgcgtatcgctgccattgaaccgaaagacattactttggttaccggttctgtatcacttcgaacctttcgcgtgcgcaccggtgaattgcaggtcatgggcgatattgtgggtgcaaaagtacataccgatgatccagagctgcaacaattccacggtcgcgcggtagaaatcgccgatgtggagctggagttatcgcgcactcgcgattggatcatcacgcgcgtggcggtgctgggtgagcgccctaaatttggccggcgcccagtgctgcacacagtgccgtggagtcatatccacggcatcaccgcaggtggtgtcggcgagtccaatcacaccgccgaactcatcgcagggtttgaggatatgaggcctgcggacgtcgcaaagcagctttatcagctgcctacggctcagcgtaccgaagtgacggaagagcttgacgacgaaaagctggcggatatcctgcaggaattgtccgaggaccgccaagccgagttgattgaagaattagacatcgaacgtgccgcggacattctggaggaaatggatccagatgatgctgcagacttgttgggtgagctgcctgatgacaaagctgatgtgttgttggatctgatggaccctgaggaatctgcgccggtgcgtcgtttgatggatttctccccggacaccgttggtgcgctgatgactcctgagccattaattatggatccttccaccacagtcgctgaagcgttggcgatggccagaaaccccgaccttcctacttctttggcatcgttgatctttgtggtgcgcccacccacggccacgcctactggaaaatacctcggctgcgtgcatctgcagaaactgcttcgggagcctccatcaagtttgattggtggcatcctcgaccccgatctgccaccgctctacgctgatgattctcaagaaaccgcagctcgattctttgccacctacaacttggtgtgcggccccgtcttggatgaaaaccgccatctgcttggtgccgtagctgtcgatgacttgctcgaccacatgctgccagaagactggcgcgacgccggaatccgaccaggaaaggagcacacccatggc

SEQ ID NO: 1247 - DNA, 516 bp, Corynebacterium glutamicum
gtgaaaaggaagatgataaagatgactcaaccacggcccgatgccgcatctgtgtcgctggaaaagaagcgcccagaaggatggccagtgggaagctttgaaacatacccagaagcccaagcagcagtggatttgctcagtgataatgcattccccgtcaccgaattgaccattgttggtgtggacctgattgaagtggaacgcgttacaggtcgtctcacgtggggtcgtgtgattgccggaggaatggcatctggcgcatggttgggtctgttctttggcattgtcatggccttgatgtctggattctggttctcttccatcgcagcgggaataggtatgggtttggtgtttggcattgtcggtgcagcagttccttatgctgcttccaaaggcaagcgggactttacctcttcaactcaaattgtggcggggcgctatgatgtgatttgttccccagaacgtgctcgggaagctcgagacatgattgccctgaaaactcgagatctccgccaa

SEQ ID NO: 1248 - DNA, 666 bp, Corynebacterium glutamicum
atgaaaaatgtggggaagcggattttagtccttgcgcttggtgcctcggtagcgggatgctcaacgctttcccaagaaccttcaccacctgttccgttgggaaacgttgatactgtgcagattgtctctcccaatggggagattgagtcttttgtgctggggaagctgtatgagaccgcattagtggaacgtggcagatctgcatcagttcagctgattgacggcgacttggatgagcaactatctatgctgcgagatgacagcactgatttggtgattgcttgctcaggacaattactggaatattacaacccagatttagcctccgagtttgccgtcgaatacgctaatcagacagcctttgataaaaactctggtgaatggcgcgaaaaagtctacgatgctctccaaggatcgctgccggactccatcgtggccaccgatccttccaatgctattggttgtaaggacgatacgtcgctgcctcaaaacatcgtgccaatttatagaaagcccaatctggatagggacaatcgggacaccctgaactttgtgagcggttctttgggtacaagcgatttggaagcattggtcaaggacgcccaaacaacaggcacaacctctgaaactgcgctggatttcttattgtctaaaggattttcacgc

SEQ ID NO: 1249 - DNA, 594 bp, Corynebacterium glutamicum
atgccgtgtgaatcacacagcatacggccctttttgctgccgtggttgcctaaggtggaaggtatgaaacgaatctgtgcggtcgcgatctcttcagtacttttgttaagtggctgctcctccacttccacaacgcagctcgagggattcgatggacgctcagcgcaggagatcatcacagaacttgatcaaaccccagtcgcagacagagcaactaacctcatggcctccattcgggcagatgagttaattctgtcggatcaaagcggacagctcagcattgacatgcctgcagatgagttctatatctccgcagccccgtacaccaccacaacccacgagtgcttctatcacagcctcaccacatgtactggtgaactcgccaacaccccagtgaaagtaacggtggtggcagataatggagaaaccatcctcgaagaggacaccatcacctacgataatggatttgttgggatgtggctcccccgcaacattgatgccacactcaccatcgaacatgacggcctgaaatccacccagccgatctctacgggtgatgacgcccccacgtgcatcaccacggctgaactagcg

SEQ ID NO: 1250 - DNA, 3771 bp, Corynebacterium glutamicum
atgctacaactggggcttaggcataatcagccaacgaccaacgttacagtggataaaacaaagctcaataaaccctcaagaagcaaggaaaagaggcgagtacctgccgtgagcagcgctagtactttcggccagaatgcgtggctggtagacgagatgttccagcagttccagaaggaccccaagtccgtggacaaggaatggagagaactctttgaggcgcaggggggaccaaatactacccccgctacaacagaagcacagccttcagcgcccaaggagtctgcgaaaccagcaccaaaggctgcccctgcagccaaggcagcaccgcgcgtagaaaccaagccggccgacaagaccgcccctaaggccaaggagtcctcagtgccacagcaacctaagcttccggagccaggacaaaccccaatcaggggtattttcaagtccatcgcgaagaacatggatatctccctggaaatcccaaccgcaacctcggttcgcgatatgccagctcgcctcatgttcgaaaaccgcgcgatggtcaacgatcagctcaagcgcacccgcggtggcaagatctccttcacccacatcattggctacgccatggtgaaggcagtcatggctcacccggacatgaacaactcctacgacgtcatcgacggcaagccaaccctgatcgtgcctgagcacatcaacctgggccttgctatcgaccttcctcagaaggacggctcccgcgcacttgtcgtagcagccatcaaggaaaccgagaagatgaacttctccgagttcctcgcagcctacgaagacatcgtggcacgctcccgcaagggcaagctcaccatggatgactaccagggcgttaccgtttccttgaccaacccaggtggcatcggtacccgccactctgttccacgtctaaccaagggccagggcaccatcatcggtgtcggttccatggattacccagcagagttccagggcgcttcagaagaccgccttgcagagctcggcgttggcaaacttgtcaccatcacctccacctacgatcaccgcgtgatccagggtgctgtgtccggtgaattcctgcgcaccatgtctcgcctgctcaccgatgattccttctgggatgagatcttcgacgcaatgaacgttccttacaccccaatgcgttgggcacaggacgttccaaacaccggtgttgataagaacacccgcgtcatgcagctcattgaggcataccgctcccgtggacacctcatcgctgacaccaacccactttcatgggttcagcctggcatgccagttccagaccaccgcgacctcgacatcgagacccacaacctgaccatctgggatctggaccgtaccttcaacgtcggtggcttcggcggcaaggagaccatgaccctgcgcgaggtactgtcccgcctccgcgctgcgtacaccctcaaggtcggctccgaatacacccacatcctggaccgcgacgagcgcacctggctgcaggaccgcctcgaggccggaatgccaaagccaacccaggcagagcagaagtacatcctgcagaagctgaacgccgcggaggctttcgagaacttcctgcagaccaagtacgtcggccagaagcgcttctccctcgaaggtgcagaagcacttatcccactgatggactccgccatcgacaccgccgcaggccaaggcctcgacgaagttgtcatcggtatgccacaccgtggtcgcctcaacgtgctgttcaacatcgtgggcaagccactggcatccatcttcaacgagtttgaaggccaaatggagcagggccagatcggtggctccggtgacgtgaagtaccacctcggttccgaaggccagcacctgcagatgttcggcgacggcgagatcaaggtctccctgactgctaacccgtcccacctggaagctgttaacccagtgatggaaggtatcgtccgcgcaaagcaggactacctggacaagggcgtagacggcaagactgttgtgccactgctgctccacggtgacgctgcattcgcaggcctgggcatcgtgccagaaaccatcaacctggctaagctgcgtggctacgacgtcggcggcaccatccacatcgtggtgaacaaccagatcggcttcaccaccaccccagactccagccgctccatgcactacgcaaccgactacgccaaggcattcggctgcccagtcttccacgtcaacggcgacgacccagaggcagttgtctgggttggccagctggccaccgagtaccgtcgtcgcttcggcaaggacgtcttcatcgacctcgtctgctaccgcctccgcggccacaacgaagctgatgatccttccatgacccagccaaagatgtatgagctcatcaccggccgcgagaccgttcgtgctcagtacaccgaagacctgctcggacgtggagacctctccaacgaagatgcagaagcagtcgtccgcgacttccacgaccagatggaatctgtgttcaacgaagtcaaggaaggcggcaagaagcaggctgaggcacagaccggcatcaccggctcccagaagcttccacacggccttgagaccaacatctcccgtgaagagctcctggaactgggacaggctttcgccaacaccccagaaggcttcaactaccacccacgtgtggctcccgttgctaagaagcgcgtctcctctgtcaccgaaggtggcatcgactgggcatggggcgagctcctcgccttcggttccctggctaactccggccgcttggttcgccttgcaggtgaagattcccgccgcggtaccttcacccagcgccacgcagttgccatcgacccagcgaccgctgaagagttcaacccactccacgagcttgcacagtccaagggcaacaacggtaagttcctggtctacaactccgcactgaccgagtacgcaggcatgggcttcgagtacggctactccgtaggaaacgaagactccatcgttgcatgggaagcacagttcggcgacttcgccaacggcgctcagaccatcatcgatgagtacgtctcctcaggcgaagctaagtggggccagacctccaagctgatccttctgctgcctcacggctacgaaggccagggcccagaccactcttccgcacgtatcgagcgcttcctgcagctgtgcgctgagggttccatgactgttgctcagccatccaccccagcaaaccacttccacctactgcgtcgtcacgctctgtccgacctgaagcgtccactggttatcttcaccccgaagtccatgctgcgtaacaaggctgctgcctccgcaccagaagacttcactgaggtcaccaagttccagtccgtgatcaacgatccaaacgttgcagatgcagccaaggtgaagaaggtcatgctggtctccggcaagctgtactacgaattggcaaagcgcaaggagaaggacggacgcgacgacatcgcgatcgttcgtatcgaaatgctccacccaattccgttcaaccgcatctccgaggctcttgccggctaccctaacgctgaggaagtcctcttcgttcaggatgagccagcaaaccagggcccatggccgttctaccaggagcacctcccagagctgatcccgaacatgccaaagatgcgccgcgtttcccgccgcgctcagtcctccaccgcaactggtgttgccaaggtgcaccagctggaggagaagcagcttatcgacgaggctttcgaggct

SEQ ID NO: 1251 - DNA, 3741 bp, Corynebacterium glutamicum
atgaaaactgagcaatcccaaaaagcacaattagcccctaagaaagcacctgaaaagccacaacgcatccgccaacttatttccgtggcgtggcagcgaccttggctcacctcattcaccgtaatcagcgctttagctgcaacgttgtttgaacttacacttcctcttttgaccggtggcgccatcgatatcgcgctcggaaataccggagatactttaaccactgacctgctggaccggttcactccgagtggattaagcgtgttgaccagcgtcattgcccttatcgtgcttctcgcgttgcttcgctatgccagtcaatttggacggcgatacaccgcaggcaagctcagcatgggggtacagcatgatgtccggcttaaaacgatgcgctcattgcagaacctcgatgggccaggtcaggactctattcgcacaggccaagtagtcagtcggtccatttcggatatcaacatggtgcaaagccttgtggcgatgttgccgatgttgatcggaaatgtggtcaagcttgtgctcactttggtgatcatgctggctatttccccgccgctgaccatcatcgctgcagtgttggtgcctttgctgttgtgggccgtggcctattcgcgaaaagcgctttttgcgtccacgtggtcggcccagcaaaaggctgcggatctgaccactcatgtggaagaaactgtcacgggtatccgcgtggtcaaggcatttgcgcaggaagaccgcgagaccgacaaattggatctcaccgcacgtgagttatttgcccagcgcatgcgcactgcacgtctgacggcaaagttcatccccatggttgagcagcttccgcagcttgctttggtggtcaacattgttggcggtggctatttggccatgactggtcacatcacggtgggcacgtttgtggcgttttcttcctatctcactagcttgtcggcggtggctaggtccctgtcgggcatgctcatgcgcgtgcagttggcgctgtcttctgtggagcgcatctttgaagtcattgatcttcagcctgaacgcaccgatcctgcacaccccctgtcacttcccgacactcccctgggtctgtcgttcaacaacgtagatttccgtgggattctcaacggttttgagctgggtgttcaggccggtgaaaccgttgtgttggtgggccctccaggttcaggcaagaccatggctgtgcagcttgctggaaacttttatcaaccagacagcggccacatcgcctttgatagcaacggccatcgcactcgcttcgacgacctcacccacagcgatatccgcaggaatctcatcgcggtttttgatgagccgttcttgtactcctcctccatccgcgagaacatctcgatgggtttggatgtcagtgatgagcagatcgaacacgcagccaggcttgcccaggctcatgattttatcgatcgccttccaaacaaatacgaggaagtcattggcgaacgcggcctgacgctttctggtggtcaacgccaacgcatcgccctcgcacgggctttcctggcgcatcccaaagtgttggtgcttgatgatgccacctctgccattgatgcctccactgaggaccgcattttccaggccttgcgcgaagaactgcacgatgtcaccattttgatcatcgcgcaccgccactccactttggagctcggcgatcgggttggtctggtcgaagatggacgggtaacagcactgggaccgttgagtgagatgcgtgatcacgctcgtttctcgcatctgatggctcttgatttccaggattctcacgatccggaattcaccctcgacaacggttcactacccagccaagagcaattgtggccggaggtctccacagaaaagcagtacaagattcttgcgcctgcccctggtcgaggccgtggcatgtccatgccagcaacccctgagctgctcgcccagattgaggcgctgccagcagcaacggaagaaacacgagttgatgccgggaggctacgcaccagtacctccggtttcaaattgctcagtttattcaagcaggtccgttggctcgtcgtcgcggtcatcgcgttgttgctggtgggcgtagccgccgatctagcatttccaacactgatgcgcgcagccatcgacaacggtgtgcaagcacaaagcacctccacgttgtggtggatcgccatcgcaggcagcgtagtagtccttctgtcctgggccgccgccgcgatcaacacgattatcacggcacgcaccggtgaacggctgctttacggcttgcgtctgcgctcatttgtgcatctattgcgcctgtccatgagctatttcgaacgcaccatgtccggccgcatcatgacgcgcatgaccaccgacatcgacaacctctcgtccttcctccaatcaggtctggcgcaaacagttgtctctgtgggcacgctcatcggtgtggtcaccatgctcgccatcaccgacgcacaactagcactcgttgcgctgtccgtggtgccgatcatcatcgtgctcactctcattttccgacgcatcagctccaggctgtacaccgcttcacgcgagcaagccagccaggtcaacgcggtattccacgagtccatcgccggtttacgcaccgcgcagatgcaccgcatggaagaccaagtctttgacaattatgcgggcgaagcagaggaattccgacgcctgcgtgtgaaatcccagacggccatcgccatctacttccccggccttggcgcgctctctgaaatcgcccaggcactcgtcctcggtttcggcgcactgcaagtaacgcgcggcgacatctccaccggcgtactcgtggcattcgtgctgtacatgggcctgatgttcggccccatccaacaactaagccaaatcttcgactcctaccaacaagccgccgtcggcttccgtcgcatcaccgaactgctcgcaacgcagcccagcgtcccagatctgggcaccaacaggcacgctaggcaggctgccacgcagcctttattgcttgacgacgtcaccttcggctattcagacgatccgatcctagacaacgtcaccgtccagatcgaaccgggaaccaccgtcgctgtggtgggaccaaccggcgctggaaaatccaccgtggtgaaactcctttcccgcctctacgaccccaatgaaggtgccgtgaaagctggcgagatcgatatcaaggacttccccaccgctgattggcgccgcacaatcggtaccgtgccacaagaagcacacttgtttagtggaagcatcgccgacaacattggctacggatgcagggaggcgtcgacaagcaaaatcgaagcggcagcacgccgcgtcggagccttaaacgccatcgccgccatccctgatggtttcaaccatcaagtcggtgaacgcgggcgcaacctgtcatccggacagcgccaactgatcgcgctggcgcgcgccgaacttatcgagccttccatcatgcttctcgacgaagccacctccaccctcgaccccgccaccgaagccgttatcctcaacgcctccgatcgagtcactaagggacgcaccagcatcatcgtcgcgcaccgcttggcaaccgctaaaagggccgaccgtattcttgttgttgaacaaggacgtatcattgaggacggatctcacgacgcgttgttgtctgctaacggcacctacgcccgcatgtggcatttaatggcc

SEQ ID NO: 1252 - DNA, 717 bp, Corynebacterium glutamicum
atggctgaacacaacgccatcatcacggatgcagtacattccgaccccgctgttttagaagacaacgccgggttcagcggaaagtacctaatccgtgccctggacaaggcagctcatatgcaaacaggtgccatcgagggatacatttcttggcttcggaagcacaatcctgagaaaacaccggcgcagctgcaggtactcgtcgacaagcattttatgcgccttgccaccggctctggcgctggtgtgggcatggctgcggccgtgccaggcattggctttgtcacgggtgctcttgccgttggtgctgaatcgttggtgtttttggatgctgctgcgttttacaccatggcatccgcgcacctgcgtggcatcgacatccgccatcctgaacgccgacgtggtttgattttggtggttctgctgggcaccgcaggcaaagccattgttgacgcaggcgtcggtgatttatccaagaaaaaccacgcgccgggcattgcgatttcccggtttaatatcggtggcttgatggaagtcaacggccgactgatgcgctacgcagtgaaggaagtaagcaagcgtttccgttcggcattgattggcaaaattctgccgtttggtatcggtgcggtgctgggcacgatggccaaccgcaaaattgccaagaggactgtcggaaacgcatacgactctcttggtcctctccccacccatttt

SEQ ID NO: 1253 - DNA, 804 bp, Corynebacterium glutamicum
atggtcaactacgtcgacagggaaacaaccctgtgcatctctctcgctgctcgtccatccaaccatggtgttcgtttccacaactggctttacgctgaacttggattgaactacctgtacaaggctgttgccccagcagatatcaccgctgcagtcgcaggtatccgtggtctgaacattcgcggcgcaggtgtctccatgccatacaagagcgatgtcatcccactcatcgatgagttgcatccttccgcagagcgcatacgttctgttaacaccatcgtcaacaatgacggacaccttgtcggatacaacaccgactacactgcggtgtaccacctccttgaagaacaccgcgtgaaccccaatgcacgagtagctatcaagggatccggcggcatggccaatgctgttgttgcagctcttgctgagtatggtctgagtggcaccgtcgttgcccgcaaccacaccaccggttctgcgctagcttcccgttacggttgggaatactccgcaactgttccggaagacgcaaaaattttggttaatgtaaccccaatgggaatgaatggacctgaccaagacgttgtatcttttggtgaggatgaagtagaccgagccgacgtaatctttgactgcgtagcattccccgtcgagaccccactgattaagttggccaaggaaaagggtaagcaaaccatcgacggcggagaagttgccgctcttcaggcagcagagcagttccacctctacaccggagttcttccaaccaacgaccagatcattgctgcggaggagttctccaag

SEQ ID NO: 1254 - DNA, 1611 bp, Corynebacterium glutamicum
ttggcggatgagatggtggttcccacctcaacagggtttgttaaaggcgtcaaaggaccagggcttaaaacctggaggggaattccctacggccgaaacactggcggaaaatatcgcttccgggcaccccggcccgccaagaaatgggacggcgtgcgcgattgctcaatgttcggtgaagtagcttctcagccaacgtactcctggacagataagattcgcggttcagaagactgccttaacctcgatgtcgtgcggcctgattccgaagaaaagcttcctgttgtggtgtatctccacggcggttccttcatcatgggctcatcaagcgaaaaagcgctgcgcggatataacctcgtcacaaacatgaatgtggtctacgtgtccgttaatttccgcctcggcgctttgggctatctagatctgcgttccgtgggggaggattgcgtagccaaccccgcgctccacgatcagctcctggccctgcagtgggtcagccgtaatatcgaagcattcggtggggatcctgacaacgtcaccctcatgggcgaatccgcgggcgctgcagcagtggttgcactcatgtgtgtgcccgctgcaggaggactattccaccgcgccatcgcccaatccgcgccggtcatctctgtgcactcatctacccaagcaaaattctgggcacgtgaactgatctaccgcatggcattgcccagggaaaccaccttggatgaactgcgccaagaatccgccgatgatctagtgcgcgccgggcagtcgatgatgtggcgctccggcgaactgctccaactcaactcttgttacgggcccacggtggatggttccttgctacctgagcacccgctcaccatgtttgaacagggaagacaacaccgcattcccttcatgatcggtactaataacggagaaacttctttctccaaagccttttatttaagaagctctgcccgacgtcgctctgccttacgcatgctgtctgtgtatgatccccacaatgcagaacgcgtggttagcgcctatggcggaggcgaggcacgcacagacttttctgaactactcgctgacgcgctgttctgggcaccgtcggttagattggcgcagtcgcacgcctcccaagatgaagatacctggatgtaccgcttcgattacgccccacaatccatgcggaaacttggcctcggcgcgattcactctttcgaactcaacgctgtctttggcgatcatgaatcttctcgctccatgaaccttgcgaaaattgccggcggcatggatcatttggataaagtcaccgaacttgtccaagagcattggaagcaattcatctacttcggcaggcccggtgaagagtggaaggcttaccgcggccgcagcgataccgaaccgggccgtgctacatttgtcatcgatatcaactcccgaatcgcgtgggatccacgccaggacaaacgcacggcgtgggaaaattacgacatgctcgaatggggcacaggccgcccagatctagccaacgaacttgatttcatcgagccggaagagacagaagaagagcagcaattgaagtggcttagccttatgcagttttttggaagtaga

SEQ ID NO: 1255 - DNA, 651 bp, Corynebacterium glutamicum
atgagcatctggaaacgtctgttagtgcagtacccgcgcttcgccgacaccctcacagccggccaacccatcacgctcgaggaattagcaaccccggaagtgatcttggaagctgttgccaaaggccaagaaattttcggcattgagcagccaaaacatgcagcacaactctggtttcactccctgtgcaccgcaattgtcggccccgccgtcaccgccatggtggaattcgatgtcatccccagcctcgacatacgtcgaggtcagctgcataacatcgacggttactggttcggcttcaggccggaggagatgcttgtcgacgcctccctccacctgtcgggcacccaattcggcgagagtatccgcgtggtgattgatgcattatgcgctgccacggatctgcgaccggcacccctgtgggcggttgcctcagatgcgttgggaatcgcagctagcggcgcaggtgtcgaggcctttgaagaagaacatgcccgcgaggtggcggaagccctcattgaaggaatgaatagtgtgaactcagttccatcgccgcggtttaacgacgacgattatttcattcgagctggatgctgcatgattttccactcaccacgagctgatttttgcacgtcgtgcccacagaagagg

SEQ ID NO: 1256 - DNA, 876 bp, Corynebacterium glutamicum
ttgtggacgctaggcttgtcggcagtgtctttgggggacgtccccagcacaaaccagatggaaggtcatcagaacatgagcttttttgaggacatcgcggctggacttgatagtgacggtatcgagtcccgcgtaaacggcgacacaatgttcgttccgatcacctctgacttggaaatccagttcgtggagatcgattccctcctacctgcagcaaacgtttatatcgctgcagccaatgttgatgaagacgatgatgagttcgaggcagttctcgtttcggtggtgttctctgttgaggatgctgtcgctgctgtcgcaaagcatgttgctactgatcaggtggtgactgtgctgcgtgatctacttgaaggaactgatgaacgcatccaggatttggagtttttccaggatgcagtgaatgcaaatttggttcgtgcggaagtcggccagaattctgagcttcaggttttggtcgaggttgaagacggcgtcccaaccgcaacggtcaatttcatcgcgatcggtgagtcctttgaagatctgattgatcaggccattgaagaattgtgggaatccgacggcgacgcagttctatcggatgaagatcgccaacgcatgttcgctgatttgacctccgagttggaatttgtcactgatgaagtcctcgacttgggtaccttcactgattttgatcgacttttcgatatcctttccctcgccgatgaccaggctgaggattgggaagcacagctcgttccttttgaggacgaggaatttgatgagccggatgtttatgaccttttcgtcgatgactctgaagaagatgacgacgacctcgatgatgacgaggacgatgaggatgatgacgaagac

SEQ ID NO: 1257 - DNA, 525 bp, Corynebacterium glutamicum
atgtcgcttgggtgctctacacttcccactatgatcaaacaccgaaaccgcctaatgtcttccatctactccgcaactcgctacgccgcccacttcaaaagcgtcttccccaccgccctggatgacattcaatccatgatgcgccaccctcgatcactggccagagccatacccacgtggcgcccgccgagcatcccgctaccgtcacttcccggcgaagatcccctcaccctcaccttgtcacgtcaccgcgcaggccccgccgcccgccaaatcatccgcgagttcggtgagcaacgtgaacccgcctatctcatcaccatccgcatcaccagcccagagggcttcaaagtatccacccgcctcgccgaaggctggatccgcgcaattctcagcaccgcgcacagcggcactgtccaccagctcaccgatgagccggcaccgacgttttgctggcttgtcgacgcccactttgatccggtgcgttccccttccttccttttcgaatattccaaaagtgcagcc

SEQ ID NO: 1258 - DNA, 1215 bp, Corynebacterium glutamicum
atgttaactcaaaaaatagaattagaggctaaaccaaaaatcccagaggagatctgggtgctggttgtggctgcgtttattattgcgctgggctatggcctgattgcgccgattttgccacagtttgtggtcggttttgatgtaagttttgcagctgccagtgcggtggtgtccatctttgcgggcgcccggttgttgtttgcgccgatgtcggggagtttgatcgataagatcggttcccgtcgtgtgtatctcactggtttactcaccgtggctatcaccacggggcttgttgcgttggcgcaggaatactggcagattctgctgcttcgtggcatcgcaggtattggttccaccatgtttacggtctctgccatgggcctgatcgtgaagatggcgccggtggagatccgcgggcggtgttcgtcggtatatgccagttcgttcctgtttggcaatattattggcccggttgtgggtgctgcgatgtccggtttgggcatgcggtggccgttcgcgatttatggtgcttccgttggcttagctgcacttgttgtgtggtggcggatgccgaaaaccaacgattcacttcggaaggctgatagcaatagtgtgccggcgttgcgctttgctgaggcaattaaggattctgcctaccgctcggcgttgtttagtgcttttgccaatggttggtcgaactttggtgtgcgtgtggcggttcttccactgtttgccgcagctgcatttagcaatggcggagctattgcgggttttgccatggctgcgttcgccgctggaaatgctttgtgtctgcaattcgcgggcgatctctcagatcgcattggccgtaaaccgatgattatttccgggctgatcgtcaatgcagtgttcacggcaatgatcggattcggcacagaagtgtggatcctgatcacggtatctgcgttggcaggtgctggtgcgggcttgcttaatccaagtcagcaggcggtgctcgctgatgttatagattcccgccccggcggaaaagtcttagcgaatttccaaatggcgcaggatttcggtgcgattgttggcccgattctcgtaggcatgatcgcagaacaggcaggcttccaaatcggattcatgctgtgtggtgtgatcagtttgctggctgcggtcgcatggatcttcggccgggagacgctgccaacggcgaaagtcgagcaggta

SEQ ID NO: 1259 - DNA, 1347 bp, Corynebacterium glutamicum
atgacgccaattgtggagtccagggcgtggaaagctctgggcgctttaagtgttgggctgtttctcacactgcttgaccaatcgttggtggctgtcgcgctgccaaagattcaagaggatttgggtgcgagcctgaaccaagcggtgtgggtgtcagcggtttatttgctcacttttgcggtgccactgttgattactgggcgcttgggtgatcgttatggacagcgaaatatttatcttgccggcatggctgtgtttaccctcgcggcgttggcctgtgtatttgcaccaagcatcgaatggttgattgctgctcgcgcggtgcagggcctgggcggatctcttcttaatccgcagcccctgagcatcattcacaagattttcgcgcatgatcgtaggggagccgccaccggggtgtggagtgctgttgcctcatcagctggacttttcgggccagttatcggtggtgttctggtggggtggatcagctggcgtgctgtgttcttggtttatgtgccgctcggattgatctccctatttatggtggcgcgttatgtgcctaaacttcccacgggaacctcgaagatcgattggctctcgggtgcggtctcacttgttgctgtacttggtgtggttcttgccttgcagcaggggccagaacttgggtggggaacactgatttgggtgtcccttgccgttggtattgctgcagctgtgctctttatatggatgcaaacaagatccaaggcgccactgatgccgttgaggattttcaagacgcgcaacttcgcgatcggtgcattttcgatcttcagcctgggctttacggtgtattccgttaatttgcccatcatgttgtatctgcaaacggctcagggaatgtcgtcgcagttggccggtttgatgttggttccgatgggcatcatctctgtggtgatgtcaccagtaattggacgattggtggatcgcctggcaccaggaatgatctccaagatcggattcggcgcgctgattttctcgatggcgttgatggctgtctttatgatcgccaacctatcgccgtggtggctactcatcccgattattttgttcggtagctccaacgcgatgagttttgcaccgaactctgtgattgctctgcgtgatgttccgcaggatttagtgggctctgcttctggtttttacaacacctcacgccaggtgggcgctgttttgggcgccgctaccttgggcgctgtgatgcaaataggagtgggcacggtgtccttcggtgttgccatgggtgcggcaatcctggtgacactcgtgcccttaatctttgggttcctagcggtaacccaatttaga

SEQ ID NO: 1260 - DNA, 705 bp, Corynebacterium glutamicum
atgggtgaccaagtcaacgccaatcgcgccaaggccgatgcccgcaagagtgttcagcgcctgatcgccagagccgaagtaagtattgacaaacacgccatcgcgcttagccaaagtggtgtaaccagcgcggacctgctccaaaacctcaggagcaacatcggtgaccaacgcaggctcatcgatctgaacccactcagtatcgaaagacttgatgaggcgctcgtagacctcaaacagtgcaggcaggtgatccaaaggattggaaccatcagtggtgcgagcaagggaaaggaaagtcagtggaccaaccagaacagggcgggcattaacgccacgaacctgctggcaacggagatcctcaatcagcgcggacgcatccaaaacgaaacgtgtatccgcagacaactccggcacgaggtagtggtagttggtatcaaaccacttggtcattgcctgtgcaggcagggtctcagtaccgcgagcagcgccaaagtagcggtcaatccacagtgggagaccatcgttttcatgatcagcgatgtcatcaaaacgctccggcagcacacccaaaatagcggcggtatcgagcattgcgtcgtagtaggaacgtcctgcaaacggaacggaatccaatccagacaaagaatccgatgcagtgttgaccaattggcgggcggtctgcgcaagttcgcgaccttcaat

SEQ ID NO: 1261 - DNA, 2235 bp, Corynebacterium glutamicum
atgacttccaacttttcttccactgtcgctggtcttcctcgcatcggagcgaagcgtgaactgaagttcgcgctcgaaggctactggaatggatcaattgaaggtcgcgaacttgcgcagaccgcccgccaattggtcaacactgcatcggattctttgtctggattggattccgttccgtttgcaggacgttcctactacgacgcaatgctcgataccgccgctattttgggtgtgctgccggagcgttttgatgacatcgctgatcatgaaaacgatggtctcccactgtggattgaccgctactttggcgctgctcgcggtactgagaccctgcctgcacaggcaatgaccaagtggtttgataccaactaccactacctcgtgccggagttgtctgcggatacacgtttcgttttggatgcgtccgcgctgattgaggatctccgttgccagcaggttcgtggcgttaatgcccgccctgttctggttggtccactgactttcctttcccttgctcgcaccactgatggttccaatcctttggatcacctgcctgcactgtttgaggtctacgagcgcctcatcaagtctttcgatactgagtgggttcagatcgatgagcctgcgttggtcaccgatgttgctcctgaggttttggagcaggtccgcgctggttacaccactttggctaagcgcgatggcgtgtttgtcaatacttacttcggctctggcgatcaggcgctgaacactcttgcgggcatcggccttggcgcgattggcgttgacttggtcacccatggcgtcactgagcttgctgcgtggaagggtgaggagctgctggttgcgggcatcgttgatggtcgtaacatttggcgcaccgacctgtgtgctgctcttgcttccctgaagcgcctggcagctcgcggcccaatcgcagtgtctacctcttgttcactgctgcacgttccttacaccctcgaggctgagaacattgagcctgaggtccgcgactggcttgccttcggctcggagaagatcaccgaggtcaagctgcttgccgacgccctagccggcaacatcgacgcggctgcgttcgatgcggcgtccgcagcaattgcttctcgacgcacctccccacgcaccgcaccaatcacgcaggaactccctggccgtagccgtggatccttcgacactcgtgttacgctgcaggagaagtcactggagcttccagctctgccaaccaccaccattggttctttcccacagaccccatccattcgttctgctcgcgctcgtctgcgcaaggaatccatcactttggagcagtacgaagaggcaatgcgcgaagaaatcgatctggtcatcgccaagcaggaagaacttggtcttgatgtgttggttcacggtgagccagagcgcaacgacatggttcagtacttctctgaacttctcgacggtttcctctcaaccgccaacggctgggtccaaagctacggctcccgctgtgttcgtcctccagtgttgttcggaaacgtttcccgcccagcgccaatgactgtcaagtggttccagtacgcacagagcctgacccagaagcatgtcaagggaatgctcaccggtccagtcaccatccttgcatggtccttcgttcgcgatgatcagccgctggctaccactgctgaccaggttgcactggcactgcgcgatgaaattaacgatctcatcgaggctggcgcgaagatcatccaggtggatgagcctgcgattcgtgaactgttgccgctacgagacgtcgataagcctgcctacctgcagtggtccgtggactccttccgcctggcgactgccggcgcacccgacgacgtccaaatccacacccacatgtgctactccgagttcaacgaagtgatctcctcggtcatcgcgttggatgccgatgtcaccaccatcgaagcagcacgttccgacatgcaggtcctcgctgctctgaaatcttccggcttcgagctcggcgtcggacctggtgtgtgggatatccactccccgcgcgttccttccgcgcaggaagtggacggtctcctcgaggctgcactgcagtccgtggatcctcgccagctgtgggtcaacccagactgtggtctgaagacccgtggatggccagaagtggaagcttccctaaaggttctcgttgagtccgctaagcaggctcgtgagaaaatcggagcaactatc

SEQ ID NO: 1262 - DNA, 456 bp, Corynebacterium glutamicum
gtggttacacccgttgatggttgggtggtgggtcacagtttagaaaaagtgacttcaaatcacgtcgaaaagaaattgaaagtacttaagaaacatgtcacgctaggagacgtgataatcattgcaagcgttgttttcctcctcgttggcgcaatgttggcgaatgctgccgctgcgctctttagtgccagcgagccattcggacgaatttcctacctcattggcctacctaacgaagacgacttcgtgccgtactcactacggttcgtggcctttttcccactgatgctctccgcatcgatggcagcatccttcttcggggtgtgggcagtactaatcattcctttcggttacttcccatcactgatgatggttcataagcacaacaagcaggtacagcgaacctgggattccgtcaccgttgctgacttctacgaggattccacccctctggtc

SEQ ID NO: 1263 - DNA, 1398 bp, Corynebacterium glutamicum
atgaagaataagcgcgttgcgattattggtgcaggtccgagtggtatcgctcagttgagggcgtttgagtctgctgaaaagcaggggcatgagatccctgagctggtgtgttttgaaaagcaggatacctggggtgggcagtggaattactcttggcgcacgggaacagactcttatggtgagcctgtgcactcaagtatgtaccgaaacctgtggtcaaacggtccgaaggaagttctcgaatttgctgagtacagcttcgatgagcacttcggaaagccaatttcttcttaccctccacgtgaagtgttgtgggattacattgcaggtcgtgcaaagaagtcgaacgttgagaagtacatcaagttcgcgcatgttgttcgctgggtgagttttgatgaggccaccaagctgttcaccgtgacggtggagaacctccgcaccggtgagaccagcagtgatacttatgacaacgtgattgttggcgctggacacttcagcttcccgaacgtccctcactttgatggtgtggagactttcccaggtcagatcatgcatgctcacgagttccgtggtgcagaggctgttgctgacaaggatattttgctgattggtgcaagttattctgcggaagatatcggtacccaggcgtacaagatgggtgctcgttcggtgactttctcttaccgctcaaacccaatggggtatgagtggcctgaagagatgactgagcttcctttggttgagcgtttcgacggctccgaggttcactttgtcaatggtgaaaagcgcaaggtcgacatcgtggtgttctgtactggttacttacaccattacccatttatgccgtctgagctgactttaagctcaccaaacaacctgtacccggatacgctttatcgtggcgtggtgtccgaggctaataaccagctgttctggttgggtgctcaggatcagtggctgacgttcaacatgtttgatgctcaggcttggtatgttcgcgatgtcattttgggccgcgtggctcttccttccaaggaagcgcagcgcaatcatatggataagtggctgtcacgtttcgaaggcttgaagtctgagaatgatcagattgatttccagtgcgattacgtcgaggatcttatcgatcagaccgattatccttcgtttgatctgaaggaagtcgcgaatatcttgaagggctgggtgaagtcgaaggaggaggatatcctcaactaccgtgattacacctatacttccgtgatgacgggcaccacctctgttgaacaccacactccgtggatgattgagttggatgattctttggagcgttacctcagtgagccacaggaagatgaagctcgtcaggtttaccgtggcaagaaagtccgcgataaagcc

SEQ ID NO: 1264 - DNA, 324 bp, Corynebacterium glutamicum
atggcaatcatagcgagtgttgtgttcctcattgcggggactattctcgcagccatcgccaccgcccgttggagcatgctcgaaccctatggattgattccgtatttcataggtcacgatattgatttcgagcaaaaaggccagttcttggtctattttctccgcgcggcgggctttttcgttttgattgtcgcagcggcgtttgcgcagcctttctttgggctgtgggcactgttgcttctggtggtgggtgggtttccttcggggatgatggtgcgtcaacacaatcgtcgggtgcgtgcgatgtggcggccccgcgagaca

SEQ ID NO: 1265 - DNA, 945 bp, Corynebacterium glutamicum
gtgcgatgtggcggccccgcgagacatagattaaggactactctcgaacacatgcctcaaatccctgcccagaattttgatgatgttgcgttgatcattgagggcggtggaacccgaaattcttatactgctgcggtgattgatcagttgatcgccaacaatattcatttcggttgggtcggaggagtctcagcgggtgcgtcgcatacggtgaattatctttcggcggatcgtttccgcacggtgtcgagtttcgtagagtttgcggccgatcggcggtattcaggaattcagccattggtgcgcggtcggggctatttcaatgcggtggatatttatgagacctccacgcaacctgaccaggaatttcctttcgattttgacactttttcagccgaccccacgccgtttcaactctctgcggtgcgtgccgataccggcgagaccgttttttggggcagggaagacaccccggatttgagcgctctgatgaagcgggttcgcgcgtcgtcgaccatgcctggtttcatgccgatcacctacatcgacggccatccatatgtcgatggcgcggtcggggagaccggcggtttgatgctacagccggccatcgatgcgggcttcacccgctttttcgttatcgcctcccgtccgcgcgattattggcgcaaggagatcgggcgcccgggtttcatcaaagctgctttacgacgtttccccacaatcgccgacctcaccatcgcgcgtcctgcactgtataactcggtaaagcaacagatcctcgacctagagaaacaaggcagcgcctatgtgttctttgcggacaacatgaacatccagaacacggaaatcaatctgaagaaactccgtgcatctttcgatgcaggcatgcagcagacccgcaaagattggccggagatcatgagcttcctgaaccaaaccaga

SEQ ID NO: 1266 - DNA, 792 bp, Corynebacterium glutamicum
atgaactctcccctacaacacagcgccttccccgtccccggcgcgcaactctccacctcatacagcgacgaacacggccaagccgtcatccaacttcacggcctcacctcctcccgccaacgcgaccgcctcctcgacctcgacctcggccgtggcctttccggcacgcgccttttgcgttacgacgcccgcggccacggcacctccaccggccgcgctgcctccaccgattatcagtgggacaccctagcgggtgaccttttaatgcttctcgacgcccacttcccccacgaacaagtccacggcgtcggcccctccatgggttgcgccaccctcctcaaagccgcggtgttaaaccccgaccgcttcagtggattcacactcatgctcccacccaccgcctgggaatcccgaaaagcccaagcctccgaatacctatcccgagcagaattcctagaaacccacggcatggacgccttcctcaacgccgaaaaactccacgcccaaccaccagcaaccgtaggaacccccgacacagtccccgacatttccgccgaactcctcccctgggcttaccgaggcgccgcccaaagcgacctcccctcaaagaaagaaatcgccaaaataacagcccccaccactattctgagctggaccgacgatcccggacaccccgtatccacggcaatcgagctaacccgcctcatgccaaacgcccaactgcgcattgccactaccccagcggaagtcgcgcggtggccacaacaccttcgcgatgacctgcagttggac

SEQ ID NO: 1267 - DNA, 1647 bp, Corynebacterium glutamicum
atgagactgacacatgtagaccaattaaaccttccgtttggcacgttgagcagctatcacccttatgcatcggctccgggtgaggcggtgccggtgtcctttgatcagcaacgacatgtgggtgccggcgagcgaccgggtagttggatggcgattagtgtttctatgcctaaggcgatcagccgtgaggaattggagcgcgcgtggcttgaagtgattgaacggcacggcaccttgcgcacagtatttagcacgggaatgggtggggaagtgcagcaacaccgcattgatgtgggcccgggaaaatggattgaccacgccgttgcgcctggtgagagcattaatgaggcgttgcgggcggtgttgaatcggcagtgttcgccgtactcgaggccatcgcatagtttgtgcattattgatgcgcatccgcgtcccacggtgattattggtagtgatcattcgcatgtggatatgtggtccatgctggtgattgtgcgcgatttgttggctgcgctcgatatggaacttcccgttgagccgccgttggcgtttgaatcgcacaccgcggaactcctcgcggctccacctgcaccggagcggattcaccagcggtggcgtgaaattttggaagctggtggtggaaaaatgcctcagttcccgcttccgcttggcgatgccatctccatgcctgaacgcgttgaagtccgcgacattttcggggtcaatggcttggcgatttactcggcacgcgcccgcgcacaacaggtaagctccctggccttgactatttcagtgatggctgatgttacggcggcgctggcggaccttccgttgcgtgctgtattcccagtccatagccgtttcgatcagcgctggcacgatagtgtcgggtggtttatctccaattcggtcattgaggtgccagattccgatcctcacactgcagcccaagctgttcgcgaggctgtttctttgggaagctacccgctggctgagctgcttgaaccgtggggtggcatgccggaaacgccaggaatgtttgctatttcttggcttgacctgcgccgactcccagtgagcattgacgatattggcctccaagcccagtatgtcagcgcttcactgcgcaccgatggtgtgatgctgtggtttattttggatcgctccggcgcgcaccttcgctgtcgttatcctgactctttggtggcgcgggaaaatgtaggccgctggattgatgcgattgttgctcagatgcgcgccgaagctgggacggtgaatctgcaggccggcggggaacagctgacacttcggcatggaactcgcgccgatatttccgagatcgccccgctacttgcccgaaacgcagctgacccttgtgagctggtggatcttgaacatgcccttgacctgctgacacacgagtcttcgcatttcctggcggtggttcgaaacgctcgtggcaagataatcgcagcgatgcagttgactattgttccggagttttcccgcggtggtgcgcttcatcttcacatcgaggggccgttcattattccggaatatcgcaccaccgatttggataaaaagctgcgcgcctgggctgtggagcatgggcgtgcgcgaggggtgaaggttgaggaggtggtggga

SEQ ID NO: 1268 - DNA, 192 bp, Corynebacterium glutamicum
ttggtttattggcgcctcgttgtggaaggcgatttaaggggtcaaggtgttccggagtggtccagagtgtcggttgaggttgtttgggtccttaaacgcgattctaggagggtgacattttggggcaagtggggtagatgtgaaacctgggtgtttgctgatcaaggactcaccacaaacaggcctggaaag

SEQ ID NO: 1269 - DNA, 1554 bp, Corynebacterium glutamicum
atgaacaccctggtaaaacttcgtttccgcgagctaattcccgccgttgttgcaggtagcgtcacgatgatcgcctccatcaccctgacggtggtgtcggcctggctgatcaccaaagcttgggaaatgccgccagtgatggatctgaccgtggcggtcaccgctgtgcgagccctgggcattagccgtgcgatgttccgttatatagagagaatcgtttcacatgacttggcgttgaaggcagccagccgagcccgttcgagtgcatatcaacgcctggcttcgtcgccaaactctgcgttgacgatgcgccgcggcgaactgcttagccgccttggtgtggatatcgattcggttgccgatgtcatcgtccgcgccgtcattcccgccggagttgccctgctcaccggagttgtcgcgatcatcttcaccgcgattctcagccccgcaaccgcacttgtcctggcgattggattgattgctgctgcaattatccctcccctgcttgctgctcgcggagttaaaacagccgaagcccggcgcgctgaatccagcgaagcctacttgagttccttggatcaggtgctgtccaaccaggcggcgcttcgtgttcgtggtgaaatgccggccgctctgtccaaggcggatgtggctgcgcgttcctattcttcttcactggaggcaggcgcgaaagacactgccattggcgcagcgagttccctgtggattcacggtttcactgtcattggtgtgctcatggtttccgcgtcactgtatgcagatggaagccattcaccgcagtggtttggtgtgttggtgctgctttcactcgcagctttcgaggctgtctctgttctccccgatgctgcgattgctcgtacccgcgccgcagatgccaccaggaggcttgcggaaatctcggcgctgccagaatctgtctctcttgagcttcgcacggcctctgaccagcccgtattacgcgccgagaatctagtttatggatgggacagcgacctaggcacgagcaacctggatctcacctttggttcacgacatgaaatcatcgcaccctctggaactggcaaaacgaccctgctgctcacacttgcggggctgttggaacctcgtggaggccaagtgcttatcgacggcaccaatccttccgagttgaaaaacgccgtgctgttcagtccagaagatgcccacatttttgccaccactgtccgagataacttagcactcggagcaccggaagcaaccgacgcggaaatgacatcgatcctggaacatgttggtttgtcagagtgggttcaaggtttacccgatggtcttggcactgtccttgattcaggtgccgatagtctctcgggaggtcagcgccgccgcctgctccttgcccgcgtactactaagtgatgcaccaattctgcttttggatgaacccaccgagcacctcgacactgcaggctcctctgaaatcttgtctatgctggcctccgatgaactccctggtaaaagagctaggagaaccgtagtgattgtgaggcatgtgagg

SEQ ID NO: 1270 - DNA, 1533 bp, Corynebacterium glutamicum
ttgagtactaaatcttcagctcctgcaaaaaggcgcgccggccccgtcgatccgcggcttttgcgcctatcccccgctacccgccgttgggtgataatcgcaggtgttctcaccgcgttgaaaaccctcgcgacagtcgcaatgggcttgctcatcggccagatggcagcgggcatcattgaggtttcgggaagttctttgccccgaatggaactcatcgcgctcgccatcacggtggttgtgcgcggacttcttgcgtgggcacaggatcggttcgcgcaacgcgcatcgtcccaggtgactgtggatcttcgggagaaaaccctgcggcacctggcacaaagcgatccccgcaccatcgatcaagccttgtggcgcacccgtttgacctctggccttgatggtttggggccttacctcaccggatttttgccagctctagccgccacgatcattgccaccccggtcatgctcgcggtggtgggttggctggatgttgggtccatggtcatcgcgatcatcacgctccccctcattccggtgttcatgtggctggtgggaacactcaccgcaggtcgcaccgaacaacgcctcagcgacctagccattttgggaggtcagctgcttgatctcatcgcaggcttgcccaccttgcgagcattcaggcgccaccaagacatggcagctcaggtcacgcgactatcctcccaacatgcaagctccacgttgagcgtgctgaaaatcgcgttcctttccagctttgtgttggaatttttggccacactatcggtcgcattggtagcggttggcatcggatttcgcctgctcgcgggcgatctcaccctcgccatcggcctgaccgtactgatcatcatcccagaggtctacgcgccgatccgcgaagtcggcacccgcttccacgacgcccaagacggcctggttgccaccgatgagatcctaaaattactcagcgtttcttcgcttgtcgacgcgcctacccacacaccccgcgacgttgcaggcgggctggaggtgagcgtcgaaaagcttcgcgctgatggacgcgatgggccgaggcctgctgatttgtcgttcaccgcaaagcctgggcagttgacggtgctgtgggggccaaacggcagcggcaaatccacggccttgctagcggtgttgggcttggcgacggaaggcatcactggagaggtttccgtcaaggatgcctcgggccaggaatttaaggacagcgcattgtgggagcactgcgcatatttgccgcagcggccggtcattgatccggaaagtgtcagtgattatgcggaactgtcgcttgggcagcgccaacggcttgcgctgaaacgtgagcttggggcgcaattgctcctgttggatgagccgaccgcgcacctggatccagacaacgctgcgatcatgatccagcaattgcaggctgaagcccgccgaggcaccacagtactggcggtttcgcatgatcctttgctgcgtgcggctgccgatgaagtggtggaggtcaaa

SEQ ID NO: 1271 - DNA, 999 bp, Corynebacterium glutamicum
atggatctcaataccttttggtttattctcatcgcatttttgtttgcgggatactttctcctcgaaggattcgacttcggcgtcggaattttggcacccatcatcggtaaagattcagcggctaggaacacagtgatccgtacgattggccctgtctgggacggaaatgaagtgtggctgatcgtggcaggtggcgctttgtttgctgccttccctgagtggtacgcaacgatgttctccggaatgtatctgccgctgttcctcgtgcttgtgtcgttgatcatgcgcgtggtgggccttgaatggcgcaagaaagtcgatgatcctcgttggcaaaagtggtctgaccgggccatctttattggttcttggactccaccgctgatgtggggattcatcttcgccaatattttgcgtggcatgcccctcaaggcggatcacaccatcgatgctgcggcagcccttcctggcatggtcaacgtcttcgccattctgggtgcacttgcgttcaccgcactgttcgcccttcatggtctcgcattcatccgcctgaaaactgctggtcgggtgcgcaccgatgcggcgaaggcagctccagtagtcgcacttcttgctgcggtgactggtggacctttcgtgttgtgggctgccatcgcatacggccgttcctggtcctggatcctcgcagtgctgatcatcgcagcggttctcggtggagctttcgcactgatcaaagaccgcgatggattaagcttcctgtccacttccgtcgctgtcatcggtgtcgttgcactgctgtttagttcgcttttccccaacgtcatgccaacaacgcttgctgatggcgtgagcctggatatctggaacgcctccgcaagcgcctacgcatttactatcctgacttggaccgccgctgtgatcgcaccgctggttgtcctctaccaaggctggacctactgggtgttccgcaaacgacttcacgccgagccagtgtctgct

SEQ ID NO: 1272 - DNA, 1539 bp, Corynebacterium glutamicum
gtggatgtcgtcgacatcgcacggtggcaattcggaattaccaccgtctatcacttcatttttgtcccactgaccattggcttagcgccgctggtcgcaatcatgcaaacgttttggcaagttaccggcaaagagcactggtatcgggccacaagattttttggcactgtgctgctcatcaacttcgcggttggtgtagcaacgggcattgtgcaggagttccagttcggtatgaactggtcggaatattcgcgtttcgtcggtgatgttttcggcggaccgctggctttggagggtcttatcgcgttcttccttgagtctgtattcctgggactgtggattttcggatgggggaagattcctggttggttgcacactgcatccatttggatcgttgctattgcgacgaatatttctgcctatttcatcatcgtggccaactcgtttatgcagcatccggtgggtgctgagtataaccctgagactggtcgtgcggagcttactgatttttgggctcttctcacaaactccaccgcgctggctgcgttcccgcatgctgttgccggtggttttttaacagctggaactttcgttctcggaatttcgggttggtggattattcgtgcgcaccgtcaggccaagaaggctgagtcggaaatcgagtcgaagcattcgatgcacaggcccgcgttgtgggttggttggtggaccacagttgtctcttccgtggcgctgttcatcactggcgatatccaggcgaagctcatgttcgtgcagcagccaatgaagatggcgtcggcggaatccttgtgtgaaaccgccacagatccaaacttctccattctgacaattggtacgcacaacaactgcgatacggtaacccacctgatcgatgttccgtttgtgcttccattcttggctgaaggaaaattcaccggtgtgactttgcagggtgtaaaccagctccaagctgcagcggagcaagcatacggtcctggcaactactcccctaacttgtttgtcacctactggtcattccgcgcaatgatcggcctgatgcttggttctttggctatcgctgcgattgcgtggctgttgctgcgtaagaagcgcacaccaactggaaagattgctcgtctgttccagatcggcagcctcattgctatcccgttcccattcttggccaactctgctggttggatcttcaccgagatgggccgccagccttgggtggtgcacccgaaccctgaatctgccggcgatgcccgaacagagatgatccggatgactgttgatatgggtgtatctgatcatgcgccatggcaagtctggctgactctcattggcttcacgattctctatctcattttgttcgtggtgtgggtgtggctgattcgccgcgcagttctgatcggaccaccagaggaaggcgctccatccgtggaggcaaagactggaccggcaaccccgattggttcagatatgcccatgacaccgctgcaatttactgccgctgccccaaccacaggtgaaaaggaa

SEQ ID NO: 1273 - DNA, 2265 bp, Corynebacterium glutamicum
atgcaggaagaggccctcgacgctctactttctttgacggagaagggagagaaacgtggtgtcattatttctgcgacaggaactggcaagactatcctggctgctctagctacaagaatgctcaagcctgaacgagttttgtttgtcgtgcaccgcgaacaaattctggataaggcgcgatccgagttcatcaaagttcttgaacgtcccgctgttgatttcggaaaaatgtctggctcgaccaaggagctagataagccgtttgtgtttggcaccatccaaacgctgacaaaggaagctacactttcccagatctcccctactgactttgatttagtcatcgtcgatgaagtccatcgcgccggtgccgaatcctatttggcattgctcaatcatctgcagccacagtttttattgggcctgactgctaccccagagcgaactgatggattcaatatttatgagttgttcgatttcaacgtgccatatgagatccgacttcaagctgctttagaatccaacatgctcgtaccgtttcactattacggtgtcacagacttcacgcttgattctgaaacaacggtgactgatacctccaaactaagtgccttggtgagcgaagagagagtccatcacattctggaggccctcaaaacttatggtcatccagaaaatgttcgtggactgatcttctgttccaagactgaagaggctgaggagctgtcaaaacttctcgaccagtcgttgtttaatggcagcttgcttaaaaccaaggcgctctctgcgaaggactcaattccctaccgcgaagaggttgtagctgagctggagtccggcgacctggactacatcttgacggttgacatcttcaatgaaggcattgatattccttcggtgaatcaaatcgtaatgattcgtagtactcaatcaagcattgtgtttacgcagcagctcgggcgtggactccgaaaagctgctggcaaagaccatctgcgcgttattgatttcattggcaactacgcgaacaactatctcattcccatcgcattgtttggcgataattctcgcaataagaacagcatcagacgccgcctgattgagagcgatattgatggaacaatctcaggtgtttcaagtgttaactttgatcccatcgcgcaggagagaatttttgctgcgttgaaggctgcgaagttggactcaaaagcacaattcaagcaggatattgttcagcttcaagatcgactcaatcatgtgccagcactgttagacttcgctcgcttcaatactgttgatccgtttatccttgccacgcattctggcaactactggtcgctgctcagttcagtgaagtttgtcgatcacgctcccagcgaatcggagaagtactttctggatttccttaccggagagcttcttaacggcaagcgacctcatgagctgttgctgatccaggaactaatgaaacagcctgaaacttctactgaagaattccgtaagctcttgcaggcccaatcgactagttcagatgagcaaacaatcaactcggttgaaaggattttgagccaagaattctatacgggaccaaaccgcaagaagtttggcgaacatccgatcctctctgttcaaaaccgcacctactcttttactcccgagttccgacgtgccctcgacgaaagcctagaagtgacggaccgagatgaggctgctcagaattttaagtttcacgtccaagacatcatcgacactggtttgtttatcgccagaaacaatggattttggcaaggaaacctcgttgttggcgagagatactcccgacgagatgtctgccgaattctcaattgggaacgaaacaacgagagcacgatttatggatacaaagtggacagttacacatctacttgcccaatctttgtgacctatcacaaggctgatgatgtatccgaaagtactcgttaccaggatgaactcgtcgatccgaatacccttcattggtattcccgcggcaaccgaaagatcacgtctaatgagatcaagcccatcgctgcgaatgctgtggatcttcatgtttttgtgaagaaggacgatgccgaaggccttgatttcttctaccttggtcaagcgcattcagaaaacagcaaacagtcatcgatgcccggaaacaaaggagttgtgcaaccggtggtcacaatggatctacagttcgacacacccgtcgaacaaagcctgtttgagtacctgagcacaaatctcgccgtaacggag

SEQ ID NO: 1274 - DNA, 342 bp, Corynebacterium glutamicum
ttggcgattaatcgcatcatcaagttgaaaagcaatgtcgccattcttgctggcagagaacttcagattccattcccggtttaccaacagagcattatctgtgaggttggaactacccactactgcggtgattcccacgtcgtgatggaaaacgtagcccttggagtggaaaccatcgccttgatgtatgaggacttccacgttctccaaagtaagaagctcacgaaacatcgttggatcattgaaatccaggtagcgggacgtgataattcgtcctttacccttgaagtccaacaatgcctgtttcaacaacgcgataccgcgactggaaataaaagcgac

SEQ ID NO: 1275 - DNA, 393 bp, Corynebacterium glutamicum
gtgaagaaacgcatcaatgtaaccggcgccgtcctagtcaaggaaaaccgtatccttgcagcacaacgtggtccagagatgtcacttcccggatattgggagtttccgggaggaaagatcgagcagggcgaaactccagaagcttcacttgcacgagagctcaaagaagaattgctttgcgacgccaccgtaggcgaacacctcaccactacagagcacgagtacgactttggaatcgtcgtgctttccacctacttctgcacactaaatgatgcagagcctcaattgaccgagcatgctgagatccgctgggtggcaccacacgaattggaatctttggagtgggcacctgctgatattcctgcggtgaaacttctcgtcgagcagcttgct

SEQ ID NO: 1276 - DNA, 765 bp, Corynebacterium glutamicum
atgtcgcttcgaaagctcacaagcttaattggcatactggctgttgttggcctagtggcgtttatccttttcaacttcgtgaaaacaaacgacgaaacatcgaatgtctctcagagcgagtcaactgcagagacagtcagcgaaacaaatggcgtgctctccgacggcgcagaaaacatcgcttctcaatctgatgagagtaaatcgggtgtagagattattgattctggatttgggcagagctcaaattcggcgatggcaattgttattgccaaaacttctggtggaagcctcgcaggggaatttgttacggcgacggtgaatttcctcgatgaaagtggcgccgttgtagcgactgaagatcaagtagaaacactcagttgggaagaccaggaattggtattgccagtatctcactacaaggaggattcaagccgcccagaaattacaagcattgaggcttttctttcagtaacggattacggttcaggacaaccagatgaaactgcattgccggtgttggaaaccaccgatatttccaacccatacgctggtagttacaatgcctcatttgcgttgaaaaatgactcctcagatgattttaagaacctgagagttggtattgtttgctacaacgagcaaactgacatcattggtggtggtttcaaatttccgaacctggttccagcgggtgggagtattcgaatggacgctagtgtgacggtctccgaaatgccagcttcttgtaaggcatatttaaatcac

SEQ ID NO: 1277 - DNA, 1404 bp, Corynebacterium glutamicum
atgaatgcctcccctgccccaacccgatcttttaaaggattgcgggctcgacacattcacttcatcgcgctgggttccgcgatcggcaccggcttgttctacggttccgctggcgcaatccaagcagctggtccatctgtactcttggtctaccttctcggtggcgccgtcgtgtacttcatgctgcgcgcactcggcgagatggctgtgcatcacccagtccgtggttccttcgcggtctacacccgcgcacaccttggcggatgggcaggctacatcaccggctggatgttcgcgtttgagatgctcatcgtctgcctggctgacctcacagccatcggcatctatatgaacttctggttccccggcaccccacaatggacttgggtggtagccacccttcttattgtcggtggcgcaaacctcgcatcagtgcgttggttcggtgagctcgagttcatcttcaccatcattaaggtcaccgcagttgtcgccatgatcgtcggcggcgcagccatcctcgcattcggtctcggcgccaacgctgaagttgccggcgtatccaacctctgggagcacggcggattcttccccaacggtgttgaaggcatgatcgcagccttcatccttgttctcttcgcattcggtggcaccgaaatcatcggtgttgcaggctctgaagctgaagatcctgagaagtccatccccaaggctgttaatactgtcccagtacgcatcctcctcttctatgtgggtgccatcctggtgatccttgcccttaatccttggccttccatcaccggcgaagaatccccattcgtccagatcttcgacaccctcggcgtcaactgggctgctggtctcctcaacgccgtggtcatcaccgctgcactgtctgccatcaacgctgacctcttcggcgctggccgcgttctcactggtcttgcgaaggaaaacctcgcaccaaaggccatgggcaagatcgccaagaacggcgttccagtcatgaccaccaccatcatgatcatcgtcttgatcgtgggagtaatcctcaacgcagtgcttcccgagcgcgtcttcgagatcgtcgcttccctagcaaccttcgccacagtttacgtctggctgatgatcctgctcgcacaggtgggatcccgccgaaacatgcctgccgacgaggtcaagtccctgaagttccctgtccccttctaccccttcggacaatacttcgcgatcctatttatcgccttcaccttcggcatcatggtctggtacgacaactaccacctgccactcgccgtcggcgttggattccttgtcctgatgacaatcctttactacgccacaggccgaccaaaggcgatcgctccgatcgattatgaagagctagatccgcgacgcgat

SEQ ID NO: 1278 - DNA, 2196 bp, Corynebacterium glutamicum
atgagtaataccgagaacgtcaacggcgacgtagaacagccgaataacgtcatttcgtcggaatctcaggaaaccccgcagggtgactcagcatcagctgacttcgctctcgaaaccccaaccaacactgttgaagatgcaccagcatctgagggtagcgaagagatcaccagggttgcggatacttctgaggacgccgactctgcagatgcagacaacgcgagcaatgtaatcaatgagaatgaggactcctcggaaggtgctaaccagccttcaaacgagtcatcctctacggaagccaaatccggcttcgatgcactcggactgccagagcgtgttcttgacgctgtgcgcaaggtgggttacgaaactccttccccaattcaggcacaaaccatcccaatcctcatggagggccaggatgttgttggtctagcacagaccggtaccggtaagactgcagctttcgcgctgccaatccttgcccgtattgacaagtccgtgcgcagcccacaggcacttgtgcttgcccctacccgtgagctggcacttcaggttgctgactccttccaatccttcgctgaccacgtcggtggcctgaacgttctgccaatctatggtggacaggcttacggcattcagctctctggcctgcgtcgtggcgctcacatcgtcgtgggtaccccaggccgaatcatcgatcacctcgaaaagggctccctggatatctccggactgcgcttcctcgtgctcgatgaagcagacgagatgctgaacatgggcttccaggaagatgtcgagcgcatcctcgaggacaccccagacgagaagcaggttgcactattctccgcaacgatgccaaacggcattcgtcgcctgtccaagcagtacctgaacaaccctgctgaaatcaccgttaagtccgagaccaggactaacaccaacatcacccagcgcttcctcaacgttgcacaccgcaacaagatggatgcactgacccgtattctcgaggtcaccgagtttgaagcaatgatcatgttcgtgcgcaccaagcacgaaactgaagaagttgctgaaaagctccgtgcacgcggattctccgcagcagccatcaacggcgacattgctcaggcacagcgtgagcgcaccgtcgaccagctgaaggacggccgcctggacatcctcgttgcaaccgacgttgcagcccgtggtcttgacgttgagcgcatctcccacgtgcttaacttcgacattccaaacgacaccgagtcctacgttcaccgcatcggccgcaccggccgtgcaggacgtaccggcgaggcaatcctgttcgtgaccccacgtgagcgtcgtatgcttcgctccatcgagcgcgcaaccaacgcaccactgcacgaaatggaactgccaaccgtcgatcaggtcaacgacttccgcaaggtcaagttcgctgactccatcaccaagtccctcgaggacaagcagatggacctgttccgcaccctggtcaaggaatactcccaggccaacgacgttcctctagaggacatcgcagcggcactggcaacccaggcacagtccggcgacttcctgctcaaggagctcccaccagagcgccgtgagcgcaacgaccgccgtcgtgaccgtgacttcgacgaccgtggtggacgtggacgcgaccgtgaccgtggcgaccgcggagatcgtggctcacgcttcgaccgcgacgacgagaacctggcaacctaccgcctcgcagtgggcaagcgccagcacatccgcccaggcgcaatcgttggtgcacttgccaacgaaggtggcctgaactccaaggacttcggccgcatcaccatcgcagccgaccacaccctggttgaactgccaaaggatctcccacagagcgttcttgacaacctgcgcgacacccgcatctccggccagctcatcaacatagaacgcgactccggtggacgcccaccacgccgcttcgagcgcgatgaccgtggcggacgcggcggattccgcggcgaccgtgatgaccgcggtggacgtggacgtgaccgtgacgatcgtggaagccgtggaggtttccgcggtggacgtgaccgtgatgatcgtggcggacgcggtggattccgcggacgcgacgaccgcggagaccgtggtggccgtggcggttaccgtggcggacgcgac

SEQ ID NO: 1279 - DNA, 687 bp, Corynebacterium glutamicum
atgcccacgccttcgcagcacaaggacgcttcaacagcacaaaccgacaaccaggtaccaactggccgccgtgcacaaaaacgcgaacaaacccgcgcgcgcctgatcacttccgctcgcacactcatggcagaacggggtgtcgacaatgtaggaatagctgaaatcaccgaaggcgcaaacatcggaacgggaaccttctacaactacttcccagaccgtgaacaactactccaagctgtcgcagaagatgcctttgaatccgtgggaattgccctcgaccaggtgctaaccaaattagacgatccggctgaagtatttgcagggtcgcttcgacatctagtacggcactcgttagaagatcggatttggggcggatttttcatacaaatgggtgctgctcatcccgtactcatgcgcatcctaggaccccgcgcacgccgagatctacttcatggtttagaaactggccgattcaccatcgaagatctggacctagcaaccacatgcacttttggttcactcatcgcagcgatccaaatggcgctttctgcagatcaagattccaacgatgacaaagatcagattttcgcagccgcgatgctccggatggtgggtgttcaagcagcagaagcccgggagatcgcttcgcgtccactccccgaaatatccccagtcaaaccgcag

SEQ ID NO: 1280 - DNA, 1590 bp, Corynebacterium glutamicum
atgtcacccaataacttcgataccgatgtctgcatcgtcggtggaggtcctaccggaacgctccttgcagtactgctcggccaaaaaggtcaccgcgtcaccatcctggaaaagtggccaacattctacgaacgacctcgtgcagtcacctttgaccacgaaatcgcacggatccttggatacattggcattgattctgaaaacgacgaagccatcgattaccactccgacagctacgactggaagaacgcagcgggggagacgcttttggaagtcgattggacctccatgacagattccggatggcgcacccgatactggttctaccagccagaacttgaaaagcgtctgcgcgatctggccctgaccatggattttgtagatattcgctgtggcttcaccgctgtcggattgtcccaagatgaaaactccgccatcattcacggcattgtcactgataccccagagaacattccagcagatgctcagcgcgaagatatccgagcgaagtatgtcatcggtgcagacggagctaacagtttcgtgcgtaactcccttggcttagagatgaatgatcttggatacttcttcgactggctgatcctggacctcaagccaactcaggacattgactacggaacagatcactggcaactgtgtgatcccaagcgcccaaccaccatcgttcctggaggccccggccgccgacgttgggaattcatggcgctgcctggtgaagatctcaaggaactcgcttctgaagaaagcgcgtggaatctacttgagccatgggatgtcacacctggcaaggccattctcgagcgctccgcagtgtatcgattccaagctcgctgggcccaggaatggcgctccggaagagctctcatcgcaggcgatgccgctcacctcatgccacctttcgcaggtgaaggcatgtgcgctggcctgagagactcactggcgttggcatggcgtcttgatttggtgctgagcggaaaatcagatgatgcattgctagacacctacggagaagaacgccgcgaacacgtccactactacattgatttctccatggacctgggcaatgtcatctgcattactgatgaagatgaagcacgtttgcgcgatgagcgcatgattaaagagcttgaagcacaagacggggtccctgttaataccgatgtcgcacacttgggaccgggaatttgggataaagattcttcccatggtggcgagctagcgaagcagggcatagtggaataccaaggtcgaaaggcgcgtttcgacgacgcagtcggccgtggctgggcagttttaggcctcaacactgatccacgagaagtgcttgatgaggattcgcttgtggcacttgacgccatcggtgcaatcgtcgaatcagtaggtgatgcaacttccgcagttttagatgttgaaggtctttacactcgctggctcaaggaagccggggcaacatttattattacccgccccgatttctacgtctattccacagcagtggacgctgaacaacttcaaacacagattaagcagctatcggatctacttcacctcaactcagttgtcggagca

SEQ ID NO: 1281 - DNA, 1068 bp, Corynebacterium glutamicum
atgtctttacagttcgatcatgaaaccctcggtcaacgagttctgttcggttcaggtgaggcggcgcaaaatctcgccgctgaaattagccgactcgatgccaaaaacgtcatggtggttgccggtgatttcgagcttcccatggcacggcaagtagcagcagatattgatgtcaaggtgtggcattcaaatgtcgtgatgcatgtgcccatcgaaacagcagaagaagcacgcagtgttgcgaaagaaaacgacattgatgttgtggtgtgtgtgggcggtggatccacaacaggtctagctaaagcgattgccatgaccaccgcattgccgatcattgcggtacccactacttatgcaggttctgaagcaacaaatgtgtggggattgaccgaagccgcgcgcaaaacaactggtgttgataacaaagtgctgccagtgacagttatctacgattcagcgttaaccatgtctttgccggtagaaatgtcggttgcttctggtctcaatggtttggctcactgcattgattctttgtggggaccgaaggcggatcccatcaatgcggctatggctgctgagggaattcgagcactttctgctggccttcccaagattgtggcagatgctcaggacgtagatggtcgcgatgaagcgctctacggtgcctacctggctgcggtgtcttttgcctctgctggctctggtctccaccacaagatctgccacgtgttgggtggaacttttaaccttccacacgcgcaaacccatgcaacagtactgccttatgttcttgccttcaacgcgccatatgcgccacaggcagaacaacgcgcagcggcagctttcggttctgcgacagcacttgaaggattgcaacagctgcgtgcccaagtgggagcaccacagcgactatccgattacggattcaccgcagcaggaatcccagaggcagtggaaatcatcttggagaaagtaccggcgaataatccacggacggtcacagaagaaaacctcactgcgctgcttaccacagcgctcaacggcgacgatccagcaactttgaat

SEQ ID NO: 1282 - DNA, 885 bp, Corynebacterium glutamicum
atgactatttcagcacaacagcaagcagtggaagaagaccttgtagagcgcgtactcgcatcttttgattcgtgtgaaaaccctcgcctcaaactagtgatgaaatccctgactgtgcatctccatgatttcatccgcgatgttcgactcactgaagaagagtggaactacgccattgatttcctcaccaaggttgggcatatcaccgacgataagcgccaagaattcgtgttgctctctgacaccttgggtgcatccatgcagaccatcgctgttaataacgaagcatatgaagacgctaccgaagcaacagtctttggccccttctttgtcgatgatgcgccactggtccaaaacggagatgacattgcctttggcgcagtcggccagccggcatgggtggagggaacggtcaaagacactgaaggaaaccccattcccaatgcacgcattgaagtatgggaatgcgatgaagatggactttatgatgtgcaatacgccgatgagcgcagtgctggacgcgcacacctgtattcagatgaaaacggcgaataccacttctggggactaactcccgtgccatatcccatcccacacgatggtccagtaggacaaatgctccaagcagttggtcgttcccccgttcgttgcgcgcacctacacttcatggtgactgcgccagagaagcgaaccttggtaacccatatcttcgttgagggcgatccgcagctagagatcggcgattccgtgtttggcgtgaaggactcactgattaagaaattcgttgagcaacctgcaggaaccgcaactccagatggtcgcgatgtgggtgatcaaacctgggcacgcacacgttttgatattgtgctcgcccccggcaatgtc

SEQ ID NO: 1283 - DNA, 471 bp, Corynebacterium glutamicum
gtgaccaccatcatgatcgctattcacgctattgcagcaatcctgttcctaggaccagcaacagtagctaactctcagttccacgtccgcgcgtacgatgcacacaacggcaacacccaagccgctggctccgcaaaaacccttttcaagatttcccagtcctacggcatgctgtccctgctcgtgcctttgctgggtatcgccatcatgcttctcgattggtctttctacaagtctgaaggccagttccacgcagcaatcgctctcagtgttatcacctgggcgctgcttctcttcgttatcttcccacgccagaagaagatgatgggtgctcttgaccttctggaggacgatgagcaggctgcaaagacttacgagatcgaaaactgggacaaggcgaagagccagctgtccatgttcggcggcatctgggctctgctgtgggtcatcatcgctgtgctgatgttcatc

SEQ ID NO: 1284 - DNA, 540 bp, Corynebacterium glutamicum
atgaagaactttattcgggtactcatcgcctttagtgttttcctctgtatatataccgttgctccccacattggccgaggtcctggagacctcgcaccagttacagcaatcccccaacgagccacagtcctaggctatgacagagcctccatgtttggcggatggttgggtggcgtgcgggaaggcatcgtggatgaagccggcgacactgatccatactccgggaatcgattagacctctctagtgccgaggtggatcatattctcccgctcagcgccgcctgggatctaggcgcacaccggtggagcgctggcgagagaatcagctttgccaacgaccccctcaacctcgtgctcgtctcaaaagctgagaaccaagaaaaatccgatcaacttcccagcgagtggctcccctctgatcgaagtgcacgatgttggtacgtggaacgccttttcgccgtggccaacgcatacgaacttccgttaccagaaaacgacattcgggttggacgaaaacagtgcgggttcgccaaaccttgg

SEQ ID NO: 1285 - DNA, 3102 bp, Corynebacterium glutamicum
atgacttctcacttgcttcacggtctctggatcaaagatcgcggtctgcaactgtggattgagcaggtcgaagggcaccgaattgtgcttccagaggcggtggaaaaaggcacgttcccgccggtagtggagcaaatcctcgacgggaaaaccttccgcgcgcgcatgaatgtgcatctgcgcactccgaaagggcgccatgttgagctgcccacgccaacagcagcttttacccctgaagaagcagtcacggttttctcacaattaagttttttgaaagcagaaacccctgccgccacccgagcgcaacgtgactccattgcgcccgatctgtggtggctgattgtcatgtatcaaggcctggcgcgttttgtgcaggccggccgcgtcacgcttcgcacggtgatgatggataatgcctggtggccccagtggcaactatctgccagcctgtcggagcgtgggtggctcgcggaaatgaaccatgccgcgccgggtattttgcggattaatggtggccgagatttggccggaagcatgtccaatgagcttccgcactggatcgccaacgccattttgcgtgattaccgcgatgaaaccatgccgtatgcgcgccatgagtttgttgaggcgttgctgtttaaccattcgctgcgcaagggctcgaccatgctcacccatgcgctgaatcagtggaaaaacaccattacatctgcgtctttgcagctggtgattttggtggaggagccccctgcggaatcggattatgaagatccgatggattccgtgtggccggtgcgtttgatggtgcgcacgggcgtggatgcgccgcaggcgattcaaaaaggatcgatcgatagcgggggaatggagcaactgcgctcccaatacgaaaccgcaaaaaccacctccatgctgctggatcctgcgcgcgaagacgcgatgctggggcatatggtggacatcgcccaaaacggtgactgggatattttcttaaccaccgaggagatcgtcaactttatctcccacgatgtagccaagctgcgcaaagccggcattcccgtcatgctgcccaaagcctggagcacctatgaaacccgcgcgcaggtggaagcgcgcacgccgaatgatgccgcggactcttcaaccaaggcaatcattggtcttgaccagctcgtggaatacaactggcgcatcagcgtcggcgatattcagctgtccgacgaagagatgcgcgaactcatcgattccaaaacaggcctcatccgcctgcgcggcgattgggtcatggcggaccaagacgcgttgcgacgcatcaccagctacatggaggaactatcaaagtcctccgaaaaacgcgcgcgcaccgaaatggaaaaagtggccatgcaggccaaactcgccgaagcaaacggcgaagaaggttggcaactcctggctgccaaggctgaaactctccgcaaggaattcaatgagaaattcagtggcgatggacaaggcgaagtaacccttgctgaactgcgcgaaatcgcactgaaagccgccgaaaacgaaccagtggaattcaccggctcgcaatggttcaactccttgctcggcggcaccgaaacacccgcgccggtgcgcgtcgacatccccgacacggtccttgctgacctgcgcgaataccagcgacgcggcgtggactggctgtactggatgtccgcaaataatttaggtgcagtgcttgccgacgacatgggcttgggaaaaaccctccagttgttgtcccttttggcagtcgagcgcgcagaaaacccagagttggaacgcggcccgacgctcgtggtgtgcccaacatctgtggtgggaaactgggcagccgaggcggctaaatttgtgccttcactaaaggtattgatgcatcacggcccgcagcgtttgaatgatgccgatttcctgagtcaatccaagggcatggacttgattatcacctcatacggtgtgatcacccgcgatttcaaactcatgggccaggtaggttttgaacgcgtcgtgctcgatgaagcgcaggcaattaaaaactcttccacacgcgtatcaaaggcagtgcgctcgttgccttcccgccaccgcgttgcactgactggcacgcccgtggaaaaccgcctgtctgaaatgcgctccatcttggacttctgcaaccccggcgtgctgggttctgcatcgtttttccgcaaccactttgccaaggccattgagcgtgaacaagacgacaccatgactgagcgcctccgccagctcaccgcaccgtttattttgcgacgcctcaaaaccgacccgaatatcatcgacgatctgcctgagaaaaccgaacagatcatccgcgtggatatgaccaccgaacaggcatctctgtacaaagcgctggttgaagatgtgcagaaacaactcgatgaacgccaaggaatgtcacgtaaaggcctggtcctggcgaccatcacgcgcatcaagcagatctgtaaccacccagcgcacttccttggcgacggctcagaggtgacactgaaaggtaaacaccgttccggcaaggtggaagcgctcatggaactgatcgatacggcagtaaaagaagagcgccgcatgctgatcttcacccagtacgcagcctttggccgtattttggcgccgtacctgtctgatcgattgggcacgaatatcccattcctgcacggcggcgtgaccaaaccaggacgcgaccgcatggtggcggaattccaatccgaagacggaccaccggcaatgatcctgtctttgaaagccggcggtactggcttgaacctgacagctgcatccatcgtggtccacatggatagatggtggaacccagccgtggaaaaccaagcaactgaccgtgccttccgcatcggccagcgcaaaaacgtggatgtatacaagatgatcacagtcggaaccatggaggaatccatccaagatatcctcgatggaaaaacacacctggccagcgccatcgtgggcgagggcgaaggctggatcaccgaactcaacccagaagaattggctatgctgatgagttaccgcgaaaaggagggtgcagatgac

SEQ ID NO: 1286 - DNA, 1065 bp, Corynebacterium glutamicum
atggcgctggccaggtgtgtttttccatcgaggatatcttggatggattcctccatggttccgactgtgatcatcttgtatacatccacgtttttgcgctggccgatgcggaaggcacggtcagttgcttggttttccacggctgggttccaccatctatccatgtggaccacgatggatgcagctgtcaggttcaagccagtaccgccggctttcaaagacaggatcattgccggtggtccgtcttcggattggaattccgccaccatgcggtcgcgtcctggtttggtcacgccgccgtgcaggaatgggatattcgtgcccaatcgatcagacaggtacggcgccaaaatacggccaaaggctgcgtactgggtgaagatcagcatgcggcgctcttcttttactgccgtatcgatcagttccatgagcgcttccaccttgccggaacggtgtttacctttcagtgtcacctctgagccgtcgccaaggaagtgcgctgggtggttacagatctgcttgatgcgcgtgatggtcgccaggaccaggcctttacgtgacattccttggcgttcatcgagttgtttctgcacatcttcaaccagcgctttgtacagagatgcctgttcggtggtcatatccacgcggatgatctgttcggttttctcaggcagatcgtcgatgatattcgggtcggttttgaggcgtcgcaaaataaacggtgcggtgagctggcggaggcgctcagtcatggtgtcgtcttgttcacgctcaatggccttggcaaagtggttgcggaaaaacgatgcagaacccagcacgccggggttgcagaagtccaagatggagcgcatttcagacaggcggttttccacgggcgtgccagtcagtgcaacgcggtggcgggaaggcaacgagcgcactgcctttgatacgcgtgtggaagagtttttaattgcctgcgcttcatcgagcacgacgcgttcaaaacctacctggcccatgagtttgaaatcgcgggtgatcacaccgtatgaggtgataatcaagtccatgcccttggat

SEQ ID NO: 1287 - DNA, 858 bp, Corynebacterium glutamicum
gtgcagatgactgaatcacgccgcgtgaaaatggataacgttatttacgccaattttggcagcaaacagcgcgtatctactcctgatgaccgcacccaggtgattaataaatcacgacacaaacaattcagcccagcgggtactcgtaccgtgatgttgacggagaaaaacgccgacagcggacgacggtcccgcggtgagcagtactaccgaaacggcaatgtcaccggcatgactgtgctggaaggccgcgtggaatgcactgtcgcgggctcccaaaacgagccgtttgttaccacagtgaccttcccataccgaagctcggaaaaactccgcgaagcctacgcagctattgcggatactcccaatggcctgcggcttgtgcgtgatggccatctgacctcctccatgctggatcacttggtgggaagtcctgatgagtcgatttattttgactgcacctgccccgaccgatcgcttgtgtgtaaacatgccgttgccagcgcgtatcacgttgccgagaagatgaccgcgaaccccggtctgatcttggatattcgtggtcaagggatggctggattagaagcactgattcggacctatcacaccaaggttgaaactgaacctgaagacaatgacagtttttggaacggcagggaacttcctgctttgcctgatccaaagattgcccctgctatcgacgattccgatatcaactacctccacaaggctttaaggatggtctcatacacctccctggagcagcttcgtgcggtcagtgatattgaagatatgtacgagattttggtagccaaccaccctgataaccagcaagtgtatgaggaagaagacactgat

SEQ ID NO: 1288 - DNA, 1173 bp, Corynebacterium glutamicum
atgtccaccgtgcatgatgagatgggcgttatgaatacaacagtgaagtttttacactcctcggacctacaaataggcatgacacggtggttcttatccgatgaagcccaggcccgttttgacgatgaccggattagggccatcgaaaagatgggcaagatcgcacggaaaaatcagtgcgagttcattgtgctcgccggcgacgtcttcgagcacaactctttagaacaacgcaccactggacgtgccttagaagccttacgatccttaaagctgccggtttatctgctgccgggtaaccatgatcctttaacagcggattcgttgttttaccgcgccaaagatattgatggcgtgacaatcttgtcggacaccaccgtgcatggggtggcccctggggtggaaattattggagcacccttgctgcacaagatggctacttcagatctagtggcagaagcattgaaagatttggaaccaacctccaacgtccgtatcgctgtggggcacggccaagcagaagctcgcaccactgaccaccgggctgacttaatcgatctgaacactgttgaagccaaattggctgacggtacgattgactacctcgctctcggcgatacccactcggctcagccagtaggtaccagtggaaaagtctggttttctggagctccagagaccacagacttccatgacttagatccagaccgtgtgggcggtgaggtgaactctggcaaagttctcattgtcagcgcctcaaagggtgacgtttcagtcgaagaagtcgaggtggggaagtggaccttccacgctttatctaaagaaatcacctcgggtaccgatgtggaagatttcttggataccttgcaggcataccctgataaatctcgaacagtcatcaaatatggtctccgcggaaccatcaccctggaacaaaacaggcgtttggaagaaggcatcgctgggttagaagatgtctttgcttcactcaagcctcgggaacgcaccactgacctcgtgctggagccaggggaggaagaattagccaatctcgatgccacaggttacgccgctgaagtattgcgagagctcgctgactctgtggtcaatggtgcagcgccggaagaagaccgcgatgcgctcaacctattgttccgactaagccgggaggtc

SEQ ID NO: 1289 - DNA, 2628 bp, Corynebacterium glutamicum
atgcgtattcatgaaatcatcattgacaatttccgagccatcgaacatctagaacttcgtgacattcctgaccagggcgttatcgtgatccacggtgacaatgagcaaggcaaatcttcaatccttgaagccataaaaacagttctgaatagtaaacacagaaccaccagcaagacgatcaaggccattcagcctgttgaccgtgatgttcccatcagcatcaccctcgaggcaaccgtaggcacggttcgattccgcatacacaaacgcttcctaaaatccacagccgcagaactgcaagtcatcgagccacgtccatccaaccaccgtggactagaagccgaagctgcactggcagaaatactggaaagccatttggacacctctttgcttgacgcattgtttatgaaacagggtgaagtagaagcaggtatcagcgctgtaggaattcctaccctgaccagcgctttgaacgctcaaaatggcaataccgaagatgccaccgaagacaccgcactcatggaggctgtagaaaaggaatacctaaagttctacaccaactccggaaaggcgaatacgaggttcctacagttttccaaacaggtggaaacccttcgtactgatttggatgaggctaacgctgaagtagcaaagctctcctcccatgttgaccgagttaaacgattggaaattgatcgggatcaggccacagcacagttacccaaggcagaggaagaactcgcagggaggaaagcagaactggaggaagcccaaaaggttaaggctcaagccacggaaatccttgcgcagttttcccgggcggaagaacagttagagcaggcaacaggagctcagaaacgacgtaaagaactccgcaataagctggaattagcacagacagaagtcgaaaaggctgaagcagggcaagagaacctggcgcaagaagcttcccgtgaagcagaagaattcctagccttaagtgaaaagttcgaggcagcgcgcgcagctgaaactctggccgttgaaaaggtgaaagcagcacgtcaatcggttgctggaatcaaaaaccgtgaccgtaaagaacacctcacggttatgcttggtgaacttgatcgaattgggcagcgcctctacgaattgcgcagcgtccagcactcatcggtgcgtgtgagccagcgtgatattgatgctctgcaaaaggcgatcaccgaggtcgatatccaaaggacgctcgttgaagcgcagcagggaagtattaccctcagtgcttccacacccaccgacattcaactaggtgatgacaccgtttcagctaccgacgctggaaccacagttgccctcgaccgagaactcaccgtcgtggtcggcgatgtcaccttggtgattaacccaggaaaaacagcagcggaaagtcgcaccgattttgaatccgccgaggcagcattggcggagctgcttgatcaactcgacgtctcagacttggaccagctcagggaacgtttcactgcccaagagcaacgagacgcggatattgcagaactggttcgcgaacaacagcgcatgagcggtgggacagaaacaacagttttacgtgccgagctagaaggcctgcacgtcccagaggatctagacccatcaatttctgtggatgatgcgcaaactcagttgaatgaggcagaagagtccagagagctcgctgcggaggcgcataaacacgcaaatgcagcacttgatggattgcgttcgcgtcccgtagataaagctctgacagttttcaacgctcagctcgcagcactgcagagaaacctctcttccgcacaagttgaattagaccgtgcagtggcagaaacctcggatgacgaagttgatgctgctgtacagcggtgcgctgaagctctagctggggtgcgggtacagaagcaggagattgaacaggtcttggcaaaaaccaacccagacatggctcaacgcttatgtgatgctgctgaagcaaatgtgcgatcgtataaaacggcagtgtctgatgccaccacagagttggtgcgcctggaaggcctcatcggtgtagctgcaggtgcgaaagaacgactagataaagttaagtctgcgctgacagcagctgaaaaccggtttgaatcagaacaacgtcgcgcccacgctgcacgtcgcctctatgccctcatggtgttctaccgtgatgaatcccgaaagcgctacgcagcacccttcgcggacaaactatccaggctggcagcatccgtatttggagaatcagcagactttgatcttgatgatgagctgaagatctccagtcgttccataggaccacgaacagtggaccttgccaatctttctggcggcgcaaaggaacagctggcaatcctcacccgctttgctatcgcagaattggtagcagaatcctccgcgcaaggtgctgtgcctgtgtttattgatgatgcattggggagcacagacccagagcgactgacccgcatatctactctgtttagtgatgcaggcaaggactctcaggtgtttgttctcacctgtgttccagaccggtacaactatgtagaggtcacccaaaagcacagcatcgagtcattgaaaactgccaacgctctgctg

SEQ ID NO: 1290 - DNA, 306 bp, Corynebacterium glutamicum
ttgcctgcatcactaaacagagtagatatgcgggtcagtcgctctgggtctgtgctccccaatgcatcatcaataaacacaggcacagcaccttgcgcggaggattctgctaccaattctgcgatagcaaagcgggtgaggattgccagctgttcctttgcgccgccagaaagattggcaaggtccactgttcgtggtcctatggaacgactggagatcttcagctcatcatcaagatcaaagtctgctgattctccaaatacggatgctgccagcctggatagtttgtccgcgaagggtgctgcg

SEQ ID NO: 1291 - DNA, 318 bp, Corynebacterium glutamicum
gtgcttttgggtgacctctacatagttgtaccggtctggaacacaggtgagaacaaacacctgagagtccttgcctgcatcactaaacagagtagatatgcgggtcagtcgctctgggtctgtgctccccaatgcatcatcaataaacacaggcacagcaccttgcgcggaggattctgctaccaattctgcgatagcaaagcgggtgaggattgccagctgttcctttgcgccgccagaaagattggcaaggtccactgttcgtggtcctatggaacgactggagatcttcagctcatcatcaagatcaaagtctgc

SEQ ID NO: 1292 - DNA, 774 bp, Corynebacterium glutamicum
gtggctagtgaagctacccggcatctcatgggggagaagacttctgtcgcgtatgttcacgatgttctgatcaagggcgtgccagtgcggatatacaatccgcaccccaacgacgggccgcttcctgtctttatctacttccatggtggcggatgggttttgggggaccttgaatcagtggattccaccgtgcgcgatattgccgttgcttcaggcgccctgtgtatcagtgtggattatcgccgtgcaccggaacatccttttctcgctgcattggatgattgccaagtggtcacggaagctgtcctcaatggtgaactcgccagtgctaaccagcatctagtggcagtcggcggggacagcgccggtggcaatattgcggcggtcatcgctcaacagctgcgcgatcagatcacccaccaagttcttgtgtatccggtgatggacgtaatcttgctggtgatttgttctatcattaccactggttttgcgctgctcatgcatccaaagagcaaggacaagacggagacgatttctgatgaattcctcgcagagatccaagcgggaagtgaaaagatctccattctgcgttcgacccctgctgaaaaagccaatgcgagccgctggatcatgtacttcgttggcggaattggcctgctctacagcgtgttcagcctgtggacaggtggcgtaaccggactgacgttgaactccttcaacttcctgttcctgtcactcggcatggtgctcaccgctaattacgggccagagtat

SEQ ID NO: 1293 - DNA, 378 bp, Corynebacterium glutamicum
ttgatttccttcaccggtctgggtgttgtgatctccggatttttcacctcgatttccacggcaaccacgtggcctgtcatcgcgttcctctactctggactgctcaacatcgcggtgccttcaggtggctcgaaattcatcatcgaagccccgtacatcatcccaaccccagtggatcttggcgctgacatgggccttgtcctgcaggcttatcaaatgagtgatggcgcgaccaacctgctcattccgttcttcgcgctgccatatttggccaatttcaagatcaaattcagccaagtggtgggctatacagttccgcctgtcctcgttgttatcgccgtgatctgcatttacctgttcctgcgagcatcaatcatt

SEQ ID NO: 1294 - DNA, 786 bp, Corynebacterium glutamicum
gtgccgcggctttttgtttgtgggcgcttaagcagccttgattgcggagccgtcgatctcgatcttgatcttctcagaaaccagaacgccaccggtggagagtggagcctggaaatctacgccgaagtccttgcggttgatttcggtggaggcttcgaagccaaggcgggtgttgccgaatggatcctcagcaacgccaccaacctcaacgtccagggtgacggacttggtggtgtcacgaattgtgaggtcgccggtaacggtgccttcgttttcgttcttgataacaaaggaagtagcttcgaaagtcatttcagggaacttgtctactgcgaagaagtcgtcgcccttaacgtgtgcatcgcggtctgcgttgccggtggtaacggaagcggtcttgataacaacctttgcagaggagttctctgggttttcagcatctacgacaatggagtcggtgtactcggtgaattcaccgcgaaccttggtaaccattgcgtggcgagccacgaacttgatttcggtgtgtgcagggtcgagggtccaggtgccagtcaacttgctcattgtgaagtccttttcggtgaaagtgtgtttcgttttttaacggtaccgacactcttgcatctgtgcagtttgtgtcgctgccgttgttcgtgttctatactagccaagattgatgatgtgtcaacaatatttctaaaaaacttgatgtggaaactaaaacccgcaggtggaggcgtgaataaaattgtttgttgggccggagagtgggctgctgtgtat

SEQ ID NO: 1295 - DNA, 537 bp, Corynebacterium glutamicum
atgagcaagttgactggcacctggaccctcgaccctgcacacaccgaaatcaagttcgtggctcgccacgcaatggttaccaaggttcgcggtgaattcaccgagtacaccgactccattgtcgtagatgctgaaaacccagagaactcctctgcaaaggttgttatcaagaccgcttccgttaccaccggcaacgcagaccgcgatgcacacgttaagggcgacgacttcttcgcagtagacaagttccctgaaatgactttcgaagctacttcctttgttatcaagaacgaaaacgaaggcaccgttaccggcgacctcacaattcgtgacaccaccaagtccgtcaccctggacgttgaggttggtggcgttgctgaggatccattcggcaacacccgccttggcttcgaagcctccaccgaaatcaaccgcaaggacttcggcgtagatttccaggctccactctccaccggtggcgttctggtttctgagaagatcaagatcgagatcgacggctccgcaatcaaggctgct

SEQ ID NO: 1296 - DNA, 486 bp, Corynebacterium glutamicum
atgacaacaccacgatggctctccactgaagagcaacaactctggcgcatgatcttgtctgcaacccgcaaaatggaacgcacactagatgagaccctcgtggaaaaccacaacctgaccacttcagaatttgcagtactagttactctttctgaggcaacgggtcagcaaatgcgcctgcgagacatgtgccaagaactagattgggaccgcagtagaacctctcaccaagtcacccgcatggacaaaaagggcttagtggccaaggttaaatgcgcaggtgacgcacgaggtgtgaacgtagaaatcaccccggaaggtgaacgacgcctcaaggatgccgtacctgctcatgtagaaacagtccgccaactagttttcgaccccatggaagaacgccacatggaaggacttcgttcctacctcaccgcagtgttgaactccaacacctgcattgagatcaacaaccaacgcgcggcagagctg

SEQ ID NO: 1297 - DNA, 222 bp, Corynebacterium glutamicum
ttgatcccgatgactttcccagcacaatctcgacgactcgcccgaagcaccaccgacaaatggatcggcggcgtcgctggtggcctcgcagagacctacggttggaatccggcctatgtgcgtctcgcgttcgtggcgtcggttctgtttccactgccaggttcacagatcctgttctacgccctagcgtggctgatcatcccatcccgagaaaatcgcttc

SEQ ID NO: 1298 - DNA, 519 bp, Corynebacterium glutamicum
ttggattcgagtcggtaccgcttgaaagtactttgcgtaagttcccaccgactgcccctagttgttgcgaatatttatagattgttgagaaagatgaacatgaagacgcacccggcttccgccaagcagaccaccgagcttcgactcctgacagccaccgtgtacttcaaagcactcaatgaagtccacaacgtcatgcagatgatcgacccactaactccagtcgttcccatcaccacgggcacctcagttgccgagctttatgctgacgcccgcgagcacctcgacaatggtgcaacccaggtgatgatccccgtcatttcaccttccaacctgaccttgtcagtagttgccctgggcaatgaagaggttgacgcactgggccattccgaaggacaagcagttcactcccttctggaaattcataccccgaagcgcagctggcctctttccgagctttatattgatgacaatgagggtttggctcaggtgtcgcgctgcttcgcccgccttgttggc

SEQ ID NO: 1299 - DNA, 750 bp, Corynebacterium glutamicum
atgagcactgatagccaaaaccctgtaagaaaatcctgcgcacagccacattcttgttcccaagaggtgcgattgaaagcgatgtccaggtcaccgcttactaaaggtctaaatcaacttgaacacctcgagttagataagtcactaactgcgtggtcgtgggcagaagatgatcctttgtacctcgcaggtgagaacttaaacggcagttacctcattgtcgcaggacgagtgcgggtctctcgcgacaccatcgacgggaaagaactcaccgttgatattgcaacgcccggcgatgttattggtgcgatagatacagaacctcagccggcagtagattccgcttgggcaatagaaaccacctgtgcgctgtttcttccagcaaccgcgttggcaactgtgattgaacagcatccaagttttgctttggcgatgattcggatgcagcagcaacgtttggctacagccagagatcatgaaattaacctgactacgaccacagttgagcaacgagtagctattgcagtgagaactctgggacgaaaaatcgggcaacgacgacccgatggaatcttgctcattcaagttcgaatccggcgggaagatgttgcgggtttagcaggcaccaccgtggaatctacttctagagttttggcgcgattacgtaaagaaggggtcattgatagcggtagggaatggattgccgtggtcgatgaacggcagctagatgccataatcggggaggacttt

SEQ ID NO: 1300 - DNA, 234 bp, Corynebacterium glutamicum
atgaccgccccaaacactctcaagcaaacaactcttcgctctgatgagttctcttgcccatcctgtgtctccaagattgaaaacaaattgaatggattggatggcgtcgacaatgcagaggtgaagttctcctccggaagaatccttgttgatcacgaccccagcaaggtctctatcaaggatctagtcgctgcagtcgcagaggttggctacaccgcaaagccatcagcaatc

SEQ ID NO: 1301 - DNA, 1875 bp, Corynebacterium glutamicum
atgaaaacgtggaagacctggggggtcgtcggagcttcaggcctcttgattattttgtcgtggttgagttcatcgagcccgatgctggcagatgcattcatgatcgcggctgcaattgttgcaggttggccgatcgcgcagtctgcatatcaagcacttcgcattcgaatggtgtcgattgacttactggtcgttgtggctgccgttggtgccatgttcatcaacaactattgggagtctgcggcggtgacgttcctctttgcccttggcaaggcactggaacgcgcgacaatgaaccgcacacgaaaagcactatcggatctggtggatgcagctccagaaactgcaacaaggctcaacgcggatgactcaacagaggtagttgagctgtgggagcttgagcccggtgacatcgtcttggtacgcaatggcgaacaaattcccgtcgatggaaacgtgattgcgggtgtcggtggaattgatgaatccaacatcacgggtgaatcaatgccggctgaaaagggtcaaggctctgatgtgtatgcaggaacctggctgcgatctggtgttttgagagtcgaggcaacaggaattggttcagactcaactttggcaaaaatcattcaccgcgttgaagacgcccaggatgacaaagcccgcacacaaacattcttagagaaattctctaagtggtacaccccgggcgtcatgatcgccgccgcagtggtgggacttatcacctgggacgtagaactagcactgacgctcttagtgatcggctgccccggcgcgttggttatctccatcccggtgtccatcgtcgcaggcatcggccgtgctgcacgcgatggcgtgctgatcaagggtggagaatacctagaaaccgccgcgaaagtcgacgtcgttgtcgtggacaaaactggaacgctgaccaccggccgcccagaactcacagacgtagaagtcatcgagcccgcctacagccagggcgaggtgctggagctcgccgcgcgcgccgagacggcttcagaacatccgcttgccgacgccatcatccgtggtgcccaggatcgggggctgtccacaacattggtggaagcagctgaaaacatcaccggccgaggcattatcgcaaatgttgatggacaggcagttgctgttggatctgctgagttacttgatcatgaaccagactcgaccaggatcctggagctaaatgccgaaggaaagaccgcgatgtttgtcggagtgaacggacacgccattggaatcgtggccgtcgccgacgccgttcgttcagattctgcctcagcaatcgaatcgctgcataaggcgggcattcaagttgtcatggcgactggcgacgctcaccgcgttgcacaaaacgtggcctccaagctgggagtggatgaagtctactcagagctactccctgaacagaaattagaactggtgcgtgatctgcaagctgccggcaaaacggtcgcgatggtgggtgacggagtcaacgacaccccagcattggcagctgctgatatcggagtagcgatgggcgtggcaggttcccctgcagccattgaaaccgctgatatcgcactcatggcggatcgtctcccacggctggcacatgcagtgaccttggcaaaacgcaccgtaagaaccatgcgcatcaatattctgattgcgttggctaccgtgatggtgttactagctggcgtcctatttggcggagttaccatgtcggttggcatgctcgttcacgaagcaagcgtgctgcttgttatcagcatcgccatgctgttgctgcgtccaacacttaaagaagatgctgcgcaagcaagtgatattaaacgctcggaaatacaacagatcgca

SEQ ID NO: 1302 - DNA, 630 bp, Corynebacterium glutamicum
atgtcagagaatttgccagcgcccgagaatctcctggacgccgagagaattcagatgatcaagaacttccgcaacgaattaacggggttcatgctcaactaccaatttggcattgatgagatcctgaccaagatcaacatcctgaaaactgaattcagccagctgcacgaatacgcacctatcgagcacgtatcttcacgattgaagacaccagaaagcatcgtcaaaaaggtcatccgaaaaggagacgagctctccctcgcagctatcaaagacacagtgtttgatatcgcaggcattcgaatcgtctgcagtttcctcaaagatgcctacgcaatcgccgatatgctgaccaaccaaaaagacgtcacggtcatcgaggccaaagactacatcgctaacccaaagccgaacggctacaagagtttgcaccttatcctccaagtgcctgtcttcctgtctaactccgtggaaaaggtcaatgttgaagtccagatccgcaccattgccatggacttctgggcaagcctcgagcacaaaatctactacaaatttgaacaagaagttcctcagtcaatccttgatgagctcagtgaagatggaaagaatccacggggaagtgaagtcact

SEQ ID NO: 1303 - DNA, 1581 bp, Corynebacterium glutamicum
atgccccgttcgacaataaaaagggtagtagcagttcttgccgcctcgactgcgcttagcccctttttggtatcaatgcccactgcagcagcgcaagaaaacatccgctgggaagaatgcccacctcaggtagatattgcctccgctcaatgtggcagcatcgacgtgcccatgcactattctgatccctcacttggcgatatcagcgtgggctttgtcaaggtccctgcccaaggcgaaaagcacggcaccatcttcggtaactccggtggccctggtggcgatgcctatagcttcttcggcagccaatccatgaactggccagaagccatgtaccaaaactacgacctcgttgcagtgcagcctcgcggaatggtcggctccacaccggttaactgcgacaacatcgcaccaggatacgatttcctctcgctgctcacccgcgaaggcgctttcgttaaagaatcctgcgagatcggcacccccggctacacctccagcctgaccaccgacaacaccgccaacgactgggagcgcgtccgccaagcacttggcgatgacaagatctccatcttcggactgtcctacggaacctacctcggatcggtctacgccacccgctacccacagcacaccgacaaggttgtcctcgattccgcaatggcgcccagcctggcatggaacggcatcatggcctcccaagaacagggctacaaaaactccctcaacgacttcttcacctgggttgcagaaaacaacgacacgtatggcctcggcactaccccactagccgtgtaccaaaactggtcaaacaagatcgtcgccgaaaccggaaccaacccaaccgttgctccaccaccagcacaagttggcgatgtcccaccagcattcgcatgggccggccaagcaggcgcagacatgatgaccgccaccaacccaacctccgtgcaactccagggccttgccacccagctcctaaaccctggatccaaccagtcactgagccctctgctcaacgtcacccgcgcctacatcccacagccatcaacctggcccatgctcgcaggcgccatctcagggcaaacacccatccctgacgtaactgacaccggcgacgacccatacgtcatcgaaagcatcaacgccagcgtcaacatgcagcgcatggtcatgtgcaacgaaaacaccgtcgcaccagacccagtagcaatggcacgcatggcctggacaagcatggtcaccggcgacgtctttgacatttactccgttaaattcagctccggacaagcctgctccggcatcaccccaacaagcggccgccagccaaccgacggatctcaactagcagtccaaccactactcctccagggaaccagcgacccacaaaccccatactggacccacaacgagcttgccgacgccatgaacgcccacgtggtcaccgtcaacggaccaggacacggccaatccatcggcggcaccaaccaagcaatcaacgacattgttgtggactacctccgcaccggacacaccgacgccacctgggtcgaaggcaacacacccaccccaattacggctggc

SEQ ID NO: 1304 - DNA, 603 bp, Corynebacterium glutamicum
atgaaccactctgacgacgatcgcatgcaaaagtggttccagatccgccgcgaactgggcaaagaaattgtgaaacagcttcaaaaggatctgcccgcagtcgcctctgacatcggctccatggtgtattcctctgatcaagttcccctcggaaacgccacgctcactgcatacggagacatcggcaaccgagtcgcttccgctgcaacaagtgcgagatacaacgtagaggaactcctggacgcaatcgaaaacgcacgatttgccatctgggttccaaattacgacaactcctactacctctccggcgaggaaggtgccgacgaattccaaacatacctcatcaaagatgcgtcaagatttcttgaatcctccgggaatactccacccgagaacccgcagtacagcgactccaaattaacctttgctagcgaactactccccttctacaccgcatttaacaactcgacctacccactacttcatgcttgtgtgcaaggtgaaccaactgaagtagacctctacttctacgagctcgagcaggcagaattgaaggaaaaagagactgcacagctctcgagtggatcaagttttggctccagt

SEQ ID NO: 1305 - DNA, 120 bp, Corynebacterium glutamicum
ttggagcttcgctcaatcattgttggtgcaggccttacagccattgcactgagttccatgctgtcgcagccagtacaggccttcaccatgaccattgagatggtgagtgtatttttcaca

SEQ ID NO: 1306 - DNA, 108 bp, Corynebacterium glutamicum
atgtggaagatcgcgtgggggttttggctgaattggctagcctgttctctgagcaaggaatctccctgcgtacaatccgacaggaagagcgcgatgatgatgcacgtc

SEQ ID NO: 1307 - DNA, 1260 bp, Corynebacterium glutamicum
atgtcgacgatgacgcaatgcacaaccccgacctccgcgccaaagcactttccatcggaacccagtgggcacacgtcatgggcattaaccacgccgaagccgaagaactcgacgaagccctctccccgctcattaaccgcctccgcgaaatgggctttgaccccaccgaaaccgaagaagcaaactccctcgctctacacagctgcccatttgtggtcaacgacaaacgcccatcagccttcgtctgcgccatccacgccggattcatccaagaaagcctcggtgaaaacaaccgcatccagctggaactcaaaccactcaacgcgccgggcacctgtaaggttcacgtgttcagcgaataattgctgcactaataaggcccccttcttgattcgaagggggccttccttgttgggcctaaggttggttaacttcaaccttgactggtcccgcaacctcaagctcaagcaccttaatgccagactcacgagcatcttccaaaaccttgtctggaattggctcagtggacagcaccatggcggttgggccggcaccggaaaggtatgccgcgtagccacggttgcgcaggcggtttacccactcagaggtaataggcaacacttctgcacgataaggctggtgcagacggtcacgagtaccctcccacagcaaatcaggacgctgctgcaacgcaacgatcatcactgcaacgcgggacacgttaaatcgcgcatcgatgtgagtgacttcagtgggaaggactcggcgcacagcttcggtggatgcgtggaaattaggaaccagcgcagtcgcacgaatattgtcctgcacctcaagtggtacagcagcatactgtggctggctcttgccgtcgatagacagatttgtccacgacaccactgctccacccagcacagaagccgcagcattatctgggtggccttcaaaggcagaggacaactgaacaatctgctcttgagtcagcgggaaatccgccaaaccattagctgcagcaacaccagcaaccgccgctgcagcagaggagccaagaccacgagactgcggaatgttgttgtggcacaccactcgcaatccaggaacttcagcgtcagctgccttcaggccagcacgaatagctttaaccaccaggtgggagccatcaagagggacttcgccttggccttcgccaaaaacttccacttccaagccagatggaataatttccacttcgacagtgtcgtataccgacagtgccaaacc

SEQ ID NO: 1308 - DNA, 690 bp, Corynebacterium glutamicum
gtgaccacacaaaccgcccctaccgcagcctccgatctttttgccgagtcctacaaactcagcccaaagcagcgcgaagttttagatgccctacaaaccttccctgacggtgcccgcgcgatcgatgtcgccaaaaaactcgaccttcacgtcaacaccgcccgcggccacctcgaagaactcgtagcaaaagaagccatccgagtagtcaccgcagcagccaaaggtcgcggacgcccctccctcatcttccaaacacgcgtccccgacaaccgcgctgtcgccaaagaatacatcaccctgatcgaactcatggccaacatgctcggcgatgtcgacgatgacgcaatgcacaaccccgacctccgcgccaaagcactttccatcggaacccagtgggcacacgtcatgggcattaaccacgccgaagccgaagaactcgacgaagccctctccccgctcattaaccgcctccgcgaaatgggctttgaccccaccgaaaccgaagaagcaaactccctcgctctacacagctgcccatttgtggtcaacgacaaacgcccatcagccttcgtctgcgccatccacgccggattcatccaagaaagcctcggtgaaaacaaccgcatccagctggaactcaaaccactcaacgcgccgggcacctgtaaggttcacgtgttcagcgaa

SEQ ID NO: 1309 - DNA, 777 bp, Corynebacterium glutamicum
atgtcaaactttgaaacgttcctctgggttgcctacccctggctgtgtatcgccgcctacatcatcggcatttcttggcgctggcgcgccgaccaattcggttggaccacccactcctcccaaatctacgaatccaaactcctccgcatcgcctccccactcttccactggggcatggtgttcgtggtgatcggccacctcatgggacttgccatccccaagagctggacccaagctgtaggaatttctgacgccgcttaccacctcatcgccaccatcccaggcaccattgccggcatcgctgcagtccttggactcatcggcttgattatccgtcgcgtgatcaacaaaaccgtcttcctgtccacctcacgctccgacaaagtgatgtatgtgctactcggcgctgcaattttgtccggtttcatcgccaccgtctccacccaggtcttcggcggcgcacacggctacgactaccgcgaaaccatctccccatggctgcgccaactgctcatcttcaacgctcaaccagagctcatggctgatgtcccttgggaattcaaggtccacatcgtcgctggattcaccctcatcgcactgtggccattcacccgcctagtccacgcgttctccgcaccagttggatacgtcacccgcccctacgtggtctatcgcacccgcgacaccacctctgaaccggcacgccaaaacgtcgcctgggaaccgatccgctcggtcaaaaatcagctcgacaatgactcgaaatggcacggcgcc

SEQ ID NO: 1310 - DNA, 732 bp, Corynebacterium glutamicum
ttggcgaacgccccgctgcgatgttcccaccaaggaaggactaggcggatgcgcacccatactggcaaaattccggatcactttgtgcctcgcatctccatgacggaggagcagcggcgcgtggtgttcatgctgaatagtttgctgttggattatccagaggagggattcgtcgacaagctaaatgccgtcgaggcgcagcttgatgtccttccgctccccgtcgcggcgcacgtggtcgagttccttgacgcggcacgcgtcgctgggctacgcgccatgcaggaagcctacgttgagacctttgaccagcgccgacgctgctcactgtttctcacctactacgctgtgggcgacacccggcagcgcggcacggcgatcctcaccttccgtcaaacgctgcaacagctcggatttgaatccgagcgcgacgaattgcccgaccacctctgcgtcgtgcttgaggccgcagcgcttgctgattcttcgcttttcgacgccgccacccaggtgttatcagctcaccgcgacggcatcgaagtgttgcgcgcagccctcgacaacctcgactcgccctacagatacctgatcatgtctttgtgccaggcattgccagaaatcgatgaagaaaccgccaacagctacatggagctcatccgcagcggtccaccagcagaaatggtgggcatcggcacgcctctaccgttccccacctcacaaccggacattcac

SEQ ID NO: 1311 - DNA, 1593 bp, Corynebacterium glutamicum
atgaaggtcatggctcagatcgcaatgatcatgaacttggataagtgcattggctgccacacgtgttctgtcacgtgtaagcaggcctggaccaaccgtcaaggtacggaatacatttggttcaacaacgtggaaacccgtccgggcgtgggttatccccgcggctgggaggatcaggataagtgggaaggcggttgggtccgcaccaactccggcaaattgaagccgaaggccggtggtcggttgaagaagctggcgaccatcttccacaacccgaagctgcccaccatcgatgattactacgagccgtggacctatgagtacgacaagttgctctcggcgccagcgggtcagaaaacacagcccactgcgcgtccggtcagtcagttggatggccgtcccatcgataaaattgagtggtcatccaactgggatgacaacctgggcggatccaccaccacgcttgatcaggatcccgtcctggagaagatgaacctcacggtgcaaaaagaaatcgaagattccttcatgttctatttgccccgcatctgcgagcactgcctcaaccccacctgtgtgtcctcctgcccatccggtgctatgtacaaacgcgccgaagacggcatcgtgctggttgaccaggatcaatgccgtggctggcgcatgtgtgtttccggctgcccctacaaaaaggtctacttcaatcacaaatcgggcaaggccgaaaagtgtacgctgtgctatccgcgcctcgaggtcggccagccgaccgtgtgctccgagacgtgcgtgggtcgcttgcgctacttgggcgttttgctttacgacgccgaccgtgtcgctgaagtcgccgccacgccagacgaaaaggatcttttcgaagcccaaaagaccctcttcctagatccccacgacccacaggtgatcgccgacgcccaacgcaacggcatcccgcactcctggctcgaagctgcgcagaactctccaatttacgatctcatcttcaaatacgaggttgccctcccgcttcaccctgaataccgcaccttgccgatggtttggtacattccgccactaagccccatcgttgatgaggtgaccgcgtccggcaacgacggcgaagaccacaagatcctgctcaccgcgctgtccaccatgcgcatcccgctggaatacctggctggattgttcactgccggtgataccaggccggtggaaaaatccctccgacgcctagccgccatgcgatcatatatgcgcgatatcagtttgggccgcgaacctcaggaagaaatcgcagaggctgtcggaatgaccggcaaggtggtgcaggaaatgtatcgcatcctggccattgccaagtatgacgatcgctatgtcatccccaccgcctcccctgagaccccgcgcggaatttcttccctggatcctttcggcgatgtcgatccagcccgagccaccgagcagctcaacatcggtttgggcgaaggcgctccagaggcctgtggcacgggagctcccagcggcaaggtgagtctgacctcgtggaacgttggcgaacgccccgctgcgatgttcccaccaaggaaggac

SEQ ID NO: 1312 - DNA, 594 bp, Corynebacterium glutamicum
atgatcttggccatcgtcttgccagggatcagcccgacctcatcaatatctggcacgataccgccaggcatattgagctcatccggggagtcatgggcaatcggtgcggtgatcacatcggtttgggtgcccaaccaggttgctgcctgtgaggagaattctttggtgagatcgtggaagacctcccagtcagtacgcgtctcccacggtgggttgatcgcagcattgaacgagtggatgaaggggtgcatatccgtggtggacaaatcatgcttctcataccaggtggctgccggcagcacgatatccgagaccaaggtggtggaagtgttgcggaaatccgtggtcagcatcaaatcgagctttccttccggagcctcatccctccacacaatggaacttggacgatcctccggcgcgttttcttcagcagatgcatcagaatccacacccaacatatggcgcaagaaaaactccgtgcccttagctgaagagcccattaggtttgtgcgccagttaagcagaatgcgtggccagttttccggtgcatccggatcctcgcaggcgaactgcaagtcaccatcggtgagctgc

SEQ ID NO: 1313 - DNA, 273 bp, Corynebacterium glutamicum
atggaattccttcaagatcacatggcccatggcaaaggcgagtgcgccgtcagtaccagggtggatgcgtgcccattcatcagcaaatttggtggagtcagcgaaatccggggaaaccacaacaaccttggtgcccttgtagcgggcttccaccatgaagtgggagtcaggcgtgcgggtcaccggaatgttggaaccccacatcatgaggtagctggagttgtaccagtcgccagattccggaacgtcagtttgatcgccgaaagtttgtgg

SEQ ID NO: 1314 - DNA, 3744 bp, Corynebacterium glutamicum
atgactacaactacttcttctgggaagtcttctgaaaagatcaaccccctcttcaagctcggcagtttcctaagaaaaggcaccgtcggttctgaaggccagcagattttccttcagggcggacgccaagccgatgtgttttatcgcaaccgatgggctttcgataaagtcgtgcgctccacacatggcgtgaactgcacgggctcctgctcgtggaaagtgtatgtaaaagacggtgtgatcacctgggaatcccaggcagtggattacccaactaccggtgcggatatgcccgactatgaaccacgtggctgccctcgtggtgcatcattttcctggtacacctactccccaacccgcatccgctacccatacatccgtggcgtgctagttgatatgtaccgcgaagccaaggaacgcctgggcgatccggtgctggcgtggcgcgacattgtagaaaccccagaaaagcgcaaagcatatgtatcccagcggggcaaaggtggcctcatccgcgttcagtatgaggaagccatggagattgctgcggcagcccatgtgtacaccatccgccaatacggccccgaccgcattcatggattcaccgttattcccgcaatgtcgcaggtgtcttacggtgctggtactcgcttcttgcagatgatcggcggagtggcgctgtccttctacgattggtacgccgacctcccaccagcatcaccacaaactttcggcgatcaaactgacgttccggaatctggcgactggtacaactccagctacctcatgatgtggggttccaacattccggtgacccgcacgcctgactcccacttcatggtggaagcccgctacaagggcaccaaggttgttgtggtttccccggatttcgctgactccaccaaatttgctgatgaatgggcacgcatccaccctggtactgacggcgcactcgcctttgccatgggccatgtgatcttgaaggaattccatgttgacaagaagacgccgtacttcatggactacatgcgcaaatacacggactctcctttcctcgtggaattagatgagcacggcgatggcacctacaccccaggtaaattcctcactgcagaccgcgcagctgatatctccccagcgcttgccgccactccaaatgccacccaccgtctccttgtgctgcaaaaagatggctcagttgtagatcccggtggcactgtcgcggaccgttggggtgaagaaggcatgggtaagtggaatctgcgcttagacggcgtagatccagtgatgactattgcagatgtacagactgacaccgaaactgcggaagtcctcttcccccgcttcgatctcccagcaactgccacccaagaaggccccattggtgctggcaccatcagccggggcgttcccaccatcacgttgaatggccgaaagtacaccactgtctttgatgtgttgctcgcacactacggtgtgaaccgcgaagagctcaaccttcctggtgagtggcctaaggatttccaggatccagtcatgggtactcctgcgtggcaggaagagctcacgggtgttcctgctaatcaggcgattcgtttgggtcgggaatttgctcagaatgctgatgattccaagggccgttcccagatcatcatgggtgctggtgtgaaccactacttccatgcggattctatttatcgcacattcttggcgctgacctctatgtgtggcacccaaggtgttaacggtggcggttgggctcactacgttggtcaggagaaactccgtccaatgaatggttgggcacagtatgcctttgctacagactggcagcgtccaccacgtcagatgatcaccactggtttctactacctcaccacggatcagtggaggtatgacaacactcgtgctaatcgtctggcttccccactggctaatcgtggcaccgtgggtgacaaaatgacggcggataccttggtggaatccatgaaacgtggatggatgccgtcattcccgcaattcaaccgcaatcccctcatcttgagccaggaggcggaagaaaagggcgtgtctgtttctgaccatattgttcagcagctcaccgatggtgacttgcagttcgcctgcgaggatccggatgcaccggaaaactggccacgcattctgcttaactggcgcacaaacctaatgggctcttcagctaagggcacggagtttttcttgcgccatatgttgggtgtggattctgatgcatctgctgaagaaaacgcgccggaggatcgtccaagttccattgtgtggagggatgaggctccggaaggaaagctcgatttgatgctgaccacggatttccgcaacacttccaccaccttggtctcggatatcgtgctgccggcagccacctggtatgagaagcatgatttgtccaccacggatatgcaccccttcatccactcgttcaatgctgcgatcaacccaccgtgggagacgcgtactgactgggaggtcttccacgatctcaccaaagaattctcctcacaggcagcaacctggttgggcacccaaaccgatgtgatcaccgcaccgattgcccatgactccccggatgagctcaatatgcctggcggtatcgtgccagatattgatgaggtcgggctgatccctggcaagacgatggccaagatcatcccggtggaacgtgattactccaaggtgtatgaaaagtggacacacttgggaccactcaccgccaaagcgggtaccggaacccacggcactgcgtttaacgtgaccaagcaaaccgaggagctggcgctgatcaacggcacctccatcacggagtctgctggtgaacgcccccgacttgattccgcagtcaaggccattgagatgattctgcacttaagtggcgtgtctaatggtgaggttgccgccgaaggtttcaagaatcagggtgcacgcgtgggcaccgacatgatggatctgattgcagaccacgaaggtacccacatcaattgggacatggtcaaagaacgtcccgccgaggtgatcacctcaccggagtggactggttccaagaaggacggacgtcgctacaccgcgttttccatcaacattgaatacgacaagccgtggcacaccctgtctggtcgcatgcactactacctcgaccacgattggtttattgattacggcgagcagttgccaatctttaggccaccgttggacaagatccacatcaatggtgaggtcggccctggccagtcggtcacaggcaccgacggcgaaccagaagtaaccgtgcgttatctgaccacccacaacaagtggtcgattcactcgcagtactacgacaatctgcatgtgctttctatttctcgtggcggccaggtgatctggatgtccaacaaggatgcagagaaactcggtatcgctgacaacgattggatcgaggcttataaccgcaacggcgttgtttctgctcgtgcgattgtctcccaccgcattcctgaaggcaccgtgtttatgaaccacgcgcaggaacgcaccgctggcaccccgctgaacgagaagtctggcaggcgcggcggaactcacaactctcttactcgaatcatgattaagccggtccatgttgccggtggctacggccacttaacctatggcttcaactacatcggcccaaccggaaataaccgcgatgaggtcaccagaattcgtcgccgctcccaggaggtgcagtac

SEQ ID NO: 1315 - DNA, 1350 bp, Corynebacterium glutamicum
atgaagaggcatcacgtgacacaactcaacaccaaaggcgttgttctgcaagggtgggatccagaagatcctgaacattgggactcgaaaattgcatggcgaaccctgtggattaccaccttctccatgattattgggttctgcgtgtggtatttggtttctgccatcgctcccctactcaatcgaattggatttgatctctcagcaggtcagctttattggctcgcatctatccccggtttggccggcggattaatccgattgatttacatgttccttccaccgattcttggaacccgcaaattggtcggaatttcctccggtctatttttgatccccatgtttgggtggttcctggctgtccaagattcaagcactccctactggtggcttctcacactcgctgcactcactggcattggtggtggcgtgttctctggatatatgccgtccacgggatacttcttccccaaggcaaaatcgggcactgcgctgggcattcaggcaggtatcggcaacctcggcgtctcgataattcagttcatgggcccatgggtcatgggtttcggtctgctgggcattggtttcctcaccccgcagcgcaccattgaaggcaccacggtgtttgtgcacaatgctgcgattgtgttggtcccgtggactattctcgcggccgttttatccttcctgtttcttaaagatgtcccagtcaccgcaaatttccggcaacagatcgatatctttggcaacaagaacacatggattttgtccattatctacttgatgacattcggtgccttcgccggtttcgccgcgcagttcggtctgatcatcaacaacaacttcggcatcgcttccccgatggcagagacttatccagctgagatgcttcacgccggtgctacgttcgcgtttcttggacctttgattggtgctttggtgcgtgctgcatggggtccactgtgtgacagattcggtggagctatctggacctttgtcggtggcatcggaatgactatcgccactgcagctgccgcaatcttcctaagcagagcggagacacctgatgatttctggccattcctgtggtccatgcttgccctgttcttcttcaccggtctgggcaatgctggcaccttcaaacaaatgcccatgattttgcctaaacgccaagcaggtggcgtgatcggctggaccggtgccattggtgccttcggccccttcattgtcggtgtcttgctctccttcactccaactgtcgcgttcttctggggctgcgtggtgttcttcatcatcgccaccgctttgacctggatctactacgcccgcccgaacgctccattcccggga

SEQ ID NO: 1316 - DNA, 489 bp, Corynebacterium glutamicum
ttgatgcccgcacagaacaaaaacctcccaggatccgtcatcgttgtgtctgatcggattaaatcgggagaaagaattgataaagcaggacccgtagcagtagaccttcttcaggaatcaggcgtggagatttccacattcaccgtcgtggaggagggctttgaacctgtccatcaagaattggttaaggcgttggcgcgccgggatcgcgtcatcatcaccatcggcggaacgggcgtggggcctagaaatcggacgccggaggccacagaaccgcacatcgatacgctactgccgggtctgatgacgcagattttgttctctggactgtccaataccgcgcaggcggggttatctcgggggctggtgggcttgagtgctcgcgattccacggccgcgctcatcgtcaacgcgccgagttcttccgggggcgtgcgcgacgcgctcggggtggtctgcccgcttttcggttccatttttgagcgtctt

SEQ ID NO: 1317 - DNA, 1866 bp, Corynebacterium glutamicum
atgcgcccctcttcccggccacttggcctcgtcctatgcaccgcactggcatcaacgatcatcaccgttcccgcagcgtccgcccaggagccagcgcttctcgatgcctccgccatcgccccacataccgccagctacggctactacgttgatgcatgggacaccaacgtttccactgatctgaatccatcaagtaatgcagctgttggcgtactggaggaaatgcttgagctgtggaccccaggcgaagaatggaacaccggcgtcaaggttgaccccaccgtgctggattccaacatcgcacagtctgtggcaatctcccagcaggcgaccgatgctcagcaagaacgtgcttgggttattgatcgccgcaaccagaactacaccgcaaccgacggtcttggcgcatacgcagatagttaccgcgagaccgcacaggtgggcaccaccatccctgacgttgttccagctgatgccaccaccgtgaagtacaacgatggcggcaatgtgaatggcaattgggcagagaccggtggagaactcggatccactgttgatctaattgaagctatccgtcagcatgccgcaaccagcaacaatgccaaggcgtactaccaatacccacgcccctaccgctggactgaatccatcgaaccagaagcctggggcgagggcgttgacatgccagagtatgcaaacccactgcgcaaggatgaatccgaagctgccagcgatggcggtttcccttccggacacacctccgcaggcggcatggcaaccaacggcctggcttacgctttcccacagcaatacgataaactgctcatgactgcagcggaaatcggcgaaagccgcatccagctgggcatgcactctccgcttgatgttattggcggccgtgttctatccaccgcgattactgcaggtgcacttaatgatccgaatctcgactcggtgaaggctgaagccttcgatgatgctcaggcatggatcagtaaccagagcgacatcaccaccaacactcgcgattttgatgagcaactcgccgagtacaccaacttcctcaccttcggcttcgagcagtccggcgacaccacccaagacatgcgcgtgccaaagggagctgaggctctgctggaaacccgccttccgtaccttgatgacgaacagcgccgttgggttctacattccactggcctcgagtccggtttcccagtacttgatgatgccgaaggttggggccgtctcaacctctacgctgcccaggctggctacagtgcattcgataccaacgttgacgtcaccatgaatgccatcgacggtggctacaacgccaaagacaactggcaaaacgacatcgagggcgcaggatccctgaccaagaacggttccggtgaactcaccctgtcaggtgacaactcctacaccggtggaaccaccatcaccgcgggcaccttggttgctgcaactgagtcagctctgggagcaggcgatctcaccatcaacgatggtgcaaccttgaagatcacccagcctgtcaccgtggatggaaccgcaaacctgggaggaactctgcacgttgcccttcctgttggcaccaaccacgtcaccgtgatcgatgctgcatcaatttccggtgaatttgatgaggttattgttgatggcgcagttgacgctcaggtgagctacgacaacggctctgtcgtgattactacaggcgcaccttctgatgacgtaaaggaaactggctcttctgctggcggaattcttgccatcgtggcagccctgggtggcattgcagcactgatcttcggtgcattcacccagtttggtttcccaccagcaatcaaggaaatgttcgacctt

SEQ ID NO: 1318 - DNA, 684 bp, Corynebacterium glutamicum
atgaatgacgtgtgggaaaaggtgggagggggcgtcgataagcacacgcaagctgccactgcgctgagctgcggcttgcacctcagcaaccgtggcgctggcgctgtgcgtaaatggagatgcggtcagggtttgaccgaccgtgattttatccagcttgataattccgctgatttgggcggcggattgctgatccagagcgccagtttctcgggaatgctcaatgagggcatggagggtatcggtgtcatagccaccagctgcagctcgatcaacgggagtttcaccaactttgcggaccaaatcgttcgccattttgttgatccactgcagcaatggacgaaacaggttaatgaagccccgtgcgggaatcgcgatagttcgaagtgccgtctccggatgcgcgattgcccaggatttcggagccatttcgccgatgaccaagtgcagaaacgttacgataaacagcgacaaaataaacgcaatgacatctgccataaccagcggtatacgcgcccattcgaagagcggcatcaaagcataatgaacccacggcttcgtgatagcacccaacgcgaaagtcaccatggtgattcccaactgcgcgcccgcgagcatgagagtaagttcattgaggcttcgcaacgcagcgcgggaagaccgcgaggtttccacagtctcctc

SEQ ID NO: 1319 - DNA, 1008 bp, Corynebacterium glutamicum
atgactgaatggtatgtcgttttacccgccactattctactcatcgcgctgtctgcgtttttcgtcatcattgagttcgctttgcttgcagctaggcggaaccggttagaggagactgtggaaacctcgcggtcttcccgcgctgcgttgcgaagcctcaatgaacttactctcatgctcgcgggcgcgcagttgggaatcaccatggtgactttcgcgttgggtgctatcacgaagccgtgggttcattatgctttgatgccgctcttcgaatgggcgcgtataccgctggttatggcagatgtcattgcgtttattttgtcgctgtttatcgtaacgtttctgcacttggtcatcggcgaaatggctccgaaatcctgggcaatcgcgcatccggagacggcacttcgaactatcgcgattcccgcacggggcttcattaacctgtttcgtccattgctgcagtggatcaacaaaatggcgaacgatttggtccgcaaagttggtgaaactcccgttgatcgagctgcagctggtggctatgacaccgataccctccatgccctcattgagcattcccgagaaactggcgctctggatcagcaatccgccgcccaaatcagcggaattatcaagctggataaaatcacggtcggtcaaaccctgaccgcatctccatttacgcacagcgccagcgccacggttgctgaggtgcaagccgcagctcagcgcagtggcagcttgcgtgtgcttatcgacgccccctcccaccttttcccacacgtcattcatgtgcgagacacccttggtgcctcgccagacgagaaggcttcgaagtggtctcgcccaatcctcaccgttgctgagaccgacacgttacaccaagcgctggaatacatgcgggagcataacgagcagatcagtgcggtgctttccgctgatgggaaaacggtgcttggtgtaataacttgggatcacatcttgaaatacctgtggcctgcatcggtg

SEQ ID NO: 1320 - DNA, 1401 bp, Corynebacterium glutamicum
ttgttaacagctgttttgtctttaattgctggtttggtggtcattggggtgatcatcgtcctcaacggatattttgtggctcaggaatttgcctacatgtccgttgatcgaaatgagctgcgagctctcgctgactctggagataagaaggctcgtcgcgctctcagcatcactaagcgcacatcctttatgctttctggtgcgcaattgggtatcaccgtcaccggacttttggtgggttttgtggccgaacctctggtgggtaacgcgttaggtgttctgctaggaggggtgggggttcccgctgcggtgtcaatctctgtgggcactgtgttggcgctagcgatctccacggttgtccaaatgatttttggtgaactcttccctaagaactacacccttgccacgccgttgaagtctgcgctggcgcttgcgccttcgaccacgtggtatttgaaactcgctggttggttgatcacattctttgattttgcatccaacgcattgcttcgactctttcgaatagagccggtggaagatgttgattcgtctgccactgcacaagaccttccgcatattgtggcgtcatctagggatagtggcgttttaaataattcgatgtctttgtcgcttgatcgattgttggatttcccgtcgcatgatgtgggtcatgcaatgattccgcgttcgcgtgtgggtgtggttgatccggagacaaccatcgctgaggttaaggccctcatgaggaaagcgcatacgcgttaccccatcatcgatgacaaccatgtgcccattggggtgatcaatctgattgatattcttggaaccgatattcacggcgccgaaatttcagattccgcgaaagtcactgagttcatgcatcagcctgtgatcgttccagagtttatgtctttgcctgacgtggtgaccgaactgcacaatcgtgaagacaggcttgcttgcgtgattgatgaatacggtggattcattggcattgtgacattagaagatttagctgaggaagtcctcggcgatatcaacgatgagcacgatgttttcagctctgaagatattacggaaacgagccctgacaaatggctaattgatggcgatacccctcttgacgaggttgagcgcgccatcgggtacgagctacctgaaggcgattacgagacgatttctggactgctctttgaccatgcgaatgcccttctaaagactggggatgtcatagaaatacctctggattttgagccagaggattacctgaacaacacctcccctacgcagcgtattttgcgcatcactgttttagaggtagagcgaaacgtgcctgtaaaactggcgctcgctctgctcgaagaccacccagacaatcaccccgctccgaaggagaatcgc

SEQ ID NO: 1321 - DNA, 561 bp, Corynebacterium glutamicum
atgaatatcatcattcttgctggtggcgagggtaaacgcatgggtggggtggataaggctgctgtggcggtggatggtcgcacgctgctggatatcctgctttcacagctggatccagaagatgacgtcgtggtggtttcccccgcgatcatcgacggaatcacgactgtctgcgaggaacctccgcttggcgggccggtcgcgggaatcgaggcagggctgaattcttttgagcacgcccatgaattcactgcgattcttgccgtggacgcgccttattctgcagcgatgctgcccctacttcaggcacagattggcaaagccgatgtggccgtaacccttgctgccgatggctgggtacaaccgttgtgcgcgctgtggagaagtggcagcctagaagcggtgattcacagcctgggcgagactagaaatcgaccggcaaaagcgttactgaagcaagcgggacacattgtggaagtgggtggcgatggcactgaaaaagactacgatacggtggctgaactggaggtattgggcaacgtaacgctccctaaagcccac

SEQ ID NO: 1322 - DNA, 1209 bp, Corynebacterium glutamicum
gtggcacagcaacgcagcgtcgatgactatctttccattttgatagacagcgtcgcaccgcttccgccagtaaaaacccctatcctcggcgcgcatccgttaagtcaccttgcagaggatgttgtcgcgacaattcctatcccgaaatttactaattctgctgttgatggttacgccattttgaaagaagacatccatggcagcgggccgtggacatttcttgtgggcggtgatactccggcgggttctgcgccggcgagcattaataatggaaaagccatccgtgtgatgacaggtggacccgtcccatccaccaacaaggacatgatcgtggttccagtggagctcaccaatgctccggtggatcactcgcttcctacagaaatcacgatcaatgagctaccaggtgagaggaataatattcgccatgctggtgagcatcttaaagaaggcgaaattgcggttgctgcggggacggcatttgatgcgggtactgtgtcgacggtgatttcagttggccatgacactgtaaaagcccatccttgccctcgggttgcggtgatcactaccggtgatgagctaaaccagggaaatccctggggtatccctaattccaatgggccgatgctggttgcggagctaaaacgcgtggggattaaggatccgcagcatttccattccgatgattctgagactgcattgagggagacgctcgataaggctgcagaggttgcggatgtgatcatcactgtgggtgggatctcggcgggcgcgttcgatgtggtcaaagccgtgggaactaagactggtggttttgaattcttccccattgcgatgaagccgggtaaaccgcaaggtcatgggcagtggggcgacgcaaaagtggtgtgtctgccgggaaacccggtggcggcgtgggttagttttaggctctttgttgttccggtaattgagagattagggggtggaaagaggctggcgtcgataagcgaactccctgtggtggcgctgcgctcgaaccgggcgctgaaggcgcgggagggcgccgtattggcgataccggtggcgattgattgggagaaaagaatggcaaattctcaggcacatcgatcccatatggtcggtgcactggctggaagtggcggtattgcactggtgacttcgtcgattgccgaggacggtctggttgatgttgtgctggggagaatg

SEQ ID NO: 1323 - DNA, 1131 bp, Corynebacterium glutamicum
atgactactcgcctttatctttcgccaacgccgccccgaaatgatcgggagggggcgtcgaaaagcacttctgcgagcatcaaacatgatgcgtacctgccacccgcagacggcaatcgcgtgcttgtggacagattcggacgcatcgcgcgtgacctgcgggtgtcactgaccgaccgatgcaacctccgctgcacctattgcatgcccgcggagggtttagagtggctgcccaccgagcagacgcttaacgacgccgaggtgctgcgactcatccgcattgcggtggttaagctgggcattcgtcaaattcgattcaccggcggcgagcctttactgcggaaaaatttggaagacatcatcgccggcaccgcagccctgcgcaccgacgaaggcgaaaaagttcacatcgctctcaccaccaacggccttggcctagacaaacgcatcgcaggactgaaagaagctggtcttgaccgggtcaatatttcactcgacaccatcgacgccgaacgctacgtctcgctaaccaggcgtgatcgattgtccggtgtgttggcgtccatcgatgccgctgttgccgctggccttcacccagtgaagatcaacgccgtggtcatgcctggggtcaatgaagtagatatcgtcccccttgcggaatactgcatttccaaaggctcccaactgcgattcatcgaacaaatgccacttggcccgcgcgagcagtggaaacgcggcgatatggtcacagccgaagaaatcctggcgcgcctggaagaaaaattcaccttatcccccgccaaggaaccccgaggagctgcacctgctgcgctgtggaatgtggtagataaatccaaccctgatatcactggacaaatcggcatcatcgcctcggtgacgcacccattttgcggagattgcgatcgctcccgcctcaccaccgacggcaccatccgaaactgccttttctcccgcactgaaactcccctacgtgacgcgcttcgcgacggcgcctccgacgatgagctcgcgcaactgtgggcaggcgccatgtgggagaagaaacccggccatggcatcgacgatgaaggcttcctccaaccagatcgccccatgtctgccatcggtggc

SEQ ID NO: 1324 - DNA, 1725 bp, Corynebacterium glutamicum
atgctcagcacgatgcaggacgtcccactgtcattaaccagaatcctcgagtacgggtccactgttcacggtgatactttgatcaccacgtggggcggtgccgatggcattgaacaagcacagcaaacttttagtgctgtgggggctagagctgcggctttggctcatgcgctgcatgattctttaggtattactggggatcagcgagtggcgtcgatgctctataactgcgcggaacacatggaaactatgtttgcagtcgcatgcatgggtgccgtgtttaatccgctgaacaagcagttgatgaatgatcagattgtgttcattctcaatcactctgaagctgaagtggttatcgctgatccgcgcatggctgaacaattgggtgagatcttaaaagaaacaccaaaagttcgtgccgtggtgtttattggaccgaatgatttctctagcgcggcggcccacatgccggagggaatgaagctgtattcctatgaagcgctccttgacggccgttccactgtttacaactggcccgagcaggatgaacgcactgctgctgcaatttgctattccaccggtacatcgggaccgccgaagggtgtggtgtattcccaccgctcgctttatttacagtcgttgagcttgcgcaccacggattccctcgcagtggaacacggcgaaacgttcctgtgctgtgtgccgatttaccacgtcctcagctggggcgtgccgatcgcagcgtttatgtccggcactcccctggtgcttcctggaccggatctttctgcgccgacattggcaaagatcatttccaccacgctgcctcgcgtggcgcatggcgtgcctactctctggattcagctgatggttcactacctgaaaaatcccccagagcgtatgtctctgcgtgagctatacgtgggcggttctgcggtgcctccaatcgtgatcaccatgtgggagcagcgctatggcgtggatgttgtccacgtgtggggtatgacggaaacctccaccgtgggtactgtgtctcgcccaccatcaggtgtttctggtgaaagccggtggaattatcgagtctcccagggccgattccccgcctccctgcagtaccgcattgtcaacgacggccaggtcatggcgtccaccgaccgcaacgagggcgagattcaggtccgcggtccgtgggtgactgcaagttacttccaccccgatgtggaaaaagaaggtggcaccgcctcaacattccgcgaccatgacgttgaagaggaaaacgatgagctcttcaccgccgacggctggctgcgcaccggggacgttggatctgtcaccagcgatggattcctcaccatccaagaccgcgcccgcgatgtcatccgttctggcggcgagtggatttactccgctcagctggaaaacctcatcgtggctacggaagaggttgtcgaatgcgccgtcattggcttccccgatgacaagtgggtggaacgtcccctcgcagtcaccatgctctaccccggcattgaacgcacccgggaaaccgccgagcgcctccgcgatcaacttcgcgaccgcctacccaactggatgctgccagaatattggacatttgttgatgaggtggataaaacctccgtcggtaaatatgacaagaaggacctccgcaaccacctgcgcaacggcgatttcgaagtaattaagcttaaagggccaggtgaaaaa

SEQ ID NO: 1325 - DNA, 2286 bp, Corynebacterium glutamicum
gtgacaaccacagacaacaccgcagcgaatcagggtgaactgaccgccctccgactgccggatctgcgcaaaattgccgccgaccttgggctcaagggaacctcggcattgcgtaagggcgatctgatcaacgccatctctgcagcccgcgagggtaagccaaccgcagctgcgaagaagacttccccacgcaaggccccatcacgcacccgtgcgacacagccttccgcaccggttgagcaagcacaagaagctcccgcgcaaacttcaactgcacctgcttcagcaccatctgaagagactcccgcagctcccgctcgtcgtggacgtcgccgtgtaaccaccaccgcgaccaccccagagccagcagcgcctgcacaatcccagcctgcagaagctcaaccagcacagactcaggctgcacagcaagaagaacttcctgttgcagcgaaggagtccgcaccagctacagaaaacactcagggccaagctcagggccaagctcagggccaagctcagggcgatgagcacgatgatcgttttgagtcccgttctgctgcacgccgagcacgccgcaaccgtcagcgccagatccaccgcgatggcgatgacaatgcgaatgcaaacacagagtctgagcagaacacccctgcccagaacgcaaccgcacaggctgagtctgagcagactgcagctcctgcacaggctgaagcagctgagcagaaccagaacgataacagcgagtcctccgagaaccgcagcgataactaccgcaacaacaatcgtcgttcccgcaacaaccggaacaatcgcaattaccgcgataacaacgagtcctctgataatgcaggacagtccagcaatgatgatgccgacaacaatcaggcacggtctgaggacaataacgacgatcgccgttctcgtaataaccgtaacaacgaccgcaatgatcgtaacgatcgcaatgaccgcgacaacgacgacaacgatgatcgccgcaaccgtcgcggacgccgcaatcgccgtggacgcaacgaccgtaacgatcgcgacaaccgagataaccgggataaccgcgacaacagcaacgatggcgacaacaaccagcaagatgagctgcagcaggtagcaggcatcctggacatcgtggaccataacgtcgcattcgtgcgcaccaccggttaccacgctgcaccttctgacgtgtttgtcagcaaccagctgatccgccgtatgggtcttcgttccggtgacgccattgaaggtcaggttcgtatgaaccagggtggtggcaaccacaacaaccatggtcgcaaccgtcagaagtacaacaacttggtgcgcgtggagatggttaacggtcttcctgctgaagagactcgcaaccgtcctgagttcggcaagctgactcctctgtacccgaaccagcgtctgcgtttggaaactgagcagaagattcttaccactcgtgtgatcgacttgatcatgcctattggtaagggacagcgtgctttgattgtgtcgccacctaaggctggtaagaccacgatcctgcagaacattgcgaacgctatttccaccaacaacccagagtgctacctcatggttgttttggttgatgagcgtccggaagaagttactgatatgcagcgctccgtcaacggcgaagtgatttcttctactttcgatcgtccaccatcagagcacactgcggttgctgagctggcgattgagcgtgcgaagcgcctggtggagcagggccaggacgtcgttgttctgcttgactccattactcgtttgggccgtgcgtacaacaacagctcacctgcatcgggacgtattttgtccggtggtgtggattccaatgcactgtacccgccgaagcgtttcttgggtgctgctcgaaacatcgaaaatggtggatctttgaccatcatcgcaactgccatggtggaaaccggctctgctggtgacaccgtgatcttcgaggagttcaagggcactggtaacgctgagctgaagctggatcgtaagatctctgagcgccgcgttttcccagctgtggatgttaatccttctggtactcgtaaggacgagctgttgctcaacccggacgaggctcgcattatgcacaagctgcgtcgtattctgtctgcacttgataatcagcaagccattgatctgttgatcaagcagctgaagaagaccaagtccaatgcggaattcctcatgcaggttgcttccagcgctccaatggcaggcacagaaaaagaggaggattactcc

SEQ ID NO: 1326 - DNA, 603 bp, Corynebacterium glutamicum
atgagcacgatgatcgttttgagtcccgttctgctgcacgccgagcacgccgcaaccgtcagcgccagatccaccgcgatggcgatgacaatgcgaatgcaaacacagagtctgagcagaacacccctgcccagaacgcaaccgcacaggctgagtctgagcagactgcagctcctgcacaggctgaagcagctgagcagaaccagaacgataacagcgagtcctccgagaaccgcagcgataactaccgcaacaacaatcgtcgttcccgcaacaaccggaacaatcgcaattaccgcgataacaacgagtcctctgataatgcaggacagtccagcaatgatgatgccgacaacaatcaggcacggtctgaggacaataacgacgatcgccgttctcgtaataaccgtaacaacgaccgcaatgatcgtaacgatcgcaatgaccgcgacaacgacgacaacgatgatcgccgcaaccgtcgcggacgccgcaatcgccgtggacgcaacgaccgtaacgatcgcgacaaccgagataaccgggataaccgcgacaacagcaacgatggcgacaacaaccagcaagatgagctgcagcagg

SEQ ID NO: 1327 - DNA, 696 bp, Corynebacterium glutamicum
atgcgacgttatggtccacgatgtccaggatgcctgctacctgctgcagctcatcttgctggttgttgtcgccatcgttgctgttgtcgcggttatcccggttatctcggttgtcgcgatcgttacggtcgttgcgtccacggcgattgcggcgtccgcgacggttgcggcgatcatcgttgtcgtcgttgtcgcggtcattgcgatcgttacgatcattgcggtcgttgttacggttattacgagaacggcgatcgtcgttattgtcctcagaccgtgcctgattgttgtcggcatcatcattgctggactgtcctgcattatcagaggactcgttgttatcgcggtaattgcgattgttccggttgttgcgggaacgacgattgttgttgcggtagttatcgctgcggttctcggaggactcgctgttatcgttctggttctgctcagctgcttcagcctgtgcaggagctgcagtctgctcagactcagcctgtgcggttgcgttctgggcaggggtgttctgctcagactctgtgtttgcattcgcattgtcatcgccatcgcggtggatctggcgctgacggttgcggcgtgctcggcgtgcagcagaacgggactcaaaacgatcatcgtgctcatcgccctgagcttggccctgagcttggccctgagcttggccctgagtgttttctg

SEQ ID NO: 1328 - DNA, 1023 bp, Corynebacterium glutamicum
atggttgttgtggttgccaccaccctggttcatacgaacctgaccttcaatggcgtcaccggaacgaagacccatacggcggatcagctggttgctgacaaacacgtcagaaggtgcagcgtggtaaccggtggtgcgcacgaatgcgacgttatggtccacgatgtccaggatgcctgctacctgctgcagctcatcttgctggttgttgtcgccatcgttgctgttgtcgcggttatcccggttatctcggttgtcgcgatcgttacggtcgttgcgtccacggcgattgcggcgtccgcgacggttgcggcgatcatcgttgtcgtcgttgtcgcggtcattgcgatcgttacgatcattgcggtcgttgttacggttattacgagaacggcgatcgtcgttattgtcctcagaccgtgcctgattgttgtcggcatcatcattgctggactgtcctgcattatcagaggactcgttgttatcgcggtaattgcgattgttccggttgttgcgggaacgacgattgttgttgcggtagttatcgctgcggttctcggaggactcgctgttatcgttctggttctgctcagctgcttcagcctgtgcaggagctgcagtctgctcagactcagcctgtgcggttgcgttctgggcaggggtgttctgctcagactctgtgtttgcattcgcattgtcatcgccatcgcggtggatctggcgctgacggttgcggcgtgctcggcgtgcagcagaacgggactcaaaacgatcatcgtgctcatcgccctgagcttggccctgagcttggccctgagcttggccctgagtgttttctgtagctggtgcggactccttcgctgcaacaggaagttcttcttgctgtgcagcctgagtctgtgctggttgagcttctgcaggctgggattgtgcaggcgctgctggctctggggtggtcgcggtggtggttacacggcgacgtccacgacgagcgggagctgcgggagtctcttcagatggtgc

SEQ ID NO: 1329 - DNA, 1074 bp, Corynebacterium glutamicum
atggcatcgcaggtttctgcagttgacgatattttgtcggagtaccacggtctggaacagcagatggctgatccggagttgcacaatgatgcggcagcagcgcgccgggtaggtaagcgctactcggagttgcagccgatcattaacgtgcaccgtgatttggtgtctgcccaggaagatcttgaggcagcccgtgaaatggcacatgaggaccatgagttccaggccgaggctgagcgccttgaggtggaagttgtggagttggaagaaaagctcgctgatcttcttgcacctcgtgatcctcatgatggcgaagacatcgtgatggaaatcaaggctggcgcaggcggcgaagaggcagcgttgttcgctggcgatttgttgcgcatgtaccaaaagtttgcggataagcacggctttgtcgtggaggttttggactctgcagaatctgacctcggtggtgtcaaggacatcaccttgtctattcgttcccgtcagccatcccgcgatggtgcgtggagccagttcaagtttgaaggtggcgtgcaccgtgttcagcgtgtgcctgttactgaatctcagggacgcatccagacctctgctgctggtgtcttggtttacccagaaccagatgaggtggaaaacgttgagatcgatgagaaggatattcgcgtcgatgtgtaccgttcctcaggtaagggtggtcagggcgttaacaccactgactccgctgtgcgtattacccacttgccaactggtttggtggtgacctgtcagaaggagcgctcccagattcagaaccgtgcgcgtgcgatgcaggttttggctgcccgtttacaggcgatgaaggaagaggaagcggcggctgaggctgctacgggacgtgctgcgcagattcgcaccatggaccgctctgagcgcatccgtacctacaactggccggaaaaccgcatcagcgatcaccgtattggttttaaggcgaacaaccttgattcggttctcgatggtgaattggatgatctgttcaccgcgttgcaggctgctgagcgtgcagaacgtcttgaggccgagggc

SEQ ID NO: 1330 - DNA, 837 bp, Corynebacterium glutamicum
atgctgacccttggggaagctttgcgcgacgccaccgccaccctggaaagggcgggggtggcgtcgccacttgtggacgctcgtttgattgcggctcatttgctgggttgcggtccgctcgatattgcattgcgcatgcgtgatgaggtgccggctgggtttgcggcggcggttgagcgtcgtgcgcgacgcgaaccgctgcagcacatcttgggcacggcacccatgggcccgttggatttgcatgtgggaccgggcgtgttcattccgcgcccggaaaccgaggtgctcgcggactgggccgtgcggcaggtggctggcgacgtcgaaaagcgaaaaatcgttgacctgtgcaccggatccggcgcgcttgcggcctacatcgggcatgcgcttatcgacgcgaccctctacgctgtcgaactcgatccgggggcagcgacctgggcgcagcgaaactttgatgaatttgccccgcaggtgaagctcatccacggtgatgtaacagatccgacattgttggctgaggtgcatggcacgatcgatctcgttgtgtcaaatccgccgtatgtgcctgaatctgatgatttggatccagaggtctaccaagatccacacatggcggtatttagtggcgctgatggcatggatgtcatcaacaagatggtgcacctgatcttcaatttgctgaaatctggtggggcagtgggcatcgaacatgatgacaccacttctgacgccgtccgccaagttttttctcagcacgggggatttggcactattgaagtgcttcatgatctcaccggcagagcgcgttttgttacagcgcgtaaactg

SEQ ID NO: 1331 - DNA, 774 bp, Corynebacterium glutamicum
atgcacctcagccaacaatgtcggatctgttacatcaccgtggatgagcttcacctgcggggcaaattcatcaaagtttcgctgcgcccaggtcgctgcccccggatcgagttcgacagcgtagagggtcgcgtcgataagcgcatgcccgatgtaggccgcaagcgcgccggatccggtgcacaggtcaacgatttttcgcttttcgacgtcgccagccacctgccgcacggcccagtccgcgagcacctcggtttccgggcgcggaatgaacacgcccggtcccacatgcaaatccaacgggcccatgggtgccgtgcccaagatgtgctgcagcggttcgcgtcgcgcacgacgctcaaccgccgccgcaaacccagccggcacctcatcacgcatgcgcaatgcaatatcgagcggaccgcaacccagcaaatgagccgcaatcaaacgagcgtccacaagtggcgacgccacccccgccctttccagggtggcggtggcgtcgcgcaaagcttccccaagggtcagcatttagccctcggcctcaagacgttctgcacgctcagcagcctgcaacgcggtgaacagatcatccaattcaccatcgagaaccgaatcaaggttgttcgccttaaaaccaatacggtgatcgctgatgcggttttccggccagttgtaggtacggatgcgctcagagcggtccatggtgcgaatctgcgcagcacgtcccgtagcagcctcagccgccgcttcctcttccttcatcgcctg

SEQ ID NO: 1332 - DNA, 648 bp, Corynebacterium glutamicum
gtgagcagaatctatgactgtgccgaccaagactcccgtgcagcaggcctaaaggcggctgtcgatgcagtcaaagccggtcagctcgttgtccttcccacggataccctttatggactcggctgcgacgctttcaacaacgaggcagtagccaaccttctggccaccaaacaccgtggccccgatatgcccgttccagtgctcgtcggcagctgggacaccattcaaggacttgtgcactcctattctgcgcaggcaaaagcgcttgtggaggcgttctggcctggtggactgtccatcatcgttccgcaggcaccaagccttccgtggaaccttggcgatacccgtggcaccgtaatgctgcgcatgccactgcacccagttgccattgaattgctgcgccaaaccggaccaatggctgtctcctccgccaacatctccggacatactcctccaaccaccgtgctggaggctcgtcagcagctcaaccaaaatgtcgctgtctacctcgatggtggcgaatgcgcgctggccaccccttcaaccatcgtggatatttcaggccccgcaccaaagattttgcgtgagggtgccatcagcgcagaacgcgttggcgaagtacttggagtgtcggcagaaagcctgcgc

SEQ ID NO: 1333 - DNA, 1146 bp, Corynebacterium glutamicum
atgggagtcggtttcgcgggaatcccgctgcgcgaattgggattggttatcctcgttgcagcggccatcacgtatctcagcacgggcatcatccgcaccgtcatggtgaaaagtggtcgcctcaatgagattcgtgaacgagacgtccatgtcatccccaaaccacggcttggtggcgtggcgatgttcagtggatttctcggcgcagtattccttgcggaccagcttcccgccttgactcgcgggttcatgcccatcaccccggagatgaatgccgtcatttgggcaggctttgtcatcgtggtggtgggcgcactggatgacctttttgatcttgatgccatcactaaattggtgggtcaagtaattggtgcggtgactatgagtttgcttggtctcacgtggtccatcctctatgttcccttcggtgggggcaccacattgcttctcgaccaagtccagtcaacaatcttgacatccctgttcaccgtggcgttgattaatgctctgaacttcgttgacggtcttgacggcttgagtgccggcgtaggaatgatcgcgggtgcagccatcctgctgttctccctgacgattctcttcgaccaaaacggcgccgtatcggcctatccgccggccatcatcgcagcggctctcgtaggaatttgcgcgggagttttgccccataattttgaaccctcgcgaatatttatgggcgattccggctccatgctcatcggcctgctgttggctgcagcatcgacctcagcgtcaggaaaaatcaacatgagcctgtatggcgcagctgattttatcgcattgatctcacccatcatcgttgttctcgccgccgtggccatcccactgctcgacctcgtgatggcagtggttaggcgcgtgggcaggggagcatcacccttttccccggacaaaatgcatctgcaccaccgactgctgtccatcggacacacccataggcgcgtggtcctagtgctctacacctgggcgagcgccgtggcattcggcgcagtgagcttctccgtcgttccgccactgtttgccaccggatcgagcatctgtggcatcctcatcgccgtcgctgtcacagccgtgccagtgatgaaaagccggcgagccgccaaacttgat

SEQ ID NO: 1334 - DNA, 486 bp, Corynebacterium glutamicum
ttgtcatattgggcgaataaaccggtaggattccccttcgtgagcgccgaaaataccgagaacacagattccccatttgaaatctccgagtttgatgatcaccgacgccccctccagcgggccctcaaattcggttccatcgccctaattgtcttcaccctgatctccctagcgatctggggtgctactcgcggcgtacccggcgtatggggagttgttatcggcgcagcagttggcggaggctttgtcctcttaacggctctcagcgtcctgtttacagctaattccaacgtcaccaccaccggtgcggtggtgctcggtggctggctgctgaagatcgttattctgatcatcgtgcttgcagtcatcaaagacatgaccttctacgacaacaccgccctttttgtcacagtggtgattgccttagtagttgtcctgctgactgaagtctggggagtcgtgacctctagggttacatacgtcgga

SEQ ID NO: 1335 - DNA, 249 bp, Corynebacterium glutamicum
gtgggcggagtgtccgtgctgggaaactggcggggaacttttagagataaccctccgaattgctggcaaatttctgatgaaatttctccgcgaagcccacatgaactacccccgtttaccctcaaaataagccctgtgacacacataacaccccctaatcgtacccgctcacacgctattttcgaggtgtggttcgccttcggaaacgaatgcccccgccccacttggataaaagacgaattcacctgt

SEQ ID NO: 1336 - DNA, 810 bp, Corynebacterium glutamicum
atgaagggcgaattccacgcccccgatttggacaaagaatttttcccggggcacgtaaccgatagtggtgaagtcgtgaacatgctgttcaccgatttcgctaatggttggttcgcaatggaccgcatcgtattgatccgtcttcttatgacggcagtcgttgtggtcttcttcctttgggctatgcgcaagccaaagcttgttccgcatggcgtccagaattttgcagagtacgcactcgatttcgttcgtattcacatcgctgaagacatcctcggaaagaaggaaggtcgtcggttcctgccgatcctggccaccatcttcttcgcggctctgttgatgaaccttgcaacgatcatcccgggactaaacatctcctccaactcacgtattgcattcccaatcgtgatggcggtagctggttacatcgcgtttatctacgcaggctctaagcgttacggattcttcaaatatgtgaagtcttctgttgtgattccgaacattccaccagcacttcacgtcttggtggttccaattgagttcttctctacattcatcttgaggccagtcaccctggcactgcgtttgatggccaacttccttgctggccacatcatcctggttctgcttttctccgcaacgaacttcttcttcttccagttcaacggatggacagcaatgtccggcgtaaccatcttgatggcagtactcttcacggtttacgagatcattgttatcttcctgcaggcatacatcttcgctctgctggtcgctgtatacattgagctttcacttcacgcggattctcac

SEQ ID NO: 1337 - DNA, 240 bp, Corynebacterium glutamicum
atgaacgagatcatcctggcacaggacgcaaccgagtccaccatcaccggacttggcgctgtcggctacggcatcgcaaccatcggacctggcctcggcatcggcatcctggttggtaaggctctcgagggtatggcacgtcagcctgagatggctggacagctccgtaccaccatgttcctgggcatcgccttcgttgaggccctggcactgatcggccttgttgctggcttcctgttc

SEQ ID NO: 1338 - DNA, 564 bp, Corynebacterium glutamicum
atggcgaattcgatttacaatttggcgcaagcagatgcgctgcctttggagagcggaaactcaattctgttccctcctctgtatgacatcgtctggtccctcatcccgtttttgatcatcctgatcgtattttggaagcttgttcttccgaagttccaggaggtcctgaccgagcgtgaggaccggatcaagggaggcattcagcgtgccgaagccgctcaggctgaggccaaggctgcccttgaaaagtacaacgcacagctcgctgaggcccgtactgaagctgctgagatccgtgagcaggcgcgcgagcgcggcaagcagatcgaagcagaactgaaggacaaggctaacgaagagagcaaccgcatcatcgagtccggtagcaagcagcttctggcacagcgcgagcaggtcgttaacgaactgcgccgcgaaatgggccagaactccatcaaccttgccgagcaccttcttggagatcagctctccgataacgtgaagcgctctggcacgattgatcgcttcctcgctgacctcgataccgtggcaccgaacggaaag

SEQ ID NO: 1339 - DNA, 813 bp, Corynebacterium glutamicum
atgcacgcagcaagccgcgaggcactggcaaaggtttcgtccgatctggacgctgctctagcagcagacaacaccatggcagttgccgcccaggctggaactgagcttttcgacgtcgtcgacattctcgacggcgaccgagctctgcgtgttgctgttgccgactcttctaaggacgcacacagccgagtcggcctcattgaggctgtcttcggtggaaaagtgagcccatctgttctcgaagtcctcaaggacgccgcagagcagacctggtccactccacgcgagttccgcgctggactagtccaacttggccgtcgcgcccttcttcgctctgcggagaaacagggtcagcttggtcaggtggaagatgaactgttccgactcagccgaatcctggatcgcgaaagcaagctgactcagcttctttcagatcgcactcaggaaattggcggtcgacgtgacctcctggctaaggtgctctacggcaaggtaactgctgttaccgaagccctcgcactgcaggctattggtcgccctgagcacaacccaattgacgatatcgcagctttggctggcgctgtagcagagctacagggtcgttccgttgcacatgtcgttaccgcagttgaactcaacgagggacagcaacaagcgctagctgaaaagctgggacgtatttatggtcgtgcgatgagcatccactccgaggttgataccagcctcctcggtggaatgatcatccgcgtcggagacgaagtaattgacggcagcacctcgggcaaactcgagcgtctgcgggcaagcttcgca

SEQ ID NO: 1340 - DNA, 1674 bp, Corynebacterium glutamicum
atgctggaagaaacaaccgagagcaggaagaacatggcggagctgacgatctcctccgatgagatccgtagcgcgattgcgaactacacctcgagctactccgcggaggcctcccgtgaggaggtcggcgtggttatttcggccgctgacggtatcgcccaggtttcgggcctcccgtcagtaatggcgaatgagctcctcgaattcccgggcggcgtcatcggcgtcgcacagaaccttgaagctgaccgagtcggcgtcgtggtcctgggtaactacgagctacttaaagaaggcgaccaagttcgtcgtactggagacgttctgtctatcccagtcggcgaggcattccttggccgcgttatcaacccccttggccagccaattgacggcctgggcgaaattgcatccgaagaggaccgcgtcctcgagcttcaggcaccaaccgtgcttgagcgccagcctgtcgaggagcctttggcaaccggcatcaaggctatcgatgcaatgaccccaatcggccgcggtcagcgtcagctgatcattggtgaccgtaagactggcaagaccgcagtctgtgtcgataccatccttaaccagaaggccaactgggagaccggcgacaagaccaagcaggttcgctgcatctacgtcgcaatcggtcagaagggctccaccattgcagccctgcgtaagaccctcgaggagcagggcgctctcgagtacaccaccatcgtggctgcacccgcttccgatgctgcaggcttcaagtggcttgcaccattcgctggcgctgctctcgcccagcactggatgtaccagggcaaccacgtcctggtcatctacgatgatctgaccaagcaggctgaggcataccgtgctatctccctgctgctgcgtcgcccaccgggccgcgaagcatacccaggtgacgtcttctacctgcactcccgtctgctggagcgcgctgcgaagctgtccgatgaactaggcgcaggttctattacagcactgccaatcattgagaccaaggctaatgacgtttccgccttcattcctaccaacgtgatttccatcaccgacggtcaggtattccttgagtccgacctgttcaaccgtggcgttcgcccggcgatcaacgtcggtgtatccgtctcccgtgtcggtggcgcagctcagaccaagggtatgaagaaggttgccggttctctccgtctggatctggctgcattccgcgacctggaagcattcgctaccttcgcatctgacttggatgctgcatccaagtctcagcttgagcgtggccagcgcctcgttcagctgttgattcagtctgagaacgcacctcaggctgttgagtaccagatcatttctctctggcttgcaggcgaaggcgcattcgacaacgttcctgttgaagatgttcgtcgcttcgagtccgaactgcacgagtacttaggctccaacgctgcacaggtctacgagcagatcgctggtggagctcagctttccgacgagtccaaggaaaccttgctcaaggcaaccgaagatttcaagagcgctttccagaccaccgatggcacccctgtcatcaacgagcctgaggttgaagcactcgatgcaggccaggtcaagaaagaccagctcaccgtttcccgcaaggtcagcaagaag

SEQ ID NO: 1341 - DNA, 975 bp, Corynebacterium glutamicum
atggcaacaattcgtgaattgcgtgaccgaattcgttcggttaactcaaccaagaagatcaccaaggctcaagagctcatcgccacctctcgcatcaccaaggcacagggtcgcgtcgcggcagctgcgccgtacgccgaggaaatccagcgcgtgctggagcgcctcgcgtcggcaagctccctagaccacccaatgctgcgtgagcgtgaaggcggcaagcgagccgccgtgctcgtggttacttctgaccgcggcatggctggtggctacaaccacaacgttctgaaaaaggcagcggagctggaaaagcttcttgctgaaagtggatacgaagtggttcgttatgtcaccggcaaaaagggcgtcgactactacaagttccgcgctgaagatgtggctggcacctggactggattctcacaggatccagactgggcagctacccacaacgtgcgccgtcacctcattgatggtttcaccgccagctctgaaggtgaagctgcatggcgcgagggactgaacctaccagaaggccaggatatccagggcttcgaccaggttcacgtggtctacaccgagttcatctccatgctgactcaaaacccagtagtgcaccaactgctgcctgttgagccagtcatcgaagatgaaattttcgaaaaaggcgaggatctgctgtcctcttccggcgaagtcgaacccgactacgagttcgagccggatgcagacactctgcttgaggcactgcttccgcagtacgtctctcgtaggctgttctccatcttcttggaggctgcagctgcagagtccgcttcacgtcgaaacgcgatgaagtctgcgactgacaacgctacggaactggtcaaggacctgtcccgtgtggccaaccaggcacgtcaggcacagatcacccaggaaatcacagagattgttggtggcgcaggcgcgctcgccgacagcggagaaagtgac

SEQ ID NO: 1342 - DNA, 1449 bp, Corynebacterium glutamicum
atgactacagctcttgaagagcagaacgcacagcaggcagccactgccggccgtgtcgtgcgtgtcattggtgcggtcgtcgacgtggagtttccccgcggcgagctgccagcactgtacaacgcacttactgtagaggtaaccctcgaatcagttaagaagaccgttgttctcgaggttgctcagcacctcggcgacaacctcatccgcaccatcgctatggcaccaaccgacggacttgtccgcggtgctgctgtaaccgatactgcacgcccaatttccgtaccagtgggcgatgttgttaagggccacgtattcaacgctttgggcgactgcctagacgacgtttccctgaacaacaacccagagatcgagcgttggggcatccaccgcgagccaccatcattcgatcagcttgagggtaagaccgagatcctggaaacaggcatcaaggttatcgaccttctcaccccttacgttaagggtggaaagatcggcctcttcggtggtgcaggtgtgggtaagaccgttcttatccaggaaatgatcacccgtattgcacgtgagttctccggtacttccgtgttcgcaggtgttggtgagcgtacccgtgagggcaccgacctcttcctcgaaatggaagaaatgggcgttctccaggacaccgccctggtgttcggtcagatggatgagccaccaggagtccgtatgcgcgtggctctgtccggcctgaccatggcggagtacttccgcgatgttcagaaccaggacgtgctgctgttcatcgacaacatcttccgtttcacccaggcaggttctgaggtttccacccttctgggtcgtatgccttccgccgtgggttaccagccaaccctggctgacgagatgggtgttctccaggagcgcattacctccaccaagggccgttcgattacctctctgcaggccgtttacgttcctgccgatgactacaccgacccggctccagcgaccaccttcgctcacttggatgcaaccaccgagcttgaccgctccattgcttccaagggtatttacccagcagtgaacccactgacctccacctctcgtattctcgagccagcaatcgttggtgagcgtcactacgaggtttctcagcgtgtcatcggcattctgcagaagaacaaggaacttcaggacatcatcgccatccttggtatggacgagctttctgaagaggacaagatcaccgttgcacgtgcgcgtcgcatcgagcgcttcctgggtcagaacttcttcgttgcagagaagttcaccggtcttcctggctcctacgtgccactgaccgacaccgtcgacgctttcgagcgtatttgcaacggcgacttcgaccactacccagatcaggctttcaacggcctcggtggtttggacgatgtcgaagctgcatacaagaagctgaccggaaag

SEQ ID NO: 1343 - DNA, 372 bp, Corynebacterium glutamicum
atggctgaaatcaccgttgaactggtgtctgtagagcgcatgctgtgggccggccaggcctccatcgtgactgcacagaccaccgagggtgagatcggcgtgctgcccgatcacgagcctcttctcggccaattggttgagaacggtgtcgtgaccatccagccgatcgacggcgaaaagcttatcgccggcgtttcggatggattcctctccgtatctaaggaaaaggtgacgatcctcgcggacttcgccgtctgggcgaatgaggttgataccgcatccgccgaggctgaccttaattcggacgacgagctggccaaggcacacgccgaggctgggctgcgcgcggtccgccgcagcagcgaaggtctc

SEQ ID NO: 1344 - DNA, 471 bp, Corynebacterium glutamicum
gtggaatatttgacctggggtttggtgattgttgcagtgtcggcagttcttcttgctgcctggcggtttttcaccttacgttctcggggaaccactgtgattctgcgtgagttgccacaaagcggtgtgcatggctggcgccatggatcatttcgctacaacggcaacgacttggagtacttcaagctgcgctctttgtctcccatggctgaccttattttgaaccgcctttcagtaactttgcttgatcgtagagatccagctgctgatgaggcggtttttatgtctcaaggcttaaaaattctgcacattaaatccaaaaatgatcagattgaattagctttggacgcccacggggagatggcgtttactgcctggttggaagcagcaccagatgcgcgggcggagcattcattgaatccacgtgatttcaaccgctttcgagccagcaaagacacccgcaaaaaccgc

SEQ ID NO: 1345 - DNA, 690 bp, Corynebacterium glutamicum
atgcgtttagtcatcgcccgttgctcagttgattatgttggccgtttggaagctcatcttccgtccgccgatcgccttttgatggttaaggcggatggttctgtatccatccatgccgatgaccgtgcctataagccactgaactggatgacacctccatgttctttagttgaaactcccatcactgatgaagatggtgaagcaacaggggaaagcctgtgggtggtggaaaacaaaaagggcgagcagcttcgaattactgtggaagaaattcattcggaacaaaacttcgatctaggccaagacccaggtttggtgaaagacggagtggaagatcatctccaagagcttcttgcagagcacatcactacgttgggtgatgggtacacattgattcgtcgggagtatccaacagctattgggcctgtcgatattttgtgtcgcaactctgacggcgagactgtcgctgtggagatcaagcgtcgtggtggcatcgacggcgttgagcagttgaccaggtatttggaattgctcaaccgtgatgaattgctcaagcctgttcatggagtgtttgcagcccaggagattaagcctcaggcaaagactctcgcggaggatcgtggcatcaagtgcgtgacgttggattatcaagcgcttcgtggcattgagtccaatgagctgacattgttc

SEQ ID NO: 1346 - DNA, 285 bp, Corynebacterium glutamicum
atgggccgaaaaaatagaagaaccaatattcagccagctagggacctgccggtcgatggtacctcctattggggaactcaaactcaggagggccctagctggacgtttggtgagccgtatttggtgagacagattggttcatcggcggcgaagaagttttatatttgccccggatgtaaccagaacattccgccgggtgtagctcatatcgtggcgtggccgaaggaagccggcgggcgcgctgatgatcgccgacactggcacaaaccttgctgggagcgtcga

SEQ ID NO: 1347 - DNA, 453 bp, Corynebacterium glutamicum
atgtctaccgaacagtctttgaatatcccccacgaatacgtcatctgcctcgatcatgttggcatcgccgtccctgacctcgaggaagccatcgaattttaccgttccgcattcggctgggtaaaccaccaccaagaaatcaatgaggaacaaggcatttcagaggccatgatcggccccaaagacattaaaagcacagaaggcatgattcagctcatcgcgccgctcaacgaggactccacaatcgccaaattcctcgaaaagaaaggtcccggcatccagcaaatgtgcctgcgcaccaacaacatcgatgcgctctccgagcacctgcgccgccaaggcgtgcgcctgctctaccccgaacccaaaaacggcaccggcggtgcccgcatcaacttcctgcaccccaaagacgcgggcggcgtgctgctcgagatcacgcagcctcaaagc

SEQ ID NO: 1348 - DNA, 312 bp, Corynebacterium glutamicum
gtggcagatatgattgttgctttttctgtagccccgactgttactgataatccagatgctgagatggccgatgcggtcacggaggcgattcgaatcgtccgcgcatcgggtctgcctaatgaaactaacgcgatgttcacgctcattgagggggagtgggatgaggtgatggcggtgattaaggaggccactgaggcgatctctagggtatctccgcgtacatcgttggtaattaaggctgatattcgtccgggacacactggccaattgacgaggaaggtggaggcggtggaggaacgcctagctagggat

SEQ ID NO: 1349 - DNA, 921 bp, Corynebacterium glutamicum
gtgacgtccccgcataattttgtcagtggtgctattgatctgggtgaggtgaaagcgcgtgcggatgcgcgccagaaggcccatgagcaggggccggtaactcagggcattgctagttcccttgatgtgaccatggagaacctggagaatgaggtgctgcgtcgttccacgcaggttccggtgattgttctcgtgggtaccccgcgcagccctgattcggagcagttgaagtcggatctgaccacgcttgctgctgaaagtggcaggaagttcattttcggttatgtcaatgctgataccgatgctgatgtggcccaggtgtttggggtgcagggcttgccgtcggtgattgctgtggcagcgggacgccctctggctgatttccagggcggacagccagcggatgcactaaagcagtggactgatcaggtggttcaggctgtgggtggacagctggaaggactgccagaggaggccacagacggcgaacaagaagacgctcctgtggaagacccccgcttcgatgctgccactgatgctctaaaccgtggcgctttcgatgaggcgattgcggtttatgagtccattttggcgcaggagccaaacaacgctgatgcgaagcaggcacgcgataccgcaaagctgttgggccggcttgccacggtggatccttcggtggatgttgtcgctgctgcagatgctgatccaacaaacgttgatctggcctacacagcagctgacgcggctgttgttgcgggtgatcctgaggctgcctttgatcgtttaattgctctgctgaccatcagcgctggcgatcagaagaatcaggtgaaggaacgtttgctggagctgtttggcatgtttgagaccgccgatccccgtgtgctgcaggcgcgaggaaagatggccagcgcgctgttc

SEQ ID NO: 1350 - DNA, 1143 bp, Corynebacterium glutamicum
atgacattaactttccattggttcctatccacttcaggcgattcccgcggcatcatcggcggcggtcacggtgcagaaaaatccggcacctcccgcgaattgagccacagctacctcaagcagttggcgctagctgccgagaccaacggttttgaatctgtcctgacaccaacgggcacgtggtgcgaagatgcgtggattactgacgcttctttgattgaggcgacaaaacgcttgaagttcctcgttgcgcttcgccctgggcagattggacctacgctgtctgctcaaatggcttctactttccagcgtctgtctggcaaccgtttgctgatcaatgtggtcaccggtggggaagatgcggagcagcgtgcgtttggtgatttcttgaacaaggaggagcgctacgcccgtaccggagaattcttggatatcgtgagccgcttgtggcgaggcgaaaccgtcacgcaccacggtgaacacctgcaggtggagcaagctagccttgcgcatccgccagagattattccggagattctttttggtggatcgtcgccagctgcaggtgaggtggctgcacgttatgcggacacctatctcacgtggggtgaaactcccgatcaggtggcgcagaaaatcaactggatcaacgagctagcagcacagcgcggccgggaactgcgccatggaatccgcttccatgtgatcacccgcgatacgtctgaagaagcatgggtggtggcagagaagttgattagcggggtcactccagaacaggtcgctaaggctcaagccgggtttgcaacgtctaagtcggaggggcagcgccggatggctgagctgcacagcaagggtcgtgcctttactagtggctcaactgctcgtgatctggaggtgtatcccaatgtgtgggcaggcgtcggtttgcttcgcggaggtgcaggaacagcccttgtgggctcgcatgaagaggtcgccgatcgcatcgaagaatacgcagcactcggcttggatcagtttgtactgtcgggttatccaaacttggaggaggccttccacttcggtgagggtgtgattccggagctgctgcgccgcggtgtggatatcaaaaatcaagaatcacgagttttggaacctgttggg

SEQ ID NO: 1351 - DNA, 768 bp, Corynebacterium glutamicum
atgactacaaccttgactcgccccaaaatcgcgctgcccgcgcgcatctattcaccgcttgcggtgcttgttttctggcagctcggctcgagcctgggcgccatcccggagcggattctgccggcaccaaccacgatcttggccgccagctgggaggtcgccacaaatggcacgcttctcgacgccctcctcgtctcaagccaacgcgtccttctaggcttcgccctcggtgctgtcctaggcatttccctaggtgtattgacaggcatgtccagatttgcagacaccgccgttgatccgctcattcaagctgcccgcgcgctgcctcacctgggtcttgtgccgctgtttatcatctggttcggtatcggtgagctgccgaaagtactgattattagcctcggcgtgctgtatccgctgtacctcaacaccgccagcgggttcaggcaaattgatccaaagcttctggaagccggccacgtgatgggcttcggatttttccagaggttgcggaccatcatcattccttctgccgcgccgcaactttttgtcggcctgcgccaagcaagtgcggccgcctggctctcactgatcgtggcggaacaggtcaacgcccgcgaaggactcggcttcctcatcaacaatgcgcgcgatttttaccgcaccgacctcgttattttcggcctcattgtctacgccagcctcggtctgctgtctgaagcgctgatcagagcttgggaacgtcacaccttccgctaccgaaacgca

SEQ ID NO: 1352 - DNA, 729 bp, Corynebacterium glutamicum
atgactgccacattgtcactcaaacccgcagccactgtccgtggattgcgcaaatcatacggaactaaagaagtcctccaaggaatcgacctcaccatcaactgcggcgaagtaaccgcgctgatcggacgctcaggttcaggaaaatccaccatcctgcgcgtgttggcgggcctatctaaagagcattccggctctgtagaaatttccggaaacccggccgttgccttccaagagcctcgcctgttgccgtggaaaacggtgctcgataatgtgacctttggcctcaaccgcactgatatttcctggtcagaagcacaagaacgcgcctcggcactgcttgcagaagtcaaacttcccgactccgacgccgcctggcccctcacgctctccggcggccaagcccagcgcgtctcccttgcgcgagcgctcatctccgagccagagcttttgcttctcgacgaacccttcggcgccctcgatgctctgacaagactgacagcccaagacctgctgctcaaaaccgtgaacacccgaaacttgggagttctgctggtcacccatgatgtttccgaggccatcgccctggccgaccacgtccttcttcttgacgacggcgccatcacacacagtttgactgtagatatccccggcgatcgccgcacccacccctcctttgcctcctacaccgctcaactccttgagtggctcgaaatcaccacacctgcc

SEQ ID NO: 1353 - DNA, 957 bp, Corynebacterium glutamicum
atgaaatttaagaaaatcgccctcgttctcgccttcggtctaggccttgcatcctgctcatcagcttctggcgatcccgccaccaacgccgatggatccatcgatctgagcaaagtaacccttaacatcggtgatcaaatcgccggaacagaacaagtgctccaagcttcaggggagctagatgatgtcccttataaaatcgaatggtcatcatttacctctggaccaccccaaatcgaagcattaaacgcaggtcaaattgatttcgcgatcaccggaaacaccccaccgatcatcggcggccccaccaacaccaaagtggtctccgcctacaacaacgatgctttaggtgatgtcatcttggtcgccccggattcttcaataacctcggtggctgaccttgctggaaagaaagtggctgtcgcccgcggatccagcgcccacggacacctcatccaacaactagaaaaagcaggcgtgagcgttgacgacgtagaaatcaacctcctccaaccctccgacgccaaagccgctttccaaaacggccaggtagatgcgtgggcagtgtgggatccctacagctcacaggcggaactggaaggagctcaagttttggtcaggggagcgggactggtcagtgggcatggatttggtgtcgcaagtgatgaagcgctcgatgaccccgcaaaggaagccgccttggcagatttcctcgatcgcgtggccgactcttatgaatgggctgaagacaacaccgatgaatgggcgacgattttcagccaagaatccggctttgatccggaggcctctcaactgaacacccgcagcctgcgccatcaggtgccgctcgacgagtccgtcaacacctatcagaacgcgcttatcgacgctttcgtctccgcgggtctcgttgaggactttaatttcgaggacaccgtagacacccgatttgagggc

SEQ ID NO: 1354 - DNA, 2193 bp, Corynebacterium glutamicum
atgaccgttgaccccgcgagccacatcaccatccctgaagcagatctggcccgcctgcgccactgcaaccatcacgatcctcatggattttatggttggcatgagaccgaagctggttcggttatccgcacgcgccaggtcggcgcgacgcaggttaatttgcttatcgacgacacctcccacgtcatgacccctatcggcgacgacattttcgcaattgacttaggtcaccgcgagcgcgctgactatcgcttggaagtcacctggcctgatcaagaaccgcaggtcaaggctgatccatactacttcctccccaccgtaggcgagatggatatttacctcttctctgagggacgccatgagcgtttgtgggagattctcggtgccaacatcaagacctaccaaactgcgctcggaacagttcgtggcaccgcatttactgtgtgggctccaaacgcaattggctgcgcagtggtcggtggcttcaacggttggaatgcatcccagcatccgatgcgttctatgggtggttcgggtctgtgggagctgttcatcccaggcatagaggaaggcgaagtgtacaaattcgccgtccaaaccagggaaggccaacgtcgtgataaggccgatccgatggctcgtcgcgcagaactggcgccggcaaccggatctattgtcgcttcctctgagtaccagtggcaggattccgagtggctgcgcgagcgttcccaaactgatctcgcatccaagccaatgagtgtctacgaggtccacctcggttcttggcgctggggtaagaactatgaggatttggctactgagctggttgattacgtcgcagatcttggctacacccacgtggaattcctccctgtcgcagagcaccccttcggtggttcctggggttaccaggtcaccggctactacgcaccgacctctcgttggggtactccagatcagttccgtgcgctagtcgacgctttccacgcccgcggtattggcgtgatcatggactgggttcctgcccacttccctaaggatgattgggctcttgcccgctttgatggcgaagccctctatgaacaccctgactggaggcgcggcgaacaaaaggattggggcaccctggtctttgacttcggtcgcaacgaagtccgcaacttcctcgtcgctaatgcgttgtactggattgaagaattccacatcgatggtctgcgcgtcgacgccgtggcctccatgctgtacctcgattactcccgtgagcacggcgaatgggaaccaaacatctacggtggtcgcgagaacctcgaggcagtgcagttcctgcaggaaatgaacgccacggtgctgcgactgcaccctggtgcgctcaccatcgctgaggaatcaacttcatggcctggcgtgaccgcaccaacgtgggacggcggcttgggattctccctcaagtggaacatgggctggatgcacgacaccttagagtacttctccaaaaaccctgtgcaccgcgcattccaccacagtgagctcactttctccttggtgtacgcattctctgagcgttttgtacttccgatctctcacgatgaagtcgtccacggcaagggttccctgtgggaccgtatgcctggcgatacgtggaacaaggccgctggtcttcgcaccttccttgcgtacatgtggtcacacccaggcaagaagctgcttttcatgggtcaggagtttggtcagcgtgaagagtgggctgaaggccagggactgccatgggatattgtcgacggctggcaaggcgagtaccacgaagccatccgcactctgacccgctccctcaacggtgtctactcagactcccctgcgctgcacactcaggatttcaccggagaaggcttcacatggaataagggcgacgacgccaccaacaacattttggcgttcactcgtttcggcagcgacggctcccagatgctgtgtgtattcaacctgtctggaacctcccagcctgagtaccagctcggtgttgcagcgggtggcgaatggaagctcgttctcaacactgatgatgctgaattcctcggtgcagaaaacgatatcgctacttccgttcaagcagcagcgacaccacgcgataatttcgcctactcactctcactgcatgtcccagcgatgagtgctcagttctactcactgcagaag

SEQ ID NO: 1355 - DNA, 1494 bp, Corynebacterium glutamicum
ttgcgtgagttggtcacgatgggtgaaaacctgcaggttcgtgtcgagcgtcgtgccgctttggtcaactcttggtatgagcttttccctcgttccacaggtggttgggatgagtccggcacccccgttcatggcactttcgctaccactgctcaggcgttggagcgtgtcgcgaagatgggcttcgatactgtttacttcccgccgatccatccgattggcgaggtcaaccgcaagggccgcaataatacgctgaccccggaacctcatgatgtgggttcgccgtgggctattggttctaaagatggtgggcatgatgcaacgcatccgcggttgggcaccattgaagatttccaggcgttgttggctcgcgcacgggaactcaatttggaagttgcactcgatctagctctgcaggctgcccctgatcatccatgggcgcaggaacaccgcgagtttttcacggtgttggctgatggcaccattgcgtatgcagaaaacccaccgaagaagtaccaggatatttatcccatcaactttgataatgatgctccgaagatctacgaagaggtctatcgtgtggtgaagttctgggtggatttgggtgtgaccacattccgcgtggataacccgcacactaagcccgctaatttctggcagtggcttatttctgccatccataaatcaaaccctgaggtcattttcctagcggaggcgtttactcgcccggcacgtctgtatggcttggccaagattggtttctcccagtcttacacctacttcacgtggaaggtcaccaaggaggagctcaccgagttcgctactgagatcgcccgcatggcggatatttctcgtccgaacctgtttgtgaacactcccgacattttgcatgcgtctctgcagcatggtggacgcgccatgttcgctatccgcgccgcattggccgccacgatgtctcctgtgtggggcgtatattccggatatgagctctttgagcacgaggccgtcaagcctggttcggaagagtacttggattctgagaagtacgagctgcgtccccgcgatttcgagggtgctctggaacgtggcgattctctcgaggattacatcgctctgctcaaccagatccgtcgcgcgaaccctgccttgcagcaactacgcaacatccacttccacgaagcggacaatgatcagatcatcgcctactccaaggttgatgctttgaccggaaataccgtgttgattgtggtcaacttggatccacgtagtgctcgtgaggctactgttcgccttgatcttggagcgcttggcttagaagcgggtgcacagtttgaggtgcgcgatgcgatcaccggctcccgttacctgtggtcagagacgaactttgtccgcctcgagcccctacgcgatgtcgcccacatctttgttcttcctgaacttccagcgtctcgccgtgagcgtctcgcgtggcgcgaaatcaagacctaccgcgcg

SEQ ID NO: 1356 - DNA, 348 bp, Corynebacterium glutamicum
atgagtgacactcgcggtgagcgctggggcgagacgtgcgcgtacatcgccgccgcgccgcagagaggaggcgacgtcgaaaagcgcagtcctatcctctttagacaaattctccgcagcacgctcaaacagctgagccccgtgctcaaagtcgttatacaactcatccgaaccctgaccggcctcaatcttagtggtaatcgcatgacgccacgtagccataggatccgaccacgcatctacacgaaatgtccaattaccagggacatcaggaacgaaaaatgcattcgactgatcctgattatcaggagtggggcgcatatgaatctgaataggctcagccgccac

SEQ ID NO: 1357 - DNA, 879 bp, Corynebacterium glutamicum
atgggagatgtgactaactctataaataactctgcagctgcatcttttccctctgatgaagaagaatccaatgaagacctcctcatcgatttccaaggagtcttctttaagagggatggtcgaaacctcgtcggccccgtcgactggcaagtagaactagatgaacgctgggtaattatcggaccaaacggagccggcaaaaccacactcatccgcatggcatccgccgaagaattcccctccggaggaatggcacgcctcatgggagaacgcatcggcaaaactgacatgcgcgacctccgctccatgatcggcgtcagctcctccgcattaggcaaccgaatcccctccgaagaaaaagtctctgacctagtcatctccgcaggctacgcaatcctcggccgctggcgcgaagactacgacgaaatggacttcggacaagccaccgaaatcctcgaacaagtcggagccatgcacctagccgaccgcacctggggaaccctctccgaaggcgaacgcaaacgagtcctggtcgcacgcgcactcatgaccaacccggaactcctcatccttgacgaaccaaccgcaggaatggacctcggcggacgcgaagacctcgtcggctacctcggagaactcgccatggacccagacgcacctgccatcgtcatgatcacccaccacgtcgaagaaatccccgccggattcacccacgcaatgctcctcgacgaaggtgaaatcgtagcccaaggcctgatcaacaccgtcatgacaaacgagaacctatccaaagcattccaccagccaatccaagtagaccgcatcggggaacgctactttgcccgccgtgtgagaaccgccaggagtcatagggctcag

SEQ ID NO: 1358 - DNA, 804 bp, Corynebacterium glutamicum
gtggcaatggtgatgcagggcattggtggtaggaagctggcggcgacggtgctgttggttcgggatgggatcatcaatgggcgtcctgatgtggaggtttacattcaggagcgtgtgtctactatggctaattttcctcgggcgacggtgtttccgggtgggggtgttgattctcgggattttgcggatggtcacggtaaggaagtgtggaggggacctagcgcggaggagtggggtgtgcgtttaggcgtggagcctcatgttgcgtatgcgttggtttttgctgcggttcgtgagttgtttgaagaggccggtacgttgcttgcggagcatacggatggttctggtttggtgaagaatgctggtcagtatcacggatatcgggagttgttggagactcatgagatgtcgctgacggatatgttgcagagtgagaatttggcgattcgtagtgatttgattgtgccttttgccaggtgggcgagccctgagggtaatagggagcagtttgatacgttttcttttgttgctgtggagccggaggggcagtgtgcggatggtaatacgtcggaggcgtcttcgacggggtattttcctgcacggctgattttggatggttggcgcgccgggttgttgaggttggttattccgacgtgggcgtcgttgtttgagttgtcgcagtttaagactgtggaggaattgctggagtacagcgcgcaggttgatatgtctcctgtgttggatgatgcggtggataatccgaggtatgcggagttttatcaggcgatgcgcacggaacggttt

SEQ ID NO: 1359 - DNA, 1056 bp, Corynebacterium glutamicum
gtggcgacgcttcggaagcacttcggtgacttcgggagggctgttgcagaactagcgggggcgaggcgcagcgcggtggggaagcttccgcaagattggctgatgtgtcaagaatctgcgcagcaaaccactccgcctgcggtgtcagcggagcgcgcccggcgtctgaaaactgcacttggtgagaacgtgattgttcatgatgtcacctgttccatcggtacggaggggcatgaacttatcgatgccggccttcgctacctgggttctgatctagatttctcacgcaccctcatggcagcccacaatctccagggcaaaaacgccctgattttccgcgccgacgcgctccagcccgcaagcaggggagccgacgtcatcatcgcggaccctgccagacgcgccgggggcaagcgcattacaaatccggcacagctcctgccacctctgccttcgcttctcgacgcctggatcaaccaaccactcgccgttaaatgtgcccccggccttgatttttcggaatggccaggtctcgtcagtattgccagcgttgatggaggcgtgaaagaagcatgcctctacactacggatctggcagatggggaaactcgcgaagctatcgtgatcaaagatgggctcattgaccgcatcaccaactttgaagacgatgccacgggacaagaccttgcggctgcacctggtgagttcatcatcgacccagacggtgccatcgtgcgcgccgggttggttcgccactatgcagtgcgtgagcagctgtggatgttggatgagcggatcgcataccttacgggcaatcggattccagagggtaccagcggttttaggtttattgaagaggttccgctgaagaagctgaaatcggcgatggcagcacatgatgcgggggcggttgaaattttagtgcgtggtgttgatgttgatcctgatcagttgcggaaaagattgcagctgaagggtaccaaggcgatgtctgtggtgatcactcgaattggcagccgaggggttgcattgatttgtggtcctcgcgagcgcgcc

SEQ ID NO: 1360 - DNA, 612 bp, Corynebacterium glutamicum
atgtgctgccatcgccgatttcagcttcttcagcggaacctcttcaataaacctaaaaccgctggtaccctctggaatccgattgcccgtaaggtatgcgatccgctcatccaacatccacagctgctcacgcactgcatagtggcgaaccaacccggcgcgcacgatggcaccgtctgggtcgatgatgaactcaccaggtgcagccgcaaggtcttgtcccgtggcatcgtcttcaaagttggtgatgcggtcaatgagcccatctttgatcacgatagcttcgcgagtttccccatctgccagatccgtagtgtagaggcatgcttctttcacgcctccatcaacgctggcaatactgacgagacctggccattccgaaaaatcaaggccgggggcacatttaacggcgagtggttggttgatccaggcgtcgagaagcgaaggcagaggtggcaggagctgtgccggatttgtaatgcgcttgcccccggcgcgtctggcagggtccgcgatgatgacgtcggctcccctgcttgcgggctggagcgcgtcggcgcggaaaatcagggcgtttttgccctggagattgtgggctgccatgagggtgcg

SEQ ID NO: 1361 - DNA, 786 bp, Corynebacterium glutamicum
atgtccacaatcgtggttctggttaaaaatgttccagacacctggtctaagaggactctggaagctgatttcacccttgaccgtgagggtgtagatcgagtcttggatgagatcaatgagtttgctctggagcaggcactgcgcttgcgggagtccaacccggatgctggttaccgcgttgttgcgctgagcgccggccctgccggtggggaagaggcgctgcgtaaggcgctgtccatgggtgctgatgaagcaatccagctcagtgatgatgccttggctggttctgatcttttgggaaccgcttgggcgctgaacaacgctatcaacaccatcgcgggtgttgctctcatcgtgacgggttcggcttcttccgatggttccatgggtgcgcttcctggcgtgttagctgagtaccgccaggtcccagcgttgactaacttgtctgcgctgaaggtcgagggtgcatctattactgccactcgcattgataaccacggcacctatgagttgcaggctgcacttcctgcggttgtgtcgatttccgataaggctgacaagccacgtttccctaacttcaagggcatcatggctgctaagaaggctgagatcaagaagctttccttggctgaaatcggcgtggctccagagcaggttggtctgtctcacgcggcaactgctgttactgctgcagctgatcgtcctgagcgctcccaaggtgatgtcattggtgcatcgggtgctgctgaaaagattgctgagtacctcgcttcagagaacctcatc
